United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 70

SEQ ID NO: 3186509 - RNA, 22 nt, Human
auacaaaaaaaaaaaaaaauua

SEQ ID NO: 3186510 - RNA, 12 nt, Human
auaaugaagccc

SEQ ID NO: 3186511 - RNA, 14 nt, Human
auaauucuacuuug

SEQ ID NO: 3186512 - RNA, 20 nt, Human
auaauucaggaagcagcuuu

SEQ ID NO: 3186513 - RNA, 16 nt, Human
auaaugaacaaaauua

SEQ ID NO: 3186514 - RNA, 17 nt, Human
auaauccaguaaaauaa

SEQ ID NO: 3186515 - RNA, 19 nt, Human
auaauacaguaucucaggg

SEQ ID NO: 3186516 - RNA, 18 nt, Human
auaauacagaaucuuguu

SEQ ID NO: 3186517 - RNA, 21 nt, Human
auaauacagaaucuuguuuug

SEQ ID NO: 3186518 - RNA, 14 nt, Human
auaauaaucucagu

SEQ ID NO: 3186519 - RNA, 15 nt, Human
auaaucaccagggcc

SEQ ID NO: 3186520 - RNA, 19 nt, Human
auaaucagaauggaagaga

SEQ ID NO: 3186521 - RNA, 21 nt, Human
uuagcagcugacuuucaaagu

SEQ ID NO: 3186522 - RNA, 21 nt, Human
uuagcacuucagggcagauuu

SEQ ID NO: 3186523 - RNA, 12 nt, Human
uuagcaccaggg

SEQ ID NO: 3186524 - RNA, 21 nt, Human
uuagauuugccauagaguaca

SEQ ID NO: 3186525 - RNA, 23 nt, Human
uuagauuugccauagaguacacu

SEQ ID NO: 3186526 - RNA, 13 nt, Human
uuagauugagaaa

SEQ ID NO: 3186527 - RNA, 15 nt, Human
uuagauugagaaaug

SEQ ID NO: 3186528 - RNA, 19 nt, Human
uuagauugagaaaugugua

SEQ ID NO: 3186529 - RNA, 15 nt, Human
uuagauucacuuuga

SEQ ID NO: 3186530 - RNA, 16 nt, Human
uuagauuugccauaga

SEQ ID NO: 3186531 - RNA, 21 nt, Human
uuagauuucucacacucuaac

SEQ ID NO: 3186532 - RNA, 15 nt, Human
uuagaugugagaaaa

SEQ ID NO: 3186533 - RNA, 19 nt, Human
uuagauuaagaaauagaca

SEQ ID NO: 3186534 - RNA, 16 nt, Human
uuagauguaauuuugu

SEQ ID NO: 3186535 - RNA, 19 nt, Human
uuagaugcauauuacugua

SEQ ID NO: 3186536 - RNA, 17 nt, Human
uuagaugcuacuaagaa

SEQ ID NO: 3186537 - RNA, 16 nt, Human
uuagaugcauauuacu

SEQ ID NO: 3186538 - RNA, 22 nt, Human
auaauugacaggcgaaagaaaa

SEQ ID NO: 3186539 - RNA, 22 nt, Human
auaauucugaaguuauauuucc

SEQ ID NO: 3186540 - RNA, 20 nt, Human
auaauucugaaguuauauuu

SEQ ID NO: 3186541 - RNA, 19 nt, Human
auaauucugaaguuauauu

SEQ ID NO: 3186542 - RNA, 18 nt, Human
auaauucugaaguuauau

SEQ ID NO: 3186543 - RNA, 17 nt, Human
auaauucugaaguuaua

SEQ ID NO: 3186544 - RNA, 13 nt, Human
auaaguuggaaac

SEQ ID NO: 3186545 - RNA, 17 nt, Human
auaaguuggaaacacua

SEQ ID NO: 3186546 - RNA, 16 nt, Human
auaaguuggaaacacu

SEQ ID NO: 3186547 - RNA, 22 nt, Human
auaaguuggaaacacuaaaugu

SEQ ID NO: 3186548 - RNA, 21 nt, Human
auaaguuggaaacacuaaaug

SEQ ID NO: 3186549 - RNA, 19 nt, Human
auaaguuggaaacacuaaa

SEQ ID NO: 3186550 - RNA, 18 nt, Human
auaaguuggaaacacuaa

SEQ ID NO: 3186551 - RNA, 22 nt, Human
auaaguuaacuuccaauuuaca

SEQ ID NO: 3186552 - RNA, 17 nt, Human
auaauaaaaaauuucag

SEQ ID NO: 3186553 - RNA, 23 nt, Human
auaaguuggaaacacuaaauguu

SEQ ID NO: 3186554 - RNA, 15 nt, Human
uuaccucucugucau

SEQ ID NO: 3186555 - RNA, 17 nt, Human
uuaccucucugucaugu

SEQ ID NO: 3186556 - RNA, 13 nt, Human
uuaccucuuugga

SEQ ID NO: 3186557 - RNA, 16 nt, Human
uuaccucuuuggaaaa

SEQ ID NO: 3186558 - RNA, 15 nt, Human
uuaccucuuuggaaa

SEQ ID NO: 3186559 - RNA, 22 nt, Human
auaagaaccuuuugagugccuu

SEQ ID NO: 3186560 - RNA, 16 nt, Human
uuaccuggaaucaaau

SEQ ID NO: 3186561 - RNA, 15 nt, Human
uuaccuggauguucu

SEQ ID NO: 3186562 - RNA, 21 nt, Human
uuaccuggcuuauuuaauaug

SEQ ID NO: 3186563 - RNA, 18 nt, Human
uuaccugaguugaagagg

SEQ ID NO: 3186564 - RNA, 22 nt, Human
uuaccugaagggguuuucuuga

SEQ ID NO: 3186565 - RNA, 21 nt, Human
uuaccugaagggguuuucuug

SEQ ID NO: 3186566 - RNA, 17 nt, Human
auaaguuaacuuccaau

SEQ ID NO: 3186567 - RNA, 12 nt, Human
auaagcaacaau

SEQ ID NO: 3186568 - RNA, 17 nt, Human
auaagcaacaauuuuca

SEQ ID NO: 3186569 - RNA, 13 nt, Human
auaagcaacaauu

SEQ ID NO: 3186570 - RNA, 22 nt, Human
auaagcaacaauuuucagauuu

SEQ ID NO: 3186571 - RNA, 20 nt, Human
auaagcaacaauuuucagau

SEQ ID NO: 3186572 - RNA, 19 nt, Human
auaagcaacaauuuucaga

SEQ ID NO: 3186573 - RNA, 18 nt, Human
auaagcaacaauuuucag

SEQ ID NO: 3186574 - RNA, 23 nt, Human
auaagaaccuuuugagugccuua

SEQ ID NO: 3186575 - RNA, 18 nt, Human
auaagcaaauugcuuuuu

SEQ ID NO: 3186576 - RNA, 22 nt, Human
auaacuguaauuauuugaauga

SEQ ID NO: 3186577 - RNA, 19 nt, Human
auaacuguaauuauuugaa

SEQ ID NO: 3186578 - RNA, 18 nt, Human
auaacuguaauuauuuga

SEQ ID NO: 3186579 - RNA, 17 nt, Human
auaacuguaauuauuug

SEQ ID NO: 3186580 - RNA, 15 nt, Human
uuacaggaaguacug

SEQ ID NO: 3186581 - RNA, 16 nt, Human
uuacaggaaguacugg

SEQ ID NO: 3186582 - RNA, 18 nt, Human
uuacaggaaguacuggag

SEQ ID NO: 3186583 - RNA, 22 nt, Human
uuacaggaaguacuggagaaaa

SEQ ID NO: 3186584 - RNA, 23 nt, Human
uuaccauuuugggguacccacug

SEQ ID NO: 3186585 - RNA, 13 nt, Human
uuaccauuggaaa

SEQ ID NO: 3186586 - RNA, 22 nt, Human
uuacaugcagccacuuaggaca

SEQ ID NO: 3186587 - RNA, 18 nt, Human
uuaccauuggaaauuuca

SEQ ID NO: 3186588 - RNA, 16 nt, Human
uuaccauuggaaauuu

SEQ ID NO: 3186589 - RNA, 15 nt, Human
uuaccauuggaaauu

SEQ ID NO: 3186590 - RNA, 19 nt, Human
uuaccauuuguuaauauca

SEQ ID NO: 3186591 - RNA, 20 nt, Human
uuaccgacaagcacagucag

SEQ ID NO: 3186592 - RNA, 19 nt, Human
auaaaugugccuucauuuu

SEQ ID NO: 3186593 - RNA, 14 nt, Human
auaaauguguguau

SEQ ID NO: 3186594 - RNA, 17 nt, Human
auaaauguguguaugug

SEQ ID NO: 3186595 - RNA, 20 nt, Human
auaaauguguguaugugugu

SEQ ID NO: 3186596 - RNA, 20 nt, Human
auaacauguaauuaaguacu

SEQ ID NO: 3186597 - RNA, 19 nt, Human
auaacaugugaaaagaaua

SEQ ID NO: 3186598 - RNA, 13 nt, Human
auaaauuauggua

SEQ ID NO: 3186599 - RNA, 14 nt, Human
auaaauuauauucc

SEQ ID NO: 3186600 - RNA, 21 nt, Human
auaaauuaugguaaaauuuug

SEQ ID NO: 3186601 - RNA, 15 nt, Human
auaacugaauuugga

SEQ ID NO: 3186602 - RNA, 15 nt, Human
auaacugacuuaguu

SEQ ID NO: 3186603 - RNA, 16 nt, Human
auaacugacuuaguuc

SEQ ID NO: 3186604 - RNA, 14 nt, Human
auaaccagacacaa

SEQ ID NO: 3186605 - RNA, 16 nt, Human
auaaccagacacaaac

SEQ ID NO: 3186606 - RNA, 12 nt, Human
auaaacacuguu

SEQ ID NO: 3186607 - RNA, 22 nt, Human
auaaacauacgugugcaugugu

SEQ ID NO: 3186608 - RNA, 20 nt, Human
auaaacauacgugugcaugu

SEQ ID NO: 3186609 - RNA, 22 nt, Human
auaaacaucagguuaggcagua

SEQ ID NO: 3186610 - RNA, 19 nt, Human
auaaacaucagguuaggca

SEQ ID NO: 3186611 - RNA, 19 nt, Human
auaaaccauuuuuguuacu

SEQ ID NO: 3186612 - RNA, 20 nt, Human
auaaaccauuuuuguuacuc

SEQ ID NO: 3186613 - RNA, 18 nt, Human
auaaaccuuaauauuucu

SEQ ID NO: 3186614 - RNA, 17 nt, Human
aguuuucugagaaagac

SEQ ID NO: 3186615 - RNA, 14 nt, Human
aguuuucugagaaa

SEQ ID NO: 3186616 - RNA, 13 nt, Human
aguuuucugagaa

SEQ ID NO: 3186617 - RNA, 12 nt, Human
aguuuucugaga

SEQ ID NO: 3186618 - RNA, 16 nt, Human
aguuuucccugaaguu

SEQ ID NO: 3186619 - RNA, 20 nt, Human
auaaagugagaaaacuguga

SEQ ID NO: 3186620 - RNA, 14 nt, Human
auaaaguauucuuu

SEQ ID NO: 3186621 - RNA, 15 nt, Human
auaaaguauucuuuu

SEQ ID NO: 3186622 - RNA, 17 nt, Human
auaaaguauaauguuua

SEQ ID NO: 3186623 - RNA, 16 nt, Human
auaaaguaguaaaaga

SEQ ID NO: 3186624 - RNA, 18 nt, Human
auaaacuggcagcucagc

SEQ ID NO: 3186625 - RNA, 13 nt, Human
auaaacucuuuua

SEQ ID NO: 3186626 - RNA, 17 nt, Human
auaaacucauuuugcuu

SEQ ID NO: 3186627 - RNA, 19 nt, Human
auaaacuagauuacauuca

SEQ ID NO: 3186628 - RNA, 17 nt, Human
auaaacuagauuacauu

SEQ ID NO: 3186629 - RNA, 22 nt, Human
auaaacguggagaaucacaggc

SEQ ID NO: 3186630 - RNA, 18 nt, Human
uguugggagugaggaugu

SEQ ID NO: 3186631 - RNA, 13 nt, Human
uguugggccagga

SEQ ID NO: 3186632 - RNA, 16 nt, Human
uguugggccaggagcc

SEQ ID NO: 3186633 - RNA, 13 nt, Human
uguuguaaaaugu

SEQ ID NO: 3186634 - RNA, 16 nt, Human
uguugggccuuuuucc

SEQ ID NO: 3186635 - RNA, 13 nt, Human
uguugucagcuga

SEQ ID NO: 3186636 - RNA, 20 nt, Human
uguugucaagaauagcauug

SEQ ID NO: 3186637 - RNA, 16 nt, Human
uguugucaagaauagc

SEQ ID NO: 3186638 - RNA, 11 nt, Human
uguugucaaga

SEQ ID NO: 3186639 - RNA, 14 nt, Human
uguuguauaaauuu

SEQ ID NO: 3186640 - RNA, 14 nt, Human
uguuguauucauug

SEQ ID NO: 3186641 - RNA, 20 nt, Human
uguuguagauacaaucagcu

SEQ ID NO: 3186642 - RNA, 21 nt, Human
uguuguagauacaaucagcug

SEQ ID NO: 3186643 - RNA, 22 nt, Human
uguuguagauacaaucagcugc

SEQ ID NO: 3186644 - RNA, 13 nt, Human
uguuguauaaauu

SEQ ID NO: 3186645 - RNA, 11 nt, Human
uguuguauaaa

SEQ ID NO: 3186646 - RNA, 14 nt, Human
aguuccugucccug

SEQ ID NO: 3186647 - RNA, 17 nt, Human
aguuccuagagaacugu

SEQ ID NO: 3186648 - RNA, 17 nt, Human
aguucccuacuuccugu

SEQ ID NO: 3186649 - RNA, 15 nt, Human
aguucccuacuuccu

SEQ ID NO: 3186650 - RNA, 22 nt, Human
aguucaaagucaugauguuuuu

SEQ ID NO: 3186651 - RNA, 13 nt, Human
aguucaagaaaug

SEQ ID NO: 3186652 - RNA, 14 nt, Human
aguucaagaaauga

SEQ ID NO: 3186653 - RNA, 21 nt, Human
aguuauuuuuauuuauuuaaa

SEQ ID NO: 3186654 - RNA, 20 nt, Human
aguucaaagucaugauguuu

SEQ ID NO: 3186655 - RNA, 15 nt, Human
aguucaaagucauga

SEQ ID NO: 3186656 - RNA, 23 nt, Human
aguuauugucccuggcuuccuua

SEQ ID NO: 3186657 - RNA, 22 nt, Human
aguuauugucccuggcuuccuu

SEQ ID NO: 3186658 - RNA, 19 nt, Human
aguuauuucccuuuagcug

SEQ ID NO: 3186659 - RNA, 22 nt, Human
aguuauguguaugugaguauuc

SEQ ID NO: 3186660 - RNA, 14 nt, Human
aguuauuaaaauug

SEQ ID NO: 3186661 - RNA, 13 nt, Human
aguuauuaaaauu

SEQ ID NO: 3186662 - RNA, 18 nt, Human
aguuauuaaaauuguugu

SEQ ID NO: 3186663 - RNA, 17 nt, Human
aguuauuaaaauuguug

SEQ ID NO: 3186664 - RNA, 16 nt, Human
aguuauuaaaauuguu

SEQ ID NO: 3186665 - RNA, 15 nt, Human
aguuauuaaaauugu

SEQ ID NO: 3186666 - RNA, 13 nt, Human
aguuauguaaaua

SEQ ID NO: 3186667 - RNA, 14 nt, Human
aguuauguaaauaa

SEQ ID NO: 3186668 - RNA, 17 nt, Human
aguuauguaaauaauuc

SEQ ID NO: 3186669 - RNA, 18 nt, Human
aguuauguaaauaauucu

SEQ ID NO: 3186670 - RNA, 20 nt, Human
aguuauguaaauaauucuuu

SEQ ID NO: 3186671 - RNA, 12 nt, Human
aguuauguguau

SEQ ID NO: 3186672 - RNA, 19 nt, Human
aguuauguguaugugagua

SEQ ID NO: 3186673 - RNA, 14 nt, Human
aguuauguguaugu

SEQ ID NO: 3186674 - RNA, 19 nt, Human
aguuauggcuauaggugcu

SEQ ID NO: 3186675 - RNA, 15 nt, Human
aguuauagaaagcaa

SEQ ID NO: 3186676 - RNA, 18 nt, Human
aguuauacaguuauaaaa

SEQ ID NO: 3186677 - RNA, 19 nt, Human
aguuauacaguuauaaaau

SEQ ID NO: 3186678 - RNA, 20 nt, Human
aguuauacaguuauaaaauu

SEQ ID NO: 3186679 - RNA, 21 nt, Human
aguuauacaguuauaaaauua

SEQ ID NO: 3186680 - RNA, 21 nt, Human
aguuacuaccuccucuccuga

SEQ ID NO: 3186681 - RNA, 16 nt, Human
aguuacuaccuccucu

SEQ ID NO: 3186682 - RNA, 14 nt, Human
aguuaguggaaauc

SEQ ID NO: 3186683 - RNA, 17 nt, Human
aguuaguggaaaucuga

SEQ ID NO: 3186684 - RNA, 13 nt, Human
aguuaguguagau

SEQ ID NO: 3186685 - RNA, 16 nt, Human
aguuaggcuuucucuu

SEQ ID NO: 3186686 - RNA, 19 nt, Human
aguuaguuccacugagacc

SEQ ID NO: 3186687 - RNA, 17 nt, Human
aguuaguuccacugaga

SEQ ID NO: 3186688 - RNA, 15 nt, Human
aguuaguuccacuga

SEQ ID NO: 3186689 - RNA, 14 nt, Human
aguuauaaaauuaa

SEQ ID NO: 3186690 - RNA, 15 nt, Human
aguuauaaaauuaaa

SEQ ID NO: 3186691 - RNA, 18 nt, Human
aguuauaaaauuaaaagu

SEQ ID NO: 3186692 - RNA, 19 nt, Human
aguuauaaaauuaaaaguu

SEQ ID NO: 3186693 - RNA, 20 nt, Human
aguuauaaaauuaaaaguuu

SEQ ID NO: 3186694 - RNA, 12 nt, Human
aguguuuaaaug

SEQ ID NO: 3186695 - RNA, 13 nt, Human
aguguuuaugugc

SEQ ID NO: 3186696 - RNA, 16 nt, Human
aguguuuaugugcuau

SEQ ID NO: 3186697 - RNA, 16 nt, Human
aguuaccagugccuua

SEQ ID NO: 3186698 - RNA, 15 nt, Human
aguuaccagugccuu

SEQ ID NO: 3186699 - RNA, 20 nt, Human
aguuaccuggaaucaaauaa

SEQ ID NO: 3186700 - RNA, 13 nt, Human
uguucugggacac

SEQ ID NO: 3186701 - RNA, 12 nt, Human
uguucugggaca

SEQ ID NO: 3186702 - RNA, 14 nt, Human
uguucugggacaca

SEQ ID NO: 3186703 - RNA, 19 nt, Human
uguucuuucacccuuuucu

SEQ ID NO: 3186704 - RNA, 16 nt, Human
uguucuuggcaauaaa

SEQ ID NO: 3186705 - RNA, 17 nt, Human
uguucuuggcaauaaau

SEQ ID NO: 3186706 - RNA, 20 nt, Human
uguucuuggcaauaaauuuu

SEQ ID NO: 3186707 - RNA, 22 nt, Human
uguucuuggcaauaaauuuuga

SEQ ID NO: 3186708 - RNA, 23 nt, Human
uguucuuggcaauaaauuuugaa

SEQ ID NO: 3186709 - RNA, 23 nt, Human
aguguacauggaauaacauguaa

SEQ ID NO: 3186710 - RNA, 12 nt, Human
aguguaccauua

SEQ ID NO: 3186711 - RNA, 19 nt, Human
aguguaccauuaaaauaug

SEQ ID NO: 3186712 - RNA, 18 nt, Human
aguguaccauuaaaauau

SEQ ID NO: 3186713 - RNA, 20 nt, Human
aguguagauuccauuuacug

SEQ ID NO: 3186714 - RNA, 21 nt, Human
aguguaccauuaaaauaugca

SEQ ID NO: 3186715 - RNA, 14 nt, Human
aguguagauuuuau

SEQ ID NO: 3186716 - RNA, 15 nt, Human
aguguagauuuuaua

SEQ ID NO: 3186717 - RNA, 13 nt, Human
uguuaugagccag

SEQ ID NO: 3186718 - RNA, 15 nt, Human
uguuaugguagaaaa

SEQ ID NO: 3186719 - RNA, 16 nt, Human
uguuaugguagaaaaa

SEQ ID NO: 3186720 - RNA, 17 nt, Human
uguuaugguagaaaaau

SEQ ID NO: 3186721 - RNA, 15 nt, Human
uguuauguauauggu

SEQ ID NO: 3186722 - RNA, 15 nt, Human
uguuauuuucagcau

SEQ ID NO: 3186723 - RNA, 22 nt, Human
uguuauuuucagcaugaaaaug

SEQ ID NO: 3186724 - RNA, 19 nt, Human
uguuauuuuaaucucagaa

SEQ ID NO: 3186725 - RNA, 20 nt, Human
uguuauuuuuauaagaaaac

SEQ ID NO: 3186726 - RNA, 16 nt, Human
uguucccauucuugca

SEQ ID NO: 3186727 - RNA, 22 nt, Human
aguguacauggaauaacaugua

SEQ ID NO: 3186728 - RNA, 21 nt, Human
aguguacauggaauaacaugu

SEQ ID NO: 3186729 - RNA, 16 nt, Human
agugguuuuaauaaaa

SEQ ID NO: 3186730 - RNA, 13 nt, Human
agugguugaauau

SEQ ID NO: 3186731 - RNA, 14 nt, Human
agugguugaauaug

SEQ ID NO: 3186732 - RNA, 15 nt, Human
agugguugaauauga

SEQ ID NO: 3186733 - RNA, 18 nt, Human
agugguugaauaugauua

SEQ ID NO: 3186734 - RNA, 21 nt, Human
agugguuccuaauccucuagg

SEQ ID NO: 3186735 - RNA, 19 nt, Human
agugggugaauaauacagu

SEQ ID NO: 3186736 - RNA, 20 nt, Human
aguggcagcugcuuuugucu

SEQ ID NO: 3186737 - RNA, 14 nt, Human
aguggcagcugcuu

SEQ ID NO: 3186738 - RNA, 22 nt, Human
aguggcagggcacagggccugg

SEQ ID NO: 3186739 - RNA, 20 nt, Human
aguggcagggcacagggccu

SEQ ID NO: 3186740 - RNA, 17 nt, Human
aguggcagggcacaggg

SEQ ID NO: 3186741 - RNA, 16 nt, Human
aguggcagggcacagg

SEQ ID NO: 3186742 - RNA, 15 nt, Human
aguggcagggcacag

SEQ ID NO: 3186743 - RNA, 13 nt, Human
aguggcagggcac

SEQ ID NO: 3186744 - RNA, 12 nt, Human
aguggcagggca

SEQ ID NO: 3186745 - RNA, 13 nt, Human
aguggcagcugcu

SEQ ID NO: 3186746 - RNA, 12 nt, Human
aguggcagcugc

SEQ ID NO: 3186747 - RNA, 11 nt, Human
aguggcagcug

SEQ ID NO: 3186748 - RNA, 13 nt, Human
agugggugaauaa

SEQ ID NO: 3186749 - RNA, 18 nt, Human
agugggugaauaauacag

SEQ ID NO: 3186750 - RNA, 19 nt, Human
agugggggaguggccacag

SEQ ID NO: 3186751 - RNA, 20 nt, Human
agugggggaguggccacaga

SEQ ID NO: 3186752 - RNA, 20 nt, Human
uuaaaaaugguuuaaauggu

SEQ ID NO: 3186753 - RNA, 19 nt, Human
uuaaaaauaucaaauuaau

SEQ ID NO: 3186754 - RNA, 13 nt, Human
uuaaaaauaucaa

SEQ ID NO: 3186755 - RNA, 18 nt, Human
uuaaaaauaucaaauuaa

SEQ ID NO: 3186756 - RNA, 17 nt, Human
uuaaaacaacacucaca

SEQ ID NO: 3186757 - RNA, 18 nt, Human
uuaaaaaguggaaaaaua

SEQ ID NO: 3186758 - RNA, 13 nt, Human
uuaaaaaacuuca

SEQ ID NO: 3186759 - RNA, 20 nt, Human
uuaaaaaacuucauguaauu

SEQ ID NO: 3186760 - RNA, 23 nt, Human
uuaaaaaguccauaccuuauaua

SEQ ID NO: 3186761 - RNA, 15 nt, Human
uuaaaaauaaagcaa

SEQ ID NO: 3186762 - RNA, 13 nt, Human
uuaaaaaguguuu

SEQ ID NO: 3186763 - RNA, 23 nt, Human
uuaaaaagucuuuuaaaaaguau

SEQ ID NO: 3186764 - RNA, 17 nt, Human
uuaaaaagucuuuuaaa

SEQ ID NO: 3186765 - RNA, 16 nt, Human
uuaaaaagucuuuuaa

SEQ ID NO: 3186766 - RNA, 22 nt, Human
uuaaaaaacuuucuacucauuu

SEQ ID NO: 3186767 - RNA, 17 nt, Human
uuaaaccgccaaggcug

SEQ ID NO: 3186768 - RNA, 13 nt, Human
uuaaaccuuuuau

SEQ ID NO: 3186769 - RNA, 14 nt, Human
uuaaaccuuuuauu

SEQ ID NO: 3186770 - RNA, 19 nt, Human
uuaaaauaugcacuaaguc

SEQ ID NO: 3186771 - RNA, 16 nt, Human
uuaaaauaugcacuaa

SEQ ID NO: 3186772 - RNA, 19 nt, Human
uuaaaauauuccugcauuu

SEQ ID NO: 3186773 - RNA, 16 nt, Human
uuaaaauauuccugca

SEQ ID NO: 3186774 - RNA, 22 nt, Human
uuaaaauauagauguguuuuau

SEQ ID NO: 3186775 - RNA, 15 nt, Human
uuaaaauaugcacua

SEQ ID NO: 3186776 - RNA, 14 nt, Human
uuaaaauaugcacu

SEQ ID NO: 3186777 - RNA, 12 nt, Human
uuaaaauauaau

SEQ ID NO: 3186778 - RNA, 23 nt, Human
uuaaaaauuuacuacaauaugua

SEQ ID NO: 3186779 - RNA, 15 nt, Human
uuaaaaauuuacuac

SEQ ID NO: 3186780 - RNA, 15 nt, Human
uuaaauaaaucauaa

SEQ ID NO: 3186781 - RNA, 13 nt, Human
uuaaauaaaucau

SEQ ID NO: 3186782 - RNA, 13 nt, Human
aguuucuaaaauu

SEQ ID NO: 3186783 - RNA, 20 nt, Human
aguuucuaaaauugaguucu

SEQ ID NO: 3186784 - RNA, 15 nt, Human
aguuucucagcuccc

SEQ ID NO: 3186785 - RNA, 16 nt, Human
aguuucucagcuccca

SEQ ID NO: 3186786 - RNA, 13 nt, Human
aguuucuccaagc

SEQ ID NO: 3186787 - RNA, 15 nt, Human
aguuucuccaagcag

SEQ ID NO: 3186788 - RNA, 23 nt, Human
aguuucaauaaaguuugaucuuc

SEQ ID NO: 3186789 - RNA, 15 nt, Human
aguuucaauaaaguu

SEQ ID NO: 3186790 - RNA, 15 nt, Human
aguuucaaguuuuaa

SEQ ID NO: 3186791 - RNA, 18 nt, Human
aguuucaaguuuuaaagu

SEQ ID NO: 3186792 - RNA, 20 nt, Human
aguuucaaguuuuaaaguuc

SEQ ID NO: 3186793 - RNA, 22 nt, Human
aguuucaaguuuuaaaguucau

SEQ ID NO: 3186794 - RNA, 21 nt, Human
aguuucaauaaaguuugaucu

SEQ ID NO: 3186795 - RNA, 18 nt, Human
aguuucaauaaaguuuga

SEQ ID NO: 3186796 - RNA, 17 nt, Human
aguuucaauaaaguuug

SEQ ID NO: 3186797 - RNA, 16 nt, Human
aguuucaauaaaguuu

SEQ ID NO: 3186798 - RNA, 14 nt, Human
aguuucaacaugaa

SEQ ID NO: 3186799 - RNA, 23 nt, Human
aguuucaaaaaucugaagauugu

SEQ ID NO: 3186800 - RNA, 22 nt, Human
aguuucaaaaaucugaagauug

SEQ ID NO: 3186801 - RNA, 21 nt, Human
aguuucaaaaaucugaagauu

SEQ ID NO: 3186802 - RNA, 18 nt, Human
aguuucaaaaaucugaag

SEQ ID NO: 3186803 - RNA, 16 nt, Human
aguuucaaaaaucuga

SEQ ID NO: 3186804 - RNA, 15 nt, Human
aguuucaaaaaucug

SEQ ID NO: 3186805 - RNA, 14 nt, Human
aguuucaaaaaucu

SEQ ID NO: 3186806 - RNA, 23 nt, Human
aguuuauuuuaaaacaauaggau

SEQ ID NO: 3186807 - RNA, 16 nt, Human
aguuuauuuuaaaaca

SEQ ID NO: 3186808 - RNA, 22 nt, Human
aguuuucacucuuauugcccac

SEQ ID NO: 3186809 - RNA, 21 nt, Human
aguuuuauuuucuaaaguacu

SEQ ID NO: 3186810 - RNA, 20 nt, Human
aguuuuauuuucuaaaguac

SEQ ID NO: 3186811 - RNA, 13 nt, Human
aguuuuauuuucu

SEQ ID NO: 3186812 - RNA, 23 nt, Human
aguuuuauuuauauuuauugacu

SEQ ID NO: 3186813 - RNA, 20 nt, Human
aguuuuauuuauauuuauug

SEQ ID NO: 3186814 - RNA, 22 nt, Human
aguuuuauuuauauuuauugac

SEQ ID NO: 3186815 - RNA, 15 nt, Human
aguuuuauuuauauu

SEQ ID NO: 3186816 - RNA, 17 nt, Human
aguuuuauuuauauuua

SEQ ID NO: 3186817 - RNA, 18 nt, Human
aguuuuauuuauauuuau

SEQ ID NO: 3186818 - RNA, 19 nt, Human
aguuuuauuuauauuuauu

SEQ ID NO: 3186819 - RNA, 14 nt, Human
aguuuuauuuauau

SEQ ID NO: 3186820 - RNA, 22 nt, Human
aguuuucaugugcucagaauua

SEQ ID NO: 3186821 - RNA, 14 nt, Human
aguuuucaugugcu

SEQ ID NO: 3186822 - RNA, 20 nt, Human
aguucucuucacucaaggau

SEQ ID NO: 3186823 - RNA, 16 nt, Human
aguucucuccuucuuc

SEQ ID NO: 3186824 - RNA, 13 nt, Human
aguucucuccuuc

SEQ ID NO: 3186825 - RNA, 12 nt, Human
aguucucuccuu

SEQ ID NO: 3186826 - RNA, 15 nt, Human
uguuuucucuugaga

SEQ ID NO: 3186827 - RNA, 21 nt, Human
uguuuuauuuuaauucaguug

SEQ ID NO: 3186828 - RNA, 14 nt, Human
uguuuucaaaugga

SEQ ID NO: 3186829 - RNA, 13 nt, Human
uguuuucaaaugg

SEQ ID NO: 3186830 - RNA, 16 nt, Human
uguuuuagcacagcgu

SEQ ID NO: 3186831 - RNA, 15 nt, Human
uguuuucaguguaca

SEQ ID NO: 3186832 - RNA, 22 nt, Human
uguuuucaaucucguauagaag

SEQ ID NO: 3186833 - RNA, 14 nt, Human
uguuugccucugcc

SEQ ID NO: 3186834 - RNA, 16 nt, Human
uguuugccucugccuc

SEQ ID NO: 3186835 - RNA, 14 nt, Human
uguugucagcugaa

SEQ ID NO: 3186836 - RNA, 17 nt, Human
uguuguccgguuuacuu

SEQ ID NO: 3186837 - RNA, 13 nt, Human
uguuuggagacag

SEQ ID NO: 3186838 - RNA, 23 nt, Human
uguuugcuccccuuccccuuccu

SEQ ID NO: 3186839 - RNA, 12 nt, Human
uguuugcucccc

SEQ ID NO: 3186840 - RNA, 22 nt, Human
uguuuggcguagcagaguuaaa

SEQ ID NO: 3186841 - RNA, 15 nt, Human
uguuuggggaugaga

SEQ ID NO: 3186842 - RNA, 20 nt, Human
uguuugggaagagcuuagaa

SEQ ID NO: 3186843 - RNA, 23 nt, Human
aguugauucagcucugcaagaau

SEQ ID NO: 3186844 - RNA, 14 nt, Human
aguugauucagcuc

SEQ ID NO: 3186845 - RNA, 15 nt, Human
aguugauucagcucu

SEQ ID NO: 3186846 - RNA, 17 nt, Human
aguugauucagcucugc

SEQ ID NO: 3186847 - RNA, 18 nt, Human
aguugauucagcucugca

SEQ ID NO: 3186848 - RNA, 22 nt, Human
aguugauagcacagacccugcc

SEQ ID NO: 3186849 - RNA, 23 nt, Human
aguugauagcacagacccugccc

SEQ ID NO: 3186850 - RNA, 13 nt, Human
aguugauucagcu

SEQ ID NO: 3186851 - RNA, 14 nt, Human
aguugaucucccca

SEQ ID NO: 3186852 - RNA, 19 nt, Human
aguucugugacuaggaaaa

SEQ ID NO: 3186853 - RNA, 11 nt, Human
aguucugugac

SEQ ID NO: 3186854 - RNA, 18 nt, Human
aguucuguguauuuucag

SEQ ID NO: 3186855 - RNA, 21 nt, Human
aguucugugacuaggaaaaaa

SEQ ID NO: 3186856 - RNA, 13 nt, Human
aguucuguauuug

SEQ ID NO: 3186857 - RNA, 14 nt, Human
aguucuguauuuga

SEQ ID NO: 3186858 - RNA, 15 nt, Human
aguucuguauuugaa

SEQ ID NO: 3186859 - RNA, 16 nt, Human
aguucuguauuugaaa

SEQ ID NO: 3186860 - RNA, 17 nt, Human
aguucuguauuugaaag

SEQ ID NO: 3186861 - RNA, 18 nt, Human
aguucuguauuugaaagu

SEQ ID NO: 3186862 - RNA, 20 nt, Human
aguucuguauuugaaagugc

SEQ ID NO: 3186863 - RNA, 21 nt, Human
aguucuguauuugaaagugcc

SEQ ID NO: 3186864 - RNA, 22 nt, Human
aguucuguauuugaaagugccu

SEQ ID NO: 3186865 - RNA, 23 nt, Human
aguucuguauuugaaagugccuu

SEQ ID NO: 3186866 - RNA, 15 nt, Human
aguugauagcacaga

SEQ ID NO: 3186867 - RNA, 19 nt, Human
aguugauagcacagacccu

SEQ ID NO: 3186868 - RNA, 20 nt, Human
aguugauagcacagacccug

SEQ ID NO: 3186869 - RNA, 21 nt, Human
aguugauagcacagacccugc

SEQ ID NO: 3186870 - RNA, 14 nt, Human
aguugauagcacag

SEQ ID NO: 3186871 - RNA, 15 nt, Human
aguucuuuaaacugu

SEQ ID NO: 3186872 - RNA, 18 nt, Human
aguucuuugauucuguaa

SEQ ID NO: 3186873 - RNA, 16 nt, Human
aguucuuugauucugu

SEQ ID NO: 3186874 - RNA, 14 nt, Human
aguucuugaacagu

SEQ ID NO: 3186875 - RNA, 11 nt, Human
ugccucugccu

SEQ ID NO: 3186876 - RNA, 19 nt, Human
ugccucugauguauuuugu

SEQ ID NO: 3186877 - RNA, 17 nt, Human
ugccucugauguauuuu

SEQ ID NO: 3186878 - RNA, 16 nt, Human
ugccucugacacacag

SEQ ID NO: 3186879 - RNA, 14 nt, Human
ugccucugacacac

SEQ ID NO: 3186880 - RNA, 19 nt, Human
ugccugcccaggccccugc

SEQ ID NO: 3186881 - RNA, 18 nt, Human
ugccugcccaggccccug

SEQ ID NO: 3186882 - RNA, 17 nt, Human
ugccugcccaggccccu

SEQ ID NO: 3186883 - RNA, 11 nt, Human
ugccugccuua

SEQ ID NO: 3186884 - RNA, 19 nt, Human
ugccugccuuaagugagga

SEQ ID NO: 3186885 - RNA, 22 nt, Human
ugccucugauguauuuugugag

SEQ ID NO: 3186886 - RNA, 23 nt, Human
ugccugcucuuuggccugaugac

SEQ ID NO: 3186887 - RNA, 12 nt, Human
ugccugcucuuu

SEQ ID NO: 3186888 - RNA, 11 nt, Human
ugccugcucuu

SEQ ID NO: 3186889 - RNA, 14 nt, Human
agcugccugugccu

SEQ ID NO: 3186890 - RNA, 23 nt, Human
agcugcuuuuuuugaaacuuuga

SEQ ID NO: 3186891 - RNA, 22 nt, Human
agcugcuuuuuuugaaacuuug

SEQ ID NO: 3186892 - RNA, 17 nt, Human
agcugcuuuuuuugaaa

SEQ ID NO: 3186893 - RNA, 21 nt, Human
agcuggagaggagcccugccu

SEQ ID NO: 3186894 - RNA, 23 nt, Human
agcuggagaggagcccugccucu

SEQ ID NO: 3186895 - RNA, 22 nt, Human
agcuggagaggagcccugccuc

SEQ ID NO: 3186896 - RNA, 24 nt, Human
agcugcuuuugucuaugggacuca

SEQ ID NO: 3186897 - RNA, 23 nt, Human
agcugcuuuugucuaugggacuc

SEQ ID NO: 3186898 - RNA, 15 nt, Human
agcugggacuacagg

SEQ ID NO: 3186899 - RNA, 22 nt, Human
agcugcuuuugucuaugggacu

SEQ ID NO: 3186900 - RNA, 13 nt, Human
agcugccuguuca

SEQ ID NO: 3186901 - RNA, 21 nt, Human
ugccugcuucagccucccaca

SEQ ID NO: 3186902 - RNA, 12 nt, Human
ugccugcuucag

SEQ ID NO: 3186903 - RNA, 10 nt, Human
agcugccugu

SEQ ID NO: 3186904 - RNA, 17 nt, Human
ugccucucucaggccaa

SEQ ID NO: 3186905 - RNA, 16 nt, Human
ugccucucucaggcca

SEQ ID NO: 3186906 - RNA, 15 nt, Human
ugccucagccucccg

SEQ ID NO: 3186907 - RNA, 15 nt, Human
ugccucagccuccug

SEQ ID NO: 3186908 - RNA, 22 nt, Human
ugccucccaucacccgcuaaga

SEQ ID NO: 3186909 - RNA, 19 nt, Human
ugccucccaucacccgcua

SEQ ID NO: 3186910 - RNA, 17 nt, Human
ugccucagcuuccccag

SEQ ID NO: 3186911 - RNA, 15 nt, Human
ugccucagcuucccc

SEQ ID NO: 3186912 - RNA, 18 nt, Human
ugccucagcuuccccagu

SEQ ID NO: 3186913 - RNA, 15 nt, Human
ugccucaccccuugc

SEQ ID NO: 3186914 - RNA, 22 nt, Human
ugccgccgcuagguagagucug

SEQ ID NO: 3186915 - RNA, 16 nt, Human
ugccgcaucucacagc

SEQ ID NO: 3186916 - RNA, 18 nt, Human
ugccgccgcuagguagag

SEQ ID NO: 3186917 - RNA, 14 nt, Human
ugccgcagcccugc

SEQ ID NO: 3186918 - RNA, 20 nt, Human
ugccgcagcccugcagaggg

SEQ ID NO: 3186919 - RNA, 19 nt, Human
ugcccuuaccugccaggaa

SEQ ID NO: 3186920 - RNA, 23 nt, Human
ugcccugugaguacuacaguccu

SEQ ID NO: 3186921 - RNA, 16 nt, Human
agcucuucuccaggcu

SEQ ID NO: 3186922 - RNA, 15 nt, Human
agcucuucuccaggc

SEQ ID NO: 3186923 - RNA, 12 nt, Human
agcucuuccugg

SEQ ID NO: 3186924 - RNA, 14 nt, Human
agcucuuccuagcu

SEQ ID NO: 3186925 - RNA, 22 nt, Human
agcucuuccuggacaggccagg

SEQ ID NO: 3186926 - RNA, 20 nt, Human
agcucuuccuggacaggcca

SEQ ID NO: 3186927 - RNA, 15 nt, Human
ugcccugugggcccc

SEQ ID NO: 3186928 - RNA, 18 nt, Human
ugcccugugggcccccaa

SEQ ID NO: 3186929 - RNA, 22 nt, Human
ugcccuuaccugccaggaagcc

SEQ ID NO: 3186930 - RNA, 23 nt, Human
agcucugcccauccugccccuga

SEQ ID NO: 3186931 - RNA, 21 nt, Human
agcucugcagagcaggaaaca

SEQ ID NO: 3186932 - RNA, 23 nt, Human
agcucugaguuccggcaccagua

SEQ ID NO: 3186933 - RNA, 23 nt, Human
agcucuguccugggagugagcug

SEQ ID NO: 3186934 - RNA, 19 nt, Human
agcuccagcucaccagccc

SEQ ID NO: 3186935 - RNA, 18 nt, Human
agcuccagcucaccagcc

SEQ ID NO: 3186936 - RNA, 21 nt, Human
agcuccagcucaccagcccca

SEQ ID NO: 3186937 - RNA, 21 nt, Human
agcuccaucuccacuccagau

SEQ ID NO: 3186938 - RNA, 17 nt, Human
agcucccacuucugcca

SEQ ID NO: 3186939 - RNA, 18 nt, Human
agcucccacuucugccag

SEQ ID NO: 3186940 - RNA, 19 nt, Human
agcucccacuucugccaga

SEQ ID NO: 3186941 - RNA, 23 nt, Human
agcuccuucuguccuacucugug

SEQ ID NO: 3186942 - RNA, 22 nt, Human
agcuccuucuguccuacucugu

SEQ ID NO: 3186943 - RNA, 14 nt, Human
agcucccccagcuc

SEQ ID NO: 3186944 - RNA, 15 nt, Human
agcuccccccaccuc

SEQ ID NO: 3186945 - RNA, 14 nt, Human
agcuccccccaccu

SEQ ID NO: 3186946 - RNA, 16 nt, Human
agcucccccagcuccc

SEQ ID NO: 3186947 - RNA, 15 nt, Human
agcucccccagcucc

SEQ ID NO: 3186948 - RNA, 20 nt, Human
agcuccccccaccuccccca

SEQ ID NO: 3186949 - RNA, 20 nt, Human
ugcccuaaugcgcaggcugg

SEQ ID NO: 3186950 - RNA, 23 nt, Human
ugcccuaaugcgcaggcuggccc

SEQ ID NO: 3186951 - RNA, 17 nt, Human
agcuccaagcucccagg

SEQ ID NO: 3186952 - RNA, 16 nt, Human
agcuccaagcucccag

SEQ ID NO: 3186953 - RNA, 18 nt, Human
agcuccaagcucccaggc

SEQ ID NO: 3186954 - RNA, 19 nt, Human
agcuccaagcucccaggca

SEQ ID NO: 3186955 - RNA, 18 nt, Human
ugcccugaccaugcauuu

SEQ ID NO: 3186956 - RNA, 19 nt, Human
ugcccugaccaugcauuuu

SEQ ID NO: 3186957 - RNA, 17 nt, Human
agcuccagcucaccagc

SEQ ID NO: 3186958 - RNA, 13 nt, Human
agcuccagcucac

SEQ ID NO: 3186959 - RNA, 21 nt, Human
agcuccaccccgcaagcacca

SEQ ID NO: 3186960 - RNA, 21 nt, Human
agcggcuggacuuggagguag

SEQ ID NO: 3186961 - RNA, 23 nt, Human
agcggcuggcagcccaccccuca

SEQ ID NO: 3186962 - RNA, 20 nt, Human
agcggggacagcuccuucug

SEQ ID NO: 3186963 - RNA, 19 nt, Human
agcggggacagcuccuucu

SEQ ID NO: 3186964 - RNA, 22 nt, Human
agcggggacagcuccuucuguc

SEQ ID NO: 3186965 - RNA, 16 nt, Human
agcguauggcuuuauu

SEQ ID NO: 3186966 - RNA, 20 nt, Human
agcguagugcagcagggcag

SEQ ID NO: 3186967 - RNA, 17 nt, Human
agcguagugcagcaggg

SEQ ID NO: 3186968 - RNA, 17 nt, Human
agcggcuggacuuggag

SEQ ID NO: 3186969 - RNA, 13 nt, Human
agcggcuggcagc

SEQ ID NO: 3186970 - RNA, 18 nt, Human
ugccagcuuaucucaggg

SEQ ID NO: 3186971 - RNA, 22 nt, Human
ugccaggaaaggagaguacuuu

SEQ ID NO: 3186972 - RNA, 20 nt, Human
ugccagcugcugagccgcag

SEQ ID NO: 3186973 - RNA, 19 nt, Human
ugccagcugcugagccgca

SEQ ID NO: 3186974 - RNA, 20 nt, Human
ugccagucccccugccccag

SEQ ID NO: 3186975 - RNA, 15 nt, Human
ugccagcugcugagc

SEQ ID NO: 3186976 - RNA, 17 nt, Human
ugccagcugcugagccg

SEQ ID NO: 3186977 - RNA, 16 nt, Human
ugccagcugcugagcc

SEQ ID NO: 3186978 - RNA, 23 nt, Human
ugccagcucuuccuagcuggaga

SEQ ID NO: 3186979 - RNA, 22 nt, Human
ugccagcucuuccuagcuggag

SEQ ID NO: 3186980 - RNA, 20 nt, Human
ugccagcucuuccuagcugg

SEQ ID NO: 3186981 - RNA, 18 nt, Human
ugccagcucuuccuagcu

SEQ ID NO: 3186982 - RNA, 15 nt, Human
ugccagcucuuccua

SEQ ID NO: 3186983 - RNA, 21 nt, Human
ugccagauguccuaaugguga

SEQ ID NO: 3186984 - RNA, 17 nt, Human
ugccacugccucuuccu

SEQ ID NO: 3186985 - RNA, 13 nt, Human
ugccacugccucu

SEQ ID NO: 3186986 - RNA, 21 nt, Human
ugcauuuagggaguauucuaa

SEQ ID NO: 3186987 - RNA, 12 nt, Human
ugcauuucagaa

SEQ ID NO: 3186988 - RNA, 17 nt, Human
ugcauuucagaaagccu

SEQ ID NO: 3186989 - RNA, 19 nt, Human
ugccacugccucuuccucc

SEQ ID NO: 3186990 - RNA, 18 nt, Human
ugccacugccucuuccuc

SEQ ID NO: 3186991 - RNA, 20 nt, Human
ugccacugccucuuccuccc

SEQ ID NO: 3186992 - RNA, 18 nt, Human
ugcagcucagaaccacag

SEQ ID NO: 3186993 - RNA, 19 nt, Human
ugcagcucagaaccacagc

SEQ ID NO: 3186994 - RNA, 20 nt, Human
ugcagcucagaaccacagca

SEQ ID NO: 3186995 - RNA, 14 nt, Human
ugcagcucuuccug

SEQ ID NO: 3186996 - RNA, 16 nt, Human
ugcagcucuuccugga

SEQ ID NO: 3186997 - RNA, 15 nt, Human
ugcagcucuuccugg

SEQ ID NO: 3186998 - RNA, 18 nt, Human
agccuuccagggguggga

SEQ ID NO: 3186999 - RNA, 22 nt, Human
ugcagcugaaauugaaaaguua

SEQ ID NO: 3187000 - RNA, 21 nt, Human
ugcagcugaaauugaaaaguu

SEQ ID NO: 3187001 - RNA, 19 nt, Human
ugcagcugaaauugaaaag

SEQ ID NO: 3187002 - RNA, 18 nt, Human
ugcagcugaaauugaaaa

SEQ ID NO: 3187003 - RNA, 15 nt, Human
ugcagcugaaauuga

SEQ ID NO: 3187004 - RNA, 18 nt, Human
ugcagcucuuccuggaca

SEQ ID NO: 3187005 - RNA, 22 nt, Human
agccuugaccauucuccaccug

SEQ ID NO: 3187006 - RNA, 23 nt, Human
agccuugaccauucuccaccugc

SEQ ID NO: 3187007 - RNA, 21 nt, Human
agccuugauucccuuguuauu

SEQ ID NO: 3187008 - RNA, 22 nt, Human
agcgauucuucugcuucagccu

SEQ ID NO: 3187009 - RNA, 15 nt, Human
ugcauuauuaaauug

SEQ ID NO: 3187010 - RNA, 17 nt, Human
ugcauuauuaaauugua

SEQ ID NO: 3187011 - RNA, 18 nt, Human
ugcauuauuaaauuguaa

SEQ ID NO: 3187012 - RNA, 21 nt, Human
agcgcagccgccuucacagca

SEQ ID NO: 3187013 - RNA, 15 nt, Human
agcgcacagcugcuc

SEQ ID NO: 3187014 - RNA, 14 nt, Human
agcgcacagcugcu

SEQ ID NO: 3187015 - RNA, 13 nt, Human
agcgcacagcugc

SEQ ID NO: 3187016 - RNA, 11 nt, Human
agcgcagcccg

SEQ ID NO: 3187017 - RNA, 23 nt, Human
ugcauucacauuuagaaaaguga

SEQ ID NO: 3187018 - RNA, 19 nt, Human
ugcauuuagggaguauucu

SEQ ID NO: 3187019 - RNA, 20 nt, Human
agcuauuacuggaucucuua

SEQ ID NO: 3187020 - RNA, 15 nt, Human
agcuaguugaauacu

SEQ ID NO: 3187021 - RNA, 16 nt, Human
agcuaguugaauacuu

SEQ ID NO: 3187022 - RNA, 17 nt, Human
agcuaguugaauacuug

SEQ ID NO: 3187023 - RNA, 16 nt, Human
agcuaggccuggccag

SEQ ID NO: 3187024 - RNA, 18 nt, Human
agcuacagugcauaguug

SEQ ID NO: 3187025 - RNA, 16 nt, Human
agcuacaucuacuuaa

SEQ ID NO: 3187026 - RNA, 21 nt, Human
agcuaggccuggccagaugca

SEQ ID NO: 3187027 - RNA, 14 nt, Human
agcuagucaacagu

SEQ ID NO: 3187028 - RNA, 19 nt, Human
agcgugaagccagggcccg

SEQ ID NO: 3187029 - RNA, 22 nt, Human
ugccauuuaaagcuuauuaaaa

SEQ ID NO: 3187030 - RNA, 15 nt, Human
ugccauuucaugucc

SEQ ID NO: 3187031 - RNA, 15 nt, Human
agcuccaagcuccca

SEQ ID NO: 3187032 - RNA, 20 nt, Human
agcucagggccuggcucagg

SEQ ID NO: 3187033 - RNA, 18 nt, Human
agcucagggccuggcuca

SEQ ID NO: 3187034 - RNA, 19 nt, Human
agcucagggccuggcucag

SEQ ID NO: 3187035 - RNA, 12 nt, Human
agcucagggccu

SEQ ID NO: 3187036 - RNA, 13 nt, Human
agcucagggccug

SEQ ID NO: 3187037 - RNA, 19 nt, Human
agcuauucaguaauaacuc

SEQ ID NO: 3187038 - RNA, 22 nt, Human
ugcccccaauaguagucucugu

SEQ ID NO: 3187039 - RNA, 23 nt, Human
ugccccgaacauguuuuucuucu

SEQ ID NO: 3187040 - RNA, 14 nt, Human
ugcccccucugccc

SEQ ID NO: 3187041 - RNA, 15 nt, Human
ugcccccucugcccu

SEQ ID NO: 3187042 - RNA, 16 nt, Human
ugcccccucugcccug

SEQ ID NO: 3187043 - RNA, 17 nt, Human
ugcccccucugcccugc

SEQ ID NO: 3187044 - RNA, 18 nt, Human
ugcccccucugcccugcg

SEQ ID NO: 3187045 - RNA, 18 nt, Human
ugcccaggccccugccac

SEQ ID NO: 3187046 - RNA, 17 nt, Human
ugcccaggccccugcca

SEQ ID NO: 3187047 - RNA, 15 nt, Human
ugcccaggccccugc

SEQ ID NO: 3187048 - RNA, 14 nt, Human
ugcccaggccccug

SEQ ID NO: 3187049 - RNA, 20 nt, Human
ugcccagcuuuucauugcug

SEQ ID NO: 3187050 - RNA, 19 nt, Human
ugcccagcuuuucauugcu

SEQ ID NO: 3187051 - RNA, 23 nt, Human
ugcccagcuuuucauugcuguga

SEQ ID NO: 3187052 - RNA, 13 nt, Human
ugcccagccccuu

SEQ ID NO: 3187053 - RNA, 12 nt, Human
ugcccagccccu

SEQ ID NO: 3187054 - RNA, 16 nt, Human
ugcccagccccuucug

SEQ ID NO: 3187055 - RNA, 17 nt, Human
ugcccagccccuucuga

SEQ ID NO: 3187056 - RNA, 17 nt, Human
ugcccaaagaugcagcc

SEQ ID NO: 3187057 - RNA, 20 nt, Human
ugcccaaagaugcagccggu

SEQ ID NO: 3187058 - RNA, 15 nt, Human
ugccauuuuucaaaa

SEQ ID NO: 3187059 - RNA, 14 nt, Human
agccaugagaaugu

SEQ ID NO: 3187060 - RNA, 15 nt, Human
agcccacuucugcca

SEQ ID NO: 3187061 - RNA, 14 nt, Human
agcccacuucugcc

SEQ ID NO: 3187062 - RNA, 13 nt, Human
agcccacuucugc

SEQ ID NO: 3187063 - RNA, 20 nt, Human
agcccagaguccccccacuc

SEQ ID NO: 3187064 - RNA, 17 nt, Human
agcccagagucccccca

SEQ ID NO: 3187065 - RNA, 16 nt, Human
agccagggaaagacug

SEQ ID NO: 3187066 - RNA, 21 nt, Human
agccagggaaagacuggcaag

SEQ ID NO: 3187067 - RNA, 21 nt, Human
agccagggcccgggaagcaaa

SEQ ID NO: 3187068 - RNA, 19 nt, Human
agccagggcccgggaagca

SEQ ID NO: 3187069 - RNA, 18 nt, Human
agccagguuccacagagg

SEQ ID NO: 3187070 - RNA, 17 nt, Human
ugauuucagcucacugc

SEQ ID NO: 3187071 - RNA, 14 nt, Human
ugauuucaguaagu

SEQ ID NO: 3187072 - RNA, 16 nt, Human
ugauuucaguaagucu

SEQ ID NO: 3187073 - RNA, 19 nt, Human
ugauuucaguaagucucau

SEQ ID NO: 3187074 - RNA, 23 nt, Human
ugauuucuaguuauuuauucugg

SEQ ID NO: 3187075 - RNA, 23 nt, Human
ugauuucuuuucaccauucguac

SEQ ID NO: 3187076 - RNA, 12 nt, Human
ugauuuggaaaa

SEQ ID NO: 3187077 - RNA, 20 nt, Human
ugauuugggcugaauguaug

SEQ ID NO: 3187078 - RNA, 21 nt, Human
ugauuugggcugaauguaugu

SEQ ID NO: 3187079 - RNA, 18 nt, Human
ugauuuggggauucagau

SEQ ID NO: 3187080 - RNA, 22 nt, Human
ugauuuggggauucagauuucu

SEQ ID NO: 3187081 - RNA, 21 nt, Human
ugauuuggggauucagauuuc

SEQ ID NO: 3187082 - RNA, 23 nt, Human
ugauuuguacagauucuuuauua

SEQ ID NO: 3187083 - RNA, 14 nt, Human
agcccaggaaaggc

SEQ ID NO: 3187084 - RNA, 23 nt, Human
agcccagcuugaaaccuucacuu

SEQ ID NO: 3187085 - RNA, 15 nt, Human
ugauucauaaugacu

SEQ ID NO: 3187086 - RNA, 16 nt, Human
ugauucauaaugacuu

SEQ ID NO: 3187087 - RNA, 21 nt, Human
ugauucauaaugacuuaagca

SEQ ID NO: 3187088 - RNA, 21 nt, Human
agcccagcuuuuccugggaca

SEQ ID NO: 3187089 - RNA, 23 nt, Human
ugauucccaagcucugcuccucu

SEQ ID NO: 3187090 - RNA, 22 nt, Human
ugauucccaagcucugcuccuc

SEQ ID NO: 3187091 - RNA, 18 nt, Human
ugauucccuuguuauuca

SEQ ID NO: 3187092 - RNA, 19 nt, Human
ugauucccuuguuauucaa

SEQ ID NO: 3187093 - RNA, 20 nt, Human
ugauucccuuguuauucaac

SEQ ID NO: 3187094 - RNA, 13 nt, Human
ugauucucaugcc

SEQ ID NO: 3187095 - RNA, 14 nt, Human
ugauucucaugccu

SEQ ID NO: 3187096 - RNA, 15 nt, Human
ugauucucaugccuc

SEQ ID NO: 3187097 - RNA, 16 nt, Human
ugauucucaugccuca

SEQ ID NO: 3187098 - RNA, 15 nt, Human
ugauuuaauuugaaa

SEQ ID NO: 3187099 - RNA, 19 nt, Human
ugaugggaugauugaagaa

SEQ ID NO: 3187100 - RNA, 21 nt, Human
ugaugggaugauugaagaaac

SEQ ID NO: 3187101 - RNA, 20 nt, Human
ugaugggaugauugaagaaa

SEQ ID NO: 3187102 - RNA, 19 nt, Human
ugaugggaaagcauuguaa

SEQ ID NO: 3187103 - RNA, 14 nt, Human
ugauggggcccugc

SEQ ID NO: 3187104 - RNA, 15 nt, Human
ugauggggcccugcc

SEQ ID NO: 3187105 - RNA, 16 nt, Human
ugauggggcccugccu

SEQ ID NO: 3187106 - RNA, 19 nt, Human
ugauggggcccugccuccu

SEQ ID NO: 3187107 - RNA, 14 nt, Human
ugaugggaaagcau

SEQ ID NO: 3187108 - RNA, 23 nt, Human
ugaugcuucuucagagacuccug

SEQ ID NO: 3187109 - RNA, 20 nt, Human
ugauggaauuuuuuuguacg

SEQ ID NO: 3187110 - RNA, 13 nt, Human
ugaugagaggaaa

SEQ ID NO: 3187111 - RNA, 14 nt, Human
ugaugagaggaaau

SEQ ID NO: 3187112 - RNA, 15 nt, Human
ugaugagaggaaauc

SEQ ID NO: 3187113 - RNA, 16 nt, Human
ugaugagaggaaauca

SEQ ID NO: 3187114 - RNA, 18 nt, Human
ugaugaaauguaaauacu

SEQ ID NO: 3187115 - RNA, 16 nt, Human
ugaugaccaauuuuaa

SEQ ID NO: 3187116 - RNA, 18 nt, Human
ugaugaccaauuuuaacu

SEQ ID NO: 3187117 - RNA, 19 nt, Human
ugaugacguacaaguaguu

SEQ ID NO: 3187118 - RNA, 18 nt, Human
ugaugacccccccagcuu

SEQ ID NO: 3187119 - RNA, 21 nt, Human
ugaugacguacaaguaguucu

SEQ ID NO: 3187120 - RNA, 22 nt, Human
ugaugacguacaaguaguucug

SEQ ID NO: 3187121 - RNA, 22 nt, Human
ugaugacuaugcuuugcuauca

SEQ ID NO: 3187122 - RNA, 16 nt, Human
ugauccuaguuccacc

SEQ ID NO: 3187123 - RNA, 15 nt, Human
ugauccucccaccuc

SEQ ID NO: 3187124 - RNA, 22 nt, Human
ugauccuaaugaaugcauaaaa

SEQ ID NO: 3187125 - RNA, 21 nt, Human
ugauccucccaccucagccuc

SEQ ID NO: 3187126 - RNA, 22 nt, Human
ugauccucccaccucagccucc

SEQ ID NO: 3187127 - RNA, 17 nt, Human
ugauuaauggaaauguu

SEQ ID NO: 3187128 - RNA, 16 nt, Human
agccacugcaccgggc

SEQ ID NO: 3187129 - RNA, 23 nt, Human
agccacuccccagccagccuggc

SEQ ID NO: 3187130 - RNA, 22 nt, Human
agccacuccccagccagccugg

SEQ ID NO: 3187131 - RNA, 17 nt, Human
agccacuccccagccag

SEQ ID NO: 3187132 - RNA, 11 nt, Human
agccacucccc

SEQ ID NO: 3187133 - RNA, 14 nt, Human
agccacuccccagc

SEQ ID NO: 3187134 - RNA, 13 nt, Human
agccacuccccag

SEQ ID NO: 3187135 - RNA, 19 nt, Human
ugauuaaccacuucagcug

SEQ ID NO: 3187136 - RNA, 17 nt, Human
ugauggugaugaaaugu

SEQ ID NO: 3187137 - RNA, 13 nt, Human
ugauggugcaaug

SEQ ID NO: 3187138 - RNA, 16 nt, Human
ugauggugaugaaaug

SEQ ID NO: 3187139 - RNA, 15 nt, Human
ugauggugaugaaau

SEQ ID NO: 3187140 - RNA, 14 nt, Human
agccagcaucggaa

SEQ ID NO: 3187141 - RNA, 22 nt, Human
agccagccaaacacacagaagg

SEQ ID NO: 3187142 - RNA, 23 nt, Human
agccagccaaacacacagaaggg

SEQ ID NO: 3187143 - RNA, 19 nt, Human
agccagccaagcuuuaaau

SEQ ID NO: 3187144 - RNA, 20 nt, Human
agccagccaagcuuuaaauu

SEQ ID NO: 3187145 - RNA, 24 nt, Human
agccagccaagcuuuaaauuaugu

SEQ ID NO: 3187146 - RNA, 17 nt, Human
agccagccuggcuggga

SEQ ID NO: 3187147 - RNA, 15 nt, Human
agccagccuggcugg

SEQ ID NO: 3187148 - RNA, 22 nt, Human
agccagccuggcugggacuggg

SEQ ID NO: 3187149 - RNA, 19 nt, Human
agccagacuggcacaguuu

SEQ ID NO: 3187150 - RNA, 19 nt, Human
agccacugcaccgggccac

SEQ ID NO: 3187151 - RNA, 18 nt, Human
agccacugcaccgggcca

SEQ ID NO: 3187152 - RNA, 10 nt, Human
agccagagga

SEQ ID NO: 3187153 - RNA, 11 nt, Human
agccagaggag

SEQ ID NO: 3187154 - RNA, 16 nt, Human
agcccuuagcagggaa

SEQ ID NO: 3187155 - RNA, 17 nt, Human
ugcagacucuacagagg

SEQ ID NO: 3187156 - RNA, 16 nt, Human
ugcagacucuacagag

SEQ ID NO: 3187157 - RNA, 20 nt, Human
agccgagauagccaaggcca

SEQ ID NO: 3187158 - RNA, 21 nt, Human
agccgagauagccaaggccaa

SEQ ID NO: 3187159 - RNA, 17 nt, Human
agccgagaucacgccac

SEQ ID NO: 3187160 - RNA, 21 nt, Human
agcccuuagcagggaaacagc

SEQ ID NO: 3187161 - RNA, 22 nt, Human
agcccuugcccaugcugggcuc

SEQ ID NO: 3187162 - RNA, 14 nt, Human
ugcagaagacagua

SEQ ID NO: 3187163 - RNA, 15 nt, Human
ugcagaacucccaag

SEQ ID NO: 3187164 - RNA, 14 nt, Human
ugcagaacucccaa

SEQ ID NO: 3187165 - RNA, 15 nt, Human
ugcagaagacaguau

SEQ ID NO: 3187166 - RNA, 22 nt, Human
ugcagacaggcaagcaccuccu

SEQ ID NO: 3187167 - RNA, 22 nt, Human
ugcagacagggggccagaacac

SEQ ID NO: 3187168 - RNA, 14 nt, Human
ugcagacccucaga

SEQ ID NO: 3187169 - RNA, 21 nt, Human
ugcagaacuugaagccugcuc

SEQ ID NO: 3187170 - RNA, 23 nt, Human
ugcagaacuugaagccugcuccu

SEQ ID NO: 3187171 - RNA, 22 nt, Human
ugcagaacuugaagccugcucc

SEQ ID NO: 3187172 - RNA, 21 nt, Human
ugcagacagggggccagaaca

SEQ ID NO: 3187173 - RNA, 16 nt, Human
ugcacuccccugcugg

SEQ ID NO: 3187174 - RNA, 17 nt, Human
ugcacuccccugcuggg

SEQ ID NO: 3187175 - RNA, 19 nt, Human
ugcacuccccugcugggug

SEQ ID NO: 3187176 - RNA, 15 nt, Human
ugcacuccccugcug

SEQ ID NO: 3187177 - RNA, 20 nt, Human
agccucauguccacugguuc

SEQ ID NO: 3187178 - RNA, 21 nt, Human
agccuccaagcuccaucucca

SEQ ID NO: 3187179 - RNA, 14 nt, Human
agccuccaauuuuu

SEQ ID NO: 3187180 - RNA, 17 nt, Human
agccuccaugcugccuc

SEQ ID NO: 3187181 - RNA, 23 nt, Human
agccuccacuuuggaucaggaaa

SEQ ID NO: 3187182 - RNA, 23 nt, Human
agccucugaaaaccaauguucuc

SEQ ID NO: 3187183 - RNA, 21 nt, Human
ugcagccucaaccuccugggc

SEQ ID NO: 3187184 - RNA, 20 nt, Human
ugcagccucaaccuccuggg

SEQ ID NO: 3187185 - RNA, 22 nt, Human
ugcagccucaaccuccugggcu

SEQ ID NO: 3187186 - RNA, 15 nt, Human
ugcagcucagaacca

SEQ ID NO: 3187187 - RNA, 13 nt, Human
agccucugggccc

SEQ ID NO: 3187188 - RNA, 22 nt, Human
agccucagucucccucccuugg

SEQ ID NO: 3187189 - RNA, 13 nt, Human
agccucagucucc

SEQ ID NO: 3187190 - RNA, 16 nt, Human
agccucagucucccuc

SEQ ID NO: 3187191 - RNA, 19 nt, Human
agccucagucucccucccu

SEQ ID NO: 3187192 - RNA, 20 nt, Human
agccucagucucccucccuu

SEQ ID NO: 3187193 - RNA, 19 nt, Human
agccucaaccuccugggcu

SEQ ID NO: 3187194 - RNA, 20 nt, Human
agccucaaccuccugggcua

SEQ ID NO: 3187195 - RNA, 17 nt, Human
agccucacaguccuuac

SEQ ID NO: 3187196 - RNA, 18 nt, Human
agccucacaguccuuacc

SEQ ID NO: 3187197 - RNA, 20 nt, Human
agccucacccggugaccucu

SEQ ID NO: 3187198 - RNA, 23 nt, Human
agccucacgcuccuuucugaucu

SEQ ID NO: 3187199 - RNA, 21 nt, Human
agccucacgcuccuuucugau

SEQ ID NO: 3187200 - RNA, 15 nt, Human
agcccgcaucagcug

SEQ ID NO: 3187201 - RNA, 14 nt, Human
agcccgcaucagcu

SEQ ID NO: 3187202 - RNA, 21 nt, Human
agcccgauccuccccuggacu

SEQ ID NO: 3187203 - RNA, 21 nt, Human
agcccccagcuuccagcagga

SEQ ID NO: 3187204 - RNA, 22 nt, Human
agcccccagcuuccagcaggag

SEQ ID NO: 3187205 - RNA, 23 nt, Human
agcccauuugggcagagaggcug

SEQ ID NO: 3187206 - RNA, 22 nt, Human
agcccauuugggcagagaggcu

SEQ ID NO: 3187207 - RNA, 21 nt, Human
agcccauuuggagggccuggg

SEQ ID NO: 3187208 - RNA, 15 nt, Human
agcccccucuucccu

SEQ ID NO: 3187209 - RNA, 14 nt, Human
agcccccucuuccc

SEQ ID NO: 3187210 - RNA, 18 nt, Human
ugcacacaccagagccca

SEQ ID NO: 3187211 - RNA, 17 nt, Human
ugcacacaccagagccc

SEQ ID NO: 3187212 - RNA, 21 nt, Human
ugcacacaccagagcccaccu

SEQ ID NO: 3187213 - RNA, 16 nt, Human
agcccugguggcagug

SEQ ID NO: 3187214 - RNA, 15 nt, Human
agcccugguggcagu

SEQ ID NO: 3187215 - RNA, 14 nt, Human
agcccugguggcag

SEQ ID NO: 3187216 - RNA, 11 nt, Human
agcccugcucc

SEQ ID NO: 3187217 - RNA, 17 nt, Human
agcccugcuuugggcug

SEQ ID NO: 3187218 - RNA, 14 nt, Human
agcccugcucccuc

SEQ ID NO: 3187219 - RNA, 13 nt, Human
agcccugcucccu

SEQ ID NO: 3187220 - RNA, 12 nt, Human
agcccugcuccc

SEQ ID NO: 3187221 - RNA, 11 nt, Human
agcccuggccc

SEQ ID NO: 3187222 - RNA, 17 nt, Human
agcccuggcccaucaug

SEQ ID NO: 3187223 - RNA, 19 nt, Human
agcccugcuuugggcugcc

SEQ ID NO: 3187224 - RNA, 22 nt, Human
agccccauucugccugcccagg

SEQ ID NO: 3187225 - RNA, 21 nt, Human
agccccauucugccugcccag

SEQ ID NO: 3187226 - RNA, 18 nt, Human
agccccaaaacucuccuc

SEQ ID NO: 3187227 - RNA, 20 nt, Human
agccccauucugccugccca

SEQ ID NO: 3187228 - RNA, 16 nt, Human
agccccaaaacucucc

SEQ ID NO: 3187229 - RNA, 17 nt, Human
agccccaaaacucuccu

SEQ ID NO: 3187230 - RNA, 20 nt, Human
agcccauuuggagggccugg

SEQ ID NO: 3187231 - RNA, 19 nt, Human
agcccauuuggagggccug

SEQ ID NO: 3187232 - RNA, 17 nt, Human
agcccauuuggagggcc

SEQ ID NO: 3187233 - RNA, 21 nt, Human
agcccaggccuccuacagcuu

SEQ ID NO: 3187234 - RNA, 18 nt, Human
agcccaggauauauuuua

SEQ ID NO: 3187235 - RNA, 20 nt, Human
agcccaggagucccacucca

SEQ ID NO: 3187236 - RNA, 22 nt, Human
agcccaggagucccacuccaag

SEQ ID NO: 3187237 - RNA, 18 nt, Human
agcccauggcacucuaug

SEQ ID NO: 3187238 - RNA, 21 nt, Human
agcccauguggagucagccuc

SEQ ID NO: 3187239 - RNA, 19 nt, Human
agcccauguggcuaaaaaa

SEQ ID NO: 3187240 - RNA, 21 nt, Human
ugcaaaccaucauugaaaucu

SEQ ID NO: 3187241 - RNA, 13 nt, Human
ugauuuuaaaaug

SEQ ID NO: 3187242 - RNA, 15 nt, Human
ugauuugucacugcu

SEQ ID NO: 3187243 - RNA, 20 nt, Human
ugcaaaccaucauugaaauc

SEQ ID NO: 3187244 - RNA, 22 nt, Human
ugauuuuaaaauguacauguau

SEQ ID NO: 3187245 - RNA, 20 nt, Human
ugauuuuaaaauguacaugu

SEQ ID NO: 3187246 - RNA, 17 nt, Human
ugauuuuaaaauguaca

SEQ ID NO: 3187247 - RNA, 14 nt, Human
ugauuuuaaaaugu

SEQ ID NO: 3187248 - RNA, 19 nt, Human
ugcaaacugggcuggaaga

SEQ ID NO: 3187249 - RNA, 14 nt, Human
ugcaaguauucuca

SEQ ID NO: 3187250 - RNA, 15 nt, Human
ugcaaguauucucau

SEQ ID NO: 3187251 - RNA, 12 nt, Human
agcccaggagcc

SEQ ID NO: 3187252 - RNA, 15 nt, Human
agcccaggagcccau

SEQ ID NO: 3187253 - RNA, 14 nt, Human
agcccaggagccca

SEQ ID NO: 3187254 - RNA, 16 nt, Human
agcccaggagcccauu

SEQ ID NO: 3187255 - RNA, 12 nt, Human
agcccaggaggg

SEQ ID NO: 3187256 - RNA, 20 nt, Human
agcccaggagggagcagagg

SEQ ID NO: 3187257 - RNA, 19 nt, Human
agcccaggagggagcagag

SEQ ID NO: 3187258 - RNA, 17 nt, Human
uggacccugaaaugugu

SEQ ID NO: 3187259 - RNA, 15 nt, Human
uggaccauuuuccug

SEQ ID NO: 3187260 - RNA, 22 nt, Human
uggaccaugcugucuggcacag

SEQ ID NO: 3187261 - RNA, 14 nt, Human
uggaccauuuuccu

SEQ ID NO: 3187262 - RNA, 16 nt, Human
uggacacagcucuucu

SEQ ID NO: 3187263 - RNA, 15 nt, Human
uggacacagcucuuc

SEQ ID NO: 3187264 - RNA, 18 nt, Human
uggacacagcucuucucc

SEQ ID NO: 3187265 - RNA, 14 nt, Human
uggacccugaggcc

SEQ ID NO: 3187266 - RNA, 18 nt, Human
uggacccugaaaugugug

SEQ ID NO: 3187267 - RNA, 12 nt, Human
uggacccugagg

SEQ ID NO: 3187268 - RNA, 13 nt, Human
uggacccugaggc

SEQ ID NO: 3187269 - RNA, 22 nt, Human
uggaauuggguggggggcuuca

SEQ ID NO: 3187270 - RNA, 17 nt, Human
aggcaacucaucuuagg

SEQ ID NO: 3187271 - RNA, 14 nt, Human
aggaugcccaaaga

SEQ ID NO: 3187272 - RNA, 19 nt, Human
aggaugcccaaagaugcag

SEQ ID NO: 3187273 - RNA, 19 nt, Human
aggauuuugauccaagcug

SEQ ID NO: 3187274 - RNA, 17 nt, Human
aggaugccccguccccc

SEQ ID NO: 3187275 - RNA, 15 nt, Human
aggcaaaaacaaaga

SEQ ID NO: 3187276 - RNA, 15 nt, Human
aggcaaaaaaggaug

SEQ ID NO: 3187277 - RNA, 21 nt, Human
aggagggagcaucagugcccu

SEQ ID NO: 3187278 - RNA, 15 nt, Human
aggauccugagccag

SEQ ID NO: 3187279 - RNA, 16 nt, Human
aggauccugagccaga

SEQ ID NO: 3187280 - RNA, 21 nt, Human
aggaucucuugagccugggag

SEQ ID NO: 3187281 - RNA, 22 nt, Human
aggaucucuugagccugggagg

SEQ ID NO: 3187282 - RNA, 17 nt, Human
aggauccugagccagau

SEQ ID NO: 3187283 - RNA, 16 nt, Human
aggaugaucuaggaag

SEQ ID NO: 3187284 - RNA, 17 nt, Human
aggaugaucuaggaaga

SEQ ID NO: 3187285 - RNA, 23 nt, Human
uggaaaugggcagagcagagacc

SEQ ID NO: 3187286 - RNA, 20 nt, Human
uggaaauuaagaagaaacua

SEQ ID NO: 3187287 - RNA, 18 nt, Human
uggaaauuaagaagaaac

SEQ ID NO: 3187288 - RNA, 18 nt, Human
uggaaaugggcagagcag

SEQ ID NO: 3187289 - RNA, 13 nt, Human
uggaaauauuaaa

SEQ ID NO: 3187290 - RNA, 16 nt, Human
uggaaauauuaaaaga

SEQ ID NO: 3187291 - RNA, 20 nt, Human
uggaaauauuaagaaagacu

SEQ ID NO: 3187292 - RNA, 12 nt, Human
aggaggaggagg

SEQ ID NO: 3187293 - RNA, 14 nt, Human
aggaggaggagggu

SEQ ID NO: 3187294 - RNA, 15 nt, Human
aggagggaaaccuuu

SEQ ID NO: 3187295 - RNA, 21 nt, Human
aggaggcugggacgcucugcu

SEQ ID NO: 3187296 - RNA, 11 nt, Human
aggaggccacc

SEQ ID NO: 3187297 - RNA, 19 nt, Human
aggagggacagucucacca

SEQ ID NO: 3187298 - RNA, 22 nt, Human
aggaggcugggacgcucugcug

SEQ ID NO: 3187299 - RNA, 17 nt, Human
aggagccccgaggccuu

SEQ ID NO: 3187300 - RNA, 11 nt, Human
aggagcccugc

SEQ ID NO: 3187301 - RNA, 14 nt, Human
aggagcccugccuc

SEQ ID NO: 3187302 - RNA, 13 nt, Human
aggagcccugccu

SEQ ID NO: 3187303 - RNA, 22 nt, Human
aggagccccgaggccuucucug

SEQ ID NO: 3187304 - RNA, 14 nt, Human
aggagcagccacau

SEQ ID NO: 3187305 - RNA, 19 nt, Human
aggagcaguaucaugaagc

SEQ ID NO: 3187306 - RNA, 18 nt, Human
aggagcauauguccuaga

SEQ ID NO: 3187307 - RNA, 11 nt, Human
aggagaaacug

SEQ ID NO: 3187308 - RNA, 23 nt, Human
aggacuuuucuuuguggcuuccu

SEQ ID NO: 3187309 - RNA, 17 nt, Human
aggagauuggaaggaac

SEQ ID NO: 3187310 - RNA, 22 nt, Human
aggacuguuacucaaugugugc

SEQ ID NO: 3187311 - RNA, 18 nt, Human
aggacugacugaggcagu

SEQ ID NO: 3187312 - RNA, 22 nt, Human
aggacugacugaggcaguuuga

SEQ ID NO: 3187313 - RNA, 16 nt, Human
aggacugacugaggca

SEQ ID NO: 3187314 - RNA, 17 nt, Human
aggacugacugaggcag

SEQ ID NO: 3187315 - RNA, 15 nt, Human
aggacugacugaggc

SEQ ID NO: 3187316 - RNA, 18 nt, Human
aggacauugcggacagcc

SEQ ID NO: 3187317 - RNA, 17 nt, Human
aggacauugcggacagc

SEQ ID NO: 3187318 - RNA, 15 nt, Human
aggacauugcggaca

SEQ ID NO: 3187319 - RNA, 23 nt, Human
aggacauugcggacagccacggc

SEQ ID NO: 3187320 - RNA, 19 nt, Human
aggacauugcggacagcca

SEQ ID NO: 3187321 - RNA, 22 nt, Human
aggacauugauuugauuuuuau

SEQ ID NO: 3187322 - RNA, 19 nt, Human
aggacucugccuccucuuc

SEQ ID NO: 3187323 - RNA, 17 nt, Human
aggagccuccugcccuu

SEQ ID NO: 3187324 - RNA, 14 nt, Human
aggagccugcccag

SEQ ID NO: 3187325 - RNA, 17 nt, Human
aggagcccugccucucc

SEQ ID NO: 3187326 - RNA, 15 nt, Human
aggagcccugccucu

SEQ ID NO: 3187327 - RNA, 22 nt, Human
aggagcgcucccuugaccugcu

SEQ ID NO: 3187328 - RNA, 14 nt, Human
aggagcgcucccuu

SEQ ID NO: 3187329 - RNA, 16 nt, Human
ugcuuggaggaaggaa

SEQ ID NO: 3187330 - RNA, 14 nt, Human
ugcuuggcccaggg

SEQ ID NO: 3187331 - RNA, 13 nt, Human
ugcuuggcccagg

SEQ ID NO: 3187332 - RNA, 15 nt, Human
ugcuuggcccagggg

SEQ ID NO: 3187333 - RNA, 12 nt, Human
ugcuugggcuuc

SEQ ID NO: 3187334 - RNA, 16 nt, Human
ugcuugggcuucaucc

SEQ ID NO: 3187335 - RNA, 21 nt, Human
ugcuuggaggaaggaaaccca

SEQ ID NO: 3187336 - RNA, 17 nt, Human
ugcuugcggcaaaagga

SEQ ID NO: 3187337 - RNA, 18 nt, Human
ugcuugcggcaaaaggaa

SEQ ID NO: 3187338 - RNA, 19 nt, Human
ugcuugcggcaaaaggaaa

SEQ ID NO: 3187339 - RNA, 21 nt, Human
ugcuugcggcaaaaggaaagc

SEQ ID NO: 3187340 - RNA, 17 nt, Human
ugcuuuuaaaaaaaaau

SEQ ID NO: 3187341 - RNA, 13 nt, Human
ugcuuuuaaaacu

SEQ ID NO: 3187342 - RNA, 12 nt, Human
ugcuuugucucc

SEQ ID NO: 3187343 - RNA, 17 nt, Human
ugcuuuuaaaauuuuaa

SEQ ID NO: 3187344 - RNA, 13 nt, Human
ugcuuuuaaaauu

SEQ ID NO: 3187345 - RNA, 17 nt, Human
ugcuuuuaaaacuacuu

SEQ ID NO: 3187346 - RNA, 14 nt, Human
ugcuuuuaaaacua

SEQ ID NO: 3187347 - RNA, 21 nt, Human
ugcuuuggucacuuuuagaug

SEQ ID NO: 3187348 - RNA, 19 nt, Human
ugcuuuggucacuuuuaga

SEQ ID NO: 3187349 - RNA, 19 nt, Human
ugcuuuuaaaauuuuaagc

SEQ ID NO: 3187350 - RNA, 19 nt, Human
ugcuuuuaaggaaaggcaa

SEQ ID NO: 3187351 - RNA, 13 nt, Human
ugcuuuuagaaaa

SEQ ID NO: 3187352 - RNA, 19 nt, Human
ugcuuuuagugugugcaua

SEQ ID NO: 3187353 - RNA, 19 nt, Human
ugcuugggcuucauccucc

SEQ ID NO: 3187354 - RNA, 17 nt, Human
ugcuuugggcugcccug

SEQ ID NO: 3187355 - RNA, 21 nt, Human
ugcuuugggcugcccuggugc

SEQ ID NO: 3187356 - RNA, 20 nt, Human
ugcuuugggcugcccuggug

SEQ ID NO: 3187357 - RNA, 19 nt, Human
ugcuuugggcugcccuggu

SEQ ID NO: 3187358 - RNA, 18 nt, Human
ugcuuugggcugcccugg

SEQ ID NO: 3187359 - RNA, 15 nt, Human
uggaaauauuaagaa

SEQ ID NO: 3187360 - RNA, 15 nt, Human
uggaaauacuagauu

SEQ ID NO: 3187361 - RNA, 22 nt, Human
ugcuauuguagagccagagguc

SEQ ID NO: 3187362 - RNA, 16 nt, Human
ugcuauugugaauagu

SEQ ID NO: 3187363 - RNA, 18 nt, Human
ugcuauuguagagccaga

SEQ ID NO: 3187364 - RNA, 18 nt, Human
agcugggacuacaggcac

SEQ ID NO: 3187365 - RNA, 16 nt, Human
agcugggacuacaggc

SEQ ID NO: 3187366 - RNA, 16 nt, Human
ugcuccagcuguucag

SEQ ID NO: 3187367 - RNA, 19 nt, Human
ugcuccagcuguucagcug

SEQ ID NO: 3187368 - RNA, 19 nt, Human
ugcuccagcucuggcaugg

SEQ ID NO: 3187369 - RNA, 17 nt, Human
ugcuccagcucuggcau

SEQ ID NO: 3187370 - RNA, 13 nt, Human
ugcuccagcucug

SEQ ID NO: 3187371 - RNA, 12 nt, Human
ugcuccagcucu

SEQ ID NO: 3187372 - RNA, 21 nt, Human
ugcucccuccgggucuuccua

SEQ ID NO: 3187373 - RNA, 22 nt, Human
ugcucugcugacagacacaggc

SEQ ID NO: 3187374 - RNA, 21 nt, Human
ugcucugcugacagacacagg

SEQ ID NO: 3187375 - RNA, 13 nt, Human
ugcucccugacug

SEQ ID NO: 3187376 - RNA, 21 nt, Human
ugcucccugacugggggcaga

SEQ ID NO: 3187377 - RNA, 14 nt, Human
ugcucccugacugg

SEQ ID NO: 3187378 - RNA, 15 nt, Human
ugcugagucugaagg

SEQ ID NO: 3187379 - RNA, 14 nt, Human
ugcugagucugaag

SEQ ID NO: 3187380 - RNA, 16 nt, Human
ugcucugcugacagac

SEQ ID NO: 3187381 - RNA, 15 nt, Human
ugcucugcugaugac

SEQ ID NO: 3187382 - RNA, 16 nt, Human
ugcugacccaugggca

SEQ ID NO: 3187383 - RNA, 15 nt, Human
ugcugacccaugggc

SEQ ID NO: 3187384 - RNA, 23 nt, Human
ugcugacccaugggcaggagacu

SEQ ID NO: 3187385 - RNA, 21 nt, Human
ugcugacccaugggcaggaga

SEQ ID NO: 3187386 - RNA, 19 nt, Human
ugcugacccaugggcagga

SEQ ID NO: 3187387 - RNA, 18 nt, Human
ugcugacccaugggcagg

SEQ ID NO: 3187388 - RNA, 23 nt, Human
aggaauugacccacaagaaauga

SEQ ID NO: 3187389 - RNA, 18 nt, Human
aggaaggaaacccagcuc

SEQ ID NO: 3187390 - RNA, 17 nt, Human
aggaagccagcaggcuc

SEQ ID NO: 3187391 - RNA, 13 nt, Human
aggaagccagcag

SEQ ID NO: 3187392 - RNA, 19 nt, Human
aggaaggaaacccagcucu

SEQ ID NO: 3187393 - RNA, 15 nt, Human
aggaaggagaggaga

SEQ ID NO: 3187394 - RNA, 16 nt, Human
ugcugagucugaaggc

SEQ ID NO: 3187395 - RNA, 17 nt, Human
ugcugagucugaaggcu

SEQ ID NO: 3187396 - RNA, 18 nt, Human
ugcugagucugaaggcug

SEQ ID NO: 3187397 - RNA, 21 nt, Human
ugcugagucugaaggcugggu

SEQ ID NO: 3187398 - RNA, 22 nt, Human
ugcugagucugaaggcuggguu

SEQ ID NO: 3187399 - RNA, 13 nt, Human
aggaagacuucau

SEQ ID NO: 3187400 - RNA, 19 nt, Human
aggaagacuucaucccucu

SEQ ID NO: 3187401 - RNA, 13 nt, Human
aggaagacuuugg

SEQ ID NO: 3187402 - RNA, 14 nt, Human
aggaagacuuugga

SEQ ID NO: 3187403 - RNA, 23 nt, Human
aggaagcacaugccucucucagg

SEQ ID NO: 3187404 - RNA, 24 nt, Human
aggaagcacaugccucucucaggc

SEQ ID NO: 3187405 - RNA, 14 nt, Human
aggaagccagcagg

SEQ ID NO: 3187406 - RNA, 15 nt, Human
aggaagccagcaggc

SEQ ID NO: 3187407 - RNA, 22 nt, Human
aggaagcacaugccucucucag

SEQ ID NO: 3187408 - RNA, 16 nt, Human
ugcuucauacagggau

SEQ ID NO: 3187409 - RNA, 15 nt, Human
ugcuucauacaggga

SEQ ID NO: 3187410 - RNA, 14 nt, Human
ugcuucauacaggg

SEQ ID NO: 3187411 - RNA, 11 nt, Human
ugcuucauaca

SEQ ID NO: 3187412 - RNA, 12 nt, Human
aggacacucccg

SEQ ID NO: 3187413 - RNA, 19 nt, Human
aggacacuaaccacgcugg

SEQ ID NO: 3187414 - RNA, 23 nt, Human
aggacacuaaccacgcuggaccu

SEQ ID NO: 3187415 - RNA, 22 nt, Human
aggacaggaaaguggcaccugu

SEQ ID NO: 3187416 - RNA, 20 nt, Human
aggacaggaaaguggcaccu

SEQ ID NO: 3187417 - RNA, 22 nt, Human
aggacagggaggugaccccagg

SEQ ID NO: 3187418 - RNA, 16 nt, Human
aggacaggagaugcug

SEQ ID NO: 3187419 - RNA, 14 nt, Human
aggacauggcuucu

SEQ ID NO: 3187420 - RNA, 21 nt, Human
aggacauggcuucugaaccug

SEQ ID NO: 3187421 - RNA, 15 nt, Human
aggacauggcuucug

SEQ ID NO: 3187422 - RNA, 16 nt, Human
ugcuucaaggauccug

SEQ ID NO: 3187423 - RNA, 12 nt, Human
ugcuuauguugu

SEQ ID NO: 3187424 - RNA, 19 nt, Human
ugcuuauguuguuuuguac

SEQ ID NO: 3187425 - RNA, 18 nt, Human
ugcuucaaggauccugag

SEQ ID NO: 3187426 - RNA, 19 nt, Human
ugcuucaaggauccugagc

SEQ ID NO: 3187427 - RNA, 14 nt, Human
ugcuucagccuccc

SEQ ID NO: 3187428 - RNA, 13 nt, Human
ugcuucagccucc

SEQ ID NO: 3187429 - RNA, 12 nt, Human
ugcuucaaggau

SEQ ID NO: 3187430 - RNA, 13 nt, Human
ugcuuauugauau

SEQ ID NO: 3187431 - RNA, 13 nt, Human
ugcuuauacacuu

SEQ ID NO: 3187432 - RNA, 17 nt, Human
ugcuuauauuguuuuca

SEQ ID NO: 3187433 - RNA, 19 nt, Human
ugcuuauaaccuaguuaaa

SEQ ID NO: 3187434 - RNA, 23 nt, Human
ugcuuauaaccuaguuaaagaaa

SEQ ID NO: 3187435 - RNA, 13 nt, Human
ugcugucuuucuu

SEQ ID NO: 3187436 - RNA, 13 nt, Human
ugcugugaaaaaa

SEQ ID NO: 3187437 - RNA, 12 nt, Human
ugcugugaaaaa

SEQ ID NO: 3187438 - RNA, 23 nt, Human
ugcugucuuuucuuugccaucuc

SEQ ID NO: 3187439 - RNA, 22 nt, Human
ugcugucuuuucuuugccaucu

SEQ ID NO: 3187440 - RNA, 14 nt, Human
ugcugucuuuucuu

SEQ ID NO: 3187441 - RNA, 21 nt, Human
ugcugucuuucuugcucccug

SEQ ID NO: 3187442 - RNA, 18 nt, Human
ugcugugaagcuggaacu

SEQ ID NO: 3187443 - RNA, 17 nt, Human
ugcugugaagcuggaac

SEQ ID NO: 3187444 - RNA, 22 nt, Human
ugcugugaaaaaaaaaaugcug

SEQ ID NO: 3187445 - RNA, 14 nt, Human
ugcugugaaaaaaa

SEQ ID NO: 3187446 - RNA, 12 nt, Human
ugcugcccugug

SEQ ID NO: 3187447 - RNA, 13 nt, Human
ugcugcccuguga

SEQ ID NO: 3187448 - RNA, 14 nt, Human
ugcugcccugugag

SEQ ID NO: 3187449 - RNA, 13 nt, Human
ugcuggagcucug

SEQ ID NO: 3187450 - RNA, 14 nt, Human
ugcuggagcucugc

SEQ ID NO: 3187451 - RNA, 15 nt, Human
ugcugcccugugagu

SEQ ID NO: 3187452 - RNA, 16 nt, Human
ugcuggcugguuagag

SEQ ID NO: 3187453 - RNA, 21 nt, Human
ugcuggcugccuuagaaccuu

SEQ ID NO: 3187454 - RNA, 14 nt, Human
ugcuggcugccuua

SEQ ID NO: 3187455 - RNA, 15 nt, Human
ugcuggcugccuuag

SEQ ID NO: 3187456 - RNA, 19 nt, Human
ugcugucuggcacagccug

SEQ ID NO: 3187457 - RNA, 15 nt, Human
ugcugucuggcacag

SEQ ID NO: 3187458 - RNA, 16 nt, Human
ugcuguagacaucugu

SEQ ID NO: 3187459 - RNA, 24 nt, Human
ugcugucauugcuucuucugaggc

SEQ ID NO: 3187460 - RNA, 21 nt, Human
ugcugucauugcuucuucuga

SEQ ID NO: 3187461 - RNA, 20 nt, Human
ugcugucauugcuucuucug

SEQ ID NO: 3187462 - RNA, 14 nt, Human
ugcugucauugcuu

SEQ ID NO: 3187463 - RNA, 13 nt, Human
ugcugucauugcu

SEQ ID NO: 3187464 - RNA, 18 nt, Human
ugcugucagucuugaccu

SEQ ID NO: 3187465 - RNA, 16 nt, Human
uggccaguggcuggau

SEQ ID NO: 3187466 - RNA, 20 nt, Human
uggccccugcccggcugcgg

SEQ ID NO: 3187467 - RNA, 14 nt, Human
uggccaguggcugg

SEQ ID NO: 3187468 - RNA, 15 nt, Human
uggccaguggcugga

SEQ ID NO: 3187469 - RNA, 21 nt, Human
uggccccugcccggcugcgga

SEQ ID NO: 3187470 - RNA, 17 nt, Human
uggcccgacagccuggc

SEQ ID NO: 3187471 - RNA, 16 nt, Human
uggcccgacagccugg

SEQ ID NO: 3187472 - RNA, 15 nt, Human
uggcccgacagccug

SEQ ID NO: 3187473 - RNA, 14 nt, Human
uggcccgacagccu

SEQ ID NO: 3187474 - RNA, 19 nt, Human
uggcccgacagccuggcac

SEQ ID NO: 3187475 - RNA, 18 nt, Human
uggcccgacagccuggca

SEQ ID NO: 3187476 - RNA, 15 nt, Human
uggccgggagccuga

SEQ ID NO: 3187477 - RNA, 16 nt, Human
uggccggacacccgac

SEQ ID NO: 3187478 - RNA, 14 nt, Human
uggccucugcacuc

SEQ ID NO: 3187479 - RNA, 15 nt, Human
uggccucugcacucc

SEQ ID NO: 3187480 - RNA, 17 nt, Human
uggccucugcacucccc

SEQ ID NO: 3187481 - RNA, 13 nt, Human
uggccucugcacu

SEQ ID NO: 3187482 - RNA, 21 nt, Human
aggccuggccagaugcaccag

SEQ ID NO: 3187483 - RNA, 17 nt, Human
aggccuggccagaugca

SEQ ID NO: 3187484 - RNA, 16 nt, Human
aggccuggccagaugc

SEQ ID NO: 3187485 - RNA, 15 nt, Human
aggccuggccagaug

SEQ ID NO: 3187486 - RNA, 23 nt, Human
aggccugggggcugggcagagga

SEQ ID NO: 3187487 - RNA, 23 nt, Human
aggccuggccagaugcaccagcc

SEQ ID NO: 3187488 - RNA, 22 nt, Human
aggccuggccagaugcaccagc

SEQ ID NO: 3187489 - RNA, 15 nt, Human
aggcccaaagccucg

SEQ ID NO: 3187490 - RNA, 13 nt, Human
aggcccaaagccu

SEQ ID NO: 3187491 - RNA, 14 nt, Human
aggccauuuuuggu

SEQ ID NO: 3187492 - RNA, 12 nt, Human
aggcccaaagcc

SEQ ID NO: 3187493 - RNA, 13 nt, Human
aggcccucugccc

SEQ ID NO: 3187494 - RNA, 14 nt, Human
aggcccucugccca

SEQ ID NO: 3187495 - RNA, 21 nt, Human
aggccucucauuccagaggaa

SEQ ID NO: 3187496 - RNA, 23 nt, Human
aggccuccuguggccugccaguc

SEQ ID NO: 3187497 - RNA, 22 nt, Human
aggccuccuguggccugccagu

SEQ ID NO: 3187498 - RNA, 17 nt, Human
aggccucccugccagua

SEQ ID NO: 3187499 - RNA, 21 nt, Human
aggccuccuguggccugccag

SEQ ID NO: 3187500 - RNA, 18 nt, Human
aggccucugccucacaac

SEQ ID NO: 3187501 - RNA, 14 nt, Human
aggccucccugcca

SEQ ID NO: 3187502 - RNA, 16 nt, Human
aggccucccugccagu

SEQ ID NO: 3187503 - RNA, 15 nt, Human
aggccucccugccag

SEQ ID NO: 3187504 - RNA, 12 nt, Human
uggcaugggaau

SEQ ID NO: 3187505 - RNA, 15 nt, Human
uggcaugggaaugaa

SEQ ID NO: 3187506 - RNA, 13 nt, Human
uggcaugcauccc

SEQ ID NO: 3187507 - RNA, 20 nt, Human
aggccugcuuugucuccucu

SEQ ID NO: 3187508 - RNA, 16 nt, Human
uggcaugcuuaaauuu

SEQ ID NO: 3187509 - RNA, 17 nt, Human
uggcaugcuuaaauuuu

SEQ ID NO: 3187510 - RNA, 18 nt, Human
uggcaugcuuaaauuuua

SEQ ID NO: 3187511 - RNA, 19 nt, Human
aggccugcuuugucuccuc

SEQ ID NO: 3187512 - RNA, 13 nt, Human
aggccugccuguu

SEQ ID NO: 3187513 - RNA, 17 nt, Human
uggccaggcuggucuca

SEQ ID NO: 3187514 - RNA, 15 nt, Human
uggccaggcuggucu

SEQ ID NO: 3187515 - RNA, 20 nt, Human
uggccaggcuggucucgaac

SEQ ID NO: 3187516 - RNA, 22 nt, Human
uggaccuuuccugaggaagagg

SEQ ID NO: 3187517 - RNA, 20 nt, Human
uggaccuugaacuggguacu

SEQ ID NO: 3187518 - RNA, 16 nt, Human
aggccaaacucaccug

SEQ ID NO: 3187519 - RNA, 17 nt, Human
aggccaaacaggcccuc

SEQ ID NO: 3187520 - RNA, 21 nt, Human
aggcauuuucccccuuggcuc

SEQ ID NO: 3187521 - RNA, 19 nt, Human
aggcauuuguaaauauuaa

SEQ ID NO: 3187522 - RNA, 20 nt, Human
aggcauuuguaaauauuaaa

SEQ ID NO: 3187523 - RNA, 14 nt, Human
aggccaaaggaagc

SEQ ID NO: 3187524 - RNA, 19 nt, Human
aggccaaagacaaauagua

SEQ ID NO: 3187525 - RNA, 18 nt, Human
aggccaaagacaaauagu

SEQ ID NO: 3187526 - RNA, 17 nt, Human
aggccaaagacaaauag

SEQ ID NO: 3187527 - RNA, 15 nt, Human
aggccaaagacaaau

SEQ ID NO: 3187528 - RNA, 20 nt, Human
aggccaaacucaccugcccc

SEQ ID NO: 3187529 - RNA, 13 nt, Human
aggccaaagacaa

SEQ ID NO: 3187530 - RNA, 23 nt, Human
aggccaaaggaagcacaugccuc

SEQ ID NO: 3187531 - RNA, 20 nt, Human
aggccaaaggaagcacaugc

SEQ ID NO: 3187532 - RNA, 18 nt, Human
aggccaaggugggaggau

SEQ ID NO: 3187533 - RNA, 19 nt, Human
uggaugccugguggcagcu

SEQ ID NO: 3187534 - RNA, 18 nt, Human
uggaugccugguggcagc

SEQ ID NO: 3187535 - RNA, 17 nt, Human
uggaguucauucauauu

SEQ ID NO: 3187536 - RNA, 20 nt, Human
uggaguucauucauauuaca

SEQ ID NO: 3187537 - RNA, 18 nt, Human
uggaguucauucauauua

SEQ ID NO: 3187538 - RNA, 16 nt, Human
uggaguucaucuugaa

SEQ ID NO: 3187539 - RNA, 17 nt, Human
uggaguucaucuugaau

SEQ ID NO: 3187540 - RNA, 20 nt, Human
uggaguucaucuugaauugu

SEQ ID NO: 3187541 - RNA, 15 nt, Human
uggaugccugguggc

SEQ ID NO: 3187542 - RNA, 15 nt, Human
aggccacaagacccu

SEQ ID NO: 3187543 - RNA, 20 nt, Human
aggccaaucagaagcuaaca

SEQ ID NO: 3187544 - RNA, 16 nt, Human
aggccaaucagaagcu

SEQ ID NO: 3187545 - RNA, 14 nt, Human
uggaguauauguca

SEQ ID NO: 3187546 - RNA, 19 nt, Human
aggccaaguacacugagag

SEQ ID NO: 3187547 - RNA, 19 nt, Human
uggagucagacagaugugg

SEQ ID NO: 3187548 - RNA, 14 nt, Human
uggagucagccucg

SEQ ID NO: 3187549 - RNA, 16 nt, Human
uggagucauuucugau

SEQ ID NO: 3187550 - RNA, 22 nt, Human
uggaguccaggacaggagaugc

SEQ ID NO: 3187551 - RNA, 17 nt, Human
uggagucauuucugauu

SEQ ID NO: 3187552 - RNA, 12 nt, Human
aggccacugaag

SEQ ID NO: 3187553 - RNA, 13 nt, Human
aggccacugaaga

SEQ ID NO: 3187554 - RNA, 14 nt, Human
aggccacugaagag

SEQ ID NO: 3187555 - RNA, 16 nt, Human
aggccacugaagagga

SEQ ID NO: 3187556 - RNA, 17 nt, Human
aggccacugaagaggag

SEQ ID NO: 3187557 - RNA, 18 nt, Human
aggccacugaagaggagg

SEQ ID NO: 3187558 - RNA, 20 nt, Human
aggccacugaagaggaggag

SEQ ID NO: 3187559 - RNA, 24 nt, Human
aggccacauuacuagaguuggcau

SEQ ID NO: 3187560 - RNA, 15 nt, Human
aggccacccugugca

SEQ ID NO: 3187561 - RNA, 22 nt, Human
aggccacccugugcagaaggga

SEQ ID NO: 3187562 - RNA, 20 nt, Human
aggccacccugugcagaagg

SEQ ID NO: 3187563 - RNA, 20 nt, Human
aggccacauccacagucucc

SEQ ID NO: 3187564 - RNA, 20 nt, Human
aggccacaagacccuugugg

SEQ ID NO: 3187565 - RNA, 15 nt, Human
uggcagccucuucaa

SEQ ID NO: 3187566 - RNA, 16 nt, Human
uggcagccucuucaaa

SEQ ID NO: 3187567 - RNA, 23 nt, Human
uggcagccgugccuucagcucua

SEQ ID NO: 3187568 - RNA, 22 nt, Human
uggcagccgugccuucagcucu

SEQ ID NO: 3187569 - RNA, 12 nt, Human
uggcagccccug

SEQ ID NO: 3187570 - RNA, 20 nt, Human
uggcagcccgcaucagcugc

SEQ ID NO: 3187571 - RNA, 17 nt, Human
uggcagcccgcaucagc

SEQ ID NO: 3187572 - RNA, 20 nt, Human
uggcacaguuuucugagaaa

SEQ ID NO: 3187573 - RNA, 12 nt, Human
uggauguucuga

SEQ ID NO: 3187574 - RNA, 22 nt, Human
uggcacaguuuucugagaaaga

SEQ ID NO: 3187575 - RNA, 18 nt, Human
uggcaccagcagccugga

SEQ ID NO: 3187576 - RNA, 21 nt, Human
uggcagaguugaagacagagc

SEQ ID NO: 3187577 - RNA, 15 nt, Human
uggcacccggccccu

SEQ ID NO: 3187578 - RNA, 22 nt, Human
uggcagaguugaagacagagcu

SEQ ID NO: 3187579 - RNA, 14 nt, Human
aggcugcuuuccaa

SEQ ID NO: 3187580 - RNA, 13 nt, Human
aggcugcuuucca

SEQ ID NO: 3187581 - RNA, 23 nt, Human
aggcugcucuugaacuccugacc

SEQ ID NO: 3187582 - RNA, 21 nt, Human
aggcugcuuuccaaagccaau

SEQ ID NO: 3187583 - RNA, 11 nt, Human
aggcuggaagg

SEQ ID NO: 3187584 - RNA, 13 nt, Human
aggcuggaaggag

SEQ ID NO: 3187585 - RNA, 15 nt, Human
aggcuggaaggagga

SEQ ID NO: 3187586 - RNA, 16 nt, Human
aggcuggaaggaggaa

SEQ ID NO: 3187587 - RNA, 17 nt, Human
aggcuggaaggaggaag

SEQ ID NO: 3187588 - RNA, 18 nt, Human
aggcuggaaggaggaaga

SEQ ID NO: 3187589 - RNA, 19 nt, Human
aggcugcuuuccaaagcca

SEQ ID NO: 3187590 - RNA, 18 nt, Human
aggcugcuuuccaaagcc

SEQ ID NO: 3187591 - RNA, 17 nt, Human
aggcugcuuuccaaagc

SEQ ID NO: 3187592 - RNA, 15 nt, Human
aggcugcuuuccaaa

SEQ ID NO: 3187593 - RNA, 16 nt, Human
aggcucugcccuuggu

SEQ ID NO: 3187594 - RNA, 17 nt, Human
aggcuggcgugcagugg

SEQ ID NO: 3187595 - RNA, 13 nt, Human
aggcuggcgugca

SEQ ID NO: 3187596 - RNA, 19 nt, Human
aggcuggcccugcccuggu

SEQ ID NO: 3187597 - RNA, 15 nt, Human
aggcuggcccugccc

SEQ ID NO: 3187598 - RNA, 16 nt, Human
aggcuggcccugcccu

SEQ ID NO: 3187599 - RNA, 17 nt, Human
aggcuggcccugcccug

SEQ ID NO: 3187600 - RNA, 18 nt, Human
aggcuggcccugcccugg

SEQ ID NO: 3187601 - RNA, 12 nt, Human
aggcuggcccug

SEQ ID NO: 3187602 - RNA, 14 nt, Human
aggcuggcccugcc

SEQ ID NO: 3187603 - RNA, 17 nt, Human
aggcuggaguuggggca

SEQ ID NO: 3187604 - RNA, 21 nt, Human
aggcucgagcaugccuggaug

SEQ ID NO: 3187605 - RNA, 20 nt, Human
aggcuccuucaacaaggcuu

SEQ ID NO: 3187606 - RNA, 15 nt, Human
aggcucgagcaugcc

SEQ ID NO: 3187607 - RNA, 17 nt, Human
aggcucgagcaugccug

SEQ ID NO: 3187608 - RNA, 18 nt, Human
aggcucgagcaugccugg

SEQ ID NO: 3187609 - RNA, 19 nt, Human
aggcucgagcaugccugga

SEQ ID NO: 3187610 - RNA, 12 nt, Human
aggcucgagcau

SEQ ID NO: 3187611 - RNA, 19 nt, Human
aggcuccuuuagcgcccag

SEQ ID NO: 3187612 - RNA, 20 nt, Human
aggcuccugccaccacgccc

SEQ ID NO: 3187613 - RNA, 13 nt, Human
aggcuccugccac

SEQ ID NO: 3187614 - RNA, 13 nt, Human
aggcuccugcccc

SEQ ID NO: 3187615 - RNA, 23 nt, Human
aggcuccuuaggguuuucucucu

SEQ ID NO: 3187616 - RNA, 22 nt, Human
aggcuccuuaggguuuucucuc

SEQ ID NO: 3187617 - RNA, 14 nt, Human
aggcuccugccacc

SEQ ID NO: 3187618 - RNA, 11 nt, Human
aggcucucagg

SEQ ID NO: 3187619 - RNA, 12 nt, Human
aggcucucaggc

SEQ ID NO: 3187620 - RNA, 14 nt, Human
aggcucucaggcca

SEQ ID NO: 3187621 - RNA, 15 nt, Human
aggcucucaggccag

SEQ ID NO: 3187622 - RNA, 16 nt, Human
aggcucucaggccagc

SEQ ID NO: 3187623 - RNA, 18 nt, Human
aggcucucaggccagcug

SEQ ID NO: 3187624 - RNA, 19 nt, Human
aggcucucaggccagcugc

SEQ ID NO: 3187625 - RNA, 20 nt, Human
aggcucucaggccagcugcu

SEQ ID NO: 3187626 - RNA, 14 nt, Human
aggcucugcccuug

SEQ ID NO: 3187627 - RNA, 15 nt, Human
aggcucugcccuugg

SEQ ID NO: 3187628 - RNA, 13 nt, Human
aggcucugcccuu

SEQ ID NO: 3187629 - RNA, 12 nt, Human
aggcucugcccu

SEQ ID NO: 3187630 - RNA, 11 nt, Human
aggcucugccc

SEQ ID NO: 3187631 - RNA, 21 nt, Human
aggcucucaggccagcugcuu

SEQ ID NO: 3187632 - RNA, 15 nt, Human
aggcucucugggcug

SEQ ID NO: 3187633 - RNA, 22 nt, Human
uggcucuugaacugagcuugga

SEQ ID NO: 3187634 - RNA, 16 nt, Human
uggcucuugaacugag

SEQ ID NO: 3187635 - RNA, 12 nt, Human
uggcugcaaagg

SEQ ID NO: 3187636 - RNA, 20 nt, Human
uggcucuuccaggcugggag

SEQ ID NO: 3187637 - RNA, 21 nt, Human
uggcucuuccaggcugggaga

SEQ ID NO: 3187638 - RNA, 19 nt, Human
uggcucuuccaggcuggga

SEQ ID NO: 3187639 - RNA, 18 nt, Human
uggcucaaguccucuuuu

SEQ ID NO: 3187640 - RNA, 18 nt, Human
uggcugccaaugggagcu

SEQ ID NO: 3187641 - RNA, 20 nt, Human
uggcugccaaugggagcuca

SEQ ID NO: 3187642 - RNA, 14 nt, Human
uggcugcagggagu

SEQ ID NO: 3187643 - RNA, 13 nt, Human
uggcugcagggag

SEQ ID NO: 3187644 - RNA, 15 nt, Human
uggcugcagggaguc

SEQ ID NO: 3187645 - RNA, 19 nt, Human
uggcugaguagcucugccu

SEQ ID NO: 3187646 - RNA, 16 nt, Human
uggcuaugagggccuu

SEQ ID NO: 3187647 - RNA, 22 nt, Human
uggcuauuagagaucaaccccu

SEQ ID NO: 3187648 - RNA, 20 nt, Human
aggcuggcgugcaguggugc

SEQ ID NO: 3187649 - RNA, 18 nt, Human
aggcuggcgugcaguggu

SEQ ID NO: 3187650 - RNA, 14 nt, Human
aggcugggagagcc

SEQ ID NO: 3187651 - RNA, 18 nt, Human
aggcugggacgcucugcu

SEQ ID NO: 3187652 - RNA, 19 nt, Human
aggcugggacgcucugcug

SEQ ID NO: 3187653 - RNA, 22 nt, Human
uggcugccuugugaaggaauua

SEQ ID NO: 3187654 - RNA, 22 nt, Human
uggcugcggggcgggcacaccu

SEQ ID NO: 3187655 - RNA, 17 nt, Human
uggcuuaaaacaacacu

SEQ ID NO: 3187656 - RNA, 15 nt, Human
uggcuguuggcuggg

SEQ ID NO: 3187657 - RNA, 14 nt, Human
uggcugugucuccc

SEQ ID NO: 3187658 - RNA, 13 nt, Human
uggcuguuggcug

SEQ ID NO: 3187659 - RNA, 22 nt, Human
uggcuucacggaagagccuugc

SEQ ID NO: 3187660 - RNA, 19 nt, Human
uggcuuauuuaauaugcuu

SEQ ID NO: 3187661 - RNA, 19 nt, Human
uggcuuaaaaaaaacucuu

SEQ ID NO: 3187662 - RNA, 18 nt, Human
uggcuuaaaaaaaacucu

SEQ ID NO: 3187663 - RNA, 13 nt, Human
uggcuuacacugg

SEQ ID NO: 3187664 - RNA, 11 nt, Human
uggcuuaauuc

SEQ ID NO: 3187665 - RNA, 23 nt, Human
uggcuucacggaagagccuugcg

SEQ ID NO: 3187666 - RNA, 21 nt, Human
ugggaaagcauuguaaaugug

SEQ ID NO: 3187667 - RNA, 17 nt, Human
uggcuucccgcucagcc

SEQ ID NO: 3187668 - RNA, 23 nt, Human
uggcuucccaaaugugugcccag

SEQ ID NO: 3187669 - RNA, 16 nt, Human
uggcuucccgcucagc

SEQ ID NO: 3187670 - RNA, 15 nt, Human
uggcuucccgcucag

SEQ ID NO: 3187671 - RNA, 16 nt, Human
ugggaaaggggaaguu

SEQ ID NO: 3187672 - RNA, 13 nt, Human
ugggaacuagacu

SEQ ID NO: 3187673 - RNA, 20 nt, Human
ugggaagagcuuagaaacug

SEQ ID NO: 3187674 - RNA, 17 nt, Human
ugggaagagcuuagaaa

SEQ ID NO: 3187675 - RNA, 23 nt, Human
ugggaaguuaaagggaagaaaac

SEQ ID NO: 3187676 - RNA, 15 nt, Human
ugggaaguuaaaggg

SEQ ID NO: 3187677 - RNA, 19 nt, Human
uugucaccugcuucucugc

SEQ ID NO: 3187678 - RNA, 15 nt, Human
uugucaccugcuucu

SEQ ID NO: 3187679 - RNA, 14 nt, Human
uugucacugcuuca

SEQ ID NO: 3187680 - RNA, 17 nt, Human
uugucacugagaagaug

SEQ ID NO: 3187681 - RNA, 16 nt, Human
uuguccccgacccuug

SEQ ID NO: 3187682 - RNA, 20 nt, Human
uugucauuuucauuagcaaa

SEQ ID NO: 3187683 - RNA, 13 nt, Human
uugucauuuucau

SEQ ID NO: 3187684 - RNA, 19 nt, Human
uugucauuuucauuagcaa

SEQ ID NO: 3187685 - RNA, 14 nt, Human
uugucauuuucauu

SEQ ID NO: 3187686 - RNA, 15 nt, Human
uuguccuuugauucc

SEQ ID NO: 3187687 - RNA, 19 nt, Human
uuguccuccugcugccagu

SEQ ID NO: 3187688 - RNA, 17 nt, Human
uuguccuccugcugcca

SEQ ID NO: 3187689 - RNA, 16 nt, Human
uuguccuccugcugcc

SEQ ID NO: 3187690 - RNA, 20 nt, Human
uuguccuauuaguguuauau

SEQ ID NO: 3187691 - RNA, 17 nt, Human
uuguccuauuaguguua

SEQ ID NO: 3187692 - RNA, 19 nt, Human
uuguccuauuaguguuaua

SEQ ID NO: 3187693 - RNA, 15 nt, Human
uuguccuccugcugc

SEQ ID NO: 3187694 - RNA, 13 nt, Human
uuguccuccugcu

SEQ ID NO: 3187695 - RNA, 18 nt, Human
uugucccugaagagaagg

SEQ ID NO: 3187696 - RNA, 19 nt, Human
uugucccuggcuuccuuac

SEQ ID NO: 3187697 - RNA, 18 nt, Human
uugucccuggcuuccuua

SEQ ID NO: 3187698 - RNA, 16 nt, Human
uuguccuauuaguguu

SEQ ID NO: 3187699 - RNA, 21 nt, Human
uuguccgguuuacuuuaacuu

SEQ ID NO: 3187700 - RNA, 17 nt, Human
uuguccgguuuacuuua

SEQ ID NO: 3187701 - RNA, 15 nt, Human
uuguccgguuuacuu

SEQ ID NO: 3187702 - RNA, 18 nt, Human
uugucacacacuuuggcu

SEQ ID NO: 3187703 - RNA, 15 nt, Human
augauaaaacacaaa

SEQ ID NO: 3187704 - RNA, 13 nt, Human
augagugagaaua

SEQ ID NO: 3187705 - RNA, 18 nt, Human
augagccucagcauccug

SEQ ID NO: 3187706 - RNA, 17 nt, Human
augagccucagcauccu

SEQ ID NO: 3187707 - RNA, 22 nt, Human
augaggucagagccugcaguua

SEQ ID NO: 3187708 - RNA, 23 nt, Human
augaguccccuguuuguuucuga

SEQ ID NO: 3187709 - RNA, 12 nt, Human
augagaggaaau

SEQ ID NO: 3187710 - RNA, 13 nt, Human
augagaggaaauc

SEQ ID NO: 3187711 - RNA, 14 nt, Human
augagaggaaauca

SEQ ID NO: 3187712 - RNA, 15 nt, Human
augagaggaaaucac

SEQ ID NO: 3187713 - RNA, 16 nt, Human
augagaggaaaucacc

SEQ ID NO: 3187714 - RNA, 20 nt, Human
augagaggggagagcugaac

SEQ ID NO: 3187715 - RNA, 15 nt, Human
augagauacuuugca

SEQ ID NO: 3187716 - RNA, 16 nt, Human
augagauacuuugcau

SEQ ID NO: 3187717 - RNA, 22 nt, Human
augagauacuuugcauugucug

SEQ ID NO: 3187718 - RNA, 16 nt, Human
augagccucagcaucc

SEQ ID NO: 3187719 - RNA, 15 nt, Human
augagccucagcauc

SEQ ID NO: 3187720 - RNA, 12 nt, Human
augagccucagc

SEQ ID NO: 3187721 - RNA, 22 nt, Human
augagcaucaggccaggcccuc

SEQ ID NO: 3187722 - RNA, 17 nt, Human
augagcaauaucugcua

SEQ ID NO: 3187723 - RNA, 14 nt, Human
augagcacuucuaa

SEQ ID NO: 3187724 - RNA, 13 nt, Human
augagcacuucua

SEQ ID NO: 3187725 - RNA, 18 nt, Human
augagcaucaggccaggc

SEQ ID NO: 3187726 - RNA, 19 nt, Human
augagcaucaggccaggcc

SEQ ID NO: 3187727 - RNA, 20 nt, Human
augagcaucaggccaggccc

SEQ ID NO: 3187728 - RNA, 21 nt, Human
augagcaucaggccaggcccu

SEQ ID NO: 3187729 - RNA, 16 nt, Human
augagcaucaggccag

SEQ ID NO: 3187730 - RNA, 17 nt, Human
augagcaucaggccagg

SEQ ID NO: 3187731 - RNA, 15 nt, Human
augagcaucaggcca

SEQ ID NO: 3187732 - RNA, 10 nt, Human
uugugugugg

SEQ ID NO: 3187733 - RNA, 13 nt, Human
uugugugugggag

SEQ ID NO: 3187734 - RNA, 16 nt, Human
uuguguguccccuugc

SEQ ID NO: 3187735 - RNA, 16 nt, Human
uugugugugggagugu

SEQ ID NO: 3187736 - RNA, 16 nt, Human
uugugaauaaugauuu

SEQ ID NO: 3187737 - RNA, 23 nt, Human
uugugaagugaaggauuuguguu

SEQ ID NO: 3187738 - RNA, 18 nt, Human
uugugaaggauuauggaa

SEQ ID NO: 3187739 - RNA, 21 nt, Human
uugugaaggauuauggaaaaa

SEQ ID NO: 3187740 - RNA, 19 nt, Human
uugugaacaagucccugua

SEQ ID NO: 3187741 - RNA, 23 nt, Human
uugugaaauuuuucauauuuuaa

SEQ ID NO: 3187742 - RNA, 21 nt, Human
uugugaaauuuuucauauuuu

SEQ ID NO: 3187743 - RNA, 19 nt, Human
uugugaaauuuuucauauu

SEQ ID NO: 3187744 - RNA, 17 nt, Human
uugugaaauuuuucaua

SEQ ID NO: 3187745 - RNA, 15 nt, Human
uugugaaauuuuuca

SEQ ID NO: 3187746 - RNA, 14 nt, Human
uugugaaauuuuuc

SEQ ID NO: 3187747 - RNA, 20 nt, Human
uugucggcuccaguccccag

SEQ ID NO: 3187748 - RNA, 14 nt, Human
uugucggcuccagu

SEQ ID NO: 3187749 - RNA, 14 nt, Human
augaucuucuuuau

SEQ ID NO: 3187750 - RNA, 15 nt, Human
augauccuaaugaau

SEQ ID NO: 3187751 - RNA, 22 nt, Human
augaucgaaaaaauaauuauuu

SEQ ID NO: 3187752 - RNA, 16 nt, Human
augauccuaggcauuu

SEQ ID NO: 3187753 - RNA, 23 nt, Human
augaucacggcucacugcagccu

SEQ ID NO: 3187754 - RNA, 19 nt, Human
augaucacuuaucaguuug

SEQ ID NO: 3187755 - RNA, 15 nt, Human
augaucacggcucac

SEQ ID NO: 3187756 - RNA, 19 nt, Human
augaucacggcucacugca

SEQ ID NO: 3187757 - RNA, 18 nt, Human
augaucacggcucacugc

SEQ ID NO: 3187758 - RNA, 17 nt, Human
augauauugcugaagaa

SEQ ID NO: 3187759 - RNA, 23 nt, Human
augauauugcugaagaaucuacu

SEQ ID NO: 3187760 - RNA, 17 nt, Human
augauauuuuaaaaucu

SEQ ID NO: 3187761 - RNA, 15 nt, Human
uuguugauucucucc

SEQ ID NO: 3187762 - RNA, 17 nt, Human
uuguugauucucuccau

SEQ ID NO: 3187763 - RNA, 20 nt, Human
uuguugcacugaaguuugau

SEQ ID NO: 3187764 - RNA, 17 nt, Human
uuguugcacugaaguuu

SEQ ID NO: 3187765 - RNA, 15 nt, Human
uuguugcacugaagu

SEQ ID NO: 3187766 - RNA, 14 nt, Human
uuguugcacugaag

SEQ ID NO: 3187767 - RNA, 23 nt, Human
augaucugugccuuuuuuauauc

SEQ ID NO: 3187768 - RNA, 19 nt, Human
augaucugugccuuuuuua

SEQ ID NO: 3187769 - RNA, 15 nt, Human
augaucugugccuuu

SEQ ID NO: 3187770 - RNA, 16 nt, Human
augcaaguauucucau

SEQ ID NO: 3187771 - RNA, 15 nt, Human
augaucuucuuuaua

SEQ ID NO: 3187772 - RNA, 16 nt, Human
augcaaaccaucauug

SEQ ID NO: 3187773 - RNA, 18 nt, Human
augcaaaccaucauugaa

SEQ ID NO: 3187774 - RNA, 19 nt, Human
augcaaaccaucauugaaa

SEQ ID NO: 3187775 - RNA, 20 nt, Human
augcaaaccaucauugaaau

SEQ ID NO: 3187776 - RNA, 21 nt, Human
augcaaaccaucauugaaauc

SEQ ID NO: 3187777 - RNA, 22 nt, Human
augcaaaccaucauugaaaucu

SEQ ID NO: 3187778 - RNA, 19 nt, Human
uuguuuuuaaguuugcacu

SEQ ID NO: 3187779 - RNA, 18 nt, Human
uuguuuuuuuuuuccacu

SEQ ID NO: 3187780 - RNA, 15 nt, Human
uuguuuuuguauauu

SEQ ID NO: 3187781 - RNA, 12 nt, Human
uuguuuuuugaa

SEQ ID NO: 3187782 - RNA, 16 nt, Human
uuguuuuuugaagugu

SEQ ID NO: 3187783 - RNA, 14 nt, Human
uuguuuuuugaagu

SEQ ID NO: 3187784 - RNA, 13 nt, Human
uuguuuuuguaua

SEQ ID NO: 3187785 - RNA, 15 nt, Human
uuguuuuuguaaaga

SEQ ID NO: 3187786 - RNA, 18 nt, Human
uuguuuuucugcuuuaga

SEQ ID NO: 3187787 - RNA, 12 nt, Human
uuguuuuucugc

SEQ ID NO: 3187788 - RNA, 13 nt, Human
uuguuuuucugau

SEQ ID NO: 3187789 - RNA, 16 nt, Human
augcaaguuuuuuuuc

SEQ ID NO: 3187790 - RNA, 13 nt, Human
uuguuuuguacag

SEQ ID NO: 3187791 - RNA, 21 nt, Human
uuguuuuguugcacugaaguu

SEQ ID NO: 3187792 - RNA, 14 nt, Human
uuguuuuguugcac

SEQ ID NO: 3187793 - RNA, 13 nt, Human
uuguuuuuugagu

SEQ ID NO: 3187794 - RNA, 12 nt, Human
uuguuuuuugag

SEQ ID NO: 3187795 - RNA, 17 nt, Human
uuguuuuuugaaguguu

SEQ ID NO: 3187796 - RNA, 19 nt, Human
uuguuuuuuuuuuccacuu

SEQ ID NO: 3187797 - RNA, 17 nt, Human
uuuaaaaaauuaaucug

SEQ ID NO: 3187798 - RNA, 18 nt, Human
uuuaaacuucuuaacugg

SEQ ID NO: 3187799 - RNA, 17 nt, Human
uuuaaagaaaaaaaugu

SEQ ID NO: 3187800 - RNA, 18 nt, Human
uuuaaagaaaaaaauguc

SEQ ID NO: 3187801 - RNA, 12 nt, Human
uugcuuuaauuu

SEQ ID NO: 3187802 - RNA, 21 nt, Human
uugcuuuaauuccaugaaugu

SEQ ID NO: 3187803 - RNA, 18 nt, Human
uugcuuuuaaaauuuuaa

SEQ ID NO: 3187804 - RNA, 13 nt, Human
uugcuuuuagaaa

SEQ ID NO: 3187805 - RNA, 14 nt, Human
uugcuuuuagaaaa

SEQ ID NO: 3187806 - RNA, 15 nt, Human
uugcuuuuaaaauuu

SEQ ID NO: 3187807 - RNA, 17 nt, Human
uuggaaagaguaggaag

SEQ ID NO: 3187808 - RNA, 21 nt, Human
uuggaaacacuaaauguuaaa

SEQ ID NO: 3187809 - RNA, 20 nt, Human
uuggaaacacuaaauguuaa

SEQ ID NO: 3187810 - RNA, 19 nt, Human
uuggaaacacuaaauguua

SEQ ID NO: 3187811 - RNA, 18 nt, Human
uuggaaacacuaaauguu

SEQ ID NO: 3187812 - RNA, 15 nt, Human
uugcuuuuuuccaaa

SEQ ID NO: 3187813 - RNA, 12 nt, Human
uugcuuuugugc

SEQ ID NO: 3187814 - RNA, 15 nt, Human
uugcuuuugagagaa

SEQ ID NO: 3187815 - RNA, 14 nt, Human
uugcuuuugagaga

SEQ ID NO: 3187816 - RNA, 17 nt, Human
uugcugauggugcaaug

SEQ ID NO: 3187817 - RNA, 18 nt, Human
uugcugauggugcaauga

SEQ ID NO: 3187818 - RNA, 20 nt, Human
uugcugaccccacuuggacu

SEQ ID NO: 3187819 - RNA, 23 nt, Human
uugcugacaaccauuaaagucag

SEQ ID NO: 3187820 - RNA, 12 nt, Human
uugcugacuuag

SEQ ID NO: 3187821 - RNA, 14 nt, Human
uugcugacuuagaa

SEQ ID NO: 3187822 - RNA, 15 nt, Human
uugcugacuuagaau

SEQ ID NO: 3187823 - RNA, 16 nt, Human
uugcuugccaaaguac

SEQ ID NO: 3187824 - RNA, 22 nt, Human
uugcuccccuuccccuuccuuc

SEQ ID NO: 3187825 - RNA, 21 nt, Human
uugcuccccuuccccuuccuu

SEQ ID NO: 3187826 - RNA, 20 nt, Human
uugcuccccuuccccuuccu

SEQ ID NO: 3187827 - RNA, 17 nt, Human
uugcuccccuuccccuu

SEQ ID NO: 3187828 - RNA, 16 nt, Human
uugcuccccuuccccu

SEQ ID NO: 3187829 - RNA, 14 nt, Human
uugcuccccuuccc

SEQ ID NO: 3187830 - RNA, 19 nt, Human
uugcugaauacagaggcaa

SEQ ID NO: 3187831 - RNA, 18 nt, Human
uugcugaacauuggagaa

SEQ ID NO: 3187832 - RNA, 17 nt, Human
uugcugaacauuggaga

SEQ ID NO: 3187833 - RNA, 20 nt, Human
uugcuaugagcuggggaugu

SEQ ID NO: 3187834 - RNA, 13 nt, Human
uugcuaucauugu

SEQ ID NO: 3187835 - RNA, 14 nt, Human
uugcuaucucuauu

SEQ ID NO: 3187836 - RNA, 23 nt, Human
uugcuaccacggccuccuuuccg

SEQ ID NO: 3187837 - RNA, 20 nt, Human
uugcuaagugaggaugaaaa

SEQ ID NO: 3187838 - RNA, 17 nt, Human
uugcuaaguaaaucucu

SEQ ID NO: 3187839 - RNA, 21 nt, Human
uugcuaaguaaaucucuucug

SEQ ID NO: 3187840 - RNA, 19 nt, Human
uugcuaaguaaaucucuuc

SEQ ID NO: 3187841 - RNA, 22 nt, Human
uugcuaaguaaaucucuucugu

SEQ ID NO: 3187842 - RNA, 16 nt, Human
augaaaugaacacaaa

SEQ ID NO: 3187843 - RNA, 14 nt, Human
augaaaugaacaca

SEQ ID NO: 3187844 - RNA, 19 nt, Human
augaaagacuguacaaagu

SEQ ID NO: 3187845 - RNA, 19 nt, Human
augaaagauggcugugccu

SEQ ID NO: 3187846 - RNA, 23 nt, Human
augaaagauggcugugccucugc

SEQ ID NO: 3187847 - RNA, 20 nt, Human
augaaagauggcugugccuc

SEQ ID NO: 3187848 - RNA, 20 nt, Human
augaaagacuguacaaagua

SEQ ID NO: 3187849 - RNA, 13 nt, Human
aucuuuuauucuu

SEQ ID NO: 3187850 - RNA, 14 nt, Human
aucuuuuauucuuu

SEQ ID NO: 3187851 - RNA, 14 nt, Human
aucuuucugcacac

SEQ ID NO: 3187852 - RNA, 21 nt, Human
aucuuucugcacacaaauauu

SEQ ID NO: 3187853 - RNA, 17 nt, Human
aucuuuccauauccaua

SEQ ID NO: 3187854 - RNA, 13 nt, Human
aucuuuauugaaa

SEQ ID NO: 3187855 - RNA, 15 nt, Human
aucuuuauugaaauu

SEQ ID NO: 3187856 - RNA, 16 nt, Human
aucuuuauugaaauuc

SEQ ID NO: 3187857 - RNA, 11 nt, Human
uuggcugcuga

SEQ ID NO: 3187858 - RNA, 15 nt, Human
uuggcugcugaaggc

SEQ ID NO: 3187859 - RNA, 14 nt, Human
uuggcugcagggag

SEQ ID NO: 3187860 - RNA, 13 nt, Human
uuggcugcaggga

SEQ ID NO: 3187861 - RNA, 22 nt, Human
uuggcuaggaccccuccaugug

SEQ ID NO: 3187862 - RNA, 18 nt, Human
uuggcgaaucucaaaauu

SEQ ID NO: 3187863 - RNA, 18 nt, Human
uuggaaagaguaggaaga

SEQ ID NO: 3187864 - RNA, 14 nt, Human
uuggaaacuaauaa

SEQ ID NO: 3187865 - RNA, 15 nt, Human
uuggaaacuaauaaa

SEQ ID NO: 3187866 - RNA, 16 nt, Human
uuggaaacuaauaaaa

SEQ ID NO: 3187867 - RNA, 17 nt, Human
uuggaaacuaauaaaau

SEQ ID NO: 3187868 - RNA, 18 nt, Human
uuggaaacuaauaaaaua

SEQ ID NO: 3187869 - RNA, 19 nt, Human
uuggaaacuaauaaaauau

SEQ ID NO: 3187870 - RNA, 20 nt, Human
uuggaaacuaauaaaauauu

SEQ ID NO: 3187871 - RNA, 22 nt, Human
uuggaaacuaauaaaauauuuu

SEQ ID NO: 3187872 - RNA, 23 nt, Human
uuggaaacuaauaaaauauuuuc

SEQ ID NO: 3187873 - RNA, 14 nt, Human
uuguaauguaacug

SEQ ID NO: 3187874 - RNA, 13 nt, Human
uuguaauguaacu

SEQ ID NO: 3187875 - RNA, 20 nt, Human
uuguaaggaaugauuaauua

SEQ ID NO: 3187876 - RNA, 16 nt, Human
uuguaagcguauggcu

SEQ ID NO: 3187877 - RNA, 17 nt, Human
uuguaagcguauggcuu

SEQ ID NO: 3187878 - RNA, 18 nt, Human
uuguaagcguauggcuuu

SEQ ID NO: 3187879 - RNA, 22 nt, Human
uuguaagcguauggcuuuauuu

SEQ ID NO: 3187880 - RNA, 21 nt, Human
uuguaauuaauaauagauugu

SEQ ID NO: 3187881 - RNA, 15 nt, Human
uuguaguucuuuaaa

SEQ ID NO: 3187882 - RNA, 23 nt, Human
uuguaauguugugaauaauuaca

SEQ ID NO: 3187883 - RNA, 21 nt, Human
uuguaauguugugaauaauua

SEQ ID NO: 3187884 - RNA, 19 nt, Human
uuguaauguugugaauaau

SEQ ID NO: 3187885 - RNA, 12 nt, Human
uuguaauguugu

SEQ ID NO: 3187886 - RNA, 20 nt, Human
uuguaauguaacugcucuug

SEQ ID NO: 3187887 - RNA, 15 nt, Human
uuguaauguaacugc

SEQ ID NO: 3187888 - RNA, 21 nt, Human
uuguauaguuauguaaauaau

SEQ ID NO: 3187889 - RNA, 22 nt, Human
uuguauaguuauguaaauaauu

SEQ ID NO: 3187890 - RNA, 15 nt, Human
uuguauaauauugaa

SEQ ID NO: 3187891 - RNA, 16 nt, Human
uuguauaauauugaaa

SEQ ID NO: 3187892 - RNA, 23 nt, Human
uuguauaaauuuauuuacugcua

SEQ ID NO: 3187893 - RNA, 17 nt, Human
uuguaguucuuuaaacu

SEQ ID NO: 3187894 - RNA, 19 nt, Human
uuguauaaauuuauuuacu

SEQ ID NO: 3187895 - RNA, 12 nt, Human
uuguauaaauuu

SEQ ID NO: 3187896 - RNA, 16 nt, Human
augacaaauguuucua

SEQ ID NO: 3187897 - RNA, 16 nt, Human
augacaaaauucuuuc

SEQ ID NO: 3187898 - RNA, 15 nt, Human
augacaaauguuucu

SEQ ID NO: 3187899 - RNA, 13 nt, Human
augacaaauguuu

SEQ ID NO: 3187900 - RNA, 19 nt, Human
augacacgaauauugcuga

SEQ ID NO: 3187901 - RNA, 20 nt, Human
augacacgaauauugcugau

SEQ ID NO: 3187902 - RNA, 20 nt, Human
augacagaaaauauguauua

SEQ ID NO: 3187903 - RNA, 19 nt, Human
augacagaaaauauguauu

SEQ ID NO: 3187904 - RNA, 18 nt, Human
augacagaaaauauguau

SEQ ID NO: 3187905 - RNA, 14 nt, Human
augacagaaaauau

SEQ ID NO: 3187906 - RNA, 23 nt, Human
augacagaaaauauguauuaaca

SEQ ID NO: 3187907 - RNA, 15 nt, Human
augacaggccugucc

SEQ ID NO: 3187908 - RNA, 20 nt, Human
augacaggcauccaaggaag

SEQ ID NO: 3187909 - RNA, 13 nt, Human
uuguaagaaauac

SEQ ID NO: 3187910 - RNA, 14 nt, Human
uuguaaggaaugau

SEQ ID NO: 3187911 - RNA, 22 nt, Human
uuguaacuauguuuaaaguaau

SEQ ID NO: 3187912 - RNA, 23 nt, Human
uuguaacuaaaauaauuuuguaa

SEQ ID NO: 3187913 - RNA, 22 nt, Human
uuguaacuaaaauaauuuugua

SEQ ID NO: 3187914 - RNA, 11 nt, Human
uuguaagaaau

SEQ ID NO: 3187915 - RNA, 13 nt, Human
uuguaaaaaugua

SEQ ID NO: 3187916 - RNA, 17 nt, Human
uuguaacuaaaauaauu

SEQ ID NO: 3187917 - RNA, 21 nt, Human
uuguaacuaaaauaauuuugu

SEQ ID NO: 3187918 - RNA, 18 nt, Human
uuguaacuaaaauaauuu

SEQ ID NO: 3187919 - RNA, 19 nt, Human
uugguuuuuauuucuccuu

SEQ ID NO: 3187920 - RNA, 19 nt, Human
uugguuaggcauuguggga

SEQ ID NO: 3187921 - RNA, 15 nt, Human
uugguucaaaugugu

SEQ ID NO: 3187922 - RNA, 13 nt, Human
uugguucaaaugu

SEQ ID NO: 3187923 - RNA, 23 nt, Human
uugguuauagugcaauauauuuu

SEQ ID NO: 3187924 - RNA, 20 nt, Human
uugguuauagugcaauauau

SEQ ID NO: 3187925 - RNA, 18 nt, Human
uugguucauuuucagauu

SEQ ID NO: 3187926 - RNA, 22 nt, Human
uugguuccaagucuuugcuauu

SEQ ID NO: 3187927 - RNA, 21 nt, Human
uugguuccaagucuuugcuau

SEQ ID NO: 3187928 - RNA, 22 nt, Human
uugggguacccacugcucuggu

SEQ ID NO: 3187929 - RNA, 15 nt, Human
augaacauguuuuag

SEQ ID NO: 3187930 - RNA, 20 nt, Human
augaaccacaucuugcucug

SEQ ID NO: 3187931 - RNA, 13 nt, Human
augaaccacaucu

SEQ ID NO: 3187932 - RNA, 16 nt, Human
augaacauacaaaugc

SEQ ID NO: 3187933 - RNA, 13 nt, Human
augaacagugcac

SEQ ID NO: 3187934 - RNA, 12 nt, Human
augaacagacuu

SEQ ID NO: 3187935 - RNA, 15 nt, Human
uugggcagagaggcu

SEQ ID NO: 3187936 - RNA, 19 nt, Human
uuggggaagaacgaagcca

SEQ ID NO: 3187937 - RNA, 17 nt, Human
uugggguacccacugcu

SEQ ID NO: 3187938 - RNA, 13 nt, Human
uugggcucugcug

SEQ ID NO: 3187939 - RNA, 17 nt, Human
uugggcugaauguaugu

SEQ ID NO: 3187940 - RNA, 22 nt, Human
uugggcugaauguauguaaaua

SEQ ID NO: 3187941 - RNA, 12 nt, Human
uugggcucccaa

SEQ ID NO: 3187942 - RNA, 15 nt, Human
uuugaaaauaguuua

SEQ ID NO: 3187943 - RNA, 18 nt, Human
uuugaaaauaguuuauuu

SEQ ID NO: 3187944 - RNA, 11 nt, Human
uuugaaaagua

SEQ ID NO: 3187945 - RNA, 12 nt, Human
uuugaaaaguaa

SEQ ID NO: 3187946 - RNA, 14 nt, Human
uuugaaaaguaaua

SEQ ID NO: 3187947 - RNA, 17 nt, Human
uuugaaaaguaauauuu

SEQ ID NO: 3187948 - RNA, 22 nt, Human
uuugaaaaguaauauuuauuaa

SEQ ID NO: 3187949 - RNA, 11 nt, Human
uuugaaaauag

SEQ ID NO: 3187950 - RNA, 14 nt, Human
uuugaaaauaguuu

SEQ ID NO: 3187951 - RNA, 23 nt, Human
uuugaaacauugcuuuuaaaacu

SEQ ID NO: 3187952 - RNA, 21 nt, Human
uuugaaacaugcuuguguuuc

SEQ ID NO: 3187953 - RNA, 13 nt, Human
uuugaaacauugc

SEQ ID NO: 3187954 - RNA, 12 nt, Human
uuugaaacauug

SEQ ID NO: 3187955 - RNA, 18 nt, Human
uuugaaacauugcuuuua

SEQ ID NO: 3187956 - RNA, 15 nt, Human
uuugaaacauugcuu

SEQ ID NO: 3187957 - RNA, 22 nt, Human
uuugaaaccccuguaggccuca

SEQ ID NO: 3187958 - RNA, 14 nt, Human
uuugaaagugccuu

SEQ ID NO: 3187959 - RNA, 18 nt, Human
uuugaaagugccuuugca

SEQ ID NO: 3187960 - RNA, 21 nt, Human
uuugaaagugccuuugcagcu

SEQ ID NO: 3187961 - RNA, 23 nt, Human
uuugaaagugccuuugcagcuca

SEQ ID NO: 3187962 - RNA, 22 nt, Human
uuugaaauauauggucuaaugu

SEQ ID NO: 3187963 - RNA, 21 nt, Human
uuugaaauauauggucuaaug

SEQ ID NO: 3187964 - RNA, 13 nt, Human
uuugaaauauaug

SEQ ID NO: 3187965 - RNA, 23 nt, Human
augggcuggguucuacccaggug

SEQ ID NO: 3187966 - RNA, 16 nt, Human
uuugaaauauggucuu

SEQ ID NO: 3187967 - RNA, 14 nt, Human
auggggcccugccu

SEQ ID NO: 3187968 - RNA, 13 nt, Human
auggggcccugcc

SEQ ID NO: 3187969 - RNA, 17 nt, Human
auggggaggacaaaaug

SEQ ID NO: 3187970 - RNA, 13 nt, Human
auggggaggacaa

SEQ ID NO: 3187971 - RNA, 13 nt, Human
uuucuuuguggcu

SEQ ID NO: 3187972 - RNA, 23 nt, Human
uuugaaaagcaauauuguauauu

SEQ ID NO: 3187973 - RNA, 17 nt, Human
uuucugcuuuagacuug

SEQ ID NO: 3187974 - RNA, 19 nt, Human
uuucugcuuuagacuugaa

SEQ ID NO: 3187975 - RNA, 20 nt, Human
uuucugcuuuagacuugaaa

SEQ ID NO: 3187976 - RNA, 16 nt, Human
uuucugccuuuuguuc

SEQ ID NO: 3187977 - RNA, 14 nt, Human
uuucugcaucagcu

SEQ ID NO: 3187978 - RNA, 22 nt, Human
uuucucauuugccaauaauaau

SEQ ID NO: 3187979 - RNA, 21 nt, Human
uuucugcagccacuauuguua

SEQ ID NO: 3187980 - RNA, 14 nt, Human
uuucugccgcagcc

SEQ ID NO: 3187981 - RNA, 16 nt, Human
uuucugccgcagcccu

SEQ ID NO: 3187982 - RNA, 19 nt, Human
uuucucacacucuaacugu

SEQ ID NO: 3187983 - RNA, 22 nt, Human
uuucucacacucuaacuguaua

SEQ ID NO: 3187984 - RNA, 22 nt, Human
uuucucaaagccccauuaacug

SEQ ID NO: 3187985 - RNA, 16 nt, Human
uuucuauuuucucuga

SEQ ID NO: 3187986 - RNA, 15 nt, Human
uuucucauauuugag

SEQ ID NO: 3187987 - RNA, 14 nt, Human
uuucuauuuucucu

SEQ ID NO: 3187988 - RNA, 18 nt, Human
uuucuauaauuuuacaag

SEQ ID NO: 3187989 - RNA, 15 nt, Human
uuucuaguuauuuau

SEQ ID NO: 3187990 - RNA, 14 nt, Human
uuucuaguuauuua

SEQ ID NO: 3187991 - RNA, 20 nt, Human
uuucuaggccuacaugcuuu

SEQ ID NO: 3187992 - RNA, 15 nt, Human
auggcuauaggugcu

SEQ ID NO: 3187993 - RNA, 15 nt, Human
augggacuggccucu

SEQ ID NO: 3187994 - RNA, 13 nt, Human
augggagcucaug

SEQ ID NO: 3187995 - RNA, 12 nt, Human
augggagccggg

SEQ ID NO: 3187996 - RNA, 21 nt, Human
augggcaacccccagccugcu

SEQ ID NO: 3187997 - RNA, 19 nt, Human
augggcaacccccagccug

SEQ ID NO: 3187998 - RNA, 18 nt, Human
augggcaacccccagccu

SEQ ID NO: 3187999 - RNA, 15 nt, Human
augggagccgggcaa

SEQ ID NO: 3188000 - RNA, 13 nt, Human
augggcagagcag

SEQ ID NO: 3188001 - RNA, 14 nt, Human
augggcagagcaga

SEQ ID NO: 3188002 - RNA, 15 nt, Human
augggcagagcagag

SEQ ID NO: 3188003 - RNA, 15 nt, Human
augggccuccugugu

SEQ ID NO: 3188004 - RNA, 15 nt, Human
augggcaguuucagu

SEQ ID NO: 3188005 - RNA, 12 nt, Human
augggcaggaga

SEQ ID NO: 3188006 - RNA, 20 nt, Human
augggcagucauuuugcaga

SEQ ID NO: 3188007 - RNA, 13 nt, Human
augggcaggagac

SEQ ID NO: 3188008 - RNA, 17 nt, Human
auggaauuucucccagu

SEQ ID NO: 3188009 - RNA, 21 nt, Human
uuuccaguaaggaaugauauu

SEQ ID NO: 3188010 - RNA, 19 nt, Human
auggacaugaucuucuuua

SEQ ID NO: 3188011 - RNA, 17 nt, Human
auggacauuuagaagaa

SEQ ID NO: 3188012 - RNA, 18 nt, Human
auggacauuuagaagaaa

SEQ ID NO: 3188013 - RNA, 20 nt, Human
auggacauuuagaagaaaga

SEQ ID NO: 3188014 - RNA, 23 nt, Human
auggaccaugcugucuggcacag

SEQ ID NO: 3188015 - RNA, 21 nt, Human
auggacccaauauuuaccaga

SEQ ID NO: 3188016 - RNA, 21 nt, Human
auggcuauaggugcuacaaaa

SEQ ID NO: 3188017 - RNA, 19 nt, Human
auggcuauaggugcuacaa

SEQ ID NO: 3188018 - RNA, 16 nt, Human
auggcuauaggugcua

SEQ ID NO: 3188019 - RNA, 18 nt, Human
uuucgcaggauucuuccu

SEQ ID NO: 3188020 - RNA, 15 nt, Human
uuucgauguuuuuga

SEQ ID NO: 3188021 - RNA, 19 nt, Human
uuucgacuugcauuuuugc

SEQ ID NO: 3188022 - RNA, 15 nt, Human
uuucgacuugcauuu

SEQ ID NO: 3188023 - RNA, 22 nt, Human
uuucgcaggauucuuccucccu

SEQ ID NO: 3188024 - RNA, 13 nt, Human
uuucuaaaagcuu

SEQ ID NO: 3188025 - RNA, 16 nt, Human
uuucuaaaagcuuuca

SEQ ID NO: 3188026 - RNA, 19 nt, Human
uuucuaaaagcuuucaugu

SEQ ID NO: 3188027 - RNA, 14 nt, Human
uuucuaaaaaguca

SEQ ID NO: 3188028 - RNA, 15 nt, Human
uuucuaaaaagucag

SEQ ID NO: 3188029 - RNA, 17 nt, Human
uuucuaaaaagucagau

SEQ ID NO: 3188030 - RNA, 20 nt, Human
uuucuaaaaagucagauguu

SEQ ID NO: 3188031 - RNA, 14 nt, Human
uuucguuuguuugu

SEQ ID NO: 3188032 - RNA, 13 nt, Human
uuucguggcuuca

SEQ ID NO: 3188033 - RNA, 20 nt, Human
uuuccuugaggggagccagg

SEQ ID NO: 3188034 - RNA, 19 nt, Human
uuuccuugcauacaaacaa

SEQ ID NO: 3188035 - RNA, 16 nt, Human
uuuccuugcauacaaa

SEQ ID NO: 3188036 - RNA, 17 nt, Human
uuuccuuuaauaugaaa

SEQ ID NO: 3188037 - RNA, 21 nt, Human
uuuccuuuuaaaacacuucca

SEQ ID NO: 3188038 - RNA, 21 nt, Human
uuuccuucauucaacccaccu

SEQ ID NO: 3188039 - RNA, 22 nt, Human
uuuccuucagugccuuauggaa

SEQ ID NO: 3188040 - RNA, 18 nt, Human
uuuccuucagugccuuau

SEQ ID NO: 3188041 - RNA, 21 nt, Human
uuuccuucagugccuuaugga

SEQ ID NO: 3188042 - RNA, 23 nt, Human
uuuccuucauucaacccaccugc

SEQ ID NO: 3188043 - RNA, 18 nt, Human
uuuccuuacauaaacauc

SEQ ID NO: 3188044 - RNA, 11 nt, Human
uuuccuucccu

SEQ ID NO: 3188045 - RNA, 12 nt, Human
uuuccugugucu

SEQ ID NO: 3188046 - RNA, 15 nt, Human
uuuccuguuugggaa

SEQ ID NO: 3188047 - RNA, 12 nt, Human
uuuccuucagug

SEQ ID NO: 3188048 - RNA, 15 nt, Human
uuuccuucagugccu

SEQ ID NO: 3188049 - RNA, 11 nt, Human
uuuccuucagu

SEQ ID NO: 3188050 - RNA, 17 nt, Human
uuuccuuacauaaacau

SEQ ID NO: 3188051 - RNA, 16 nt, Human
uuuccuuacauaaaca

SEQ ID NO: 3188052 - RNA, 17 nt, Human
uuuaaaggcccuaucug

SEQ ID NO: 3188053 - RNA, 18 nt, Human
uuuaaaggcauuagaguc

SEQ ID NO: 3188054 - RNA, 24 nt, Human
uuuaaagcuuauuaaaacucauuu

SEQ ID NO: 3188055 - RNA, 12 nt, Human
uuuaaagcuuuu

SEQ ID NO: 3188056 - RNA, 18 nt, Human
uuuaaagaaacaugguuu

SEQ ID NO: 3188057 - RNA, 18 nt, Human
uuuaaagccauucugauu

SEQ ID NO: 3188058 - RNA, 20 nt, Human
uuuaaagaaaaaaaugucaa

SEQ ID NO: 3188059 - RNA, 13 nt, Human
augcuaagugaaa

SEQ ID NO: 3188060 - RNA, 23 nt, Human
augcgcaggcuggcccugcccug

SEQ ID NO: 3188061 - RNA, 15 nt, Human
augcgcaguugcugu

SEQ ID NO: 3188062 - RNA, 12 nt, Human
augccuauugua

SEQ ID NO: 3188063 - RNA, 17 nt, Human
uuuaccuugucauuuug

SEQ ID NO: 3188064 - RNA, 22 nt, Human
uuuaccugaagucuuuguacag

SEQ ID NO: 3188065 - RNA, 21 nt, Human
uuuaccuggcuuauuuaauau

SEQ ID NO: 3188066 - RNA, 17 nt, Human
augcuaaucuugugaaa

SEQ ID NO: 3188067 - RNA, 16 nt, Human
uuuaccuucaaacuuu

SEQ ID NO: 3188068 - RNA, 18 nt, Human
uuuaccuucaaacuuuag

SEQ ID NO: 3188069 - RNA, 13 nt, Human
uuuauuaaauuuu

SEQ ID NO: 3188070 - RNA, 12 nt, Human
uuuauuaaauuu

SEQ ID NO: 3188071 - RNA, 17 nt, Human
uuuauuaacuuaauaau

SEQ ID NO: 3188072 - RNA, 23 nt, Human
uuuauuaaauuuuuuuguaugaa

SEQ ID NO: 3188073 - RNA, 19 nt, Human
uuuauuaaaugcccagccc

SEQ ID NO: 3188074 - RNA, 21 nt, Human
uuuauaucuuggcagguagga

SEQ ID NO: 3188075 - RNA, 14 nt, Human
uuuauaucuuggca

SEQ ID NO: 3188076 - RNA, 14 nt, Human
uuuauauauaugca

SEQ ID NO: 3188077 - RNA, 15 nt, Human
uuuauauauauaucu

SEQ ID NO: 3188078 - RNA, 21 nt, Human
uuuauaucuccuuuguauucu

SEQ ID NO: 3188079 - RNA, 16 nt, Human
uuuauauccauuuuua

SEQ ID NO: 3188080 - RNA, 13 nt, Human
uuuauauccauuu

SEQ ID NO: 3188081 - RNA, 21 nt, Human
uuuacuacaauauguacauuu

SEQ ID NO: 3188082 - RNA, 19 nt, Human
uuuacuacaauauguacau

SEQ ID NO: 3188083 - RNA, 19 nt, Human
uuuagauagcagccuggcu

SEQ ID NO: 3188084 - RNA, 22 nt, Human
uuuagccugugucauugcccca

SEQ ID NO: 3188085 - RNA, 13 nt, Human
uuuagccuguguc

SEQ ID NO: 3188086 - RNA, 14 nt, Human
uuuagcuauuacug

SEQ ID NO: 3188087 - RNA, 14 nt, Human
uuuaggugaaaaua

SEQ ID NO: 3188088 - RNA, 15 nt, Human
augcugggcucccgu

SEQ ID NO: 3188089 - RNA, 20 nt, Human
uuuauuaacuuaauaaucaa

SEQ ID NO: 3188090 - RNA, 22 nt, Human
augcuggcuguuggcugggggc

SEQ ID NO: 3188091 - RNA, 20 nt, Human
augcuguagacaucuguccu

SEQ ID NO: 3188092 - RNA, 16 nt, Human
augcugucuggcacag

SEQ ID NO: 3188093 - RNA, 19 nt, Human
augcugucuggcacagccu

SEQ ID NO: 3188094 - RNA, 17 nt, Human
augcugucuggcacagc

SEQ ID NO: 3188095 - RNA, 14 nt, Human
augcuguauauguu

SEQ ID NO: 3188096 - RNA, 14 nt, Human
augcuguaucugug

SEQ ID NO: 3188097 - RNA, 15 nt, Human
augcuguaucugugc

SEQ ID NO: 3188098 - RNA, 23 nt, Human
augcugucuuucuugcucccuga

SEQ ID NO: 3188099 - RNA, 21 nt, Human
augcugucuuucuugcucccu

SEQ ID NO: 3188100 - RNA, 20 nt, Human
augcugucuuucuugcuccc

SEQ ID NO: 3188101 - RNA, 18 nt, Human
augcugucuuucuugcuc

SEQ ID NO: 3188102 - RNA, 22 nt, Human
augcugucuggcacagccugca

SEQ ID NO: 3188103 - RNA, 18 nt, Human
augcugugccccuggccu

SEQ ID NO: 3188104 - RNA, 17 nt, Human
augcugugccccuggcc

SEQ ID NO: 3188105 - RNA, 14 nt, Human
augcugugccccug

SEQ ID NO: 3188106 - RNA, 13 nt, Human
augcugugccccu

SEQ ID NO: 3188107 - RNA, 16 nt, Human
auggaacauaaaauac

SEQ ID NO: 3188108 - RNA, 21 nt, Human
auggaaguacuauaauuuacc

SEQ ID NO: 3188109 - RNA, 18 nt, Human
auggaacacucugagacu

SEQ ID NO: 3188110 - RNA, 17 nt, Human
auggaacacucugagac

SEQ ID NO: 3188111 - RNA, 20 nt, Human
uuuauuuuaaaauuucauag

SEQ ID NO: 3188112 - RNA, 15 nt, Human
auggaauaacaugua

SEQ ID NO: 3188113 - RNA, 14 nt, Human
auggaauaacaugu

SEQ ID NO: 3188114 - RNA, 18 nt, Human
uuuauuuugaaauggaaa

SEQ ID NO: 3188115 - RNA, 15 nt, Human
uuuauuuuguaugaa

SEQ ID NO: 3188116 - RNA, 21 nt, Human
uuuauuuuguaugaaauauau

SEQ ID NO: 3188117 - RNA, 13 nt, Human
uuuauuuuuuggg

SEQ ID NO: 3188118 - RNA, 16 nt, Human
uuuauuuuuugggaaa

SEQ ID NO: 3188119 - RNA, 13 nt, Human
uuuauuuuuuggu

SEQ ID NO: 3188120 - RNA, 23 nt, Human
uuucaaaaacaccccccccccac

SEQ ID NO: 3188121 - RNA, 21 nt, Human
uuuauuuuuuuuaauuguauu

SEQ ID NO: 3188122 - RNA, 14 nt, Human
uuucacucuccuug

SEQ ID NO: 3188123 - RNA, 15 nt, Human
uuucacccuucuacu

SEQ ID NO: 3188124 - RNA, 21 nt, Human
uuucaccccaucccuccuuaa

SEQ ID NO: 3188125 - RNA, 15 nt, Human
uuucacugucugucu

SEQ ID NO: 3188126 - RNA, 13 nt, Human
uuucacugucugu

SEQ ID NO: 3188127 - RNA, 23 nt, Human
uuucacuucuuucccuuccucca

SEQ ID NO: 3188128 - RNA, 16 nt, Human
uuucacuucuuucccu

SEQ ID NO: 3188129 - RNA, 14 nt, Human
uuucacuucuuucc

SEQ ID NO: 3188130 - RNA, 15 nt, Human
uuucacucuccuugg

SEQ ID NO: 3188131 - RNA, 24 nt, Human
uuucacucuuauugcccacgcugg

SEQ ID NO: 3188132 - RNA, 23 nt, Human
uuucacuggccacaguuguuuga

SEQ ID NO: 3188133 - RNA, 24 nt, Human
uuucacugcuggcugccuuagaac

SEQ ID NO: 3188134 - RNA, 17 nt, Human
uuucccaggcaaauaaa

SEQ ID NO: 3188135 - RNA, 19 nt, Human
uuuccauauuuuuuuccuu

SEQ ID NO: 3188136 - RNA, 17 nt, Human
uuuccauauuuuuacaa

SEQ ID NO: 3188137 - RNA, 21 nt, Human
uuuccauauccauagugacuu

SEQ ID NO: 3188138 - RNA, 11 nt, Human
uuucccacccu

SEQ ID NO: 3188139 - RNA, 23 nt, Human
uuucccacucauucugaauuaau

SEQ ID NO: 3188140 - RNA, 17 nt, Human
uuuccaguuccucuuuu

SEQ ID NO: 3188141 - RNA, 18 nt, Human
uuuccagguucugaaaga

SEQ ID NO: 3188142 - RNA, 17 nt, Human
uuuccaguauuuuagug

SEQ ID NO: 3188143 - RNA, 16 nt, Human
uuuccaguauuuuagu

SEQ ID NO: 3188144 - RNA, 15 nt, Human
uuuccaguauuuuag

SEQ ID NO: 3188145 - RNA, 12 nt, Human
uuuccaguauuu

SEQ ID NO: 3188146 - RNA, 19 nt, Human
uuuccagguuuaagcuguu

SEQ ID NO: 3188147 - RNA, 23 nt, Human
uuucauauaggaauagaaacaug

SEQ ID NO: 3188148 - RNA, 12 nt, Human
uuucauaucauu

SEQ ID NO: 3188149 - RNA, 15 nt, Human
uuucauaucauuucu

SEQ ID NO: 3188150 - RNA, 21 nt, Human
uuucauauaggaauagaaaca

SEQ ID NO: 3188151 - RNA, 14 nt, Human
uuucauaggaagac

SEQ ID NO: 3188152 - RNA, 19 nt, Human
uuucauaggaagacacauu

SEQ ID NO: 3188153 - RNA, 21 nt, Human
uuucaguuuauuugaaccaau

SEQ ID NO: 3188154 - RNA, 15 nt, Human
uuucauaagauauuu

SEQ ID NO: 3188155 - RNA, 19 nt, Human
uuucauaagauauuuuauu

SEQ ID NO: 3188156 - RNA, 18 nt, Human
uuucauaagauauuuuau

SEQ ID NO: 3188157 - RNA, 13 nt, Human
uuucauaauuugu

SEQ ID NO: 3188158 - RNA, 23 nt, Human
aucgguuaacaaauaacaacuuu

SEQ ID NO: 3188159 - RNA, 16 nt, Human
aucgguuaacaaauaa

SEQ ID NO: 3188160 - RNA, 15 nt, Human
aucgguuaacaaaua

SEQ ID NO: 3188161 - RNA, 21 nt, Human
aucggggagguuuucuccccc

SEQ ID NO: 3188162 - RNA, 12 nt, Human
auccuuacaaau

SEQ ID NO: 3188163 - RNA, 20 nt, Human
auccugucaucugagaauga

SEQ ID NO: 3188164 - RNA, 18 nt, Human
auccugucaucugagaau

SEQ ID NO: 3188165 - RNA, 17 nt, Human
auccugucaucugagaa

SEQ ID NO: 3188166 - RNA, 16 nt, Human
auccugucaucugaga

SEQ ID NO: 3188167 - RNA, 21 nt, Human
auccuggcacccggccccugc

SEQ ID NO: 3188168 - RNA, 20 nt, Human
auccuggcacccggccccug

SEQ ID NO: 3188169 - RNA, 19 nt, Human
auccuggcacccggccccu

SEQ ID NO: 3188170 - RNA, 17 nt, Human
auccuggcacccggccc

SEQ ID NO: 3188171 - RNA, 15 nt, Human
auccuggaguucugg

SEQ ID NO: 3188172 - RNA, 23 nt, Human
auccuggcacccggccccugcug

SEQ ID NO: 3188173 - RNA, 22 nt, Human
auccuggcacccggccccugcu

SEQ ID NO: 3188174 - RNA, 22 nt, Human
auccugguuccuaggggaauga

SEQ ID NO: 3188175 - RNA, 23 nt, Human
auccugguuccuaggggaaugag

SEQ ID NO: 3188176 - RNA, 22 nt, Human
auccugggcuuuuguuuugcuu

SEQ ID NO: 3188177 - RNA, 21 nt, Human
auccugggcuuuuguuuugcu

SEQ ID NO: 3188178 - RNA, 13 nt, Human
auccugccccuga

SEQ ID NO: 3188179 - RNA, 19 nt, Human
auccugcacugacucugga

SEQ ID NO: 3188180 - RNA, 18 nt, Human
auccugcacugacucugg

SEQ ID NO: 3188181 - RNA, 22 nt, Human
auccugaggcuccacuuggucu

SEQ ID NO: 3188182 - RNA, 16 nt, Human
auccugcaauuccacu

SEQ ID NO: 3188183 - RNA, 15 nt, Human
auccugcacugacuc

SEQ ID NO: 3188184 - RNA, 17 nt, Human
auccugcacugacucug

SEQ ID NO: 3188185 - RNA, 16 nt, Human
auccugcacugacucu

SEQ ID NO: 3188186 - RNA, 11 nt, Human
auccugaggcu

SEQ ID NO: 3188187 - RNA, 13 nt, Human
auccugaggcucc

SEQ ID NO: 3188188 - RNA, 16 nt, Human
auccugaggcuccacu

SEQ ID NO: 3188189 - RNA, 18 nt, Human
auccugaggcuccacuug

SEQ ID NO: 3188190 - RNA, 14 nt, Human
auccugagccagau

SEQ ID NO: 3188191 - RNA, 15 nt, Human
auccugagccagauu

SEQ ID NO: 3188192 - RNA, 17 nt, Human
auccugagccagauuuc

SEQ ID NO: 3188193 - RNA, 21 nt, Human
auccugagccagauuucacuc

SEQ ID NO: 3188194 - RNA, 19 nt, Human
uucuuugccaucucugcuc

SEQ ID NO: 3188195 - RNA, 18 nt, Human
uucuuugccaucucugcu

SEQ ID NO: 3188196 - RNA, 15 nt, Human
uucuuugccaucucu

SEQ ID NO: 3188197 - RNA, 20 nt, Human
uucuuuucuucacucaaauu

SEQ ID NO: 3188198 - RNA, 18 nt, Human
auccucuguacagagccc

SEQ ID NO: 3188199 - RNA, 20 nt, Human
auccucuguacagagcccac

SEQ ID NO: 3188200 - RNA, 17 nt, Human
auccucuuugagugaag

SEQ ID NO: 3188201 - RNA, 12 nt, Human
auccugagccag

SEQ ID NO: 3188202 - RNA, 13 nt, Human
auccugagccaga

SEQ ID NO: 3188203 - RNA, 11 nt, Human
auccugagcca

SEQ ID NO: 3188204 - RNA, 20 nt, Human
uugauaagggacugauguuu

SEQ ID NO: 3188205 - RNA, 21 nt, Human
uugauaagggacugauguuug

SEQ ID NO: 3188206 - RNA, 22 nt, Human
uugauaacagggauugauuuua

SEQ ID NO: 3188207 - RNA, 18 nt, Human
uugauaacaauguuuuaa

SEQ ID NO: 3188208 - RNA, 15 nt, Human
uugauaaauaguguu

SEQ ID NO: 3188209 - RNA, 13 nt, Human
uugauaaauagug

SEQ ID NO: 3188210 - RNA, 22 nt, Human
uugauaaauaguguuauugaga

SEQ ID NO: 3188211 - RNA, 17 nt, Human
aucuaagaauaauaaaa

SEQ ID NO: 3188212 - RNA, 18 nt, Human
aucuaagaauaauaaaau

SEQ ID NO: 3188213 - RNA, 22 nt, Human
uugauaagggacugauguuugu

SEQ ID NO: 3188214 - RNA, 21 nt, Human
aucuaagugccucacauuuuu

SEQ ID NO: 3188215 - RNA, 12 nt, Human
uugauaaaguaa

SEQ ID NO: 3188216 - RNA, 15 nt, Human
uugauaaaaauacug

SEQ ID NO: 3188217 - RNA, 23 nt, Human
uugagagagauguguaauuuuuc

SEQ ID NO: 3188218 - RNA, 16 nt, Human
uugagagagcagccag

SEQ ID NO: 3188219 - RNA, 22 nt, Human
uugagagagauguguaauuuuu

SEQ ID NO: 3188220 - RNA, 21 nt, Human
uugagagagauguguaauuuu

SEQ ID NO: 3188221 - RNA, 18 nt, Human
uugagagagauguguaau

SEQ ID NO: 3188222 - RNA, 15 nt, Human
uugagagagaugugu

SEQ ID NO: 3188223 - RNA, 14 nt, Human
uugagagagaugug

SEQ ID NO: 3188224 - RNA, 13 nt, Human
uugagagagaugu

SEQ ID NO: 3188225 - RNA, 24 nt, Human
uugaccauucuccaccugccaggg

SEQ ID NO: 3188226 - RNA, 21 nt, Human
uugagaacuaccuggauuugu

SEQ ID NO: 3188227 - RNA, 19 nt, Human
uugacacuuaaaaaugguu

SEQ ID NO: 3188228 - RNA, 19 nt, Human
uugacagggcacaccgggc

SEQ ID NO: 3188229 - RNA, 17 nt, Human
uugaccauucuccaccu

SEQ ID NO: 3188230 - RNA, 18 nt, Human
uugaccauucuccaccug

SEQ ID NO: 3188231 - RNA, 19 nt, Human
uugaccauucuccaccugc

SEQ ID NO: 3188232 - RNA, 12 nt, Human
aucuaagaauaa

SEQ ID NO: 3188233 - RNA, 16 nt, Human
aucuaagaauaauaaa

SEQ ID NO: 3188234 - RNA, 15 nt, Human
aucuaaauguugaaa

SEQ ID NO: 3188235 - RNA, 14 nt, Human
aucuaacauuauua

SEQ ID NO: 3188236 - RNA, 16 nt, Human
aucuaacauuauuacu

SEQ ID NO: 3188237 - RNA, 19 nt, Human
aucuaacauuauuacuuuu

SEQ ID NO: 3188238 - RNA, 15 nt, Human
aucuaaacugccccc

SEQ ID NO: 3188239 - RNA, 23 nt, Human
aucuaaaaauauacauguuuaug

SEQ ID NO: 3188240 - RNA, 18 nt, Human
aucuaaaaauauacaugu

SEQ ID NO: 3188241 - RNA, 17 nt, Human
aucuaaaaauauacaug

SEQ ID NO: 3188242 - RNA, 16 nt, Human
aucuaaaaauauacau

SEQ ID NO: 3188243 - RNA, 14 nt, Human
aucuaaaaauauac

SEQ ID NO: 3188244 - RNA, 13 nt, Human
aucuaaaaauaua

SEQ ID NO: 3188245 - RNA, 16 nt, Human
aucguauucaccuuca

SEQ ID NO: 3188246 - RNA, 15 nt, Human
aucgugacaacacuu

SEQ ID NO: 3188247 - RNA, 14 nt, Human
aucgugacaacacu

SEQ ID NO: 3188248 - RNA, 16 nt, Human
uugaaggaaaaauuca

SEQ ID NO: 3188249 - RNA, 16 nt, Human
uugaagguuuuugaua

SEQ ID NO: 3188250 - RNA, 14 nt, Human
uugaagguuuuuga

SEQ ID NO: 3188251 - RNA, 22 nt, Human
uugaaggugauaagggaaaaga

SEQ ID NO: 3188252 - RNA, 15 nt, Human
uugaagucaugcucc

SEQ ID NO: 3188253 - RNA, 17 nt, Human
uugacacuuaaaaaugg

SEQ ID NO: 3188254 - RNA, 23 nt, Human
uugaauaugauuaaaaauaucaa

SEQ ID NO: 3188255 - RNA, 14 nt, Human
uugaauaugauuaa

SEQ ID NO: 3188256 - RNA, 15 nt, Human
uugaauaugauuaaa

SEQ ID NO: 3188257 - RNA, 23 nt, Human
uugaaguugacucugcucuugca

SEQ ID NO: 3188258 - RNA, 23 nt, Human
uugaauagggcuaggaauauaga

SEQ ID NO: 3188259 - RNA, 15 nt, Human
uugaauaguauugug

SEQ ID NO: 3188260 - RNA, 16 nt, Human
uugaauaguauugugu

SEQ ID NO: 3188261 - RNA, 13 nt, Human
uugaauauaaaaa

SEQ ID NO: 3188262 - RNA, 17 nt, Human
uugaauauaaaaaauca

SEQ ID NO: 3188263 - RNA, 19 nt, Human
uugaaguuucaaguuuuaa

SEQ ID NO: 3188264 - RNA, 22 nt, Human
uugaaguuucaaguuuuaaagu

SEQ ID NO: 3188265 - RNA, 22 nt, Human
uugaaguuaguggaaaucugaa

SEQ ID NO: 3188266 - RNA, 20 nt, Human
uugaagugagaaaaugaaca

SEQ ID NO: 3188267 - RNA, 23 nt, Human
aucauaguggcuuaaaacaacac

SEQ ID NO: 3188268 - RNA, 15 nt, Human
aucauaaaacuugau

SEQ ID NO: 3188269 - RNA, 19 nt, Human
aucauauauaauaaauuaa

SEQ ID NO: 3188270 - RNA, 13 nt, Human
aucauauaaauau

SEQ ID NO: 3188271 - RNA, 13 nt, Human
aucauaaagucag

SEQ ID NO: 3188272 - RNA, 14 nt, Human
aucauaaagucagu

SEQ ID NO: 3188273 - RNA, 14 nt, Human
aucauaguuuuauu

SEQ ID NO: 3188274 - RNA, 16 nt, Human
aucauaguuuuauuua

SEQ ID NO: 3188275 - RNA, 17 nt, Human
aucauaguuuuauuuau

SEQ ID NO: 3188276 - RNA, 19 nt, Human
aucauaguuuuauuuauau

SEQ ID NO: 3188277 - RNA, 23 nt, Human
aucauaguuuuauuuauauuuau

SEQ ID NO: 3188278 - RNA, 20 nt, Human
aucauuaucagccugugcca

SEQ ID NO: 3188279 - RNA, 15 nt, Human
aucauucuaaagaua

SEQ ID NO: 3188280 - RNA, 14 nt, Human
aucauucuaaagau

SEQ ID NO: 3188281 - RNA, 21 nt, Human
aucauccacugugccaugugc

SEQ ID NO: 3188282 - RNA, 14 nt, Human
aucaucauuauuau

SEQ ID NO: 3188283 - RNA, 15 nt, Human
aucaucauuauuauu

SEQ ID NO: 3188284 - RNA, 16 nt, Human
aucaucauuauuauua

SEQ ID NO: 3188285 - RNA, 17 nt, Human
aucagugcccuccagga

SEQ ID NO: 3188286 - RNA, 13 nt, Human
aucagugcccucc

SEQ ID NO: 3188287 - RNA, 15 nt, Human
aucagugcccuccag

SEQ ID NO: 3188288 - RNA, 19 nt, Human
aucagucugauucccaagc

SEQ ID NO: 3188289 - RNA, 14 nt, Human
aucaggugcugcca

SEQ ID NO: 3188290 - RNA, 14 nt, Human
aucaguguuuaugu

SEQ ID NO: 3188291 - RNA, 22 nt, Human
aucaguguuuaugugcuauuaa

SEQ ID NO: 3188292 - RNA, 22 nt, Human
aucaguuauacaguuauaaaau

SEQ ID NO: 3188293 - RNA, 23 nt, Human
aucacuugaacccgggaggcaga

SEQ ID NO: 3188294 - RNA, 15 nt, Human
aucaggugcugccau

SEQ ID NO: 3188295 - RNA, 17 nt, Human
aucaggugcugccaucc

SEQ ID NO: 3188296 - RNA, 22 nt, Human
aucacuguuuagauuugccaua

SEQ ID NO: 3188297 - RNA, 12 nt, Human
aucacuuaaaac

SEQ ID NO: 3188298 - RNA, 13 nt, Human
aucacuuaaaaca

SEQ ID NO: 3188299 - RNA, 18 nt, Human
aucacuuaaaacacguuu

SEQ ID NO: 3188300 - RNA, 14 nt, Human
aucacuuaaaacac

SEQ ID NO: 3188301 - RNA, 15 nt, Human
aucacuuaaaacacg

SEQ ID NO: 3188302 - RNA, 12 nt, Human
aucacugaaaua

SEQ ID NO: 3188303 - RNA, 18 nt, Human
aucacuguuuagauuugc

SEQ ID NO: 3188304 - RNA, 17 nt, Human
aucacuguuuagauuug

SEQ ID NO: 3188305 - RNA, 13 nt, Human
aucauucuaaaga

SEQ ID NO: 3188306 - RNA, 19 nt, Human
aucauuguuggacauuugg

SEQ ID NO: 3188307 - RNA, 18 nt, Human
aucauuguucuuuucaau

SEQ ID NO: 3188308 - RNA, 23 nt, Human
aucauuguccagagcugcuuccc

SEQ ID NO: 3188309 - RNA, 12 nt, Human
aucauugaaauc

SEQ ID NO: 3188310 - RNA, 17 nt, Human
aucauucuaaagauaga

SEQ ID NO: 3188311 - RNA, 16 nt, Human
aucauuguccagagcu

SEQ ID NO: 3188312 - RNA, 14 nt, Human
aucauuguccagag

SEQ ID NO: 3188313 - RNA, 17 nt, Human
uucuccuuucacaaccu

SEQ ID NO: 3188314 - RNA, 17 nt, Human
uucucccgggacucugc

SEQ ID NO: 3188315 - RNA, 22 nt, Human
uucuccccuuccauuucugccu

SEQ ID NO: 3188316 - RNA, 18 nt, Human
uucuccccuuccauuucu

SEQ ID NO: 3188317 - RNA, 13 nt, Human
uucuccccuucca

SEQ ID NO: 3188318 - RNA, 19 nt, Human
uucugaagguagcauucuu

SEQ ID NO: 3188319 - RNA, 11 nt, Human
uucucucagac

SEQ ID NO: 3188320 - RNA, 21 nt, Human
uucucucagaccgucuuccuc

SEQ ID NO: 3188321 - RNA, 22 nt, Human
uucucucagaccgucuuccucc

SEQ ID NO: 3188322 - RNA, 23 nt, Human
uucucucagaccgucuuccucca

SEQ ID NO: 3188323 - RNA, 22 nt, Human
uucuccuuucacaaccuucugu

SEQ ID NO: 3188324 - RNA, 18 nt, Human
uucuccuuucacaaccuu

SEQ ID NO: 3188325 - RNA, 19 nt, Human
uucugcagccacuauuguu

SEQ ID NO: 3188326 - RNA, 16 nt, Human
uucugaaucuucugaa

SEQ ID NO: 3188327 - RNA, 13 nt, Human
uucugaaguuaua

SEQ ID NO: 3188328 - RNA, 17 nt, Human
uucugaaguuauauuuc

SEQ ID NO: 3188329 - RNA, 15 nt, Human
uucugaaguuauauu

SEQ ID NO: 3188330 - RNA, 22 nt, Human
uucugaaguuauauuuccuaua

SEQ ID NO: 3188331 - RNA, 20 nt, Human
uucugaaguuauauuuccua

SEQ ID NO: 3188332 - RNA, 19 nt, Human
uucugaaguuauauuuccu

SEQ ID NO: 3188333 - RNA, 18 nt, Human
uucugaaguuauauuucc

SEQ ID NO: 3188334 - RNA, 20 nt, Human
auccauggggcugauuguau

SEQ ID NO: 3188335 - RNA, 18 nt, Human
auccauggggucucucac

SEQ ID NO: 3188336 - RNA, 16 nt, Human
aucccaugagccucag

SEQ ID NO: 3188337 - RNA, 13 nt, Human
aucccaugagccu

SEQ ID NO: 3188338 - RNA, 11 nt, Human
aucccagcccc

SEQ ID NO: 3188339 - RNA, 17 nt, Human
aucccugaaggccccgc

SEQ ID NO: 3188340 - RNA, 22 nt, Human
aucccugaaggccccgcccagg

SEQ ID NO: 3188341 - RNA, 18 nt, Human
aucccaugagccucagca

SEQ ID NO: 3188342 - RNA, 17 nt, Human
aucccaugagccucagc

SEQ ID NO: 3188343 - RNA, 15 nt, Human
auccaaccauuuuca

SEQ ID NO: 3188344 - RNA, 17 nt, Human
auccaaccauuuucauu

SEQ ID NO: 3188345 - RNA, 16 nt, Human
uucugccugcccaggc

SEQ ID NO: 3188346 - RNA, 15 nt, Human
uucugccugcccagg

SEQ ID NO: 3188347 - RNA, 13 nt, Human
auccaaauauugu

SEQ ID NO: 3188348 - RNA, 19 nt, Human
auccaaaguccccauucag

SEQ ID NO: 3188349 - RNA, 15 nt, Human
auccaguaaaauaau

SEQ ID NO: 3188350 - RNA, 14 nt, Human
auccaguaucuuga

SEQ ID NO: 3188351 - RNA, 17 nt, Human
auccagguucagcuugu

SEQ ID NO: 3188352 - RNA, 20 nt, Human
auccacagucucccccaccc

SEQ ID NO: 3188353 - RNA, 16 nt, Human
auccacauguuucaga

SEQ ID NO: 3188354 - RNA, 18 nt, Human
auccacauguuucagagc

SEQ ID NO: 3188355 - RNA, 14 nt, Human
uucuguuuucaauc

SEQ ID NO: 3188356 - RNA, 16 nt, Human
uucuuaccgacaagca

SEQ ID NO: 3188357 - RNA, 15 nt, Human
uucuuagaacagugg

SEQ ID NO: 3188358 - RNA, 20 nt, Human
uucuuagaacaguggaaacu

SEQ ID NO: 3188359 - RNA, 22 nt, Human
uucuuagaacaguggaaacuau

SEQ ID NO: 3188360 - RNA, 14 nt, Human
uucuuacugcuuaa

SEQ ID NO: 3188361 - RNA, 13 nt, Human
uucuguuuucaau

SEQ ID NO: 3188362 - RNA, 12 nt, Human
uucuguuuucaa

SEQ ID NO: 3188363 - RNA, 21 nt, Human
uucuguuucuaauuugcugcu

SEQ ID NO: 3188364 - RNA, 23 nt, Human
uucuguuucuaauuugcugcuga

SEQ ID NO: 3188365 - RNA, 21 nt, Human
uucuguuggccagugugacaa

SEQ ID NO: 3188366 - RNA, 15 nt, Human
aucccugaucccuuc

SEQ ID NO: 3188367 - RNA, 22 nt, Human
aucccugauaaauauucacacu

SEQ ID NO: 3188368 - RNA, 17 nt, Human
uucuucucccccauccu

SEQ ID NO: 3188369 - RNA, 22 nt, Human
uucuucuccacuuucuagccag

SEQ ID NO: 3188370 - RNA, 18 nt, Human
uucuuagacuuuuccaau

SEQ ID NO: 3188371 - RNA, 22 nt, Human
uucuugcgauaguuuacugaga

SEQ ID NO: 3188372 - RNA, 15 nt, Human
uucuuugaucaugaa

SEQ ID NO: 3188373 - RNA, 17 nt, Human
uucuuugaucaugaaua

SEQ ID NO: 3188374 - RNA, 16 nt, Human
uucuuugaucaugaau

SEQ ID NO: 3188375 - RNA, 22 nt, Human
uucuuugaucaugaauaacuga

SEQ ID NO: 3188376 - RNA, 19 nt, Human
uucuuugcacuuuuucuua

SEQ ID NO: 3188377 - RNA, 16 nt, Human
uucuuugcaaaaaucc

SEQ ID NO: 3188378 - RNA, 15 nt, Human
uucuuugcaaaaauc

SEQ ID NO: 3188379 - RNA, 14 nt, Human
uucuuugauucugu

SEQ ID NO: 3188380 - RNA, 16 nt, Human
uucuuugaauuuucau

SEQ ID NO: 3188381 - RNA, 15 nt, Human
uucuuugaauuuuca

SEQ ID NO: 3188382 - RNA, 22 nt, Human
uucuuugaauuuucauuuuaca

SEQ ID NO: 3188383 - RNA, 18 nt, Human
uucuuugaauuuucauuu

SEQ ID NO: 3188384 - RNA, 17 nt, Human
uucuuugaauuuucauu

SEQ ID NO: 3188385 - RNA, 16 nt, Human
uucagauuugccuuau

SEQ ID NO: 3188386 - RNA, 21 nt, Human
uucagauucaggcauuuuccc

SEQ ID NO: 3188387 - RNA, 17 nt, Human
uucagauuucucuuuga

SEQ ID NO: 3188388 - RNA, 15 nt, Human
uucagauuugcacaa

SEQ ID NO: 3188389 - RNA, 19 nt, Human
uucagauuucucuuugaaa

SEQ ID NO: 3188390 - RNA, 19 nt, Human
uucagauuugcacaaaaag

SEQ ID NO: 3188391 - RNA, 18 nt, Human
uucagauuugcacaaaaa

SEQ ID NO: 3188392 - RNA, 17 nt, Human
uucagauuugcacaaaa

SEQ ID NO: 3188393 - RNA, 16 nt, Human
uucagauuugcacaaa

SEQ ID NO: 3188394 - RNA, 15 nt, Human
uucagauuggacaua

SEQ ID NO: 3188395 - RNA, 19 nt, Human
uucagauuggacauaacug

SEQ ID NO: 3188396 - RNA, 15 nt, Human
uucagauuucucuuu

SEQ ID NO: 3188397 - RNA, 16 nt, Human
uucagaagaaauaaau

SEQ ID NO: 3188398 - RNA, 22 nt, Human
uucagaaaacugagcugcaauc

SEQ ID NO: 3188399 - RNA, 11 nt, Human
uucagaaaaaa

SEQ ID NO: 3188400 - RNA, 19 nt, Human
uucacuucugacucuuccc

SEQ ID NO: 3188401 - RNA, 22 nt, Human
uucacuucuuucccuuccucca

SEQ ID NO: 3188402 - RNA, 16 nt, Human
uucacuucuuucccuu

SEQ ID NO: 3188403 - RNA, 15 nt, Human
uucacuucuuucccu

SEQ ID NO: 3188404 - RNA, 13 nt, Human
uucacuucuuucc

SEQ ID NO: 3188405 - RNA, 14 nt, Human
uucacuuugacacu

SEQ ID NO: 3188406 - RNA, 16 nt, Human
uucagcguuuugcaag

SEQ ID NO: 3188407 - RNA, 21 nt, Human
uucagcaucugaccucuaccu

SEQ ID NO: 3188408 - RNA, 22 nt, Human
uucagcaugaaaauguguguuu

SEQ ID NO: 3188409 - RNA, 13 nt, Human
uucagcaggcagc

SEQ ID NO: 3188410 - RNA, 12 nt, Human
uucagcaggcag

SEQ ID NO: 3188411 - RNA, 13 nt, Human
uucagcaucugac

SEQ ID NO: 3188412 - RNA, 12 nt, Human
uucagcaucuga

SEQ ID NO: 3188413 - RNA, 16 nt, Human
uucagguaacaggcag

SEQ ID NO: 3188414 - RNA, 15 nt, Human
uucagguaacaggca

SEQ ID NO: 3188415 - RNA, 22 nt, Human
uucaggguuggccccugcccgg

SEQ ID NO: 3188416 - RNA, 19 nt, Human
uucaggguuggccccugcc

SEQ ID NO: 3188417 - RNA, 17 nt, Human
uucaggguuggccccug

SEQ ID NO: 3188418 - RNA, 16 nt, Human
uucaggguuggccccu

SEQ ID NO: 3188419 - RNA, 14 nt, Human
uucaggguuggccc

SEQ ID NO: 3188420 - RNA, 22 nt, Human
uucagcuaggaacaaaucuucc

SEQ ID NO: 3188421 - RNA, 20 nt, Human
uucagcuaggaacaaaucuu

SEQ ID NO: 3188422 - RNA, 14 nt, Human
uucagcuaggaaca

SEQ ID NO: 3188423 - RNA, 9 nt, Human
auauauuuc

SEQ ID NO: 3188424 - RNA, 22 nt, Human
auauauguuuuaagaggcaggg

SEQ ID NO: 3188425 - RNA, 21 nt, Human
auauauguuuuaagaggcagg

SEQ ID NO: 3188426 - RNA, 15 nt, Human
uucaucaaugaauga

SEQ ID NO: 3188427 - RNA, 22 nt, Human
uucaucagaacagcuguugacu

SEQ ID NO: 3188428 - RNA, 16 nt, Human
uucaucagaacagcug

SEQ ID NO: 3188429 - RNA, 18 nt, Human
auauauggucuaauguuu

SEQ ID NO: 3188430 - RNA, 16 nt, Human
auauauggucuaaugu

SEQ ID NO: 3188431 - RNA, 20 nt, Human
auauaugcauauauauaugu

SEQ ID NO: 3188432 - RNA, 16 nt, Human
auauaugcauauauau

SEQ ID NO: 3188433 - RNA, 19 nt, Human
uucaucauauuauacagac

SEQ ID NO: 3188434 - RNA, 13 nt, Human
auauaugcauaua

SEQ ID NO: 3188435 - RNA, 14 nt, Human
uucaguaagccgug

SEQ ID NO: 3188436 - RNA, 23 nt, Human
uucaguaagucucauagguuaaa

SEQ ID NO: 3188437 - RNA, 13 nt, Human
uucagucauuaaa

SEQ ID NO: 3188438 - RNA, 15 nt, Human
uucagucauuaaauu

SEQ ID NO: 3188439 - RNA, 16 nt, Human
uucagucauuaaauua

SEQ ID NO: 3188440 - RNA, 17 nt, Human
uucagguaacaggcaga

SEQ ID NO: 3188441 - RNA, 20 nt, Human
uucagguagaggugcaugcc

SEQ ID NO: 3188442 - RNA, 14 nt, Human
uucagguagaggug

SEQ ID NO: 3188443 - RNA, 22 nt, Human
uucagguaaagggcaaauaaug

SEQ ID NO: 3188444 - RNA, 22 nt, Human
uucauauuuuaaacagaggaua

SEQ ID NO: 3188445 - RNA, 20 nt, Human
uucauauuuuaauuucaagc

SEQ ID NO: 3188446 - RNA, 18 nt, Human
uucauauuuuaauuucaa

SEQ ID NO: 3188447 - RNA, 17 nt, Human
uucauauuuuaauuuca

SEQ ID NO: 3188448 - RNA, 19 nt, Human
uucauauuuuucaaaauag

SEQ ID NO: 3188449 - RNA, 17 nt, Human
uucauauuuuucaaaau

SEQ ID NO: 3188450 - RNA, 22 nt, Human
uucauauuuuaauuucaagcuu

SEQ ID NO: 3188451 - RNA, 11 nt, Human
uucauaucauu

SEQ ID NO: 3188452 - RNA, 15 nt, Human
uucagugaugugccu

SEQ ID NO: 3188453 - RNA, 23 nt, Human
uucagugcauuaucuacuugugu

SEQ ID NO: 3188454 - RNA, 23 nt, Human
auaugaccaaauaucaccaggac

SEQ ID NO: 3188455 - RNA, 14 nt, Human
auaugcaaagcacu

SEQ ID NO: 3188456 - RNA, 13 nt, Human
auaugcaaagcac

SEQ ID NO: 3188457 - RNA, 16 nt, Human
auaugaacauacaaau

SEQ ID NO: 3188458 - RNA, 20 nt, Human
auaugaaagucuuauuaaaa

SEQ ID NO: 3188459 - RNA, 11 nt, Human
auauauuuuag

SEQ ID NO: 3188460 - RNA, 22 nt, Human
auauauuuuauuuuuagaauuu

SEQ ID NO: 3188461 - RNA, 18 nt, Human
auauauuuuauuuuuaga

SEQ ID NO: 3188462 - RNA, 23 nt, Human
auauauuuuguaugcaagcaguu

SEQ ID NO: 3188463 - RNA, 22 nt, Human
auauauuuuguaugcaagcagu

SEQ ID NO: 3188464 - RNA, 20 nt, Human
auauauuuuguaugcaagca

SEQ ID NO: 3188465 - RNA, 19 nt, Human
auauauuuuguaugcaagc

SEQ ID NO: 3188466 - RNA, 17 nt, Human
auauauuuuguaugcaa

SEQ ID NO: 3188467 - RNA, 16 nt, Human
auauauuuuguaugca

SEQ ID NO: 3188468 - RNA, 14 nt, Human
auauauuuuguaug

SEQ ID NO: 3188469 - RNA, 13 nt, Human
auauauuuuguau

SEQ ID NO: 3188470 - RNA, 14 nt, Human
auaugacaaauguu

SEQ ID NO: 3188471 - RNA, 17 nt, Human
auaugacaaauguuucu

SEQ ID NO: 3188472 - RNA, 16 nt, Human
auaugacaaauguuuc

SEQ ID NO: 3188473 - RNA, 18 nt, Human
auaugacaaauguuucua

SEQ ID NO: 3188474 - RNA, 19 nt, Human
auaugaacauacaaaugca

SEQ ID NO: 3188475 - RNA, 14 nt, Human
auaugaacuuaaca

SEQ ID NO: 3188476 - RNA, 17 nt, Human
auaugaacuuaacaugc

SEQ ID NO: 3188477 - RNA, 17 nt, Human
auaugaacauacaaaug

SEQ ID NO: 3188478 - RNA, 18 nt, Human
auaugaacauacaaaugc

SEQ ID NO: 3188479 - RNA, 23 nt, Human
auauguaccuaacgaaguauccu

SEQ ID NO: 3188480 - RNA, 14 nt, Human
auaugggagaaaua

SEQ ID NO: 3188481 - RNA, 15 nt, Human
auaugggagaaauag

SEQ ID NO: 3188482 - RNA, 20 nt, Human
auauguggaguucaucuuga

SEQ ID NO: 3188483 - RNA, 21 nt, Human
auauguggaguucaucuugaa

SEQ ID NO: 3188484 - RNA, 19 nt, Human
auauguagccuuuacuguu

SEQ ID NO: 3188485 - RNA, 16 nt, Human
uucauuaauucaggca

SEQ ID NO: 3188486 - RNA, 14 nt, Human
uucaugcuuuauca

SEQ ID NO: 3188487 - RNA, 23 nt, Human
auauguguguguguguguugcuu

SEQ ID NO: 3188488 - RNA, 13 nt, Human
uucauugcuguga

SEQ ID NO: 3188489 - RNA, 22 nt, Human
uucauugguacugccuuaaaga

SEQ ID NO: 3188490 - RNA, 19 nt, Human
uucauugguacugccuuaa

SEQ ID NO: 3188491 - RNA, 22 nt, Human
uuccaauuuacauacucugcuu

SEQ ID NO: 3188492 - RNA, 13 nt, Human
uuccaauguuuca

SEQ ID NO: 3188493 - RNA, 14 nt, Human
uuccaauuuuccuu

SEQ ID NO: 3188494 - RNA, 13 nt, Human
uuccaauuuuccu

SEQ ID NO: 3188495 - RNA, 14 nt, Human
uucauuaucucaaa

SEQ ID NO: 3188496 - RNA, 22 nt, Human
uucauuagcaaaaaaaguugua

SEQ ID NO: 3188497 - RNA, 21 nt, Human
uucauuagcaaaaaaaguugu

SEQ ID NO: 3188498 - RNA, 20 nt, Human
uucauuagcaaaaaaaguug

SEQ ID NO: 3188499 - RNA, 16 nt, Human
uucauugcaauuaaac

SEQ ID NO: 3188500 - RNA, 21 nt, Human
uuccacaagagcccaggccuc

SEQ ID NO: 3188501 - RNA, 22 nt, Human
uuccacagaggacacagagaag

SEQ ID NO: 3188502 - RNA, 13 nt, Human
uuccacagaggac

SEQ ID NO: 3188503 - RNA, 14 nt, Human
uuccacagaggaca

SEQ ID NO: 3188504 - RNA, 15 nt, Human
uuccacauguuacug

SEQ ID NO: 3188505 - RNA, 15 nt, Human
uuccaccuucccaug

SEQ ID NO: 3188506 - RNA, 17 nt, Human
uuccaccugcucugcug

SEQ ID NO: 3188507 - RNA, 13 nt, Human
uuccaccugcucu

SEQ ID NO: 3188508 - RNA, 16 nt, Human
uuccaccugcucugcu

SEQ ID NO: 3188509 - RNA, 15 nt, Human
uuccaccugcucugc

SEQ ID NO: 3188510 - RNA, 13 nt, Human
uuccaggcuggga

SEQ ID NO: 3188511 - RNA, 15 nt, Human
uuccaggcugggaga

SEQ ID NO: 3188512 - RNA, 17 nt, Human
uuccaggcugggagagc

SEQ ID NO: 3188513 - RNA, 18 nt, Human
uuccagguuuaagcuguu

SEQ ID NO: 3188514 - RNA, 17 nt, Human
uuccagguuuaagcugu

SEQ ID NO: 3188515 - RNA, 12 nt, Human
uuccaguauuuu

SEQ ID NO: 3188516 - RNA, 11 nt, Human
uuccaguauuu

SEQ ID NO: 3188517 - RNA, 15 nt, Human
uuccagguuuaagua

SEQ ID NO: 3188518 - RNA, 21 nt, Human
uuccaguaaggaaugauauug

SEQ ID NO: 3188519 - RNA, 17 nt, Human
auauguuauuuuaaaca

SEQ ID NO: 3188520 - RNA, 16 nt, Human
auauguuaauuugugu

SEQ ID NO: 3188521 - RNA, 15 nt, Human
uuccagugaggcucu

SEQ ID NO: 3188522 - RNA, 16 nt, Human
uuccagugaggcucug

SEQ ID NO: 3188523 - RNA, 22 nt, Human
uuccagucgggggaacugaggc

SEQ ID NO: 3188524 - RNA, 22 nt, Human
uuccagucaggcucucugggcu

SEQ ID NO: 3188525 - RNA, 14 nt, Human
uuccaguauuuuag

SEQ ID NO: 3188526 - RNA, 22 nt, Human
uuccagugaaaucaguuacucu

SEQ ID NO: 3188527 - RNA, 16 nt, Human
uucccaggcaaauaaa

SEQ ID NO: 3188528 - RNA, 18 nt, Human
uucccaggcaaauaaaau

SEQ ID NO: 3188529 - RNA, 19 nt, Human
uucccaggcaaauaaaauu

SEQ ID NO: 3188530 - RNA, 20 nt, Human
uucccaggcaaauaaaauuc

SEQ ID NO: 3188531 - RNA, 22 nt, Human
uucccaggcaaauaaaauuccc

SEQ ID NO: 3188532 - RNA, 19 nt, Human
uucccaggaaagaagcauu

SEQ ID NO: 3188533 - RNA, 14 nt, Human
auauuaaaagaaag

SEQ ID NO: 3188534 - RNA, 23 nt, Human
auauuaaaagaaaggguucugua

SEQ ID NO: 3188535 - RNA, 19 nt, Human
auauuaaaccauaagaugg

SEQ ID NO: 3188536 - RNA, 15 nt, Human
auauuaaaauuccaa

SEQ ID NO: 3188537 - RNA, 21 nt, Human
auauuaaaauuccaaauucau

SEQ ID NO: 3188538 - RNA, 22 nt, Human
auauuaaaauuccaaauucaug

SEQ ID NO: 3188539 - RNA, 12 nt, Human
auauuaaacaaa

SEQ ID NO: 3188540 - RNA, 18 nt, Human
auauuaaacaaaguuuca

SEQ ID NO: 3188541 - RNA, 20 nt, Human
auauuaaacaaaguuucaga

SEQ ID NO: 3188542 - RNA, 22 nt, Human
auauuaaacaaaguuucagagu

SEQ ID NO: 3188543 - RNA, 20 nt, Human
auauuaaaaagucuuuuaaa

SEQ ID NO: 3188544 - RNA, 19 nt, Human
auauuaaaaagucuuuuaa

SEQ ID NO: 3188545 - RNA, 17 nt, Human
auauuaaaaagucuuuu

SEQ ID NO: 3188546 - RNA, 16 nt, Human
auauuaaaaagucuuu

SEQ ID NO: 3188547 - RNA, 12 nt, Human
auauuaaaaagu

SEQ ID NO: 3188548 - RNA, 15 nt, Human
auauuaaaaagucuu

SEQ ID NO: 3188549 - RNA, 13 nt, Human
auauuaaaaaguc

SEQ ID NO: 3188550 - RNA, 12 nt, Human
auauuaaaaaac

SEQ ID NO: 3188551 - RNA, 17 nt, Human
auauuaaaaaacuucau

SEQ ID NO: 3188552 - RNA, 24 nt, Human
auauuaaaaaacuucauguaauuu

SEQ ID NO: 3188553 - RNA, 20 nt, Human
auauuaauuuaucagauugc

SEQ ID NO: 3188554 - RNA, 13 nt, Human
auauuacaauauu

SEQ ID NO: 3188555 - RNA, 17 nt, Human
auauuacaauauuugug

SEQ ID NO: 3188556 - RNA, 15 nt, Human
auauuacaauauuug

SEQ ID NO: 3188557 - RNA, 17 nt, Human
auauuaagaaagacuau

SEQ ID NO: 3188558 - RNA, 15 nt, Human
auauuaagaaagacu

SEQ ID NO: 3188559 - RNA, 16 nt, Human
auauuaagaaagacua

SEQ ID NO: 3188560 - RNA, 12 nt, Human
auauuuaaaggg

SEQ ID NO: 3188561 - RNA, 13 nt, Human
auauuuaaagucu

SEQ ID NO: 3188562 - RNA, 19 nt, Human
auauuuaaagggaaauuga

SEQ ID NO: 3188563 - RNA, 14 nt, Human
auauuuaaagggaa

SEQ ID NO: 3188564 - RNA, 13 nt, Human
auauuuacaaccu

SEQ ID NO: 3188565 - RNA, 16 nt, Human
auauuuacaauguauu

SEQ ID NO: 3188566 - RNA, 17 nt, Human
auauuuacaauguauua

SEQ ID NO: 3188567 - RNA, 21 nt, Human
auauuuacaauguauuaagcc

SEQ ID NO: 3188568 - RNA, 22 nt, Human
auauuuacaacacuuuaauggg

SEQ ID NO: 3188569 - RNA, 22 nt, Human
auauuuaauguugaacaaaaua

SEQ ID NO: 3188570 - RNA, 21 nt, Human
auauuuaauguugaacaaaau

SEQ ID NO: 3188571 - RNA, 20 nt, Human
auauuuaauguugaacaaaa

SEQ ID NO: 3188572 - RNA, 16 nt, Human
auauuuaauguugaac

SEQ ID NO: 3188573 - RNA, 15 nt, Human
auauuuaauguugaa

SEQ ID NO: 3188574 - RNA, 22 nt, Human
auauuuaaaggcccuaucuguu

SEQ ID NO: 3188575 - RNA, 13 nt, Human
auauuguuuucag

SEQ ID NO: 3188576 - RNA, 22 nt, Human
auauuguauuguuagauguuug

SEQ ID NO: 3188577 - RNA, 20 nt, Human
auauugucucuuuuuuaagu

SEQ ID NO: 3188578 - RNA, 15 nt, Human
auauugauaugcuua

SEQ ID NO: 3188579 - RNA, 14 nt, Human
auauugagcaauau

SEQ ID NO: 3188580 - RNA, 18 nt, Human
auauugagcaauauguca

SEQ ID NO: 3188581 - RNA, 20 nt, Human
auauugagcaauaugucagu

SEQ ID NO: 3188582 - RNA, 13 nt, Human
auauugagcagaa

SEQ ID NO: 3188583 - RNA, 14 nt, Human
auauugagcagaau

SEQ ID NO: 3188584 - RNA, 16 nt, Human
auauugagcagaauuc

SEQ ID NO: 3188585 - RNA, 21 nt, Human
auauugacaaguuuaaaggcu

SEQ ID NO: 3188586 - RNA, 14 nt, Human
auauucuauuuuac

SEQ ID NO: 3188587 - RNA, 16 nt, Human
auauucuauuuuacaa

SEQ ID NO: 3188588 - RNA, 19 nt, Human
auauucuaguaauaaagac

SEQ ID NO: 3188589 - RNA, 21 nt, Human
auauucuaguaauaaagacuc

SEQ ID NO: 3188590 - RNA, 13 nt, Human
auauucuauuuua

SEQ ID NO: 3188591 - RNA, 21 nt, Human
auauuccugcauuugugaaau

SEQ ID NO: 3188592 - RNA, 18 nt, Human
auauucuaagaaauaucu

SEQ ID NO: 3188593 - RNA, 22 nt, Human
auauucuaagaaauaucuguga

SEQ ID NO: 3188594 - RNA, 23 nt, Human
auauucuaagaaauaucugugaa

SEQ ID NO: 3188595 - RNA, 22 nt, Human
auauugcugauggugcaaugac

SEQ ID NO: 3188596 - RNA, 21 nt, Human
auauugcugauggugcaauga

SEQ ID NO: 3188597 - RNA, 21 nt, Human
auauugaggagcacugaaagu

SEQ ID NO: 3188598 - RNA, 21 nt, Human
auauugguauauccuuuucug

SEQ ID NO: 3188599 - RNA, 12 nt, Human
auauugguuuua

SEQ ID NO: 3188600 - RNA, 13 nt, Human
auauugguuuuau

SEQ ID NO: 3188601 - RNA, 15 nt, Human
auauugguuuuauga

SEQ ID NO: 3188602 - RNA, 17 nt, Human
auauugguuuuaugaug

SEQ ID NO: 3188603 - RNA, 18 nt, Human
auauugguuuuaugauga

SEQ ID NO: 3188604 - RNA, 12 nt, Human
auauuguaagaa

SEQ ID NO: 3188605 - RNA, 19 nt, Human
auauugguuuuaugaugac

SEQ ID NO: 3188606 - RNA, 16 nt, Human
auauuguaagaaauac

SEQ ID NO: 3188607 - RNA, 15 nt, Human
auauuguaagaaaua

SEQ ID NO: 3188608 - RNA, 14 nt, Human
auauuguaagaaau

SEQ ID NO: 3188609 - RNA, 13 nt, Human
auauuguaagaaa

SEQ ID NO: 3188610 - RNA, 18 nt, Human
uuccucuccacugccuuc

SEQ ID NO: 3188611 - RNA, 16 nt, Human
uuccucuccacugccu

SEQ ID NO: 3188612 - RNA, 19 nt, Human
uuccucuccacugccuucg

SEQ ID NO: 3188613 - RNA, 13 nt, Human
uuccucugagccu

SEQ ID NO: 3188614 - RNA, 22 nt, Human
uuccucuuuuuauuuaguuccu

SEQ ID NO: 3188615 - RNA, 21 nt, Human
uuccucuuuugugcugcuucu

SEQ ID NO: 3188616 - RNA, 19 nt, Human
uuccuggcacugcuuccag

SEQ ID NO: 3188617 - RNA, 20 nt, Human
uuccuggcacugcuuccagu

SEQ ID NO: 3188618 - RNA, 22 nt, Human
uuccuggcacugcuuccaguga

SEQ ID NO: 3188619 - RNA, 17 nt, Human
uuccuguuugggaagag

SEQ ID NO: 3188620 - RNA, 13 nt, Human
uuccuguuucaag

SEQ ID NO: 3188621 - RNA, 17 nt, Human
uuccuguugucaagaau

SEQ ID NO: 3188622 - RNA, 21 nt, Human
auauuugaauguaugcuucau

SEQ ID NO: 3188623 - RNA, 17 nt, Human
auauuugaggaguguua

SEQ ID NO: 3188624 - RNA, 12 nt, Human
auauuugauuua

SEQ ID NO: 3188625 - RNA, 14 nt, Human
auauuugauuuauu

SEQ ID NO: 3188626 - RNA, 15 nt, Human
auauuugauuuauua

SEQ ID NO: 3188627 - RNA, 16 nt, Human
auauuugauuuauuaa

SEQ ID NO: 3188628 - RNA, 18 nt, Human
auauuugauuuauuaacu

SEQ ID NO: 3188629 - RNA, 14 nt, Human
auauuuggaauaaa

SEQ ID NO: 3188630 - RNA, 23 nt, Human
auauuugauuuauuaacuuaaua

SEQ ID NO: 3188631 - RNA, 19 nt, Human
auauuugcaguuuuucauu

SEQ ID NO: 3188632 - RNA, 23 nt, Human
auauuugcaguuuuucauuuuaa

SEQ ID NO: 3188633 - RNA, 19 nt, Human
uucccgccgcccagcccac

SEQ ID NO: 3188634 - RNA, 12 nt, Human
uucccgcucagc

SEQ ID NO: 3188635 - RNA, 14 nt, Human
uucccgcucagccc

SEQ ID NO: 3188636 - RNA, 20 nt, Human
auauuuggaugcagaguuca

SEQ ID NO: 3188637 - RNA, 17 nt, Human
auauuuggaugcagagu

SEQ ID NO: 3188638 - RNA, 23 nt, Human
auauuuggaauaaaaauuccaga

SEQ ID NO: 3188639 - RNA, 18 nt, Human
uuccgcauucuuuguaca

SEQ ID NO: 3188640 - RNA, 20 nt, Human
uucccuuuuuuggcugcuga

SEQ ID NO: 3188641 - RNA, 11 nt, Human
uucccuaaagc

SEQ ID NO: 3188642 - RNA, 12 nt, Human
uucccuaaagcc

SEQ ID NO: 3188643 - RNA, 14 nt, Human
auauuuuucuuaaa

SEQ ID NO: 3188644 - RNA, 13 nt, Human
auauuuuucuuaa

SEQ ID NO: 3188645 - RNA, 17 nt, Human
uuccuuacauaaacauc

SEQ ID NO: 3188646 - RNA, 16 nt, Human
uuccuuacauaaacau

SEQ ID NO: 3188647 - RNA, 13 nt, Human
uuccuuacauaaa

SEQ ID NO: 3188648 - RNA, 17 nt, Human
uuccuguuuguugaagg

SEQ ID NO: 3188649 - RNA, 19 nt, Human
auauuuuucuuaaaaagua

SEQ ID NO: 3188650 - RNA, 18 nt, Human
auauuuuucuuaaaaagu

SEQ ID NO: 3188651 - RNA, 17 nt, Human
auauuuuucuuaaaaag

SEQ ID NO: 3188652 - RNA, 15 nt, Human
auauuuuucuuaaaa

SEQ ID NO: 3188653 - RNA, 15 nt, Human
aucaaauaugcaaag

SEQ ID NO: 3188654 - RNA, 18 nt, Human
aucaaauaugcaaagcac

SEQ ID NO: 3188655 - RNA, 12 nt, Human
aucaacuaaagu

SEQ ID NO: 3188656 - RNA, 20 nt, Human
aucaacuaaaguuguacuuu

SEQ ID NO: 3188657 - RNA, 18 nt, Human
aucaacuaaaguuguacu

SEQ ID NO: 3188658 - RNA, 15 nt, Human
aucaacuaguauuug

SEQ ID NO: 3188659 - RNA, 22 nt, Human
aucaacuaaaguuguacuuuaa

SEQ ID NO: 3188660 - RNA, 21 nt, Human
aucaacuaaaguuguacuuua

SEQ ID NO: 3188661 - RNA, 17 nt, Human
aucaaauaugcaaagca

SEQ ID NO: 3188662 - RNA, 16 nt, Human
aucaaauaugcaaagc

SEQ ID NO: 3188663 - RNA, 21 nt, Human
aucaacugcaucaagauguga

SEQ ID NO: 3188664 - RNA, 13 nt, Human
aucaacucauguu

SEQ ID NO: 3188665 - RNA, 14 nt, Human
aucaaugugucuuu

SEQ ID NO: 3188666 - RNA, 17 nt, Human
aucaaugugucuuucua

SEQ ID NO: 3188667 - RNA, 22 nt, Human
aucaaugugucuuucuaagaaa

SEQ ID NO: 3188668 - RNA, 19 nt, Human
aucaaguagacuacuguuc

SEQ ID NO: 3188669 - RNA, 18 nt, Human
aucaaguagacuacuguu

SEQ ID NO: 3188670 - RNA, 17 nt, Human
aucaaguagacuacugu

SEQ ID NO: 3188671 - RNA, 13 nt, Human
aucaaguaaugaa

SEQ ID NO: 3188672 - RNA, 13 nt, Human
aucaauuuaaaaa

SEQ ID NO: 3188673 - RNA, 14 nt, Human
aucaauuuuucuua

SEQ ID NO: 3188674 - RNA, 12 nt, Human
aucaauuuaagu

SEQ ID NO: 3188675 - RNA, 17 nt, Human
aucaauuuaaguguugg

SEQ ID NO: 3188676 - RNA, 17 nt, Human
aucacgccacugcacua

SEQ ID NO: 3188677 - RNA, 15 nt, Human
aucacgccacugcac

SEQ ID NO: 3188678 - RNA, 14 nt, Human
aucacgccacugca

SEQ ID NO: 3188679 - RNA, 14 nt, Human
aucacucagagcag

SEQ ID NO: 3188680 - RNA, 18 nt, Human
aucacucagagcagucug

SEQ ID NO: 3188681 - RNA, 13 nt, Human
aucacucauuaau

SEQ ID NO: 3188682 - RNA, 15 nt, Human
aucacucauuaauua

SEQ ID NO: 3188683 - RNA, 16 nt, Human
aucacucauuaauuaa

SEQ ID NO: 3188684 - RNA, 17 nt, Human
auuuccccuaaucuuuu

SEQ ID NO: 3188685 - RNA, 22 nt, Human
auuucccuuuagcuguguuauu

SEQ ID NO: 3188686 - RNA, 21 nt, Human
auuucccuuuagcuguguuau

SEQ ID NO: 3188687 - RNA, 20 nt, Human
auuucccuuuagcuguguua

SEQ ID NO: 3188688 - RNA, 16 nt, Human
auuucccuuuagcugu

SEQ ID NO: 3188689 - RNA, 23 nt, Human
auuucccuuuagcuguguuauua

SEQ ID NO: 3188690 - RNA, 16 nt, Human
auuuccguaauucuua

SEQ ID NO: 3188691 - RNA, 14 nt, Human
auuuccguaauucu

SEQ ID NO: 3188692 - RNA, 18 nt, Human
auuuccguaauucuuauu

SEQ ID NO: 3188693 - RNA, 16 nt, Human
auuucuagcuuuuuaa

SEQ ID NO: 3188694 - RNA, 18 nt, Human
auuucuagcuuuuuaauu

SEQ ID NO: 3188695 - RNA, 16 nt, Human
auuugaaagugccuuu

SEQ ID NO: 3188696 - RNA, 17 nt, Human
auuugaaagugccuuug

SEQ ID NO: 3188697 - RNA, 18 nt, Human
auuugaaaaugauaaaag

SEQ ID NO: 3188698 - RNA, 14 nt, Human
auuugaaccaauaa

SEQ ID NO: 3188699 - RNA, 20 nt, Human
auuugaaagugccuuugcag

SEQ ID NO: 3188700 - RNA, 22 nt, Human
auuugaaagugccuuugcagcu

SEQ ID NO: 3188701 - RNA, 20 nt, Human
auuugaaaacagaaauuggu

SEQ ID NO: 3188702 - RNA, 19 nt, Human
auuugaaaacagaaauugg

SEQ ID NO: 3188703 - RNA, 17 nt, Human
auuugaaaacagaaauu

SEQ ID NO: 3188704 - RNA, 12 nt, Human
auuucauuucuu

SEQ ID NO: 3188705 - RNA, 21 nt, Human
auuucauucgggccccaccug

SEQ ID NO: 3188706 - RNA, 16 nt, Human
auuucaaacggccuca

SEQ ID NO: 3188707 - RNA, 17 nt, Human
auuuccagccaaagccu

SEQ ID NO: 3188708 - RNA, 22 nt, Human
auuucauuugugccagaaugcu

SEQ ID NO: 3188709 - RNA, 20 nt, Human
auuuccagugaaaucaguua

SEQ ID NO: 3188710 - RNA, 15 nt, Human
auuuccccagggcac

SEQ ID NO: 3188711 - RNA, 14 nt, Human
auuuccccagggca

SEQ ID NO: 3188712 - RNA, 20 nt, Human
auuucccccauuuuucccag

SEQ ID NO: 3188713 - RNA, 17 nt, Human
auuucccccuuucuucc

SEQ ID NO: 3188714 - RNA, 14 nt, Human
auuucccccuuucu

SEQ ID NO: 3188715 - RNA, 16 nt, Human
auuuccccuaaucuuu

SEQ ID NO: 3188716 - RNA, 20 nt, Human
auuucccccuuucuuccuca

SEQ ID NO: 3188717 - RNA, 19 nt, Human
auuucccccuuucuuccuc

SEQ ID NO: 3188718 - RNA, 18 nt, Human
auuucccccuuucuuccu

SEQ ID NO: 3188719 - RNA, 17 nt, Human
auuuauuuacugcuagu

SEQ ID NO: 3188720 - RNA, 13 nt, Human
auuuauucugcuc

SEQ ID NO: 3188721 - RNA, 14 nt, Human
auuuauucuaauua

SEQ ID NO: 3188722 - RNA, 22 nt, Human
auuuauuaaaugcccagccccu

SEQ ID NO: 3188723 - RNA, 13 nt, Human
auuuauuaacuua

SEQ ID NO: 3188724 - RNA, 22 nt, Human
auuuauuaacugcucaguguuu

SEQ ID NO: 3188725 - RNA, 14 nt, Human
auuuauuaacuuaa

SEQ ID NO: 3188726 - RNA, 16 nt, Human
auuuauuaacuuaaua

SEQ ID NO: 3188727 - RNA, 21 nt, Human
auuuauuaaauuuuuuuguau

SEQ ID NO: 3188728 - RNA, 24 nt, Human
auuuauuaaauuuuuuuguaugaa

SEQ ID NO: 3188729 - RNA, 14 nt, Human
auuuauuaaauuuu

SEQ ID NO: 3188730 - RNA, 20 nt, Human
auuuauuaagguuacagauu

SEQ ID NO: 3188731 - RNA, 17 nt, Human
auuuauuaacuuaauaa

SEQ ID NO: 3188732 - RNA, 20 nt, Human
auuuauuaacuuaauaauca

SEQ ID NO: 3188733 - RNA, 21 nt, Human
auuuauuaacuuaauaaucaa

SEQ ID NO: 3188734 - RNA, 23 nt, Human
auuuauuaacuuaauaaucaaga

SEQ ID NO: 3188735 - RNA, 16 nt, Human
auuuagaugcauauua

SEQ ID NO: 3188736 - RNA, 17 nt, Human
auuuagaauggugauuu

SEQ ID NO: 3188737 - RNA, 11 nt, Human
auuuagaaugg

SEQ ID NO: 3188738 - RNA, 21 nt, Human
auuuagaauggugauuuuaaa

SEQ ID NO: 3188739 - RNA, 14 nt, Human
auuuagaagaaaga

SEQ ID NO: 3188740 - RNA, 15 nt, Human
auuuagaagaaagau

SEQ ID NO: 3188741 - RNA, 18 nt, Human
auuuagaagaaagauguu

SEQ ID NO: 3188742 - RNA, 15 nt, Human
auuuagaaauauaau

SEQ ID NO: 3188743 - RNA, 16 nt, Human
auuuacuucuuauaca

SEQ ID NO: 3188744 - RNA, 14 nt, Human
auuuacuucuuaua

SEQ ID NO: 3188745 - RNA, 21 nt, Human
auuuagaaaagugaauugaag

SEQ ID NO: 3188746 - RNA, 21 nt, Human
auuuacugcuagucuuaagaa

SEQ ID NO: 3188747 - RNA, 21 nt, Human
auuuacugcauucuucugauc

SEQ ID NO: 3188748 - RNA, 17 nt, Human
auuuacugcauucuucu

SEQ ID NO: 3188749 - RNA, 15 nt, Human
auuuaaaaagcccaa

SEQ ID NO: 3188750 - RNA, 20 nt, Human
auuuaaaaacaaaaggcaau

SEQ ID NO: 3188751 - RNA, 18 nt, Human
auuuaaaaagcccaaccu

SEQ ID NO: 3188752 - RNA, 16 nt, Human
auuuaaaaagcccaac

SEQ ID NO: 3188753 - RNA, 19 nt, Human
auuuaaaaagcccaaccuc

SEQ ID NO: 3188754 - RNA, 21 nt, Human
auuuaaaaagguuuaaaacua

SEQ ID NO: 3188755 - RNA, 16 nt, Human
auuuaaauuuaaguaa

SEQ ID NO: 3188756 - RNA, 14 nt, Human
auuuauucugcuca

SEQ ID NO: 3188757 - RNA, 13 nt, Human
auugugauguguc

SEQ ID NO: 3188758 - RNA, 14 nt, Human
auugugaugugucc

SEQ ID NO: 3188759 - RNA, 15 nt, Human
auugugauguguccu

SEQ ID NO: 3188760 - RNA, 17 nt, Human
auugugaauaaugauuu

SEQ ID NO: 3188761 - RNA, 17 nt, Human
auuguccccgacccuug

SEQ ID NO: 3188762 - RNA, 23 nt, Human
auuguccagagcugcuuccccgu

SEQ ID NO: 3188763 - RNA, 19 nt, Human
auuguccagagcugcuucc

SEQ ID NO: 3188764 - RNA, 13 nt, Human
auuguccagagcu

SEQ ID NO: 3188765 - RNA, 19 nt, Human
auuguccccgacccuugcc

SEQ ID NO: 3188766 - RNA, 20 nt, Human
auuguccccgacccuugccg

SEQ ID NO: 3188767 - RNA, 13 nt, Human
auuguauuguuag

SEQ ID NO: 3188768 - RNA, 12 nt, Human
auugguguugac

SEQ ID NO: 3188769 - RNA, 19 nt, Human
auugguguaagguacuuuc

SEQ ID NO: 3188770 - RNA, 18 nt, Human
auuggucuaucuacuggc

SEQ ID NO: 3188771 - RNA, 17 nt, Human
auuggugaguuaggaac

SEQ ID NO: 3188772 - RNA, 18 nt, Human
auugugucucuugguccu

SEQ ID NO: 3188773 - RNA, 14 nt, Human
auuuaaaaaaaauc

SEQ ID NO: 3188774 - RNA, 14 nt, Human
auugugucucuugg

SEQ ID NO: 3188775 - RNA, 21 nt, Human
auucuguuggccagugugaca

SEQ ID NO: 3188776 - RNA, 23 nt, Human
auucugucuucauccccucagaa

SEQ ID NO: 3188777 - RNA, 19 nt, Human
auucuguuuuuaaaaauua

SEQ ID NO: 3188778 - RNA, 15 nt, Human
auucugggaauguau

SEQ ID NO: 3188779 - RNA, 19 nt, Human
auucugggaauguauagua

SEQ ID NO: 3188780 - RNA, 22 nt, Human
auucugggaauguauaguauuu

SEQ ID NO: 3188781 - RNA, 22 nt, Human
auucugggcaccacaaaauaua

SEQ ID NO: 3188782 - RNA, 24 nt, Human
auucugggcaccacaaaauauaca

SEQ ID NO: 3188783 - RNA, 22 nt, Human
auucuggggaaacaacauuuau

SEQ ID NO: 3188784 - RNA, 17 nt, Human
auucugggaauguauag

SEQ ID NO: 3188785 - RNA, 16 nt, Human
auucugggaauguaua

SEQ ID NO: 3188786 - RNA, 14 nt, Human
auucugauuucuuu

SEQ ID NO: 3188787 - RNA, 20 nt, Human
auucugauuucuuuucacca

SEQ ID NO: 3188788 - RNA, 10 nt, Human
auucuucaaa

SEQ ID NO: 3188789 - RNA, 23 nt, Human
auucuuauuccauauuagaaaac

SEQ ID NO: 3188790 - RNA, 18 nt, Human
auucuuauuuaaugaaag

SEQ ID NO: 3188791 - RNA, 14 nt, Human
auucuuauuuaaug

SEQ ID NO: 3188792 - RNA, 13 nt, Human
auucuuauuuaau

SEQ ID NO: 3188793 - RNA, 13 nt, Human
auucuuauuacua

SEQ ID NO: 3188794 - RNA, 13 nt, Human
auucuuauuccau

SEQ ID NO: 3188795 - RNA, 22 nt, Human
auucuuauuccauauuagaaaa

SEQ ID NO: 3188796 - RNA, 21 nt, Human
auucuuauuccauauuagaaa

SEQ ID NO: 3188797 - RNA, 22 nt, Human
auucuuccucccucccucuuuc

SEQ ID NO: 3188798 - RNA, 13 nt, Human
auucuuccucccu

SEQ ID NO: 3188799 - RNA, 13 nt, Human
auucuucuccacu

SEQ ID NO: 3188800 - RNA, 21 nt, Human
auucuuugcacuuuuucuuaa

SEQ ID NO: 3188801 - RNA, 17 nt, Human
auucuuuguuaauuugg

SEQ ID NO: 3188802 - RNA, 15 nt, Human
auucuuugcaaaaau

SEQ ID NO: 3188803 - RNA, 21 nt, Human
auucuuuggaguuaaaaugca

SEQ ID NO: 3188804 - RNA, 14 nt, Human
auucuuuuaaauua

SEQ ID NO: 3188805 - RNA, 18 nt, Human
auucuuuuaaauuagaaa

SEQ ID NO: 3188806 - RNA, 19 nt, Human
auucuuuuaaauuagaaaa

SEQ ID NO: 3188807 - RNA, 23 nt, Human
auucuuuuaaauuagaaaauauu

SEQ ID NO: 3188808 - RNA, 18 nt, Human
auucuuuucugaaguugu

SEQ ID NO: 3188809 - RNA, 21 nt, Human
auuggguggggggcuucauac

SEQ ID NO: 3188810 - RNA, 20 nt, Human
auuggguggggggcuucaua

SEQ ID NO: 3188811 - RNA, 15 nt, Human
auugggccccugcca

SEQ ID NO: 3188812 - RNA, 16 nt, Human
auugggccccugccag

SEQ ID NO: 3188813 - RNA, 18 nt, Human
auugacccacaagaaaug

SEQ ID NO: 3188814 - RNA, 18 nt, Human
auugacaggauuauugga

SEQ ID NO: 3188815 - RNA, 17 nt, Human
auugacaggcgaaagaa

SEQ ID NO: 3188816 - RNA, 15 nt, Human
auugaaaaaccauuu

SEQ ID NO: 3188817 - RNA, 16 nt, Human
auucuuuuucuuuuuu

SEQ ID NO: 3188818 - RNA, 22 nt, Human
auucuuuuucuuuuuuaaauua

SEQ ID NO: 3188819 - RNA, 20 nt, Human
auugaaaagaaguagugucu

SEQ ID NO: 3188820 - RNA, 12 nt, Human
auugaaaaguac

SEQ ID NO: 3188821 - RNA, 13 nt, Human
auugaaagaaugu

SEQ ID NO: 3188822 - RNA, 17 nt, Human
auugaaagaauguaaag

SEQ ID NO: 3188823 - RNA, 14 nt, Human
auugaaagaaugua

SEQ ID NO: 3188824 - RNA, 20 nt, Human
auugaaagaauguaaagcaa

SEQ ID NO: 3188825 - RNA, 18 nt, Human
auugaaagaauguaaagc

SEQ ID NO: 3188826 - RNA, 21 nt, Human
auugaaaaguuauuucccuuu

SEQ ID NO: 3188827 - RNA, 20 nt, Human
auugaaaauuauuaaucaga

SEQ ID NO: 3188828 - RNA, 22 nt, Human
auugaaaauuauuaaucagaag

SEQ ID NO: 3188829 - RNA, 16 nt, Human
auugaaaauugaaaag

SEQ ID NO: 3188830 - RNA, 18 nt, Human
auugaaaauugaaaagua

SEQ ID NO: 3188831 - RNA, 18 nt, Human
auuuuauuuuuagaauuu

SEQ ID NO: 3188832 - RNA, 23 nt, Human
auuuuagcaaagcggguuauaau

SEQ ID NO: 3188833 - RNA, 11 nt, Human
auuuuauucuu

SEQ ID NO: 3188834 - RNA, 15 nt, Human
auuuuauuuuuagaa

SEQ ID NO: 3188835 - RNA, 14 nt, Human
auuuuauucuugau

SEQ ID NO: 3188836 - RNA, 13 nt, Human
auuuuauucuuga

SEQ ID NO: 3188837 - RNA, 12 nt, Human
auuuuauucuug

SEQ ID NO: 3188838 - RNA, 13 nt, Human
auuuuagaaauau

SEQ ID NO: 3188839 - RNA, 15 nt, Human
auuuuagaaauauuc

SEQ ID NO: 3188840 - RNA, 17 nt, Human
auuuuagaaauauucac

SEQ ID NO: 3188841 - RNA, 20 nt, Human
auuuucaagacugaauucca

SEQ ID NO: 3188842 - RNA, 20 nt, Human
auuuucaacgcagcccugcu

SEQ ID NO: 3188843 - RNA, 18 nt, Human
auuuucaacgcagcccug

SEQ ID NO: 3188844 - RNA, 14 nt, Human
auuuucaaugugau

SEQ ID NO: 3188845 - RNA, 13 nt, Human
auuuucagauuug

SEQ ID NO: 3188846 - RNA, 12 nt, Human
auuuucagauuu

SEQ ID NO: 3188847 - RNA, 13 nt, Human
auuuucagauuca

SEQ ID NO: 3188848 - RNA, 20 nt, Human
auuuucagauuugcacaaaa

SEQ ID NO: 3188849 - RNA, 18 nt, Human
auuuucagcaugaaaaug

SEQ ID NO: 3188850 - RNA, 23 nt, Human
auuuucagcaugaaaaugugugu

SEQ ID NO: 3188851 - RNA, 19 nt, Human
auuuucagauuugcacaaa

SEQ ID NO: 3188852 - RNA, 18 nt, Human
auuuucagauuugcacaa

SEQ ID NO: 3188853 - RNA, 17 nt, Human
auuuucagauuugcaca

SEQ ID NO: 3188854 - RNA, 16 nt, Human
auuuucagauuugcac

SEQ ID NO: 3188855 - RNA, 15 nt, Human
auuuucagauuugca

SEQ ID NO: 3188856 - RNA, 14 nt, Human
auuuucagauuugc

SEQ ID NO: 3188857 - RNA, 20 nt, Human
auuuucagucaaaacuuuaa

SEQ ID NO: 3188858 - RNA, 18 nt, Human
auuuuccaucuaaaaaua

SEQ ID NO: 3188859 - RNA, 15 nt, Human
auuuuccaucuaaaa

SEQ ID NO: 3188860 - RNA, 16 nt, Human
auuuucauuagcaaaa

SEQ ID NO: 3188861 - RNA, 15 nt, Human
auuuucauuagcaaa

SEQ ID NO: 3188862 - RNA, 14 nt, Human
auuuucauuagcaa

SEQ ID NO: 3188863 - RNA, 13 nt, Human
auuuucauuagca

SEQ ID NO: 3188864 - RNA, 17 nt, Human
auuuucauuuuacaguu

SEQ ID NO: 3188865 - RNA, 14 nt, Human
auuuucauuuuaca

SEQ ID NO: 3188866 - RNA, 22 nt, Human
auuuucauuagcaaaaaaaguu

SEQ ID NO: 3188867 - RNA, 17 nt, Human
auuuucauuagcaaaaa

SEQ ID NO: 3188868 - RNA, 16 nt, Human
auuugaagacuucaaa

SEQ ID NO: 3188869 - RNA, 17 nt, Human
auuugaagacuucaaaa

SEQ ID NO: 3188870 - RNA, 12 nt, Human
auuuuaaaaaag

SEQ ID NO: 3188871 - RNA, 13 nt, Human
auuuuaaaaaagg

SEQ ID NO: 3188872 - RNA, 14 nt, Human
auuuuaaaaaaggg

SEQ ID NO: 3188873 - RNA, 23 nt, Human
auuuuaaaaaguccauaccuuau

SEQ ID NO: 3188874 - RNA, 22 nt, Human
auuuuaaaauguacauguauua

SEQ ID NO: 3188875 - RNA, 13 nt, Human
auuuuaaaauuuc

SEQ ID NO: 3188876 - RNA, 14 nt, Human
auuuuaaaauuuca

SEQ ID NO: 3188877 - RNA, 15 nt, Human
auuuuaaaauuucau

SEQ ID NO: 3188878 - RNA, 16 nt, Human
auuuuaaaauuucaua

SEQ ID NO: 3188879 - RNA, 15 nt, Human
auuuuaaacagagga

SEQ ID NO: 3188880 - RNA, 15 nt, Human
auuuuaauucaguug

SEQ ID NO: 3188881 - RNA, 16 nt, Human
auuuuaauguaauuga

SEQ ID NO: 3188882 - RNA, 21 nt, Human
auuuuacuuuaaaaggagcca

SEQ ID NO: 3188883 - RNA, 21 nt, Human
auuuuaccaucacacauguuc

SEQ ID NO: 3188884 - RNA, 14 nt, Human
auucaggaagcuca

SEQ ID NO: 3188885 - RNA, 19 nt, Human
auucagacagcugccuggg

SEQ ID NO: 3188886 - RNA, 17 nt, Human
auucaggaagcucaggg

SEQ ID NO: 3188887 - RNA, 19 nt, Human
auucaggaagcucagggcc

SEQ ID NO: 3188888 - RNA, 19 nt, Human
auucaguaauaacucuacc

SEQ ID NO: 3188889 - RNA, 15 nt, Human
auucaguaauaacuc

SEQ ID NO: 3188890 - RNA, 15 nt, Human
auucccaagcucugc

SEQ ID NO: 3188891 - RNA, 14 nt, Human
auucccaagcucug

SEQ ID NO: 3188892 - RNA, 16 nt, Human
auucccaagcucugcu

SEQ ID NO: 3188893 - RNA, 18 nt, Human
auucccucgucuuuccca

SEQ ID NO: 3188894 - RNA, 17 nt, Human
auucccucgucuuuccc

SEQ ID NO: 3188895 - RNA, 13 nt, Human
auuccaaauucau

SEQ ID NO: 3188896 - RNA, 16 nt, Human
auuccagguuuaagua

SEQ ID NO: 3188897 - RNA, 23 nt, Human
auuccauauuagaaaacuuuguu

SEQ ID NO: 3188898 - RNA, 22 nt, Human
auuccauauuagaaaacuuugu

SEQ ID NO: 3188899 - RNA, 21 nt, Human
auuccauauuagaaaacuuug

SEQ ID NO: 3188900 - RNA, 20 nt, Human
auuccauauuagaaaacuuu

SEQ ID NO: 3188901 - RNA, 19 nt, Human
auuccauauuagaaaacuu

SEQ ID NO: 3188902 - RNA, 15 nt, Human
auuccauauuagaaa

SEQ ID NO: 3188903 - RNA, 20 nt, Human
auuccagucaggcucucugg

SEQ ID NO: 3188904 - RNA, 17 nt, Human
auucucccgggacucug

SEQ ID NO: 3188905 - RNA, 23 nt, Human
auucucccgggacucugcauauu

SEQ ID NO: 3188906 - RNA, 18 nt, Human
auucucccgggacucugc

SEQ ID NO: 3188907 - RNA, 18 nt, Human
auucuccaccugccaggg

SEQ ID NO: 3188908 - RNA, 18 nt, Human
auucucaguuuuucuuaa

SEQ ID NO: 3188909 - RNA, 14 nt, Human
auucucaguuuuuc

SEQ ID NO: 3188910 - RNA, 21 nt, Human
auucuccagggguuuacagug

SEQ ID NO: 3188911 - RNA, 21 nt, Human
auucuccaccugccagggaca

SEQ ID NO: 3188912 - RNA, 13 nt, Human
auucuccugccuc

SEQ ID NO: 3188913 - RNA, 14 nt, Human
auucuccugccuca

SEQ ID NO: 3188914 - RNA, 11 nt, Human
auucuccugcc

SEQ ID NO: 3188915 - RNA, 12 nt, Human
auucuccugccu

SEQ ID NO: 3188916 - RNA, 17 nt, Human
auucuccugccucagcc

SEQ ID NO: 3188917 - RNA, 15 nt, Human
auucuccugccucag

SEQ ID NO: 3188918 - RNA, 19 nt, Human
auucuccugccucagccuc

SEQ ID NO: 3188919 - RNA, 20 nt, Human
auucuccugccucagccucc

SEQ ID NO: 3188920 - RNA, 19 nt, Human
auucuccaccugccaggga

SEQ ID NO: 3188921 - RNA, 20 nt, Human
auucuccaccugccagggac

SEQ ID NO: 3188922 - RNA, 14 nt, Human
auucucaugccuca

SEQ ID NO: 3188923 - RNA, 15 nt, Human
auucucaugccucag

SEQ ID NO: 3188924 - RNA, 13 nt, Human
auucucaguuuuu

SEQ ID NO: 3188925 - RNA, 21 nt, Human
auucucaagggacguccucca

SEQ ID NO: 3188926 - RNA, 21 nt, Human
auucuauuucaacuucaggaa

SEQ ID NO: 3188927 - RNA, 12 nt, Human
auucuauuucaa

SEQ ID NO: 3188928 - RNA, 13 nt, Human
auucuauuuuaca

SEQ ID NO: 3188929 - RNA, 17 nt, Human
auucuauggagcuauuu

SEQ ID NO: 3188930 - RNA, 15 nt, Human
auucuaucuacugau

SEQ ID NO: 3188931 - RNA, 17 nt, Human
auucuaucuacugauuu

SEQ ID NO: 3188932 - RNA, 12 nt, Human
auucuaaagaua

SEQ ID NO: 3188933 - RNA, 23 nt, Human
uuuugagucuuuuuuuuuuaagu

SEQ ID NO: 3188934 - RNA, 17 nt, Human
uuuugauccaagcuggu

SEQ ID NO: 3188935 - RNA, 15 nt, Human
uuuugauaguugugu

SEQ ID NO: 3188936 - RNA, 19 nt, Human
uuuugauagcauuguaagc

SEQ ID NO: 3188937 - RNA, 17 nt, Human
uuuugagugccuuacac

SEQ ID NO: 3188938 - RNA, 16 nt, Human
uuuugagcccuuguuu

SEQ ID NO: 3188939 - RNA, 19 nt, Human
uuuugagcgacaucucuga

SEQ ID NO: 3188940 - RNA, 21 nt, Human
uuuugagcuacuggauucuua

SEQ ID NO: 3188941 - RNA, 22 nt, Human
auuaagcaugacagaaaauaug

SEQ ID NO: 3188942 - RNA, 18 nt, Human
auuaagcccacaguauau

SEQ ID NO: 3188943 - RNA, 19 nt, Human
auuaagcccacaguauauu

SEQ ID NO: 3188944 - RNA, 20 nt, Human
auuaagcaugacagaaaaua

SEQ ID NO: 3188945 - RNA, 18 nt, Human
auuaagauuauaauuguu

SEQ ID NO: 3188946 - RNA, 17 nt, Human
auuaagauuauaauugu

SEQ ID NO: 3188947 - RNA, 16 nt, Human
auuaagauuauaauug

SEQ ID NO: 3188948 - RNA, 15 nt, Human
auuaagauuauaauu

SEQ ID NO: 3188949 - RNA, 13 nt, Human
auuaagauuauaa

SEQ ID NO: 3188950 - RNA, 16 nt, Human
auuaaagaaauaauuu

SEQ ID NO: 3188951 - RNA, 19 nt, Human
auuaaagaaauaauuuuau

SEQ ID NO: 3188952 - RNA, 23 nt, Human
uuuugccauguuggccaggcugg

SEQ ID NO: 3188953 - RNA, 13 nt, Human
uuuugccagccca

SEQ ID NO: 3188954 - RNA, 21 nt, Human
uuuugcauaguucuagugcag

SEQ ID NO: 3188955 - RNA, 13 nt, Human
uuuugcaggagca

SEQ ID NO: 3188956 - RNA, 18 nt, Human
uuuugcaagguaaaauuu

SEQ ID NO: 3188957 - RNA, 17 nt, Human
uuuugcaagguaaaauu

SEQ ID NO: 3188958 - RNA, 21 nt, Human
uuuugcaagguaaaauuuuag

SEQ ID NO: 3188959 - RNA, 16 nt, Human
uuuugauguaaagaug

SEQ ID NO: 3188960 - RNA, 18 nt, Human
uuuugauguaaagauguu

SEQ ID NO: 3188961 - RNA, 14 nt, Human
uuuugaucucacau

SEQ ID NO: 3188962 - RNA, 21 nt, Human
uuuugugaugucccaacuugu

SEQ ID NO: 3188963 - RNA, 22 nt, Human
uuuugcucuaaaauauuuauga

SEQ ID NO: 3188964 - RNA, 16 nt, Human
uuuugcucuaaaauau

SEQ ID NO: 3188965 - RNA, 15 nt, Human
uuuugcucuaaaaua

SEQ ID NO: 3188966 - RNA, 13 nt, Human
uuuugcucuaaaa

SEQ ID NO: 3188967 - RNA, 22 nt, Human
uuuugcuaaguaaaucucuucu

SEQ ID NO: 3188968 - RNA, 24 nt, Human
uuuuguucauuucauccuuucacu

SEQ ID NO: 3188969 - RNA, 15 nt, Human
uuuuguuccacaagu

SEQ ID NO: 3188970 - RNA, 18 nt, Human
uuuuuaucuauauaaaau

SEQ ID NO: 3188971 - RNA, 22 nt, Human
uuuuuaucuauauaaaauaacu

SEQ ID NO: 3188972 - RNA, 22 nt, Human
uuuuuaguaaguuaauguauau

SEQ ID NO: 3188973 - RNA, 20 nt, Human
uuuuuagaugugcugcuuug

SEQ ID NO: 3188974 - RNA, 19 nt, Human
uuuuuagauugagaaaugu

SEQ ID NO: 3188975 - RNA, 20 nt, Human
uuuuuagauugagaaaugug

SEQ ID NO: 3188976 - RNA, 12 nt, Human
uuuuuauaaaaa

SEQ ID NO: 3188977 - RNA, 23 nt, Human
uuuuuauaacaucuuuauugaaa

SEQ ID NO: 3188978 - RNA, 22 nt, Human
uuuuuagacagagucucacugu

SEQ ID NO: 3188979 - RNA, 12 nt, Human
uuuuuagaauuu

SEQ ID NO: 3188980 - RNA, 20 nt, Human
auuauauacauacugcaucu

SEQ ID NO: 3188981 - RNA, 13 nt, Human
auuagucccuggc

SEQ ID NO: 3188982 - RNA, 21 nt, Human
auuaguacuuuauagaagaau

SEQ ID NO: 3188983 - RNA, 18 nt, Human
auuaguacuuuauagaag

SEQ ID NO: 3188984 - RNA, 14 nt, Human
auuacuagaguugg

SEQ ID NO: 3188985 - RNA, 21 nt, Human
auuacuagacugccacaagga

SEQ ID NO: 3188986 - RNA, 17 nt, Human
auuacgaaguucaagau

SEQ ID NO: 3188987 - RNA, 22 nt, Human
auuacgaaguucaagaucaaaa

SEQ ID NO: 3188988 - RNA, 18 nt, Human
auuacguacuaaggauac

SEQ ID NO: 3188989 - RNA, 22 nt, Human
auuacuaacuucuaaaacugua

SEQ ID NO: 3188990 - RNA, 21 nt, Human
auuacuaacuucuaaaacugu

SEQ ID NO: 3188991 - RNA, 16 nt, Human
auuacuaacuucuaaa

SEQ ID NO: 3188992 - RNA, 15 nt, Human
auuacuaacuucuaa

SEQ ID NO: 3188993 - RNA, 14 nt, Human
auuacuaacuucua

SEQ ID NO: 3188994 - RNA, 12 nt, Human
auuacuaacuuc

SEQ ID NO: 3188995 - RNA, 20 nt, Human
uuuuuguagagccagggucu

SEQ ID NO: 3188996 - RNA, 19 nt, Human
uuuuuguagagccaggguc

SEQ ID NO: 3188997 - RNA, 12 nt, Human
uuuuuaugugug

SEQ ID NO: 3188998 - RNA, 15 nt, Human
uuuuuauuaaucacu

SEQ ID NO: 3188999 - RNA, 19 nt, Human
uuuuuauuaaucacugugu

SEQ ID NO: 3189000 - RNA, 21 nt, Human
uuuuuauuaaucacuguguau

SEQ ID NO: 3189001 - RNA, 12 nt, Human
auuaccagggac

SEQ ID NO: 3189002 - RNA, 14 nt, Human
auuaccauuuguua

SEQ ID NO: 3189003 - RNA, 19 nt, Human
auuaccauuuguuaauauc

SEQ ID NO: 3189004 - RNA, 21 nt, Human
auuaauacucuauuuuuacau

SEQ ID NO: 3189005 - RNA, 15 nt, Human
auuacauaauuuagu

SEQ ID NO: 3189006 - RNA, 22 nt, Human
auuacauaauuuaguuguuucu

SEQ ID NO: 3189007 - RNA, 23 nt, Human
auuacauaauuuaguuguuucua

SEQ ID NO: 3189008 - RNA, 14 nt, Human
auuaaguacuaugu

SEQ ID NO: 3189009 - RNA, 12 nt, Human
auuaauaaaaag

SEQ ID NO: 3189010 - RNA, 13 nt, Human
auuaauaaaaaga

SEQ ID NO: 3189011 - RNA, 22 nt, Human
auguggaagugugggucugugu

SEQ ID NO: 3189012 - RNA, 23 nt, Human
auguggaagugugggucugugug

SEQ ID NO: 3189013 - RNA, 15 nt, Human
auguggaaguguggg

SEQ ID NO: 3189014 - RNA, 16 nt, Human
auguggaagugugggu

SEQ ID NO: 3189015 - RNA, 13 nt, Human
auguggaagugug

SEQ ID NO: 3189016 - RNA, 20 nt, Human
auguggaguucaucuugaau

SEQ ID NO: 3189017 - RNA, 19 nt, Human
auguggagucagccucgca

SEQ ID NO: 3189018 - RNA, 16 nt, Human
auguggacuuaggaag

SEQ ID NO: 3189019 - RNA, 17 nt, Human
auguggacuuaggaagg

SEQ ID NO: 3189020 - RNA, 24 nt, Human
auguggaguucaucuugaauugua

SEQ ID NO: 3189021 - RNA, 10 nt, Human
augugugugu

SEQ ID NO: 3189022 - RNA, 12 nt, Human
augugugugugc

SEQ ID NO: 3189023 - RNA, 19 nt, Human
augugugugaugugacauu

SEQ ID NO: 3189024 - RNA, 18 nt, Human
augugugugaugugacau

SEQ ID NO: 3189025 - RNA, 20 nt, Human
augugugugaugugacauuu

SEQ ID NO: 3189026 - RNA, 16 nt, Human
uuuuaaguuugcacuc

SEQ ID NO: 3189027 - RNA, 15 nt, Human
uuuuaaguuugcacu

SEQ ID NO: 3189028 - RNA, 13 nt, Human
uuuuaaguuugca

SEQ ID NO: 3189029 - RNA, 20 nt, Human
auggggcccugccuccuuug

SEQ ID NO: 3189030 - RNA, 19 nt, Human
auggggcugacagcacuaa

SEQ ID NO: 3189031 - RNA, 18 nt, Human
augugccuaaauaaguua

SEQ ID NO: 3189032 - RNA, 14 nt, Human
augugccuaaauaa

SEQ ID NO: 3189033 - RNA, 17 nt, Human
augugccuuauguugaa

SEQ ID NO: 3189034 - RNA, 21 nt, Human
augugccuuauguugaaaaaa

SEQ ID NO: 3189035 - RNA, 23 nt, Human
augugccugcuucagccucccac

SEQ ID NO: 3189036 - RNA, 15 nt, Human
augugccugcuucag

SEQ ID NO: 3189037 - RNA, 22 nt, Human
augugccagguuuuuggucuga

SEQ ID NO: 3189038 - RNA, 21 nt, Human
augugccagguuuuuggucug

SEQ ID NO: 3189039 - RNA, 13 nt, Human
auguguucuuauu

SEQ ID NO: 3189040 - RNA, 13 nt, Human
auguguugccacu

SEQ ID NO: 3189041 - RNA, 19 nt, Human
auguguugccacuuuccaa

SEQ ID NO: 3189042 - RNA, 13 nt, Human
auguguuaaucuu

SEQ ID NO: 3189043 - RNA, 14 nt, Human
auguguuaaucuua

SEQ ID NO: 3189044 - RNA, 17 nt, Human
auguguuaaucuuaaug

SEQ ID NO: 3189045 - RNA, 20 nt, Human
auguguuaaucuuaauguau

SEQ ID NO: 3189046 - RNA, 22 nt, Human
auguguuaaucuuaauguauau

SEQ ID NO: 3189047 - RNA, 11 nt, Human
auguguuuaga

SEQ ID NO: 3189048 - RNA, 14 nt, Human
auguuaaaauaaau

SEQ ID NO: 3189049 - RNA, 18 nt, Human
auguuaaaauaaaugguu

SEQ ID NO: 3189050 - RNA, 19 nt, Human
auguuaauugauagaauaa

SEQ ID NO: 3189051 - RNA, 20 nt, Human
auguugcccaggcaggucuu

SEQ ID NO: 3189052 - RNA, 13 nt, Human
uuuuacuuggaaa

SEQ ID NO: 3189053 - RNA, 18 nt, Human
uuuuagaaacaauaugga

SEQ ID NO: 3189054 - RNA, 22 nt, Human
uuuuacuuuuuuuuuauuuuau

SEQ ID NO: 3189055 - RNA, 12 nt, Human
uuuuacuuuuuu

SEQ ID NO: 3189056 - RNA, 16 nt, Human
uuuuacuuuuuuuagu

SEQ ID NO: 3189057 - RNA, 17 nt, Human
uuuuacuuuuuuuagua

SEQ ID NO: 3189058 - RNA, 17 nt, Human
uuuuagaaauauucaca

SEQ ID NO: 3189059 - RNA, 16 nt, Human
auguugccaaaauggu

SEQ ID NO: 3189060 - RNA, 12 nt, Human
auguugcccagg

SEQ ID NO: 3189061 - RNA, 17 nt, Human
auguugcccaggcaggu

SEQ ID NO: 3189062 - RNA, 16 nt, Human
auguugcccaggcagg

SEQ ID NO: 3189063 - RNA, 22 nt, Human
auguugccaaaaugguggccug

SEQ ID NO: 3189064 - RNA, 18 nt, Human
auguucaucaaugaauga

SEQ ID NO: 3189065 - RNA, 13 nt, Human
uuuuccaaaacaa

SEQ ID NO: 3189066 - RNA, 19 nt, Human
uuuuccaaaacaaaaagau

SEQ ID NO: 3189067 - RNA, 14 nt, Human
uuuucauugcugug

SEQ ID NO: 3189068 - RNA, 17 nt, Human
uuuucaugcuuuaucaa

SEQ ID NO: 3189069 - RNA, 13 nt, Human
uuuucauuuuaca

SEQ ID NO: 3189070 - RNA, 20 nt, Human
uuuucauuuaggugaggaag

SEQ ID NO: 3189071 - RNA, 16 nt, Human
uuuucaugcuuuauca

SEQ ID NO: 3189072 - RNA, 22 nt, Human
uuuucauauuuuaauuucaagc

SEQ ID NO: 3189073 - RNA, 19 nt, Human
uuuucauauuuuaauuuca

SEQ ID NO: 3189074 - RNA, 16 nt, Human
uuuucauauuuuaauu

SEQ ID NO: 3189075 - RNA, 15 nt, Human
uuuucauauuuuaau

SEQ ID NO: 3189076 - RNA, 17 nt, Human
uuuucugaaucuucuga

SEQ ID NO: 3189077 - RNA, 16 nt, Human
uuuucugaaucuucug

SEQ ID NO: 3189078 - RNA, 15 nt, Human
uuuucugaaucuucu

SEQ ID NO: 3189079 - RNA, 14 nt, Human
uuuucugaaguugu

SEQ ID NO: 3189080 - RNA, 18 nt, Human
uuuucugagaaagacuau

SEQ ID NO: 3189081 - RNA, 15 nt, Human
uuuucugagaaagac

SEQ ID NO: 3189082 - RNA, 18 nt, Human
uuuucugauauguuugua

SEQ ID NO: 3189083 - RNA, 15 nt, Human
uuuuaggcaaguuuu

SEQ ID NO: 3189084 - RNA, 16 nt, Human
uuuuauuuauauguau

SEQ ID NO: 3189085 - RNA, 14 nt, Human
uuuuauuuauaugu

SEQ ID NO: 3189086 - RNA, 14 nt, Human
uuuuauuucaaugu

SEQ ID NO: 3189087 - RNA, 18 nt, Human
uuuuauuucuccuuuugu

SEQ ID NO: 3189088 - RNA, 16 nt, Human
uuuuauuucuccuuuu

SEQ ID NO: 3189089 - RNA, 14 nt, Human
uuuuauuucuccuu

SEQ ID NO: 3189090 - RNA, 14 nt, Human
uuuucaguguacau

SEQ ID NO: 3189091 - RNA, 15 nt, Human
uuuucaguucaaagu

SEQ ID NO: 3189092 - RNA, 24 nt, Human
uuuucaguucaaagucaugauguu

SEQ ID NO: 3189093 - RNA, 23 nt, Human
uuuucaguucaaagucaugaugu

SEQ ID NO: 3189094 - RNA, 13 nt, Human
uuuucauaucauu

SEQ ID NO: 3189095 - RNA, 16 nt, Human
uuuucauaucauuucu

SEQ ID NO: 3189096 - RNA, 16 nt, Human
uuuucauaggaagaca

SEQ ID NO: 3189097 - RNA, 22 nt, Human
uuuucaguuuauuugaaccaau

SEQ ID NO: 3189098 - RNA, 19 nt, Human
uuuucauaagauauuuuau

SEQ ID NO: 3189099 - RNA, 17 nt, Human
uuuucauaagauauuuu

SEQ ID NO: 3189100 - RNA, 16 nt, Human
uuuucauaagauauuu

SEQ ID NO: 3189101 - RNA, 12 nt, Human
auguuuaaaaca

SEQ ID NO: 3189102 - RNA, 14 nt, Human
auguuuaaaacacc

SEQ ID NO: 3189103 - RNA, 16 nt, Human
auguuuaaaacaccuu

SEQ ID NO: 3189104 - RNA, 21 nt, Human
auguuuaaaacaccuucuaua

SEQ ID NO: 3189105 - RNA, 21 nt, Human
auguuguuuuguacagaugug

SEQ ID NO: 3189106 - RNA, 19 nt, Human
auguuguuuuguacagaug

SEQ ID NO: 3189107 - RNA, 18 nt, Human
auguuguuuuguacagau

SEQ ID NO: 3189108 - RNA, 17 nt, Human
auguuguuuuguacaga

SEQ ID NO: 3189109 - RNA, 15 nt, Human
auguuguuuuguaca

SEQ ID NO: 3189110 - RNA, 11 nt, Human
uuuucugugug

SEQ ID NO: 3189111 - RNA, 12 nt, Human
uuuucugugugu

SEQ ID NO: 3189112 - RNA, 10 nt, Human
uuuucugugu

SEQ ID NO: 3189113 - RNA, 15 nt, Human
uuuucuguguguucc

SEQ ID NO: 3189114 - RNA, 16 nt, Human
uuuucuguguguuccu

SEQ ID NO: 3189115 - RNA, 17 nt, Human
uuuucuguguguuccug

SEQ ID NO: 3189116 - RNA, 13 nt, Human
auguuuauguaaa

SEQ ID NO: 3189117 - RNA, 12 nt, Human
auguuuauguaa

SEQ ID NO: 3189118 - RNA, 22 nt, Human
auguuuaaaacaccuucuauag

SEQ ID NO: 3189119 - RNA, 21 nt, Human
auguuuauguaaacaaaucuu

SEQ ID NO: 3189120 - RNA, 23 nt, Human
auguuuauguaaacaaaucuuuc

SEQ ID NO: 3189121 - RNA, 13 nt, Human
auguuuauuaaau

SEQ ID NO: 3189122 - RNA, 17 nt, Human
auguuuauuaaaugcuu

SEQ ID NO: 3189123 - RNA, 19 nt, Human
auguuuauuaaaugcuuca

SEQ ID NO: 3189124 - RNA, 17 nt, Human
auguuuugguccacuuu

SEQ ID NO: 3189125 - RNA, 23 nt, Human
auguuuugguccacuuuuccagu

SEQ ID NO: 3189126 - RNA, 22 nt, Human
auguuuugguccacuuuuccag

SEQ ID NO: 3189127 - RNA, 23 nt, Human
auguuuugcauguaaaagccuag

SEQ ID NO: 3189128 - RNA, 23 nt, Human
auuaaaacacaacaucuuuuucu

SEQ ID NO: 3189129 - RNA, 12 nt, Human
auguuuuuaaaa

SEQ ID NO: 3189130 - RNA, 16 nt, Human
auguuuuguaaacuuu

SEQ ID NO: 3189131 - RNA, 15 nt, Human
auguuuuguaaacuu

SEQ ID NO: 3189132 - RNA, 21 nt, Human
auguuuuguaaacuuugaaau

SEQ ID NO: 3189133 - RNA, 20 nt, Human
auguuuuguaaacuuugaaa

SEQ ID NO: 3189134 - RNA, 18 nt, Human
auguuuuguaaacuuuga

SEQ ID NO: 3189135 - RNA, 17 nt, Human
auguuuuguaaacuuug

SEQ ID NO: 3189136 - RNA, 23 nt, Human
auuaaaagaaaauaaaaaaaaga

SEQ ID NO: 3189137 - RNA, 21 nt, Human
auuaaaaccugggauuauaua

SEQ ID NO: 3189138 - RNA, 13 nt, Human
auuaaacuguuaa

SEQ ID NO: 3189139 - RNA, 17 nt, Human
auuaaacuguuaacuua

SEQ ID NO: 3189140 - RNA, 17 nt, Human
auuaaacuuccaaagaa

SEQ ID NO: 3189141 - RNA, 21 nt, Human
auuaaacuuccaaagaaaguu

SEQ ID NO: 3189142 - RNA, 17 nt, Human
ugagagcugugcaucag

SEQ ID NO: 3189143 - RNA, 10 nt, Human
ugagaggaaa

SEQ ID NO: 3189144 - RNA, 14 nt, Human
ugagagcugggugu

SEQ ID NO: 3189145 - RNA, 15 nt, Human
ugagagcgcagcccg

SEQ ID NO: 3189146 - RNA, 16 nt, Human
ugagagcgcagcccgc

SEQ ID NO: 3189147 - RNA, 11 nt, Human
ugagaggaaau

SEQ ID NO: 3189148 - RNA, 12 nt, Human
ugagaggaaauc

SEQ ID NO: 3189149 - RNA, 13 nt, Human
ugagaggaaauca

SEQ ID NO: 3189150 - RNA, 14 nt, Human
ugagaggaaaucac

SEQ ID NO: 3189151 - RNA, 16 nt, Human
ugagagagauguguaa

SEQ ID NO: 3189152 - RNA, 14 nt, Human
ugagagagaugugu

SEQ ID NO: 3189153 - RNA, 21 nt, Human
ugagagaggcuaaaauguuuu

SEQ ID NO: 3189154 - RNA, 20 nt, Human
ugagagaggcuaaaauguuu

SEQ ID NO: 3189155 - RNA, 19 nt, Human
ugagagaggcuaaaauguu

SEQ ID NO: 3189156 - RNA, 18 nt, Human
ugagagaggcuaaaaugu

SEQ ID NO: 3189157 - RNA, 22 nt, Human
ugagagagauguguaauuuuuc

SEQ ID NO: 3189158 - RNA, 16 nt, Human
ugagagagcagccagg

SEQ ID NO: 3189159 - RNA, 17 nt, Human
ugagagagcagccagga

SEQ ID NO: 3189160 - RNA, 14 nt, Human
ugagagaugcugua

SEQ ID NO: 3189161 - RNA, 23 nt, Human
ugagagaugcuguagacaucugu

SEQ ID NO: 3189162 - RNA, 18 nt, Human
ugagagagagucuuacuc

SEQ ID NO: 3189163 - RNA, 13 nt, Human
ugagaugugaaca

SEQ ID NO: 3189164 - RNA, 20 nt, Human
ugagaugcuagaacucccuu

SEQ ID NO: 3189165 - RNA, 16 nt, Human
ugagaggacacucccg

SEQ ID NO: 3189166 - RNA, 17 nt, Human
ugagaggaaaucaccga

SEQ ID NO: 3189167 - RNA, 23 nt, Human
ugagaggacuuuucuuuguggcu

SEQ ID NO: 3189168 - RNA, 24 nt, Human
ugagaugugaacacaucagcuugc

SEQ ID NO: 3189169 - RNA, 22 nt, Human
ugagaugguaugcacaauucca

SEQ ID NO: 3189170 - RNA, 20 nt, Human
ugagaugguaugcacaauuc

SEQ ID NO: 3189171 - RNA, 15 nt, Human
ugagauguguaucag

SEQ ID NO: 3189172 - RNA, 17 nt, Human
ugagauguguaucagug

SEQ ID NO: 3189173 - RNA, 18 nt, Human
ugagauguguaucagugu

SEQ ID NO: 3189174 - RNA, 19 nt, Human
ugagauguguaucaguguu

SEQ ID NO: 3189175 - RNA, 20 nt, Human
ugagauguguaucaguguuu

SEQ ID NO: 3189176 - RNA, 19 nt, Human
ugagaugugaacacaucag

SEQ ID NO: 3189177 - RNA, 18 nt, Human
ugagaugugaacacauca

SEQ ID NO: 3189178 - RNA, 20 nt, Human
ugagaagcagaggaaggaga

SEQ ID NO: 3189179 - RNA, 13 nt, Human
ugagacagcccgg

SEQ ID NO: 3189180 - RNA, 21 nt, Human
ugagacagaguuuucacucuu

SEQ ID NO: 3189181 - RNA, 11 nt, Human
ugagacagagu

SEQ ID NO: 3189182 - RNA, 20 nt, Human
ugagacagaaucucgcucug

SEQ ID NO: 3189183 - RNA, 17 nt, Human
ugagaaugaacaaagac

SEQ ID NO: 3189184 - RNA, 15 nt, Human
ugagaaugaacaaag

SEQ ID NO: 3189185 - RNA, 14 nt, Human
ugagaaugaacaaa

SEQ ID NO: 3189186 - RNA, 13 nt, Human
ugagaaugaacaa

SEQ ID NO: 3189187 - RNA, 15 nt, Human
ugagacagcagucuu

SEQ ID NO: 3189188 - RNA, 20 nt, Human
ugagacucugucucagucca

SEQ ID NO: 3189189 - RNA, 20 nt, Human
ugagacucugucucaaaaaa

SEQ ID NO: 3189190 - RNA, 22 nt, Human
ugagacagcccgggcucugccu

SEQ ID NO: 3189191 - RNA, 17 nt, Human
ugagacagcccgggcuc

SEQ ID NO: 3189192 - RNA, 18 nt, Human
ugagacagcccgggcucu

SEQ ID NO: 3189193 - RNA, 19 nt, Human
ugagacagcccgggcucug

SEQ ID NO: 3189194 - RNA, 20 nt, Human
ugagacagcccgggcucugc

SEQ ID NO: 3189195 - RNA, 19 nt, Human
agcaaggucuugcucuccu

SEQ ID NO: 3189196 - RNA, 20 nt, Human
agcaaggucuugcucuccua

SEQ ID NO: 3189197 - RNA, 22 nt, Human
agcaagggugaugggaaagcau

SEQ ID NO: 3189198 - RNA, 20 nt, Human
agcaagggugaugggaaagc

SEQ ID NO: 3189199 - RNA, 16 nt, Human
agcaagugagagcugg

SEQ ID NO: 3189200 - RNA, 15 nt, Human
agcaagugagagcug

SEQ ID NO: 3189201 - RNA, 16 nt, Human
agcaagggugauggga

SEQ ID NO: 3189202 - RNA, 20 nt, Human
agcaaggcgcuaacuugcuu

SEQ ID NO: 3189203 - RNA, 17 nt, Human
agcaaggcgcuaacuug

SEQ ID NO: 3189204 - RNA, 12 nt, Human
agcaaggccacc

SEQ ID NO: 3189205 - RNA, 15 nt, Human
agcaaggccaccucu

SEQ ID NO: 3189206 - RNA, 14 nt, Human
agcaaggccaccuc

SEQ ID NO: 3189207 - RNA, 21 nt, Human
agcaaggccaccucuuccugg

SEQ ID NO: 3189208 - RNA, 19 nt, Human
agcaaggccaccucuuccu

SEQ ID NO: 3189209 - RNA, 22 nt, Human
agcaaggccaccucuuccuggc

SEQ ID NO: 3189210 - RNA, 16 nt, Human
agcaaggaagguaaaa

SEQ ID NO: 3189211 - RNA, 22 nt, Human
agcaaggaagguaaaaaguuaa

SEQ ID NO: 3189212 - RNA, 21 nt, Human
agcaaggaagguaaaaaguua

SEQ ID NO: 3189213 - RNA, 23 nt, Human
agcaagcuuuuacaacagugcug

SEQ ID NO: 3189214 - RNA, 22 nt, Human
agcaagcuuuuacaacagugcu

SEQ ID NO: 3189215 - RNA, 13 nt, Human
ugagccacugcac

SEQ ID NO: 3189216 - RNA, 12 nt, Human
ugagccacugca

SEQ ID NO: 3189217 - RNA, 14 nt, Human
ugagcauuagauuu

SEQ ID NO: 3189218 - RNA, 16 nt, Human
ugagcauuagauuucu

SEQ ID NO: 3189219 - RNA, 16 nt, Human
ugagcauuacaggcaa

SEQ ID NO: 3189220 - RNA, 18 nt, Human
ugagccagauuucacucu

SEQ ID NO: 3189221 - RNA, 19 nt, Human
ugagccagauuucacucuc

SEQ ID NO: 3189222 - RNA, 14 nt, Human
ugagccacugcacc

SEQ ID NO: 3189223 - RNA, 21 nt, Human
ugagccaccgugccuggccac

SEQ ID NO: 3189224 - RNA, 20 nt, Human
ugagccagauuucacucucc

SEQ ID NO: 3189225 - RNA, 16 nt, Human
agcaccuccugccucg

SEQ ID NO: 3189226 - RNA, 14 nt, Human
agcaccuccugccu

SEQ ID NO: 3189227 - RNA, 13 nt, Human
agcaccuccugcc

SEQ ID NO: 3189228 - RNA, 17 nt, Human
agcaccuagccucgcuc

SEQ ID NO: 3189229 - RNA, 16 nt, Human
agcaccaucucuccuc

SEQ ID NO: 3189230 - RNA, 16 nt, Human
agcaccauccccuccg

SEQ ID NO: 3189231 - RNA, 23 nt, Human
agcacccauccaccguccccucc

SEQ ID NO: 3189232 - RNA, 14 nt, Human
agcacccauuucaa

SEQ ID NO: 3189233 - RNA, 21 nt, Human
agcacccauuucaauguguau

SEQ ID NO: 3189234 - RNA, 23 nt, Human
agcacaugccucucucaggccaa

SEQ ID NO: 3189235 - RNA, 15 nt, Human
agcaccauccccucc

SEQ ID NO: 3189236 - RNA, 14 nt, Human
agcaccauccccuc

SEQ ID NO: 3189237 - RNA, 12 nt, Human
agcacccugagg

SEQ ID NO: 3189238 - RNA, 13 nt, Human
agcacccugaggg

SEQ ID NO: 3189239 - RNA, 14 nt, Human
agcacccugagggc

SEQ ID NO: 3189240 - RNA, 15 nt, Human
agcacccugagggcg

SEQ ID NO: 3189241 - RNA, 16 nt, Human
agcaccgaauauugag

SEQ ID NO: 3189242 - RNA, 18 nt, Human
agcaccgaauauugagca

SEQ ID NO: 3189243 - RNA, 18 nt, Human
agcaccgccucuucccgc

SEQ ID NO: 3189244 - RNA, 16 nt, Human
agcaccgccucuuccc

SEQ ID NO: 3189245 - RNA, 19 nt, Human
agcacaugccucucucagg

SEQ ID NO: 3189246 - RNA, 20 nt, Human
agcacaugccucucucaggc

SEQ ID NO: 3189247 - RNA, 21 nt, Human
agcacaugccucucucaggcc

SEQ ID NO: 3189248 - RNA, 22 nt, Human
agcacaugccucucucaggcca

SEQ ID NO: 3189249 - RNA, 18 nt, Human
agcacaugccucucucag

SEQ ID NO: 3189250 - RNA, 16 nt, Human
agcacaugccucucuc

SEQ ID NO: 3189251 - RNA, 23 nt, Human
agcacaggcugagugcaggccca

SEQ ID NO: 3189252 - RNA, 22 nt, Human
agcacaggcugagugcaggccc

SEQ ID NO: 3189253 - RNA, 21 nt, Human
agcacaggcugagugcaggcc

SEQ ID NO: 3189254 - RNA, 20 nt, Human
agcacaggcugagugcaggc

SEQ ID NO: 3189255 - RNA, 19 nt, Human
agcacaggcugagugcagg

SEQ ID NO: 3189256 - RNA, 12 nt, Human
agcacaggcuga

SEQ ID NO: 3189257 - RNA, 18 nt, Human
agcacaggcugagugcag

SEQ ID NO: 3189258 - RNA, 21 nt, Human
agcacagcuucauuuccugug

SEQ ID NO: 3189259 - RNA, 16 nt, Human
agcacagcuucauuuc

SEQ ID NO: 3189260 - RNA, 12 nt, Human
agcaauauguca

SEQ ID NO: 3189261 - RNA, 12 nt, Human
agcaauauucuu

SEQ ID NO: 3189262 - RNA, 13 nt, Human
agcaauaucugcu

SEQ ID NO: 3189263 - RNA, 21 nt, Human
agcaauauucuuggagauuga

SEQ ID NO: 3189264 - RNA, 13 nt, Human
agcaauauuguau

SEQ ID NO: 3189265 - RNA, 19 nt, Human
agcaauauuguauauuuuu

SEQ ID NO: 3189266 - RNA, 21 nt, Human
agcaauauuguauauuuuuau

SEQ ID NO: 3189267 - RNA, 17 nt, Human
agcaagugagagcuggg

SEQ ID NO: 3189268 - RNA, 16 nt, Human
agcaauaauuucugua

SEQ ID NO: 3189269 - RNA, 12 nt, Human
agcaauaauuuc

SEQ ID NO: 3189270 - RNA, 15 nt, Human
ugacagguuugggac

SEQ ID NO: 3189271 - RNA, 22 nt, Human
ugacagggcacaccgggcacuc

SEQ ID NO: 3189272 - RNA, 21 nt, Human
ugacagggcacaccgggcacu

SEQ ID NO: 3189273 - RNA, 19 nt, Human
ugacaggcaaugcuggcug

SEQ ID NO: 3189274 - RNA, 17 nt, Human
ugacaggcaaugcuggc

SEQ ID NO: 3189275 - RNA, 19 nt, Human
ugacagccccucccuccuc

SEQ ID NO: 3189276 - RNA, 11 nt, Human
ugacagccccu

SEQ ID NO: 3189277 - RNA, 14 nt, Human
ugacagccagaacu

SEQ ID NO: 3189278 - RNA, 13 nt, Human
ugacauguuuuau

SEQ ID NO: 3189279 - RNA, 13 nt, Human
ugacauuugucau

SEQ ID NO: 3189280 - RNA, 15 nt, Human
ugacauuugucauuu

SEQ ID NO: 3189281 - RNA, 14 nt, Human
ugacauuugucauu

SEQ ID NO: 3189282 - RNA, 19 nt, Human
ugacauuugucauuuucau

SEQ ID NO: 3189283 - RNA, 18 nt, Human
ugacauuugucauuuuca

SEQ ID NO: 3189284 - RNA, 17 nt, Human
ugacauuugucauuuuc

SEQ ID NO: 3189285 - RNA, 16 nt, Human
ugacauuugucauuuu

SEQ ID NO: 3189286 - RNA, 15 nt, Human
ugacacuuaaaaaug

SEQ ID NO: 3189287 - RNA, 22 nt, Human
ugacagagugagacucugucuc

SEQ ID NO: 3189288 - RNA, 22 nt, Human
ugacagcacuaaacuuggugcu

SEQ ID NO: 3189289 - RNA, 19 nt, Human
ugacacgaauauugcugau

SEQ ID NO: 3189290 - RNA, 16 nt, Human
ugacacgaauauugcu

SEQ ID NO: 3189291 - RNA, 21 nt, Human
agaugcuagaacucccuuuca

SEQ ID NO: 3189292 - RNA, 15 nt, Human
agaugcuagaacucc

SEQ ID NO: 3189293 - RNA, 14 nt, Human
agaugcauuuggaa

SEQ ID NO: 3189294 - RNA, 19 nt, Human
agaugcuagaacucccuuu

SEQ ID NO: 3189295 - RNA, 21 nt, Human
agaucucccacaugccagggg

SEQ ID NO: 3189296 - RNA, 13 nt, Human
agaucucaggucc

SEQ ID NO: 3189297 - RNA, 13 nt, Human
agaucuaaaaaua

SEQ ID NO: 3189298 - RNA, 20 nt, Human
agaucuaaaaauaacuguaa

SEQ ID NO: 3189299 - RNA, 22 nt, Human
ugacauuuguuugguuauagug

SEQ ID NO: 3189300 - RNA, 15 nt, Human
ugacauuuguuuggu

SEQ ID NO: 3189301 - RNA, 20 nt, Human
ugacauuugucauuuucauu

SEQ ID NO: 3189302 - RNA, 14 nt, Human
ugaccaaguauaaa

SEQ ID NO: 3189303 - RNA, 18 nt, Human
ugaccaaguauaaacuuu

SEQ ID NO: 3189304 - RNA, 14 nt, Human
agauccuaagaugu

SEQ ID NO: 3189305 - RNA, 16 nt, Human
agauccuaagaugugu

SEQ ID NO: 3189306 - RNA, 18 nt, Human
agauccccaagccuggca

SEQ ID NO: 3189307 - RNA, 12 nt, Human
ugaccuuucaau

SEQ ID NO: 3189308 - RNA, 15 nt, Human
ugaccuuuagguauu

SEQ ID NO: 3189309 - RNA, 16 nt, Human
ugaccuuuagguauua

SEQ ID NO: 3189310 - RNA, 21 nt, Human
ugaccuuguaauguaacugcu

SEQ ID NO: 3189311 - RNA, 18 nt, Human
ugaccuuguaauguaacu

SEQ ID NO: 3189312 - RNA, 16 nt, Human
ugacuauaaugccucu

SEQ ID NO: 3189313 - RNA, 21 nt, Human
ugacuguuuucucuugagagg

SEQ ID NO: 3189314 - RNA, 19 nt, Human
ugacuuaacauagccaaaa

SEQ ID NO: 3189315 - RNA, 20 nt, Human
ugacuuaacauagccaaaau

SEQ ID NO: 3189316 - RNA, 22 nt, Human
ugacuuaacauagccaaaaugu

SEQ ID NO: 3189317 - RNA, 19 nt, Human
ugacucuaguacugugaau

SEQ ID NO: 3189318 - RNA, 23 nt, Human
ugacucuaguacugugaauccag

SEQ ID NO: 3189319 - RNA, 15 nt, Human
ugacucuauaagcaa

SEQ ID NO: 3189320 - RNA, 16 nt, Human
ugacucuauaagcaaa

SEQ ID NO: 3189321 - RNA, 21 nt, Human
ugacucuauaagcaaauugcu

SEQ ID NO: 3189322 - RNA, 21 nt, Human
ugacucguauaugucucaggu

SEQ ID NO: 3189323 - RNA, 17 nt, Human
agaugugaacacaucag

SEQ ID NO: 3189324 - RNA, 22 nt, Human
agaugugaacacaucagcuugc

SEQ ID NO: 3189325 - RNA, 15 nt, Human
ugaccuuuaagagaa

SEQ ID NO: 3189326 - RNA, 16 nt, Human
ugaccuuguaauguaa

SEQ ID NO: 3189327 - RNA, 14 nt, Human
ugaccuuguaaugu

SEQ ID NO: 3189328 - RNA, 13 nt, Human
ugaccuuguaaug

SEQ ID NO: 3189329 - RNA, 12 nt, Human
ugaccuuguaau

SEQ ID NO: 3189330 - RNA, 20 nt, Human
ugaccuggaaggcccagcac

SEQ ID NO: 3189331 - RNA, 13 nt, Human
ugaccuggucagg

SEQ ID NO: 3189332 - RNA, 21 nt, Human
agauugugccccugcacucca

SEQ ID NO: 3189333 - RNA, 19 nt, Human
agauuccagagaguggcuc

SEQ ID NO: 3189334 - RNA, 22 nt, Human
agauuccagagaguggcuccuc

SEQ ID NO: 3189335 - RNA, 21 nt, Human
agauuccagagaguggcuccu

SEQ ID NO: 3189336 - RNA, 22 nt, Human
agauuguuuaucuagauguaaa

SEQ ID NO: 3189337 - RNA, 21 nt, Human
agauuguuuaucuagauguaa

SEQ ID NO: 3189338 - RNA, 20 nt, Human
agauuuaaacucugaauuua

SEQ ID NO: 3189339 - RNA, 19 nt, Human
agauuuaaacucugaauuu

SEQ ID NO: 3189340 - RNA, 19 nt, Human
agauuguuuaucuagaugu

SEQ ID NO: 3189341 - RNA, 18 nt, Human
agauuguuuaucuagaug

SEQ ID NO: 3189342 - RNA, 16 nt, Human
agauuguuuaucuaga

SEQ ID NO: 3189343 - RNA, 14 nt, Human
agauuguuuaucua

SEQ ID NO: 3189344 - RNA, 15 nt, Human
agauuguuauuaaau

SEQ ID NO: 3189345 - RNA, 16 nt, Human
agauuguuauuaaaug

SEQ ID NO: 3189346 - RNA, 17 nt, Human
agauuguuauuaaaugu

SEQ ID NO: 3189347 - RNA, 19 nt, Human
agauuucacucuccuuggu

SEQ ID NO: 3189348 - RNA, 17 nt, Human
agauuucacucuccuug

SEQ ID NO: 3189349 - RNA, 21 nt, Human
agauuuaaacucugaauuuau

SEQ ID NO: 3189350 - RNA, 15 nt, Human
agauuucauccagaa

SEQ ID NO: 3189351 - RNA, 22 nt, Human
agauuucauccagaagucaaca

SEQ ID NO: 3189352 - RNA, 20 nt, Human
agauuuuaaaacuucaucug

SEQ ID NO: 3189353 - RNA, 17 nt, Human
agauuaauacucuauuu

SEQ ID NO: 3189354 - RNA, 20 nt, Human
agauuaauacucuauuuuua

SEQ ID NO: 3189355 - RNA, 15 nt, Human
agauuaagaaauaga

SEQ ID NO: 3189356 - RNA, 14 nt, Human
agauuaagaaauag

SEQ ID NO: 3189357 - RNA, 13 nt, Human
ugacuuagaaucc

SEQ ID NO: 3189358 - RNA, 19 nt, Human
ugacuuagaaucccugugu

SEQ ID NO: 3189359 - RNA, 20 nt, Human
ugacuuagaaucccuguguu

SEQ ID NO: 3189360 - RNA, 21 nt, Human
ugacuuagaaucccuguguua

SEQ ID NO: 3189361 - RNA, 22 nt, Human
ugacuuagaaucccuguguuaa

SEQ ID NO: 3189362 - RNA, 23 nt, Human
ugacuuagaaucccuguguuaau

SEQ ID NO: 3189363 - RNA, 18 nt, Human
agauuauaauuguugcau

SEQ ID NO: 3189364 - RNA, 13 nt, Human
agauuauaauugu

SEQ ID NO: 3189365 - RNA, 16 nt, Human
agauucauauuuacuu

SEQ ID NO: 3189366 - RNA, 13 nt, Human
agauucauauuua

SEQ ID NO: 3189367 - RNA, 23 nt, Human
agauucacuuugacacuuuucau

SEQ ID NO: 3189368 - RNA, 14 nt, Human
agauucaggcauuu

SEQ ID NO: 3189369 - RNA, 22 nt, Human
ugaaacugagaugugaacacau

SEQ ID NO: 3189370 - RNA, 14 nt, Human
ugaaaauguguguu

SEQ ID NO: 3189371 - RNA, 18 nt, Human
ugaaaauaguuuauuuua

SEQ ID NO: 3189372 - RNA, 22 nt, Human
ugaaaauauuuguaucacaaau

SEQ ID NO: 3189373 - RNA, 21 nt, Human
ugaaaauauuuguaucacaaa

SEQ ID NO: 3189374 - RNA, 17 nt, Human
ugaaaauauuuguauca

SEQ ID NO: 3189375 - RNA, 12 nt, Human
ugaaaauaauug

SEQ ID NO: 3189376 - RNA, 17 nt, Human
ugaaaauaaugcuguuc

SEQ ID NO: 3189377 - RNA, 20 nt, Human
ugaaaauaagccaugagaau

SEQ ID NO: 3189378 - RNA, 19 nt, Human
ugaaaauaagccaugagaa

SEQ ID NO: 3189379 - RNA, 18 nt, Human
ugaaaauaagccaugaga

SEQ ID NO: 3189380 - RNA, 14 nt, Human
ugaaaauaagccau

SEQ ID NO: 3189381 - RNA, 16 nt, Human
ugaaaauaacugaauu

SEQ ID NO: 3189382 - RNA, 18 nt, Human
ugaaaauaacugaauuug

SEQ ID NO: 3189383 - RNA, 21 nt, Human
ugaaaauaacugaauuuggag

SEQ ID NO: 3189384 - RNA, 16 nt, Human
ucuuuuuuugugaugu

SEQ ID NO: 3189385 - RNA, 14 nt, Human
ucuuuuuuugugau

SEQ ID NO: 3189386 - RNA, 18 nt, Human
ugaaaaaaaaaaugcuga

SEQ ID NO: 3189387 - RNA, 23 nt, Human
ucuuuuuuuuuuaagugaaauuu

SEQ ID NO: 3189388 - RNA, 19 nt, Human
ucuuuuuuuuuuaagugaa

SEQ ID NO: 3189389 - RNA, 21 nt, Human
ugaaaaaaaaaaugcugaaca

SEQ ID NO: 3189390 - RNA, 20 nt, Human
ugaaaaaaaaaaugcugaac

SEQ ID NO: 3189391 - RNA, 18 nt, Human
agagaccaucccugaagg

SEQ ID NO: 3189392 - RNA, 19 nt, Human
agagaccaucccugaaggc

SEQ ID NO: 3189393 - RNA, 21 nt, Human
agagaccaucccugaaggccc

SEQ ID NO: 3189394 - RNA, 22 nt, Human
agagaccaucccugaaggcccc

SEQ ID NO: 3189395 - RNA, 23 nt, Human
agagaccaucccugaaggccccg

SEQ ID NO: 3189396 - RNA, 17 nt, Human
ugaaagaggaaugaagu

SEQ ID NO: 3189397 - RNA, 22 nt, Human
ugaaagacuguacaaaguagaa

SEQ ID NO: 3189398 - RNA, 19 nt, Human
ugaaagacuguacaaagua

SEQ ID NO: 3189399 - RNA, 18 nt, Human
ugaaagacuguacaaagu

SEQ ID NO: 3189400 - RNA, 15 nt, Human
ugaaagaaaacuuuu

SEQ ID NO: 3189401 - RNA, 15 nt, Human
ugaaacugcauuugu

SEQ ID NO: 3189402 - RNA, 16 nt, Human
ugaaacugcauuugug

SEQ ID NO: 3189403 - RNA, 16 nt, Human
ugaaagacuguacaaa

SEQ ID NO: 3189404 - RNA, 18 nt, Human
ugaaagaaaacuuuuaug

SEQ ID NO: 3189405 - RNA, 20 nt, Human
agagauaggaaggucauuuc

SEQ ID NO: 3189406 - RNA, 14 nt, Human
agagauacucuggg

SEQ ID NO: 3189407 - RNA, 17 nt, Human
agagaguggcuccuccc

SEQ ID NO: 3189408 - RNA, 14 nt, Human
agagaugagcuuuc

SEQ ID NO: 3189409 - RNA, 15 nt, Human
agagaugagcuuucu

SEQ ID NO: 3189410 - RNA, 23 nt, Human
agagauaggaaggucauuuccau

SEQ ID NO: 3189411 - RNA, 22 nt, Human
agagauaggaaggucauuucca

SEQ ID NO: 3189412 - RNA, 13 nt, Human
agagacuccugca

SEQ ID NO: 3189413 - RNA, 14 nt, Human
agagacuccugcag

SEQ ID NO: 3189414 - RNA, 12 nt, Human
agagacuccugc

SEQ ID NO: 3189415 - RNA, 11 nt, Human
agagacuccug

SEQ ID NO: 3189416 - RNA, 15 nt, Human
agacuuuuccaaccc

SEQ ID NO: 3189417 - RNA, 19 nt, Human
agacuuuggaaagaguagg

SEQ ID NO: 3189418 - RNA, 16 nt, Human
agagacacaagccuuc

SEQ ID NO: 3189419 - RNA, 19 nt, Human
agagacacaagccuucggc

SEQ ID NO: 3189420 - RNA, 15 nt, Human
agagacacaagccuu

SEQ ID NO: 3189421 - RNA, 19 nt, Human
agacuuuuccaauauguga

SEQ ID NO: 3189422 - RNA, 17 nt, Human
agacuuuggaaagacuu

SEQ ID NO: 3189423 - RNA, 15 nt, Human
agacuuuggaaagag

SEQ ID NO: 3189424 - RNA, 15 nt, Human
agacuuuggaaagac

SEQ ID NO: 3189425 - RNA, 16 nt, Human
ucuuuuuuucucuaga

SEQ ID NO: 3189426 - RNA, 14 nt, Human
ucuuuguaccaaaa

SEQ ID NO: 3189427 - RNA, 17 nt, Human
ucuuuguaccaaaauuu

SEQ ID NO: 3189428 - RNA, 19 nt, Human
ucuuuguaccaaaauuuua

SEQ ID NO: 3189429 - RNA, 21 nt, Human
ucuuuguaccaaaauuuuaaa

SEQ ID NO: 3189430 - RNA, 23 nt, Human
ucuuuguaccaaaauuuuaaaaa

SEQ ID NO: 3189431 - RNA, 14 nt, Human
ucuuuguacagaca

SEQ ID NO: 3189432 - RNA, 15 nt, Human
ucuuuguacagacaa

SEQ ID NO: 3189433 - RNA, 20 nt, Human
ucuuuguacagacaacaaac

SEQ ID NO: 3189434 - RNA, 14 nt, Human
agagacagaaagca

SEQ ID NO: 3189435 - RNA, 21 nt, Human
agacuuuuccaauaugugauu

SEQ ID NO: 3189436 - RNA, 16 nt, Human
agacuccaccaagccu

SEQ ID NO: 3189437 - RNA, 12 nt, Human
agacuccaccaa

SEQ ID NO: 3189438 - RNA, 22 nt, Human
agacuccaaagaaauguaaggg

SEQ ID NO: 3189439 - RNA, 17 nt, Human
ucuuucccuuccuccau

SEQ ID NO: 3189440 - RNA, 16 nt, Human
ucuuucccuuccucca

SEQ ID NO: 3189441 - RNA, 19 nt, Human
ucuuucuaaugugugaauc

SEQ ID NO: 3189442 - RNA, 22 nt, Human
agacaggaccccugcaguuccc

SEQ ID NO: 3189443 - RNA, 15 nt, Human
agacaggaccccugc

SEQ ID NO: 3189444 - RNA, 14 nt, Human
agacaggaccccug

SEQ ID NO: 3189445 - RNA, 19 nt, Human
agacagagcgacagagcag

SEQ ID NO: 3189446 - RNA, 20 nt, Human
agacaggcaagcaccuccug

SEQ ID NO: 3189447 - RNA, 15 nt, Human
ucuuuaaugucacag

SEQ ID NO: 3189448 - RNA, 21 nt, Human
agacaggagaagaaagaacua

SEQ ID NO: 3189449 - RNA, 18 nt, Human
agacaggagaagaaagaa

SEQ ID NO: 3189450 - RNA, 18 nt, Human
ucuuuaaugucacaggca

SEQ ID NO: 3189451 - RNA, 23 nt, Human
ucuuucccucccuuccucuuucc

SEQ ID NO: 3189452 - RNA, 15 nt, Human
ucuuucccuuccagu

SEQ ID NO: 3189453 - RNA, 15 nt, Human
ucuuucccuuccucc

SEQ ID NO: 3189454 - RNA, 14 nt, Human
ucuuucccuuccuc

SEQ ID NO: 3189455 - RNA, 16 nt, Human
ucuuucccuuccaguu

SEQ ID NO: 3189456 - RNA, 23 nt, Human
agacuggcacaguuuucugagaa

SEQ ID NO: 3189457 - RNA, 20 nt, Human
agacuggccugaaccacagg

SEQ ID NO: 3189458 - RNA, 18 nt, Human
agacuggcacaguuuucu

SEQ ID NO: 3189459 - RNA, 13 nt, Human
agacucucucugg

SEQ ID NO: 3189460 - RNA, 15 nt, Human
agacucuaguauuua

SEQ ID NO: 3189461 - RNA, 17 nt, Human
agacucuaguauuuaug

SEQ ID NO: 3189462 - RNA, 21 nt, Human
agacuggcacaguuuucugag

SEQ ID NO: 3189463 - RNA, 20 nt, Human
agacuggcacaguuuucuga

SEQ ID NO: 3189464 - RNA, 13 nt, Human
agacuccugcagg

SEQ ID NO: 3189465 - RNA, 16 nt, Human
agacucccaagcugga

SEQ ID NO: 3189466 - RNA, 21 nt, Human
agacuccagcuggguuggaaa

SEQ ID NO: 3189467 - RNA, 22 nt, Human
agacuccagaaaugucccuuuc

SEQ ID NO: 3189468 - RNA, 13 nt, Human
ugaauaauuacag

SEQ ID NO: 3189469 - RNA, 18 nt, Human
ugaauaauuacagugccu

SEQ ID NO: 3189470 - RNA, 17 nt, Human
ugaauaauuacagugcc

SEQ ID NO: 3189471 - RNA, 13 nt, Human
ugaauaauacagu

SEQ ID NO: 3189472 - RNA, 13 nt, Human
ugaauaaugauuu

SEQ ID NO: 3189473 - RNA, 17 nt, Human
ugaauaaugccuuugua

SEQ ID NO: 3189474 - RNA, 21 nt, Human
ugaauaaugccuuuguaacca

SEQ ID NO: 3189475 - RNA, 14 nt, Human
ugaauaauggaaaa

SEQ ID NO: 3189476 - RNA, 16 nt, Human
ugaauaauggaaaaug

SEQ ID NO: 3189477 - RNA, 19 nt, Human
ugaauaauggaaaaugcca

SEQ ID NO: 3189478 - RNA, 22 nt, Human
ugaauaagccauucugacucau

SEQ ID NO: 3189479 - RNA, 17 nt, Human
ugaauaagccauucuga

SEQ ID NO: 3189480 - RNA, 17 nt, Human
ugaaguacucauacaug

SEQ ID NO: 3189481 - RNA, 15 nt, Human
ugaaguaagcaaaga

SEQ ID NO: 3189482 - RNA, 12 nt, Human
ugaauaauacag

SEQ ID NO: 3189483 - RNA, 15 nt, Human
ugaauaagcacuuuu

SEQ ID NO: 3189484 - RNA, 13 nt, Human
ugaauaagcacuu

SEQ ID NO: 3189485 - RNA, 12 nt, Human
ugaauaagcacu

SEQ ID NO: 3189486 - RNA, 23 nt, Human
ugaauaacugauuaguaagucuu

SEQ ID NO: 3189487 - RNA, 13 nt, Human
ugaagucacacag

SEQ ID NO: 3189488 - RNA, 24 nt, Human
ugaagauuguuuaucuagauguaa

SEQ ID NO: 3189489 - RNA, 22 nt, Human
ugaagauuguuuaucuagaugu

SEQ ID NO: 3189490 - RNA, 19 nt, Human
ugaagguuuuugauagcau

SEQ ID NO: 3189491 - RNA, 13 nt, Human
ugaagguuuuugu

SEQ ID NO: 3189492 - RNA, 16 nt, Human
ugaagguuuuuguaaa

SEQ ID NO: 3189493 - RNA, 15 nt, Human
ugaagguuuuuguaa

SEQ ID NO: 3189494 - RNA, 14 nt, Human
ugaagguuuuugau

SEQ ID NO: 3189495 - RNA, 18 nt, Human
ugaagguuuuugauagca

SEQ ID NO: 3189496 - RNA, 13 nt, Human
ugaagguuuuuga

SEQ ID NO: 3189497 - RNA, 14 nt, Human
ugaaguaagcaaag

SEQ ID NO: 3189498 - RNA, 13 nt, Human
ugaaguaagcaaa

SEQ ID NO: 3189499 - RNA, 21 nt, Human
ugaagguuuuuguaaagauuu

SEQ ID NO: 3189500 - RNA, 19 nt, Human
ugaagguuuuuguaaagau

SEQ ID NO: 3189501 - RNA, 18 nt, Human
ugaagguuuuuguaaaga

SEQ ID NO: 3189502 - RNA, 17 nt, Human
ugaagguuuuuguaaag

SEQ ID NO: 3189503 - RNA, 16 nt, Human
agaggcugcagccagg

SEQ ID NO: 3189504 - RNA, 22 nt, Human
agaggcugccucucccaucacu

SEQ ID NO: 3189505 - RNA, 20 nt, Human
agagggagugacagaggcag

SEQ ID NO: 3189506 - RNA, 15 nt, Human
agagggagugacaga

SEQ ID NO: 3189507 - RNA, 15 nt, Human
agagggagguaagga

SEQ ID NO: 3189508 - RNA, 16 nt, Human
ugaagauuguuuaucu

SEQ ID NO: 3189509 - RNA, 13 nt, Human
ugaagauuguuua

SEQ ID NO: 3189510 - RNA, 18 nt, Human
agagcuguucacagccag

SEQ ID NO: 3189511 - RNA, 22 nt, Human
agagcugugggcaaaagagugu

SEQ ID NO: 3189512 - RNA, 13 nt, Human
agagcuguacauu

SEQ ID NO: 3189513 - RNA, 23 nt, Human
agaggcagccccauucugccugc

SEQ ID NO: 3189514 - RNA, 21 nt, Human
agaggcagggucucacucugu

SEQ ID NO: 3189515 - RNA, 22 nt, Human
agaggcagccccauucugccug

SEQ ID NO: 3189516 - RNA, 21 nt, Human
agaggcagccccauucugccu

SEQ ID NO: 3189517 - RNA, 18 nt, Human
agaggccacauuacuaga

SEQ ID NO: 3189518 - RNA, 19 nt, Human
agaggccaaacaggcccuc

SEQ ID NO: 3189519 - RNA, 16 nt, Human
agaggccaaacaggcc

SEQ ID NO: 3189520 - RNA, 21 nt, Human
agaggcaugggcuugcugugg

SEQ ID NO: 3189521 - RNA, 22 nt, Human
agaggcaguugcccagccucuu

SEQ ID NO: 3189522 - RNA, 18 nt, Human
agaggcaguugcccagcc

SEQ ID NO: 3189523 - RNA, 23 nt, Human
agaggccuccuguggccugccag

SEQ ID NO: 3189524 - RNA, 19 nt, Human
agaggccugaaauccuggu

SEQ ID NO: 3189525 - RNA, 20 nt, Human
agaggccugaaauccugguu

SEQ ID NO: 3189526 - RNA, 23 nt, Human
agaggccugaaauccugguuccu

SEQ ID NO: 3189527 - RNA, 18 nt, Human
agaggccgagagcuaugg

SEQ ID NO: 3189528 - RNA, 15 nt, Human
ugaacuccugaccuc

SEQ ID NO: 3189529 - RNA, 13 nt, Human
ugaagaauuuaaa

SEQ ID NO: 3189530 - RNA, 15 nt, Human
ugaagaauuuaaaga

SEQ ID NO: 3189531 - RNA, 11 nt, Human
ugaagaauuua

SEQ ID NO: 3189532 - RNA, 20 nt, Human
ugaagaaucuacuuaacccu

SEQ ID NO: 3189533 - RNA, 22 nt, Human
ugaacccauauuuguacaccaa

SEQ ID NO: 3189534 - RNA, 18 nt, Human
ugaacccgggaggcagag

SEQ ID NO: 3189535 - RNA, 17 nt, Human
ugaacguuugguucaaa

SEQ ID NO: 3189536 - RNA, 20 nt, Human
ugaacguuugguucaaaugu

SEQ ID NO: 3189537 - RNA, 19 nt, Human
ugaacguuugguucaaaug

SEQ ID NO: 3189538 - RNA, 21 nt, Human
ugaacguuugguucaaaugug

SEQ ID NO: 3189539 - RNA, 13 nt, Human
ugaacaaauuuac

SEQ ID NO: 3189540 - RNA, 21 nt, Human
ugaaccaccacacccagccca

SEQ ID NO: 3189541 - RNA, 22 nt, Human
ugaaccaccacacccagcccac

SEQ ID NO: 3189542 - RNA, 18 nt, Human
ugaaccauaaaaugucca

SEQ ID NO: 3189543 - RNA, 19 nt, Human
ugaaccauaguuacuguaa

SEQ ID NO: 3189544 - RNA, 18 nt, Human
ugaaccauaguuacugua

SEQ ID NO: 3189545 - RNA, 16 nt, Human
ugaaccacuuguagau

SEQ ID NO: 3189546 - RNA, 20 nt, Human
ugaaccacuuguagauuuga

SEQ ID NO: 3189547 - RNA, 21 nt, Human
ugaaccacuuguagauuugau

SEQ ID NO: 3189548 - RNA, 23 nt, Human
ugaaccacuuguagauuugauuu

SEQ ID NO: 3189549 - RNA, 13 nt, Human
ugaaccauaaaau

SEQ ID NO: 3189550 - RNA, 18 nt, Human
ugaaccagaaccagucuu

SEQ ID NO: 3189551 - RNA, 15 nt, Human
ugaaccauaaaaugu

SEQ ID NO: 3189552 - RNA, 16 nt, Human
ugaaccauaaaauguc

SEQ ID NO: 3189553 - RNA, 14 nt, Human
ugaaccacuuguag

SEQ ID NO: 3189554 - RNA, 15 nt, Human
ugaaccacuuguaga

SEQ ID NO: 3189555 - RNA, 13 nt, Human
ugaaccacuugua

SEQ ID NO: 3189556 - RNA, 17 nt, Human
agagauuggaucaagua

SEQ ID NO: 3189557 - RNA, 20 nt, Human
agagauuggaucaaguauua

SEQ ID NO: 3189558 - RNA, 21 nt, Human
agagauuggaucaaguauuac

SEQ ID NO: 3189559 - RNA, 14 nt, Human
ugaaauaaaagcua

SEQ ID NO: 3189560 - RNA, 16 nt, Human
ugaaauaccauuauua

SEQ ID NO: 3189561 - RNA, 18 nt, Human
ugaaauaaccguaaaggu

SEQ ID NO: 3189562 - RNA, 23 nt, Human
ugaaauaaccguaaagguuuauu

SEQ ID NO: 3189563 - RNA, 17 nt, Human
ugaaauaacacagcagu

SEQ ID NO: 3189564 - RNA, 22 nt, Human
ugaaauacauaugauaaauuug

SEQ ID NO: 3189565 - RNA, 18 nt, Human
ugaaauugaaaaguuauu

SEQ ID NO: 3189566 - RNA, 16 nt, Human
ugaaauugaaaaguua

SEQ ID NO: 3189567 - RNA, 23 nt, Human
ugaaauagacccacaagaggcag

SEQ ID NO: 3189568 - RNA, 21 nt, Human
ugaaauaggagggaaaccuuu

SEQ ID NO: 3189569 - RNA, 22 nt, Human
ugaaauaggagggaaaccuuug

SEQ ID NO: 3189570 - RNA, 23 nt, Human
ugaaauuuauugaggaaaaauau

SEQ ID NO: 3189571 - RNA, 22 nt, Human
ugaaauuuauugaggaaaaaua

SEQ ID NO: 3189572 - RNA, 17 nt, Human
ugaaauuuauugaggaa

SEQ ID NO: 3189573 - RNA, 15 nt, Human
ugaaauuuauugagg

SEQ ID NO: 3189574 - RNA, 13 nt, Human
ugaaauuuauuga

SEQ ID NO: 3189575 - RNA, 20 nt, Human
ugaaauuuuuauuaaauuau

SEQ ID NO: 3189576 - RNA, 14 nt, Human
ugaaauuuuucaua

SEQ ID NO: 3189577 - RNA, 13 nt, Human
ugaaauuuuucau

SEQ ID NO: 3189578 - RNA, 12 nt, Human
ugaaauuuuuca

SEQ ID NO: 3189579 - RNA, 19 nt, Human
ugaaauuuuuauuaaauua

SEQ ID NO: 3189580 - RNA, 13 nt, Human
ugaacaaaauuau

SEQ ID NO: 3189581 - RNA, 15 nt, Human
ugaacaaaauuauuu

SEQ ID NO: 3189582 - RNA, 15 nt, Human
ugaacaaagaccaau

SEQ ID NO: 3189583 - RNA, 19 nt, Human
ugaacaaagaccaauuuuu

SEQ ID NO: 3189584 - RNA, 21 nt, Human
ugaaauuuuucauauuuuaau

SEQ ID NO: 3189585 - RNA, 20 nt, Human
ugaaauuuuucauauuuuaa

SEQ ID NO: 3189586 - RNA, 18 nt, Human
ugaaauuuuucauauuuu

SEQ ID NO: 3189587 - RNA, 17 nt, Human
ugaaauuuuucauauuu

SEQ ID NO: 3189588 - RNA, 16 nt, Human
ugaaauuuuucauauu

SEQ ID NO: 3189589 - RNA, 18 nt, Human
ugaacaaaauaaauugga

SEQ ID NO: 3189590 - RNA, 16 nt, Human
ugaacaaaauaaauug

SEQ ID NO: 3189591 - RNA, 14 nt, Human
ugaacaaaauaaau

SEQ ID NO: 3189592 - RNA, 23 nt, Human
ugaaauuuuuuuucaugcuuuau

SEQ ID NO: 3189593 - RNA, 14 nt, Human
agaagaaguguguc

SEQ ID NO: 3189594 - RNA, 12 nt, Human
agaagaaagaug

SEQ ID NO: 3189595 - RNA, 13 nt, Human
agaagaaagaugu

SEQ ID NO: 3189596 - RNA, 15 nt, Human
agaagaaagauguuu

SEQ ID NO: 3189597 - RNA, 14 nt, Human
agaagaaauaaaua

SEQ ID NO: 3189598 - RNA, 18 nt, Human
agaagaaauaguucugug

SEQ ID NO: 3189599 - RNA, 15 nt, Human
agaagaaugcaugcu

SEQ ID NO: 3189600 - RNA, 15 nt, Human
agaagaauuugaaga

SEQ ID NO: 3189601 - RNA, 22 nt, Human
agaagaauuugaagacuucaaa

SEQ ID NO: 3189602 - RNA, 22 nt, Human
agaagaaugcaugcuuuccaua

SEQ ID NO: 3189603 - RNA, 14 nt, Human
agaagaauauugua

SEQ ID NO: 3189604 - RNA, 16 nt, Human
agaagaauauuguauu

SEQ ID NO: 3189605 - RNA, 22 nt, Human
agaagaauauuguauuguuaga

SEQ ID NO: 3189606 - RNA, 22 nt, Human
agaacuuagccuuuaccuguga

SEQ ID NO: 3189607 - RNA, 23 nt, Human
agaacugcuuucuuucguuuguu

SEQ ID NO: 3189608 - RNA, 20 nt, Human
agaaauugcauuuccugaca

SEQ ID NO: 3189609 - RNA, 17 nt, Human
agaaauugcauuuccug

SEQ ID NO: 3189610 - RNA, 21 nt, Human
agaaauucuguuuuuaaaaau

SEQ ID NO: 3189611 - RNA, 12 nt, Human
agaaauucuugu

SEQ ID NO: 3189612 - RNA, 18 nt, Human
agaaauucuuguuauggu

SEQ ID NO: 3189613 - RNA, 19 nt, Human
agaaauucuguuuuuaaaa

SEQ ID NO: 3189614 - RNA, 16 nt, Human
agaaauucuguuuuua

SEQ ID NO: 3189615 - RNA, 11 nt, Human
agaagcccaga

SEQ ID NO: 3189616 - RNA, 13 nt, Human
agaagcccagaau

SEQ ID NO: 3189617 - RNA, 12 nt, Human
agaagcccagaa

SEQ ID NO: 3189618 - RNA, 18 nt, Human
agaagauuuugaaauuuu

SEQ ID NO: 3189619 - RNA, 12 nt, Human
agaagcccagga

SEQ ID NO: 3189620 - RNA, 16 nt, Human
agaagcccaggaaagg

SEQ ID NO: 3189621 - RNA, 18 nt, Human
agaagcccaggaaaggcu

SEQ ID NO: 3189622 - RNA, 20 nt, Human
agaagcccaggaaaggcucc

SEQ ID NO: 3189623 - RNA, 21 nt, Human
agaagcccaggaaaggcucca

SEQ ID NO: 3189624 - RNA, 22 nt, Human
agaagcccaggaaaggcuccag

SEQ ID NO: 3189625 - RNA, 16 nt, Human
ucugcccacucccugc

SEQ ID NO: 3189626 - RNA, 17 nt, Human
ucugcccacucccugca

SEQ ID NO: 3189627 - RNA, 20 nt, Human
ucugcuccagcucuggcaug

SEQ ID NO: 3189628 - RNA, 15 nt, Human
ucugcuccagcucug

SEQ ID NO: 3189629 - RNA, 14 nt, Human
ucugcuccagcucu

SEQ ID NO: 3189630 - RNA, 15 nt, Human
ucugcuucagccucc

SEQ ID NO: 3189631 - RNA, 14 nt, Human
ucugcuucagccuc

SEQ ID NO: 3189632 - RNA, 13 nt, Human
ucugcuucagccu

SEQ ID NO: 3189633 - RNA, 20 nt, Human
ucugcucacauaucugucau

SEQ ID NO: 3189634 - RNA, 19 nt, Human
ucugcucacauaucuguca

SEQ ID NO: 3189635 - RNA, 17 nt, Human
ucugcucacauaucugu

SEQ ID NO: 3189636 - RNA, 21 nt, Human
ucugcuaaauugauguugaug

SEQ ID NO: 3189637 - RNA, 20 nt, Human
ucugcuaaauugauguugau

SEQ ID NO: 3189638 - RNA, 19 nt, Human
ucugcuaaauugauguuga

SEQ ID NO: 3189639 - RNA, 17 nt, Human
ucugcuaaauugauguu

SEQ ID NO: 3189640 - RNA, 15 nt, Human
ucugcuaaauugaug

SEQ ID NO: 3189641 - RNA, 17 nt, Human
ucugcuaaauuucaaau

SEQ ID NO: 3189642 - RNA, 15 nt, Human
ucugcuaaauuucaa

SEQ ID NO: 3189643 - RNA, 23 nt, Human
ucugcccuugguuaggcauugug

SEQ ID NO: 3189644 - RNA, 22 nt, Human
ucugccgcagcccugcagaggg

SEQ ID NO: 3189645 - RNA, 22 nt, Human
ucugccugcccaggccccugcc

SEQ ID NO: 3189646 - RNA, 21 nt, Human
ucugccugcccaggccccugc

SEQ ID NO: 3189647 - RNA, 12 nt, Human
ucugccugcccu

SEQ ID NO: 3189648 - RNA, 18 nt, Human
ucugcccacucccugcaa

SEQ ID NO: 3189649 - RNA, 21 nt, Human
ucugcccacucccugcaaccu

SEQ ID NO: 3189650 - RNA, 18 nt, Human
ucugcccuccaagaccuu

SEQ ID NO: 3189651 - RNA, 19 nt, Human
ucugcccuccaagaccuuc

SEQ ID NO: 3189652 - RNA, 14 nt, Human
ucugccgcagcccu

SEQ ID NO: 3189653 - RNA, 15 nt, Human
ucugccgcagcccug

SEQ ID NO: 3189654 - RNA, 11 nt, Human
ucugcccugcg

SEQ ID NO: 3189655 - RNA, 12 nt, Human
ucugcccugcgg

SEQ ID NO: 3189656 - RNA, 10 nt, Human
ucugcccugc

SEQ ID NO: 3189657 - RNA, 18 nt, Human
ucugcagauaaacaguag

SEQ ID NO: 3189658 - RNA, 15 nt, Human
ucugcagauaaacag

SEQ ID NO: 3189659 - RNA, 13 nt, Human
ucugcacuccccu

SEQ ID NO: 3189660 - RNA, 14 nt, Human
ucugcacuccccug

SEQ ID NO: 3189661 - RNA, 15 nt, Human
ucugcacuccccugc

SEQ ID NO: 3189662 - RNA, 16 nt, Human
ucugcacuccccugcu

SEQ ID NO: 3189663 - RNA, 21 nt, Human
ucugaugcaagcaagaaacac

SEQ ID NO: 3189664 - RNA, 16 nt, Human
ucugaugcaagcaaga

SEQ ID NO: 3189665 - RNA, 13 nt, Human
ucugaugaaaugu

SEQ ID NO: 3189666 - RNA, 15 nt, Human
ucugaugaaauguua

SEQ ID NO: 3189667 - RNA, 18 nt, Human
ucugaugaaauguuaaca

SEQ ID NO: 3189668 - RNA, 20 nt, Human
ucugaugaaauguuaacaau

SEQ ID NO: 3189669 - RNA, 22 nt, Human
ucugaucacugaaauaaaagcu

SEQ ID NO: 3189670 - RNA, 21 nt, Human
ucugaucauccacugugccau

SEQ ID NO: 3189671 - RNA, 17 nt, Human
ucugaucauccacugug

SEQ ID NO: 3189672 - RNA, 21 nt, Human
ucugagacucgcgacaaugca

SEQ ID NO: 3189673 - RNA, 13 nt, Human
ucugacugacaug

SEQ ID NO: 3189674 - RNA, 16 nt, Human
ucugacucuuccccag

SEQ ID NO: 3189675 - RNA, 12 nt, Human
ucugagaaugaa

SEQ ID NO: 3189676 - RNA, 16 nt, Human
ucugagaaugaacaaa

SEQ ID NO: 3189677 - RNA, 14 nt, Human
ucugagaaugaaca

SEQ ID NO: 3189678 - RNA, 21 nt, Human
ucugaaggacauugcggacag

SEQ ID NO: 3189679 - RNA, 12 nt, Human
ucugacacacag

SEQ ID NO: 3189680 - RNA, 21 nt, Human
ucugaauuaauuaauuuggag

SEQ ID NO: 3189681 - RNA, 14 nt, Human
ucugacacacagcu

SEQ ID NO: 3189682 - RNA, 13 nt, Human
ucugacacacagc

SEQ ID NO: 3189683 - RNA, 15 nt, Human
ucugacacacagcuc

SEQ ID NO: 3189684 - RNA, 19 nt, Human
ucugacucauauccccuau

SEQ ID NO: 3189685 - RNA, 14 nt, Human
agaaaugaaagcag

SEQ ID NO: 3189686 - RNA, 21 nt, Human
agaaauauuuuaauuuuuaaa

SEQ ID NO: 3189687 - RNA, 14 nt, Human
agaaauauuuuaau

SEQ ID NO: 3189688 - RNA, 14 nt, Human
agaaauaucuguga

SEQ ID NO: 3189689 - RNA, 15 nt, Human
agaaauaucugugaa

SEQ ID NO: 3189690 - RNA, 17 nt, Human
agaaauaucugugaaau

SEQ ID NO: 3189691 - RNA, 19 nt, Human
agaaauaucugugaaauau

SEQ ID NO: 3189692 - RNA, 23 nt, Human
agaaauaucugugaaauaucauc

SEQ ID NO: 3189693 - RNA, 17 nt, Human
agaaauauguauucugu

SEQ ID NO: 3189694 - RNA, 15 nt, Human
ucuccuuuguauucu

SEQ ID NO: 3189695 - RNA, 22 nt, Human
ucuccuuuguauucugucuuca

SEQ ID NO: 3189696 - RNA, 17 nt, Human
ucuccuuuguauucugu

SEQ ID NO: 3189697 - RNA, 16 nt, Human
ucuccuuucacaaccu

SEQ ID NO: 3189698 - RNA, 20 nt, Human
ucuccuuuagggacagcuua

SEQ ID NO: 3189699 - RNA, 14 nt, Human
ucuguuuacagugu

SEQ ID NO: 3189700 - RNA, 16 nt, Human
ucuguuguauucauug

SEQ ID NO: 3189701 - RNA, 17 nt, Human
ucuguuggccaguguga

SEQ ID NO: 3189702 - RNA, 12 nt, Human
ucuguuggccag

SEQ ID NO: 3189703 - RNA, 15 nt, Human
ucuguugcugccuca

SEQ ID NO: 3189704 - RNA, 13 nt, Human
ucuguugcccagg

SEQ ID NO: 3189705 - RNA, 15 nt, Human
ucugugaaauaucau

SEQ ID NO: 3189706 - RNA, 16 nt, Human
ucugugaaauaucauc

SEQ ID NO: 3189707 - RNA, 22 nt, Human
ucugugaaaggaaagagggagg

SEQ ID NO: 3189708 - RNA, 18 nt, Human
ucugucacaguaaaaaua

SEQ ID NO: 3189709 - RNA, 19 nt, Human
ucugucacaguaaaaauaa

SEQ ID NO: 3189710 - RNA, 20 nt, Human
ucugucacaguaaaaauaaa

SEQ ID NO: 3189711 - RNA, 22 nt, Human
ucugucacaguaaaaauaaaau

SEQ ID NO: 3189712 - RNA, 15 nt, Human
ucugucaaagucaga

SEQ ID NO: 3189713 - RNA, 18 nt, Human
ucuguauuugaaagugcc

SEQ ID NO: 3189714 - RNA, 22 nt, Human
ucuguauuugaaagugccuuug

SEQ ID NO: 3189715 - RNA, 13 nt, Human
ucuguauuugaaa

SEQ ID NO: 3189716 - RNA, 14 nt, Human
ucuguauuugaaag

SEQ ID NO: 3189717 - RNA, 15 nt, Human
ucuguauuugaaagu

SEQ ID NO: 3189718 - RNA, 14 nt, Human
ucugggccagaauu

SEQ ID NO: 3189719 - RNA, 15 nt, Human
ucugggccagaauuu

SEQ ID NO: 3189720 - RNA, 23 nt, Human
ucugugagaugcuagaacucccu

SEQ ID NO: 3189721 - RNA, 17 nt, Human
ucugugagaugcuagaa

SEQ ID NO: 3189722 - RNA, 22 nt, Human
ucugugagaugcuagaacuccc

SEQ ID NO: 3189723 - RNA, 14 nt, Human
ucugugagaugcua

SEQ ID NO: 3189724 - RNA, 19 nt, Human
ucugugacuuaguggacag

SEQ ID NO: 3189725 - RNA, 13 nt, Human
agacacaggcccg

SEQ ID NO: 3189726 - RNA, 12 nt, Human
agacacaggccc

SEQ ID NO: 3189727 - RNA, 16 nt, Human
agaauuugucacagga

SEQ ID NO: 3189728 - RNA, 20 nt, Human
agaauugcaaucuauaauau

SEQ ID NO: 3189729 - RNA, 17 nt, Human
agaauugcaaucuauaa

SEQ ID NO: 3189730 - RNA, 15 nt, Human
agaauugcaaucuau

SEQ ID NO: 3189731 - RNA, 22 nt, Human
agaauuuuaagccuuuguugaa

SEQ ID NO: 3189732 - RNA, 16 nt, Human
agaauuuuaagccuuu

SEQ ID NO: 3189733 - RNA, 14 nt, Human
agaauuuuaagccu

SEQ ID NO: 3189734 - RNA, 21 nt, Human
agaauugaagguuuuugauag

SEQ ID NO: 3189735 - RNA, 18 nt, Human
agaauugaagguuuuuga

SEQ ID NO: 3189736 - RNA, 20 nt, Human
agaauugaagguuuuugaua

SEQ ID NO: 3189737 - RNA, 13 nt, Human
agaauugaagguu

SEQ ID NO: 3189738 - RNA, 14 nt, Human
agaauugaagguuu

SEQ ID NO: 3189739 - RNA, 15 nt, Human
agaauugaagguuuu

SEQ ID NO: 3189740 - RNA, 16 nt, Human
agaauugaagguuuuu

SEQ ID NO: 3189741 - RNA, 12 nt, Human
agaauugaaggu

SEQ ID NO: 3189742 - RNA, 20 nt, Human
agacagagcaaccccuggac

SEQ ID NO: 3189743 - RNA, 16 nt, Human
agacaggaccagggau

SEQ ID NO: 3189744 - RNA, 20 nt, Human
agacacuuccgucacauccc

SEQ ID NO: 3189745 - RNA, 13 nt, Human
agacacuuccguc

SEQ ID NO: 3189746 - RNA, 16 nt, Human
agacacauguccaaga

SEQ ID NO: 3189747 - RNA, 13 nt, Human
agacacaggggac

SEQ ID NO: 3189748 - RNA, 18 nt, Human
agacaccuugacagggca

SEQ ID NO: 3189749 - RNA, 17 nt, Human
agacaccuugacagggc

SEQ ID NO: 3189750 - RNA, 16 nt, Human
ucugcuuuagacuuga

SEQ ID NO: 3189751 - RNA, 17 nt, Human
ucugcuuuagacuugaa

SEQ ID NO: 3189752 - RNA, 12 nt, Human
ucugcuuuagac

SEQ ID NO: 3189753 - RNA, 18 nt, Human
ucugcuuuagacuugaaa

SEQ ID NO: 3189754 - RNA, 19 nt, Human
ucugcuuuagacuugaaaa

SEQ ID NO: 3189755 - RNA, 12 nt, Human
ucugcuuuccuc

SEQ ID NO: 3189756 - RNA, 13 nt, Human
ucugcuuuccucu

SEQ ID NO: 3189757 - RNA, 18 nt, Human
ucugcuuuccucuuccug

SEQ ID NO: 3189758 - RNA, 17 nt, Human
agaaguggacuggagga

SEQ ID NO: 3189759 - RNA, 21 nt, Human
agaaguuucugccgcagcccu

SEQ ID NO: 3189760 - RNA, 22 nt, Human
agaaguuucugccgcagcccug

SEQ ID NO: 3189761 - RNA, 23 nt, Human
agaaguuucugccgcagcccugc

SEQ ID NO: 3189762 - RNA, 20 nt, Human
agaaguggggacagagcaga

SEQ ID NO: 3189763 - RNA, 21 nt, Human
agaauacugauggaauuuuuu

SEQ ID NO: 3189764 - RNA, 17 nt, Human
agaauacugauggaauu

SEQ ID NO: 3189765 - RNA, 15 nt, Human
agaauacugauggaa

SEQ ID NO: 3189766 - RNA, 20 nt, Human
agaauaugcaucuuaaaaug

SEQ ID NO: 3189767 - RNA, 19 nt, Human
agaauagaacaacauauac

SEQ ID NO: 3189768 - RNA, 21 nt, Human
agaauagaacaacauauacaa

SEQ ID NO: 3189769 - RNA, 15 nt, Human
agaauagcauguugu

SEQ ID NO: 3189770 - RNA, 16 nt, Human
agaauagaugcugacu

SEQ ID NO: 3189771 - RNA, 15 nt, Human
agaauuaacacauga

SEQ ID NO: 3189772 - RNA, 16 nt, Human
agaauguauuugcuga

SEQ ID NO: 3189773 - RNA, 14 nt, Human
agaauguaguuuga

SEQ ID NO: 3189774 - RNA, 18 nt, Human
agaauguaguuugaggaa

SEQ ID NO: 3189775 - RNA, 23 nt, Human
agaauguaagguauaucauucua

SEQ ID NO: 3189776 - RNA, 21 nt, Human
agaauguaagguauaucauuc

SEQ ID NO: 3189777 - RNA, 19 nt, Human
agaauguaagguauaucau

SEQ ID NO: 3189778 - RNA, 18 nt, Human
ucugggcaccacaaaaua

SEQ ID NO: 3189779 - RNA, 20 nt, Human
ucugggcaccacaaaauaua

SEQ ID NO: 3189780 - RNA, 21 nt, Human
ucugggcaccacaaaauauac

SEQ ID NO: 3189781 - RNA, 14 nt, Human
ucugggagcuggag

SEQ ID NO: 3189782 - RNA, 13 nt, Human
agaauucauucau

SEQ ID NO: 3189783 - RNA, 18 nt, Human
agaauucauucauacuua

SEQ ID NO: 3189784 - RNA, 21 nt, Human
agaauucauucauacuuaaaa

SEQ ID NO: 3189785 - RNA, 23 nt, Human
agaauggugauuuuaaaugugug

SEQ ID NO: 3189786 - RNA, 21 nt, Human
agaauggugauuuuaaaugug

SEQ ID NO: 3189787 - RNA, 20 nt, Human
agaauggugauuuuaaaugu

SEQ ID NO: 3189788 - RNA, 19 nt, Human
agaauggugauuuuaaaug

SEQ ID NO: 3189789 - RNA, 18 nt, Human
agaauggugauuuuaaau

SEQ ID NO: 3189790 - RNA, 16 nt, Human
agaauggugauuuuaa

SEQ ID NO: 3189791 - RNA, 14 nt, Human
agaauggugauuuu

SEQ ID NO: 3189792 - RNA, 17 nt, Human
agaauggggcugggccc

SEQ ID NO: 3189793 - RNA, 12 nt, Human
agaauguaaagc

SEQ ID NO: 3189794 - RNA, 15 nt, Human
agaauguaaagcaac

SEQ ID NO: 3189795 - RNA, 15 nt, Human
agaaucccuguguua

SEQ ID NO: 3189796 - RNA, 17 nt, Human
agaaucccuguguuaau

SEQ ID NO: 3189797 - RNA, 18 nt, Human
agaaucccuguguuaauu

SEQ ID NO: 3189798 - RNA, 19 nt, Human
agaaucccuguguuaauuu

SEQ ID NO: 3189799 - RNA, 21 nt, Human
agaaucccuguguuaauuuaa

SEQ ID NO: 3189800 - RNA, 13 nt, Human
agaauauuguauu

SEQ ID NO: 3189801 - RNA, 15 nt, Human
agaauauuguauugu

SEQ ID NO: 3189802 - RNA, 16 nt, Human
agaauauuguauuguu

SEQ ID NO: 3189803 - RNA, 18 nt, Human
agaauauuguauuguuag

SEQ ID NO: 3189804 - RNA, 21 nt, Human
agaaucauguuucuuugauca

SEQ ID NO: 3189805 - RNA, 19 nt, Human
agaaucauguuucuuugau

SEQ ID NO: 3189806 - RNA, 18 nt, Human
agaaucauguuucuuuga

SEQ ID NO: 3189807 - RNA, 21 nt, Human
agaaucaugugcgucagucca

SEQ ID NO: 3189808 - RNA, 16 nt, Human
agaaucauguuucuuu

SEQ ID NO: 3189809 - RNA, 15 nt, Human
agaaucauguuucuu

SEQ ID NO: 3189810 - RNA, 14 nt, Human
agaaucauguuucu

SEQ ID NO: 3189811 - RNA, 13 nt, Human
agaaucauguuuc

SEQ ID NO: 3189812 - RNA, 18 nt, Human
ucuagcauggcugccaau

SEQ ID NO: 3189813 - RNA, 21 nt, Human
ucuagagaaguggacuggagg

SEQ ID NO: 3189814 - RNA, 22 nt, Human
ucuagaguagagguauaauugu

SEQ ID NO: 3189815 - RNA, 9 nt, Human
ucuagaggc

SEQ ID NO: 3189816 - RNA, 19 nt, Human
ucuagaggccugaaauccu

SEQ ID NO: 3189817 - RNA, 21 nt, Human
ucuagaggccugaaauccugg

SEQ ID NO: 3189818 - RNA, 23 nt, Human
ucuagaggccugaaauccugguu

SEQ ID NO: 3189819 - RNA, 21 nt, Human
acuucccuggguuagacugcc

SEQ ID NO: 3189820 - RNA, 19 nt, Human
ucuagaauuuuaagccuuu

SEQ ID NO: 3189821 - RNA, 17 nt, Human
ucuagaauuuuaagccu

SEQ ID NO: 3189822 - RNA, 23 nt, Human
acuucccuggguuagacugccag

SEQ ID NO: 3189823 - RNA, 22 nt, Human
acuucccuggguuagacugcca

SEQ ID NO: 3189824 - RNA, 16 nt, Human
ucuagaauuuuaagcc

SEQ ID NO: 3189825 - RNA, 23 nt, Human
ucuagacacuuuuucuuuacaaa

SEQ ID NO: 3189826 - RNA, 16 nt, Human
ucuagacuauaaaugu

SEQ ID NO: 3189827 - RNA, 16 nt, Human
ucuagacacuuuuucu

SEQ ID NO: 3189828 - RNA, 15 nt, Human
ucuagacacuuuuuc

SEQ ID NO: 3189829 - RNA, 13 nt, Human
acuuccccuuccu

SEQ ID NO: 3189830 - RNA, 19 nt, Human
acuuccccuuccuaauucc

SEQ ID NO: 3189831 - RNA, 22 nt, Human
ucuaguuguuugauucagacag

SEQ ID NO: 3189832 - RNA, 19 nt, Human
ucuagcauuagguauaucu

SEQ ID NO: 3189833 - RNA, 23 nt, Human
ucuaguuguuugauucagacagc

SEQ ID NO: 3189834 - RNA, 21 nt, Human
ucuauaagcaaauugcuuuuu

SEQ ID NO: 3189835 - RNA, 16 nt, Human
ucucacuauguugccc

SEQ ID NO: 3189836 - RNA, 19 nt, Human
ucucacuauguugcccagg

SEQ ID NO: 3189837 - RNA, 17 nt, Human
ucucacuauguugccca

SEQ ID NO: 3189838 - RNA, 13 nt, Human
ucuauuuuuacau

SEQ ID NO: 3189839 - RNA, 16 nt, Human
ucuauuuuuacauuua

SEQ ID NO: 3189840 - RNA, 17 nt, Human
ucuauuuuuacauuuaa

SEQ ID NO: 3189841 - RNA, 20 nt, Human
ucucaccauuuccccagggc

SEQ ID NO: 3189842 - RNA, 21 nt, Human
ucucaccauuuccccagggca

SEQ ID NO: 3189843 - RNA, 20 nt, Human
ucuauuuucucugauacuuu

SEQ ID NO: 3189844 - RNA, 18 nt, Human
ucuauuugaauuauuucu

SEQ ID NO: 3189845 - RNA, 13 nt, Human
ucuauuuuacaac

SEQ ID NO: 3189846 - RNA, 11 nt, Human
ucuauuuuaca

SEQ ID NO: 3189847 - RNA, 19 nt, Human
ucuauuuucucugauacuu

SEQ ID NO: 3189848 - RNA, 14 nt, Human
ucuauuuauaauac

SEQ ID NO: 3189849 - RNA, 13 nt, Human
ucuauuuaauuuu

SEQ ID NO: 3189850 - RNA, 23 nt, Human
ucuauuuaauuuugacacugaaa

SEQ ID NO: 3189851 - RNA, 23 nt, Human
ucuaugggacucaaugcacugac

SEQ ID NO: 3189852 - RNA, 24 nt, Human
ucuauagaaaguguucuguuacaa

SEQ ID NO: 3189853 - RNA, 15 nt, Human
ucuauagcaucacuu

SEQ ID NO: 3189854 - RNA, 23 nt, Human
ucuauagaaaguguucuguuaca

SEQ ID NO: 3189855 - RNA, 22 nt, Human
ucuauagaaaguguucuguuac

SEQ ID NO: 3189856 - RNA, 21 nt, Human
ucuauagaaaguguucuguua

SEQ ID NO: 3189857 - RNA, 19 nt, Human
ucuauagaaaguguucugu

SEQ ID NO: 3189858 - RNA, 12 nt, Human
ucuauagaaagu

SEQ ID NO: 3189859 - RNA, 16 nt, Human
ucuauagaaaguguuc

SEQ ID NO: 3189860 - RNA, 15 nt, Human
ucuauagaaaguguu

SEQ ID NO: 3189861 - RNA, 14 nt, Human
ucuauagaaagugu

SEQ ID NO: 3189862 - RNA, 13 nt, Human
ucuauagaaagug

SEQ ID NO: 3189863 - RNA, 20 nt, Human
ucuauuagcuuacugauuaa

SEQ ID NO: 3189864 - RNA, 18 nt, Human
ucuauuagcuuacugauu

SEQ ID NO: 3189865 - RNA, 23 nt, Human
acuuaacccugacaaauuuuaau

SEQ ID NO: 3189866 - RNA, 21 nt, Human
acuuaacuguccguaagcagu

SEQ ID NO: 3189867 - RNA, 13 nt, Human
acuuaaauuuuag

SEQ ID NO: 3189868 - RNA, 15 nt, Human
acuuaaauuccucaa

SEQ ID NO: 3189869 - RNA, 22 nt, Human
acuuaaauguuauguauauggu

SEQ ID NO: 3189870 - RNA, 16 nt, Human
acuuaaauguuaugua

SEQ ID NO: 3189871 - RNA, 15 nt, Human
acuuaacaugcugug

SEQ ID NO: 3189872 - RNA, 18 nt, Human
acuuaacaugcuguguaa

SEQ ID NO: 3189873 - RNA, 20 nt, Human
acuuaacauagccaaaaugu

SEQ ID NO: 3189874 - RNA, 14 nt, Human
acuuaaauguuaug

SEQ ID NO: 3189875 - RNA, 13 nt, Human
acuuaauucuguu

SEQ ID NO: 3189876 - RNA, 14 nt, Human
acuuaauucuguuc

SEQ ID NO: 3189877 - RNA, 16 nt, Human
acuuacacuuuaugca

SEQ ID NO: 3189878 - RNA, 13 nt, Human
acuuaagcacacu

SEQ ID NO: 3189879 - RNA, 17 nt, Human
acuuacacuuuaugcac

SEQ ID NO: 3189880 - RNA, 19 nt, Human
acuuacauauuuauuuuua

SEQ ID NO: 3189881 - RNA, 14 nt, Human
acuuagcugggaga

SEQ ID NO: 3189882 - RNA, 19 nt, Human
acuuagcuggagaugucuc

SEQ ID NO: 3189883 - RNA, 23 nt, Human
acuuaggaagguggccuuccugc

SEQ ID NO: 3189884 - RNA, 21 nt, Human
acuuagcuggagaugucucua

SEQ ID NO: 3189885 - RNA, 15 nt, Human
acuuagguguggggg

SEQ ID NO: 3189886 - RNA, 15 nt, Human
acuucaguuaucuug

SEQ ID NO: 3189887 - RNA, 13 nt, Human
acuuauucaaaga

SEQ ID NO: 3189888 - RNA, 15 nt, Human
acuuauucaaagaga

SEQ ID NO: 3189889 - RNA, 17 nt, Human
acuuauucaaagagaaa

SEQ ID NO: 3189890 - RNA, 19 nt, Human
ucuaaguaaaaccacagca

SEQ ID NO: 3189891 - RNA, 23 nt, Human
uccugggcacacgcugcucugcc

SEQ ID NO: 3189892 - RNA, 15 nt, Human
ucuaaguaaaaccac

SEQ ID NO: 3189893 - RNA, 14 nt, Human
ucuaaguaaaacca

SEQ ID NO: 3189894 - RNA, 21 nt, Human
uccugggcacacgcugcucug

SEQ ID NO: 3189895 - RNA, 19 nt, Human
uccugggcacacgcugcuc

SEQ ID NO: 3189896 - RNA, 18 nt, Human
uccugggcacacgcugcu

SEQ ID NO: 3189897 - RNA, 15 nt, Human
uccugggcacacgcu

SEQ ID NO: 3189898 - RNA, 18 nt, Human
uccugggagugagcuggu

SEQ ID NO: 3189899 - RNA, 16 nt, Human
ucuacagaggccaugg

SEQ ID NO: 3189900 - RNA, 20 nt, Human
ucuacagcuaaucagcauuc

SEQ ID NO: 3189901 - RNA, 19 nt, Human
ucuacccagcgagcccugg

SEQ ID NO: 3189902 - RNA, 23 nt, Human
ucuacagcuaaucagcauucuca

SEQ ID NO: 3189903 - RNA, 20 nt, Human
ucuacagcucccccagcucc

SEQ ID NO: 3189904 - RNA, 16 nt, Human
ucuacagcucccccag

SEQ ID NO: 3189905 - RNA, 15 nt, Human
ucuacagcuccccca

SEQ ID NO: 3189906 - RNA, 12 nt, Human
ucuacagcuccc

SEQ ID NO: 3189907 - RNA, 21 nt, Human
ucuacagaggccaugggccuc

SEQ ID NO: 3189908 - RNA, 23 nt, Human
ucuaaguuuuaggguacaugugc

SEQ ID NO: 3189909 - RNA, 22 nt, Human
ucuaaguuuuaggguacaugug

SEQ ID NO: 3189910 - RNA, 18 nt, Human
ucuaauaagcuaguugaa

SEQ ID NO: 3189911 - RNA, 14 nt, Human
ucuacccuggcacu

SEQ ID NO: 3189912 - RNA, 19 nt, Human
ucuacccuggcacuauaau

SEQ ID NO: 3189913 - RNA, 20 nt, Human
ucuacccagcgagcccuggu

SEQ ID NO: 3189914 - RNA, 21 nt, Human
ucuacccuggcacuauaaugu

SEQ ID NO: 3189915 - RNA, 18 nt, Human
ucuaccggagagagaaug

SEQ ID NO: 3189916 - RNA, 16 nt, Human
acuguucucugcccuc

SEQ ID NO: 3189917 - RNA, 17 nt, Human
acuguucucugcccucc

SEQ ID NO: 3189918 - RNA, 17 nt, Human
acuguuauuuucagcau

SEQ ID NO: 3189919 - RNA, 19 nt, Human
acuguuauuuucagcauga

SEQ ID NO: 3189920 - RNA, 17 nt, Human
acuguucagcuuuuauu

SEQ ID NO: 3189921 - RNA, 18 nt, Human
acuguucucugcccucca

SEQ ID NO: 3189922 - RNA, 15 nt, Human
acuguucucugcccu

SEQ ID NO: 3189923 - RNA, 16 nt, Human
acuugcacucuucuac

SEQ ID NO: 3189924 - RNA, 23 nt, Human
acuugcagacucuacagaggcca

SEQ ID NO: 3189925 - RNA, 22 nt, Human
acuugcagacucuacagaggcc

SEQ ID NO: 3189926 - RNA, 19 nt, Human
acuugcagacucuacagag

SEQ ID NO: 3189927 - RNA, 23 nt, Human
ucucacuauguugcccaggcagg

SEQ ID NO: 3189928 - RNA, 22 nt, Human
ucucacuauguugcccaggcag

SEQ ID NO: 3189929 - RNA, 21 nt, Human
ucucacuauguugcccaggca

SEQ ID NO: 3189930 - RNA, 20 nt, Human
ucucacuauguugcccaggc

SEQ ID NO: 3189931 - RNA, 15 nt, Human
acuugcacucuucua

SEQ ID NO: 3189932 - RNA, 17 nt, Human
acuugauuugagauuuu

SEQ ID NO: 3189933 - RNA, 17 nt, Human
acuugcuuaaaugugaa

SEQ ID NO: 3189934 - RNA, 16 nt, Human
acuugcuuaaauguga

SEQ ID NO: 3189935 - RNA, 18 nt, Human
acuugcuuaaaugugaau

SEQ ID NO: 3189936 - RNA, 12 nt, Human
acuugcugccuc

SEQ ID NO: 3189937 - RNA, 11 nt, Human
acuugcugccu

SEQ ID NO: 3189938 - RNA, 13 nt, Human
acuugcugccucg

SEQ ID NO: 3189939 - RNA, 14 nt, Human
acuugcugugacuu

SEQ ID NO: 3189940 - RNA, 15 nt, Human
acuugcuuaaaugug

SEQ ID NO: 3189941 - RNA, 14 nt, Human
acuugcuuaaaugu

SEQ ID NO: 3189942 - RNA, 23 nt, Human
acuugcuuuggucacuuuuagau

SEQ ID NO: 3189943 - RNA, 19 nt, Human
acuugcuuuggucacuuuu

SEQ ID NO: 3189944 - RNA, 18 nt, Human
acuuguggacacagcucu

SEQ ID NO: 3189945 - RNA, 22 nt, Human
acuuguggacacagcucuucuc

SEQ ID NO: 3189946 - RNA, 19 nt, Human
acuuguggacacagcucuu

SEQ ID NO: 3189947 - RNA, 20 nt, Human
acuugucuuuggacccugag

SEQ ID NO: 3189948 - RNA, 18 nt, Human
acuugucuuuggacccug

SEQ ID NO: 3189949 - RNA, 21 nt, Human
acuugucuuuggacccugagg

SEQ ID NO: 3189950 - RNA, 21 nt, Human
ucucaugccucagccuccuga

SEQ ID NO: 3189951 - RNA, 15 nt, Human
ucucaugcuccuuaa

SEQ ID NO: 3189952 - RNA, 16 nt, Human
ucucaugcuccuuaau

SEQ ID NO: 3189953 - RNA, 13 nt, Human
ucucaugcugccc

SEQ ID NO: 3189954 - RNA, 19 nt, Human
ucucaugcugccccugccu

SEQ ID NO: 3189955 - RNA, 19 nt, Human
ucucauuguucaauuccca

SEQ ID NO: 3189956 - RNA, 17 nt, Human
ucucaggccagcugcuu

SEQ ID NO: 3189957 - RNA, 18 nt, Human
ucucaggccagcugcuug

SEQ ID NO: 3189958 - RNA, 21 nt, Human
ucucaggccagcugcuugggc

SEQ ID NO: 3189959 - RNA, 20 nt, Human
ucucaugccucagccuccug

SEQ ID NO: 3189960 - RNA, 14 nt, Human
ucucauuugucaca

SEQ ID NO: 3189961 - RNA, 19 nt, Human
ucucauuugccaauaauaa

SEQ ID NO: 3189962 - RNA, 15 nt, Human
ucuccaagcaggaca

SEQ ID NO: 3189963 - RNA, 16 nt, Human
ucuccaagcaggacau

SEQ ID NO: 3189964 - RNA, 16 nt, Human
ucucauuugucacaca

SEQ ID NO: 3189965 - RNA, 21 nt, Human
ucuccaaaaaaaaaaaaaaua

SEQ ID NO: 3189966 - RNA, 23 nt, Human
ucuccaaaaaaaaaaaaaauaca

SEQ ID NO: 3189967 - RNA, 23 nt, Human
ucucaggaaaucaaauaugcaaa

SEQ ID NO: 3189968 - RNA, 21 nt, Human
ucucaggaaaucaaauaugca

SEQ ID NO: 3189969 - RNA, 14 nt, Human
ucucaggaaaucaa

SEQ ID NO: 3189970 - RNA, 21 nt, Human
ucucagcauuaccucuuugga

SEQ ID NO: 3189971 - RNA, 12 nt, Human
ucucaggaaauc

SEQ ID NO: 3189972 - RNA, 12 nt, Human
ucucaggccagc

SEQ ID NO: 3189973 - RNA, 13 nt, Human
ucucaggccagcu

SEQ ID NO: 3189974 - RNA, 12 nt, Human
ucucaggccaaa

SEQ ID NO: 3189975 - RNA, 10 nt, Human
ucucaggcca

SEQ ID NO: 3189976 - RNA, 21 nt, Human
acuuugacagcgcacagcugc

SEQ ID NO: 3189977 - RNA, 16 nt, Human
acuuuggaucaggaaa

SEQ ID NO: 3189978 - RNA, 22 nt, Human
acuuugguagcugggaaagcau

SEQ ID NO: 3189979 - RNA, 23 nt, Human
acuuugguagcugggaaagcaua

SEQ ID NO: 3189980 - RNA, 21 nt, Human
acuuuguuaguuucuccaagc

SEQ ID NO: 3189981 - RNA, 14 nt, Human
acuuuguucuggcu

SEQ ID NO: 3189982 - RNA, 20 nt, Human
acuuuguuaguuucuccaag

SEQ ID NO: 3189983 - RNA, 18 nt, Human
acuuuguguucaccuugu

SEQ ID NO: 3189984 - RNA, 18 nt, Human
acuuuguuaggccaaaga

SEQ ID NO: 3189985 - RNA, 14 nt, Human
acuuuguuaggcca

SEQ ID NO: 3189986 - RNA, 14 nt, Human
acuuugguuucuga

SEQ ID NO: 3189987 - RNA, 14 nt, Human
acuuuguaaauucu

SEQ ID NO: 3189988 - RNA, 16 nt, Human
acuuuguaaauucuga

SEQ ID NO: 3189989 - RNA, 17 nt, Human
acuuuguaaauucugau

SEQ ID NO: 3189990 - RNA, 18 nt, Human
acuuuguaaauucugauu

SEQ ID NO: 3189991 - RNA, 19 nt, Human
acuuuguaaauucugauuu

SEQ ID NO: 3189992 - RNA, 21 nt, Human
acuuuguaaauucugauuucu

SEQ ID NO: 3189993 - RNA, 23 nt, Human
acuuuguaaauucugauuucuuu

SEQ ID NO: 3189994 - RNA, 16 nt, Human
ucuccuucaccuuugu

SEQ ID NO: 3189995 - RNA, 14 nt, Human
ucuccuucaccuuu

SEQ ID NO: 3189996 - RNA, 15 nt, Human
ucuccuucaccuuug

SEQ ID NO: 3189997 - RNA, 17 nt, Human
agaaaaaauauuuuccc

SEQ ID NO: 3189998 - RNA, 22 nt, Human
agaaaaaagguucuuuguguau

SEQ ID NO: 3189999 - RNA, 22 nt, Human
acuuuguuaggccaaagacaaa

SEQ ID NO: 3190000 - RNA, 18 nt, Human
acuuuuuaaaaaacuuuc

SEQ ID NO: 3190001 - RNA, 10 nt, Human
agaaaaaaga

SEQ ID NO: 3190002 - RNA, 14 nt, Human
agaaaaaaguugua

SEQ ID NO: 3190003 - RNA, 12 nt, Human
agaaaaaaguug

SEQ ID NO: 3190004 - RNA, 10 nt, Human
agaaaaaagu

SEQ ID NO: 3190005 - RNA, 18 nt, Human
agaaaaaagagaaaagaa

SEQ ID NO: 3190006 - RNA, 17 nt, Human
agaaaaaagagaaaaga

SEQ ID NO: 3190007 - RNA, 23 nt, Human
ucuccgaaaugcugucuuucuug

SEQ ID NO: 3190008 - RNA, 20 nt, Human
ucuccgaaaugcugucuuuc

SEQ ID NO: 3190009 - RNA, 14 nt, Human
ucuccucaggacca

SEQ ID NO: 3190010 - RNA, 10 nt, Human
ucuccucagg

SEQ ID NO: 3190011 - RNA, 17 nt, Human
ucuccgaccagacaccu

SEQ ID NO: 3190012 - RNA, 21 nt, Human
ucucccuuggauuguccccga

SEQ ID NO: 3190013 - RNA, 17 nt, Human
ucuccgaaaugcugucu

SEQ ID NO: 3190014 - RNA, 15 nt, Human
ucucccuuuuccaug

SEQ ID NO: 3190015 - RNA, 23 nt, Human
ucuccccagcaagugagagcugg

SEQ ID NO: 3190016 - RNA, 18 nt, Human
ucuccaagcaggacaugg

SEQ ID NO: 3190017 - RNA, 19 nt, Human
ucuccaagcaggacaugga

SEQ ID NO: 3190018 - RNA, 15 nt, Human
acuuuaccucucugu

SEQ ID NO: 3190019 - RNA, 22 nt, Human
acuuuaccucucugucaugugc

SEQ ID NO: 3190020 - RNA, 14 nt, Human
acuuucuucaaaau

SEQ ID NO: 3190021 - RNA, 19 nt, Human
acuuugacagcgcacagcu

SEQ ID NO: 3190022 - RNA, 17 nt, Human
acuuucuucaaaauaua

SEQ ID NO: 3190023 - RNA, 14 nt, Human
acuuucuucaggua

SEQ ID NO: 3190024 - RNA, 23 nt, Human
acuuugaauuuuagcacauugca

SEQ ID NO: 3190025 - RNA, 17 nt, Human
acuuugacacuuuucau

SEQ ID NO: 3190026 - RNA, 18 nt, Human
acuuugacacuuuucaua

SEQ ID NO: 3190027 - RNA, 22 nt, Human
acuuugacacuuuucauaucau

SEQ ID NO: 3190028 - RNA, 23 nt, Human
acuuugacacuuuucauaucauu

SEQ ID NO: 3190029 - RNA, 12 nt, Human
acuuucuguuaa

SEQ ID NO: 3190030 - RNA, 16 nt, Human
acuuucuguuaaaaug

SEQ ID NO: 3190031 - RNA, 13 nt, Human
acuuucuguuaaa

SEQ ID NO: 3190032 - RNA, 23 nt, Human
acuuucuguuaaaaugcaugauu

SEQ ID NO: 3190033 - RNA, 22 nt, Human
acuuucuguuaaaaugcaugau

SEQ ID NO: 3190034 - RNA, 19 nt, Human
acuuucuguuaaaaugcau

SEQ ID NO: 3190035 - RNA, 17 nt, Human
acuuucuguuaaaaugc

SEQ ID NO: 3190036 - RNA, 19 nt, Human
acuuucugaaauucacaaa

SEQ ID NO: 3190037 - RNA, 23 nt, Human
acuuucuggggccuaauaaaacu

SEQ ID NO: 3190038 - RNA, 17 nt, Human
ucuccucugcugcuggc

SEQ ID NO: 3190039 - RNA, 18 nt, Human
ucuccucugcugcuggcu

SEQ ID NO: 3190040 - RNA, 15 nt, Human
ucuccucugcugcug

SEQ ID NO: 3190041 - RNA, 16 nt, Human
ucuccucugcugcugg

SEQ ID NO: 3190042 - RNA, 15 nt, Human
ucuccuccagaguca

SEQ ID NO: 3190043 - RNA, 17 nt, Human
ucagauuugccuuauug

SEQ ID NO: 3190044 - RNA, 20 nt, Human
ucagauuugcacaaaaagau

SEQ ID NO: 3190045 - RNA, 19 nt, Human
ucagauuugcacaaaaaga

SEQ ID NO: 3190046 - RNA, 16 nt, Human
ucagauuugcacaaaa

SEQ ID NO: 3190047 - RNA, 15 nt, Human
ucagauuugcacaaa

SEQ ID NO: 3190048 - RNA, 15 nt, Human
ucagcaaaagaugcu

SEQ ID NO: 3190049 - RNA, 15 nt, Human
ucagccacugaggga

SEQ ID NO: 3190050 - RNA, 21 nt, Human
ucagccagaagccacccaaag

SEQ ID NO: 3190051 - RNA, 21 nt, Human
ucagauuugaacucuucaauc

SEQ ID NO: 3190052 - RNA, 14 nt, Human
ucagauuugcacaa

SEQ ID NO: 3190053 - RNA, 12 nt, Human
ucagauuugaac

SEQ ID NO: 3190054 - RNA, 22 nt, Human
accauaauguacugauuucagu

SEQ ID NO: 3190055 - RNA, 16 nt, Human
ucagcccucccugccc

SEQ ID NO: 3190056 - RNA, 15 nt, Human
ucagcccucccugcc

SEQ ID NO: 3190057 - RNA, 14 nt, Human
ucagcccucccugc

SEQ ID NO: 3190058 - RNA, 13 nt, Human
ucagcccucccug

SEQ ID NO: 3190059 - RNA, 23 nt, Human
acccaggagccccgaggccuucu

SEQ ID NO: 3190060 - RNA, 19 nt, Human
acccaggagccccgaggcc

SEQ ID NO: 3190061 - RNA, 13 nt, Human
accccagccccaa

SEQ ID NO: 3190062 - RNA, 22 nt, Human
accccagccccaaaacucuccu

SEQ ID NO: 3190063 - RNA, 12 nt, Human
accccagccuca

SEQ ID NO: 3190064 - RNA, 17 nt, Human
accccacacacgccaga

SEQ ID NO: 3190065 - RNA, 14 nt, Human
accccuggacccca

SEQ ID NO: 3190066 - RNA, 12 nt, Human
accccuggaccc

SEQ ID NO: 3190067 - RNA, 15 nt, Human
accccugagcuugca

SEQ ID NO: 3190068 - RNA, 22 nt, Human
accccugcaguuccccuggaag

SEQ ID NO: 3190069 - RNA, 11 nt, Human
accccugcccc

SEQ ID NO: 3190070 - RNA, 16 nt, Human
accccugcccagauca

SEQ ID NO: 3190071 - RNA, 14 nt, Human
accccucgcccagu

SEQ ID NO: 3190072 - RNA, 19 nt, Human
accccucgcccagucccag

SEQ ID NO: 3190073 - RNA, 18 nt, Human
accccucgcccaguccca

SEQ ID NO: 3190074 - RNA, 23 nt, Human
accccucgcccagucccagcagc

SEQ ID NO: 3190075 - RNA, 22 nt, Human
accccucgcccagucccagcag

SEQ ID NO: 3190076 - RNA, 24 nt, Human
accccucgcccagucccagcagcc

SEQ ID NO: 3190077 - RNA, 18 nt, Human
accccaucucuacaaaaa

SEQ ID NO: 3190078 - RNA, 18 nt, Human
accccaucccuccuuaag

SEQ ID NO: 3190079 - RNA, 21 nt, Human
accccagccucaaauccagga

SEQ ID NO: 3190080 - RNA, 20 nt, Human
accccagccucaaauccagg

SEQ ID NO: 3190081 - RNA, 18 nt, Human
accccauccuccagggcu

SEQ ID NO: 3190082 - RNA, 12 nt, Human
ucagcuccagcu

SEQ ID NO: 3190083 - RNA, 14 nt, Human
ucagcguuuugcaa

SEQ ID NO: 3190084 - RNA, 23 nt, Human
ucagcggggacagcuccuucugu

SEQ ID NO: 3190085 - RNA, 21 nt, Human
ucagcggggacagcuccuucu

SEQ ID NO: 3190086 - RNA, 20 nt, Human
ucagcggggacagcuccuuc

SEQ ID NO: 3190087 - RNA, 19 nt, Human
ucagcggggacagcuccuu

SEQ ID NO: 3190088 - RNA, 16 nt, Human
accccuggugguucac

SEQ ID NO: 3190089 - RNA, 17 nt, Human
accccuggcuuuucacu

SEQ ID NO: 3190090 - RNA, 15 nt, Human
accccuggaccccag

SEQ ID NO: 3190091 - RNA, 21 nt, Human
accccuggcuuuucacugcug

SEQ ID NO: 3190092 - RNA, 20 nt, Human
accccuggcuuuucacugcu

SEQ ID NO: 3190093 - RNA, 19 nt, Human
accccuggcuuuucacugc

SEQ ID NO: 3190094 - RNA, 18 nt, Human
accccuggcuuuucacug

SEQ ID NO: 3190095 - RNA, 18 nt, Human
ucagcggggacagcuccu

SEQ ID NO: 3190096 - RNA, 15 nt, Human
acccgggaggcagag

SEQ ID NO: 3190097 - RNA, 17 nt, Human
acccgggaggcagaggu

SEQ ID NO: 3190098 - RNA, 12 nt, Human
acccgggaaggg

SEQ ID NO: 3190099 - RNA, 13 nt, Human
acccgggaagggg

SEQ ID NO: 3190100 - RNA, 20 nt, Human
acccggccccugcugguuca

SEQ ID NO: 3190101 - RNA, 17 nt, Human
acccggccccugcuggu

SEQ ID NO: 3190102 - RNA, 22 nt, Human
acccggccccugcugguucagg

SEQ ID NO: 3190103 - RNA, 16 nt, Human
acccggccccugcugg

SEQ ID NO: 3190104 - RNA, 15 nt, Human
acccggccccugcug

SEQ ID NO: 3190105 - RNA, 14 nt, Human
acccggccccugcu

SEQ ID NO: 3190106 - RNA, 21 nt, Human
acccggaggggccuggcagcc

SEQ ID NO: 3190107 - RNA, 18 nt, Human
acccggaggggccuggca

SEQ ID NO: 3190108 - RNA, 22 nt, Human
ucagguaacaggcagauacagg

SEQ ID NO: 3190109 - RNA, 21 nt, Human
ucagguaacaggcagauacag

SEQ ID NO: 3190110 - RNA, 23 nt, Human
ucagguaacaggcagauacagga

SEQ ID NO: 3190111 - RNA, 15 nt, Human
acccggaggggccug

SEQ ID NO: 3190112 - RNA, 19 nt, Human
ucagggucccugguggcag

SEQ ID NO: 3190113 - RNA, 16 nt, Human
ucaggguuggccccug

SEQ ID NO: 3190114 - RNA, 16 nt, Human
ucagggugucccagac

SEQ ID NO: 3190115 - RNA, 23 nt, Human
ucaggccaggcccucugcccacu

SEQ ID NO: 3190116 - RNA, 22 nt, Human
ucagcuuguaaauagcucaggu

SEQ ID NO: 3190117 - RNA, 21 nt, Human
ucagcuuguaaauagcucagg

SEQ ID NO: 3190118 - RNA, 14 nt, Human
ucagcuccagcuca

SEQ ID NO: 3190119 - RNA, 20 nt, Human
ucagcuuguaaauagcucag

SEQ ID NO: 3190120 - RNA, 21 nt, Human
ucaggccaggcccucugccca

SEQ ID NO: 3190121 - RNA, 22 nt, Human
ucaggccaggcccucugcccac

SEQ ID NO: 3190122 - RNA, 20 nt, Human
ucaggccaggcccucugccc

SEQ ID NO: 3190123 - RNA, 13 nt, Human
acccugaggccca

SEQ ID NO: 3190124 - RNA, 14 nt, Human
acccugaggcccag

SEQ ID NO: 3190125 - RNA, 12 nt, Human
acccugaaaugu

SEQ ID NO: 3190126 - RNA, 11 nt, Human
acccugaaaug

SEQ ID NO: 3190127 - RNA, 23 nt, Human
acccugaacaacgagccuuuuca

SEQ ID NO: 3190128 - RNA, 15 nt, Human
acccugaaaugugug

SEQ ID NO: 3190129 - RNA, 14 nt, Human
acccugaaaugugu

SEQ ID NO: 3190130 - RNA, 13 nt, Human
acccugaaaugug

SEQ ID NO: 3190131 - RNA, 16 nt, Human
acccugaaagcccuga

SEQ ID NO: 3190132 - RNA, 18 nt, Human
acccugaaagcccugagc

SEQ ID NO: 3190133 - RNA, 14 nt, Human
acccgguccccacu

SEQ ID NO: 3190134 - RNA, 22 nt, Human
acccgguucaguguuucugggg

SEQ ID NO: 3190135 - RNA, 14 nt, Human
acccgguucagugu

SEQ ID NO: 3190136 - RNA, 20 nt, Human
acccuuguggucccacccca

SEQ ID NO: 3190137 - RNA, 23 nt, Human
acccuuguggucccaccccacac

SEQ ID NO: 3190138 - RNA, 17 nt, Human
acccuugccgucuaccu

SEQ ID NO: 3190139 - RNA, 15 nt, Human
accgaaaacguggcu

SEQ ID NO: 3190140 - RNA, 19 nt, Human
acccuuucuacuuccaaga

SEQ ID NO: 3190141 - RNA, 21 nt, Human
acccuuuccagguucugaaag

SEQ ID NO: 3190142 - RNA, 13 nt, Human
acccuuguuccag

SEQ ID NO: 3190143 - RNA, 18 nt, Human
acccuuucuacuuccaag

SEQ ID NO: 3190144 - RNA, 15 nt, Human
acccugaggcccaga

SEQ ID NO: 3190145 - RNA, 16 nt, Human
acccugaggcccagag

SEQ ID NO: 3190146 - RNA, 15 nt, Human
acccugcccuguggg

SEQ ID NO: 3190147 - RNA, 14 nt, Human
acccugcccugugg

SEQ ID NO: 3190148 - RNA, 17 nt, Human
acccugcccugugggcc

SEQ ID NO: 3190149 - RNA, 22 nt, Human
acccugcccugugggcccccaa

SEQ ID NO: 3190150 - RNA, 14 nt, Human
acccuucuucaugu

SEQ ID NO: 3190151 - RNA, 17 nt, Human
acccuucuucauguuca

SEQ ID NO: 3190152 - RNA, 22 nt, Human
acccuucuucauguucaauuau

SEQ ID NO: 3190153 - RNA, 16 nt, Human
ucauaaauuuaugguu

SEQ ID NO: 3190154 - RNA, 14 nt, Human
ucauaaccuagccu

SEQ ID NO: 3190155 - RNA, 13 nt, Human
ucauaaauucaaa

SEQ ID NO: 3190156 - RNA, 19 nt, Human
ucauaguaugguggcuggg

SEQ ID NO: 3190157 - RNA, 18 nt, Human
ucauaguaugguggcugg

SEQ ID NO: 3190158 - RNA, 15 nt, Human
ucauaguaugguggc

SEQ ID NO: 3190159 - RNA, 20 nt, Human
ucauaguagaacuuuauaaa

SEQ ID NO: 3190160 - RNA, 24 nt, Human
ucauaaauucaaaccuaaguugcu

SEQ ID NO: 3190161 - RNA, 21 nt, Human
ucauaguaugguggcuggguu

SEQ ID NO: 3190162 - RNA, 17 nt, Human
ucauaguuuuauuuaua

SEQ ID NO: 3190163 - RNA, 15 nt, Human
ucauaguuuuauuua

SEQ ID NO: 3190164 - RNA, 16 nt, Human
ucauaguuuuauuuau

SEQ ID NO: 3190165 - RNA, 18 nt, Human
ucauauaagauucauauu

SEQ ID NO: 3190166 - RNA, 17 nt, Human
ucauauauaauaaauua

SEQ ID NO: 3190167 - RNA, 21 nt, Human
ucauauuuuaauuucaagcuu

SEQ ID NO: 3190168 - RNA, 17 nt, Human
ucauauuuuaauuucaa

SEQ ID NO: 3190169 - RNA, 16 nt, Human
ucauauuuuaauuuca

SEQ ID NO: 3190170 - RNA, 22 nt, Human
ucauauuuguacuuucuguuaa

SEQ ID NO: 3190171 - RNA, 20 nt, Human
ucauauuugaggaguguuaa

SEQ ID NO: 3190172 - RNA, 19 nt, Human
ucauauuuguacuuucugu

SEQ ID NO: 3190173 - RNA, 14 nt, Human
ucauauuuguacuu

SEQ ID NO: 3190174 - RNA, 20 nt, Human
ucauauuuuaaacagaggau

SEQ ID NO: 3190175 - RNA, 16 nt, Human
accgagucucuucucc

SEQ ID NO: 3190176 - RNA, 17 nt, Human
accgagucucuucucca

SEQ ID NO: 3190177 - RNA, 23 nt, Human
ucauauuuacuucuuauacauuu

SEQ ID NO: 3190178 - RNA, 15 nt, Human
ucauauuuacuucuu

SEQ ID NO: 3190179 - RNA, 22 nt, Human
ucauauugguauauccuuuucu

SEQ ID NO: 3190180 - RNA, 21 nt, Human
ucauauugguauauccuuuuc

SEQ ID NO: 3190181 - RNA, 13 nt, Human
ucauauuuaauau

SEQ ID NO: 3190182 - RNA, 22 nt, Human
ucauauauuuuaugaaucagaa

SEQ ID NO: 3190183 - RNA, 16 nt, Human
ucauauauuuuaugaa

SEQ ID NO: 3190184 - RNA, 18 nt, Human
ucauauccccuauuuaac

SEQ ID NO: 3190185 - RNA, 12 nt, Human
ucauaucauuuc

SEQ ID NO: 3190186 - RNA, 13 nt, Human
ucauaucauuucu

SEQ ID NO: 3190187 - RNA, 14 nt, Human
ucauaucauuucuu

SEQ ID NO: 3190188 - RNA, 14 nt, Human
ucaguauguggaag

SEQ ID NO: 3190189 - RNA, 12 nt, Human
ucaguaugugga

SEQ ID NO: 3190190 - RNA, 16 nt, Human
ucagugccaaaaacaa

SEQ ID NO: 3190191 - RNA, 12 nt, Human
ucagugccacua

SEQ ID NO: 3190192 - RNA, 17 nt, Human
accgaaaacguggcugc

SEQ ID NO: 3190193 - RNA, 19 nt, Human
accgaaaacguggcugcuu

SEQ ID NO: 3190194 - RNA, 22 nt, Human
ucaguaguuugcauuucagaaa

SEQ ID NO: 3190195 - RNA, 21 nt, Human
ucaguaguuugcauuucagaa

SEQ ID NO: 3190196 - RNA, 20 nt, Human
ucaguaguuugcauuucaga

SEQ ID NO: 3190197 - RNA, 19 nt, Human
ucaguaguuugcauuucag

SEQ ID NO: 3190198 - RNA, 11 nt, Human
ucagugccuua

SEQ ID NO: 3190199 - RNA, 12 nt, Human
ucagugccuuau

SEQ ID NO: 3190200 - RNA, 14 nt, Human
ucagugccuuaugg

SEQ ID NO: 3190201 - RNA, 15 nt, Human
ucagugccuuaugga

SEQ ID NO: 3190202 - RNA, 9 nt, Human
ucagugccu

SEQ ID NO: 3190203 - RNA, 10 nt, Human
ucagugccuu

SEQ ID NO: 3190204 - RNA, 20 nt, Human
ucagugcccuccaggauaga

SEQ ID NO: 3190205 - RNA, 23 nt, Human
ucagugccccgucuacagcuccc

SEQ ID NO: 3190206 - RNA, 15 nt, Human
ucaguuuuucuuaau

SEQ ID NO: 3190207 - RNA, 16 nt, Human
ucagugccuuauggaa

SEQ ID NO: 3190208 - RNA, 15 nt, Human
ucagugcuucgcaga

SEQ ID NO: 3190209 - RNA, 11 nt, Human
ucaguggcagc

SEQ ID NO: 3190210 - RNA, 12 nt, Human
ucaguggcagcu

SEQ ID NO: 3190211 - RNA, 16 nt, Human
ucaguggcagcugcuu

SEQ ID NO: 3190212 - RNA, 16 nt, Human
ucaguggggaggggcu

SEQ ID NO: 3190213 - RNA, 12 nt, Human
accuagaaaaca

SEQ ID NO: 3190214 - RNA, 13 nt, Human
accuacuuucuuc

SEQ ID NO: 3190215 - RNA, 12 nt, Human
accgcagacagg

SEQ ID NO: 3190216 - RNA, 16 nt, Human
accgcagacaggacca

SEQ ID NO: 3190217 - RNA, 20 nt, Human
accuauuuuugacauggaaa

SEQ ID NO: 3190218 - RNA, 21 nt, Human
accucacgugcaaagccacca

SEQ ID NO: 3190219 - RNA, 14 nt, Human
accuccucuccuga

SEQ ID NO: 3190220 - RNA, 13 nt, Human
accuccucuccug

SEQ ID NO: 3190221 - RNA, 19 nt, Human
accuccccuugccagcugc

SEQ ID NO: 3190222 - RNA, 17 nt, Human
accuccccuugccagcu

SEQ ID NO: 3190223 - RNA, 16 nt, Human
accuccccuugccagc

SEQ ID NO: 3190224 - RNA, 15 nt, Human
accuccccuugccag

SEQ ID NO: 3190225 - RNA, 20 nt, Human
accucccacaaaggagagcu

SEQ ID NO: 3190226 - RNA, 22 nt, Human
accuccauguggacuuaggaag

SEQ ID NO: 3190227 - RNA, 15 nt, Human
accucacucugcuac

SEQ ID NO: 3190228 - RNA, 16 nt, Human
accucacucugcuacc

SEQ ID NO: 3190229 - RNA, 23 nt, Human
accucacucugcuaccuugcccc

SEQ ID NO: 3190230 - RNA, 24 nt, Human
accucacucugcuaccuugcccca

SEQ ID NO: 3190231 - RNA, 22 nt, Human
accucacucagcaccacucaag

SEQ ID NO: 3190232 - RNA, 20 nt, Human
accucacucagcaccacuca

SEQ ID NO: 3190233 - RNA, 19 nt, Human
accucacucagcaccacuc

SEQ ID NO: 3190234 - RNA, 17 nt, Human
accucacucagcaccac

SEQ ID NO: 3190235 - RNA, 16 nt, Human
accucacucagcacca

SEQ ID NO: 3190236 - RNA, 15 nt, Human
accucacucagcacc

SEQ ID NO: 3190237 - RNA, 14 nt, Human
accucacucagcac

SEQ ID NO: 3190238 - RNA, 21 nt, Human
accucacucagaaguccagag

SEQ ID NO: 3190239 - RNA, 23 nt, Human
ucauccuuucacuucuuucccuu

SEQ ID NO: 3190240 - RNA, 13 nt, Human
ucauccauccagg

SEQ ID NO: 3190241 - RNA, 11 nt, Human
ucaugauuuuu

SEQ ID NO: 3190242 - RNA, 15 nt, Human
ucaugaaauuacccu

SEQ ID NO: 3190243 - RNA, 21 nt, Human
ucaugaaaugcuaugucauuu

SEQ ID NO: 3190244 - RNA, 20 nt, Human
ucaugaaaugcuaugucauu

SEQ ID NO: 3190245 - RNA, 18 nt, Human
ucaugaaaugcuauguca

SEQ ID NO: 3190246 - RNA, 17 nt, Human
ucauguuuacagaggac

SEQ ID NO: 3190247 - RNA, 11 nt, Human
ucauguuucuu

SEQ ID NO: 3190248 - RNA, 14 nt, Human
ucauguuucuuuga

SEQ ID NO: 3190249 - RNA, 12 nt, Human
ucauguuucuuu

SEQ ID NO: 3190250 - RNA, 21 nt, Human
ucauguuucuuugaucaugaa

SEQ ID NO: 3190251 - RNA, 15 nt, Human
ucauguuucuuugau

SEQ ID NO: 3190252 - RNA, 22 nt, Human
ucaugugggccacacaagugca

SEQ ID NO: 3190253 - RNA, 16 nt, Human
ucaugcacacaauuag

SEQ ID NO: 3190254 - RNA, 21 nt, Human
ucaugcacacaauuagauuuc

SEQ ID NO: 3190255 - RNA, 16 nt, Human
ucaugcagguuagaaa

SEQ ID NO: 3190256 - RNA, 21 nt, Human
ucaugcagaguauuucuaaag

SEQ ID NO: 3190257 - RNA, 17 nt, Human
ucaugcagaguauuucu

SEQ ID NO: 3190258 - RNA, 19 nt, Human
accaccaacuacuaccugu

SEQ ID NO: 3190259 - RNA, 16 nt, Human
accacaucuugcucug

SEQ ID NO: 3190260 - RNA, 18 nt, Human
accacaugugcacaugca

SEQ ID NO: 3190261 - RNA, 20 nt, Human
accaccacacccagcccacu

SEQ ID NO: 3190262 - RNA, 15 nt, Human
accaccacacccagc

SEQ ID NO: 3190263 - RNA, 19 nt, Human
accacaucuugcucugcug

SEQ ID NO: 3190264 - RNA, 18 nt, Human
accacaucuugcucugcu

SEQ ID NO: 3190265 - RNA, 17 nt, Human
accacaucuugcucugc

SEQ ID NO: 3190266 - RNA, 15 nt, Human
accacaggugcccgc

SEQ ID NO: 3190267 - RNA, 21 nt, Human
accacagcuccuuuuccagag

SEQ ID NO: 3190268 - RNA, 17 nt, Human
accacagcuccuuuucc

SEQ ID NO: 3190269 - RNA, 15 nt, Human
accacagcuccuuuu

SEQ ID NO: 3190270 - RNA, 12 nt, Human
accacagcuccu

SEQ ID NO: 3190271 - RNA, 16 nt, Human
ucaccaugaucacuua

SEQ ID NO: 3190272 - RNA, 20 nt, Human
ucaccauuuccccagggcac

SEQ ID NO: 3190273 - RNA, 19 nt, Human
ucaccauuuccccagggca

SEQ ID NO: 3190274 - RNA, 17 nt, Human
ucaccauuuccccaggg

SEQ ID NO: 3190275 - RNA, 16 nt, Human
ucaccauuuccccagg

SEQ ID NO: 3190276 - RNA, 19 nt, Human
ucaccauguuggccaggcu

SEQ ID NO: 3190277 - RNA, 22 nt, Human
ucaccauguuggccaggcuggu

SEQ ID NO: 3190278 - RNA, 21 nt, Human
ucaccauucguacauaauacu

SEQ ID NO: 3190279 - RNA, 16 nt, Human
ucacccaccagacuuu

SEQ ID NO: 3190280 - RNA, 23 nt, Human
ucacagcaagucacuggccagug

SEQ ID NO: 3190281 - RNA, 23 nt, Human
ucacagaugugugauucacagug

SEQ ID NO: 3190282 - RNA, 21 nt, Human
ucacagaugugugauucacag

SEQ ID NO: 3190283 - RNA, 16 nt, Human
ucacaguucucuccuu

SEQ ID NO: 3190284 - RNA, 20 nt, Human
ucacaguucucuccuucuuc

SEQ ID NO: 3190285 - RNA, 13 nt, Human
ucacagccucuga

SEQ ID NO: 3190286 - RNA, 20 nt, Human
ucacagaugggugcuuggag

SEQ ID NO: 3190287 - RNA, 14 nt, Human
ucacaaccuucugu

SEQ ID NO: 3190288 - RNA, 16 nt, Human
accaaagcgaauuuua

SEQ ID NO: 3190289 - RNA, 21 nt, Human
ucacaacagauuauuaccuua

SEQ ID NO: 3190290 - RNA, 17 nt, Human
ucacaaaggaugcccaa

SEQ ID NO: 3190291 - RNA, 19 nt, Human
ucaauuucaauuuugucug

SEQ ID NO: 3190292 - RNA, 16 nt, Human
ucacuaggcuucuggu

SEQ ID NO: 3190293 - RNA, 18 nt, Human
ucacuacagguuaaaaga

SEQ ID NO: 3190294 - RNA, 13 nt, Human
ucacuaaacucug

SEQ ID NO: 3190295 - RNA, 19 nt, Human
ucacuaaaaggaagacagu

SEQ ID NO: 3190296 - RNA, 22 nt, Human
ucacuaagaacaaaagaagcag

SEQ ID NO: 3190297 - RNA, 16 nt, Human
ucacgucauaggaagu

SEQ ID NO: 3190298 - RNA, 14 nt, Human
ucacgucauaggaa

SEQ ID NO: 3190299 - RNA, 17 nt, Human
ucacgucauaggaaguu

SEQ ID NO: 3190300 - RNA, 14 nt, Human
ucacgugcaaagcc

SEQ ID NO: 3190301 - RNA, 22 nt, Human
accagcgugugacuacuccccc

SEQ ID NO: 3190302 - RNA, 13 nt, Human
accagcugugucc

SEQ ID NO: 3190303 - RNA, 18 nt, Human
accagcuguguccggccc

SEQ ID NO: 3190304 - RNA, 15 nt, Human
accagcuuugacccg

SEQ ID NO: 3190305 - RNA, 20 nt, Human
accagcuuggcucaggcuga

SEQ ID NO: 3190306 - RNA, 19 nt, Human
accagcuuggcucaggcug

SEQ ID NO: 3190307 - RNA, 18 nt, Human
accaguacauucucaguu

SEQ ID NO: 3190308 - RNA, 20 nt, Human
accagucuuucaacucauug

SEQ ID NO: 3190309 - RNA, 23 nt, Human
ucacuugaacccgggaggcagag

SEQ ID NO: 3190310 - RNA, 21 nt, Human
ucacuguuuagauuugccaua

SEQ ID NO: 3190311 - RNA, 14 nt, Human
ucacuguuucaucu

SEQ ID NO: 3190312 - RNA, 23 nt, Human
ucacuguuucaucuaagugccuc

SEQ ID NO: 3190313 - RNA, 15 nt, Human
ucacuguuuagauuu

SEQ ID NO: 3190314 - RNA, 16 nt, Human
ucacuguuuagauuug

SEQ ID NO: 3190315 - RNA, 17 nt, Human
ucacuguuuagauuugc

SEQ ID NO: 3190316 - RNA, 13 nt, Human
ucacuguuuagau

SEQ ID NO: 3190317 - RNA, 12 nt, Human
ucacuguuuaga

SEQ ID NO: 3190318 - RNA, 10 nt, Human
ucacuugagu

SEQ ID NO: 3190319 - RNA, 16 nt, Human
accaguauaaaauuac

SEQ ID NO: 3190320 - RNA, 17 nt, Human
accaguacauucucagu

SEQ ID NO: 3190321 - RNA, 17 nt, Human
ucacugagacagcccgg

SEQ ID NO: 3190322 - RNA, 21 nt, Human
ucacugagacagcccgggcuc

SEQ ID NO: 3190323 - RNA, 22 nt, Human
ucacugagacagcccgggcucu

SEQ ID NO: 3190324 - RNA, 14 nt, Human
ucacugcagccuca

SEQ ID NO: 3190325 - RNA, 16 nt, Human
ucacugagacagcccg

SEQ ID NO: 3190326 - RNA, 20 nt, Human
ucacuaucccggcugcccuu

SEQ ID NO: 3190327 - RNA, 19 nt, Human
ucacuaucccggcugcccu

SEQ ID NO: 3190328 - RNA, 19 nt, Human
ucacuauaaugugaaaugu

SEQ ID NO: 3190329 - RNA, 13 nt, Human
ucacugcagccuc

SEQ ID NO: 3190330 - RNA, 14 nt, Human
ucacugcagccucc

SEQ ID NO: 3190331 - RNA, 23 nt, Human
ucacugcagccuccgcuucccug

SEQ ID NO: 3190332 - RNA, 22 nt, Human
ucacugcagccuccgcuucccu

SEQ ID NO: 3190333 - RNA, 15 nt, Human
ucacugcagccucaa

SEQ ID NO: 3190334 - RNA, 19 nt, Human
ucacuguugcccaggcugg

SEQ ID NO: 3190335 - RNA, 23 nt, Human
ucacuguugcccaggcuggcgug

SEQ ID NO: 3190336 - RNA, 16 nt, Human
ucacuguggugucugu

SEQ ID NO: 3190337 - RNA, 12 nt, Human
ucacuguguaua

SEQ ID NO: 3190338 - RNA, 14 nt, Human
ucacuguguauauu

SEQ ID NO: 3190339 - RNA, 15 nt, Human
ucacuguguauauuu

SEQ ID NO: 3190340 - RNA, 17 nt, Human
ucacuguguauauuuga

SEQ ID NO: 3190341 - RNA, 18 nt, Human
ucacuguguauauuugau

SEQ ID NO: 3190342 - RNA, 19 nt, Human
ucacuguguauauuugauu

SEQ ID NO: 3190343 - RNA, 21 nt, Human
ucacuguguauauuugauuua

SEQ ID NO: 3190344 - RNA, 23 nt, Human
acauuguccccaaugaauauacu

SEQ ID NO: 3190345 - RNA, 24 nt, Human
acauuguccccaaugaauauacuc

SEQ ID NO: 3190346 - RNA, 19 nt, Human
acauugccguggcaucuua

SEQ ID NO: 3190347 - RNA, 19 nt, Human
acauugcauauaacuuaua

SEQ ID NO: 3190348 - RNA, 16 nt, Human
acauugauuugauuuu

SEQ ID NO: 3190349 - RNA, 17 nt, Human
acauuuucuuaauccag

SEQ ID NO: 3190350 - RNA, 18 nt, Human
acauuuucucuuagaaaa

SEQ ID NO: 3190351 - RNA, 17 nt, Human
acauuuucucuuagaaa

SEQ ID NO: 3190352 - RNA, 16 nt, Human
acauuuucucuuagaa

SEQ ID NO: 3190353 - RNA, 13 nt, Human
acauuuucucuua

SEQ ID NO: 3190354 - RNA, 22 nt, Human
accaaaaguuauuaaaauuguu

SEQ ID NO: 3190355 - RNA, 18 nt, Human
accaaaauaagaaaagau

SEQ ID NO: 3190356 - RNA, 15 nt, Human
accaaaauaauaaaa

SEQ ID NO: 3190357 - RNA, 17 nt, Human
accaaaauaagaaaaga

SEQ ID NO: 3190358 - RNA, 16 nt, Human
accaaaauaagaaaag

SEQ ID NO: 3190359 - RNA, 15 nt, Human
accaaaauaagaaaa

SEQ ID NO: 3190360 - RNA, 13 nt, Human
accaaaauaagaa

SEQ ID NO: 3190361 - RNA, 19 nt, Human
accaaaaguuauuaaaauu

SEQ ID NO: 3190362 - RNA, 18 nt, Human
accaaaaguuauuaaaau

SEQ ID NO: 3190363 - RNA, 16 nt, Human
accaaaaguuauuaaa

SEQ ID NO: 3190364 - RNA, 19 nt, Human
accaaacccacccuuucua

SEQ ID NO: 3190365 - RNA, 22 nt, Human
accaaacccacccuuucuacuu

SEQ ID NO: 3190366 - RNA, 20 nt, Human
accaaacccacccuuucuac

SEQ ID NO: 3190367 - RNA, 21 nt, Human
accaaaauuugggguauuuau

SEQ ID NO: 3190368 - RNA, 14 nt, Human
accaaaauuuuaaa

SEQ ID NO: 3190369 - RNA, 18 nt, Human
accaaaauuuuaaaaaag

SEQ ID NO: 3190370 - RNA, 18 nt, Human
accaaacuggaucacugg

SEQ ID NO: 3190371 - RNA, 15 nt, Human
accaaacucccauca

SEQ ID NO: 3190372 - RNA, 14 nt, Human
accaaaccuucuga

SEQ ID NO: 3190373 - RNA, 17 nt, Human
accaaacuacugaauga

SEQ ID NO: 3190374 - RNA, 18 nt, Human
acauucuuuuugcucuaa

SEQ ID NO: 3190375 - RNA, 14 nt, Human
acauucuuuuugcu

SEQ ID NO: 3190376 - RNA, 23 nt, Human
acauucuuuuugcucuaaaauau

SEQ ID NO: 3190377 - RNA, 19 nt, Human
acauucuuuuugcucuaaa

SEQ ID NO: 3190378 - RNA, 23 nt, Human
ucaaugaaugaaugaauggcuaa

SEQ ID NO: 3190379 - RNA, 17 nt, Human
ucaaugaacaagcauuc

SEQ ID NO: 3190380 - RNA, 16 nt, Human
ucaaucucguauagaa

SEQ ID NO: 3190381 - RNA, 24 nt, Human
ucaaucucguauagaagucuucau

SEQ ID NO: 3190382 - RNA, 22 nt, Human
ucaaucucguauagaagucuuc

SEQ ID NO: 3190383 - RNA, 21 nt, Human
ucaaucucguauagaagucuu

SEQ ID NO: 3190384 - RNA, 20 nt, Human
ucaaucucguauagaagucu

SEQ ID NO: 3190385 - RNA, 18 nt, Human
ucaaucucguauagaagu

SEQ ID NO: 3190386 - RNA, 17 nt, Human
ucaaucucguauagaag

SEQ ID NO: 3190387 - RNA, 22 nt, Human
ucaaguccucuuuucugagagg

SEQ ID NO: 3190388 - RNA, 14 nt, Human
ucaacuucaggaaa

SEQ ID NO: 3190389 - RNA, 15 nt, Human
ucaauauauuuguau

SEQ ID NO: 3190390 - RNA, 12 nt, Human
ucaauaguugaa

SEQ ID NO: 3190391 - RNA, 13 nt, Human
ucaauaguugaau

SEQ ID NO: 3190392 - RNA, 15 nt, Human
ucaauaguugaauua

SEQ ID NO: 3190393 - RNA, 16 nt, Human
ucaauaguugaauuag

SEQ ID NO: 3190394 - RNA, 13 nt, Human
ucaauaguaauau

SEQ ID NO: 3190395 - RNA, 14 nt, Human
ucaauaguaauaua

SEQ ID NO: 3190396 - RNA, 22 nt, Human
ucaauaucuuuuuuuuaauaaa

SEQ ID NO: 3190397 - RNA, 16 nt, Human
acagucagguugaaga

SEQ ID NO: 3190398 - RNA, 15 nt, Human
acagucagguugaag

SEQ ID NO: 3190399 - RNA, 16 nt, Human
acaugagguacugaga

SEQ ID NO: 3190400 - RNA, 20 nt, Human
acaugagguacugagaguga

SEQ ID NO: 3190401 - RNA, 23 nt, Human
acaugagguacugagagugaaca

SEQ ID NO: 3190402 - RNA, 19 nt, Human
acaugcuguguaagcugug

SEQ ID NO: 3190403 - RNA, 20 nt, Human
acaugcuguguaagcugugu

SEQ ID NO: 3190404 - RNA, 21 nt, Human
acaugcuguguaagcuguguc

SEQ ID NO: 3190405 - RNA, 20 nt, Human
acaugcuuguguuucuuagu

SEQ ID NO: 3190406 - RNA, 12 nt, Human
acauggaacagu

SEQ ID NO: 3190407 - RNA, 13 nt, Human
acaugcuuuguga

SEQ ID NO: 3190408 - RNA, 22 nt, Human
acaugcuuguugacagagagag

SEQ ID NO: 3190409 - RNA, 17 nt, Human
acaugggacuaugcuuu

SEQ ID NO: 3190410 - RNA, 20 nt, Human
acaugggacuaugcuuuucu

SEQ ID NO: 3190411 - RNA, 18 nt, Human
acaugggacuaugcuuuu

SEQ ID NO: 3190412 - RNA, 22 nt, Human
acauguaauuaaguacuaugua

SEQ ID NO: 3190413 - RNA, 21 nt, Human
acauguaauuaaguacuaugu

SEQ ID NO: 3190414 - RNA, 19 nt, Human
acauguaauuaaguacuau

SEQ ID NO: 3190415 - RNA, 17 nt, Human
acauguaauuaaguacu

SEQ ID NO: 3190416 - RNA, 15 nt, Human
acauguaauuaagua

SEQ ID NO: 3190417 - RNA, 16 nt, Human
acaugggucgcccaug

SEQ ID NO: 3190418 - RNA, 11 nt, Human
acauggugaug

SEQ ID NO: 3190419 - RNA, 19 nt, Human
acauucucaguuuuucuua

SEQ ID NO: 3190420 - RNA, 17 nt, Human
acauucucaguuuuucu

SEQ ID NO: 3190421 - RNA, 15 nt, Human
acauucucaguuuuu

SEQ ID NO: 3190422 - RNA, 14 nt, Human
acauucucaguuuu

SEQ ID NO: 3190423 - RNA, 18 nt, Human
ucaaauuuauuuccaaug

SEQ ID NO: 3190424 - RNA, 14 nt, Human
acauuccugaugcu

SEQ ID NO: 3190425 - RNA, 14 nt, Human
acauucuaucuacu

SEQ ID NO: 3190426 - RNA, 18 nt, Human
acauucuaucuacugauu

SEQ ID NO: 3190427 - RNA, 13 nt, Human
acauucucaguuu

SEQ ID NO: 3190428 - RNA, 18 nt, Human
acauucuauuucaacuuc

SEQ ID NO: 3190429 - RNA, 23 nt, Human
acauguaauuaaguacuauguau

SEQ ID NO: 3190430 - RNA, 15 nt, Human
acauguaauuugugu

SEQ ID NO: 3190431 - RNA, 15 nt, Human
acauguccaagaagc

SEQ ID NO: 3190432 - RNA, 14 nt, Human
ucaaccagcagaug

SEQ ID NO: 3190433 - RNA, 12 nt, Human
ucaaccacaaaa

SEQ ID NO: 3190434 - RNA, 14 nt, Human
ucaaccacaaaacu

SEQ ID NO: 3190435 - RNA, 18 nt, Human
ucaaccauuccccauggg

SEQ ID NO: 3190436 - RNA, 22 nt, Human
ucaaccagguccagaugugcua

SEQ ID NO: 3190437 - RNA, 15 nt, Human
ucaaccauuccccau

SEQ ID NO: 3190438 - RNA, 20 nt, Human
ucaacugcaucaagauguga

SEQ ID NO: 3190439 - RNA, 24 nt, Human
ucaacugaccagccuccaugcugc

SEQ ID NO: 3190440 - RNA, 13 nt, Human
ucaaccaaauggu

SEQ ID NO: 3190441 - RNA, 20 nt, Human
ucaaccaaaugguacaaaac

SEQ ID NO: 3190442 - RNA, 18 nt, Human
ucaaccaaaugguacaaa

SEQ ID NO: 3190443 - RNA, 17 nt, Human
ucaaccaaaugguacaa

SEQ ID NO: 3190444 - RNA, 16 nt, Human
ucaaccaaaugguaca

SEQ ID NO: 3190445 - RNA, 14 nt, Human
ucaaccaaauggua

SEQ ID NO: 3190446 - RNA, 21 nt, Human
ucaacaacauuccucaaaaug

SEQ ID NO: 3190447 - RNA, 20 nt, Human
ucaacaaggcuugcugcaga

SEQ ID NO: 3190448 - RNA, 16 nt, Human
ucaacaaggcuugcug

SEQ ID NO: 3190449 - RNA, 21 nt, Human
ucaacaaggcaaaaacaaaga

SEQ ID NO: 3190450 - RNA, 15 nt, Human
ucaacaagaagaauu

SEQ ID NO: 3190451 - RNA, 16 nt, Human
ucaacaagaagaauuu

SEQ ID NO: 3190452 - RNA, 17 nt, Human
ucaacaagaagaauuug

SEQ ID NO: 3190453 - RNA, 22 nt, Human
uccugcacacgcuccuuccucu

SEQ ID NO: 3190454 - RNA, 14 nt, Human
uccugcacacgcuc

SEQ ID NO: 3190455 - RNA, 21 nt, Human
uccugcacacgcuccuuccuc

SEQ ID NO: 3190456 - RNA, 20 nt, Human
uccugaugcuucuucagaga

SEQ ID NO: 3190457 - RNA, 21 nt, Human
uccugaugcuucuucagagac

SEQ ID NO: 3190458 - RNA, 19 nt, Human
uccugaugcuucuucagag

SEQ ID NO: 3190459 - RNA, 19 nt, Human
acugcacuccagccugggu

SEQ ID NO: 3190460 - RNA, 20 nt, Human
acugcacuccagccugggug

SEQ ID NO: 3190461 - RNA, 18 nt, Human
acugcacuccagccuggg

SEQ ID NO: 3190462 - RNA, 17 nt, Human
acugcacuccagccugg

SEQ ID NO: 3190463 - RNA, 14 nt, Human
acugcacguuuuca

SEQ ID NO: 3190464 - RNA, 14 nt, Human
acugcacuccagcc

SEQ ID NO: 3190465 - RNA, 21 nt, Human
acugcacuauagccuagguga

SEQ ID NO: 3190466 - RNA, 20 nt, Human
acugcacuauagccuaggug

SEQ ID NO: 3190467 - RNA, 16 nt, Human
acugcaccgggccaca

SEQ ID NO: 3190468 - RNA, 14 nt, Human
acugcaccgggcca

SEQ ID NO: 3190469 - RNA, 15 nt, Human
acugcacaugauuuc

SEQ ID NO: 3190470 - RNA, 23 nt, Human
acugcacagugcaucucagccca

SEQ ID NO: 3190471 - RNA, 23 nt, Human
acugcacaugauuucacaaauau

SEQ ID NO: 3190472 - RNA, 22 nt, Human
acugcacaugauuucacaaaua

SEQ ID NO: 3190473 - RNA, 21 nt, Human
acugcacaugauuucacaaau

SEQ ID NO: 3190474 - RNA, 20 nt, Human
acugcacaugauuucacaaa

SEQ ID NO: 3190475 - RNA, 19 nt, Human
acugcacaugauuucacaa

SEQ ID NO: 3190476 - RNA, 18 nt, Human
acugcacaugauuucaca

SEQ ID NO: 3190477 - RNA, 17 nt, Human
acugcacaugauuucac

SEQ ID NO: 3190478 - RNA, 16 nt, Human
acugcacaugauuuca

SEQ ID NO: 3190479 - RNA, 22 nt, Human
acugcacagugcaucucagccc

SEQ ID NO: 3190480 - RNA, 16 nt, Human
acugagcagugauauu

SEQ ID NO: 3190481 - RNA, 19 nt, Human
acugauauauuuaaaaaca

SEQ ID NO: 3190482 - RNA, 23 nt, Human
acugcaaccuucgccaccugggu

SEQ ID NO: 3190483 - RNA, 14 nt, Human
acugcaaccuuguu

SEQ ID NO: 3190484 - RNA, 17 nt, Human
acugcaaccuuguuuau

SEQ ID NO: 3190485 - RNA, 20 nt, Human
acugcaaccuuguuuauuaa

SEQ ID NO: 3190486 - RNA, 20 nt, Human
acugcaacuuguaaaugugg

SEQ ID NO: 3190487 - RNA, 15 nt, Human
uccuggaaauauuaa

SEQ ID NO: 3190488 - RNA, 17 nt, Human
uccugggagugagcugg

SEQ ID NO: 3190489 - RNA, 14 nt, Human
uccugggagugagc

SEQ ID NO: 3190490 - RNA, 12 nt, Human
uccugggaguga

SEQ ID NO: 3190491 - RNA, 21 nt, Human
uccugcugcaguugccaguca

SEQ ID NO: 3190492 - RNA, 13 nt, Human
uccugcugccagu

SEQ ID NO: 3190493 - RNA, 21 nt, Human
uccugcugccaguaccagccc

SEQ ID NO: 3190494 - RNA, 14 nt, Human
uccugcuguuacau

SEQ ID NO: 3190495 - RNA, 13 nt, Human
uccugcuuccuca

SEQ ID NO: 3190496 - RNA, 14 nt, Human
uccugcgaggcuau

SEQ ID NO: 3190497 - RNA, 17 nt, Human
uccugcgaggcuaugag

SEQ ID NO: 3190498 - RNA, 12 nt, Human
uccugcaggcag

SEQ ID NO: 3190499 - RNA, 13 nt, Human
uccugcaggcagc

SEQ ID NO: 3190500 - RNA, 14 nt, Human
uccugcaggcagcc

SEQ ID NO: 3190501 - RNA, 21 nt, Human
uccugccucgaacuggcugca

SEQ ID NO: 3190502 - RNA, 15 nt, Human
acucuuuaacuugua

SEQ ID NO: 3190503 - RNA, 20 nt, Human
uccugacaccccacuuagcc

SEQ ID NO: 3190504 - RNA, 19 nt, Human
acucuuuaacuuguaauaa

SEQ ID NO: 3190505 - RNA, 15 nt, Human
acucuuuauugucug

SEQ ID NO: 3190506 - RNA, 16 nt, Human
acucuuuauugucugu

SEQ ID NO: 3190507 - RNA, 19 nt, Human
acucuuuauugucuguaaa

SEQ ID NO: 3190508 - RNA, 20 nt, Human
acucuuuauugucuguaaau

SEQ ID NO: 3190509 - RNA, 21 nt, Human
acucuuuuccaaacacaggca

SEQ ID NO: 3190510 - RNA, 20 nt, Human
acugaacucugacaacagac

SEQ ID NO: 3190511 - RNA, 16 nt, Human
acugaaccacuuguag

SEQ ID NO: 3190512 - RNA, 18 nt, Human
acugaaccacuuguagau

SEQ ID NO: 3190513 - RNA, 19 nt, Human
acugaaccacuuguagauu

SEQ ID NO: 3190514 - RNA, 20 nt, Human
acugaaccacuuguagauuu

SEQ ID NO: 3190515 - RNA, 21 nt, Human
acugaaccacuuguagauuug

SEQ ID NO: 3190516 - RNA, 22 nt, Human
acugaaccugggaaagagauuu

SEQ ID NO: 3190517 - RNA, 19 nt, Human
acugaacgauccuucaaag

SEQ ID NO: 3190518 - RNA, 20 nt, Human
acugaacgauccuucaaagu

SEQ ID NO: 3190519 - RNA, 22 nt, Human
uccucuuuggucuacacugugc

SEQ ID NO: 3190520 - RNA, 21 nt, Human
uccugaauuuuauuuuuuggg

SEQ ID NO: 3190521 - RNA, 17 nt, Human
uccugacacaccugcag

SEQ ID NO: 3190522 - RNA, 21 nt, Human
uccugacacaccugcagccuc

SEQ ID NO: 3190523 - RNA, 22 nt, Human
uccugacacaccugcagccucc

SEQ ID NO: 3190524 - RNA, 15 nt, Human
uccugacaccccacu

SEQ ID NO: 3190525 - RNA, 19 nt, Human
uccugacaccccacuuagc

SEQ ID NO: 3190526 - RNA, 16 nt, Human
uccugacaccccacuu

SEQ ID NO: 3190527 - RNA, 12 nt, Human
uccucuuuccau

SEQ ID NO: 3190528 - RNA, 11 nt, Human
uccucuuucca

SEQ ID NO: 3190529 - RNA, 14 nt, Human
uccucccucccucu

SEQ ID NO: 3190530 - RNA, 11 nt, Human
uccucccuccc

SEQ ID NO: 3190531 - RNA, 19 nt, Human
uccucuuuggucuacacug

SEQ ID NO: 3190532 - RNA, 21 nt, Human
uccucuuuggucuacacugug

SEQ ID NO: 3190533 - RNA, 19 nt, Human
uccucuuuccaucuacccu

SEQ ID NO: 3190534 - RNA, 13 nt, Human
uccucccucccag

SEQ ID NO: 3190535 - RNA, 15 nt, Human
uccucccucccagcu

SEQ ID NO: 3190536 - RNA, 21 nt, Human
acugacugaggcaguuugagg

SEQ ID NO: 3190537 - RNA, 15 nt, Human
acugagacagcccgg

SEQ ID NO: 3190538 - RNA, 18 nt, Human
acugagacagcccgggcu

SEQ ID NO: 3190539 - RNA, 21 nt, Human
acugagacagcccgggcucug

SEQ ID NO: 3190540 - RNA, 22 nt, Human
acugagaugugaacacaucagc

SEQ ID NO: 3190541 - RNA, 17 nt, Human
acugagaugugaacaca

SEQ ID NO: 3190542 - RNA, 18 nt, Human
acugagagccuuuuugaa

SEQ ID NO: 3190543 - RNA, 18 nt, Human
acugagagugaacaaauu

SEQ ID NO: 3190544 - RNA, 16 nt, Human
acugagagagcgcagc

SEQ ID NO: 3190545 - RNA, 15 nt, Human
acugagagccuuuuu

SEQ ID NO: 3190546 - RNA, 22 nt, Human
acugagacagcccgggcucugc

SEQ ID NO: 3190547 - RNA, 23 nt, Human
acugagacagcccgggcucugcc

SEQ ID NO: 3190548 - RNA, 22 nt, Human
acugacuucuaaguaaaaccac

SEQ ID NO: 3190549 - RNA, 16 nt, Human
acugacuucuaaguaa

SEQ ID NO: 3190550 - RNA, 15 nt, Human
acugacuucuaagua

SEQ ID NO: 3190551 - RNA, 13 nt, Human
acugacuucuaag

SEQ ID NO: 3190552 - RNA, 12 nt, Human
acugacugaggc

SEQ ID NO: 3190553 - RNA, 15 nt, Human
acugacugaggcagu

SEQ ID NO: 3190554 - RNA, 21 nt, Human
acugacucuggaaaaggcaua

SEQ ID NO: 3190555 - RNA, 12 nt, Human
acugacucugga

SEQ ID NO: 3190556 - RNA, 14 nt, Human
acucuuggagccug

SEQ ID NO: 3190557 - RNA, 16 nt, Human
acucuuggagccugca

SEQ ID NO: 3190558 - RNA, 15 nt, Human
acucuuggagccugc

SEQ ID NO: 3190559 - RNA, 23 nt, Human
acucuuggagccugcagagcugc

SEQ ID NO: 3190560 - RNA, 22 nt, Human
acucuuggagccugcagagcug

SEQ ID NO: 3190561 - RNA, 16 nt, Human
acucuugaccucaggu

SEQ ID NO: 3190562 - RNA, 15 nt, Human
acucuugaccucagg

SEQ ID NO: 3190563 - RNA, 15 nt, Human
acucuugacucuugc

SEQ ID NO: 3190564 - RNA, 12 nt, Human
acucuugacagc

SEQ ID NO: 3190565 - RNA, 22 nt, Human
acucuugaguuguuuuuguaua

SEQ ID NO: 3190566 - RNA, 15 nt, Human
acucuugaguuguuu

SEQ ID NO: 3190567 - RNA, 16 nt, Human
acucuugaguuguuuu

SEQ ID NO: 3190568 - RNA, 20 nt, Human
acucuugaguuguuuuugua

SEQ ID NO: 3190569 - RNA, 21 nt, Human
acucuugaguuguuuuuguau

SEQ ID NO: 3190570 - RNA, 14 nt, Human
acucuugaccucag

SEQ ID NO: 3190571 - RNA, 22 nt, Human
acucuggcagcaccgccucuuc

SEQ ID NO: 3190572 - RNA, 21 nt, Human
uccucccaggcgccccuuccc

SEQ ID NO: 3190573 - RNA, 19 nt, Human
uccucccaggcgccccuuc

SEQ ID NO: 3190574 - RNA, 22 nt, Human
uccucauacccacccccaccca

SEQ ID NO: 3190575 - RNA, 22 nt, Human
uccucauaguaugguggcuggg

SEQ ID NO: 3190576 - RNA, 13 nt, Human
uccucccaggcgc

SEQ ID NO: 3190577 - RNA, 23 nt, Human
uccucauacccacccccacccaa

SEQ ID NO: 3190578 - RNA, 12 nt, Human
uccucaggacca

SEQ ID NO: 3190579 - RNA, 23 nt, Human
acuccuugaaaacacuguucucu

SEQ ID NO: 3190580 - RNA, 24 nt, Human
acuccuugaaaacacuguucucug

SEQ ID NO: 3190581 - RNA, 14 nt, Human
acucuccuccagag

SEQ ID NO: 3190582 - RNA, 17 nt, Human
acucuccuccagaguca

SEQ ID NO: 3190583 - RNA, 18 nt, Human
acucuccuggaaauauua

SEQ ID NO: 3190584 - RNA, 15 nt, Human
acucuccuugguguc

SEQ ID NO: 3190585 - RNA, 21 nt, Human
acucuccucugcugcuggcug

SEQ ID NO: 3190586 - RNA, 13 nt, Human
acucuccucugcu

SEQ ID NO: 3190587 - RNA, 14 nt, Human
acucuccucugcug

SEQ ID NO: 3190588 - RNA, 12 nt, Human
acucuccucugc

SEQ ID NO: 3190589 - RNA, 13 nt, Human
acucuggcagcuc

SEQ ID NO: 3190590 - RNA, 15 nt, Human
acucuggcagcucag

SEQ ID NO: 3190591 - RNA, 20 nt, Human
acucuggcagcaccgccucu

SEQ ID NO: 3190592 - RNA, 15 nt, Human
acucuggcagcaccg

SEQ ID NO: 3190593 - RNA, 21 nt, Human
acucuggagguuuguuuagaa

SEQ ID NO: 3190594 - RNA, 12 nt, Human
acucugccuccu

SEQ ID NO: 3190595 - RNA, 16 nt, Human
acucuccuuggugucg

SEQ ID NO: 3190596 - RNA, 23 nt, Human
acucuccuuggugucgggcauga

SEQ ID NO: 3190597 - RNA, 11 nt, Human
acucugagacu

SEQ ID NO: 3190598 - RNA, 22 nt, Human
acucugagacucgcgacaaugc

SEQ ID NO: 3190599 - RNA, 19 nt, Human
acucucucuuguucuuacu

SEQ ID NO: 3190600 - RNA, 18 nt, Human
uccgguguuuaagacauu

SEQ ID NO: 3190601 - RNA, 14 nt, Human
uccuacucuguguc

SEQ ID NO: 3190602 - RNA, 13 nt, Human
uccuacucugugu

SEQ ID NO: 3190603 - RNA, 12 nt, Human
uccuacucugug

SEQ ID NO: 3190604 - RNA, 16 nt, Human
uccgguuuacuuuaac

SEQ ID NO: 3190605 - RNA, 15 nt, Human
uccgguuuacuuuaa

SEQ ID NO: 3190606 - RNA, 15 nt, Human
uccuacucuguguca

SEQ ID NO: 3190607 - RNA, 13 nt, Human
uccuacucuucuc

SEQ ID NO: 3190608 - RNA, 24 nt, Human
uccuagcuggagaggagcccugcc

SEQ ID NO: 3190609 - RNA, 23 nt, Human
uccuagcuggagaggagcccugc

SEQ ID NO: 3190610 - RNA, 22 nt, Human
uccuagcuggagaggagcccug

SEQ ID NO: 3190611 - RNA, 21 nt, Human
uccuagcuggagaggagcccu

SEQ ID NO: 3190612 - RNA, 14 nt, Human
acuccuggccucaa

SEQ ID NO: 3190613 - RNA, 13 nt, Human
acuccuggccuca

SEQ ID NO: 3190614 - RNA, 13 nt, Human
uccuaggcauuug

SEQ ID NO: 3190615 - RNA, 12 nt, Human
acuccuggccuc

SEQ ID NO: 3190616 - RNA, 23 nt, Human
ucccuuuuuuggcugcugaaggc

SEQ ID NO: 3190617 - RNA, 20 nt, Human
ucccuuuuuuggcugcugaa

SEQ ID NO: 3190618 - RNA, 22 nt, Human
ucccuuuuuuggcugcugaagg

SEQ ID NO: 3190619 - RNA, 19 nt, Human
ucccuuugacgccauccca

SEQ ID NO: 3190620 - RNA, 17 nt, Human
ucccuuuuuuggcugcu

SEQ ID NO: 3190621 - RNA, 19 nt, Human
ucccuuuuuuggcugcuga

SEQ ID NO: 3190622 - RNA, 22 nt, Human
ucccugguggcagcucaccucu

SEQ ID NO: 3190623 - RNA, 19 nt, Human
ucccuuggauuguccccga

SEQ ID NO: 3190624 - RNA, 20 nt, Human
ucccuuggauuguccccgac

SEQ ID NO: 3190625 - RNA, 16 nt, Human
ucccuuugacgccauc

SEQ ID NO: 3190626 - RNA, 18 nt, Human
ucccuuugacgccauccc

SEQ ID NO: 3190627 - RNA, 19 nt, Human
acuccagugagacagcucu

SEQ ID NO: 3190628 - RNA, 19 nt, Human
acuccagaccccuggcuuu

SEQ ID NO: 3190629 - RNA, 18 nt, Human
acuccagaccccuggcuu

SEQ ID NO: 3190630 - RNA, 21 nt, Human
acuccagaccccuggcuuuuc

SEQ ID NO: 3190631 - RNA, 14 nt, Human
acuccuaugcuuua

SEQ ID NO: 3190632 - RNA, 22 nt, Human
acuccuaguagggguaccacug

SEQ ID NO: 3190633 - RNA, 14 nt, Human
acucaccccagccc

SEQ ID NO: 3190634 - RNA, 15 nt, Human
acucaccccagcccc

SEQ ID NO: 3190635 - RNA, 16 nt, Human
acucaccccagcccca

SEQ ID NO: 3190636 - RNA, 15 nt, Human
acuccagaccccugg

SEQ ID NO: 3190637 - RNA, 13 nt, Human
acuccagaccccu

SEQ ID NO: 3190638 - RNA, 13 nt, Human
acucaccccagcc

SEQ ID NO: 3190639 - RNA, 22 nt, Human
acucacagccagcgaacugaca

SEQ ID NO: 3190640 - RNA, 18 nt, Human
acucacagccagcgaacu

SEQ ID NO: 3190641 - RNA, 13 nt, Human
acucacagccagc

SEQ ID NO: 3190642 - RNA, 18 nt, Human
ucccugguggcagcucac

SEQ ID NO: 3190643 - RNA, 19 nt, Human
ucccugguggcagcucacc

SEQ ID NO: 3190644 - RNA, 20 nt, Human
ucccugguggcagcucaccu

SEQ ID NO: 3190645 - RNA, 21 nt, Human
ucccugguggcagcucaccuc

SEQ ID NO: 3190646 - RNA, 16 nt, Human
ucccugguggcagcuc

SEQ ID NO: 3190647 - RNA, 17 nt, Human
ucccugguggcagcuca

SEQ ID NO: 3190648 - RNA, 11 nt, Human
acuccuggccu

SEQ ID NO: 3190649 - RNA, 16 nt, Human
acuccugcucugcucg

SEQ ID NO: 3190650 - RNA, 15 nt, Human
acuccugcucugcuc

SEQ ID NO: 3190651 - RNA, 13 nt, Human
acuccugcucugc

SEQ ID NO: 3190652 - RNA, 10 nt, Human
acuccugcuc

SEQ ID NO: 3190653 - RNA, 15 nt, Human
acuccugcaggcagc

SEQ ID NO: 3190654 - RNA, 16 nt, Human
acuccugcaggcagcc

SEQ ID NO: 3190655 - RNA, 22 nt, Human
acuccugcaggcagccaggcca

SEQ ID NO: 3190656 - RNA, 12 nt, Human
acuccugcaggc

SEQ ID NO: 3190657 - RNA, 14 nt, Human
acuccugcaggcag

SEQ ID NO: 3190658 - RNA, 12 nt, Human
acuccucccagg

SEQ ID NO: 3190659 - RNA, 18 nt, Human
acguaaugaaacuuggau

SEQ ID NO: 3190660 - RNA, 15 nt, Human
acguacaaguaguuc

SEQ ID NO: 3190661 - RNA, 16 nt, Human
acguacaaguaguucu

SEQ ID NO: 3190662 - RNA, 17 nt, Human
acguacaaguaguucug

SEQ ID NO: 3190663 - RNA, 22 nt, Human
acguacaaguaguucuguauuu

SEQ ID NO: 3190664 - RNA, 24 nt, Human
acguacaaguaguucuguauuuga

SEQ ID NO: 3190665 - RNA, 18 nt, Human
acguacaaguaguucugu

SEQ ID NO: 3190666 - RNA, 19 nt, Human
acguacaaguaguucugua

SEQ ID NO: 3190667 - RNA, 20 nt, Human
acguacaaguaguucuguau

SEQ ID NO: 3190668 - RNA, 21 nt, Human
acguacaaguaguucuguauu

SEQ ID NO: 3190669 - RNA, 17 nt, Human
acgguuuuacugcagcu

SEQ ID NO: 3190670 - RNA, 11 nt, Human
uccauccugag

SEQ ID NO: 3190671 - RNA, 12 nt, Human
uccauccugagg

SEQ ID NO: 3190672 - RNA, 15 nt, Human
uccauccugaggcuc

SEQ ID NO: 3190673 - RNA, 15 nt, Human
acguuaccaggcagg

SEQ ID NO: 3190674 - RNA, 17 nt, Human
acguggcugcuucaagg

SEQ ID NO: 3190675 - RNA, 18 nt, Human
acguggcugcuucaagga

SEQ ID NO: 3190676 - RNA, 20 nt, Human
acgucagauguuuaaaacac

SEQ ID NO: 3190677 - RNA, 22 nt, Human
acgucauaggaaguuagccuuu

SEQ ID NO: 3190678 - RNA, 15 nt, Human
acgucagauguuuaa

SEQ ID NO: 3190679 - RNA, 17 nt, Human
acgucagauguuuaaaa

SEQ ID NO: 3190680 - RNA, 18 nt, Human
acgucagauguuuaaaac

SEQ ID NO: 3190681 - RNA, 19 nt, Human
acguggcugcuucaaggau

SEQ ID NO: 3190682 - RNA, 21 nt, Human
acguggcugcuucaaggaucc

SEQ ID NO: 3190683 - RNA, 13 nt, Human
acguuaaaguagg

SEQ ID NO: 3190684 - RNA, 13 nt, Human
acuaaauuuuaaa

SEQ ID NO: 3190685 - RNA, 15 nt, Human
acuaaauuuuaaagc

SEQ ID NO: 3190686 - RNA, 20 nt, Human
acuaacaaaguuuucaugug

SEQ ID NO: 3190687 - RNA, 19 nt, Human
acuaaauguuaaagaugua

SEQ ID NO: 3190688 - RNA, 18 nt, Human
acuaaauguuaaagaugu

SEQ ID NO: 3190689 - RNA, 23 nt, Human
acuaauuuugcaugcguauuuau

SEQ ID NO: 3190690 - RNA, 11 nt, Human
acuaaauguua

SEQ ID NO: 3190691 - RNA, 15 nt, Human
acuaaauguuaaaga

SEQ ID NO: 3190692 - RNA, 14 nt, Human
acuaaauguuaaag

SEQ ID NO: 3190693 - RNA, 13 nt, Human
acuaaauguuaaa

SEQ ID NO: 3190694 - RNA, 12 nt, Human
acuaaauguuaa

SEQ ID NO: 3190695 - RNA, 19 nt, Human
acguuugguucaaaugugu

SEQ ID NO: 3190696 - RNA, 12 nt, Human
acguuuuaagga

SEQ ID NO: 3190697 - RNA, 14 nt, Human
acguuuuaaggacu

SEQ ID NO: 3190698 - RNA, 18 nt, Human
acuaaacuuggugcuuau

SEQ ID NO: 3190699 - RNA, 19 nt, Human
acuaaacuuggugcuuauu

SEQ ID NO: 3190700 - RNA, 22 nt, Human
acuaaacuuggugcuuauugau

SEQ ID NO: 3190701 - RNA, 23 nt, Human
acuaaacuuggugcuuauugaua

SEQ ID NO: 3190702 - RNA, 16 nt, Human
acguugggacagggag

SEQ ID NO: 3190703 - RNA, 20 nt, Human
ucccagagcucccucugccc

SEQ ID NO: 3190704 - RNA, 16 nt, Human
ucccagauacuugggg

SEQ ID NO: 3190705 - RNA, 12 nt, Human
ucccagccccaa

SEQ ID NO: 3190706 - RNA, 18 nt, Human
ucccagauacuugggggg

SEQ ID NO: 3190707 - RNA, 23 nt, Human
acuacacgguucaaaccugugaa

SEQ ID NO: 3190708 - RNA, 17 nt, Human
ucccagaccccgacacc

SEQ ID NO: 3190709 - RNA, 16 nt, Human
ucccacuuuugccaga

SEQ ID NO: 3190710 - RNA, 18 nt, Human
acuauagccuaggugaca

SEQ ID NO: 3190711 - RNA, 22 nt, Human
acuauagccuaggugacagagu

SEQ ID NO: 3190712 - RNA, 20 nt, Human
acuauagccuaggugacaga

SEQ ID NO: 3190713 - RNA, 21 nt, Human
acuaucuaaauguugaaagau

SEQ ID NO: 3190714 - RNA, 16 nt, Human
acuaucuaaauguuga

SEQ ID NO: 3190715 - RNA, 19 nt, Human
acucaaugugugccgagcc

SEQ ID NO: 3190716 - RNA, 16 nt, Human
acucaaugcacugaca

SEQ ID NO: 3190717 - RNA, 21 nt, Human
acucaaggauaccuucuuauu

SEQ ID NO: 3190718 - RNA, 16 nt, Human
acuauguugcccaggc

SEQ ID NO: 3190719 - RNA, 15 nt, Human
acuauguugcccagg

SEQ ID NO: 3190720 - RNA, 14 nt, Human
acuauguugcccag

SEQ ID NO: 3190721 - RNA, 23 nt, Human
uccccacccugaaagcccugagc

SEQ ID NO: 3190722 - RNA, 15 nt, Human
uccccaccgcagaca

SEQ ID NO: 3190723 - RNA, 16 nt, Human
uccccaccgcagacag

SEQ ID NO: 3190724 - RNA, 18 nt, Human
uccccaggaggccagccu

SEQ ID NO: 3190725 - RNA, 12 nt, Human
uccccacccuga

SEQ ID NO: 3190726 - RNA, 21 nt, Human
ucccauuuagaauggugauuu

SEQ ID NO: 3190727 - RNA, 15 nt, Human
ucccauuuagaaugg

SEQ ID NO: 3190728 - RNA, 23 nt, Human
ucccauuuagaauggugauuuua

SEQ ID NO: 3190729 - RNA, 15 nt, Human
ucccagcuccacccc

SEQ ID NO: 3190730 - RNA, 14 nt, Human
ucccagcuccaccc

SEQ ID NO: 3190731 - RNA, 17 nt, Human
uccccaggaggccagcc

SEQ ID NO: 3190732 - RNA, 21 nt, Human
uccccagggcacgugguugag

SEQ ID NO: 3190733 - RNA, 13 nt, Human
uccccagggcacg

SEQ ID NO: 3190734 - RNA, 12 nt, Human
uccccagggcac

SEQ ID NO: 3190735 - RNA, 20 nt, Human
uccccaggaggccagccuug

SEQ ID NO: 3190736 - RNA, 21 nt, Human
uccccaggaggccagccuuga

SEQ ID NO: 3190737 - RNA, 11 nt, Human
ucccccagccc

SEQ ID NO: 3190738 - RNA, 13 nt, Human
ucccccagcccca

SEQ ID NO: 3190739 - RNA, 15 nt, Human
ucccccagccccauc

SEQ ID NO: 3190740 - RNA, 16 nt, Human
ucccccagccccaucc

SEQ ID NO: 3190741 - RNA, 18 nt, Human
acuacugggacucuucag

SEQ ID NO: 3190742 - RNA, 19 nt, Human
acuacugaccagacaagcu

SEQ ID NO: 3190743 - RNA, 20 nt, Human
acuacuguucagcuuuuauu

SEQ ID NO: 3190744 - RNA, 16 nt, Human
acuagagauauuuugu

SEQ ID NO: 3190745 - RNA, 17 nt, Human
acuagagauauuuugua

SEQ ID NO: 3190746 - RNA, 18 nt, Human
acuagagauauuuuguaa

SEQ ID NO: 3190747 - RNA, 19 nt, Human
acuagagauauuuuguaaa

SEQ ID NO: 3190748 - RNA, 21 nt, Human
acuagagauauuuuguaaaau

SEQ ID NO: 3190749 - RNA, 19 nt, Human
acuagacucccaagcugga

SEQ ID NO: 3190750 - RNA, 22 nt, Human
uccagcccugaguuccuagcca

SEQ ID NO: 3190751 - RNA, 20 nt, Human
uccagcccugaguuccuagc

SEQ ID NO: 3190752 - RNA, 14 nt, Human
uccagaauuuccca

SEQ ID NO: 3190753 - RNA, 15 nt, Human
uccagaauuucccaa

SEQ ID NO: 3190754 - RNA, 13 nt, Human
uccagacacaugu

SEQ ID NO: 3190755 - RNA, 13 nt, Human
uccagccugccac

SEQ ID NO: 3190756 - RNA, 11 nt, Human
uccagccugcc

SEQ ID NO: 3190757 - RNA, 22 nt, Human
uccaggagcagccacauuccug

SEQ ID NO: 3190758 - RNA, 22 nt, Human
uccagccuggaaaccugucuga

SEQ ID NO: 3190759 - RNA, 20 nt, Human
uccaggcugggagagccuuc

SEQ ID NO: 3190760 - RNA, 21 nt, Human
uccaggcugggagagccuucc

SEQ ID NO: 3190761 - RNA, 12 nt, Human
uccaggcuccuu

SEQ ID NO: 3190762 - RNA, 10 nt, Human
uccaggcucc

SEQ ID NO: 3190763 - RNA, 23 nt, Human
uccaggcugggagagccuuccag

SEQ ID NO: 3190764 - RNA, 15 nt, Human
acgaauauugcugau

SEQ ID NO: 3190765 - RNA, 18 nt, Human
acgaauauugcugauggu

SEQ ID NO: 3190766 - RNA, 17 nt, Human
accuuuguccccaccgc

SEQ ID NO: 3190767 - RNA, 18 nt, Human
accuuuguccccaccgca

SEQ ID NO: 3190768 - RNA, 19 nt, Human
accuugaaaacuuuaugcu

SEQ ID NO: 3190769 - RNA, 20 nt, Human
accuugaacuggguacuugu

SEQ ID NO: 3190770 - RNA, 15 nt, Human
accuugaacugaagg

SEQ ID NO: 3190771 - RNA, 20 nt, Human
accuuucuauaauuuuacaa

SEQ ID NO: 3190772 - RNA, 19 nt, Human
ucauucccucgucuuuccc

SEQ ID NO: 3190773 - RNA, 20 nt, Human
ucauucccucgucuuuccca

SEQ ID NO: 3190774 - RNA, 21 nt, Human
uccacuccuccuagccaccca

SEQ ID NO: 3190775 - RNA, 16 nt, Human
accuuuuuauuucaaa

SEQ ID NO: 3190776 - RNA, 17 nt, Human
accuuuucuuguaucug

SEQ ID NO: 3190777 - RNA, 11 nt, Human
accuuuucagg

SEQ ID NO: 3190778 - RNA, 13 nt, Human
accuuuucaggaa

SEQ ID NO: 3190779 - RNA, 16 nt, Human
accuuuucaggaaaau

SEQ ID NO: 3190780 - RNA, 22 nt, Human
accuuuucaggaaaauaacuua

SEQ ID NO: 3190781 - RNA, 13 nt, Human
accuuuuauuaua

SEQ ID NO: 3190782 - RNA, 22 nt, Human
uccacugguucuucuuggucuc

SEQ ID NO: 3190783 - RNA, 18 nt, Human
uccacugggguggccuga

SEQ ID NO: 3190784 - RNA, 17 nt, Human
uccacugggguggccug

SEQ ID NO: 3190785 - RNA, 18 nt, Human
uccagaauggucuuucua

SEQ ID NO: 3190786 - RNA, 22 nt, Human
uccagaauguauagacaggaaa

SEQ ID NO: 3190787 - RNA, 21 nt, Human
acgaauauugcugauggugca

SEQ ID NO: 3190788 - RNA, 14 nt, Human
acgaauauugcuga

SEQ ID NO: 3190789 - RNA, 21 nt, Human
acgaaugaaaauaacugaauu

SEQ ID NO: 3190790 - RNA, 17 nt, Human
acgccuagccucacgcu

SEQ ID NO: 3190791 - RNA, 21 nt, Human
acgcuacccgggaagggggcu

SEQ ID NO: 3190792 - RNA, 18 nt, Human
acgcuacccgggaagggg

SEQ ID NO: 3190793 - RNA, 12 nt, Human
acgccugccuuu

SEQ ID NO: 3190794 - RNA, 11 nt, Human
acgcucucugg

SEQ ID NO: 3190795 - RNA, 13 nt, Human
acgcuggaccuug

SEQ ID NO: 3190796 - RNA, 22 nt, Human
acgcucuaaggcaggauguggc

SEQ ID NO: 3190797 - RNA, 15 nt, Human
acgcuccuuccucug

SEQ ID NO: 3190798 - RNA, 20 nt, Human
acgcuccuuucugaucuuca

SEQ ID NO: 3190799 - RNA, 14 nt, Human
acgcuccuuucuga

SEQ ID NO: 3190800 - RNA, 14 nt, Human
acgcuccuuccucu

SEQ ID NO: 3190801 - RNA, 16 nt, Human
acgcuggagugcagug

SEQ ID NO: 3190802 - RNA, 15 nt, Human
acgcuggagugcagu

SEQ ID NO: 3190803 - RNA, 23 nt, Human
acgcuggaccuugaacuggguac

SEQ ID NO: 3190804 - RNA, 20 nt, Human
acgcuggaccuugaacuggg

SEQ ID NO: 3190805 - RNA, 17 nt, Human
acgcuggagugcaguga

SEQ ID NO: 3190806 - RNA, 21 nt, Human
acggagucccaccuuggcugc

SEQ ID NO: 3190807 - RNA, 23 nt, Human
acggagucccaccuuggcugcag

SEQ ID NO: 3190808 - RNA, 18 nt, Human
uccagugagacagcucug

SEQ ID NO: 3190809 - RNA, 15 nt, Human
uccagugaggcucug

SEQ ID NO: 3190810 - RNA, 16 nt, Human
uccagugaggcucugc

SEQ ID NO: 3190811 - RNA, 14 nt, Human
uccagugagacagc

SEQ ID NO: 3190812 - RNA, 22 nt, Human
uccagugaggcucugcccuugg

SEQ ID NO: 3190813 - RNA, 23 nt, Human
uccagugaggcucugcccuuggu

SEQ ID NO: 3190814 - RNA, 16 nt, Human
uccaguaucuugaaga

SEQ ID NO: 3190815 - RNA, 18 nt, Human
uccaguaucuugaagacu

SEQ ID NO: 3190816 - RNA, 14 nt, Human
uccaguauuuuagu

SEQ ID NO: 3190817 - RNA, 12 nt, Human
uccagucaggcu

SEQ ID NO: 3190818 - RNA, 22 nt, Human
uccaguaagaucacuguuuaga

SEQ ID NO: 3190819 - RNA, 12 nt, Human
uccaguccccag

SEQ ID NO: 3190820 - RNA, 15 nt, Human
uccaguccccagaac

SEQ ID NO: 3190821 - RNA, 14 nt, Human
uccaguccccagaa

SEQ ID NO: 3190822 - RNA, 20 nt, Human
uccagucaggcucucugggc

SEQ ID NO: 3190823 - RNA, 13 nt, Human
uccagucaggcuc

SEQ ID NO: 3190824 - RNA, 21 nt, Human
uccaguccccagaacucugcc

SEQ ID NO: 3190825 - RNA, 16 nt, Human
uccaguccccagaacu

SEQ ID NO: 3190826 - RNA, 22 nt, Human
uccaguccccagaacucugccu

SEQ ID NO: 3190827 - RNA, 16 nt, Human
uccagucuaucauugu

SEQ ID NO: 3190828 - RNA, 22 nt, Human
acggauccugcacugacucugg

SEQ ID NO: 3190829 - RNA, 23 nt, Human
acggauccugcacugacucugga

SEQ ID NO: 3190830 - RNA, 12 nt, Human
acggccaggcca

SEQ ID NO: 3190831 - RNA, 18 nt, Human
acggcucacugcagccuc

SEQ ID NO: 3190832 - RNA, 17 nt, Human
acggcucacugcagccu

SEQ ID NO: 3190833 - RNA, 15 nt, Human
acggcucacugcagc

SEQ ID NO: 3190834 - RNA, 16 nt, Human
acggcucacugcagcc

SEQ ID NO: 3190835 - RNA, 18 nt, Human
acggcuuuuacuuaaacc

SEQ ID NO: 3190836 - RNA, 14 nt, Human
uccaguaucuugaa

SEQ ID NO: 3190837 - RNA, 15 nt, Human
uccaguaucuugaag

SEQ ID NO: 3190838 - RNA, 23 nt, Human
uccaguaagaucacuguuuagau

SEQ ID NO: 3190839 - RNA, 18 nt, Human
uccaguaaggaaugauau

SEQ ID NO: 3190840 - RNA, 21 nt, Human
uccaguaagaucacuguuuag

SEQ ID NO: 3190841 - RNA, 22 nt, Human
uaacuuaaaagaacauguauau

SEQ ID NO: 3190842 - RNA, 13 nt, Human
uaacuuaauaauc

SEQ ID NO: 3190843 - RNA, 14 nt, Human
uaacuuaauaauca

SEQ ID NO: 3190844 - RNA, 16 nt, Human
uaacuuaauaaucaag

SEQ ID NO: 3190845 - RNA, 17 nt, Human
uaacuuaauaaucaaga

SEQ ID NO: 3190846 - RNA, 17 nt, Human
uaacuuccaauuuacau

SEQ ID NO: 3190847 - RNA, 21 nt, Human
uaacuuaauaaucaagagccu

SEQ ID NO: 3190848 - RNA, 18 nt, Human
uaacaugguuuaaaagaa

SEQ ID NO: 3190849 - RNA, 17 nt, Human
uaaccuuaucauaaauu

SEQ ID NO: 3190850 - RNA, 14 nt, Human
uaagaauauuugaa

SEQ ID NO: 3190851 - RNA, 14 nt, Human
uaagacacuuccgu

SEQ ID NO: 3190852 - RNA, 14 nt, Human
uaagacagcaugug

SEQ ID NO: 3190853 - RNA, 17 nt, Human
uaagacagcauguguua

SEQ ID NO: 3190854 - RNA, 13 nt, Human
uaagaauauuuga

SEQ ID NO: 3190855 - RNA, 19 nt, Human
uaagaauagaacaacauau

SEQ ID NO: 3190856 - RNA, 13 nt, Human
uaagaauaauaaa

SEQ ID NO: 3190857 - RNA, 14 nt, Human
uaagaauaauaaaa

SEQ ID NO: 3190858 - RNA, 17 nt, Human
uaagaauaauaaaauca

SEQ ID NO: 3190859 - RNA, 18 nt, Human
uaagaagugaaaaucuac

SEQ ID NO: 3190860 - RNA, 16 nt, Human
uaacuucauaagcaaa

SEQ ID NO: 3190861 - RNA, 13 nt, Human
uaacuugcuuaaa

SEQ ID NO: 3190862 - RNA, 17 nt, Human
uaacuugcuuaaaugug

SEQ ID NO: 3190863 - RNA, 16 nt, Human
uaacuugcuuaaaugu

SEQ ID NO: 3190864 - RNA, 15 nt, Human
uaacuugcuuaaaug

SEQ ID NO: 3190865 - RNA, 14 nt, Human
uaacuugcuuaaau

SEQ ID NO: 3190866 - RNA, 21 nt, Human
uaacuuuagaaauaaaccuua

SEQ ID NO: 3190867 - RNA, 23 nt, Human
uaacuuggaugaguuuugggaag

SEQ ID NO: 3190868 - RNA, 17 nt, Human
uaacuuggaugaguuuu

SEQ ID NO: 3190869 - RNA, 20 nt, Human
uaacuugcuuaaaugugaau

SEQ ID NO: 3190870 - RNA, 19 nt, Human
uaacuugcuuaaaugugaa

SEQ ID NO: 3190871 - RNA, 18 nt, Human
uaacuugcuuaaauguga

SEQ ID NO: 3190872 - RNA, 14 nt, Human
aauaguuguugauu

SEQ ID NO: 3190873 - RNA, 17 nt, Human
aauaguuuauuuuaaaa

SEQ ID NO: 3190874 - RNA, 13 nt, Human
aauaguuggcuag

SEQ ID NO: 3190875 - RNA, 12 nt, Human
aauaguugaauu

SEQ ID NO: 3190876 - RNA, 15 nt, Human
aauaguugaauuagu

SEQ ID NO: 3190877 - RNA, 21 nt, Human
aauaguucagguaacaggcag

SEQ ID NO: 3190878 - RNA, 11 nt, Human
aauaguucugu

SEQ ID NO: 3190879 - RNA, 22 nt, Human
aauaguguggaaauuaagaaga

SEQ ID NO: 3190880 - RNA, 20 nt, Human
aauaguguggaaauuaagaa

SEQ ID NO: 3190881 - RNA, 19 nt, Human
aauaguguggaaauuaaga

SEQ ID NO: 3190882 - RNA, 12 nt, Human
aauaguguggaa

SEQ ID NO: 3190883 - RNA, 15 nt, Human
aauagugugaaauau

SEQ ID NO: 3190884 - RNA, 16 nt, Human
aauagugugaaauaua

SEQ ID NO: 3190885 - RNA, 17 nt, Human
aauagugugaaauauau

SEQ ID NO: 3190886 - RNA, 21 nt, Human
uaaaauuuccccuaaucuuuu

SEQ ID NO: 3190887 - RNA, 21 nt, Human
uaaaauuugaaacauugcuuu

SEQ ID NO: 3190888 - RNA, 17 nt, Human
uaaaauuugaaacauug

SEQ ID NO: 3190889 - RNA, 16 nt, Human
uaaaauuugaaacauu

SEQ ID NO: 3190890 - RNA, 15 nt, Human
uaaaauuugaaacau

SEQ ID NO: 3190891 - RNA, 14 nt, Human
uaaaauuugaaaca

SEQ ID NO: 3190892 - RNA, 12 nt, Human
uaaaauuugaaa

SEQ ID NO: 3190893 - RNA, 17 nt, Human
uaacaguggacaaaguu

SEQ ID NO: 3190894 - RNA, 19 nt, Human
uaacauagccaaaauguga

SEQ ID NO: 3190895 - RNA, 23 nt, Human
uaacauagaauugcaaucuauaa

SEQ ID NO: 3190896 - RNA, 17 nt, Human
uaacaucuuuauugaaa

SEQ ID NO: 3190897 - RNA, 20 nt, Human
uaacaucuuuauugaaauuc

SEQ ID NO: 3190898 - RNA, 21 nt, Human
uaacaucuuuauugaaauucu

SEQ ID NO: 3190899 - RNA, 22 nt, Human
uaacaucuuuauugaaauucua

SEQ ID NO: 3190900 - RNA, 23 nt, Human
uaacauggacaugaucuucuuua

SEQ ID NO: 3190901 - RNA, 18 nt, Human
uaacauggacaugaucuu

SEQ ID NO: 3190902 - RNA, 16 nt, Human
uaacauggaaguacua

SEQ ID NO: 3190903 - RNA, 14 nt, Human
aauauuguauauuu

SEQ ID NO: 3190904 - RNA, 20 nt, Human
aauauuguauauuuuuaucu

SEQ ID NO: 3190905 - RNA, 15 nt, Human
aauauuguauuguua

SEQ ID NO: 3190906 - RNA, 22 nt, Human
aauauuguauuguuagauguuu

SEQ ID NO: 3190907 - RNA, 20 nt, Human
aauauugaaaggcaaacauu

SEQ ID NO: 3190908 - RNA, 22 nt, Human
aauauugaauuuuuauuuuuga

SEQ ID NO: 3190909 - RNA, 13 nt, Human
aauauugaaaauu

SEQ ID NO: 3190910 - RNA, 14 nt, Human
aauauugaaaauug

SEQ ID NO: 3190911 - RNA, 15 nt, Human
aauauugaaaauuga

SEQ ID NO: 3190912 - RNA, 16 nt, Human
aauauugaaaauugaa

SEQ ID NO: 3190913 - RNA, 20 nt, Human
aauauugaaaauugaaaagu

SEQ ID NO: 3190914 - RNA, 21 nt, Human
aauauugaaaauugaaaagua

SEQ ID NO: 3190915 - RNA, 14 nt, Human
aauauugagcaaua

SEQ ID NO: 3190916 - RNA, 18 nt, Human
aauauugagcaauauguc

SEQ ID NO: 3190917 - RNA, 19 nt, Human
aauauugagcagaauucau

SEQ ID NO: 3190918 - RNA, 14 nt, Human
aauauuuaauguug

SEQ ID NO: 3190919 - RNA, 13 nt, Human
aauauuuaauguu

SEQ ID NO: 3190920 - RNA, 15 nt, Human
aauauuuaauguuga

SEQ ID NO: 3190921 - RNA, 15 nt, Human
aauauuuacaaugua

SEQ ID NO: 3190922 - RNA, 16 nt, Human
aauauuuacaauguau

SEQ ID NO: 3190923 - RNA, 17 nt, Human
aauauuuacaauguauu

SEQ ID NO: 3190924 - RNA, 19 nt, Human
aauauuuacaauguauuaa

SEQ ID NO: 3190925 - RNA, 14 nt, Human
aauauuugaaugua

SEQ ID NO: 3190926 - RNA, 23 nt, Human
aauauuugaauguaugcuucaua

SEQ ID NO: 3190927 - RNA, 21 nt, Human
aauauuugaauguaugcuuca

SEQ ID NO: 3190928 - RNA, 22 nt, Human
aauaugcacuaagucucuuuuu

SEQ ID NO: 3190929 - RNA, 20 nt, Human
aauaugcacuaagucucuuu

SEQ ID NO: 3190930 - RNA, 19 nt, Human
aauauucauaguagaacuu

SEQ ID NO: 3190931 - RNA, 15 nt, Human
aauauuccugcauuu

SEQ ID NO: 3190932 - RNA, 14 nt, Human
aauauucucuauuu

SEQ ID NO: 3190933 - RNA, 18 nt, Human
aauauucucuauuugaau

SEQ ID NO: 3190934 - RNA, 15 nt, Human
aauauucucuguaca

SEQ ID NO: 3190935 - RNA, 14 nt, Human
aauauucucuguac

SEQ ID NO: 3190936 - RNA, 21 nt, Human
aauauucucuguacauauuag

SEQ ID NO: 3190937 - RNA, 18 nt, Human
aauauucucuguacauau

SEQ ID NO: 3190938 - RNA, 17 nt, Human
aauauucucuguacaua

SEQ ID NO: 3190939 - RNA, 15 nt, Human
uaagagaaaugagcu

SEQ ID NO: 3190940 - RNA, 15 nt, Human
uaagagaaaagagag

SEQ ID NO: 3190941 - RNA, 18 nt, Human
uaagagaaaagagagaaa

SEQ ID NO: 3190942 - RNA, 20 nt, Human
uaagagaaaagagagaaaca

SEQ ID NO: 3190943 - RNA, 18 nt, Human
aauaugcacuaagucucu

SEQ ID NO: 3190944 - RNA, 17 nt, Human
aauaugcacuaagucuc

SEQ ID NO: 3190945 - RNA, 21 nt, Human
aauauuugugugcuaaacgug

SEQ ID NO: 3190946 - RNA, 17 nt, Human
aauauuugugugcuaaa

SEQ ID NO: 3190947 - RNA, 19 nt, Human
uaagaugaucaucuaauuu

SEQ ID NO: 3190948 - RNA, 19 nt, Human
uaagauggcaggugauguc

SEQ ID NO: 3190949 - RNA, 21 nt, Human
uaagauuccagagaguggcuc

SEQ ID NO: 3190950 - RNA, 14 nt, Human
uaagauuccagaga

SEQ ID NO: 3190951 - RNA, 21 nt, Human
uaagcaaaaugugauauguac

SEQ ID NO: 3190952 - RNA, 18 nt, Human
uaagcacacuugacauca

SEQ ID NO: 3190953 - RNA, 21 nt, Human
uaagcaaagcacccauuucaa

SEQ ID NO: 3190954 - RNA, 13 nt, Human
uaagcaacaauuu

SEQ ID NO: 3190955 - RNA, 18 nt, Human
uaagcaacaauuuucaga

SEQ ID NO: 3190956 - RNA, 16 nt, Human
uaagcaacaauuuuca

SEQ ID NO: 3190957 - RNA, 13 nt, Human
uaagauucuuggu

SEQ ID NO: 3190958 - RNA, 14 nt, Human
uaagauucuuggua

SEQ ID NO: 3190959 - RNA, 20 nt, Human
uaagauucuugguauuugga

SEQ ID NO: 3190960 - RNA, 14 nt, Human
uaagauucuuuuaa

SEQ ID NO: 3190961 - RNA, 15 nt, Human
uaagauucuuuuaaa

SEQ ID NO: 3190962 - RNA, 23 nt, Human
uaagauucuuuuaaauuagaaaa

SEQ ID NO: 3190963 - RNA, 18 nt, Human
uaagauuguuauuaaaug

SEQ ID NO: 3190964 - RNA, 19 nt, Human
uaagauuguuauuaaaugu

SEQ ID NO: 3190965 - RNA, 20 nt, Human
uaagauuguuauuaaaugua

SEQ ID NO: 3190966 - RNA, 22 nt, Human
uaagcuguuacugucuucagua

SEQ ID NO: 3190967 - RNA, 17 nt, Human
uaagcuguguccuaguu

SEQ ID NO: 3190968 - RNA, 13 nt, Human
uaagcugugucug

SEQ ID NO: 3190969 - RNA, 22 nt, Human
uaagcugugucugcccaaugaa

SEQ ID NO: 3190970 - RNA, 21 nt, Human
uaagcagaauuggaaaagacu

SEQ ID NO: 3190971 - RNA, 17 nt, Human
uaagcagaauuggaaaa

SEQ ID NO: 3190972 - RNA, 13 nt, Human
uaagcacuuuuua

SEQ ID NO: 3190973 - RNA, 16 nt, Human
uaagcacuuuuuaaaa

SEQ ID NO: 3190974 - RNA, 15 nt, Human
uaagcacuuuuuaaa

SEQ ID NO: 3190975 - RNA, 21 nt, Human
uaagcacuuuuuaaaaaacuu

SEQ ID NO: 3190976 - RNA, 13 nt, Human
aaucuuacuuugu

SEQ ID NO: 3190977 - RNA, 14 nt, Human
aaucuuacuuugua

SEQ ID NO: 3190978 - RNA, 22 nt, Human
aaucuuaauacuguuauucuuu

SEQ ID NO: 3190979 - RNA, 15 nt, Human
aaucuuacuuuguaa

SEQ ID NO: 3190980 - RNA, 16 nt, Human
aaucuuacuuuguaaa

SEQ ID NO: 3190981 - RNA, 17 nt, Human
aaucuuacuuuguaaau

SEQ ID NO: 3190982 - RNA, 18 nt, Human
aaucuuacuuuguaaauu

SEQ ID NO: 3190983 - RNA, 19 nt, Human
aaucuuacuuuguaaauuc

SEQ ID NO: 3190984 - RNA, 20 nt, Human
aaucuuacuuuguaaauucu

SEQ ID NO: 3190985 - RNA, 21 nt, Human
aaucuguuuuauaccuugcuu

SEQ ID NO: 3190986 - RNA, 19 nt, Human
aaucuguuuuuacguaugu

SEQ ID NO: 3190987 - RNA, 14 nt, Human
aaucuuaagaaaua

SEQ ID NO: 3190988 - RNA, 13 nt, Human
aaucuuaagaaau

SEQ ID NO: 3190989 - RNA, 15 nt, Human
aaucuuaagaaauaa

SEQ ID NO: 3190990 - RNA, 21 nt, Human
aaucuuaauacuguuauucuu

SEQ ID NO: 3190991 - RNA, 18 nt, Human
aaucuuaauacuguuauu

SEQ ID NO: 3190992 - RNA, 17 nt, Human
aaucuuaauacuguuau

SEQ ID NO: 3190993 - RNA, 16 nt, Human
aaucuuaauacuguua

SEQ ID NO: 3190994 - RNA, 15 nt, Human
aaucuuaauacuguu

SEQ ID NO: 3190995 - RNA, 14 nt, Human
aaucuuaauacugu

SEQ ID NO: 3190996 - RNA, 12 nt, Human
aaucuuaauacu

SEQ ID NO: 3190997 - RNA, 19 nt, Human
aaucuacacuccagugaga

SEQ ID NO: 3190998 - RNA, 19 nt, Human
aaucuggaugccucauuau

SEQ ID NO: 3190999 - RNA, 21 nt, Human
aaucuggaugccucauuaugu

SEQ ID NO: 3191000 - RNA, 16 nt, Human
aaucugggccagaauu

SEQ ID NO: 3191001 - RNA, 17 nt, Human
aaucugggccagaauuu

SEQ ID NO: 3191002 - RNA, 16 nt, Human
aaucauguuucuuuga

SEQ ID NO: 3191003 - RNA, 19 nt, Human
aaucauguuucuuugauca

SEQ ID NO: 3191004 - RNA, 18 nt, Human
aaucauguuucuuugauc

SEQ ID NO: 3191005 - RNA, 17 nt, Human
aaucauguuucuuugau

SEQ ID NO: 3191006 - RNA, 21 nt, Human
aaucgagugccgcaucucaca

SEQ ID NO: 3191007 - RNA, 15 nt, Human
aaucgaccugccucg

SEQ ID NO: 3191008 - RNA, 12 nt, Human
aauccugguucc

SEQ ID NO: 3191009 - RNA, 19 nt, Human
uaaguauucuuauuuaaug

SEQ ID NO: 3191010 - RNA, 20 nt, Human
uaaguauucuuauuuaauga

SEQ ID NO: 3191011 - RNA, 16 nt, Human
uaaguacuauguauca

SEQ ID NO: 3191012 - RNA, 13 nt, Human
uaaguacuaugua

SEQ ID NO: 3191013 - RNA, 17 nt, Human
uaaguacuauguaucaa

SEQ ID NO: 3191014 - RNA, 18 nt, Human
uaaguaaaucucuucugu

SEQ ID NO: 3191015 - RNA, 16 nt, Human
uaaguaaaucucuucu

SEQ ID NO: 3191016 - RNA, 19 nt, Human
uaaguaaaaccacagcagu

SEQ ID NO: 3191017 - RNA, 22 nt, Human
uaaguaaaucucuucuguguuu

SEQ ID NO: 3191018 - RNA, 15 nt, Human
uaagcuuaugcuuaa

SEQ ID NO: 3191019 - RNA, 22 nt, Human
uaagcuguuugguuuuaaaaua

SEQ ID NO: 3191020 - RNA, 21 nt, Human
uaagcuguuugguuuuaaaau

SEQ ID NO: 3191021 - RNA, 18 nt, Human
uaagcuguuugguuuuaa

SEQ ID NO: 3191022 - RNA, 13 nt, Human
uaagcuuuuugga

SEQ ID NO: 3191023 - RNA, 15 nt, Human
uaagcuuuuuggaau

SEQ ID NO: 3191024 - RNA, 23 nt, Human
uaaguuggaaacacuaaauguua

SEQ ID NO: 3191025 - RNA, 22 nt, Human
uaaguuggaaacacuaaauguu

SEQ ID NO: 3191026 - RNA, 21 nt, Human
uaaguuggaaacacuaaaugu

SEQ ID NO: 3191027 - RNA, 18 nt, Human
uaaguuggaaacacuaaa

SEQ ID NO: 3191028 - RNA, 17 nt, Human
uaaguuggaaacacuaa

SEQ ID NO: 3191029 - RNA, 16 nt, Human
uaaguuggaaacacua

SEQ ID NO: 3191030 - RNA, 15 nt, Human
uaaguuggaaacacu

SEQ ID NO: 3191031 - RNA, 12 nt, Human
uaaguugaguau

SEQ ID NO: 3191032 - RNA, 13 nt, Human
uaaguuggaaaca

SEQ ID NO: 3191033 - RNA, 12 nt, Human
uaaguuggaaac

SEQ ID NO: 3191034 - RNA, 17 nt, Human
aaucauauuagacuucu

SEQ ID NO: 3191035 - RNA, 12 nt, Human
aaucauaaguau

SEQ ID NO: 3191036 - RNA, 19 nt, Human
aaucauacuccuaugcuuu

SEQ ID NO: 3191037 - RNA, 16 nt, Human
aaucauaaguauuugg

SEQ ID NO: 3191038 - RNA, 15 nt, Human
aaucauaaguauuug

SEQ ID NO: 3191039 - RNA, 14 nt, Human
aaucauaaguauuu

SEQ ID NO: 3191040 - RNA, 20 nt, Human
aaucauacuccuaugcuuua

SEQ ID NO: 3191041 - RNA, 13 nt, Human
aaucauauauaau

SEQ ID NO: 3191042 - RNA, 17 nt, Human
aaucauauauaauaaau

SEQ ID NO: 3191043 - RNA, 14 nt, Human
aaugaaacuuggau

SEQ ID NO: 3191044 - RNA, 17 nt, Human
aaugaaaccugugucuc

SEQ ID NO: 3191045 - RNA, 17 nt, Human
aaugaaagacuguacaa

SEQ ID NO: 3191046 - RNA, 16 nt, Human
aaugaaagacuguaca

SEQ ID NO: 3191047 - RNA, 17 nt, Human
aaugaaacauuuuguca

SEQ ID NO: 3191048 - RNA, 17 nt, Human
aaucuuuccauauccau

SEQ ID NO: 3191049 - RNA, 22 nt, Human
aaugaauggcuaagcaaaaugu

SEQ ID NO: 3191050 - RNA, 17 nt, Human
aaugaaugcauaaaaug

SEQ ID NO: 3191051 - RNA, 13 nt, Human
aaugaaugucagu

SEQ ID NO: 3191052 - RNA, 22 nt, Human
aaugaaugucagugugacugau

SEQ ID NO: 3191053 - RNA, 15 nt, Human
aaugaccuuucaaua

SEQ ID NO: 3191054 - RNA, 13 nt, Human
aaucuuuaauuaa

SEQ ID NO: 3191055 - RNA, 17 nt, Human
aaucuuuagaaaaggca

SEQ ID NO: 3191056 - RNA, 14 nt, Human
aaucuuuaauuaaa

SEQ ID NO: 3191057 - RNA, 19 nt, Human
uaaugugucaucuagcauu

SEQ ID NO: 3191058 - RNA, 15 nt, Human
uaaugaaugcauaaa

SEQ ID NO: 3191059 - RNA, 18 nt, Human
uaauguacugauuucagu

SEQ ID NO: 3191060 - RNA, 19 nt, Human
uaauguacugauuucagua

SEQ ID NO: 3191061 - RNA, 19 nt, Human
uaauguaucaaauacauuu

SEQ ID NO: 3191062 - RNA, 13 nt, Human
uaauguauauaaa

SEQ ID NO: 3191063 - RNA, 14 nt, Human
uaauguauauaaaa

SEQ ID NO: 3191064 - RNA, 15 nt, Human
uaauguauauaaaaa

SEQ ID NO: 3191065 - RNA, 16 nt, Human
uaauguauauaaaaau

SEQ ID NO: 3191066 - RNA, 22 nt, Human
uaauguauaugaacuuaacaug

SEQ ID NO: 3191067 - RNA, 13 nt, Human
uaauguacugcau

SEQ ID NO: 3191068 - RNA, 14 nt, Human
uaauguauucauau

SEQ ID NO: 3191069 - RNA, 18 nt, Human
uaauguauucauauuugu

SEQ ID NO: 3191070 - RNA, 17 nt, Human
uaauguauucauauuug

SEQ ID NO: 3191071 - RNA, 16 nt, Human
uaauguauucauauuu

SEQ ID NO: 3191072 - RNA, 15 nt, Human
uaauguauucauauu

SEQ ID NO: 3191073 - RNA, 18 nt, Human
uaaugucacaggcagguc

SEQ ID NO: 3191074 - RNA, 16 nt, Human
uaaugucauaaaguga

SEQ ID NO: 3191075 - RNA, 17 nt, Human
uaaugucauaaagugag

SEQ ID NO: 3191076 - RNA, 20 nt, Human
uaaugucauaaagugagaaa

SEQ ID NO: 3191077 - RNA, 20 nt, Human
uaauguauucauauuuguac

SEQ ID NO: 3191078 - RNA, 19 nt, Human
uaauguauucauauuugua

SEQ ID NO: 3191079 - RNA, 18 nt, Human
aaucuuauuaaaguuuca

SEQ ID NO: 3191080 - RNA, 17 nt, Human
aaucuuauuaaaguuuc

SEQ ID NO: 3191081 - RNA, 18 nt, Human
uaauagauugugaauaau

SEQ ID NO: 3191082 - RNA, 18 nt, Human
uaauauuucuucaaauau

SEQ ID NO: 3191083 - RNA, 13 nt, Human
uaauauuuauuaa

SEQ ID NO: 3191084 - RNA, 16 nt, Human
uaauauuuauuaaauu

SEQ ID NO: 3191085 - RNA, 17 nt, Human
uaauauuuauuaaauuu

SEQ ID NO: 3191086 - RNA, 13 nt, Human
uaauauuuacaau

SEQ ID NO: 3191087 - RNA, 15 nt, Human
uaauauuuacaaugu

SEQ ID NO: 3191088 - RNA, 16 nt, Human
uaauauuuacaaugua

SEQ ID NO: 3191089 - RNA, 19 nt, Human
uaauauuuacaauguauua

SEQ ID NO: 3191090 - RNA, 20 nt, Human
uaauauuuacaauguauuaa

SEQ ID NO: 3191091 - RNA, 16 nt, Human
aaucuuauuaaaguuu

SEQ ID NO: 3191092 - RNA, 15 nt, Human
aaucuuauuaaaguu

SEQ ID NO: 3191093 - RNA, 14 nt, Human
aaucuuauuaaagu

SEQ ID NO: 3191094 - RNA, 13 nt, Human
aaucuuauuaaag

SEQ ID NO: 3191095 - RNA, 14 nt, Human
uaaucuuuucugaa

SEQ ID NO: 3191096 - RNA, 17 nt, Human
uaaugaaugaaacauuu

SEQ ID NO: 3191097 - RNA, 12 nt, Human
uaaugaaugacu

SEQ ID NO: 3191098 - RNA, 15 nt, Human
uaaucuuuucugaau

SEQ ID NO: 3191099 - RNA, 17 nt, Human
uaauauuuuuacaugca

SEQ ID NO: 3191100 - RNA, 22 nt, Human
uaaucacuguguauauuugauu

SEQ ID NO: 3191101 - RNA, 20 nt, Human
uaaucacuguguauauuuga

SEQ ID NO: 3191102 - RNA, 21 nt, Human
uaaucacuguguauauuugau

SEQ ID NO: 3191103 - RNA, 10 nt, Human
uaaucacugu

SEQ ID NO: 3191104 - RNA, 12 nt, Human
uaaucacugugu

SEQ ID NO: 3191105 - RNA, 16 nt, Human
uaaucacucagagcag

SEQ ID NO: 3191106 - RNA, 13 nt, Human
uaaucacugugua

SEQ ID NO: 3191107 - RNA, 14 nt, Human
uaaucacuguguau

SEQ ID NO: 3191108 - RNA, 15 nt, Human
uaaucacuguguaua

SEQ ID NO: 3191109 - RNA, 16 nt, Human
uaaucacuguguauau

SEQ ID NO: 3191110 - RNA, 22 nt, Human
uaaucagaauggaagagagaaa

SEQ ID NO: 3191111 - RNA, 12 nt, Human
uaauccaguaaa

SEQ ID NO: 3191112 - RNA, 14 nt, Human
uacuggauaaauug

SEQ ID NO: 3191113 - RNA, 16 nt, Human
uacuggauaaauuguu

SEQ ID NO: 3191114 - RNA, 17 nt, Human
uacuggauaaauuguuu

SEQ ID NO: 3191115 - RNA, 15 nt, Human
uacuggaucucuuaa

SEQ ID NO: 3191116 - RNA, 13 nt, Human
uacuggauucuua

SEQ ID NO: 3191117 - RNA, 16 nt, Human
uacuggagaaaaugga

SEQ ID NO: 3191118 - RNA, 12 nt, Human
uacucuguguca

SEQ ID NO: 3191119 - RNA, 11 nt, Human
uacucugggaa

SEQ ID NO: 3191120 - RNA, 13 nt, Human
uacucugggaacu

SEQ ID NO: 3191121 - RNA, 12 nt, Human
uacucugggaac

SEQ ID NO: 3191122 - RNA, 12 nt, Human
aauugcauuucc

SEQ ID NO: 3191123 - RNA, 14 nt, Human
aauugccuuucugu

SEQ ID NO: 3191124 - RNA, 16 nt, Human
aauugcauuugcuuuu

SEQ ID NO: 3191125 - RNA, 22 nt, Human
aauugacccacaagaaaugaaa

SEQ ID NO: 3191126 - RNA, 23 nt, Human
aauugaccgacagcuuuccagua

SEQ ID NO: 3191127 - RNA, 21 nt, Human
aauugacccacaagaaaugaa

SEQ ID NO: 3191128 - RNA, 15 nt, Human
uacuguacaugggac

SEQ ID NO: 3191129 - RNA, 14 nt, Human
aauucccuaaagcc

SEQ ID NO: 3191130 - RNA, 22 nt, Human
uacgccaggggaaaaucagccu

SEQ ID NO: 3191131 - RNA, 20 nt, Human
uacgagcaagcuuuuacaac

SEQ ID NO: 3191132 - RNA, 20 nt, Human
uacgaguaauugcauuugcu

SEQ ID NO: 3191133 - RNA, 22 nt, Human
uacguaaaaaucucucauuugu

SEQ ID NO: 3191134 - RNA, 18 nt, Human
uacgggaggguaaggcug

SEQ ID NO: 3191135 - RNA, 23 nt, Human
uacucuccuggaaauauuaagaa

SEQ ID NO: 3191136 - RNA, 22 nt, Human
uacucuccuggaaauauuaaga

SEQ ID NO: 3191137 - RNA, 22 nt, Human
uacuaucuuaucucagauauuu

SEQ ID NO: 3191138 - RNA, 13 nt, Human
uacuauguaucaa

SEQ ID NO: 3191139 - RNA, 12 nt, Human
uacuauguauca

SEQ ID NO: 3191140 - RNA, 21 nt, Human
uacuaucuuaucucagauauu

SEQ ID NO: 3191141 - RNA, 17 nt, Human
uacuaucuuaucucaga

SEQ ID NO: 3191142 - RNA, 17 nt, Human
uacuacuccuguaggaa

SEQ ID NO: 3191143 - RNA, 13 nt, Human
uacuacuccugua

SEQ ID NO: 3191144 - RNA, 20 nt, Human
uacuaucaugucaaacguga

SEQ ID NO: 3191145 - RNA, 16 nt, Human
uacuacugaccagaca

SEQ ID NO: 3191146 - RNA, 20 nt, Human
uacuacugaccagacaagcu

SEQ ID NO: 3191147 - RNA, 21 nt, Human
uaccaccaucccgugcuuuua

SEQ ID NO: 3191148 - RNA, 22 nt, Human
uacauucuuuuugcucuaaaau

SEQ ID NO: 3191149 - RNA, 23 nt, Human
uaccaccucacuuuuucauuucc

SEQ ID NO: 3191150 - RNA, 18 nt, Human
uaccacccgguccccacu

SEQ ID NO: 3191151 - RNA, 19 nt, Human
uaccacggccuccuuuccg

SEQ ID NO: 3191152 - RNA, 18 nt, Human
uaccacggccuccuuucc

SEQ ID NO: 3191153 - RNA, 16 nt, Human
uaccacgaaauacuua

SEQ ID NO: 3191154 - RNA, 18 nt, Human
uaccugccaggaagccag

SEQ ID NO: 3191155 - RNA, 20 nt, Human
uaccugccaggaagccagca

SEQ ID NO: 3191156 - RNA, 23 nt, Human
uaccugccaggaagccagcaggc

SEQ ID NO: 3191157 - RNA, 16 nt, Human
uaccugccaggaagcc

SEQ ID NO: 3191158 - RNA, 13 nt, Human
uaccugucccccu

SEQ ID NO: 3191159 - RNA, 14 nt, Human
uaccugucccccug

SEQ ID NO: 3191160 - RNA, 16 nt, Human
uaccugucccccugac

SEQ ID NO: 3191161 - RNA, 17 nt, Human
uaccugucccccugaca

SEQ ID NO: 3191162 - RNA, 10 nt, Human
uaccuguccc

SEQ ID NO: 3191163 - RNA, 20 nt, Human
uaccugcgcuuguuuuaaag

SEQ ID NO: 3191164 - RNA, 16 nt, Human
uaccugcgcuuguuuu

SEQ ID NO: 3191165 - RNA, 15 nt, Human
uaccuggaaucaaau

SEQ ID NO: 3191166 - RNA, 21 nt, Human
uaccuggaaucaaauaaaaau

SEQ ID NO: 3191167 - RNA, 20 nt, Human
uaccuggguccccagcccuu

SEQ ID NO: 3191168 - RNA, 19 nt, Human
uaccuggguccccagcccu

SEQ ID NO: 3191169 - RNA, 17 nt, Human
uaccuggguccccagcc

SEQ ID NO: 3191170 - RNA, 15 nt, Human
uaccuggauguucuu

SEQ ID NO: 3191171 - RNA, 19 nt, Human
uaccuggauguucuuuuua

SEQ ID NO: 3191172 - RNA, 22 nt, Human
aauuagccuaagauauacuugu

SEQ ID NO: 3191173 - RNA, 20 nt, Human
aauuagccuaagauauacuu

SEQ ID NO: 3191174 - RNA, 19 nt, Human
aauuagccuaagauauacu

SEQ ID NO: 3191175 - RNA, 15 nt, Human
aauuagccaagugug

SEQ ID NO: 3191176 - RNA, 20 nt, Human
aauuagauccauuaauuuaa

SEQ ID NO: 3191177 - RNA, 21 nt, Human
aauuagauccauuaauuuaaa

SEQ ID NO: 3191178 - RNA, 23 nt, Human
aauuagauccauuaauuuaaaug

SEQ ID NO: 3191179 - RNA, 13 nt, Human
aauuagauuucuc

SEQ ID NO: 3191180 - RNA, 21 nt, Human
aauuagauuuuaaaacuucau

SEQ ID NO: 3191181 - RNA, 13 nt, Human
aauuagauuuuaa

SEQ ID NO: 3191182 - RNA, 15 nt, Human
aauuagccuaagaua

SEQ ID NO: 3191183 - RNA, 11 nt, Human
aauuacaggaa

SEQ ID NO: 3191184 - RNA, 16 nt, Human
aauuacaauauuucug

SEQ ID NO: 3191185 - RNA, 16 nt, Human
aauuacaacuaaguga

SEQ ID NO: 3191186 - RNA, 14 nt, Human
aauuacaacuaagu

SEQ ID NO: 3191187 - RNA, 13 nt, Human
aauuaauuucagu

SEQ ID NO: 3191188 - RNA, 13 nt, Human
aauuaauuuggag

SEQ ID NO: 3191189 - RNA, 12 nt, Human
aauuaauuucag

SEQ ID NO: 3191190 - RNA, 20 nt, Human
uaccuguauacguuucaaaa

SEQ ID NO: 3191191 - RNA, 22 nt, Human
aauuaauugugugaacuuggaa

SEQ ID NO: 3191192 - RNA, 20 nt, Human
aauuacacucuuccuccauu

SEQ ID NO: 3191193 - RNA, 17 nt, Human
aauuacccuuuugcagg

SEQ ID NO: 3191194 - RNA, 16 nt, Human
aauuaccauuuguuaa

SEQ ID NO: 3191195 - RNA, 18 nt, Human
aauuaccauuuguuaaua

SEQ ID NO: 3191196 - RNA, 23 nt, Human
aauuaccauuuguuaauaucacu

SEQ ID NO: 3191197 - RNA, 18 nt, Human
aauuaccuggauguucuu

SEQ ID NO: 3191198 - RNA, 17 nt, Human
aauuacuauagcaaagu

SEQ ID NO: 3191199 - RNA, 23 nt, Human
aauuacuaacuucuaaaacugua

SEQ ID NO: 3191200 - RNA, 21 nt, Human
aauuacuaacuucuaaaacug

SEQ ID NO: 3191201 - RNA, 20 nt, Human
aauuacuaacuucuaaaacu

SEQ ID NO: 3191202 - RNA, 18 nt, Human
aauuacuaacuucuaaaa

SEQ ID NO: 3191203 - RNA, 13 nt, Human
aauuacuaacuuc

SEQ ID NO: 3191204 - RNA, 17 nt, Human
aauuacuaacuucuaaa

SEQ ID NO: 3191205 - RNA, 16 nt, Human
aauuacuaacuucuaa

SEQ ID NO: 3191206 - RNA, 15 nt, Human
aauuacuaacuucua

SEQ ID NO: 3191207 - RNA, 14 nt, Human
aauuacuaacuucu

SEQ ID NO: 3191208 - RNA, 16 nt, Human
aauuauugaugaaaau

SEQ ID NO: 3191209 - RNA, 15 nt, Human
aauuauugaugaaaa

SEQ ID NO: 3191210 - RNA, 15 nt, Human
aauuauuuuuaagug

SEQ ID NO: 3191211 - RNA, 16 nt, Human
aauucaaaccuaaguu

SEQ ID NO: 3191212 - RNA, 13 nt, Human
aauucaaaccuaa

SEQ ID NO: 3191213 - RNA, 14 nt, Human
aauucaaagaauca

SEQ ID NO: 3191214 - RNA, 13 nt, Human
aauucaaagcaug

SEQ ID NO: 3191215 - RNA, 19 nt, Human
aauucaaagcauggacauu

SEQ ID NO: 3191216 - RNA, 17 nt, Human
aauuauuccaaaccaaa

SEQ ID NO: 3191217 - RNA, 18 nt, Human
aauuagggcucuaauuuc

SEQ ID NO: 3191218 - RNA, 20 nt, Human
aauuagggcucuaauuuccu

SEQ ID NO: 3191219 - RNA, 19 nt, Human
aauuagggcucuaauuucc

SEQ ID NO: 3191220 - RNA, 16 nt, Human
aauucauuuucucuuu

SEQ ID NO: 3191221 - RNA, 15 nt, Human
aauucacaaaguuaa

SEQ ID NO: 3191222 - RNA, 18 nt, Human
aauucaccacagacuuua

SEQ ID NO: 3191223 - RNA, 17 nt, Human
aauucaccacagacuuu

SEQ ID NO: 3191224 - RNA, 22 nt, Human
aauuccacuuauaggaauugac

SEQ ID NO: 3191225 - RNA, 14 nt, Human
aauuccagaaugaa

SEQ ID NO: 3191226 - RNA, 17 nt, Human
aauuccaaacaugguuu

SEQ ID NO: 3191227 - RNA, 14 nt, Human
aauuccaaacaugg

SEQ ID NO: 3191228 - RNA, 14 nt, Human
aauuccccacccug

SEQ ID NO: 3191229 - RNA, 12 nt, Human
aauuccccagau

SEQ ID NO: 3191230 - RNA, 24 nt, Human
aauuccaucaagccaagccuccug

SEQ ID NO: 3191231 - RNA, 16 nt, Human
aauuccaugaauguuc

SEQ ID NO: 3191232 - RNA, 14 nt, Human
aauuccaugaaugu

SEQ ID NO: 3191233 - RNA, 20 nt, Human
aauggaaaugggcagagcag

SEQ ID NO: 3191234 - RNA, 21 nt, Human
aauggaaaugggcagagcaga

SEQ ID NO: 3191235 - RNA, 23 nt, Human
aauggacguguuaugacuccaga

SEQ ID NO: 3191236 - RNA, 20 nt, Human
aauggacuaacuugucuuug

SEQ ID NO: 3191237 - RNA, 21 nt, Human
aauggacguguuaugacucca

SEQ ID NO: 3191238 - RNA, 22 nt, Human
aaugcuguauuagucacagaga

SEQ ID NO: 3191239 - RNA, 11 nt, Human
aaugcccagcc

SEQ ID NO: 3191240 - RNA, 12 nt, Human
aaugcccagccc

SEQ ID NO: 3191241 - RNA, 15 nt, Human
aaugccaucaaauga

SEQ ID NO: 3191242 - RNA, 13 nt, Human
aaugccaugaauu

SEQ ID NO: 3191243 - RNA, 22 nt, Human
aaugcacuuuguucuggcucuu

SEQ ID NO: 3191244 - RNA, 12 nt, Human
aaugcagaacuc

SEQ ID NO: 3191245 - RNA, 13 nt, Human
uacaaugugacuu

SEQ ID NO: 3191246 - RNA, 20 nt, Human
aaugcacuuuguucuggcuc

SEQ ID NO: 3191247 - RNA, 18 nt, Human
aaugaccuuucaauagga

SEQ ID NO: 3191248 - RNA, 16 nt, Human
aaugaccuuucaauag

SEQ ID NO: 3191249 - RNA, 17 nt, Human
aaugaccuuucaauagg

SEQ ID NO: 3191250 - RNA, 21 nt, Human
aaugcacuuuguucuggcucu

SEQ ID NO: 3191251 - RNA, 13 nt, Human
uacaauguauuaa

SEQ ID NO: 3191252 - RNA, 15 nt, Human
uacacuaaaagguga

SEQ ID NO: 3191253 - RNA, 23 nt, Human
aauguaacuguuaccauuggaaa

SEQ ID NO: 3191254 - RNA, 22 nt, Human
uacagacaacaaaccuguuucu

SEQ ID NO: 3191255 - RNA, 19 nt, Human
uacagacaaagcguggugg

SEQ ID NO: 3191256 - RNA, 23 nt, Human
uacagaccgaacuguuguauaaa

SEQ ID NO: 3191257 - RNA, 21 nt, Human
uacagaccgaacuguuguaua

SEQ ID NO: 3191258 - RNA, 20 nt, Human
uacagaccgaacuguuguau

SEQ ID NO: 3191259 - RNA, 19 nt, Human
uacagaccgaacuguugua

SEQ ID NO: 3191260 - RNA, 18 nt, Human
uacagaggccaugggccu

SEQ ID NO: 3191261 - RNA, 21 nt, Human
uacagauaaaugauucaaaaa

SEQ ID NO: 3191262 - RNA, 20 nt, Human
uacagauccccaagccuggc

SEQ ID NO: 3191263 - RNA, 20 nt, Human
uacagauaaaugauucaaaa

SEQ ID NO: 3191264 - RNA, 16 nt, Human
uacagauaaaugauuc

SEQ ID NO: 3191265 - RNA, 15 nt, Human
uacagauaaaugauu

SEQ ID NO: 3191266 - RNA, 13 nt, Human
uacagauaaauga

SEQ ID NO: 3191267 - RNA, 16 nt, Human
aauggcagccuuggca

SEQ ID NO: 3191268 - RNA, 12 nt, Human
aauggcagccuu

SEQ ID NO: 3191269 - RNA, 20 nt, Human
aauggcaauguuuugcuuuu

SEQ ID NO: 3191270 - RNA, 23 nt, Human
aauggcacaaucucggcucacug

SEQ ID NO: 3191271 - RNA, 17 nt, Human
aauggcaaguuuuccau

SEQ ID NO: 3191272 - RNA, 14 nt, Human
aauggcaaguuuuc

SEQ ID NO: 3191273 - RNA, 21 nt, Human
aauggcaacaaacugcacaug

SEQ ID NO: 3191274 - RNA, 20 nt, Human
aauggcaacaaacugcacau

SEQ ID NO: 3191275 - RNA, 17 nt, Human
aauggcaacaaacugca

SEQ ID NO: 3191276 - RNA, 14 nt, Human
aauggcaacaaacu

SEQ ID NO: 3191277 - RNA, 16 nt, Human
aauggacuauccauua

SEQ ID NO: 3191278 - RNA, 22 nt, Human
aauguaacuguuaccauuggaa

SEQ ID NO: 3191279 - RNA, 20 nt, Human
aauguaacuguuaccauugg

SEQ ID NO: 3191280 - RNA, 13 nt, Human
aauguaacuguua

SEQ ID NO: 3191281 - RNA, 12 nt, Human
aauguaacuguu

SEQ ID NO: 3191282 - RNA, 16 nt, Human
aauguaacugcucuug

SEQ ID NO: 3191283 - RNA, 20 nt, Human
aauguaacuguccguaguau

SEQ ID NO: 3191284 - RNA, 15 nt, Human
aauguaacugcucuu

SEQ ID NO: 3191285 - RNA, 11 nt, Human
aauguaacugc

SEQ ID NO: 3191286 - RNA, 14 nt, Human
aauggcugaagcca

SEQ ID NO: 3191287 - RNA, 14 nt, Human
aauggcuauuaaca

SEQ ID NO: 3191288 - RNA, 15 nt, Human
aauggcauuugcaau

SEQ ID NO: 3191289 - RNA, 22 nt, Human
aauguuaagcaucuaaggacaa

SEQ ID NO: 3191290 - RNA, 15 nt, Human
aauguguuuuggucc

SEQ ID NO: 3191291 - RNA, 21 nt, Human
aauguuaaagauguagcaaac

SEQ ID NO: 3191292 - RNA, 20 nt, Human
aauguuaaagauguagcaaa

SEQ ID NO: 3191293 - RNA, 19 nt, Human
aauguuaaagauguagcaa

SEQ ID NO: 3191294 - RNA, 16 nt, Human
aauguuaaagauguag

SEQ ID NO: 3191295 - RNA, 15 nt, Human
aauguuaaagaugua

SEQ ID NO: 3191296 - RNA, 14 nt, Human
aauguuaaagaugu

SEQ ID NO: 3191297 - RNA, 13 nt, Human
aauguuaaagaug

SEQ ID NO: 3191298 - RNA, 20 nt, Human
aauuaaccaagguagaauga

SEQ ID NO: 3191299 - RNA, 20 nt, Human
aauuaaccccauaauuagau

SEQ ID NO: 3191300 - RNA, 15 nt, Human
aauguugaacaaaau

SEQ ID NO: 3191301 - RNA, 21 nt, Human
aauguucucucuucuccaccu

SEQ ID NO: 3191302 - RNA, 14 nt, Human
aauguucuuccagu

SEQ ID NO: 3191303 - RNA, 12 nt, Human
aauguucuucca

SEQ ID NO: 3191304 - RNA, 19 nt, Human
aauguucugcuaaauuuca

SEQ ID NO: 3191305 - RNA, 12 nt, Human
aauuaagaagaa

SEQ ID NO: 3191306 - RNA, 16 nt, Human
aauuaagaagaaacua

SEQ ID NO: 3191307 - RNA, 13 nt, Human
aauuaauugugug

SEQ ID NO: 3191308 - RNA, 13 nt, Human
aauuaauaucuuu

SEQ ID NO: 3191309 - RNA, 17 nt, Human
aauuaauaucuuucugc

SEQ ID NO: 3191310 - RNA, 22 nt, Human
aauuaaucugggccagaauuuc

SEQ ID NO: 3191311 - RNA, 17 nt, Human
aauuaauauauuaaaau

SEQ ID NO: 3191312 - RNA, 19 nt, Human
aauuaauauauuaaaauuc

SEQ ID NO: 3191313 - RNA, 22 nt, Human
uacauugccguggcaucuuaaa

SEQ ID NO: 3191314 - RNA, 21 nt, Human
uacauucuuuuugcucuaaaa

SEQ ID NO: 3191315 - RNA, 18 nt, Human
uacauucuuuuugcucua

SEQ ID NO: 3191316 - RNA, 15 nt, Human
uacauucuuuuugcu

SEQ ID NO: 3191317 - RNA, 16 nt, Human
uacauucuuuuugcuc

SEQ ID NO: 3191318 - RNA, 20 nt, Human
uacaugugcacauugugcag

SEQ ID NO: 3191319 - RNA, 16 nt, Human
uacaugugcacauugu

SEQ ID NO: 3191320 - RNA, 15 nt, Human
aauuaauugugugaa

SEQ ID NO: 3191321 - RNA, 15 nt, Human
uacauaugauaaauu

SEQ ID NO: 3191322 - RNA, 15 nt, Human
aauguaguuugagga

SEQ ID NO: 3191323 - RNA, 18 nt, Human
aauguaguuugaggaaau

SEQ ID NO: 3191324 - RNA, 23 nt, Human
aauguaguuugaggaaauuugca

SEQ ID NO: 3191325 - RNA, 20 nt, Human
aauguaguuugaggaaauuu

SEQ ID NO: 3191326 - RNA, 20 nt, Human
uacagguacuuugucuaaga

SEQ ID NO: 3191327 - RNA, 15 nt, Human
uacagguacuuuguc

SEQ ID NO: 3191328 - RNA, 14 nt, Human
uacagguacuuugu

SEQ ID NO: 3191329 - RNA, 16 nt, Human
uacaggugugagucac

SEQ ID NO: 3191330 - RNA, 16 nt, Human
uacagaugugggccac

SEQ ID NO: 3191331 - RNA, 16 nt, Human
uacagguaccaguucu

SEQ ID NO: 3191332 - RNA, 18 nt, Human
aauguaucaaauacauuu

SEQ ID NO: 3191333 - RNA, 20 nt, Human
aauguauguguaaguauucu

SEQ ID NO: 3191334 - RNA, 23 nt, Human
aauguauuaagcccacaguauau

SEQ ID NO: 3191335 - RNA, 17 nt, Human
aaugugaaaagaaaaau

SEQ ID NO: 3191336 - RNA, 22 nt, Human
aauguauuauguccugugagau

SEQ ID NO: 3191337 - RNA, 19 nt, Human
aauguauguguaaguauuc

SEQ ID NO: 3191338 - RNA, 20 nt, Human
aauguauaugaacuuaacau

SEQ ID NO: 3191339 - RNA, 14 nt, Human
aauguauaguauuu

SEQ ID NO: 3191340 - RNA, 22 nt, Human
aauguauaguauuugaaaacag

SEQ ID NO: 3191341 - RNA, 12 nt, Human
aauguauauaaa

SEQ ID NO: 3191342 - RNA, 13 nt, Human
aauguauauaaaa

SEQ ID NO: 3191343 - RNA, 14 nt, Human
aauguauauaaaaa

SEQ ID NO: 3191344 - RNA, 15 nt, Human
aauguauauaaaaau

SEQ ID NO: 3191345 - RNA, 17 nt, Human
aauguauauaaaaaugg

SEQ ID NO: 3191346 - RNA, 21 nt, Human
aauguauaguauuugaaaaca

SEQ ID NO: 3191347 - RNA, 19 nt, Human
aauguauaguauuugaaaa

SEQ ID NO: 3191348 - RNA, 18 nt, Human
aauguauaguauuugaaa

SEQ ID NO: 3191349 - RNA, 17 nt, Human
aauguauaguauuugaa

SEQ ID NO: 3191350 - RNA, 16 nt, Human
aauguauaguauuuga

SEQ ID NO: 3191351 - RNA, 15 nt, Human
aauguauaguauuug

SEQ ID NO: 3191352 - RNA, 19 nt, Human
aaugugaaaagaaaaauga

SEQ ID NO: 3191353 - RNA, 11 nt, Human
aaugugugugu

SEQ ID NO: 3191354 - RNA, 16 nt, Human
acaccugacagccccu

SEQ ID NO: 3191355 - RNA, 19 nt, Human
acaccucugcacaagcugc

SEQ ID NO: 3191356 - RNA, 21 nt, Human
acaccucugcacaagcugcac

SEQ ID NO: 3191357 - RNA, 19 nt, Human
acacccugugauggggccc

SEQ ID NO: 3191358 - RNA, 14 nt, Human
acacccuuggagcu

SEQ ID NO: 3191359 - RNA, 16 nt, Human
acaccgggcacucaga

SEQ ID NO: 3191360 - RNA, 18 nt, Human
acacccuuggagcucuga

SEQ ID NO: 3191361 - RNA, 14 nt, Human
acaccgggccugga

SEQ ID NO: 3191362 - RNA, 20 nt, Human
acacuaaccacgcuggaccu

SEQ ID NO: 3191363 - RNA, 12 nt, Human
acaccuucuaua

SEQ ID NO: 3191364 - RNA, 21 nt, Human
acaccuuagccugcccuccuu

SEQ ID NO: 3191365 - RNA, 16 nt, Human
uauaagaaaaauguga

SEQ ID NO: 3191366 - RNA, 13 nt, Human
uauaacuuuagaa

SEQ ID NO: 3191367 - RNA, 16 nt, Human
uauaacuuuagaaaua

SEQ ID NO: 3191368 - RNA, 24 nt, Human
uauaacuuauauuguaagaaauac

SEQ ID NO: 3191369 - RNA, 22 nt, Human
uauaacuuauauuguaagaaau

SEQ ID NO: 3191370 - RNA, 21 nt, Human
uauaacuuauauuguaagaaa

SEQ ID NO: 3191371 - RNA, 19 nt, Human
uauaacuuauauuguaaga

SEQ ID NO: 3191372 - RNA, 18 nt, Human
acacucaaaucaagaaac

SEQ ID NO: 3191373 - RNA, 20 nt, Human
acacucacauuuauucugcu

SEQ ID NO: 3191374 - RNA, 17 nt, Human
uauaacuuauauuguaa

SEQ ID NO: 3191375 - RNA, 19 nt, Human
acacucaaaucaagaaacu

SEQ ID NO: 3191376 - RNA, 15 nt, Human
acacucaaaagcugg

SEQ ID NO: 3191377 - RNA, 23 nt, Human
acacauauaaauugucuuaaugg

SEQ ID NO: 3191378 - RNA, 18 nt, Human
uaguucagguaacaggca

SEQ ID NO: 3191379 - RNA, 20 nt, Human
uaguucaucccuucucuucc

SEQ ID NO: 3191380 - RNA, 20 nt, Human
uaguuccaccaucaagccac

SEQ ID NO: 3191381 - RNA, 15 nt, Human
uaguuccacugagac

SEQ ID NO: 3191382 - RNA, 14 nt, Human
uaguuccacugaga

SEQ ID NO: 3191383 - RNA, 22 nt, Human
uauaaaaaaucaugccaguauu

SEQ ID NO: 3191384 - RNA, 21 nt, Human
uaguuccccaaauacaaaguu

SEQ ID NO: 3191385 - RNA, 14 nt, Human
uauaaaaagauaau

SEQ ID NO: 3191386 - RNA, 15 nt, Human
acacaucagcuugcc

SEQ ID NO: 3191387 - RNA, 18 nt, Human
acacaugauccugcaauu

SEQ ID NO: 3191388 - RNA, 21 nt, Human
acacaugagcaucaggccagg

SEQ ID NO: 3191389 - RNA, 15 nt, Human
acaccauuaccaaaa

SEQ ID NO: 3191390 - RNA, 16 nt, Human
acaccauuaccaaaau

SEQ ID NO: 3191391 - RNA, 20 nt, Human
acaccauuaccaaaauaaua

SEQ ID NO: 3191392 - RNA, 21 nt, Human
acaccauuaccaaaauaauaa

SEQ ID NO: 3191393 - RNA, 20 nt, Human
acacaucagccaucaacuaa

SEQ ID NO: 3191394 - RNA, 19 nt, Human
acaccaucacagcuuguuu

SEQ ID NO: 3191395 - RNA, 21 nt, Human
acaccaucacagcuuguuuug

SEQ ID NO: 3191396 - RNA, 15 nt, Human
acaccaucuuuuauu

SEQ ID NO: 3191397 - RNA, 18 nt, Human
acaccaucuuuuauucuu

SEQ ID NO: 3191398 - RNA, 21 nt, Human
acaccaucuuuuauucuuuuu

SEQ ID NO: 3191399 - RNA, 14 nt, Human
acacacacauacac

SEQ ID NO: 3191400 - RNA, 13 nt, Human
acacacaaagcag

SEQ ID NO: 3191401 - RNA, 15 nt, Human
acacaauuagauuuc

SEQ ID NO: 3191402 - RNA, 17 nt, Human
acacaauuggaagucua

SEQ ID NO: 3191403 - RNA, 19 nt, Human
acaaugugaaaagaaaaau

SEQ ID NO: 3191404 - RNA, 17 nt, Human
acaaugugaaaagaaaa

SEQ ID NO: 3191405 - RNA, 15 nt, Human
acacacucaaaucaa

SEQ ID NO: 3191406 - RNA, 13 nt, Human
acacacgcugccu

SEQ ID NO: 3191407 - RNA, 14 nt, Human
acacacgcugccuu

SEQ ID NO: 3191408 - RNA, 21 nt, Human
acacacgcgugcacacaccag

SEQ ID NO: 3191409 - RNA, 20 nt, Human
acacaccagagcccaccuug

SEQ ID NO: 3191410 - RNA, 15 nt, Human
acacaccagagccca

SEQ ID NO: 3191411 - RNA, 14 nt, Human
acacaccagagccc

SEQ ID NO: 3191412 - RNA, 14 nt, Human
acacacagcucugu

SEQ ID NO: 3191413 - RNA, 13 nt, Human
acacacagcucug

SEQ ID NO: 3191414 - RNA, 17 nt, Human
acacacagcucuguccu

SEQ ID NO: 3191415 - RNA, 17 nt, Human
uagugaagacuccagaa

SEQ ID NO: 3191416 - RNA, 18 nt, Human
uagugaagacuccagaaa

SEQ ID NO: 3191417 - RNA, 22 nt, Human
uaguacuagagauauuuuguaa

SEQ ID NO: 3191418 - RNA, 23 nt, Human
uaguacuagagauauuuuguaaa

SEQ ID NO: 3191419 - RNA, 14 nt, Human
uaguuaaucuauaa

SEQ ID NO: 3191420 - RNA, 13 nt, Human
uaguuaaagaaag

SEQ ID NO: 3191421 - RNA, 17 nt, Human
uaguuaaagaaaggaaa

SEQ ID NO: 3191422 - RNA, 18 nt, Human
uaguuaaagaaaggaaaa

SEQ ID NO: 3191423 - RNA, 21 nt, Human
uaguuaaagaaaggaaaagaa

SEQ ID NO: 3191424 - RNA, 16 nt, Human
acacaguauuacuucu

SEQ ID NO: 3191425 - RNA, 18 nt, Human
acacaguauuacuucugc

SEQ ID NO: 3191426 - RNA, 19 nt, Human
acacaguauuacuucugcu

SEQ ID NO: 3191427 - RNA, 13 nt, Human
acacagugagucg

SEQ ID NO: 3191428 - RNA, 12 nt, Human
acacauaaauau

SEQ ID NO: 3191429 - RNA, 15 nt, Human
acacauaauuaacac

SEQ ID NO: 3191430 - RNA, 16 nt, Human
uaguaaauguaguuca

SEQ ID NO: 3191431 - RNA, 17 nt, Human
uaggcaagauggcacag

SEQ ID NO: 3191432 - RNA, 16 nt, Human
uaggagggaaaccuuu

SEQ ID NO: 3191433 - RNA, 17 nt, Human
uaggcaaguuuucccug

SEQ ID NO: 3191434 - RNA, 19 nt, Human
uaggcaagauggcacaggg

SEQ ID NO: 3191435 - RNA, 16 nt, Human
uaggcauuugcugaau

SEQ ID NO: 3191436 - RNA, 20 nt, Human
uaggcauuugcugaauacag

SEQ ID NO: 3191437 - RNA, 14 nt, Human
uaggcauuguggga

SEQ ID NO: 3191438 - RNA, 15 nt, Human
uagggagagaagaua

SEQ ID NO: 3191439 - RNA, 14 nt, Human
uagggagagaagau

SEQ ID NO: 3191440 - RNA, 15 nt, Human
uagggaccagaacca

SEQ ID NO: 3191441 - RNA, 16 nt, Human
uaggcagccugagagu

SEQ ID NO: 3191442 - RNA, 12 nt, Human
uaggcauuugua

SEQ ID NO: 3191443 - RNA, 13 nt, Human
uaggcauuuguaa

SEQ ID NO: 3191444 - RNA, 14 nt, Human
uaggcauuuguaaa

SEQ ID NO: 3191445 - RNA, 21 nt, Human
uaggcauuuguaaauauuaaa

SEQ ID NO: 3191446 - RNA, 14 nt, Human
uagggaccagaacc

SEQ ID NO: 3191447 - RNA, 16 nt, Human
uaggaaauccagggug

SEQ ID NO: 3191448 - RNA, 12 nt, Human
uagcuuaagaaa

SEQ ID NO: 3191449 - RNA, 15 nt, Human
uagcuuaagaaaaaa

SEQ ID NO: 3191450 - RNA, 14 nt, Human
uagcuuaagaaaaa

SEQ ID NO: 3191451 - RNA, 11 nt, Human
uagcuguguua

SEQ ID NO: 3191452 - RNA, 13 nt, Human
uaggagacuugua

SEQ ID NO: 3191453 - RNA, 17 nt, Human
uaggacuuguuuuuguu

SEQ ID NO: 3191454 - RNA, 19 nt, Human
uagcuaauaacaugugaaa

SEQ ID NO: 3191455 - RNA, 13 nt, Human
acaaucauguaca

SEQ ID NO: 3191456 - RNA, 18 nt, Human
acaaucagcugcuuuguu

SEQ ID NO: 3191457 - RNA, 19 nt, Human
acaaucagcugcuuuguua

SEQ ID NO: 3191458 - RNA, 17 nt, Human
acaaucaguuauacagu

SEQ ID NO: 3191459 - RNA, 22 nt, Human
acaaggacagccccuccuccau

SEQ ID NO: 3191460 - RNA, 21 nt, Human
acaaggacagccccuccucca

SEQ ID NO: 3191461 - RNA, 18 nt, Human
acaaggacuaggguccug

SEQ ID NO: 3191462 - RNA, 19 nt, Human
acaaggacuaggguccugg

SEQ ID NO: 3191463 - RNA, 19 nt, Human
aauugccuuucuguguuua

SEQ ID NO: 3191464 - RNA, 16 nt, Human
aauuguuacuccauau

SEQ ID NO: 3191465 - RNA, 22 nt, Human
acaaaggaugcccaaagaugca

SEQ ID NO: 3191466 - RNA, 20 nt, Human
acaaaggcuguauucagcaa

SEQ ID NO: 3191467 - RNA, 19 nt, Human
acaaaggcuguauucagca

SEQ ID NO: 3191468 - RNA, 16 nt, Human
acaaaggcuguauuca

SEQ ID NO: 3191469 - RNA, 21 nt, Human
acaaaagcugaacacauuucu

SEQ ID NO: 3191470 - RNA, 21 nt, Human
acaaaagcauucggagggagg

SEQ ID NO: 3191471 - RNA, 22 nt, Human
acaaaagcugaacacauuucuu

SEQ ID NO: 3191472 - RNA, 19 nt, Human
uagaggagaaacuggaacu

SEQ ID NO: 3191473 - RNA, 16 nt, Human
uagagauauuuuguaa

SEQ ID NO: 3191474 - RNA, 21 nt, Human
uagagauauuuuguaaaaugu

SEQ ID NO: 3191475 - RNA, 22 nt, Human
uagagauauuuuguaaaaugua

SEQ ID NO: 3191476 - RNA, 13 nt, Human
uagagaugagcuu

SEQ ID NO: 3191477 - RNA, 16 nt, Human
uagagaugagcuuucu

SEQ ID NO: 3191478 - RNA, 21 nt, Human
uagagaugagcuuucuuuuua

SEQ ID NO: 3191479 - RNA, 22 nt, Human
uagaggagaaacuggaacucuc

SEQ ID NO: 3191480 - RNA, 23 nt, Human
uagaggcaguucgaccagccagg

SEQ ID NO: 3191481 - RNA, 15 nt, Human
uagauauaugcucug

SEQ ID NO: 3191482 - RNA, 20 nt, Human
uagaggcaugggcuugcugu

SEQ ID NO: 3191483 - RNA, 19 nt, Human
uagauauagagucauugua

SEQ ID NO: 3191484 - RNA, 16 nt, Human
uagauauagagucauu

SEQ ID NO: 3191485 - RNA, 19 nt, Human
uagauauaugcucugcaug

SEQ ID NO: 3191486 - RNA, 19 nt, Human
uagcauggcugccaauggg

SEQ ID NO: 3191487 - RNA, 18 nt, Human
uagaugauuuuuugaaag

SEQ ID NO: 3191488 - RNA, 19 nt, Human
uagaugauuuuuugaaagu

SEQ ID NO: 3191489 - RNA, 22 nt, Human
uagaugauuuuuugaaaguuaa

SEQ ID NO: 3191490 - RNA, 14 nt, Human
uagaugcugacugu

SEQ ID NO: 3191491 - RNA, 23 nt, Human
uagaugcugacuguacuccuccc

SEQ ID NO: 3191492 - RNA, 21 nt, Human
uagccaaggccaaaggaagca

SEQ ID NO: 3191493 - RNA, 22 nt, Human
uagcauuuugcuaaaugugaau

SEQ ID NO: 3191494 - RNA, 14 nt, Human
uagccaaggccaaa

SEQ ID NO: 3191495 - RNA, 15 nt, Human
uagcauuuuggcgcu

SEQ ID NO: 3191496 - RNA, 16 nt, Human
uagcauuuugcuaaau

SEQ ID NO: 3191497 - RNA, 20 nt, Human
acaagacccaaaaggcagaa

SEQ ID NO: 3191498 - RNA, 19 nt, Human
acaagacccuugugguccc

SEQ ID NO: 3191499 - RNA, 23 nt, Human
acaacagauuggauuuuauguug

SEQ ID NO: 3191500 - RNA, 22 nt, Human
acaacagauuggauuuuauguu

SEQ ID NO: 3191501 - RNA, 20 nt, Human
acaacagauuggauuuuaug

SEQ ID NO: 3191502 - RNA, 18 nt, Human
acaacagauuggauuuua

SEQ ID NO: 3191503 - RNA, 13 nt, Human
acaacagauugga

SEQ ID NO: 3191504 - RNA, 22 nt, Human
acaacagagacugaaauguguu

SEQ ID NO: 3191505 - RNA, 23 nt, Human
acaacacucauugaccugaggcc

SEQ ID NO: 3191506 - RNA, 21 nt, Human
acaacacucauugaccugagg

SEQ ID NO: 3191507 - RNA, 15 nt, Human
acaacacuuuaaugg

SEQ ID NO: 3191508 - RNA, 16 nt, Human
acaaauuuuucugugg

SEQ ID NO: 3191509 - RNA, 14 nt, Human
acaaauuuuucugu

SEQ ID NO: 3191510 - RNA, 18 nt, Human
acaaauuuacagagacag

SEQ ID NO: 3191511 - RNA, 19 nt, Human
acaaauuuacagagacaga

SEQ ID NO: 3191512 - RNA, 20 nt, Human
acaaauuucucuguuccaua

SEQ ID NO: 3191513 - RNA, 11 nt, Human
uagccagagga

SEQ ID NO: 3191514 - RNA, 15 nt, Human
uagccagaggagaga

SEQ ID NO: 3191515 - RNA, 22 nt, Human
acaggcauguucucugaggaca

SEQ ID NO: 3191516 - RNA, 21 nt, Human
acaggccacccugugcagaag

SEQ ID NO: 3191517 - RNA, 19 nt, Human
acaggccacccugugcaga

SEQ ID NO: 3191518 - RNA, 16 nt, Human
acaggccacccugugc

SEQ ID NO: 3191519 - RNA, 20 nt, Human
acaggcauguucucugagga

SEQ ID NO: 3191520 - RNA, 19 nt, Human
acaggcauguucucugagg

SEQ ID NO: 3191521 - RNA, 18 nt, Human
acaggcauguucucugag

SEQ ID NO: 3191522 - RNA, 15 nt, Human
acaggcauguucucu

SEQ ID NO: 3191523 - RNA, 14 nt, Human
uaugugaaaggaua

SEQ ID NO: 3191524 - RNA, 22 nt, Human
uaugugaaaggauaugaaucug

SEQ ID NO: 3191525 - RNA, 18 nt, Human
uaugugaguauucucauu

SEQ ID NO: 3191526 - RNA, 17 nt, Human
uaugugaguauucucau

SEQ ID NO: 3191527 - RNA, 14 nt, Human
uaugugaguauucu

SEQ ID NO: 3191528 - RNA, 12 nt, Human
uauguggaagug

SEQ ID NO: 3191529 - RNA, 16 nt, Human
uauguggaaguguggg

SEQ ID NO: 3191530 - RNA, 20 nt, Human
uauguggaguucaucuugaa

SEQ ID NO: 3191531 - RNA, 12 nt, Human
uauguguaugug

SEQ ID NO: 3191532 - RNA, 16 nt, Human
uauguguccauuuccu

SEQ ID NO: 3191533 - RNA, 22 nt, Human
uauguguccauuuccuuaugcu

SEQ ID NO: 3191534 - RNA, 11 nt, Human
uauguuuuuca

SEQ ID NO: 3191535 - RNA, 16 nt, Human
uauguuuuucaguuca

SEQ ID NO: 3191536 - RNA, 15 nt, Human
uauguuuuucaguuc

SEQ ID NO: 3191537 - RNA, 14 nt, Human
uauguuuuucaguu

SEQ ID NO: 3191538 - RNA, 13 nt, Human
uauguuuuucagu

SEQ ID NO: 3191539 - RNA, 12 nt, Human
uauguuuugguc

SEQ ID NO: 3191540 - RNA, 16 nt, Human
uauuaaaacucauuuu

SEQ ID NO: 3191541 - RNA, 17 nt, Human
uauuaaaagaaaggguu

SEQ ID NO: 3191542 - RNA, 22 nt, Human
uauuaaaaagucuuuuaaaaag

SEQ ID NO: 3191543 - RNA, 15 nt, Human
uauuaaaaaagucua

SEQ ID NO: 3191544 - RNA, 13 nt, Human
uauuaaaaagucu

SEQ ID NO: 3191545 - RNA, 12 nt, Human
uauuaaaaaguc

SEQ ID NO: 3191546 - RNA, 19 nt, Human
uauuaaaaagucuuuuaaa

SEQ ID NO: 3191547 - RNA, 17 nt, Human
uauuaaaaagucuuuua

SEQ ID NO: 3191548 - RNA, 15 nt, Human
uauuaaaaagucuuu

SEQ ID NO: 3191549 - RNA, 14 nt, Human
uauuaaaaagucuu

SEQ ID NO: 3191550 - RNA, 20 nt, Human
uauguuuuucaguucaaagu

SEQ ID NO: 3191551 - RNA, 19 nt, Human
uauguuuuucaguucaaag

SEQ ID NO: 3191552 - RNA, 18 nt, Human
uauguuuuucaguucaaa

SEQ ID NO: 3191553 - RNA, 16 nt, Human
uauguuuuugaaggca

SEQ ID NO: 3191554 - RNA, 14 nt, Human
uauguuuuugaagg

SEQ ID NO: 3191555 - RNA, 15 nt, Human
uauuaaaaaacuuca

SEQ ID NO: 3191556 - RNA, 18 nt, Human
uauuaaaaaacuucaugu

SEQ ID NO: 3191557 - RNA, 23 nt, Human
uaugugcuauuaauauuuguuua

SEQ ID NO: 3191558 - RNA, 21 nt, Human
acagcggcuggacuuggaggu

SEQ ID NO: 3191559 - RNA, 11 nt, Human
acagccuggca

SEQ ID NO: 3191560 - RNA, 22 nt, Human
acagcggcuggacuuggaggua

SEQ ID NO: 3191561 - RNA, 13 nt, Human
acagcuaacaugg

SEQ ID NO: 3191562 - RNA, 16 nt, Human
acagcguuaugugucu

SEQ ID NO: 3191563 - RNA, 16 nt, Human
acagcuuguuuuggac

SEQ ID NO: 3191564 - RNA, 19 nt, Human
acagcuuguuuuggacuuu

SEQ ID NO: 3191565 - RNA, 22 nt, Human
acagcuuguuuuggacuuuguu

SEQ ID NO: 3191566 - RNA, 23 nt, Human
acagcuuguuuuggacuuuguua

SEQ ID NO: 3191567 - RNA, 17 nt, Human
acaggaaguagaggagg

SEQ ID NO: 3191568 - RNA, 13 nt, Human
acaggaaguacug

SEQ ID NO: 3191569 - RNA, 21 nt, Human
acaggaaaagcaugucuuauu

SEQ ID NO: 3191570 - RNA, 19 nt, Human
acaggaaaagcaugucuua

SEQ ID NO: 3191571 - RNA, 17 nt, Human
acaggaaaagcugcuga

SEQ ID NO: 3191572 - RNA, 16 nt, Human
acaggaaaagcugcug

SEQ ID NO: 3191573 - RNA, 15 nt, Human
acaggaaaagcugcu

SEQ ID NO: 3191574 - RNA, 20 nt, Human
acaggaccccugcaguuccc

SEQ ID NO: 3191575 - RNA, 16 nt, Human
acaggaccccugcagu

SEQ ID NO: 3191576 - RNA, 15 nt, Human
acaggaccccugcag

SEQ ID NO: 3191577 - RNA, 14 nt, Human
acaggacucugccu

SEQ ID NO: 3191578 - RNA, 23 nt, Human
acaggaccagggauuuccaugau

SEQ ID NO: 3191579 - RNA, 18 nt, Human
acaggacagggguuccuu

SEQ ID NO: 3191580 - RNA, 13 nt, Human
acaggcaggucca

SEQ ID NO: 3191581 - RNA, 14 nt, Human
acaggaucagucug

SEQ ID NO: 3191582 - RNA, 16 nt, Human
acaggagugagcacua

SEQ ID NO: 3191583 - RNA, 17 nt, Human
acaggagguuggaggga

SEQ ID NO: 3191584 - RNA, 15 nt, Human
acaggagguuggagg

SEQ ID NO: 3191585 - RNA, 16 nt, Human
acaggcagguccaggg

SEQ ID NO: 3191586 - RNA, 14 nt, Human
acaggcagguccag

SEQ ID NO: 3191587 - RNA, 14 nt, Human
acaggcauguucuc

SEQ ID NO: 3191588 - RNA, 21 nt, Human
uauucagcuugcacauuuggu

SEQ ID NO: 3191589 - RNA, 17 nt, Human
uauucaauuaaagaaau

SEQ ID NO: 3191590 - RNA, 15 nt, Human
uauucaccuucaguu

SEQ ID NO: 3191591 - RNA, 14 nt, Human
uauucaggaagcuc

SEQ ID NO: 3191592 - RNA, 20 nt, Human
uauucaguaauaacucuacc

SEQ ID NO: 3191593 - RNA, 12 nt, Human
acaggcuccugc

SEQ ID NO: 3191594 - RNA, 22 nt, Human
acaggcgugagccaccgugccu

SEQ ID NO: 3191595 - RNA, 23 nt, Human
uauucaaacagucucaggaaauc

SEQ ID NO: 3191596 - RNA, 14 nt, Human
uauucaaacugaaa

SEQ ID NO: 3191597 - RNA, 16 nt, Human
uauucaaagagaaaac

SEQ ID NO: 3191598 - RNA, 15 nt, Human
uauucaaacagucuc

SEQ ID NO: 3191599 - RNA, 19 nt, Human
uauuagugaccucagcuuu

SEQ ID NO: 3191600 - RNA, 19 nt, Human
uauuagaaaacuuuguuag

SEQ ID NO: 3191601 - RNA, 18 nt, Human
uauuagaaaacuuuguua

SEQ ID NO: 3191602 - RNA, 17 nt, Human
uauuagaaaacuuuguu

SEQ ID NO: 3191603 - RNA, 14 nt, Human
uauuacuuuaacau

SEQ ID NO: 3191604 - RNA, 15 nt, Human
uauuacuuuaacaug

SEQ ID NO: 3191605 - RNA, 17 nt, Human
uauuacuuuaacaugcc

SEQ ID NO: 3191606 - RNA, 16 nt, Human
uauuagaaaacuuugu

SEQ ID NO: 3191607 - RNA, 14 nt, Human
uauuagaaaacuuu

SEQ ID NO: 3191608 - RNA, 14 nt, Human
uauuacuaaauuga

SEQ ID NO: 3191609 - RNA, 17 nt, Human
uauuacuaaauugaccu

SEQ ID NO: 3191610 - RNA, 16 nt, Human
uauuaaaauuguuguc

SEQ ID NO: 3191611 - RNA, 15 nt, Human
uauuaaaauuguugu

SEQ ID NO: 3191612 - RNA, 10 nt, Human
uauuaaaauu

SEQ ID NO: 3191613 - RNA, 14 nt, Human
uauuaaaauuccaa

SEQ ID NO: 3191614 - RNA, 15 nt, Human
uauuaaaauuccaaa

SEQ ID NO: 3191615 - RNA, 19 nt, Human
uauuaaaauuccaaauuca

SEQ ID NO: 3191616 - RNA, 11 nt, Human
uauuaaaauug

SEQ ID NO: 3191617 - RNA, 14 nt, Human
uauuacuucugcua

SEQ ID NO: 3191618 - RNA, 13 nt, Human
uauuacuucugcu

SEQ ID NO: 3191619 - RNA, 22 nt, Human
uauuacuagacugccacaagga

SEQ ID NO: 3191620 - RNA, 13 nt, Human
acagucacaaauu

SEQ ID NO: 3191621 - RNA, 12 nt, Human
acagggcacacc

SEQ ID NO: 3191622 - RNA, 16 nt, Human
acagggauugauuuua

SEQ ID NO: 3191623 - RNA, 22 nt, Human
acagggauugauuuuaaaaugu

SEQ ID NO: 3191624 - RNA, 13 nt, Human
acaguaaucaguu

SEQ ID NO: 3191625 - RNA, 16 nt, Human
acaguaaugucauaaa

SEQ ID NO: 3191626 - RNA, 20 nt, Human
acaguacccugguugugugu

SEQ ID NO: 3191627 - RNA, 14 nt, Human
acaguacuuugaau

SEQ ID NO: 3191628 - RNA, 19 nt, Human
acaguacccugguugugug

SEQ ID NO: 3191629 - RNA, 22 nt, Human
acaguaccccucuagcuuuguu

SEQ ID NO: 3191630 - RNA, 20 nt, Human
acagggaggacgcucucugg

SEQ ID NO: 3191631 - RNA, 21 nt, Human
acagggaggacgcucucuggc

SEQ ID NO: 3191632 - RNA, 22 nt, Human
acaggcugagugcaggcccacc

SEQ ID NO: 3191633 - RNA, 21 nt, Human
acaggcugagugcaggcccac

SEQ ID NO: 3191634 - RNA, 20 nt, Human
acaggcugagugcaggccca

SEQ ID NO: 3191635 - RNA, 19 nt, Human
acaggcugagugcaggccc

SEQ ID NO: 3191636 - RNA, 18 nt, Human
acaggcugagugcaggcc

SEQ ID NO: 3191637 - RNA, 17 nt, Human
acaggcugagugcaggc

SEQ ID NO: 3191638 - RNA, 16 nt, Human
acaggcugagugcagg

SEQ ID NO: 3191639 - RNA, 15 nt, Human
acaggcugagugcag

SEQ ID NO: 3191640 - RNA, 13 nt, Human
acaggcuccugcc

SEQ ID NO: 3191641 - RNA, 15 nt, Human
acaggcuccugccac

SEQ ID NO: 3191642 - RNA, 21 nt, Human
acaggcuccugccaccacgcc

SEQ ID NO: 3191643 - RNA, 22 nt, Human
acaggcuccugccaccacgccc

SEQ ID NO: 3191644 - RNA, 22 nt, Human
acaggcugggcuucaguggcag

SEQ ID NO: 3191645 - RNA, 21 nt, Human
acaggcugggcuucaguggca

SEQ ID NO: 3191646 - RNA, 23 nt, Human
acaggcugggcuucaguggcagc

SEQ ID NO: 3191647 - RNA, 23 nt, Human
acaggcugagugcaggcccaccc

SEQ ID NO: 3191648 - RNA, 20 nt, Human
uauggggauagaugugugga

SEQ ID NO: 3191649 - RNA, 14 nt, Human
uaugguaaucauau

SEQ ID NO: 3191650 - RNA, 19 nt, Human
acagcggcuggacuuggag

SEQ ID NO: 3191651 - RNA, 14 nt, Human
uaugguagaaaaau

SEQ ID NO: 3191652 - RNA, 16 nt, Human
uaugguaaucauauua

SEQ ID NO: 3191653 - RNA, 18 nt, Human
uaugguaaucauauuaga

SEQ ID NO: 3191654 - RNA, 16 nt, Human
uaugcuguaaaagcaa

SEQ ID NO: 3191655 - RNA, 22 nt, Human
uaugcuggaagucucaaauaau

SEQ ID NO: 3191656 - RNA, 15 nt, Human
uaugcuuauacacuu

SEQ ID NO: 3191657 - RNA, 14 nt, Human
uaugcuguaucugu

SEQ ID NO: 3191658 - RNA, 15 nt, Human
uaugcuguaucugug

SEQ ID NO: 3191659 - RNA, 17 nt, Human
uaugaacauacaaaugc

SEQ ID NO: 3191660 - RNA, 14 nt, Human
uaugaacuuaacau

SEQ ID NO: 3191661 - RNA, 15 nt, Human
uaugaacuuaacaug

SEQ ID NO: 3191662 - RNA, 17 nt, Human
uaugaacuuaacaugcu

SEQ ID NO: 3191663 - RNA, 19 nt, Human
uaugaacuuaacaugcugu

SEQ ID NO: 3191664 - RNA, 23 nt, Human
uaugaacuuaacaugcuguguaa

SEQ ID NO: 3191665 - RNA, 23 nt, Human
uaugauuaaaaauaucaaauuaa

SEQ ID NO: 3191666 - RNA, 17 nt, Human
uaugcauuauuaaauug

SEQ ID NO: 3191667 - RNA, 12 nt, Human
uaugcauucaca

SEQ ID NO: 3191668 - RNA, 19 nt, Human
uaugcauucacauuuagaa

SEQ ID NO: 3191669 - RNA, 22 nt, Human
uaugcauucacauuuagaaaag

SEQ ID NO: 3191670 - RNA, 23 nt, Human
uaugcauucacauuuagaaaagu

SEQ ID NO: 3191671 - RNA, 18 nt, Human
uaugaacucaucauuuuu

SEQ ID NO: 3191672 - RNA, 14 nt, Human
uaugccuuguauaa

SEQ ID NO: 3191673 - RNA, 16 nt, Human
uaugcuaagaauuuuu

SEQ ID NO: 3191674 - RNA, 14 nt, Human
uaugcuaagaauuu

SEQ ID NO: 3191675 - RNA, 17 nt, Human
uaugccugggcagaagg

SEQ ID NO: 3191676 - RNA, 16 nt, Human
uaugccugcucuuugg

SEQ ID NO: 3191677 - RNA, 14 nt, Human
uaugccugcucuuu

SEQ ID NO: 3191678 - RNA, 23 nt, Human
acagauuggauuuuauguugaca

SEQ ID NO: 3191679 - RNA, 22 nt, Human
acagauuggauuuuauguugac

SEQ ID NO: 3191680 - RNA, 21 nt, Human
acagauuggauuuuauguuga

SEQ ID NO: 3191681 - RNA, 13 nt, Human
acagauuggauuu

SEQ ID NO: 3191682 - RNA, 17 nt, Human
acagauuggauuuuaug

SEQ ID NO: 3191683 - RNA, 15 nt, Human
acagauuggauuuua

SEQ ID NO: 3191684 - RNA, 14 nt, Human
acagauuugagcuc

SEQ ID NO: 3191685 - RNA, 18 nt, Human
acagaugaccccugccca

SEQ ID NO: 3191686 - RNA, 18 nt, Human
acagagcccacgccccca

SEQ ID NO: 3191687 - RNA, 19 nt, Human
acagagcccacgcccccac

SEQ ID NO: 3191688 - RNA, 15 nt, Human
acagagcccacgccc

SEQ ID NO: 3191689 - RNA, 14 nt, Human
acagagcccacgcc

SEQ ID NO: 3191690 - RNA, 18 nt, Human
acagagacaaguaauuuc

SEQ ID NO: 3191691 - RNA, 17 nt, Human
acagauccccaagccug

SEQ ID NO: 3191692 - RNA, 22 nt, Human
acagaucucugcuuuggaaauc

SEQ ID NO: 3191693 - RNA, 18 nt, Human
acagauccccaagccugg

SEQ ID NO: 3191694 - RNA, 20 nt, Human
uaugaaauuuuuuuucaugc

SEQ ID NO: 3191695 - RNA, 14 nt, Human
uaugaacagacuuu

SEQ ID NO: 3191696 - RNA, 18 nt, Human
acagccguuuguucccca

SEQ ID NO: 3191697 - RNA, 15 nt, Human
acagccgcuccagag

SEQ ID NO: 3191698 - RNA, 14 nt, Human
acagccgcuccaga

SEQ ID NO: 3191699 - RNA, 13 nt, Human
acagccgcuccag

SEQ ID NO: 3191700 - RNA, 18 nt, Human
acagcccgggcucugccu

SEQ ID NO: 3191701 - RNA, 19 nt, Human
acagcccgggcucugccuc

SEQ ID NO: 3191702 - RNA, 17 nt, Human
acagcccgggcucugcc

SEQ ID NO: 3191703 - RNA, 16 nt, Human
acagcccgggcucugc

SEQ ID NO: 3191704 - RNA, 14 nt, Human
uauauuuaaaaaca

SEQ ID NO: 3191705 - RNA, 15 nt, Human
uauauuguugaagag

SEQ ID NO: 3191706 - RNA, 22 nt, Human
uauauuguaagaaauacuguac

SEQ ID NO: 3191707 - RNA, 20 nt, Human
uauauuguaagaaauacugu

SEQ ID NO: 3191708 - RNA, 23 nt, Human
uauauugguuuuaugaugacgua

SEQ ID NO: 3191709 - RNA, 12 nt, Human
uauauuguaaga

SEQ ID NO: 3191710 - RNA, 19 nt, Human
uauauuguaagaaauacug

SEQ ID NO: 3191711 - RNA, 15 nt, Human
uauauuguaagaaau

SEQ ID NO: 3191712 - RNA, 13 nt, Human
acagacccugccc

SEQ ID NO: 3191713 - RNA, 14 nt, Human
acagacccugcccu

SEQ ID NO: 3191714 - RNA, 15 nt, Human
acagacccugcccug

SEQ ID NO: 3191715 - RNA, 21 nt, Human
uauauuaaaauuccaaauuca

SEQ ID NO: 3191716 - RNA, 22 nt, Human
uauauuaaaauuccaaauucau

SEQ ID NO: 3191717 - RNA, 13 nt, Human
uauauuaaacaaa

SEQ ID NO: 3191718 - RNA, 22 nt, Human
uauauuaaacaaaguuucagag

SEQ ID NO: 3191719 - RNA, 21 nt, Human
acagaaauugguaccuugcac

SEQ ID NO: 3191720 - RNA, 19 nt, Human
uauauugguuuuaugauga

SEQ ID NO: 3191721 - RNA, 22 nt, Human
uauauuagaucaaauaguugca

SEQ ID NO: 3191722 - RNA, 13 nt, Human
uauauuauaauag

SEQ ID NO: 3191723 - RNA, 23 nt, Human
uauacaacaccaaaaaauaucua

SEQ ID NO: 3191724 - RNA, 21 nt, Human
uauacaacaccaaaaaauauc

SEQ ID NO: 3191725 - RNA, 18 nt, Human
uauacaacaccaaaaaau

SEQ ID NO: 3191726 - RNA, 13 nt, Human
uauacaacaccaa

SEQ ID NO: 3191727 - RNA, 13 nt, Human
uauacaaaacuuu

SEQ ID NO: 3191728 - RNA, 15 nt, Human
uauacaaaacuuuau

SEQ ID NO: 3191729 - RNA, 17 nt, Human
uauacaaaacuuuauca

SEQ ID NO: 3191730 - RNA, 20 nt, Human
acagaaaauggaagacagcu

SEQ ID NO: 3191731 - RNA, 17 nt, Human
acagaaaauucuucucc

SEQ ID NO: 3191732 - RNA, 20 nt, Human
acagaaauugguaccuugca

SEQ ID NO: 3191733 - RNA, 12 nt, Human
acagaaauuggu

SEQ ID NO: 3191734 - RNA, 15 nt, Human
acagaaaauauguau

SEQ ID NO: 3191735 - RNA, 14 nt, Human
acagaaaauaugua

SEQ ID NO: 3191736 - RNA, 13 nt, Human
acagaaaauaugu

SEQ ID NO: 3191737 - RNA, 12 nt, Human
acagaaaauaug

SEQ ID NO: 3191738 - RNA, 18 nt, Human
uaucauuuuuuccuguuu

SEQ ID NO: 3191739 - RNA, 16 nt, Human
uaucauuuuuuccugu

SEQ ID NO: 3191740 - RNA, 15 nt, Human
uaucauuuuuuccug

SEQ ID NO: 3191741 - RNA, 15 nt, Human
uaucauuucuuaacc

SEQ ID NO: 3191742 - RNA, 17 nt, Human
uaucauuucuuaaccca

SEQ ID NO: 3191743 - RNA, 22 nt, Human
uaucaagccuagauguuuuaua

SEQ ID NO: 3191744 - RNA, 20 nt, Human
uaucaaauuaauugugugaa

SEQ ID NO: 3191745 - RNA, 21 nt, Human
uaucaaauuaauugugugaac

SEQ ID NO: 3191746 - RNA, 19 nt, Human
uaucaaauuaauuguguga

SEQ ID NO: 3191747 - RNA, 22 nt, Human
uauccauagugacuuuucaagu

SEQ ID NO: 3191748 - RNA, 19 nt, Human
uauccauagugacuuuuca

SEQ ID NO: 3191749 - RNA, 18 nt, Human
uauccacgagagcgcagc

SEQ ID NO: 3191750 - RNA, 17 nt, Human
uauccacgagagcgcag

SEQ ID NO: 3191751 - RNA, 13 nt, Human
uauccacuugucc

SEQ ID NO: 3191752 - RNA, 21 nt, Human
uauccagaauggaauuuugcu

SEQ ID NO: 3191753 - RNA, 15 nt, Human
uauccagaauggaau

SEQ ID NO: 3191754 - RNA, 14 nt, Human
uaucucccccagcc

SEQ ID NO: 3191755 - RNA, 13 nt, Human
uaucucccccagc

SEQ ID NO: 3191756 - RNA, 22 nt, Human
uaucuccaugaugauaguugaa

SEQ ID NO: 3191757 - RNA, 15 nt, Human
uaucucagggccugg

SEQ ID NO: 3191758 - RNA, 18 nt, Human
acagagaaaguacuucuc

SEQ ID NO: 3191759 - RNA, 11 nt, Human
acagagaaagu

SEQ ID NO: 3191760 - RNA, 14 nt, Human
acagagaaagaaau

SEQ ID NO: 3191761 - RNA, 12 nt, Human
aagcaaaaggca

SEQ ID NO: 3191762 - RNA, 13 nt, Human
guguauguggggg

SEQ ID NO: 3191763 - RNA, 21 nt, Human
guguaugugggggucugugug

SEQ ID NO: 3191764 - RNA, 17 nt, Human
aagcaacccaaauguuc

SEQ ID NO: 3191765 - RNA, 12 nt, Human
aagcaacaauuu

SEQ ID NO: 3191766 - RNA, 17 nt, Human
aagcaaauugcuuuuuu

SEQ ID NO: 3191767 - RNA, 20 nt, Human
aagcaacaauuuucagauuu

SEQ ID NO: 3191768 - RNA, 18 nt, Human
aagcaacaauuuucagau

SEQ ID NO: 3191769 - RNA, 17 nt, Human
aagcaacaauuuucaga

SEQ ID NO: 3191770 - RNA, 13 nt, Human
aagcaacaauuuu

SEQ ID NO: 3191771 - RNA, 14 nt, Human
aagcaacaucagcu

SEQ ID NO: 3191772 - RNA, 22 nt, Human
aagcaacaauuuucagauuugc

SEQ ID NO: 3191773 - RNA, 15 nt, Human
aagcaaccaaaaaga

SEQ ID NO: 3191774 - RNA, 16 nt, Human
aagauggcugugccuc

SEQ ID NO: 3191775 - RNA, 20 nt, Human
aagaucaaaagguuaauaaa

SEQ ID NO: 3191776 - RNA, 23 nt, Human
aagaucaaaagguuaauaaagua

SEQ ID NO: 3191777 - RNA, 21 nt, Human
aagaucaaaaaggcuuauaaa

SEQ ID NO: 3191778 - RNA, 23 nt, Human
aagaucaaaaaggcuuauaaaac

SEQ ID NO: 3191779 - RNA, 22 nt, Human
gugucuuaauuaaaagaauauu

SEQ ID NO: 3191780 - RNA, 19 nt, Human
gugucagguggggcagcuu

SEQ ID NO: 3191781 - RNA, 23 nt, Human
gugugaaccaccacacccagccc

SEQ ID NO: 3191782 - RNA, 13 nt, Human
gugugaaauauau

SEQ ID NO: 3191783 - RNA, 15 nt, Human
gugugaacuuggaag

SEQ ID NO: 3191784 - RNA, 17 nt, Human
gugugaacuuggaagca

SEQ ID NO: 3191785 - RNA, 14 nt, Human
gugucaccugaaga

SEQ ID NO: 3191786 - RNA, 17 nt, Human
gugucaaguggcaaagc

SEQ ID NO: 3191787 - RNA, 19 nt, Human
aagcaaccauauagaaagc

SEQ ID NO: 3191788 - RNA, 13 nt, Human
guguauguuuuuc

SEQ ID NO: 3191789 - RNA, 21 nt, Human
guguauguuuuucaguucaaa

SEQ ID NO: 3191790 - RNA, 16 nt, Human
guguauguuuuucagu

SEQ ID NO: 3191791 - RNA, 15 nt, Human
guguauguuuuucag

SEQ ID NO: 3191792 - RNA, 18 nt, Human
gugucagguggggcagcu

SEQ ID NO: 3191793 - RNA, 14 nt, Human
gugucagguggggc

SEQ ID NO: 3191794 - RNA, 22 nt, Human
gugucaccugaagacucauucu

SEQ ID NO: 3191795 - RNA, 16 nt, Human
gugguuuuucuuuucu

SEQ ID NO: 3191796 - RNA, 21 nt, Human
gugguucacucuuggagccug

SEQ ID NO: 3191797 - RNA, 23 nt, Human
gugguucacucuuggagccugca

SEQ ID NO: 3191798 - RNA, 22 nt, Human
gugguucacucuuggagccugc

SEQ ID NO: 3191799 - RNA, 16 nt, Human
gugguugaauaugauu

SEQ ID NO: 3191800 - RNA, 18 nt, Human
gugguugaauaugauuaa

SEQ ID NO: 3191801 - RNA, 15 nt, Human
gugcugcuaauucuu

SEQ ID NO: 3191802 - RNA, 19 nt, Human
gugcugcuaauucuuugca

SEQ ID NO: 3191803 - RNA, 18 nt, Human
gugcugcuaauucuuugc

SEQ ID NO: 3191804 - RNA, 17 nt, Human
gugcugcuaauucuuug

SEQ ID NO: 3191805 - RNA, 23 nt, Human
gugcugcccugcccaccuggccu

SEQ ID NO: 3191806 - RNA, 18 nt, Human
aagaggugugcaagagag

SEQ ID NO: 3191807 - RNA, 16 nt, Human
aagaggugugcaagag

SEQ ID NO: 3191808 - RNA, 22 nt, Human
aagagggucugaggaauccaga

SEQ ID NO: 3191809 - RNA, 14 nt, Human
aagauagcagggca

SEQ ID NO: 3191810 - RNA, 15 nt, Human
aagauagcagggcau

SEQ ID NO: 3191811 - RNA, 16 nt, Human
aagauagucuuggaag

SEQ ID NO: 3191812 - RNA, 20 nt, Human
aagauagucuuggaagcugu

SEQ ID NO: 3191813 - RNA, 18 nt, Human
guguaagaaauacagacu

SEQ ID NO: 3191814 - RNA, 11 nt, Human
aagaggcaggg

SEQ ID NO: 3191815 - RNA, 14 nt, Human
aagaggcagggucu

SEQ ID NO: 3191816 - RNA, 19 nt, Human
aagaggcaguugcccagcc

SEQ ID NO: 3191817 - RNA, 22 nt, Human
aagaggcaguugcccagccucu

SEQ ID NO: 3191818 - RNA, 21 nt, Human
aagagggagggagggcuccag

SEQ ID NO: 3191819 - RNA, 22 nt, Human
aagagggagggagggcuccaga

SEQ ID NO: 3191820 - RNA, 12 nt, Human
aagcaugaacag

SEQ ID NO: 3191821 - RNA, 20 nt, Human
aagcaugacagaaaauaugu

SEQ ID NO: 3191822 - RNA, 19 nt, Human
aagcaugacagaaaauaug

SEQ ID NO: 3191823 - RNA, 18 nt, Human
aagcaugacagaaaauau

SEQ ID NO: 3191824 - RNA, 20 nt, Human
aagcaugaacagugcaccug

SEQ ID NO: 3191825 - RNA, 15 nt, Human
aagcaugaagauaaa

SEQ ID NO: 3191826 - RNA, 19 nt, Human
aagcaugccaauuucucuu

SEQ ID NO: 3191827 - RNA, 16 nt, Human
aagcaugccaauuucu

SEQ ID NO: 3191828 - RNA, 22 nt, Human
aagcaugacagaaaauauguau

SEQ ID NO: 3191829 - RNA, 14 nt, Human
aagcauggacauuu

SEQ ID NO: 3191830 - RNA, 19 nt, Human
aagcauggacauuuagaag

SEQ ID NO: 3191831 - RNA, 18 nt, Human
aagcauuguaaaugugcu

SEQ ID NO: 3191832 - RNA, 20 nt, Human
aagcacugacuucuaaguaa

SEQ ID NO: 3191833 - RNA, 19 nt, Human
aagcacugacuucuaagua

SEQ ID NO: 3191834 - RNA, 17 nt, Human
aagcauauaaaauggca

SEQ ID NO: 3191835 - RNA, 16 nt, Human
aagcauauaaaauggc

SEQ ID NO: 3191836 - RNA, 15 nt, Human
aagcauauaaaaugg

SEQ ID NO: 3191837 - RNA, 14 nt, Human
aagcauauaaaaug

SEQ ID NO: 3191838 - RNA, 22 nt, Human
aagcauauaaaauggcaacaaa

SEQ ID NO: 3191839 - RNA, 13 nt, Human
aagcauauugacu

SEQ ID NO: 3191840 - RNA, 19 nt, Human
aagcauuguaaaugugcuu

SEQ ID NO: 3191841 - RNA, 14 nt, Human
aagcauguuuugca

SEQ ID NO: 3191842 - RNA, 13 nt, Human
aagcauguuuugc

SEQ ID NO: 3191843 - RNA, 17 nt, Human
aagcauguuuugcaugu

SEQ ID NO: 3191844 - RNA, 15 nt, Human
aagcauguuuugcau

SEQ ID NO: 3191845 - RNA, 20 nt, Human
aagcauuugguuuuucacau

SEQ ID NO: 3191846 - RNA, 13 nt, Human
aagcauuuuguaa

SEQ ID NO: 3191847 - RNA, 12 nt, Human
aagcauuuugua

SEQ ID NO: 3191848 - RNA, 18 nt, Human
aagccaaagcuaggccug

SEQ ID NO: 3191849 - RNA, 17 nt, Human
aagccaaagcuaggccu

SEQ ID NO: 3191850 - RNA, 17 nt, Human
aagcaccuccugccucg

SEQ ID NO: 3191851 - RNA, 17 nt, Human
aagcacugacuucuaag

SEQ ID NO: 3191852 - RNA, 16 nt, Human
aagcacugacuucuaa

SEQ ID NO: 3191853 - RNA, 16 nt, Human
aagcaccuccugccuc

SEQ ID NO: 3191854 - RNA, 15 nt, Human
aagcaccuccugccu

SEQ ID NO: 3191855 - RNA, 14 nt, Human
aagcaccuccugcc

SEQ ID NO: 3191856 - RNA, 13 nt, Human
aagcaccuccugc

SEQ ID NO: 3191857 - RNA, 21 nt, Human
aagcacaugccucucucaggc

SEQ ID NO: 3191858 - RNA, 22 nt, Human
aagcaccaaaauaagaaaagau

SEQ ID NO: 3191859 - RNA, 16 nt, Human
aagcaccauccccucc

SEQ ID NO: 3191860 - RNA, 15 nt, Human
aagcacccauuucaa

SEQ ID NO: 3191861 - RNA, 15 nt, Human
aagcaccauccccuc

SEQ ID NO: 3191862 - RNA, 21 nt, Human
aagcaccaaaauaagaaaaga

SEQ ID NO: 3191863 - RNA, 19 nt, Human
aagcaccaaaauaagaaaa

SEQ ID NO: 3191864 - RNA, 17 nt, Human
aagcaccaaaauaagaa

SEQ ID NO: 3191865 - RNA, 16 nt, Human
aagcaccaaaauaaga

SEQ ID NO: 3191866 - RNA, 23 nt, Human
aagcacaccaaucuuacuuugua

SEQ ID NO: 3191867 - RNA, 13 nt, Human
aagcacagucagg

SEQ ID NO: 3191868 - RNA, 14 nt, Human
aagcacaugccucu

SEQ ID NO: 3191869 - RNA, 15 nt, Human
aagcacaugccucuc

SEQ ID NO: 3191870 - RNA, 16 nt, Human
aagcacaugccucucu

SEQ ID NO: 3191871 - RNA, 19 nt, Human
aagcacaugccucucucag

SEQ ID NO: 3191872 - RNA, 20 nt, Human
aagcacaugccucucucagg

SEQ ID NO: 3191873 - RNA, 16 nt, Human
aagcacacuugacauc

SEQ ID NO: 3191874 - RNA, 18 nt, Human
aagcacaccaaucuuacu

SEQ ID NO: 3191875 - RNA, 19 nt, Human
aagcacaccaaucuuacuu

SEQ ID NO: 3191876 - RNA, 22 nt, Human
aagcacaccaaucuuacuuugu

SEQ ID NO: 3191877 - RNA, 19 nt, Human
guguuugcuccccuucccc

SEQ ID NO: 3191878 - RNA, 13 nt, Human
aagcacaaaggaa

SEQ ID NO: 3191879 - RNA, 12 nt, Human
guguuucugggg

SEQ ID NO: 3191880 - RNA, 13 nt, Human
guguuucuguccu

SEQ ID NO: 3191881 - RNA, 20 nt, Human
guguuucuguccuguaacug

SEQ ID NO: 3191882 - RNA, 21 nt, Human
guguuucuguccuguaacugu

SEQ ID NO: 3191883 - RNA, 15 nt, Human
aagccuguuguuuaa

SEQ ID NO: 3191884 - RNA, 18 nt, Human
aagccuguuguuuaagug

SEQ ID NO: 3191885 - RNA, 18 nt, Human
aagccuggucagcccaaa

SEQ ID NO: 3191886 - RNA, 17 nt, Human
aagccuggucagcccaa

SEQ ID NO: 3191887 - RNA, 15 nt, Human
aagccuccuccagcc

SEQ ID NO: 3191888 - RNA, 16 nt, Human
aagccucccacgacug

SEQ ID NO: 3191889 - RNA, 22 nt, Human
aagcuaggccuggccagaugca

SEQ ID NO: 3191890 - RNA, 15 nt, Human
aagcuagucaacagu

SEQ ID NO: 3191891 - RNA, 17 nt, Human
aagcuagucaacaguac

SEQ ID NO: 3191892 - RNA, 13 nt, Human
aagcuaguugaau

SEQ ID NO: 3191893 - RNA, 15 nt, Human
aagcuaguugaauac

SEQ ID NO: 3191894 - RNA, 17 nt, Human
aagcuaguugaauacuu

SEQ ID NO: 3191895 - RNA, 19 nt, Human
aagcuaguugaauacuuga

SEQ ID NO: 3191896 - RNA, 20 nt, Human
aagcuaguugaauacuugaa

SEQ ID NO: 3191897 - RNA, 21 nt, Human
aagcuaguugaauacuugaac

SEQ ID NO: 3191898 - RNA, 17 nt, Human
aagccuuaagcugcagg

SEQ ID NO: 3191899 - RNA, 12 nt, Human
guucagcuuggg

SEQ ID NO: 3191900 - RNA, 23 nt, Human
guucagcuuguaaauagcucagg

SEQ ID NO: 3191901 - RNA, 18 nt, Human
guucagcuccagcucacc

SEQ ID NO: 3191902 - RNA, 18 nt, Human
guuauuuugauguaaaga

SEQ ID NO: 3191903 - RNA, 22 nt, Human
guucaggguuggccccugcccg

SEQ ID NO: 3191904 - RNA, 21 nt, Human
guucaggguuggccccugccc

SEQ ID NO: 3191905 - RNA, 20 nt, Human
guucaggguuggccccugcc

SEQ ID NO: 3191906 - RNA, 23 nt, Human
guucagggaagauaaguuggaaa

SEQ ID NO: 3191907 - RNA, 19 nt, Human
guucagggaagauaaguug

SEQ ID NO: 3191908 - RNA, 18 nt, Human
guucagguaacaggcaga

SEQ ID NO: 3191909 - RNA, 17 nt, Human
guucagguaacaggcag

SEQ ID NO: 3191910 - RNA, 21 nt, Human
aagccgugauuuucauugcug

SEQ ID NO: 3191911 - RNA, 14 nt, Human
aagccguggcuucc

SEQ ID NO: 3191912 - RNA, 13 nt, Human
aagccguggcuuc

SEQ ID NO: 3191913 - RNA, 15 nt, Human
aagccguggcuuccc

SEQ ID NO: 3191914 - RNA, 17 nt, Human
guuagacugccagcucu

SEQ ID NO: 3191915 - RNA, 19 nt, Human
guuagagguucccuuugac

SEQ ID NO: 3191916 - RNA, 17 nt, Human
guuacuguaaaaugcaa

SEQ ID NO: 3191917 - RNA, 14 nt, Human
guuacuguaaaaug

SEQ ID NO: 3191918 - RNA, 19 nt, Human
guuacuguaaaaugcaaaa

SEQ ID NO: 3191919 - RNA, 12 nt, Human
guuagacugcca

SEQ ID NO: 3191920 - RNA, 22 nt, Human
guuagacugccagcucuuccua

SEQ ID NO: 3191921 - RNA, 20 nt, Human
guuagagaacuaaacuaguu

SEQ ID NO: 3191922 - RNA, 23 nt, Human
guuagagaacuaaacuaguuuuu

SEQ ID NO: 3191923 - RNA, 15 nt, Human
guuagacugccagcu

SEQ ID NO: 3191924 - RNA, 14 nt, Human
guuagacugccagc

SEQ ID NO: 3191925 - RNA, 22 nt, Human
guuauugguguaagguacuuuc

SEQ ID NO: 3191926 - RNA, 17 nt, Human
guuauugcaauaaagua

SEQ ID NO: 3191927 - RNA, 18 nt, Human
guuauugcaauaaaguau

SEQ ID NO: 3191928 - RNA, 15 nt, Human
guuauuuucagcaug

SEQ ID NO: 3191929 - RNA, 23 nt, Human
guuaauuuaaguuuugacaagcu

SEQ ID NO: 3191930 - RNA, 13 nt, Human
guuaauuuaaguu

SEQ ID NO: 3191931 - RNA, 19 nt, Human
guuaauuuaaguuuugaca

SEQ ID NO: 3191932 - RNA, 12 nt, Human
guuaauuuaagu

SEQ ID NO: 3191933 - RNA, 17 nt, Human
guuaauugauagaauaa

SEQ ID NO: 3191934 - RNA, 19 nt, Human
guuaauauuuauaggucac

SEQ ID NO: 3191935 - RNA, 22 nt, Human
guuaauuuggaccauuuuccug

SEQ ID NO: 3191936 - RNA, 18 nt, Human
guuaauuuguguguuuuu

SEQ ID NO: 3191937 - RNA, 20 nt, Human
guuaauuuggaccauuuucc

SEQ ID NO: 3191938 - RNA, 17 nt, Human
guuaauuuggaccauuu

SEQ ID NO: 3191939 - RNA, 12 nt, Human
guuaauuuggac

SEQ ID NO: 3191940 - RNA, 23 nt, Human
guuacucuucaguuaagccuuug

SEQ ID NO: 3191941 - RNA, 18 nt, Human
guuacuggauaaauuguu

SEQ ID NO: 3191942 - RNA, 19 nt, Human
guuacuggauaaauuguuu

SEQ ID NO: 3191943 - RNA, 15 nt, Human
guuacucuugggaca

SEQ ID NO: 3191944 - RNA, 12 nt, Human
aagcccaaccuc

SEQ ID NO: 3191945 - RNA, 13 nt, Human
aagcccagcuuga

SEQ ID NO: 3191946 - RNA, 18 nt, Human
guuaauaucacucauuaa

SEQ ID NO: 3191947 - RNA, 14 nt, Human
guuaauauggcuga

SEQ ID NO: 3191948 - RNA, 14 nt, Human
aagcuuuuccuaau

SEQ ID NO: 3191949 - RNA, 13 nt, Human
aagcuuuuugaaa

SEQ ID NO: 3191950 - RNA, 12 nt, Human
aagcuuuuugga

SEQ ID NO: 3191951 - RNA, 15 nt, Human
guuccccaagacauu

SEQ ID NO: 3191952 - RNA, 18 nt, Human
guucccccuguuucagag

SEQ ID NO: 3191953 - RNA, 21 nt, Human
guucccuuuuuuggcugcuga

SEQ ID NO: 3191954 - RNA, 22 nt, Human
guucccuuuuuuggcugcugaa

SEQ ID NO: 3191955 - RNA, 22 nt, Human
guucccuuugacgccaucccag

SEQ ID NO: 3191956 - RNA, 17 nt, Human
aagcucugcuccucucc

SEQ ID NO: 3191957 - RNA, 11 nt, Human
aagcugaaauu

SEQ ID NO: 3191958 - RNA, 12 nt, Human
aagcugaaauuu

SEQ ID NO: 3191959 - RNA, 13 nt, Human
aagcugaaauuuu

SEQ ID NO: 3191960 - RNA, 17 nt, Human
aagcuguuugguuuuaa

SEQ ID NO: 3191961 - RNA, 16 nt, Human
aagcucacuugcuuua

SEQ ID NO: 3191962 - RNA, 14 nt, Human
aagcuauaaauuau

SEQ ID NO: 3191963 - RNA, 18 nt, Human
aagcuuaugcuuaaauuc

SEQ ID NO: 3191964 - RNA, 17 nt, Human
aagcuucccucccugcu

SEQ ID NO: 3191965 - RNA, 19 nt, Human
aagcuguuugguuuuaaaa

SEQ ID NO: 3191966 - RNA, 21 nt, Human
aagcuguuugguuuuaaaaua

SEQ ID NO: 3191967 - RNA, 20 nt, Human
aagcuguuugguuuuaaaau

SEQ ID NO: 3191968 - RNA, 14 nt, Human
guugauagcacaga

SEQ ID NO: 3191969 - RNA, 19 nt, Human
guugauagcacagacccug

SEQ ID NO: 3191970 - RNA, 18 nt, Human
guugacuuuauaaauuuc

SEQ ID NO: 3191971 - RNA, 22 nt, Human
guugacucuaguacugugaauc

SEQ ID NO: 3191972 - RNA, 20 nt, Human
guucuuggcaauaaauuuug

SEQ ID NO: 3191973 - RNA, 15 nt, Human
guucuuccuguaauc

SEQ ID NO: 3191974 - RNA, 21 nt, Human
guugacucuaguacugugaau

SEQ ID NO: 3191975 - RNA, 19 nt, Human
guugacucuaguacuguga

SEQ ID NO: 3191976 - RNA, 21 nt, Human
guucuuggcaauaaauuuuga

SEQ ID NO: 3191977 - RNA, 22 nt, Human
guucuuggcaauaaauuuugaa

SEQ ID NO: 3191978 - RNA, 23 nt, Human
guucuuggcaauaaauuuugaaa

SEQ ID NO: 3191979 - RNA, 12 nt, Human
guugacauuugu

SEQ ID NO: 3191980 - RNA, 19 nt, Human
guucuagcauggcugccaa

SEQ ID NO: 3191981 - RNA, 13 nt, Human
guucucuccuucu

SEQ ID NO: 3191982 - RNA, 21 nt, Human
guucucucuacugguccucuu

SEQ ID NO: 3191983 - RNA, 13 nt, Human
guucucugcccuc

SEQ ID NO: 3191984 - RNA, 15 nt, Human
guucucugcccucca

SEQ ID NO: 3191985 - RNA, 15 nt, Human
guucucucuucucca

SEQ ID NO: 3191986 - RNA, 12 nt, Human
guucucugagga

SEQ ID NO: 3191987 - RNA, 17 nt, Human
guucucugcccuccaag

SEQ ID NO: 3191988 - RNA, 18 nt, Human
guucucugcccuccaaga

SEQ ID NO: 3191989 - RNA, 11 nt, Human
guucuucauga

SEQ ID NO: 3191990 - RNA, 15 nt, Human
guucuuccaaagcag

SEQ ID NO: 3191991 - RNA, 14 nt, Human
guucuuccaaagca

SEQ ID NO: 3191992 - RNA, 19 nt, Human
guucuuccaguuacuuucc

SEQ ID NO: 3191993 - RNA, 11 nt, Human
aaguuaagaau

SEQ ID NO: 3191994 - RNA, 22 nt, Human
aaguuagagaacuaaacuaguu

SEQ ID NO: 3191995 - RNA, 17 nt, Human
aaguuagccuuuaucua

SEQ ID NO: 3191996 - RNA, 16 nt, Human
aaguuagccuuuaucu

SEQ ID NO: 3191997 - RNA, 17 nt, Human
aaguuaauguauauaaa

SEQ ID NO: 3191998 - RNA, 19 nt, Human
aaguuaauguauauaaaaa

SEQ ID NO: 3191999 - RNA, 22 nt, Human
aaguuaauguauauaaaaaugg

SEQ ID NO: 3192000 - RNA, 23 nt, Human
aaguuaagaauguucuuauguug

SEQ ID NO: 3192001 - RNA, 16 nt, Human
aaguuaagauucuugg

SEQ ID NO: 3192002 - RNA, 17 nt, Human
aaguuauuaaaauuguu

SEQ ID NO: 3192003 - RNA, 16 nt, Human
aaguuauuaaaauugu

SEQ ID NO: 3192004 - RNA, 14 nt, Human
aaguuauuaaaauu

SEQ ID NO: 3192005 - RNA, 16 nt, Human
aaguuauguguaugug

SEQ ID NO: 3192006 - RNA, 22 nt, Human
aaguuauauuuccuauaccauu

SEQ ID NO: 3192007 - RNA, 14 nt, Human
aaguuauauuuccu

SEQ ID NO: 3192008 - RNA, 23 nt, Human
aaguuauauuuccuauaccauuu

SEQ ID NO: 3192009 - RNA, 15 nt, Human
aaguuauguguaugu

SEQ ID NO: 3192010 - RNA, 14 nt, Human
aaguuauguguaug

SEQ ID NO: 3192011 - RNA, 16 nt, Human
aaguuaguaggauaug

SEQ ID NO: 3192012 - RNA, 19 nt, Human
aaguuaguaggauaugccu

SEQ ID NO: 3192013 - RNA, 21 nt, Human
aaguuagccuuuaucuaccaa

SEQ ID NO: 3192014 - RNA, 15 nt, Human
aaguuaguaggauau

SEQ ID NO: 3192015 - RNA, 13 nt, Human
aaguuauaguacu

SEQ ID NO: 3192016 - RNA, 16 nt, Human
aaguuaguggaaaucu

SEQ ID NO: 3192017 - RNA, 19 nt, Human
aaguuaguggaaaucugaa

SEQ ID NO: 3192018 - RNA, 22 nt, Human
aaguuaguggaaaucugaacau

SEQ ID NO: 3192019 - RNA, 23 nt, Human
aaguuaguggaaaucugaacauu

SEQ ID NO: 3192020 - RNA, 18 nt, Human
aaguuaguuccacugaga

SEQ ID NO: 3192021 - RNA, 14 nt, Human
aaguuaguuucagu

SEQ ID NO: 3192022 - RNA, 19 nt, Human
aaguuaguuccacugagac

SEQ ID NO: 3192023 - RNA, 18 nt, Human
aagugugugauugaaggu

SEQ ID NO: 3192024 - RNA, 20 nt, Human
aagugugggucugugugugu

SEQ ID NO: 3192025 - RNA, 13 nt, Human
aagugugguagag

SEQ ID NO: 3192026 - RNA, 10 nt, Human
aagugugggu

SEQ ID NO: 3192027 - RNA, 17 nt, Human
aagugugggucugugug

SEQ ID NO: 3192028 - RNA, 18 nt, Human
aagugugggucugugugu

SEQ ID NO: 3192029 - RNA, 20 nt, Human
aagugugaauacugcuugaa

SEQ ID NO: 3192030 - RNA, 14 nt, Human
aagugugaauacug

SEQ ID NO: 3192031 - RNA, 15 nt, Human
aagugugaauacugc

SEQ ID NO: 3192032 - RNA, 16 nt, Human
aagugugaauacugcu

SEQ ID NO: 3192033 - RNA, 18 nt, Human
aagugugaauacugcuug

SEQ ID NO: 3192034 - RNA, 23 nt, Human
uaaaauugaguucuuccuguaau

SEQ ID NO: 3192035 - RNA, 15 nt, Human
uaaaauucucuucca

SEQ ID NO: 3192036 - RNA, 14 nt, Human
uaaaauucaguuuu

SEQ ID NO: 3192037 - RNA, 22 nt, Human
uaaaauucaguuuuuuuccagu

SEQ ID NO: 3192038 - RNA, 17 nt, Human
uaaaauuccaaauucau

SEQ ID NO: 3192039 - RNA, 15 nt, Human
uaaaauugugaugug

SEQ ID NO: 3192040 - RNA, 19 nt, Human
uaaaauuguacaugaacau

SEQ ID NO: 3192041 - RNA, 16 nt, Human
uaaaauugugaugugu

SEQ ID NO: 3192042 - RNA, 15 nt, Human
uaaaaugucuuucca

SEQ ID NO: 3192043 - RNA, 16 nt, Human
uaaaaugucuuuccaa

SEQ ID NO: 3192044 - RNA, 20 nt, Human
uaaaaugucuuuccaaauua

SEQ ID NO: 3192045 - RNA, 22 nt, Human
uaaaaugucuuuccaaauuauu

SEQ ID NO: 3192046 - RNA, 21 nt, Human
uaaaauguccaguaagaucac

SEQ ID NO: 3192047 - RNA, 22 nt, Human
uaaaauguccaguaagaucacu

SEQ ID NO: 3192048 - RNA, 19 nt, Human
uaaaauguccaguaagauc

SEQ ID NO: 3192049 - RNA, 20 nt, Human
uaaaauguccaguaagauca

SEQ ID NO: 3192050 - RNA, 12 nt, Human
uaaaauguauua

SEQ ID NO: 3192051 - RNA, 20 nt, Human
uaaaauguauuauguccugu

SEQ ID NO: 3192052 - RNA, 14 nt, Human
uaaaauguacaugu

SEQ ID NO: 3192053 - RNA, 17 nt, Human
uaaaauguaucuaagaa

SEQ ID NO: 3192054 - RNA, 22 nt, Human
uaaaauguaucuaagaauaaua

SEQ ID NO: 3192055 - RNA, 22 nt, Human
uaaaauguacauguauuaaauu

SEQ ID NO: 3192056 - RNA, 18 nt, Human
uaaaauguacauguauua

SEQ ID NO: 3192057 - RNA, 17 nt, Human
uaaaauguacauguauu

SEQ ID NO: 3192058 - RNA, 15 nt, Human
uaaaauguacaugua

SEQ ID NO: 3192059 - RNA, 23 nt, Human
aaguuugaucuuccucugcuaaa

SEQ ID NO: 3192060 - RNA, 13 nt, Human
uaaaauguaaaaa

SEQ ID NO: 3192061 - RNA, 9 nt, Human
uaaaauggu

SEQ ID NO: 3192062 - RNA, 20 nt, Human
aaguuugagaucagccuggg

SEQ ID NO: 3192063 - RNA, 12 nt, Human
aaguuugauaaa

SEQ ID NO: 3192064 - RNA, 20 nt, Human
aaguuugauaaauaguguua

SEQ ID NO: 3192065 - RNA, 17 nt, Human
aaguuugauaaauagug

SEQ ID NO: 3192066 - RNA, 18 nt, Human
aaguuugaucuuccucug

SEQ ID NO: 3192067 - RNA, 15 nt, Human
aaguuugaucuuccu

SEQ ID NO: 3192068 - RNA, 12 nt, Human
aaguuugaucuu

SEQ ID NO: 3192069 - RNA, 21 nt, Human
aaguuugauaaauaguguuau

SEQ ID NO: 3192070 - RNA, 19 nt, Human
aaguuucugccgcagcccu

SEQ ID NO: 3192071 - RNA, 21 nt, Human
aaguuucugccgcagcccugc

SEQ ID NO: 3192072 - RNA, 13 nt, Human
aaguuucucuucu

SEQ ID NO: 3192073 - RNA, 18 nt, Human
aaguuugaaaagcaauau

SEQ ID NO: 3192074 - RNA, 20 nt, Human
aaguuugaaaagcaauauug

SEQ ID NO: 3192075 - RNA, 15 nt, Human
aaguuauuucccuuu

SEQ ID NO: 3192076 - RNA, 20 nt, Human
aaguucccuacuuccuguga

SEQ ID NO: 3192077 - RNA, 17 nt, Human
aaguucccuacuuccug

SEQ ID NO: 3192078 - RNA, 14 nt, Human
aaguucccuacuuc

SEQ ID NO: 3192079 - RNA, 22 nt, Human
uaaaaagcuccaaaugcagcuu

SEQ ID NO: 3192080 - RNA, 21 nt, Human
uaaaaaaaaaccugagcccca

SEQ ID NO: 3192081 - RNA, 13 nt, Human
aagucagauguuu

SEQ ID NO: 3192082 - RNA, 14 nt, Human
aagucagauguuug

SEQ ID NO: 3192083 - RNA, 18 nt, Human
aagucagauguuugagca

SEQ ID NO: 3192084 - RNA, 15 nt, Human
uaaaaaaaaaaguca

SEQ ID NO: 3192085 - RNA, 16 nt, Human
uaaaaaaaaaagucac

SEQ ID NO: 3192086 - RNA, 21 nt, Human
uaaaaauauacauguuuaugu

SEQ ID NO: 3192087 - RNA, 17 nt, Human
uaaaaauauacauguuu

SEQ ID NO: 3192088 - RNA, 16 nt, Human
uaaaaauauacauguu

SEQ ID NO: 3192089 - RNA, 15 nt, Human
uaaaaauauacaugu

SEQ ID NO: 3192090 - RNA, 13 nt, Human
uaaaaauauacau

SEQ ID NO: 3192091 - RNA, 16 nt, Human
uaaaaagucuuuuaaa

SEQ ID NO: 3192092 - RNA, 21 nt, Human
uaaaaaguauugccaaacauu

SEQ ID NO: 3192093 - RNA, 19 nt, Human
uaaaaagucagauguuuga

SEQ ID NO: 3192094 - RNA, 22 nt, Human
uaaaaaguccauaccuuauaua

SEQ ID NO: 3192095 - RNA, 14 nt, Human
uaaaaagucuuuua

SEQ ID NO: 3192096 - RNA, 23 nt, Human
uaaaaagguccucacaggugucu

SEQ ID NO: 3192097 - RNA, 20 nt, Human
uaaaaaguauugccaaacau

SEQ ID NO: 3192098 - RNA, 13 nt, Human
uaaaaaguauugc

SEQ ID NO: 3192099 - RNA, 18 nt, Human
uaaaaaggaauaugaaag

SEQ ID NO: 3192100 - RNA, 15 nt, Human
uaaaaaugagguacu

SEQ ID NO: 3192101 - RNA, 16 nt, Human
uaaaaaucucucauuu

SEQ ID NO: 3192102 - RNA, 23 nt, Human
uaaaaauaucaaauuaauugugu

SEQ ID NO: 3192103 - RNA, 13 nt, Human
uaaaaccacagca

SEQ ID NO: 3192104 - RNA, 15 nt, Human
uaaaaccacagcagu

SEQ ID NO: 3192105 - RNA, 14 nt, Human
uaaaaccacagcag

SEQ ID NO: 3192106 - RNA, 22 nt, Human
uaaaacuguacuuugauucaca

SEQ ID NO: 3192107 - RNA, 20 nt, Human
uaaaacuguacuuugauuca

SEQ ID NO: 3192108 - RNA, 19 nt, Human
uaaaacuguacuuugauuc

SEQ ID NO: 3192109 - RNA, 17 nt, Human
uaaaacuguacuuugau

SEQ ID NO: 3192110 - RNA, 16 nt, Human
uaaaacuguacuuuga

SEQ ID NO: 3192111 - RNA, 15 nt, Human
uaaaacuguacuuug

SEQ ID NO: 3192112 - RNA, 23 nt, Human
uaaaacuguacuuugauucacau

SEQ ID NO: 3192113 - RNA, 16 nt, Human
uaaaacugucacuguu

SEQ ID NO: 3192114 - RNA, 13 nt, Human
uaaaacccaagug

SEQ ID NO: 3192115 - RNA, 17 nt, Human
uaaaacuacuuagcacu

SEQ ID NO: 3192116 - RNA, 19 nt, Human
uaaaacuaggcauuuguaa

SEQ ID NO: 3192117 - RNA, 21 nt, Human
uaaaacuaggcauuuguaaau

SEQ ID NO: 3192118 - RNA, 17 nt, Human
uaaaaccaggcuuucua

SEQ ID NO: 3192119 - RNA, 11 nt, Human
uaaaacuaaga

SEQ ID NO: 3192120 - RNA, 13 nt, Human
uaaaacuguacuu

SEQ ID NO: 3192121 - RNA, 14 nt, Human
uaaaacuguacuuu

SEQ ID NO: 3192122 - RNA, 14 nt, Human
uaaaacugauguga

SEQ ID NO: 3192123 - RNA, 16 nt, Human
uaaaacugaugugaaa

SEQ ID NO: 3192124 - RNA, 18 nt, Human
uaaaacugaugugaaacu

SEQ ID NO: 3192125 - RNA, 22 nt, Human
uaaaauaagaauagaacaacau

SEQ ID NO: 3192126 - RNA, 21 nt, Human
uaaaauacacacucaaaucaa

SEQ ID NO: 3192127 - RNA, 16 nt, Human
uaaaauaacuaaaaug

SEQ ID NO: 3192128 - RNA, 17 nt, Human
uaaaauaacuaaaaugu

SEQ ID NO: 3192129 - RNA, 18 nt, Human
uaaaauaacuaaaaugua

SEQ ID NO: 3192130 - RNA, 19 nt, Human
uaaaauaacuaaaauguau

SEQ ID NO: 3192131 - RNA, 21 nt, Human
uaaaauaacuaaaauguaucu

SEQ ID NO: 3192132 - RNA, 12 nt, Human
uaaaauaaaugg

SEQ ID NO: 3192133 - RNA, 13 nt, Human
uaaaauaaauggu

SEQ ID NO: 3192134 - RNA, 16 nt, Human
uaaaauaaacuuucuu

SEQ ID NO: 3192135 - RNA, 15 nt, Human
uaaaauaaacuuucu

SEQ ID NO: 3192136 - RNA, 14 nt, Human
uaaaauaaacuuuc

SEQ ID NO: 3192137 - RNA, 13 nt, Human
uaaaauaaacuuu

SEQ ID NO: 3192138 - RNA, 13 nt, Human
uaaaagaauauuu

SEQ ID NO: 3192139 - RNA, 19 nt, Human
uaaaaggugaccaaugaug

SEQ ID NO: 3192140 - RNA, 13 nt, Human
uaaaagucuugug

SEQ ID NO: 3192141 - RNA, 22 nt, Human
uaaaagaagaaauaguucugug

SEQ ID NO: 3192142 - RNA, 14 nt, Human
uaaaaguaaaaugu

SEQ ID NO: 3192143 - RNA, 16 nt, Human
uaaaaguaaaaugucu

SEQ ID NO: 3192144 - RNA, 18 nt, Human
uaaaaguaaaaugucuuu

SEQ ID NO: 3192145 - RNA, 21 nt, Human
uaaaagaagaaauaguucugu

SEQ ID NO: 3192146 - RNA, 15 nt, Human
uaaaagaaaggguuc

SEQ ID NO: 3192147 - RNA, 20 nt, Human
uaaaagaaaggguucuguaa

SEQ ID NO: 3192148 - RNA, 23 nt, Human
uaaaagaaaggguucuguaaaau

SEQ ID NO: 3192149 - RNA, 15 nt, Human
uaaaagaaaaaauga

SEQ ID NO: 3192150 - RNA, 17 nt, Human
uaaaagaaaaaaugaca

SEQ ID NO: 3192151 - RNA, 14 nt, Human
uaaaagaaaauaaa

SEQ ID NO: 3192152 - RNA, 22 nt, Human
uaaaagaaaauaaaaaaaagaa

SEQ ID NO: 3192153 - RNA, 17 nt, Human
uaaaagaaaauaaaaaa

SEQ ID NO: 3192154 - RNA, 20 nt, Human
aagugauccucccaccucag

SEQ ID NO: 3192155 - RNA, 19 nt, Human
aagugauccucccaccuca

SEQ ID NO: 3192156 - RNA, 13 nt, Human
aagugauccuccc

SEQ ID NO: 3192157 - RNA, 12 nt, Human
uaaaauaauaaa

SEQ ID NO: 3192158 - RNA, 20 nt, Human
aagugauucuccugccucag

SEQ ID NO: 3192159 - RNA, 13 nt, Human
aagugauucucau

SEQ ID NO: 3192160 - RNA, 16 nt, Human
aagugauucucaugcc

SEQ ID NO: 3192161 - RNA, 23 nt, Human
aagugauccucccaccucagccu

SEQ ID NO: 3192162 - RNA, 19 nt, Human
aagugcagaacugcaguca

SEQ ID NO: 3192163 - RNA, 17 nt, Human
aagugauucucaugccu

SEQ ID NO: 3192164 - RNA, 20 nt, Human
guuuuaaaguucauugcaau

SEQ ID NO: 3192165 - RNA, 13 nt, Human
guuuggagacaga

SEQ ID NO: 3192166 - RNA, 15 nt, Human
guuuggaauauuaaa

SEQ ID NO: 3192167 - RNA, 16 nt, Human
guuuggaauauuaaaa

SEQ ID NO: 3192168 - RNA, 20 nt, Human
guuugcuuuguaugcacuuu

SEQ ID NO: 3192169 - RNA, 22 nt, Human
guuugcuccccuuccccuuccu

SEQ ID NO: 3192170 - RNA, 20 nt, Human
guuugcugaacauuggagaa

SEQ ID NO: 3192171 - RNA, 23 nt, Human
guuugcuccccuuccccuuccuu

SEQ ID NO: 3192172 - RNA, 14 nt, Human
guuugcuguugcug

SEQ ID NO: 3192173 - RNA, 17 nt, Human
guuuuaacaagaagcaa

SEQ ID NO: 3192174 - RNA, 21 nt, Human
guuuuaucguccagugacuuu

SEQ ID NO: 3192175 - RNA, 12 nt, Human
guuuuauuuaua

SEQ ID NO: 3192176 - RNA, 14 nt, Human
guuuuauuuauauu

SEQ ID NO: 3192177 - RNA, 17 nt, Human
guuuuauuuauauuuau

SEQ ID NO: 3192178 - RNA, 18 nt, Human
guuuuauuuauauuuauu

SEQ ID NO: 3192179 - RNA, 22 nt, Human
guuuuauuuauauuuauugacu

SEQ ID NO: 3192180 - RNA, 20 nt, Human
guuuuauuuucuaaaguacu

SEQ ID NO: 3192181 - RNA, 12 nt, Human
guuuugagcccu

SEQ ID NO: 3192182 - RNA, 21 nt, Human
guuuugagcuacuggauucuu

SEQ ID NO: 3192183 - RNA, 21 nt, Human
aagucacuggccaguggcugg

SEQ ID NO: 3192184 - RNA, 22 nt, Human
aagucacugcacagugcaucuc

SEQ ID NO: 3192185 - RNA, 16 nt, Human
aagucaaacacuugug

SEQ ID NO: 3192186 - RNA, 20 nt, Human
aagucaaacacuugugacuu

SEQ ID NO: 3192187 - RNA, 19 nt, Human
aagucaaacacuugugacu

SEQ ID NO: 3192188 - RNA, 14 nt, Human
aagucacugcacag

SEQ ID NO: 3192189 - RNA, 20 nt, Human
aagucagaaacuaaaacaaa

SEQ ID NO: 3192190 - RNA, 12 nt, Human
aagucagaaguu

SEQ ID NO: 3192191 - RNA, 13 nt, Human
aagucagaaguuu

SEQ ID NO: 3192192 - RNA, 16 nt, Human
aagucagaaucagaag

SEQ ID NO: 3192193 - RNA, 18 nt, Human
aagucagaaucagaagau

SEQ ID NO: 3192194 - RNA, 23 nt, Human
aagucagaaucagaagauagucu

SEQ ID NO: 3192195 - RNA, 19 nt, Human
aaguauucuuauuuaauga

SEQ ID NO: 3192196 - RNA, 21 nt, Human
aaguauucuuauuuaaugaaa

SEQ ID NO: 3192197 - RNA, 23 nt, Human
aaguauucuuauuuaaugaaaga

SEQ ID NO: 3192198 - RNA, 17 nt, Human
aaguauugccaaacauu

SEQ ID NO: 3192199 - RNA, 13 nt, Human
aaguauugccaaa

SEQ ID NO: 3192200 - RNA, 14 nt, Human
aaguauucuuuuuc

SEQ ID NO: 3192201 - RNA, 13 nt, Human
aaguauuuaagcc

SEQ ID NO: 3192202 - RNA, 17 nt, Human
aaguauuguacaaauaa

SEQ ID NO: 3192203 - RNA, 18 nt, Human
aaguauugccaaacauua

SEQ ID NO: 3192204 - RNA, 15 nt, Human
aaguauuuuccuguu

SEQ ID NO: 3192205 - RNA, 19 nt, Human
aaguacuucuccacccugc

SEQ ID NO: 3192206 - RNA, 18 nt, Human
aaguacuucuccacccug

SEQ ID NO: 3192207 - RNA, 20 nt, Human
aaguauuauaaacaagaaug

SEQ ID NO: 3192208 - RNA, 15 nt, Human
aaguaauuguuccag

SEQ ID NO: 3192209 - RNA, 13 nt, Human
aaguaauuucagu

SEQ ID NO: 3192210 - RNA, 14 nt, Human
aaguaauuucagug

SEQ ID NO: 3192211 - RNA, 23 nt, Human
aaguaauuucaguguaaagugug

SEQ ID NO: 3192212 - RNA, 13 nt, Human
aaguacuauguau

SEQ ID NO: 3192213 - RNA, 17 nt, Human
aaguacuauaauuuacc

SEQ ID NO: 3192214 - RNA, 14 nt, Human
aaguacuauaauuu

SEQ ID NO: 3192215 - RNA, 18 nt, Human
aaguaacuggugauauau

SEQ ID NO: 3192216 - RNA, 22 nt, Human
aagguauuaagauuauaauugu

SEQ ID NO: 3192217 - RNA, 21 nt, Human
aagguauuaagauuauaauug

SEQ ID NO: 3192218 - RNA, 23 nt, Human
aagguuucagaaagaagugggga

SEQ ID NO: 3192219 - RNA, 17 nt, Human
aagguuuauuuuucugu

SEQ ID NO: 3192220 - RNA, 16 nt, Human
aagguauaucauucua

SEQ ID NO: 3192221 - RNA, 23 nt, Human
aagguauaucauucuaaagauag

SEQ ID NO: 3192222 - RNA, 22 nt, Human
aagguauaucauucuaaagaua

SEQ ID NO: 3192223 - RNA, 12 nt, Human
aagggggcuggg

SEQ ID NO: 3192224 - RNA, 23 nt, Human
aagggggcugggacaugggaaag

SEQ ID NO: 3192225 - RNA, 13 nt, Human
aaggggagaguaa

SEQ ID NO: 3192226 - RNA, 22 nt, Human
aagguagaaugaccuuguaaug

SEQ ID NO: 3192227 - RNA, 14 nt, Human
aagguagacuuuua

SEQ ID NO: 3192228 - RNA, 18 nt, Human
aagguagcauucuuugga

SEQ ID NO: 3192229 - RNA, 20 nt, Human
aagguagcauucuuuggagu

SEQ ID NO: 3192230 - RNA, 15 nt, Human
aagguaguucaagaa

SEQ ID NO: 3192231 - RNA, 22 nt, Human
aagguaggguaggcagccugag

SEQ ID NO: 3192232 - RNA, 22 nt, Human
aagguaguucaagaaaugaaga

SEQ ID NO: 3192233 - RNA, 15 nt, Human
aaggggguagggaaa

SEQ ID NO: 3192234 - RNA, 20 nt, Human
aagguagaaugaccuuguaa

SEQ ID NO: 3192235 - RNA, 19 nt, Human
aagguagaaugaccuugua

SEQ ID NO: 3192236 - RNA, 14 nt, Human
aaggcuuauaaaac

SEQ ID NO: 3192237 - RNA, 20 nt, Human
aaggggacaaguagccaccu

SEQ ID NO: 3192238 - RNA, 19 nt, Human
aaggggacugccaccuccc

SEQ ID NO: 3192239 - RNA, 17 nt, Human
aaggggacugccaccuc

SEQ ID NO: 3192240 - RNA, 16 nt, Human
aaggcugggggaagaa

SEQ ID NO: 3192241 - RNA, 14 nt, Human
aaggcugggggaag

SEQ ID NO: 3192242 - RNA, 19 nt, Human
aaggcugggggaagaagcu

SEQ ID NO: 3192243 - RNA, 22 nt, Human
aaggcugggggaagaagcucuc

SEQ ID NO: 3192244 - RNA, 20 nt, Human
aaggcugucaauuacaggaa

SEQ ID NO: 3192245 - RNA, 18 nt, Human
aaggcugucucagauaaa

SEQ ID NO: 3192246 - RNA, 17 nt, Human
aaggcuguauucagcaa

SEQ ID NO: 3192247 - RNA, 16 nt, Human
aaggcuguauucagca

SEQ ID NO: 3192248 - RNA, 12 nt, Human
aaggcuguauuc

SEQ ID NO: 3192249 - RNA, 19 nt, Human
guuuauucaaacugaaaag

SEQ ID NO: 3192250 - RNA, 14 nt, Human
guuuauucaaacug

SEQ ID NO: 3192251 - RNA, 15 nt, Human
guuuauuccagagcu

SEQ ID NO: 3192252 - RNA, 20 nt, Human
guuuauuccagagcugccag

SEQ ID NO: 3192253 - RNA, 18 nt, Human
guuuauucuugaugaaaa

SEQ ID NO: 3192254 - RNA, 17 nt, Human
guuuauucuugaugaaa

SEQ ID NO: 3192255 - RNA, 16 nt, Human
guuuauucuugaugaa

SEQ ID NO: 3192256 - RNA, 22 nt, Human
guuucaccauguuggccaggcu

SEQ ID NO: 3192257 - RNA, 17 nt, Human
guuucaaguuuuaaagu

SEQ ID NO: 3192258 - RNA, 12 nt, Human
guuucaauaaag

SEQ ID NO: 3192259 - RNA, 18 nt, Human
guuucaauaaaguuugau

SEQ ID NO: 3192260 - RNA, 17 nt, Human
guuucaauaaaguuuga

SEQ ID NO: 3192261 - RNA, 16 nt, Human
guuucaauaaaguuug

SEQ ID NO: 3192262 - RNA, 14 nt, Human
guuucaauaaaguu

SEQ ID NO: 3192263 - RNA, 14 nt, Human
guuuaugauuccac

SEQ ID NO: 3192264 - RNA, 20 nt, Human
guuuauguaaacaaaucuuu

SEQ ID NO: 3192265 - RNA, 19 nt, Human
guuuauguaaacaaaucuu

SEQ ID NO: 3192266 - RNA, 15 nt, Human
guuuaugcagugcug

SEQ ID NO: 3192267 - RNA, 17 nt, Human
guuuaugcagugcugcu

SEQ ID NO: 3192268 - RNA, 18 nt, Human
guuuaugcagugcugcuu

SEQ ID NO: 3192269 - RNA, 17 nt, Human
guuguuuguauguauaa

SEQ ID NO: 3192270 - RNA, 14 nt, Human
guuguuuuuguaua

SEQ ID NO: 3192271 - RNA, 21 nt, Human
guuguuuuuguauauugguuu

SEQ ID NO: 3192272 - RNA, 17 nt, Human
guuguuuuguacagaug

SEQ ID NO: 3192273 - RNA, 15 nt, Human
guuguuuuguacaga

SEQ ID NO: 3192274 - RNA, 12 nt, Human
guuuaaaaaugg

SEQ ID NO: 3192275 - RNA, 21 nt, Human
guuuaagugacugauggcuaa

SEQ ID NO: 3192276 - RNA, 15 nt, Human
guuuaaguagauuuc

SEQ ID NO: 3192277 - RNA, 18 nt, Human
guuuaaguagauuucaug

SEQ ID NO: 3192278 - RNA, 22 nt, Human
guuuaauaaagcgaaaaacuca

SEQ ID NO: 3192279 - RNA, 20 nt, Human
aaggaaaagaaaacaaaaaa

SEQ ID NO: 3192280 - RNA, 17 nt, Human
aaggaaacccagcucug

SEQ ID NO: 3192281 - RNA, 22 nt, Human
aaggaaacccagcucuggucca

SEQ ID NO: 3192282 - RNA, 23 nt, Human
guuguuugauucagacagcugcc

SEQ ID NO: 3192283 - RNA, 20 nt, Human
guuguuugauucagacagcu

SEQ ID NO: 3192284 - RNA, 13 nt, Human
guuguuuguaugu

SEQ ID NO: 3192285 - RNA, 16 nt, Human
aaggaaacccagcucu

SEQ ID NO: 3192286 - RNA, 12 nt, Human
aaggaaaccuuu

SEQ ID NO: 3192287 - RNA, 18 nt, Human
aaggaaaccuuuucuugu

SEQ ID NO: 3192288 - RNA, 19 nt, Human
aaggaaaccuuuucuugua

SEQ ID NO: 3192289 - RNA, 13 nt, Human
aaggaaaaauuca

SEQ ID NO: 3192290 - RNA, 15 nt, Human
gugcucaucagaaac

SEQ ID NO: 3192291 - RNA, 22 nt, Human
gugcucaucagaaacaauuucu

SEQ ID NO: 3192292 - RNA, 15 nt, Human
gugcucuccaagccc

SEQ ID NO: 3192293 - RNA, 16 nt, Human
gugcucugaucaucca

SEQ ID NO: 3192294 - RNA, 14 nt, Human
gugcucuggacagg

SEQ ID NO: 3192295 - RNA, 13 nt, Human
gugcucuggacag

SEQ ID NO: 3192296 - RNA, 12 nt, Human
gugcugcccugc

SEQ ID NO: 3192297 - RNA, 13 nt, Human
gugcugcccugcc

SEQ ID NO: 3192298 - RNA, 14 nt, Human
gugcugcccugccc

SEQ ID NO: 3192299 - RNA, 15 nt, Human
gugcugcccugccca

SEQ ID NO: 3192300 - RNA, 19 nt, Human
aagaagugugucacccuua

SEQ ID NO: 3192301 - RNA, 17 nt, Human
aagaaguuuaaggaaua

SEQ ID NO: 3192302 - RNA, 14 nt, Human
aagaaguuuaagga

SEQ ID NO: 3192303 - RNA, 20 nt, Human
aagaaguucuuugauucugu

SEQ ID NO: 3192304 - RNA, 14 nt, Human
aagaaguucuuuga

SEQ ID NO: 3192305 - RNA, 16 nt, Human
aagaauaaaggcagcu

SEQ ID NO: 3192306 - RNA, 12 nt, Human
aagaauaauaaa

SEQ ID NO: 3192307 - RNA, 13 nt, Human
aagaauaauaaaa

SEQ ID NO: 3192308 - RNA, 14 nt, Human
aagaauaauaaaau

SEQ ID NO: 3192309 - RNA, 15 nt, Human
aagaauaauaaaauc

SEQ ID NO: 3192310 - RNA, 16 nt, Human
aagaauaauaaaauca

SEQ ID NO: 3192311 - RNA, 22 nt, Human
gugcuacaaaaacacagcaagg

SEQ ID NO: 3192312 - RNA, 21 nt, Human
gugcuacaaaaacacagcaag

SEQ ID NO: 3192313 - RNA, 11 nt, Human
gugcuacagaa

SEQ ID NO: 3192314 - RNA, 11 nt, Human
aagaauaauuu

SEQ ID NO: 3192315 - RNA, 22 nt, Human
gugcuauaaucuguuuuuacgu

SEQ ID NO: 3192316 - RNA, 23 nt, Human
gugcuauaaucuguuuuuacgua

SEQ ID NO: 3192317 - RNA, 21 nt, Human
gugcuagaggauuaguaagau

SEQ ID NO: 3192318 - RNA, 15 nt, Human
gugcuaucuccccca

SEQ ID NO: 3192319 - RNA, 18 nt, Human
gugcuaucucccccagcc

SEQ ID NO: 3192320 - RNA, 22 nt, Human
aagaaaacaaaaccaaaaguua

SEQ ID NO: 3192321 - RNA, 12 nt, Human
aagaaaaaugug

SEQ ID NO: 3192322 - RNA, 18 nt, Human
aagaaaaaugagccuggc

SEQ ID NO: 3192323 - RNA, 17 nt, Human
aagaaaaaugagccugg

SEQ ID NO: 3192324 - RNA, 14 nt, Human
aagaaaaacuguuu

SEQ ID NO: 3192325 - RNA, 13 nt, Human
aagaaaaagaaaa

SEQ ID NO: 3192326 - RNA, 19 nt, Human
aagaaaaaauauuuucccu

SEQ ID NO: 3192327 - RNA, 15 nt, Human
aacuuuagaaauaaa

SEQ ID NO: 3192328 - RNA, 20 nt, Human
aacuuuagaaauaaaccuua

SEQ ID NO: 3192329 - RNA, 17 nt, Human
aagaaagaggaaaagaa

SEQ ID NO: 3192330 - RNA, 12 nt, Human
aagaaagaggaa

SEQ ID NO: 3192331 - RNA, 14 nt, Human
aagaaagauguuug

SEQ ID NO: 3192332 - RNA, 16 nt, Human
aagaaaggaaaagaaa

SEQ ID NO: 3192333 - RNA, 16 nt, Human
aagaaaggaaaccuuu

SEQ ID NO: 3192334 - RNA, 16 nt, Human
aagaaagaaaaucagg

SEQ ID NO: 3192335 - RNA, 12 nt, Human
aagaaagaaaua

SEQ ID NO: 3192336 - RNA, 12 nt, Human
aagaaagaaaga

SEQ ID NO: 3192337 - RNA, 14 nt, Human
aagaaagaaaauca

SEQ ID NO: 3192338 - RNA, 13 nt, Human
aagaaagaaaauc

SEQ ID NO: 3192339 - RNA, 11 nt, Human
aagaaacauug

SEQ ID NO: 3192340 - RNA, 19 nt, Human
aagaaacagcuaugagagg

SEQ ID NO: 3192341 - RNA, 17 nt, Human
aagaaacauuggaagca

SEQ ID NO: 3192342 - RNA, 14 nt, Human
aagaaacauuggaa

SEQ ID NO: 3192343 - RNA, 16 nt, Human
aagaaaauacuuaaau

SEQ ID NO: 3192344 - RNA, 13 nt, Human
aagaaaauacuua

SEQ ID NO: 3192345 - RNA, 20 nt, Human
aagaaaauacuuaaauguua

SEQ ID NO: 3192346 - RNA, 22 nt, Human
aagaaaauagagaugagcuuuc

SEQ ID NO: 3192347 - RNA, 15 nt, Human
aagaaaacacuguua

SEQ ID NO: 3192348 - RNA, 13 nt, Human
aagaaaacacugu

SEQ ID NO: 3192349 - RNA, 10 nt, Human
gugauguguc

SEQ ID NO: 3192350 - RNA, 22 nt, Human
gugaugguuccccuguucacuc

SEQ ID NO: 3192351 - RNA, 15 nt, Human
gugauguccuguaaa

SEQ ID NO: 3192352 - RNA, 19 nt, Human
gugauguccuguaaacacu

SEQ ID NO: 3192353 - RNA, 21 nt, Human
gugauguccuguaaacacuca

SEQ ID NO: 3192354 - RNA, 18 nt, Human
gugaugugacauuuguca

SEQ ID NO: 3192355 - RNA, 16 nt, Human
gugaugugacauuugu

SEQ ID NO: 3192356 - RNA, 13 nt, Human
gugaugugacauu

SEQ ID NO: 3192357 - RNA, 23 nt, Human
gugauccucccaccucagccucc

SEQ ID NO: 3192358 - RNA, 23 nt, Human
gugaucucauuguucaauuccca

SEQ ID NO: 3192359 - RNA, 23 nt, Human
gugaugguuccccuguucacucu

SEQ ID NO: 3192360 - RNA, 19 nt, Human
gugaucugcugcagagcag

SEQ ID NO: 3192361 - RNA, 20 nt, Human
gugaucugcugcagagcagu

SEQ ID NO: 3192362 - RNA, 17 nt, Human
gugauuaccagggacug

SEQ ID NO: 3192363 - RNA, 11 nt, Human
gugauuaccag

SEQ ID NO: 3192364 - RNA, 16 nt, Human
gugauuaccagggacu

SEQ ID NO: 3192365 - RNA, 13 nt, Human
gugcaauauauuu

SEQ ID NO: 3192366 - RNA, 15 nt, Human
gugcaauauauuuug

SEQ ID NO: 3192367 - RNA, 14 nt, Human
gugcaauauauuuu

SEQ ID NO: 3192368 - RNA, 22 nt, Human
gugcauuguauagauauaauga

SEQ ID NO: 3192369 - RNA, 18 nt, Human
gugcauuggauaacacca

SEQ ID NO: 3192370 - RNA, 23 nt, Human
gugccaaaaacaacaacaaaaug

SEQ ID NO: 3192371 - RNA, 18 nt, Human
gugcaaugaccuuucaau

SEQ ID NO: 3192372 - RNA, 13 nt, Human
gugcacaagcucc

SEQ ID NO: 3192373 - RNA, 16 nt, Human
gugcacaagcuccaag

SEQ ID NO: 3192374 - RNA, 21 nt, Human
gugcacaagcuccaagcuccc

SEQ ID NO: 3192375 - RNA, 21 nt, Human
gugcacaugcacgugugugca

SEQ ID NO: 3192376 - RNA, 23 nt, Human
gugcaauauauuuuguaugcaag

SEQ ID NO: 3192377 - RNA, 20 nt, Human
gugcaauauauuuuguaugc

SEQ ID NO: 3192378 - RNA, 16 nt, Human
gugcaauauauuuugu

SEQ ID NO: 3192379 - RNA, 23 nt, Human
gugcaccugggacagggagcagc

SEQ ID NO: 3192380 - RNA, 12 nt, Human
gugcaccugggc

SEQ ID NO: 3192381 - RNA, 22 nt, Human
gugcaccugggacagggagcag

SEQ ID NO: 3192382 - RNA, 15 nt, Human
aacugugugauuaaa

SEQ ID NO: 3192383 - RNA, 18 nt, Human
aacugcccccucugcccu

SEQ ID NO: 3192384 - RNA, 19 nt, Human
aacugcccccucugcccug

SEQ ID NO: 3192385 - RNA, 20 nt, Human
aacugcccccucugcccugc

SEQ ID NO: 3192386 - RNA, 21 nt, Human
aacugcccccucugcccugcg

SEQ ID NO: 3192387 - RNA, 16 nt, Human
aacugcccccucugcc

SEQ ID NO: 3192388 - RNA, 17 nt, Human
aacugcccccucugccc

SEQ ID NO: 3192389 - RNA, 19 nt, Human
aacugccaguuuuguuucc

SEQ ID NO: 3192390 - RNA, 14 nt, Human
aacugccaguuuug

SEQ ID NO: 3192391 - RNA, 18 nt, Human
aacuguccguaagcagua

SEQ ID NO: 3192392 - RNA, 19 nt, Human
aacuguccguaagcaguau

SEQ ID NO: 3192393 - RNA, 21 nt, Human
aacuguccguaagcaguauau

SEQ ID NO: 3192394 - RNA, 15 nt, Human
aacugucauuacaga

SEQ ID NO: 3192395 - RNA, 16 nt, Human
aacugcccaguuucca

SEQ ID NO: 3192396 - RNA, 15 nt, Human
aacugucgugucaua

SEQ ID NO: 3192397 - RNA, 20 nt, Human
aacugucgugucauacucga

SEQ ID NO: 3192398 - RNA, 19 nt, Human
aacugucuagcacuuccuu

SEQ ID NO: 3192399 - RNA, 13 nt, Human
aacuucagacaua

SEQ ID NO: 3192400 - RNA, 22 nt, Human
aacuuccuuggacucauuuuaa

SEQ ID NO: 3192401 - RNA, 23 nt, Human
aacuucuaaaacuguacuuugau

SEQ ID NO: 3192402 - RNA, 16 nt, Human
aacuucuaaaacugua

SEQ ID NO: 3192403 - RNA, 15 nt, Human
aacuucuaaaacugu

SEQ ID NO: 3192404 - RNA, 13 nt, Human
aacuucuaaaacu

SEQ ID NO: 3192405 - RNA, 23 nt, Human
aacuuccuuggacucauuuuaaa

SEQ ID NO: 3192406 - RNA, 18 nt, Human
aacuugaagccugcuccu

SEQ ID NO: 3192407 - RNA, 23 nt, Human
gugaauaauacaguaucucaggg

SEQ ID NO: 3192408 - RNA, 12 nt, Human
aacuccugaccu

SEQ ID NO: 3192409 - RNA, 14 nt, Human
aacuccugaccuca

SEQ ID NO: 3192410 - RNA, 19 nt, Human
aacuccaacauccacucuc

SEQ ID NO: 3192411 - RNA, 22 nt, Human
gugacagagugagacucugucu

SEQ ID NO: 3192412 - RNA, 20 nt, Human
gugacagagugagacucugu

SEQ ID NO: 3192413 - RNA, 23 nt, Human
gugacagaggcagccccauucug

SEQ ID NO: 3192414 - RNA, 14 nt, Human
gugaauaaugauuu

SEQ ID NO: 3192415 - RNA, 14 nt, Human
gugacaugucuuuu

SEQ ID NO: 3192416 - RNA, 12 nt, Human
gugacaguguug

SEQ ID NO: 3192417 - RNA, 12 nt, Human
gugacuuugaaa

SEQ ID NO: 3192418 - RNA, 16 nt, Human
gugacuucagcucugu

SEQ ID NO: 3192419 - RNA, 19 nt, Human
gugacaugucuuuucuugc

SEQ ID NO: 3192420 - RNA, 22 nt, Human
gugacauguguuggcagccucu

SEQ ID NO: 3192421 - RNA, 19 nt, Human
gugacauuugucauuuuca

SEQ ID NO: 3192422 - RNA, 17 nt, Human
gugacauuugucauuuu

SEQ ID NO: 3192423 - RNA, 16 nt, Human
gugagacucugucuca

SEQ ID NO: 3192424 - RNA, 14 nt, Human
gugagacucugucu

SEQ ID NO: 3192425 - RNA, 16 nt, Human
gugagaccugccccuc

SEQ ID NO: 3192426 - RNA, 23 nt, Human
gugagaccugccccuccucucug

SEQ ID NO: 3192427 - RNA, 22 nt, Human
gugagacccugucucaaaaaaa

SEQ ID NO: 3192428 - RNA, 14 nt, Human
gugagaccugcccc

SEQ ID NO: 3192429 - RNA, 15 nt, Human
gugagaccugccccu

SEQ ID NO: 3192430 - RNA, 13 nt, Human
gugagaccugccc

SEQ ID NO: 3192431 - RNA, 14 nt, Human
gugaggcucugccc

SEQ ID NO: 3192432 - RNA, 15 nt, Human
gugaggcucugcccu

SEQ ID NO: 3192433 - RNA, 16 nt, Human
gugaggcucugcccuu

SEQ ID NO: 3192434 - RNA, 17 nt, Human
gugaggcucugcccuug

SEQ ID NO: 3192435 - RNA, 12 nt, Human
gugaggcucugc

SEQ ID NO: 3192436 - RNA, 13 nt, Human
gugaggcucugcc

SEQ ID NO: 3192437 - RNA, 18 nt, Human
gugagacucugucucaaa

SEQ ID NO: 3192438 - RNA, 19 nt, Human
aacucuccucugcugcugg

SEQ ID NO: 3192439 - RNA, 21 nt, Human
aacucuccucugcugcuggcu

SEQ ID NO: 3192440 - RNA, 21 nt, Human
gugaguacuacaguccuccca

SEQ ID NO: 3192441 - RNA, 17 nt, Human
aacucuccucugcugcu

SEQ ID NO: 3192442 - RNA, 23 nt, Human
gugaguacuacaguccucccauc

SEQ ID NO: 3192443 - RNA, 17 nt, Human
gugagucaccaagccca

SEQ ID NO: 3192444 - RNA, 18 nt, Human
gugaggcucugcccuugg

SEQ ID NO: 3192445 - RNA, 22 nt, Human
aacucuccucugcugcuggcug

SEQ ID NO: 3192446 - RNA, 23 nt, Human
aacucuccucugcugcuggcugg

SEQ ID NO: 3192447 - RNA, 23 nt, Human
aacucugaauuuaucuuugauaa

SEQ ID NO: 3192448 - RNA, 22 nt, Human
aacucugaauuuaucuuugaua

SEQ ID NO: 3192449 - RNA, 21 nt, Human
aacucugaauuuaucuuugau

SEQ ID NO: 3192450 - RNA, 19 nt, Human
aacucugaauuuaucuuug

SEQ ID NO: 3192451 - RNA, 16 nt, Human
aacucugaauuuaucu

SEQ ID NO: 3192452 - RNA, 18 nt, Human
aacucugaauaagcacuu

SEQ ID NO: 3192453 - RNA, 15 nt, Human
aacucugaauaagca

SEQ ID NO: 3192454 - RNA, 12 nt, Human
aacucugaauaa

SEQ ID NO: 3192455 - RNA, 21 nt, Human
aacucuugacagcuauaauua

SEQ ID NO: 3192456 - RNA, 13 nt, Human
aacucuuuaacuu

SEQ ID NO: 3192457 - RNA, 11 nt, Human
aacucuuuaac

SEQ ID NO: 3192458 - RNA, 16 nt, Human
aacucuucucauuacu

SEQ ID NO: 3192459 - RNA, 17 nt, Human
aacucuucucauuacuu

SEQ ID NO: 3192460 - RNA, 13 nt, Human
aacucuucucauu

SEQ ID NO: 3192461 - RNA, 12 nt, Human
aacucuuccucc

SEQ ID NO: 3192462 - RNA, 11 nt, Human
aacucuuccuc

SEQ ID NO: 3192463 - RNA, 20 nt, Human
aacugauuuuuuuuuccuuc

SEQ ID NO: 3192464 - RNA, 21 nt, Human
aacugauuuuuuuuuccuuca

SEQ ID NO: 3192465 - RNA, 23 nt, Human
aacucuuuuaucuccugaaaaaa

SEQ ID NO: 3192466 - RNA, 22 nt, Human
aacugauuuuuuuuuccuucag

SEQ ID NO: 3192467 - RNA, 23 nt, Human
aacugauuuuuuuuuccuucagu

SEQ ID NO: 3192468 - RNA, 16 nt, Human
aacugcauuggcuuug

SEQ ID NO: 3192469 - RNA, 22 nt, Human
gucuuuccacuccuccuagcca

SEQ ID NO: 3192470 - RNA, 21 nt, Human
gucuuuccaaauuauuucuua

SEQ ID NO: 3192471 - RNA, 22 nt, Human
gucuuuccaaauuauuucuuaa

SEQ ID NO: 3192472 - RNA, 22 nt, Human
gucuuguuuuuuuuuuccacuu

SEQ ID NO: 3192473 - RNA, 19 nt, Human
gucuuuaaaaacuguuuua

SEQ ID NO: 3192474 - RNA, 21 nt, Human
gucuuauauuuacaacacuuu

SEQ ID NO: 3192475 - RNA, 17 nt, Human
gucuuaauggaugaaau

SEQ ID NO: 3192476 - RNA, 23 nt, Human
gucuuauuaaaacacuucauuga

SEQ ID NO: 3192477 - RNA, 21 nt, Human
gucuuaugcuuccagaaacac

SEQ ID NO: 3192478 - RNA, 15 nt, Human
gucuuaugcuuccag

SEQ ID NO: 3192479 - RNA, 14 nt, Human
gucuuaugcuucca

SEQ ID NO: 3192480 - RNA, 14 nt, Human
gucuuaauuaaaag

SEQ ID NO: 3192481 - RNA, 16 nt, Human
gucuggaaugcagugg

SEQ ID NO: 3192482 - RNA, 15 nt, Human
gucuggaaugcagug

SEQ ID NO: 3192483 - RNA, 21 nt, Human
gucuuaaaaaguggaaaaaua

SEQ ID NO: 3192484 - RNA, 14 nt, Human
gucugacaggcaau

SEQ ID NO: 3192485 - RNA, 13 nt, Human
gucugacaggcaa

SEQ ID NO: 3192486 - RNA, 12 nt, Human
gucugacaggca

SEQ ID NO: 3192487 - RNA, 18 nt, Human
gucugacaggcaaugcug

SEQ ID NO: 3192488 - RNA, 15 nt, Human
gucugacaggcaaug

SEQ ID NO: 3192489 - RNA, 20 nt, Human
gucugacaggcaaugcuggc

SEQ ID NO: 3192490 - RNA, 23 nt, Human
gucugacaagguggucaacaaca

SEQ ID NO: 3192491 - RNA, 23 nt, Human
gucucuuuaaugucacaggcagg

SEQ ID NO: 3192492 - RNA, 17 nt, Human
gucucaaaaaaagaaaa

SEQ ID NO: 3192493 - RNA, 14 nt, Human
gucucaaaaaaaca

SEQ ID NO: 3192494 - RNA, 22 nt, Human
gucuauuucaucagaacagcug

SEQ ID NO: 3192495 - RNA, 20 nt, Human
gucuauuucaucagaacagc

SEQ ID NO: 3192496 - RNA, 15 nt, Human
gucugaaacauuuca

SEQ ID NO: 3192497 - RNA, 16 nt, Human
gucugaaacauuucau

SEQ ID NO: 3192498 - RNA, 17 nt, Human
gucugaaacauuucaua

SEQ ID NO: 3192499 - RNA, 18 nt, Human
gucucuuuuuuacaaagg

SEQ ID NO: 3192500 - RNA, 16 nt, Human
gucucuuuuuuacaaa

SEQ ID NO: 3192501 - RNA, 20 nt, Human
gucucuuuuuuacaaaggcu

SEQ ID NO: 3192502 - RNA, 15 nt, Human
gucucuuuuuuacaa

SEQ ID NO: 3192503 - RNA, 20 nt, Human
gucuauuuggauuauucuuu

SEQ ID NO: 3192504 - RNA, 17 nt, Human
aacuagggaagauaaua

SEQ ID NO: 3192505 - RNA, 17 nt, Human
aacuaaaauaauuuugu

SEQ ID NO: 3192506 - RNA, 19 nt, Human
aacuaaaauaauuuuguaa

SEQ ID NO: 3192507 - RNA, 12 nt, Human
aacuaaaaugua

SEQ ID NO: 3192508 - RNA, 13 nt, Human
aacuaaaauguau

SEQ ID NO: 3192509 - RNA, 15 nt, Human
aacuaaaauaauuuu

SEQ ID NO: 3192510 - RNA, 12 nt, Human
aacguggcugcu

SEQ ID NO: 3192511 - RNA, 13 nt, Human
aacguggcugcuu

SEQ ID NO: 3192512 - RNA, 20 nt, Human
aacguuugguucaaaugugu

SEQ ID NO: 3192513 - RNA, 19 nt, Human
aacuauguguuuuucucau

SEQ ID NO: 3192514 - RNA, 20 nt, Human
aacuauguguuuuucucaua

SEQ ID NO: 3192515 - RNA, 22 nt, Human
aacuauguguuuuucucauauu

SEQ ID NO: 3192516 - RNA, 23 nt, Human
aacuaguuuuuccuaucauguua

SEQ ID NO: 3192517 - RNA, 22 nt, Human
aacuaggucugauauucaaaug

SEQ ID NO: 3192518 - RNA, 16 nt, Human
aacuaaacuaguuuuu

SEQ ID NO: 3192519 - RNA, 19 nt, Human
aacuaaacuaguuuuuccu

SEQ ID NO: 3192520 - RNA, 15 nt, Human
aacuaggcuccuuca

SEQ ID NO: 3192521 - RNA, 16 nt, Human
aacuccaacauccacu

SEQ ID NO: 3192522 - RNA, 24 nt, Human
aacucauuuuuguuuucauuaucu

SEQ ID NO: 3192523 - RNA, 21 nt, Human
aacucauuuuuguuuucauua

SEQ ID NO: 3192524 - RNA, 18 nt, Human
aacuauguuuaaaguaau

SEQ ID NO: 3192525 - RNA, 17 nt, Human
aacuauguuuaaaguaa

SEQ ID NO: 3192526 - RNA, 15 nt, Human
aacuauguugauaaa

SEQ ID NO: 3192527 - RNA, 13 nt, Human
aacgucugugcca

SEQ ID NO: 3192528 - RNA, 21 nt, Human
aaccuucgccaccuggguucc

SEQ ID NO: 3192529 - RNA, 12 nt, Human
aacgugaaaaug

SEQ ID NO: 3192530 - RNA, 23 nt, Human
aacgugaugugcucaucagaaac

SEQ ID NO: 3192531 - RNA, 20 nt, Human
aacguggagaaucacaggcu

SEQ ID NO: 3192532 - RNA, 21 nt, Human
aaccugggaaagagauuuaaa

SEQ ID NO: 3192533 - RNA, 16 nt, Human
aaccugggaaagagau

SEQ ID NO: 3192534 - RNA, 16 nt, Human
gucuuucuugcucccu

SEQ ID NO: 3192535 - RNA, 15 nt, Human
gucuuucuucuucaa

SEQ ID NO: 3192536 - RNA, 19 nt, Human
gucuuucugggguuuuucu

SEQ ID NO: 3192537 - RNA, 12 nt, Human
gucuuucugggg

SEQ ID NO: 3192538 - RNA, 19 nt, Human
gucuuucuaagaaaucaag

SEQ ID NO: 3192539 - RNA, 10 nt, Human
gucuuuccca

SEQ ID NO: 3192540 - RNA, 22 nt, Human
guccccuguuuguuucugaaag

SEQ ID NO: 3192541 - RNA, 18 nt, Human
guccccuguuuguuucug

SEQ ID NO: 3192542 - RNA, 22 nt, Human
guccccagcccuuccucugcuc

SEQ ID NO: 3192543 - RNA, 23 nt, Human
guccccagaacucugccugcccu

SEQ ID NO: 3192544 - RNA, 19 nt, Human
gucccugguggcagcucac

SEQ ID NO: 3192545 - RNA, 18 nt, Human
gucccugguggcagcuca

SEQ ID NO: 3192546 - RNA, 18 nt, Human
gucccuuacgugaguccu

SEQ ID NO: 3192547 - RNA, 19 nt, Human
gucccuuacgugaguccug

SEQ ID NO: 3192548 - RNA, 22 nt, Human
guccccagacuccaccaagccu

SEQ ID NO: 3192549 - RNA, 22 nt, Human
guccccaccgcagacaggacca

SEQ ID NO: 3192550 - RNA, 18 nt, Human
guccccaccgcagacagg

SEQ ID NO: 3192551 - RNA, 17 nt, Human
guccccaccgcagacag

SEQ ID NO: 3192552 - RNA, 18 nt, Human
gucccaagguucugggug

SEQ ID NO: 3192553 - RNA, 17 nt, Human
gucccaagguucugggu

SEQ ID NO: 3192554 - RNA, 15 nt, Human
gucccaccccacaca

SEQ ID NO: 3192555 - RNA, 22 nt, Human
guccaugaagauguagaggaga

SEQ ID NO: 3192556 - RNA, 12 nt, Human
gucauuucugau

SEQ ID NO: 3192557 - RNA, 21 nt, Human
aacacucacauuuauucugcu

SEQ ID NO: 3192558 - RNA, 12 nt, Human
aacacucagcug

SEQ ID NO: 3192559 - RNA, 13 nt, Human
aacacucagcugu

SEQ ID NO: 3192560 - RNA, 14 nt, Human
aacacucagcuguu

SEQ ID NO: 3192561 - RNA, 19 nt, Human
aacacuguucucugcccuc

SEQ ID NO: 3192562 - RNA, 17 nt, Human
gucauuugagcagggcu

SEQ ID NO: 3192563 - RNA, 11 nt, Human
gucauuuccau

SEQ ID NO: 3192564 - RNA, 13 nt, Human
gucauuucauguc

SEQ ID NO: 3192565 - RNA, 22 nt, Human
gucauuuccauguaugcauaau

SEQ ID NO: 3192566 - RNA, 21 nt, Human
gucauuuccauguaugcauaa

SEQ ID NO: 3192567 - RNA, 18 nt, Human
gucauuuccauguaugca

SEQ ID NO: 3192568 - RNA, 12 nt, Human
gucauuuccaug

SEQ ID NO: 3192569 - RNA, 17 nt, Human
aacacuguucucugccc

SEQ ID NO: 3192570 - RNA, 18 nt, Human
aacacuguucucugcccu

SEQ ID NO: 3192571 - RNA, 16 nt, Human
aacacuguucucugcc

SEQ ID NO: 3192572 - RNA, 20 nt, Human
aacacagcaagggugauggg

SEQ ID NO: 3192573 - RNA, 18 nt, Human
aacacagcaagggugaug

SEQ ID NO: 3192574 - RNA, 22 nt, Human
aacacacagaaggggacugcca

SEQ ID NO: 3192575 - RNA, 19 nt, Human
aacacaaacgggcucagca

SEQ ID NO: 3192576 - RNA, 23 nt, Human
aaauuugaaacauugcuuuuaaa

SEQ ID NO: 3192577 - RNA, 20 nt, Human
aaauuugaaacauugcuuuu

SEQ ID NO: 3192578 - RNA, 16 nt, Human
aaauuugaaacauugc

SEQ ID NO: 3192579 - RNA, 15 nt, Human
aaauuugaaacauug

SEQ ID NO: 3192580 - RNA, 14 nt, Human
aaauuugaaacauu

SEQ ID NO: 3192581 - RNA, 13 nt, Human
aaauuugaaacau

SEQ ID NO: 3192582 - RNA, 12 nt, Human
aaauuucucugu

SEQ ID NO: 3192583 - RNA, 12 nt, Human
gucgccucugca

SEQ ID NO: 3192584 - RNA, 21 nt, Human
gucgccuuucagcaggcagcc

SEQ ID NO: 3192585 - RNA, 20 nt, Human
gucgccuuucagcaggcagc

SEQ ID NO: 3192586 - RNA, 14 nt, Human
gucuaccugagggg

SEQ ID NO: 3192587 - RNA, 13 nt, Human
gucuaccugaggg

SEQ ID NO: 3192588 - RNA, 15 nt, Human
gucuaccugaggggc

SEQ ID NO: 3192589 - RNA, 16 nt, Human
gucuaccugaggggcc

SEQ ID NO: 3192590 - RNA, 22 nt, Human
gucuaugggacucaaugcacug

SEQ ID NO: 3192591 - RNA, 15 nt, Human
gucuaugggacucaa

SEQ ID NO: 3192592 - RNA, 11 nt, Human
gucuauugucu

SEQ ID NO: 3192593 - RNA, 20 nt, Human
gucuagauuaauacucuauu

SEQ ID NO: 3192594 - RNA, 21 nt, Human
gucuagcguagugcagcaggg

SEQ ID NO: 3192595 - RNA, 22 nt, Human
gucuagcuaugcuguaucugug

SEQ ID NO: 3192596 - RNA, 16 nt, Human
gucgaggacagggagg

SEQ ID NO: 3192597 - RNA, 12 nt, Human
gucgaggcagga

SEQ ID NO: 3192598 - RNA, 19 nt, Human
guccugcugcaguugccag

SEQ ID NO: 3192599 - RNA, 17 nt, Human
guccugcugcaguugcc

SEQ ID NO: 3192600 - RNA, 16 nt, Human
guccuggcaugggaau

SEQ ID NO: 3192601 - RNA, 14 nt, Human
guccucuuuucuga

SEQ ID NO: 3192602 - RNA, 23 nt, Human
aacauguaauuaaguacuaugua

SEQ ID NO: 3192603 - RNA, 17 nt, Human
aacaugugaaaagaaua

SEQ ID NO: 3192604 - RNA, 16 nt, Human
aacauuccucaaaaug

SEQ ID NO: 3192605 - RNA, 18 nt, Human
aacauucaugcucauugc

SEQ ID NO: 3192606 - RNA, 17 nt, Human
aacauuauuacuuuucc

SEQ ID NO: 3192607 - RNA, 20 nt, Human
aacauuauuacuuuuccucu

SEQ ID NO: 3192608 - RNA, 24 nt, Human
aacauuggaagcagguuaaauguu

SEQ ID NO: 3192609 - RNA, 22 nt, Human
aacauugcauauaacuuauauu

SEQ ID NO: 3192610 - RNA, 19 nt, Human
aacauucuaucuacugauu

SEQ ID NO: 3192611 - RNA, 23 nt, Human
aacauuggaagcagguuaaaugu

SEQ ID NO: 3192612 - RNA, 22 nt, Human
aacauuggaagcagguuaaaug

SEQ ID NO: 3192613 - RNA, 16 nt, Human
aacauuggaagcaggu

SEQ ID NO: 3192614 - RNA, 12 nt, Human
aacauuggaagc

SEQ ID NO: 3192615 - RNA, 19 nt, Human
aacauugcuuuuaaaacua

SEQ ID NO: 3192616 - RNA, 17 nt, Human
aacauugcuuuuaaaac

SEQ ID NO: 3192617 - RNA, 15 nt, Human
aacauugcuuuuaaa

SEQ ID NO: 3192618 - RNA, 14 nt, Human
aacauugcuuuuaa

SEQ ID NO: 3192619 - RNA, 17 nt, Human
guccuccugcugccagu

SEQ ID NO: 3192620 - RNA, 16 nt, Human
guccuccugcugccag

SEQ ID NO: 3192621 - RNA, 15 nt, Human
guccuccugcugcca

SEQ ID NO: 3192622 - RNA, 14 nt, Human
guccuccugcugcc

SEQ ID NO: 3192623 - RNA, 17 nt, Human
aacauagccaaaaugug

SEQ ID NO: 3192624 - RNA, 21 nt, Human
aacauagcagaucuguuuugu

SEQ ID NO: 3192625 - RNA, 14 nt, Human
aacauaaaauacaa

SEQ ID NO: 3192626 - RNA, 13 nt, Human
aacagucucagga

SEQ ID NO: 3192627 - RNA, 17 nt, Human
guccgguuuacuuuaac

SEQ ID NO: 3192628 - RNA, 22 nt, Human
guccguaguaucagagaugucc

SEQ ID NO: 3192629 - RNA, 15 nt, Human
guccgguuuacuuua

SEQ ID NO: 3192630 - RNA, 20 nt, Human
gucccuugaacuacugggug

SEQ ID NO: 3192631 - RNA, 21 nt, Human
guccggucccugucccagugc

SEQ ID NO: 3192632 - RNA, 18 nt, Human
aaaucaugccaguauuuu

SEQ ID NO: 3192633 - RNA, 19 nt, Human
aaaucauauuuggaauaaa

SEQ ID NO: 3192634 - RNA, 19 nt, Human
guauucuaauaagcuaguu

SEQ ID NO: 3192635 - RNA, 22 nt, Human
guauucuaauaagcuaguugaa

SEQ ID NO: 3192636 - RNA, 14 nt, Human
guauucucauucuu

SEQ ID NO: 3192637 - RNA, 17 nt, Human
guauuguaggugguguu

SEQ ID NO: 3192638 - RNA, 10 nt, Human
guauuguaca

SEQ ID NO: 3192639 - RNA, 13 nt, Human
guauuguccuauu

SEQ ID NO: 3192640 - RNA, 21 nt, Human
guauuguccuauuaguguuau

SEQ ID NO: 3192641 - RNA, 11 nt, Human
guauucuuuuu

SEQ ID NO: 3192642 - RNA, 21 nt, Human
guauuuauaagaaaaauguga

SEQ ID NO: 3192643 - RNA, 22 nt, Human
guauuuauggguggauuuaucc

SEQ ID NO: 3192644 - RNA, 13 nt, Human
aaauguaguucau

SEQ ID NO: 3192645 - RNA, 16 nt, Human
guauuguuagauguuu

SEQ ID NO: 3192646 - RNA, 17 nt, Human
guauuguuagauguuug

SEQ ID NO: 3192647 - RNA, 21 nt, Human
aaaugucucuuuaaugucaca

SEQ ID NO: 3192648 - RNA, 14 nt, Human
aaaugucuuccugg

SEQ ID NO: 3192649 - RNA, 24 nt, Human
aaaugucuaguuguaacaccauga

SEQ ID NO: 3192650 - RNA, 15 nt, Human
aaauguaucuaagaa

SEQ ID NO: 3192651 - RNA, 20 nt, Human
aaauguaucuaagaauaaua

SEQ ID NO: 3192652 - RNA, 16 nt, Human
aaauucacaaaguuaa

SEQ ID NO: 3192653 - RNA, 19 nt, Human
aaauucccaaccugcucau

SEQ ID NO: 3192654 - RNA, 13 nt, Human
aaauuccagaaug

SEQ ID NO: 3192655 - RNA, 14 nt, Human
aaauucuagauuac

SEQ ID NO: 3192656 - RNA, 18 nt, Human
aaauuuaaaaagcccaac

SEQ ID NO: 3192657 - RNA, 17 nt, Human
aaauuuaaaaguaaaau

SEQ ID NO: 3192658 - RNA, 18 nt, Human
aaauuuaaaaguaaaaug

SEQ ID NO: 3192659 - RNA, 19 nt, Human
aaauuuaaaaguaaaaugu

SEQ ID NO: 3192660 - RNA, 22 nt, Human
aaauuuaaaaguaaaaugucuu

SEQ ID NO: 3192661 - RNA, 18 nt, Human
aaauugucagaugcugug

SEQ ID NO: 3192662 - RNA, 19 nt, Human
aaauugucaccugcuucuc

SEQ ID NO: 3192663 - RNA, 18 nt, Human
aaauuguaucucauuacu

SEQ ID NO: 3192664 - RNA, 21 nt, Human
aaauuaugugaccauaaugua

SEQ ID NO: 3192665 - RNA, 14 nt, Human
aaauucaaagcaug

SEQ ID NO: 3192666 - RNA, 21 nt, Human
aaauucaaagcauggacauuu

SEQ ID NO: 3192667 - RNA, 17 nt, Human
aaauucaauaguaauau

SEQ ID NO: 3192668 - RNA, 14 nt, Human
aaauucaauaguaa

SEQ ID NO: 3192669 - RNA, 14 nt, Human
aaauuaugguaaaa

SEQ ID NO: 3192670 - RNA, 21 nt, Human
aaauuaugcuaagaauuuuuu

SEQ ID NO: 3192671 - RNA, 17 nt, Human
aaauuaugcuaagaauu

SEQ ID NO: 3192672 - RNA, 19 nt, Human
aaauuaggauuucaugauu

SEQ ID NO: 3192673 - RNA, 18 nt, Human
aaauuaggauuucaugau

SEQ ID NO: 3192674 - RNA, 15 nt, Human
aaaugugcuuuuaaa

SEQ ID NO: 3192675 - RNA, 18 nt, Human
aaaugugccuucauuuuu

SEQ ID NO: 3192676 - RNA, 14 nt, Human
aaauuaaucugggc

SEQ ID NO: 3192677 - RNA, 15 nt, Human
aaauguggcuccugg

SEQ ID NO: 3192678 - RNA, 14 nt, Human
aaauuaauaucuuu

SEQ ID NO: 3192679 - RNA, 17 nt, Human
aaauuaauaucuuucug

SEQ ID NO: 3192680 - RNA, 13 nt, Human
aaauuaauugugu

SEQ ID NO: 3192681 - RNA, 22 nt, Human
aaauuagccuaagauauacuug

SEQ ID NO: 3192682 - RNA, 21 nt, Human
aaauuagccuaagauauacuu

SEQ ID NO: 3192683 - RNA, 20 nt, Human
aaauuagccuaagauauacu

SEQ ID NO: 3192684 - RNA, 19 nt, Human
aaauuagccuaagauauac

SEQ ID NO: 3192685 - RNA, 18 nt, Human
aaauuacauuuguaauuu

SEQ ID NO: 3192686 - RNA, 16 nt, Human
aaauuacauuuguaau

SEQ ID NO: 3192687 - RNA, 15 nt, Human
aaauuacauuuguaa

SEQ ID NO: 3192688 - RNA, 13 nt, Human
aaauuacauuugu

SEQ ID NO: 3192689 - RNA, 23 nt, Human
aaauuacauuuguaauuuaaggu

SEQ ID NO: 3192690 - RNA, 20 nt, Human
aaauuacauuuguaauuuaa

SEQ ID NO: 3192691 - RNA, 14 nt, Human
aaauuacauauacu

SEQ ID NO: 3192692 - RNA, 12 nt, Human
aaauuacauuug

SEQ ID NO: 3192693 - RNA, 13 nt, Human
aaauuacauuucg

SEQ ID NO: 3192694 - RNA, 18 nt, Human
aaauuaauugugugaacu

SEQ ID NO: 3192695 - RNA, 15 nt, Human
aaauuaauuguguga

SEQ ID NO: 3192696 - RNA, 16 nt, Human
aaauuaauugugugaa

SEQ ID NO: 3192697 - RNA, 13 nt, Human
aaauuacaacuaa

SEQ ID NO: 3192698 - RNA, 12 nt, Human
aaauuacaacua

SEQ ID NO: 3192699 - RNA, 20 nt, Human
gucacaggaaguagaggagg

SEQ ID NO: 3192700 - RNA, 18 nt, Human
gucacaggacucugccuc

SEQ ID NO: 3192701 - RNA, 17 nt, Human
gucacaggacucugccu

SEQ ID NO: 3192702 - RNA, 16 nt, Human
gucacaggagggaggg

SEQ ID NO: 3192703 - RNA, 19 nt, Human
gucacaggacucugccucc

SEQ ID NO: 3192704 - RNA, 22 nt, Human
gucaccaaaucagcugcuacua

SEQ ID NO: 3192705 - RNA, 22 nt, Human
gucacaucccaccccauccucc

SEQ ID NO: 3192706 - RNA, 16 nt, Human
gucacaguaaaaauaa

SEQ ID NO: 3192707 - RNA, 20 nt, Human
gucacaguaaaaauaaaaua

SEQ ID NO: 3192708 - RNA, 22 nt, Human
gucacaguaaaaauaaaauacu

SEQ ID NO: 3192709 - RNA, 21 nt, Human
gucaauuuuguuauguauauu

SEQ ID NO: 3192710 - RNA, 13 nt, Human
gucacaggaagua

SEQ ID NO: 3192711 - RNA, 15 nt, Human
gucacaggaaguaga

SEQ ID NO: 3192712 - RNA, 22 nt, Human
gucaauuacaggaaguacugga

SEQ ID NO: 3192713 - RNA, 16 nt, Human
gucaauuacaggaagu

SEQ ID NO: 3192714 - RNA, 23 nt, Human
gucacugcacagugcaucucagc

SEQ ID NO: 3192715 - RNA, 20 nt, Human
gucacugcacagugcaucuc

SEQ ID NO: 3192716 - RNA, 17 nt, Human
gucacugagacagcccg

SEQ ID NO: 3192717 - RNA, 18 nt, Human
gucacugagacagcccgg

SEQ ID NO: 3192718 - RNA, 21 nt, Human
gucacugagacagcccgggcu

SEQ ID NO: 3192719 - RNA, 23 nt, Human
gucacugagacagcccgggcucu

SEQ ID NO: 3192720 - RNA, 22 nt, Human
gucacucuggcagcucagagag

SEQ ID NO: 3192721 - RNA, 14 nt, Human
gucacugagacagc

SEQ ID NO: 3192722 - RNA, 15 nt, Human
gucacugagacagcc

SEQ ID NO: 3192723 - RNA, 16 nt, Human
gucacugagacagccc

SEQ ID NO: 3192724 - RNA, 23 nt, Human
gucacucuggcagcucagagagg

SEQ ID NO: 3192725 - RNA, 22 nt, Human
gucaccaaauagugugaaauau

SEQ ID NO: 3192726 - RNA, 15 nt, Human
gucaccaagcccagu

SEQ ID NO: 3192727 - RNA, 12 nt, Human
gucaccaagccc

SEQ ID NO: 3192728 - RNA, 11 nt, Human
gucacuuuuag

SEQ ID NO: 3192729 - RNA, 15 nt, Human
gucagaaacuaaaac

SEQ ID NO: 3192730 - RNA, 17 nt, Human
gucacuuuguuuuacug

SEQ ID NO: 3192731 - RNA, 19 nt, Human
gucacuucuucuguccaag

SEQ ID NO: 3192732 - RNA, 13 nt, Human
gucacuucuucug

SEQ ID NO: 3192733 - RNA, 17 nt, Human
gucacuucuucugucca

SEQ ID NO: 3192734 - RNA, 14 nt, Human
gucacuucuucugu

SEQ ID NO: 3192735 - RNA, 21 nt, Human
gucagaaguuucugccgcagc

SEQ ID NO: 3192736 - RNA, 22 nt, Human
gucagaagagagggugaguccu

SEQ ID NO: 3192737 - RNA, 22 nt, Human
gucacugcugcuucauguuugc

SEQ ID NO: 3192738 - RNA, 22 nt, Human
gucacuggggcccaagagucug

SEQ ID NO: 3192739 - RNA, 17 nt, Human
gucacuggggcccaaga

SEQ ID NO: 3192740 - RNA, 16 nt, Human
gucaguguagaucaac

SEQ ID NO: 3192741 - RNA, 23 nt, Human
gucagucgccuuucagcaggcag

SEQ ID NO: 3192742 - RNA, 14 nt, Human
gucagucgccuuuc

SEQ ID NO: 3192743 - RNA, 21 nt, Human
gucaguccaagggguccccuc

SEQ ID NO: 3192744 - RNA, 15 nt, Human
gucagggugagccca

SEQ ID NO: 3192745 - RNA, 18 nt, Human
gucagguugacaggaggu

SEQ ID NO: 3192746 - RNA, 13 nt, Human
gucagguugacag

SEQ ID NO: 3192747 - RNA, 22 nt, Human
gucagguggggcagcuugaggg

SEQ ID NO: 3192748 - RNA, 18 nt, Human
gucagguggggcagcuug

SEQ ID NO: 3192749 - RNA, 17 nt, Human
gucagguggggcagcuu

SEQ ID NO: 3192750 - RNA, 16 nt, Human
gucagguggggcagcu

SEQ ID NO: 3192751 - RNA, 17 nt, Human
gucaggaggcagaagga

SEQ ID NO: 3192752 - RNA, 15 nt, Human
gucaggaggcagaag

SEQ ID NO: 3192753 - RNA, 21 nt, Human
caaccgggaugggagccgggc

SEQ ID NO: 3192754 - RNA, 14 nt, Human
caaccuccugggcu

SEQ ID NO: 3192755 - RNA, 15 nt, Human
caaccuccugggcua

SEQ ID NO: 3192756 - RNA, 13 nt, Human
caaccucgcucca

SEQ ID NO: 3192757 - RNA, 17 nt, Human
caaccucgcuccaacuc

SEQ ID NO: 3192758 - RNA, 16 nt, Human
caaccucgcuccaacu

SEQ ID NO: 3192759 - RNA, 20 nt, Human
caaccucuaccuccuggguu

SEQ ID NO: 3192760 - RNA, 21 nt, Human
caaccucgcuccaacuccaac

SEQ ID NO: 3192761 - RNA, 20 nt, Human
caaccucgcuccaacuccaa

SEQ ID NO: 3192762 - RNA, 19 nt, Human
caaccucuagaauuuuaag

SEQ ID NO: 3192763 - RNA, 13 nt, Human
caacgucugugcc

SEQ ID NO: 3192764 - RNA, 14 nt, Human
caacgucugugcca

SEQ ID NO: 3192765 - RNA, 17 nt, Human
caacugaccagccucca

SEQ ID NO: 3192766 - RNA, 15 nt, Human
caacugaccagccuc

SEQ ID NO: 3192767 - RNA, 20 nt, Human
caaccuguucugcuuuccuc

SEQ ID NO: 3192768 - RNA, 19 nt, Human
caaccuucgccaccugggu

SEQ ID NO: 3192769 - RNA, 14 nt, Human
caaccuucaagcug

SEQ ID NO: 3192770 - RNA, 13 nt, Human
caaccuucauuua

SEQ ID NO: 3192771 - RNA, 14 nt, Human
caacggcagugaag

SEQ ID NO: 3192772 - RNA, 22 nt, Human
caaccccuucgcuccugugucu

SEQ ID NO: 3192773 - RNA, 20 nt, Human
caacacucauugaccugagg

SEQ ID NO: 3192774 - RNA, 22 nt, Human
caacacucauugaccugaggcc

SEQ ID NO: 3192775 - RNA, 18 nt, Human
caacacucauugaccuga

SEQ ID NO: 3192776 - RNA, 22 nt, Human
caacacucacauuuauucugcu

SEQ ID NO: 3192777 - RNA, 13 nt, Human
caacccucagagc

SEQ ID NO: 3192778 - RNA, 17 nt, Human
caacccuggcacccagg

SEQ ID NO: 3192779 - RNA, 16 nt, Human
caagaggcugcagcca

SEQ ID NO: 3192780 - RNA, 14 nt, Human
caagaggcugcagc

SEQ ID NO: 3192781 - RNA, 16 nt, Human
caagagcccaggccuc

SEQ ID NO: 3192782 - RNA, 13 nt, Human
caagagggcacug

SEQ ID NO: 3192783 - RNA, 17 nt, Human
caagcaccuccugccuc

SEQ ID NO: 3192784 - RNA, 16 nt, Human
caagcaccuccugccu

SEQ ID NO: 3192785 - RNA, 15 nt, Human
caagcaccuccugcc

SEQ ID NO: 3192786 - RNA, 15 nt, Human
caagagggcacuggu

SEQ ID NO: 3192787 - RNA, 14 nt, Human
caagagggcacugg

SEQ ID NO: 3192788 - RNA, 18 nt, Human
caagacucuuuggacacu

SEQ ID NO: 3192789 - RNA, 13 nt, Human
caagagcccaggc

SEQ ID NO: 3192790 - RNA, 14 nt, Human
caagagcccaggcc

SEQ ID NO: 3192791 - RNA, 15 nt, Human
caagagcccaggccu

SEQ ID NO: 3192792 - RNA, 23 nt, Human
caagacgcugugcugcccugccc

SEQ ID NO: 3192793 - RNA, 15 nt, Human
caagacgcugugcug

SEQ ID NO: 3192794 - RNA, 18 nt, Human
caagacgcugugcugccc

SEQ ID NO: 3192795 - RNA, 17 nt, Human
caagaagaauuugaaga

SEQ ID NO: 3192796 - RNA, 16 nt, Human
caacuuuuuuuuuccc

SEQ ID NO: 3192797 - RNA, 17 nt, Human
caacuuuuuuuucuuuu

SEQ ID NO: 3192798 - RNA, 20 nt, Human
caagaacacagcccugcuuc

SEQ ID NO: 3192799 - RNA, 19 nt, Human
caacugaccagccuccaug

SEQ ID NO: 3192800 - RNA, 15 nt, Human
caacuuuuuuuucuu

SEQ ID NO: 3192801 - RNA, 17 nt, Human
caagaccuucuccuuca

SEQ ID NO: 3192802 - RNA, 18 nt, Human
caagaccuucuccuucac

SEQ ID NO: 3192803 - RNA, 16 nt, Human
caagacgcugugcugc

SEQ ID NO: 3192804 - RNA, 17 nt, Human
caagacgcugugcugcc

SEQ ID NO: 3192805 - RNA, 14 nt, Human
caagaccuucuccu

SEQ ID NO: 3192806 - RNA, 16 nt, Human
caagaccuucuccuuc

SEQ ID NO: 3192807 - RNA, 20 nt, Human
caagaacuuuccaggaaggc

SEQ ID NO: 3192808 - RNA, 13 nt, Human
caagaacuuguuu

SEQ ID NO: 3192809 - RNA, 17 nt, Human
caagaacuuguuuaaua

SEQ ID NO: 3192810 - RNA, 15 nt, Human
caagaacuuguuuaa

SEQ ID NO: 3192811 - RNA, 14 nt, Human
caagaacuuguuua

SEQ ID NO: 3192812 - RNA, 17 nt, Human
caagccguggcuucccg

SEQ ID NO: 3192813 - RNA, 22 nt, Human
caagccaccaacauacucccau

SEQ ID NO: 3192814 - RNA, 21 nt, Human
caagccaccagaugugacagu

SEQ ID NO: 3192815 - RNA, 14 nt, Human
caagcaccuccugc

SEQ ID NO: 3192816 - RNA, 14 nt, Human
caagcaggacaugg

SEQ ID NO: 3192817 - RNA, 18 nt, Human
caagcaggacauggacaa

SEQ ID NO: 3192818 - RNA, 12 nt, Human
caagcaggaggc

SEQ ID NO: 3192819 - RNA, 13 nt, Human
caagcaggaggcu

SEQ ID NO: 3192820 - RNA, 19 nt, Human
caagcgauucuucugcuuc

SEQ ID NO: 3192821 - RNA, 18 nt, Human
caagccguggcuucccgc

SEQ ID NO: 3192822 - RNA, 12 nt, Human
caagccagcaag

SEQ ID NO: 3192823 - RNA, 22 nt, Human
caagcgauucuucugcuucagc

SEQ ID NO: 3192824 - RNA, 20 nt, Human
caagcgauucuucugcuuca

SEQ ID NO: 3192825 - RNA, 14 nt, Human
caagcgcccuggcc

SEQ ID NO: 3192826 - RNA, 15 nt, Human
caagccuggaaaaaa

SEQ ID NO: 3192827 - RNA, 14 nt, Human
caagccuggcaagg

SEQ ID NO: 3192828 - RNA, 17 nt, Human
caagcuggcuuacacug

SEQ ID NO: 3192829 - RNA, 16 nt, Human
caagcgcccuggcccc

SEQ ID NO: 3192830 - RNA, 15 nt, Human
caagcgcccuggccc

SEQ ID NO: 3192831 - RNA, 17 nt, Human
caaggcugauuaaacca

SEQ ID NO: 3192832 - RNA, 22 nt, Human
caaggacugcagggacugccag

SEQ ID NO: 3192833 - RNA, 21 nt, Human
caaggacagaaggcuccugcc

SEQ ID NO: 3192834 - RNA, 14 nt, Human
caaggagccaaaca

SEQ ID NO: 3192835 - RNA, 18 nt, Human
caaggacagaaggcuccu

SEQ ID NO: 3192836 - RNA, 15 nt, Human
caaggacugcaggga

SEQ ID NO: 3192837 - RNA, 17 nt, Human
caaggaagggauguauu

SEQ ID NO: 3192838 - RNA, 18 nt, Human
caaggaagggauguauuu

SEQ ID NO: 3192839 - RNA, 20 nt, Human
caaggaagggauguauuugu

SEQ ID NO: 3192840 - RNA, 19 nt, Human
caagcuggucccacucagu

SEQ ID NO: 3192841 - RNA, 17 nt, Human
caagcuggucccacuca

SEQ ID NO: 3192842 - RNA, 18 nt, Human
caaggggcccaaauucuu

SEQ ID NO: 3192843 - RNA, 17 nt, Human
caaggggcccaaauucu

SEQ ID NO: 3192844 - RNA, 12 nt, Human
caaggcugcagu

SEQ ID NO: 3192845 - RNA, 23 nt, Human
caaggcugucaauuacaggaagu

SEQ ID NO: 3192846 - RNA, 21 nt, Human
caaggcugucaauuacaggaa

SEQ ID NO: 3192847 - RNA, 22 nt, Human
caaggcugagacagugaauuug

SEQ ID NO: 3192848 - RNA, 14 nt, Human
caaguccucuuuuc

SEQ ID NO: 3192849 - RNA, 20 nt, Human
caagucccuguaauuguugu

SEQ ID NO: 3192850 - RNA, 11 nt, Human
caagucccugu

SEQ ID NO: 3192851 - RNA, 18 nt, Human
caaggguagggugggccu

SEQ ID NO: 3192852 - RNA, 20 nt, Human
caagggguccccuccaggag

SEQ ID NO: 3192853 - RNA, 18 nt, Human
caaguggcauaaagcaua

SEQ ID NO: 3192854 - RNA, 17 nt, Human
caaguggcauaaagcau

SEQ ID NO: 3192855 - RNA, 19 nt, Human
caaguggcucccacacccu

SEQ ID NO: 3192856 - RNA, 23 nt, Human
caaguggcaaagcuguucuuccu

SEQ ID NO: 3192857 - RNA, 20 nt, Human
caaguggcaaagcuguucuu

SEQ ID NO: 3192858 - RNA, 21 nt, Human
caaguggagccugacagccag

SEQ ID NO: 3192859 - RNA, 18 nt, Human
caaguggagccugacagc

SEQ ID NO: 3192860 - RNA, 14 nt, Human
caaguuaaauaaau

SEQ ID NO: 3192861 - RNA, 14 nt, Human
caagugugaauacu

SEQ ID NO: 3192862 - RNA, 15 nt, Human
caagugugaauacug

SEQ ID NO: 3192863 - RNA, 16 nt, Human
caagugugaauacugc

SEQ ID NO: 3192864 - RNA, 17 nt, Human
caagugagagcugggug

SEQ ID NO: 3192865 - RNA, 15 nt, Human
caagugagagcuggg

SEQ ID NO: 3192866 - RNA, 14 nt, Human
caagugagagcugg

SEQ ID NO: 3192867 - RNA, 21 nt, Human
caaguccucuuuucugagagg

SEQ ID NO: 3192868 - RNA, 19 nt, Human
caagugagacccugucuca

SEQ ID NO: 3192869 - RNA, 18 nt, Human
caagugagagcugggugu

SEQ ID NO: 3192870 - RNA, 17 nt, Human
caagugauucucaugcc

SEQ ID NO: 3192871 - RNA, 18 nt, Human
caagugauucucaugccu

SEQ ID NO: 3192872 - RNA, 20 nt, Human
caagugauucucaugccuca

SEQ ID NO: 3192873 - RNA, 19 nt, Human
caauguagaggggaaaaga

SEQ ID NO: 3192874 - RNA, 22 nt, Human
caaugugacuuaaugccacuaa

SEQ ID NO: 3192875 - RNA, 18 nt, Human
caaugucaaugaacaagc

SEQ ID NO: 3192876 - RNA, 23 nt, Human
caauggugaacugucauuacaga

SEQ ID NO: 3192877 - RNA, 14 nt, Human
caaugguaguuucu

SEQ ID NO: 3192878 - RNA, 16 nt, Human
caaugguaguuucugu

SEQ ID NO: 3192879 - RNA, 17 nt, Human
caaugguaguuucugug

SEQ ID NO: 3192880 - RNA, 20 nt, Human
caaugguaguuucugugguu

SEQ ID NO: 3192881 - RNA, 16 nt, Human
caaugguaauuauaaa

SEQ ID NO: 3192882 - RNA, 15 nt, Human
caaugguaauuauaa

SEQ ID NO: 3192883 - RNA, 20 nt, Human
caaugcacuuuguucuggcu

SEQ ID NO: 3192884 - RNA, 21 nt, Human
caaugcacuuuguucuggcuc

SEQ ID NO: 3192885 - RNA, 15 nt, Human
caaugggagcucaug

SEQ ID NO: 3192886 - RNA, 17 nt, Human
caaugcacuuuguucug

SEQ ID NO: 3192887 - RNA, 15 nt, Human
caaugugauaaaacc

SEQ ID NO: 3192888 - RNA, 17 nt, Human
caaugugauaaaacccc

SEQ ID NO: 3192889 - RNA, 22 nt, Human
caaugugauauaaacagcuucu

SEQ ID NO: 3192890 - RNA, 20 nt, Human
caaugugauauaaacagcuu

SEQ ID NO: 3192891 - RNA, 18 nt, Human
caaugugauauaaacagc

SEQ ID NO: 3192892 - RNA, 16 nt, Human
caaugugacuuugaaa

SEQ ID NO: 3192893 - RNA, 14 nt, Human
caauuaauugucuu

SEQ ID NO: 3192894 - RNA, 18 nt, Human
caauuaauugucuugcac

SEQ ID NO: 3192895 - RNA, 16 nt, Human
caauuacaggaaguac

SEQ ID NO: 3192896 - RNA, 23 nt, Human
caauucucauuugucacacacuu

SEQ ID NO: 3192897 - RNA, 13 nt, Human
caauucuccugcc

SEQ ID NO: 3192898 - RNA, 19 nt, Human
caauucucccgggacucug

SEQ ID NO: 3192899 - RNA, 20 nt, Human
caauucucccgggacucugc

SEQ ID NO: 3192900 - RNA, 14 nt, Human
caauucuccugccu

SEQ ID NO: 3192901 - RNA, 15 nt, Human
caauucuccugccuc

SEQ ID NO: 3192902 - RNA, 13 nt, Human
caauacagugcuc

SEQ ID NO: 3192903 - RNA, 12 nt, Human
caauaggaaaaa

SEQ ID NO: 3192904 - RNA, 16 nt, Human
caauagcguguguaga

SEQ ID NO: 3192905 - RNA, 18 nt, Human
caauagcguguguagaua

SEQ ID NO: 3192906 - RNA, 21 nt, Human
caauagcccaggauauauuuu

SEQ ID NO: 3192907 - RNA, 13 nt, Human
caauaggaaaaac

SEQ ID NO: 3192908 - RNA, 18 nt, Human
caauaauaauaccucccu

SEQ ID NO: 3192909 - RNA, 16 nt, Human
caagugugcuaaaaau

SEQ ID NO: 3192910 - RNA, 19 nt, Human
caagugugcuaaaaaugag

SEQ ID NO: 3192911 - RNA, 13 nt, Human
caaguuaagauuc

SEQ ID NO: 3192912 - RNA, 15 nt, Human
caaguuaagauucuu

SEQ ID NO: 3192913 - RNA, 20 nt, Human
caauaauuuguggugauuug

SEQ ID NO: 3192914 - RNA, 18 nt, Human
caauaauuuguggugauu

SEQ ID NO: 3192915 - RNA, 21 nt, Human
caauaauuauuugucucagau

SEQ ID NO: 3192916 - RNA, 17 nt, Human
caauauucgcuguguca

SEQ ID NO: 3192917 - RNA, 13 nt, Human
caauauauuuugu

SEQ ID NO: 3192918 - RNA, 15 nt, Human
caauauauuuuguau

SEQ ID NO: 3192919 - RNA, 14 nt, Human
caauauauuuugua

SEQ ID NO: 3192920 - RNA, 14 nt, Human
caauauaagagcuu

SEQ ID NO: 3192921 - RNA, 22 nt, Human
caauauauuuuguaugcaagca

SEQ ID NO: 3192922 - RNA, 16 nt, Human
caauauauuuuguaug

SEQ ID NO: 3192923 - RNA, 17 nt, Human
caauauucucuguacau

SEQ ID NO: 3192924 - RNA, 16 nt, Human
caauauucucuguaca

SEQ ID NO: 3192925 - RNA, 15 nt, Human
caauauucucuguac

SEQ ID NO: 3192926 - RNA, 12 nt, Human
caauauucucug

SEQ ID NO: 3192927 - RNA, 22 nt, Human
caauauucucuguacauauuag

SEQ ID NO: 3192928 - RNA, 19 nt, Human
caauauucucuguacauau

SEQ ID NO: 3192929 - RNA, 18 nt, Human
caauauucucuguacaua

SEQ ID NO: 3192930 - RNA, 22 nt, Human
caaucucguauagaagucuuca

SEQ ID NO: 3192931 - RNA, 21 nt, Human
caaugaccuuucaauaggaaa

SEQ ID NO: 3192932 - RNA, 15 nt, Human
caaucuuacuuugua

SEQ ID NO: 3192933 - RNA, 14 nt, Human
caaucuuacuuugu

SEQ ID NO: 3192934 - RNA, 23 nt, Human
caaugaccuuucaauaggaaaaa

SEQ ID NO: 3192935 - RNA, 19 nt, Human
caaucuggggaaauaauaa

SEQ ID NO: 3192936 - RNA, 20 nt, Human
caaucuggaugccucauuau

SEQ ID NO: 3192937 - RNA, 18 nt, Human
caaucuguaaaacuaaga

SEQ ID NO: 3192938 - RNA, 16 nt, Human
caaaaauucucaguuc

SEQ ID NO: 3192939 - RNA, 11 nt, Human
caaaacaaaaa

SEQ ID NO: 3192940 - RNA, 16 nt, Human
caaaacaaaaagaugu

SEQ ID NO: 3192941 - RNA, 18 nt, Human
caaaacaaaaagaugucu

SEQ ID NO: 3192942 - RNA, 16 nt, Human
caaaacaaaggccuaa

SEQ ID NO: 3192943 - RNA, 15 nt, Human
caaaacaaaggccua

SEQ ID NO: 3192944 - RNA, 12 nt, Human
caaaacaaaggc

SEQ ID NO: 3192945 - RNA, 20 nt, Human
caaaaauccaaauauuguua

SEQ ID NO: 3192946 - RNA, 15 nt, Human
caaaaauccaaauau

SEQ ID NO: 3192947 - RNA, 20 nt, Human
caaaaaucugaagauuguuu

SEQ ID NO: 3192948 - RNA, 18 nt, Human
caaaaaucugaagauugu

SEQ ID NO: 3192949 - RNA, 17 nt, Human
caaaaaucugaagauug

SEQ ID NO: 3192950 - RNA, 15 nt, Human
caaaaaucugaagau

SEQ ID NO: 3192951 - RNA, 19 nt, Human
caaaaauguuaagcaucua

SEQ ID NO: 3192952 - RNA, 21 nt, Human
caaaaaucugaagauuguuua

SEQ ID NO: 3192953 - RNA, 16 nt, Human
caaaaauaaucaugaa

SEQ ID NO: 3192954 - RNA, 14 nt, Human
caaaaaguauauua

SEQ ID NO: 3192955 - RNA, 13 nt, Human
caaaaaggcuuau

SEQ ID NO: 3192956 - RNA, 15 nt, Human
caaaaagcuucugug

SEQ ID NO: 3192957 - RNA, 14 nt, Human
caaaaagcuucugu

SEQ ID NO: 3192958 - RNA, 23 nt, Human
caaaacuucagacauagaauuaa

SEQ ID NO: 3192959 - RNA, 17 nt, Human
caaaacuuuaaaccugu

SEQ ID NO: 3192960 - RNA, 23 nt, Human
caaaacuuuaucagggaaacuaa

SEQ ID NO: 3192961 - RNA, 17 nt, Human
caaaauaaaaaugaggu

SEQ ID NO: 3192962 - RNA, 12 nt, Human
caaaagaaaaac

SEQ ID NO: 3192963 - RNA, 20 nt, Human
caaaacucuccucugcugcu

SEQ ID NO: 3192964 - RNA, 21 nt, Human
caaaacucuccucugcugcug

SEQ ID NO: 3192965 - RNA, 22 nt, Human
caaaacucuccucugcugcugg

SEQ ID NO: 3192966 - RNA, 19 nt, Human
caaaacucuccucugcugc

SEQ ID NO: 3192967 - RNA, 21 nt, Human
caaaacccagcugcaccccuu

SEQ ID NO: 3192968 - RNA, 18 nt, Human
caaaacccagcugcaccc

SEQ ID NO: 3192969 - RNA, 15 nt, Human
caaaacccagcugca

SEQ ID NO: 3192970 - RNA, 14 nt, Human
caaaacccagcugc

SEQ ID NO: 3192971 - RNA, 13 nt, Human
caaaacccagcug

SEQ ID NO: 3192972 - RNA, 22 nt, Human
caaaacaaaggccuaauucuau

SEQ ID NO: 3192973 - RNA, 20 nt, Human
caaaacaccugacagccccu

SEQ ID NO: 3192974 - RNA, 23 nt, Human
caaaaccaaaaguuauuaaaauu

SEQ ID NO: 3192975 - RNA, 18 nt, Human
caaaaccaaaaguuauua

SEQ ID NO: 3192976 - RNA, 17 nt, Human
caaaaccaaaaguuauu

SEQ ID NO: 3192977 - RNA, 13 nt, Human
auuuuccuuuaau

SEQ ID NO: 3192978 - RNA, 23 nt, Human
auuuuccuuuaauaugaaauuuu

SEQ ID NO: 3192979 - RNA, 15 nt, Human
auuuucuaaaguacu

SEQ ID NO: 3192980 - RNA, 15 nt, Human
auuuucuaaaagcuu

SEQ ID NO: 3192981 - RNA, 19 nt, Human
auuuucuaaaagcuuucau

SEQ ID NO: 3192982 - RNA, 21 nt, Human
auuuucuaaaagcuuucaugu

SEQ ID NO: 3192983 - RNA, 20 nt, Human
auuuucuaaaguacugagca

SEQ ID NO: 3192984 - RNA, 16 nt, Human
auuuucuaaaguacug

SEQ ID NO: 3192985 - RNA, 21 nt, Human
auuuugggguacccacugcuc

SEQ ID NO: 3192986 - RNA, 21 nt, Human
auuuuggccaugaaagcaugg

SEQ ID NO: 3192987 - RNA, 21 nt, Human
auuuuggcgaaucucaaaauu

SEQ ID NO: 3192988 - RNA, 22 nt, Human
auuuuggcgaaucucaaaauua

SEQ ID NO: 3192989 - RNA, 17 nt, Human
auuuuggagagauagga

SEQ ID NO: 3192990 - RNA, 19 nt, Human
auuuuggagagauaggaag

SEQ ID NO: 3192991 - RNA, 18 nt, Human
auuuuggagagauaggaa

SEQ ID NO: 3192992 - RNA, 16 nt, Human
caaaaaaugcuugcuu

SEQ ID NO: 3192993 - RNA, 17 nt, Human
auuuuggugucuuucuc

SEQ ID NO: 3192994 - RNA, 10 nt, Human
auuuuggucu

SEQ ID NO: 3192995 - RNA, 23 nt, Human
auuuugggguacccacugcucug

SEQ ID NO: 3192996 - RNA, 22 nt, Human
auuuugggguacccacugcucu

SEQ ID NO: 3192997 - RNA, 20 nt, Human
auuuuggagagauaggaagg

SEQ ID NO: 3192998 - RNA, 14 nt, Human
caaaaacacagcaa

SEQ ID NO: 3192999 - RNA, 13 nt, Human
caaaaacacagca

SEQ ID NO: 3193000 - RNA, 12 nt, Human
auuuuguaaaau

SEQ ID NO: 3193001 - RNA, 14 nt, Human
auuuuguaaaaugu

SEQ ID NO: 3193002 - RNA, 17 nt, Human
auuuuguaaaauguauu

SEQ ID NO: 3193003 - RNA, 18 nt, Human
auuuuguaaaauguauua

SEQ ID NO: 3193004 - RNA, 19 nt, Human
auuuuguaaaauguauuau

SEQ ID NO: 3193005 - RNA, 21 nt, Human
auuuuguaaaauguauuaugu

SEQ ID NO: 3193006 - RNA, 17 nt, Human
caaaaacacagcaaggg

SEQ ID NO: 3193007 - RNA, 15 nt, Human
caaaaacacagcaag

SEQ ID NO: 3193008 - RNA, 13 nt, Human
caaaaaggcagga

SEQ ID NO: 3193009 - RNA, 23 nt, Human
caaaaagauaccuuaaaauuuga

SEQ ID NO: 3193010 - RNA, 22 nt, Human
caaaaagauaccuuaaaauuug

SEQ ID NO: 3193011 - RNA, 20 nt, Human
caaaaagauaccuuaaaauu

SEQ ID NO: 3193012 - RNA, 19 nt, Human
caaaaagauaccuuaaaau

SEQ ID NO: 3193013 - RNA, 18 nt, Human
caaaaagauaccuuaaaa

SEQ ID NO: 3193014 - RNA, 22 nt, Human
caaaaagaaaaaaaaaaagaaa

SEQ ID NO: 3193015 - RNA, 19 nt, Human
caaagcgaauuuuaaaaga

SEQ ID NO: 3193016 - RNA, 14 nt, Human
caaagcgaauuuua

SEQ ID NO: 3193017 - RNA, 17 nt, Human
caaagccuccuccagcc

SEQ ID NO: 3193018 - RNA, 18 nt, Human
caaagccuccuccagccg

SEQ ID NO: 3193019 - RNA, 22 nt, Human
caaagccaaagcuaggccuggc

SEQ ID NO: 3193020 - RNA, 21 nt, Human
caaagccaccaacagccacuc

SEQ ID NO: 3193021 - RNA, 18 nt, Human
caaagcccuuccaugucg

SEQ ID NO: 3193022 - RNA, 17 nt, Human
caaacucaccugccccu

SEQ ID NO: 3193023 - RNA, 16 nt, Human
caaacuacugaaugaa

SEQ ID NO: 3193024 - RNA, 21 nt, Human
caaacuacugaaugaagcagu

SEQ ID NO: 3193025 - RNA, 22 nt, Human
caaacuacugaaugaagcagua

SEQ ID NO: 3193026 - RNA, 23 nt, Human
caaacuacugaaugaagcaguau

SEQ ID NO: 3193027 - RNA, 17 nt, Human
caaacugguuauuuaaa

SEQ ID NO: 3193028 - RNA, 16 nt, Human
caaacugguuauuuaa

SEQ ID NO: 3193029 - RNA, 20 nt, Human
caaagcgaauuuuaaaagau

SEQ ID NO: 3193030 - RNA, 18 nt, Human
caaagcuaggccuggcca

SEQ ID NO: 3193031 - RNA, 19 nt, Human
caaagcuaggccuggccag

SEQ ID NO: 3193032 - RNA, 14 nt, Human
caaagcuaggccug

SEQ ID NO: 3193033 - RNA, 13 nt, Human
caaagcuaggccu

SEQ ID NO: 3193034 - RNA, 12 nt, Human
caaaggaagcac

SEQ ID NO: 3193035 - RNA, 13 nt, Human
caaaggaagcaca

SEQ ID NO: 3193036 - RNA, 18 nt, Human
caaaggguaucaggugcu

SEQ ID NO: 3193037 - RNA, 16 nt, Human
caaaggguaucaggug

SEQ ID NO: 3193038 - RNA, 23 nt, Human
caaaggccuaauucuaugccugu

SEQ ID NO: 3193039 - RNA, 14 nt, Human
caaaggaagcacau

SEQ ID NO: 3193040 - RNA, 23 nt, Human
caaaggcacauggaauauauuuu

SEQ ID NO: 3193041 - RNA, 16 nt, Human
caaaauuaagguguuu

SEQ ID NO: 3193042 - RNA, 19 nt, Human
caaaauuaagguguuugaa

SEQ ID NO: 3193043 - RNA, 20 nt, Human
caaaauuaagguguuugaaa

SEQ ID NO: 3193044 - RNA, 21 nt, Human
caaaauuagauccuaagaugu

SEQ ID NO: 3193045 - RNA, 23 nt, Human
caaaauuagauccuaagaugugu

SEQ ID NO: 3193046 - RNA, 13 nt, Human
caaaauuauuugu

SEQ ID NO: 3193047 - RNA, 15 nt, Human
caaaauucaaagcau

SEQ ID NO: 3193048 - RNA, 17 nt, Human
caaaauucaaagcaugg

SEQ ID NO: 3193049 - RNA, 21 nt, Human
caaaauuauaggagacuugua

SEQ ID NO: 3193050 - RNA, 22 nt, Human
caaaauuauaggagacuuguag

SEQ ID NO: 3193051 - RNA, 15 nt, Human
caaaauguaggguua

SEQ ID NO: 3193052 - RNA, 20 nt, Human
caaaaugggagaucuucuca

SEQ ID NO: 3193053 - RNA, 14 nt, Human
caaaauguaacugu

SEQ ID NO: 3193054 - RNA, 13 nt, Human
caaaauguaacug

SEQ ID NO: 3193055 - RNA, 12 nt, Human
caaaauguaacu

SEQ ID NO: 3193056 - RNA, 11 nt, Human
caaaauguaac

SEQ ID NO: 3193057 - RNA, 21 nt, Human
caaaaugugagugguugaaua

SEQ ID NO: 3193058 - RNA, 12 nt, Human
caaaaugugagu

SEQ ID NO: 3193059 - RNA, 19 nt, Human
caaaaugugagugguugaa

SEQ ID NO: 3193060 - RNA, 19 nt, Human
caaaauguaacuguuacca

SEQ ID NO: 3193061 - RNA, 18 nt, Human
caaaauguaacuguuacc

SEQ ID NO: 3193062 - RNA, 16 nt, Human
caaaauguaacuguua

SEQ ID NO: 3193063 - RNA, 15 nt, Human
caaaauguaacuguu

SEQ ID NO: 3193064 - RNA, 15 nt, Human
caaacacauacagga

SEQ ID NO: 3193065 - RNA, 12 nt, Human
caaacacaggca

SEQ ID NO: 3193066 - RNA, 15 nt, Human
caaacacacagaagg

SEQ ID NO: 3193067 - RNA, 14 nt, Human
caaacccuucagug

SEQ ID NO: 3193068 - RNA, 20 nt, Human
caaacccuucagugccaaaa

SEQ ID NO: 3193069 - RNA, 15 nt, Human
caaaccuaauugcac

SEQ ID NO: 3193070 - RNA, 13 nt, Human
caaaccuaaguug

SEQ ID NO: 3193071 - RNA, 19 nt, Human
caaauuaugcuaagaauuu

SEQ ID NO: 3193072 - RNA, 21 nt, Human
caaauuaugcuaagaauuuuu

SEQ ID NO: 3193073 - RNA, 20 nt, Human
caaauuaugcuaagaauuuu

SEQ ID NO: 3193074 - RNA, 20 nt, Human
caaauuauaauguauucaua

SEQ ID NO: 3193075 - RNA, 18 nt, Human
caaauuauaauguauuca

SEQ ID NO: 3193076 - RNA, 17 nt, Human
caaauuauaauguauuc

SEQ ID NO: 3193077 - RNA, 15 nt, Human
caaauuauaauguau

SEQ ID NO: 3193078 - RNA, 14 nt, Human
caaauuauaaugua

SEQ ID NO: 3193079 - RNA, 13 nt, Human
caaauuauaaugu

SEQ ID NO: 3193080 - RNA, 12 nt, Human
caaauguaaagu

SEQ ID NO: 3193081 - RNA, 22 nt, Human
caaauguaauguggcuucugga

SEQ ID NO: 3193082 - RNA, 19 nt, Human
caaauguaacuauguuuua

SEQ ID NO: 3193083 - RNA, 12 nt, Human
caaauguaacua

SEQ ID NO: 3193084 - RNA, 21 nt, Human
caaauuguaauuaauaauaga

SEQ ID NO: 3193085 - RNA, 20 nt, Human
caaauuguaauuaauaauag

SEQ ID NO: 3193086 - RNA, 18 nt, Human
caaauuguaauuaauaau

SEQ ID NO: 3193087 - RNA, 16 nt, Human
caaauuguaauuaaua

SEQ ID NO: 3193088 - RNA, 15 nt, Human
caaauuguaauuaau

SEQ ID NO: 3193089 - RNA, 19 nt, Human
caaauugucaccugcuucu

SEQ ID NO: 3193090 - RNA, 21 nt, Human
caaauugucaccugcuucucu

SEQ ID NO: 3193091 - RNA, 20 nt, Human
caaauugucaccugcuucuc

SEQ ID NO: 3193092 - RNA, 14 nt, Human
caaauuuauuucca

SEQ ID NO: 3193093 - RNA, 15 nt, Human
caaauuuauuuccaa

SEQ ID NO: 3193094 - RNA, 21 nt, Human
caaauaugcaaagcacugacu

SEQ ID NO: 3193095 - RNA, 19 nt, Human
caaauaugcaaagcacuga

SEQ ID NO: 3193096 - RNA, 23 nt, Human
caaauauuaaaaagucuuuuaaa

SEQ ID NO: 3193097 - RNA, 22 nt, Human
caaauauuaaaaagucuuuuaa

SEQ ID NO: 3193098 - RNA, 19 nt, Human
caaauauuaaaaagucuuu

SEQ ID NO: 3193099 - RNA, 13 nt, Human
caaauauuaaaaa

SEQ ID NO: 3193100 - RNA, 13 nt, Human
caaaugguacaaa

SEQ ID NO: 3193101 - RNA, 24 nt, Human
caaaugguacaaaaccacagugua

SEQ ID NO: 3193102 - RNA, 15 nt, Human
caaaugguacaaaac

SEQ ID NO: 3193103 - RNA, 12 nt, Human
caaauauuauuu

SEQ ID NO: 3193104 - RNA, 19 nt, Human
caaaggguaucaggugcug

SEQ ID NO: 3193105 - RNA, 19 nt, Human
caaagugcugggauuacag

SEQ ID NO: 3193106 - RNA, 23 nt, Human
caaagugcugggauuacaggugu

SEQ ID NO: 3193107 - RNA, 22 nt, Human
caaagggggaggagaagaaaau

SEQ ID NO: 3193108 - RNA, 18 nt, Human
caaauacugaaauauuag

SEQ ID NO: 3193109 - RNA, 15 nt, Human
cacaguuuucugaga

SEQ ID NO: 3193110 - RNA, 19 nt, Human
cacaguuuucugagaaaga

SEQ ID NO: 3193111 - RNA, 17 nt, Human
cacaguuuucugagaaa

SEQ ID NO: 3193112 - RNA, 16 nt, Human
cacaguuuucugagaa

SEQ ID NO: 3193113 - RNA, 14 nt, Human
cacauaucugucau

SEQ ID NO: 3193114 - RNA, 16 nt, Human
cacauagacugugcgc

SEQ ID NO: 3193115 - RNA, 21 nt, Human
cacauaccaacucaacuuuuu

SEQ ID NO: 3193116 - RNA, 15 nt, Human
cacauagacugugcg

SEQ ID NO: 3193117 - RNA, 21 nt, Human
cacauagaaaguaaauaaaag

SEQ ID NO: 3193118 - RNA, 22 nt, Human
cacagcuucauuuccugugucu

SEQ ID NO: 3193119 - RNA, 21 nt, Human
cacagcuucauuuccuguguc

SEQ ID NO: 3193120 - RNA, 22 nt, Human
cacagcugggguggggaccuca

SEQ ID NO: 3193121 - RNA, 23 nt, Human
cacagcugggguggggaccucag

SEQ ID NO: 3193122 - RNA, 15 nt, Human
cacaggcagguccag

SEQ ID NO: 3193123 - RNA, 14 nt, Human
cacaggcaggucca

SEQ ID NO: 3193124 - RNA, 11 nt, Human
cacaggcaggu

SEQ ID NO: 3193125 - RNA, 19 nt, Human
cacaggagaggauggccca

SEQ ID NO: 3193126 - RNA, 19 nt, Human
cacaggagggagggggaag

SEQ ID NO: 3193127 - RNA, 21 nt, Human
cacaggagggagggggaaggc

SEQ ID NO: 3193128 - RNA, 14 nt, Human
cacaggagggaggg

SEQ ID NO: 3193129 - RNA, 13 nt, Human
cacaguccuuacc

SEQ ID NO: 3193130 - RNA, 15 nt, Human
cacaguccuuaccag

SEQ ID NO: 3193131 - RNA, 21 nt, Human
cacaguccuuaccagcagagc

SEQ ID NO: 3193132 - RNA, 21 nt, Human
cacagugagucgaggacaggg

SEQ ID NO: 3193133 - RNA, 22 nt, Human
cacagugagucgaggacaggga

SEQ ID NO: 3193134 - RNA, 14 nt, Human
cacagugcaucuca

SEQ ID NO: 3193135 - RNA, 22 nt, Human
cacaggcagggcaggaccagcc

SEQ ID NO: 3193136 - RNA, 19 nt, Human
cacaggcagggcaggacca

SEQ ID NO: 3193137 - RNA, 15 nt, Human
cacaguucucuccuu

SEQ ID NO: 3193138 - RNA, 14 nt, Human
cacaguucucuccu

SEQ ID NO: 3193139 - RNA, 14 nt, Human
cacagugugauuuu

SEQ ID NO: 3193140 - RNA, 15 nt, Human
cacaguguaccauua

SEQ ID NO: 3193141 - RNA, 22 nt, Human
cacaguguaccauuaaaauaug

SEQ ID NO: 3193142 - RNA, 21 nt, Human
cacaguguaccauuaaaauau

SEQ ID NO: 3193143 - RNA, 19 nt, Human
cacaguguaccauuaaaau

SEQ ID NO: 3193144 - RNA, 18 nt, Human
cacaguguaccauuaaaa

SEQ ID NO: 3193145 - RNA, 17 nt, Human
cacaguguaccauuaaa

SEQ ID NO: 3193146 - RNA, 13 nt, Human
uauucuaauaagc

SEQ ID NO: 3193147 - RNA, 15 nt, Human
uauucuaauaagcua

SEQ ID NO: 3193148 - RNA, 19 nt, Human
uauucuaagaaauaucugu

SEQ ID NO: 3193149 - RNA, 17 nt, Human
uauucuauuuuacaacu

SEQ ID NO: 3193150 - RNA, 15 nt, Human
uauucuauuuuacaa

SEQ ID NO: 3193151 - RNA, 14 nt, Human
uauucuauuuuaca

SEQ ID NO: 3193152 - RNA, 12 nt, Human
uauucuauuuua

SEQ ID NO: 3193153 - RNA, 17 nt, Human
uauucuaauaagcuagu

SEQ ID NO: 3193154 - RNA, 20 nt, Human
uauucuaauaagcuaguuga

SEQ ID NO: 3193155 - RNA, 19 nt, Human
uauuccugcccugcuguuu

SEQ ID NO: 3193156 - RNA, 20 nt, Human
uauuccucuugcauuucacu

SEQ ID NO: 3193157 - RNA, 21 nt, Human
uauuccugcauuugugaaaug

SEQ ID NO: 3193158 - RNA, 20 nt, Human
uauuccugcauuugugaaau

SEQ ID NO: 3193159 - RNA, 19 nt, Human
uauuccugcauuugugaaa

SEQ ID NO: 3193160 - RNA, 17 nt, Human
uauuccugcauuuguga

SEQ ID NO: 3193161 - RNA, 12 nt, Human
uauucccaugag

SEQ ID NO: 3193162 - RNA, 22 nt, Human
uauuccccacccuccccuuccc

SEQ ID NO: 3193163 - RNA, 19 nt, Human
uauuccccacccuccccuu

SEQ ID NO: 3193164 - RNA, 23 nt, Human
uauuccauauuagaaaacuuugu

SEQ ID NO: 3193165 - RNA, 14 nt, Human
uauuccauauuaga

SEQ ID NO: 3193166 - RNA, 20 nt, Human
uauuccauauuagaaaacuu

SEQ ID NO: 3193167 - RNA, 19 nt, Human
uauuccauauuagaaaacu

SEQ ID NO: 3193168 - RNA, 12 nt, Human
uauuccagagcu

SEQ ID NO: 3193169 - RNA, 17 nt, Human
uauuccagagcugccag

SEQ ID NO: 3193170 - RNA, 16 nt, Human
uauuauucccauucua

SEQ ID NO: 3193171 - RNA, 15 nt, Human
uauuauuaaugcuuu

SEQ ID NO: 3193172 - RNA, 14 nt, Human
uauuauuaaugcuu

SEQ ID NO: 3193173 - RNA, 11 nt, Human
uauuauuaaug

SEQ ID NO: 3193174 - RNA, 16 nt, Human
uauuauuaaugcuuug

SEQ ID NO: 3193175 - RNA, 12 nt, Human
uauuacaauauu

SEQ ID NO: 3193176 - RNA, 14 nt, Human
uauuacaauauuug

SEQ ID NO: 3193177 - RNA, 13 nt, Human
uauuacaauauuu

SEQ ID NO: 3193178 - RNA, 19 nt, Human
uauuacaauauuugugugc

SEQ ID NO: 3193179 - RNA, 15 nt, Human
uauuacaauauuugu

SEQ ID NO: 3193180 - RNA, 22 nt, Human
uauuggccauaagcaacaauuu

SEQ ID NO: 3193181 - RNA, 20 nt, Human
uauuggccauaagcaacaau

SEQ ID NO: 3193182 - RNA, 17 nt, Human
uauugcugauggugcaa

SEQ ID NO: 3193183 - RNA, 15 nt, Human
uauugcugaagaauc

SEQ ID NO: 3193184 - RNA, 20 nt, Human
uauugcugaagaaucuacuu

SEQ ID NO: 3193185 - RNA, 22 nt, Human
uauuggaaauuuguuauaauga

SEQ ID NO: 3193186 - RNA, 21 nt, Human
uauugauaugcuuauacacuu

SEQ ID NO: 3193187 - RNA, 22 nt, Human
uauucuccuucugucaaaguca

SEQ ID NO: 3193188 - RNA, 15 nt, Human
uauucucuauuugaa

SEQ ID NO: 3193189 - RNA, 13 nt, Human
uauucucauucuu

SEQ ID NO: 3193190 - RNA, 11 nt, Human
uauugauauuc

SEQ ID NO: 3193191 - RNA, 12 nt, Human
uauugaugaaaa

SEQ ID NO: 3193192 - RNA, 13 nt, Human
uauugaugaaaau

SEQ ID NO: 3193193 - RNA, 14 nt, Human
uauugauugcuuuu

SEQ ID NO: 3193194 - RNA, 21 nt, Human
uauugcccaugauauaacuuu

SEQ ID NO: 3193195 - RNA, 19 nt, Human
uauuuaaagaaauauguau

SEQ ID NO: 3193196 - RNA, 13 nt, Human
uauuuaaagaaau

SEQ ID NO: 3193197 - RNA, 13 nt, Human
uauuuaaaaugua

SEQ ID NO: 3193198 - RNA, 15 nt, Human
uauuuaaaauguaaa

SEQ ID NO: 3193199 - RNA, 13 nt, Human
uauuuaaaaacaa

SEQ ID NO: 3193200 - RNA, 19 nt, Human
uauuuaaaaacaaaaggca

SEQ ID NO: 3193201 - RNA, 22 nt, Human
uauuguuuucaguguacaugga

SEQ ID NO: 3193202 - RNA, 20 nt, Human
uauuguuuucaguguacaug

SEQ ID NO: 3193203 - RNA, 18 nt, Human
uauuguuuucaguguaca

SEQ ID NO: 3193204 - RNA, 12 nt, Human
uauuguuuucag

SEQ ID NO: 3193205 - RNA, 14 nt, Human
uauuguuagauguu

SEQ ID NO: 3193206 - RNA, 16 nt, Human
uauguugacauuuguu

SEQ ID NO: 3193207 - RNA, 15 nt, Human
uauguugacauuugu

SEQ ID NO: 3193208 - RNA, 14 nt, Human
uauguugauaaaag

SEQ ID NO: 3193209 - RNA, 14 nt, Human
uauguugacauuug

SEQ ID NO: 3193210 - RNA, 13 nt, Human
uauguugacauuu

SEQ ID NO: 3193211 - RNA, 16 nt, Human
uaugucauuucauguc

SEQ ID NO: 3193212 - RNA, 16 nt, Human
uaugucagucacuaaa

SEQ ID NO: 3193213 - RNA, 12 nt, Human
uaugucauuuca

SEQ ID NO: 3193214 - RNA, 15 nt, Human
uaugucauuucaugu

SEQ ID NO: 3193215 - RNA, 13 nt, Human
uaugucauuucau

SEQ ID NO: 3193216 - RNA, 14 nt, Human
uauguauuaacacu

SEQ ID NO: 3193217 - RNA, 22 nt, Human
uauguauuaacacuacucaaag

SEQ ID NO: 3193218 - RNA, 16 nt, Human
uauguauucuguaaaa

SEQ ID NO: 3193219 - RNA, 13 nt, Human
uauguauucugua

SEQ ID NO: 3193220 - RNA, 13 nt, Human
uauguugcccagg

SEQ ID NO: 3193221 - RNA, 19 nt, Human
uauguugcccaggcagguc

SEQ ID NO: 3193222 - RNA, 16 nt, Human
uauguugcccaggcag

SEQ ID NO: 3193223 - RNA, 20 nt, Human
uauguugcccaggcaggucu

SEQ ID NO: 3193224 - RNA, 22 nt, Human
uauguuuaaaguaauuguucca

SEQ ID NO: 3193225 - RNA, 16 nt, Human
uauguuguuuuguaca

SEQ ID NO: 3193226 - RNA, 23 nt, Human
uauguuuaaaguaauuguuccag

SEQ ID NO: 3193227 - RNA, 15 nt, Human
uauuaaucacugugu

SEQ ID NO: 3193228 - RNA, 16 nt, Human
uauuaaucacugugua

SEQ ID NO: 3193229 - RNA, 17 nt, Human
uauuaaucacuguguau

SEQ ID NO: 3193230 - RNA, 19 nt, Human
uauuaaucacuguguauau

SEQ ID NO: 3193231 - RNA, 13 nt, Human
uauuaaucacugu

SEQ ID NO: 3193232 - RNA, 14 nt, Human
uauuaaucacugug

SEQ ID NO: 3193233 - RNA, 12 nt, Human
uauuaaucacug

SEQ ID NO: 3193234 - RNA, 17 nt, Human
uauuaagauuauaauug

SEQ ID NO: 3193235 - RNA, 20 nt, Human
uauuaaucacuguguauauu

SEQ ID NO: 3193236 - RNA, 22 nt, Human
uauuaaucacuguguauauuug

SEQ ID NO: 3193237 - RNA, 23 nt, Human
uauuaaucacuguguauauuuga

SEQ ID NO: 3193238 - RNA, 17 nt, Human
uauuaaucagaagaaaa

SEQ ID NO: 3193239 - RNA, 12 nt, Human
uauuaaauuaug

SEQ ID NO: 3193240 - RNA, 22 nt, Human
uauuaaauuacauuuguaauuu

SEQ ID NO: 3193241 - RNA, 20 nt, Human
uauuaaauuacauuuguaau

SEQ ID NO: 3193242 - RNA, 14 nt, Human
uauuaaauuacauu

SEQ ID NO: 3193243 - RNA, 12 nt, Human
uauuaaauuaca

SEQ ID NO: 3193244 - RNA, 19 nt, Human
uauguuuguacaagauugu

SEQ ID NO: 3193245 - RNA, 22 nt, Human
uauguuugccacuuugcaaagg

SEQ ID NO: 3193246 - RNA, 24 nt, Human
uauuaagaaagacuaucuaaaugu

SEQ ID NO: 3193247 - RNA, 23 nt, Human
uauuaaauuuuuuuguaugaaaa

SEQ ID NO: 3193248 - RNA, 21 nt, Human
uauuaaauuuuuuuguaugaa

SEQ ID NO: 3193249 - RNA, 22 nt, Human
uauuaaauuuuuuuguaugaaa

SEQ ID NO: 3193250 - RNA, 17 nt, Human
uauuaaauuuuuuugua

SEQ ID NO: 3193251 - RNA, 18 nt, Human
uauuaaauuuuuuuguau

SEQ ID NO: 3193252 - RNA, 20 nt, Human
uauuaaauuuuuuuguauga

SEQ ID NO: 3193253 - RNA, 18 nt, Human
uauuaagacaauagcacu

SEQ ID NO: 3193254 - RNA, 21 nt, Human
uauuaagacaauagcacuuaa

SEQ ID NO: 3193255 - RNA, 21 nt, Human
uauguacauuucuaagucaaa

SEQ ID NO: 3193256 - RNA, 17 nt, Human
uauguacauuucuaagu

SEQ ID NO: 3193257 - RNA, 16 nt, Human
uauguacauuucuaag

SEQ ID NO: 3193258 - RNA, 15 nt, Human
uauguacauuucuaa

SEQ ID NO: 3193259 - RNA, 14 nt, Human
uauguacauuucua

SEQ ID NO: 3193260 - RNA, 13 nt, Human
uauguacauuucu

SEQ ID NO: 3193261 - RNA, 15 nt, Human
uauguagacaauaua

SEQ ID NO: 3193262 - RNA, 14 nt, Human
uauguacuacauga

SEQ ID NO: 3193263 - RNA, 13 nt, Human
uauguauacaugu

SEQ ID NO: 3193264 - RNA, 21 nt, Human
uauguauacaugugccaugcu

SEQ ID NO: 3193265 - RNA, 14 nt, Human
uauguauacaugug

SEQ ID NO: 3193266 - RNA, 15 nt, Human
uauguauaauucaaa

SEQ ID NO: 3193267 - RNA, 13 nt, Human
uauguauguguuu

SEQ ID NO: 3193268 - RNA, 15 nt, Human
uauguauguguuuag

SEQ ID NO: 3193269 - RNA, 16 nt, Human
uauguauguguuuaga

SEQ ID NO: 3193270 - RNA, 17 nt, Human
uauguauguguuuagaa

SEQ ID NO: 3193271 - RNA, 20 nt, Human
uauguauguguuuagaauug

SEQ ID NO: 3193272 - RNA, 21 nt, Human
uauguauguguuuagaauuga

SEQ ID NO: 3193273 - RNA, 22 nt, Human
uauguauguguuuagaauugaa

SEQ ID NO: 3193274 - RNA, 16 nt, Human
uauguaugguuugaaa

SEQ ID NO: 3193275 - RNA, 17 nt, Human
uauguaugguuugaaaa

SEQ ID NO: 3193276 - RNA, 15 nt, Human
uauguaaauaauucu

SEQ ID NO: 3193277 - RNA, 20 nt, Human
uauguaaaugguaugucauu

SEQ ID NO: 3193278 - RNA, 21 nt, Human
uauguaaaugguaugucauuc

SEQ ID NO: 3193279 - RNA, 13 nt, Human
uauguaaauaauu

SEQ ID NO: 3193280 - RNA, 14 nt, Human
uauguaaauaauuc

SEQ ID NO: 3193281 - RNA, 17 nt, Human
uauguaaauaauucuuu

SEQ ID NO: 3193282 - RNA, 20 nt, Human
uauguaaauagguuucuaaa

SEQ ID NO: 3193283 - RNA, 17 nt, Human
uauguaaacaaaucuuu

SEQ ID NO: 3193284 - RNA, 16 nt, Human
uauguaaacaaaucuu

SEQ ID NO: 3193285 - RNA, 23 nt, Human
uauguaaacaaaucuuuccauau

SEQ ID NO: 3193286 - RNA, 21 nt, Human
uauguaaacaaaucuuuccau

SEQ ID NO: 3193287 - RNA, 13 nt, Human
gggaguggccaca

SEQ ID NO: 3193288 - RNA, 15 nt, Human
gggaguggccacaga

SEQ ID NO: 3193289 - RNA, 18 nt, Human
uauggauaugaaaaauga

SEQ ID NO: 3193290 - RNA, 16 nt, Human
uauuuauaagaaaaau

SEQ ID NO: 3193291 - RNA, 16 nt, Human
uauuuauaauacagaa

SEQ ID NO: 3193292 - RNA, 18 nt, Human
uauuuauaauacagaauc

SEQ ID NO: 3193293 - RNA, 20 nt, Human
uauuuauaauacagaaucuu

SEQ ID NO: 3193294 - RNA, 20 nt, Human
uauuuauaagaaaaauguga

SEQ ID NO: 3193295 - RNA, 13 nt, Human
uauuuuauuaaua

SEQ ID NO: 3193296 - RNA, 20 nt, Human
uauuuuauuuuuagaauuuu

SEQ ID NO: 3193297 - RNA, 15 nt, Human
uauuuuauuucaaug

SEQ ID NO: 3193298 - RNA, 16 nt, Human
uauuuuauuucaaugu

SEQ ID NO: 3193299 - RNA, 13 nt, Human
uauuuuuuugaac

SEQ ID NO: 3193300 - RNA, 14 nt, Human
ucaaaaaaagaaaa

SEQ ID NO: 3193301 - RNA, 15 nt, Human
ucaaaaaaagaaaaa

SEQ ID NO: 3193302 - RNA, 16 nt, Human
uauuuuuuuuaauugu

SEQ ID NO: 3193303 - RNA, 18 nt, Human
uauuuuuuuuaauuguau

SEQ ID NO: 3193304 - RNA, 19 nt, Human
uauuuuuuuuaauuguauu

SEQ ID NO: 3193305 - RNA, 15 nt, Human
uauuuuuuuaacuuu

SEQ ID NO: 3193306 - RNA, 17 nt, Human
uauuuuuuuaacuuuac

SEQ ID NO: 3193307 - RNA, 20 nt, Human
uauuuuuuuaacuuuaccau

SEQ ID NO: 3193308 - RNA, 21 nt, Human
uauuuuuuuaacuuuaccaug

SEQ ID NO: 3193309 - RNA, 11 nt, Human
uauuuucugug

SEQ ID NO: 3193310 - RNA, 12 nt, Human
uauuuucugugu

SEQ ID NO: 3193311 - RNA, 13 nt, Human
uauuuucugugug

SEQ ID NO: 3193312 - RNA, 14 nt, Human
uauuuucugugugu

SEQ ID NO: 3193313 - RNA, 15 nt, Human
uauuuucuguguguu

SEQ ID NO: 3193314 - RNA, 16 nt, Human
uauuuucuguguguuc

SEQ ID NO: 3193315 - RNA, 17 nt, Human
uauuuucuguguguucc

SEQ ID NO: 3193316 - RNA, 18 nt, Human
uauuuucuguguguuccu

SEQ ID NO: 3193317 - RNA, 19 nt, Human
uauuuucuguguguuccug

SEQ ID NO: 3193318 - RNA, 20 nt, Human
uauuuucuguguguuccugg

SEQ ID NO: 3193319 - RNA, 21 nt, Human
uauuuucucugauacuuuuuu

SEQ ID NO: 3193320 - RNA, 22 nt, Human
uauuuucccuauuagagaagag

SEQ ID NO: 3193321 - RNA, 18 nt, Human
uauuuuccugauagcaua

SEQ ID NO: 3193322 - RNA, 14 nt, Human
uauuuuccugauag

SEQ ID NO: 3193323 - RNA, 14 nt, Human
uauuuucuaaagua

SEQ ID NO: 3193324 - RNA, 19 nt, Human
uauuuuccugauagcauau

SEQ ID NO: 3193325 - RNA, 13 nt, Human
ucaaauuguaauu

SEQ ID NO: 3193326 - RNA, 23 nt, Human
ucaaccccuucgcuccugugucu

SEQ ID NO: 3193327 - RNA, 16 nt, Human
ucaaauuguaauuaau

SEQ ID NO: 3193328 - RNA, 20 nt, Human
ucaaccccuucgcuccugug

SEQ ID NO: 3193329 - RNA, 10 nt, Human
ucaaauuaau

SEQ ID NO: 3193330 - RNA, 15 nt, Human
ucaaauuaauugugu

SEQ ID NO: 3193331 - RNA, 16 nt, Human
ucaaauuaauugugug

SEQ ID NO: 3193332 - RNA, 13 nt, Human
ucaaauuaauugu

SEQ ID NO: 3193333 - RNA, 17 nt, Human
ucaaauuaauuguguga

SEQ ID NO: 3193334 - RNA, 18 nt, Human
ucaaauuaauugugugaa

SEQ ID NO: 3193335 - RNA, 22 nt, Human
ucaaauccaggacccugccagg

SEQ ID NO: 3193336 - RNA, 21 nt, Human
ucaaauccaggacccugccag

SEQ ID NO: 3193337 - RNA, 19 nt, Human
ucaaauccaggacccugcc

SEQ ID NO: 3193338 - RNA, 16 nt, Human
ucaaauccaggacccu

SEQ ID NO: 3193339 - RNA, 15 nt, Human
ucaaauccaggaccc

SEQ ID NO: 3193340 - RNA, 22 nt, Human
ucaaaugaugugccugcuucag

SEQ ID NO: 3193341 - RNA, 18 nt, Human
ucaaaugcuagaaaaauu

SEQ ID NO: 3193342 - RNA, 17 nt, Human
ucaaaugcuagaaaaau

SEQ ID NO: 3193343 - RNA, 19 nt, Human
ucaaaugaugugccugcuu

SEQ ID NO: 3193344 - RNA, 18 nt, Human
ucaaaugaugugccugcu

SEQ ID NO: 3193345 - RNA, 15 nt, Human
ucaaaaaacuuguaa

SEQ ID NO: 3193346 - RNA, 14 nt, Human
ucaaaaaacuugua

SEQ ID NO: 3193347 - RNA, 11 nt, Human
ucaaaaaucug

SEQ ID NO: 3193348 - RNA, 18 nt, Human
ucaaaaaucaauaugcag

SEQ ID NO: 3193349 - RNA, 22 nt, Human
ucaaaacaaacagaugcucuga

SEQ ID NO: 3193350 - RNA, 20 nt, Human
ucaaaaaucugaagauuguu

SEQ ID NO: 3193351 - RNA, 16 nt, Human
ucaaaaaucugaagau

SEQ ID NO: 3193352 - RNA, 15 nt, Human
ucaaaaaucugaaga

SEQ ID NO: 3193353 - RNA, 14 nt, Human
ucaaaaaucugaag

SEQ ID NO: 3193354 - RNA, 13 nt, Human
ucaaaaaucugaa

SEQ ID NO: 3193355 - RNA, 18 nt, Human
ucaaaaaucugaagauug

SEQ ID NO: 3193356 - RNA, 17 nt, Human
ucaaaaaucugaagauu

SEQ ID NO: 3193357 - RNA, 16 nt, Human
ucaaaacaaaggccua

SEQ ID NO: 3193358 - RNA, 23 nt, Human
ucaaagaccuggggcugcuguga

SEQ ID NO: 3193359 - RNA, 23 nt, Human
ucaaagaaucaccuaauuaauuu

SEQ ID NO: 3193360 - RNA, 21 nt, Human
ucaaagaccuggggcugcugu

SEQ ID NO: 3193361 - RNA, 20 nt, Human
ucaaaucaagaaacuuaagg

SEQ ID NO: 3193362 - RNA, 14 nt, Human
ucaaauaugcaaag

SEQ ID NO: 3193363 - RNA, 14 nt, Human
ucaaauccaggacc

SEQ ID NO: 3193364 - RNA, 18 nt, Human
ucaaauaucucuauuuaa

SEQ ID NO: 3193365 - RNA, 20 nt, Human
ucaaaucaaucuguaaaacu

SEQ ID NO: 3193366 - RNA, 15 nt, Human
ucaauaaacagcagg

SEQ ID NO: 3193367 - RNA, 19 nt, Human
ucaauaaacagcaggugau

SEQ ID NO: 3193368 - RNA, 15 nt, Human
ucaaguuuuaaaguu

SEQ ID NO: 3193369 - RNA, 17 nt, Human
ucaaguuuuaaaguuca

SEQ ID NO: 3193370 - RNA, 16 nt, Human
ucaaguucacaccugc

SEQ ID NO: 3193371 - RNA, 13 nt, Human
ucaaguucacacc

SEQ ID NO: 3193372 - RNA, 20 nt, Human
ucaagugauucuccugccuc

SEQ ID NO: 3193373 - RNA, 18 nt, Human
ucaagugauucuccugcc

SEQ ID NO: 3193374 - RNA, 15 nt, Human
ucaacgcagcccugc

SEQ ID NO: 3193375 - RNA, 14 nt, Human
ucaacgcagcccug

SEQ ID NO: 3193376 - RNA, 18 nt, Human
ucaacgcagcccugcuuu

SEQ ID NO: 3193377 - RNA, 13 nt, Human
ucaaugcagcccc

SEQ ID NO: 3193378 - RNA, 23 nt, Human
ucaauaauuuguggugauuugga

SEQ ID NO: 3193379 - RNA, 16 nt, Human
ucaauaacagccgcuc

SEQ ID NO: 3193380 - RNA, 14 nt, Human
ucaauaacagccgc

SEQ ID NO: 3193381 - RNA, 24 nt, Human
ucaauaacagccgcuccagaguca

SEQ ID NO: 3193382 - RNA, 21 nt, Human
ucaauaacagccgcuccagag

SEQ ID NO: 3193383 - RNA, 20 nt, Human
ucaauaacagccgcuccaga

SEQ ID NO: 3193384 - RNA, 18 nt, Human
ucaauaacagccgcucca

SEQ ID NO: 3193385 - RNA, 19 nt, Human
ucaauaaaguuugaucuuc

SEQ ID NO: 3193386 - RNA, 18 nt, Human
ucaauaaaguuugaucuu

SEQ ID NO: 3193387 - RNA, 17 nt, Human
ucaauaaaguuugaucu

SEQ ID NO: 3193388 - RNA, 15 nt, Human
ucaauaaaguuugau

SEQ ID NO: 3193389 - RNA, 12 nt, Human
ucaauaaaguuu

SEQ ID NO: 3193390 - RNA, 14 nt, Human
ucaauaaaguuuga

SEQ ID NO: 3193391 - RNA, 13 nt, Human
ucaauaaaguuug

SEQ ID NO: 3193392 - RNA, 21 nt, Human
ucaauuacaggaaguacugga

SEQ ID NO: 3193393 - RNA, 23 nt, Human
ucaauuacaggaaguacuggaga

SEQ ID NO: 3193394 - RNA, 14 nt, Human
ucaauguguauaaa

SEQ ID NO: 3193395 - RNA, 16 nt, Human
ucaauguguauaaauu

SEQ ID NO: 3193396 - RNA, 17 nt, Human
ucaauguguauaaauug

SEQ ID NO: 3193397 - RNA, 22 nt, Human
ucaauguguauaaauugucuuu

SEQ ID NO: 3193398 - RNA, 16 nt, Human
ucaaugugucuuucua

SEQ ID NO: 3193399 - RNA, 17 nt, Human
ucaaugugucuuucuaa

SEQ ID NO: 3193400 - RNA, 20 nt, Human
ucaaugugucuuucuaagaa

SEQ ID NO: 3193401 - RNA, 12 nt, Human
ucaaugugugca

SEQ ID NO: 3193402 - RNA, 21 nt, Human
ucaaugugauauaaacagcuu

SEQ ID NO: 3193403 - RNA, 17 nt, Human
ucacauuuauucugcuc

SEQ ID NO: 3193404 - RNA, 19 nt, Human
ucacauuuauucugcucac

SEQ ID NO: 3193405 - RNA, 18 nt, Human
ucacauuuauucugcuca

SEQ ID NO: 3193406 - RNA, 17 nt, Human
ucacagugugauuuuga

SEQ ID NO: 3193407 - RNA, 16 nt, Human
ucacagugugauuuug

SEQ ID NO: 3193408 - RNA, 14 nt, Human
ucaccaaggcugau

SEQ ID NO: 3193409 - RNA, 14 nt, Human
ucacauuuuuuucu

SEQ ID NO: 3193410 - RNA, 15 nt, Human
ucacauuuuuuucua

SEQ ID NO: 3193411 - RNA, 17 nt, Human
ucacauuuuuuucuacc

SEQ ID NO: 3193412 - RNA, 20 nt, Human
ucacauuuuuauaccuguuu

SEQ ID NO: 3193413 - RNA, 17 nt, Human
ucaccaaauagugugaa

SEQ ID NO: 3193414 - RNA, 20 nt, Human
ucaccaaaucagcugcuacu

SEQ ID NO: 3193415 - RNA, 19 nt, Human
ucaccaaaucagcugcuac

SEQ ID NO: 3193416 - RNA, 22 nt, Human
ucacauuuuuauaccuguuuaa

SEQ ID NO: 3193417 - RNA, 14 nt, Human
ucaccacagacuuu

SEQ ID NO: 3193418 - RNA, 16 nt, Human
ucacagucacauucca

SEQ ID NO: 3193419 - RNA, 19 nt, Human
ucacaguccuuaccagcag

SEQ ID NO: 3193420 - RNA, 22 nt, Human
ucacaguccuuaccagcagagc

SEQ ID NO: 3193421 - RNA, 23 nt, Human
ucacaguccuuaccagcagagca

SEQ ID NO: 3193422 - RNA, 18 nt, Human
ucacaggcagguccaggg

SEQ ID NO: 3193423 - RNA, 17 nt, Human
ucacaggcagguccagg

SEQ ID NO: 3193424 - RNA, 16 nt, Human
ucacaggcagguccag

SEQ ID NO: 3193425 - RNA, 17 nt, Human
ucacaagacccaaaagg

SEQ ID NO: 3193426 - RNA, 13 nt, Human
ucacaagacccaa

SEQ ID NO: 3193427 - RNA, 20 nt, Human
ucaauuacaggaaguacugg

SEQ ID NO: 3193428 - RNA, 14 nt, Human
ucaauuacauguuu

SEQ ID NO: 3193429 - RNA, 12 nt, Human
ucacaccccacc

SEQ ID NO: 3193430 - RNA, 16 nt, Human
ucacaccccaccugcg

SEQ ID NO: 3193431 - RNA, 15 nt, Human
ucacaccccaccugc

SEQ ID NO: 3193432 - RNA, 14 nt, Human
ucacaccccaccug

SEQ ID NO: 3193433 - RNA, 13 nt, Human
ucacaccccaccu

SEQ ID NO: 3193434 - RNA, 20 nt, Human
ucacaccccaccugcgcuuc

SEQ ID NO: 3193435 - RNA, 18 nt, Human
ucacaccccaccugcgcu

SEQ ID NO: 3193436 - RNA, 17 nt, Human
ucacaccccaccugcgc

SEQ ID NO: 3193437 - RNA, 14 nt, Human
ucauuccagaggaa

SEQ ID NO: 3193438 - RNA, 23 nt, Human
ucauuccaccuucccaugcccug

SEQ ID NO: 3193439 - RNA, 17 nt, Human
ucauucaccaguacauu

SEQ ID NO: 3193440 - RNA, 22 nt, Human
ucauucaccaguacauucucag

SEQ ID NO: 3193441 - RNA, 21 nt, Human
ucauucaacccaccugcgucu

SEQ ID NO: 3193442 - RNA, 20 nt, Human
ucauuaucucaaaacugcac

SEQ ID NO: 3193443 - RNA, 19 nt, Human
ucauuaucucaaaacugca

SEQ ID NO: 3193444 - RNA, 12 nt, Human
ucauuauuauua

SEQ ID NO: 3193445 - RNA, 13 nt, Human
ucauuaugucaac

SEQ ID NO: 3193446 - RNA, 18 nt, Human
ucauuaugucaaccaggu

SEQ ID NO: 3193447 - RNA, 13 nt, Human
ucauuaucucaaa

SEQ ID NO: 3193448 - RNA, 18 nt, Human
ucaugcugccccugccuu

SEQ ID NO: 3193449 - RNA, 17 nt, Human
ucaugcugccccugccu

SEQ ID NO: 3193450 - RNA, 13 nt, Human
ucaugcugccccu

SEQ ID NO: 3193451 - RNA, 15 nt, Human
ucauuguuaaaguaa

SEQ ID NO: 3193452 - RNA, 18 nt, Human
ucauuucaccugcugcuu

SEQ ID NO: 3193453 - RNA, 12 nt, Human
ucauuucaccug

SEQ ID NO: 3193454 - RNA, 17 nt, Human
ucauuguucaauuccca

SEQ ID NO: 3193455 - RNA, 21 nt, Human
ucauuuccauguaugcauaau

SEQ ID NO: 3193456 - RNA, 17 nt, Human
ucauuuccauguaugca

SEQ ID NO: 3193457 - RNA, 16 nt, Human
ucauuuccauguaugc

SEQ ID NO: 3193458 - RNA, 12 nt, Human
ucauuuccaugu

SEQ ID NO: 3193459 - RNA, 23 nt, Human
ucauuucauguccugugucaguu

SEQ ID NO: 3193460 - RNA, 20 nt, Human
ucauuucauguccuguguca

SEQ ID NO: 3193461 - RNA, 15 nt, Human
ucauuucauguccug

SEQ ID NO: 3193462 - RNA, 18 nt, Human
ucauuucauccuuucacu

SEQ ID NO: 3193463 - RNA, 16 nt, Human
ucauuuccugugucuu

SEQ ID NO: 3193464 - RNA, 13 nt, Human
ucauuuccugugu

SEQ ID NO: 3193465 - RNA, 14 nt, Human
ucaucugagaauga

SEQ ID NO: 3193466 - RNA, 13 nt, Human
ucaucugagaaug

SEQ ID NO: 3193467 - RNA, 11 nt, Human
ucaucugagag

SEQ ID NO: 3193468 - RNA, 19 nt, Human
ucaucugagaaugaacaaa

SEQ ID NO: 3193469 - RNA, 16 nt, Human
ucaucugagaaugaac

SEQ ID NO: 3193470 - RNA, 15 nt, Human
ucaucugagaaugaa

SEQ ID NO: 3193471 - RNA, 23 nt, Human
ucaucugagagaggcuaaaaugu

SEQ ID NO: 3193472 - RNA, 22 nt, Human
ucaucagaugcuugcggcaaaa

SEQ ID NO: 3193473 - RNA, 18 nt, Human
ucaucagaacagcuguug

SEQ ID NO: 3193474 - RNA, 16 nt, Human
ucaucagaacagcugu

SEQ ID NO: 3193475 - RNA, 15 nt, Human
ucaucagaacagcug

SEQ ID NO: 3193476 - RNA, 21 nt, Human
ucaucagaacagcuguugacu

SEQ ID NO: 3193477 - RNA, 13 nt, Human
ucaucagaacagc

SEQ ID NO: 3193478 - RNA, 16 nt, Human
ucauaggaaguuagcc

SEQ ID NO: 3193479 - RNA, 19 nt, Human
ucaugcuccccugugccag

SEQ ID NO: 3193480 - RNA, 23 nt, Human
ucaugcuccccugugccagccca

SEQ ID NO: 3193481 - RNA, 24 nt, Human
ucaugcuccccugugccagcccag

SEQ ID NO: 3193482 - RNA, 14 nt, Human
ucaugcuccuuaau

SEQ ID NO: 3193483 - RNA, 23 nt, Human
ucaucuuagguuggcaaaaaggc

SEQ ID NO: 3193484 - RNA, 18 nt, Human
ucauaccuaucaucuuaa

SEQ ID NO: 3193485 - RNA, 21 nt, Human
ucauacccacccccacccaag

SEQ ID NO: 3193486 - RNA, 21 nt, Human
ucaggugagaagcagaggaag

SEQ ID NO: 3193487 - RNA, 23 nt, Human
ucaggugccucaagagaaggcaa

SEQ ID NO: 3193488 - RNA, 14 nt, Human
ucaggugcugccau

SEQ ID NO: 3193489 - RNA, 13 nt, Human
ucaggugcugcca

SEQ ID NO: 3193490 - RNA, 19 nt, Human
ucaucaccaacgucugugc

SEQ ID NO: 3193491 - RNA, 15 nt, Human
ucauaggaaguuagc

SEQ ID NO: 3193492 - RNA, 20 nt, Human
ucaucaccaacgucugugcc

SEQ ID NO: 3193493 - RNA, 21 nt, Human
ucaucaccaacgucugugcca

SEQ ID NO: 3193494 - RNA, 12 nt, Human
ucauagcagcuu

SEQ ID NO: 3193495 - RNA, 21 nt, Human
ucauagcccucacccuggggc

SEQ ID NO: 3193496 - RNA, 16 nt, Human
ucauagcauugucuau

SEQ ID NO: 3193497 - RNA, 22 nt, Human
ucauagcauugucuauuuuucu

SEQ ID NO: 3193498 - RNA, 20 nt, Human
ucauagcauugucuauuuuu

SEQ ID NO: 3193499 - RNA, 18 nt, Human
uccaauuuacauacucug

SEQ ID NO: 3193500 - RNA, 17 nt, Human
uccaauuuacauacucu

SEQ ID NO: 3193501 - RNA, 15 nt, Human
uccaauuuuccuuca

SEQ ID NO: 3193502 - RNA, 13 nt, Human
uccaauuuuccuu

SEQ ID NO: 3193503 - RNA, 13 nt, Human
uccaauucuccuu

SEQ ID NO: 3193504 - RNA, 15 nt, Human
uccaauucuccuuua

SEQ ID NO: 3193505 - RNA, 16 nt, Human
uccacaagagcccagg

SEQ ID NO: 3193506 - RNA, 17 nt, Human
uccacaagagcccaggc

SEQ ID NO: 3193507 - RNA, 18 nt, Human
uccacaagagcccaggcc

SEQ ID NO: 3193508 - RNA, 15 nt, Human
uccacaagagcccag

SEQ ID NO: 3193509 - RNA, 18 nt, Human
uccacaaguuaaauaaau

SEQ ID NO: 3193510 - RNA, 17 nt, Human
uccacaaguuaaauaaa

SEQ ID NO: 3193511 - RNA, 14 nt, Human
uccacacacacaaa

SEQ ID NO: 3193512 - RNA, 13 nt, Human
uccacacacacaa

SEQ ID NO: 3193513 - RNA, 21 nt, Human
uccacacacacaaaaaaagac

SEQ ID NO: 3193514 - RNA, 18 nt, Human
uccacacacacaaaaaaa

SEQ ID NO: 3193515 - RNA, 17 nt, Human
uccaccugccagggaca

SEQ ID NO: 3193516 - RNA, 15 nt, Human
uccaccugccaggga

SEQ ID NO: 3193517 - RNA, 18 nt, Human
uccaccugccagggacag

SEQ ID NO: 3193518 - RNA, 21 nt, Human
uccaccugccagggacagagg

SEQ ID NO: 3193519 - RNA, 18 nt, Human
uccaccugcucugcugau

SEQ ID NO: 3193520 - RNA, 17 nt, Human
uccaccugcucugcuga

SEQ ID NO: 3193521 - RNA, 16 nt, Human
uccaccugcucugcug

SEQ ID NO: 3193522 - RNA, 15 nt, Human
uccaccugcucugcu

SEQ ID NO: 3193523 - RNA, 14 nt, Human
uccaccugcucugc

SEQ ID NO: 3193524 - RNA, 15 nt, Human
uccacagaggacaca

SEQ ID NO: 3193525 - RNA, 19 nt, Human
uccacagaggacacagaga

SEQ ID NO: 3193526 - RNA, 17 nt, Human
uccacagaggacacaga

SEQ ID NO: 3193527 - RNA, 12 nt, Human
uccacccugcuc

SEQ ID NO: 3193528 - RNA, 14 nt, Human
uccagguggcauca

SEQ ID NO: 3193529 - RNA, 11 nt, Human
uccaggguggu

SEQ ID NO: 3193530 - RNA, 16 nt, Human
uccagguucagcuugu

SEQ ID NO: 3193531 - RNA, 15 nt, Human
uccagguucagcuug

SEQ ID NO: 3193532 - RNA, 18 nt, Human
uccaggugcacaagcucc

SEQ ID NO: 3193533 - RNA, 20 nt, Human
uccaggugcacaagcuccaa

SEQ ID NO: 3193534 - RNA, 21 nt, Human
uccaggugcacaagcuccaag

SEQ ID NO: 3193535 - RNA, 22 nt, Human
uccaggugcacaagcuccaagc

SEQ ID NO: 3193536 - RNA, 23 nt, Human
uccaggggugggacacccuguga

SEQ ID NO: 3193537 - RNA, 14 nt, Human
uccagggguuuaca

SEQ ID NO: 3193538 - RNA, 17 nt, Human
uccagggguuuacagug

SEQ ID NO: 3193539 - RNA, 15 nt, Human
uccaggugcacaagc

SEQ ID NO: 3193540 - RNA, 17 nt, Human
uccaggagcagccacau

SEQ ID NO: 3193541 - RNA, 18 nt, Human
uccaggagcagccacauu

SEQ ID NO: 3193542 - RNA, 22 nt, Human
uccaggggugggacacccugug

SEQ ID NO: 3193543 - RNA, 14 nt, Human
uccacuuggucugu

SEQ ID NO: 3193544 - RNA, 15 nt, Human
uccacuuggucugug

SEQ ID NO: 3193545 - RNA, 16 nt, Human
uccacuuggucuguga

SEQ ID NO: 3193546 - RNA, 23 nt, Human
uccagccaaagccuccuccagcc

SEQ ID NO: 3193547 - RNA, 17 nt, Human
uccagcucaccagcccc

SEQ ID NO: 3193548 - RNA, 16 nt, Human
uccagcucaccagccc

SEQ ID NO: 3193549 - RNA, 18 nt, Human
uccagcucaccagcccca

SEQ ID NO: 3193550 - RNA, 19 nt, Human
uccagcuggguuggaaaac

SEQ ID NO: 3193551 - RNA, 15 nt, Human
uccagcucaccagcc

SEQ ID NO: 3193552 - RNA, 17 nt, Human
uccagcuguucagcugg

SEQ ID NO: 3193553 - RNA, 16 nt, Human
uccaggagcagccaca

SEQ ID NO: 3193554 - RNA, 21 nt, Human
ucagaggggaauaaacuguug

SEQ ID NO: 3193555 - RNA, 16 nt, Human
ucagagaaaugucugu

SEQ ID NO: 3193556 - RNA, 17 nt, Human
ucagagaaaugucuguc

SEQ ID NO: 3193557 - RNA, 16 nt, Human
ucagacugcuuugaga

SEQ ID NO: 3193558 - RNA, 12 nt, Human
ucagacuguaua

SEQ ID NO: 3193559 - RNA, 13 nt, Human
ucagacagcugcc

SEQ ID NO: 3193560 - RNA, 14 nt, Human
ucagaccgucuucc

SEQ ID NO: 3193561 - RNA, 16 nt, Human
ucagaccgucuuccuc

SEQ ID NO: 3193562 - RNA, 18 nt, Human
ucagaccgucuuccucca

SEQ ID NO: 3193563 - RNA, 17 nt, Human
ucagacgacagccccug

SEQ ID NO: 3193564 - RNA, 16 nt, Human
ucagaaacaauuucug

SEQ ID NO: 3193565 - RNA, 16 nt, Human
ucagaaacuaaaacaa

SEQ ID NO: 3193566 - RNA, 20 nt, Human
ucagaaacccucauuguguu

SEQ ID NO: 3193567 - RNA, 21 nt, Human
ucagaaacccucauuguguuu

SEQ ID NO: 3193568 - RNA, 22 nt, Human
ucagaaacaaagcauuugacuu

SEQ ID NO: 3193569 - RNA, 24 nt, Human
ucagaaacaaagcauuugacuuuc

SEQ ID NO: 3193570 - RNA, 15 nt, Human
ucacuuuauuucauu

SEQ ID NO: 3193571 - RNA, 14 nt, Human
ucacuuuauuucau

SEQ ID NO: 3193572 - RNA, 19 nt, Human
ucacugcuaagaauauuug

SEQ ID NO: 3193573 - RNA, 13 nt, Human
ucacugccucccc

SEQ ID NO: 3193574 - RNA, 18 nt, Human
ucacugccaugccagcuu

SEQ ID NO: 3193575 - RNA, 20 nt, Human
ucacucuuauugcccacgcu

SEQ ID NO: 3193576 - RNA, 18 nt, Human
ucacugcauccuccgccu

SEQ ID NO: 3193577 - RNA, 13 nt, Human
ucacugcauccuc

SEQ ID NO: 3193578 - RNA, 19 nt, Human
ucacugcauccuccgccuc

SEQ ID NO: 3193579 - RNA, 22 nt, Human
ucaccccggccaccugcggugc

SEQ ID NO: 3193580 - RNA, 13 nt, Human
ucaccagccccag

SEQ ID NO: 3193581 - RNA, 22 nt, Human
ucacucugucgcccagucugga

SEQ ID NO: 3193582 - RNA, 17 nt, Human
ucacucuuauugcccac

SEQ ID NO: 3193583 - RNA, 11 nt, Human
ucacugcuuca

SEQ ID NO: 3193584 - RNA, 22 nt, Human
ucacugcuggcugccuuagaac

SEQ ID NO: 3193585 - RNA, 18 nt, Human
ucacugcuggcugccuua

SEQ ID NO: 3193586 - RNA, 17 nt, Human
ucacugcuggcugccuu

SEQ ID NO: 3193587 - RNA, 12 nt, Human
ucacugcuggcu

SEQ ID NO: 3193588 - RNA, 16 nt, Human
ucacugcuggcugccu

SEQ ID NO: 3193589 - RNA, 15 nt, Human
ucacugcuggcugcc

SEQ ID NO: 3193590 - RNA, 14 nt, Human
ucacugcuggcugc

SEQ ID NO: 3193591 - RNA, 13 nt, Human
ucacugcuggcug

SEQ ID NO: 3193592 - RNA, 18 nt, Human
ucaggagcuccauacaca

SEQ ID NO: 3193593 - RNA, 21 nt, Human
ucagcugagccuucugagcug

SEQ ID NO: 3193594 - RNA, 18 nt, Human
ucagcugagccuucugag

SEQ ID NO: 3193595 - RNA, 14 nt, Human
ucagcugagccuuc

SEQ ID NO: 3193596 - RNA, 12 nt, Human
ucagcugagccu

SEQ ID NO: 3193597 - RNA, 18 nt, Human
ucaggauuuccucuugaa

SEQ ID NO: 3193598 - RNA, 17 nt, Human
ucaggauuuccucuuga

SEQ ID NO: 3193599 - RNA, 15 nt, Human
ucaggcucucugggc

SEQ ID NO: 3193600 - RNA, 17 nt, Human
ucaggcucucugggcug

SEQ ID NO: 3193601 - RNA, 12 nt, Human
ucaggcucccag

SEQ ID NO: 3193602 - RNA, 13 nt, Human
ucaggcucccagg

SEQ ID NO: 3193603 - RNA, 15 nt, Human
ucaggugagaagcag

SEQ ID NO: 3193604 - RNA, 16 nt, Human
ucaggugagaagcaga

SEQ ID NO: 3193605 - RNA, 14 nt, Human
ucagggccuggcuc

SEQ ID NO: 3193606 - RNA, 16 nt, Human
ucagggccuggcucag

SEQ ID NO: 3193607 - RNA, 23 nt, Human
ucaggcugucaguguuuggugca

SEQ ID NO: 3193608 - RNA, 19 nt, Human
ucagggaaacuaagauucu

SEQ ID NO: 3193609 - RNA, 21 nt, Human
ucagggaaacuaagauucuuu

SEQ ID NO: 3193610 - RNA, 18 nt, Human
ucagggcagauuuuaguu

SEQ ID NO: 3193611 - RNA, 14 nt, Human
ucagggcagauuuu

SEQ ID NO: 3193612 - RNA, 17 nt, Human
ucagcuccccucggaga

SEQ ID NO: 3193613 - RNA, 23 nt, Human
ucagccucgcaggccucccugcc

SEQ ID NO: 3193614 - RNA, 13 nt, Human
ucagccucgcagg

SEQ ID NO: 3193615 - RNA, 18 nt, Human
ucagcuccccucggagaa

SEQ ID NO: 3193616 - RNA, 15 nt, Human
ucagcugaaccuggg

SEQ ID NO: 3193617 - RNA, 16 nt, Human
ucagcugaaccugggu

SEQ ID NO: 3193618 - RNA, 22 nt, Human
ucagccucccgaguagcuggga

SEQ ID NO: 3193619 - RNA, 21 nt, Human
ucagccucccgaguagcuggg

SEQ ID NO: 3193620 - RNA, 20 nt, Human
ucagccucccgaauagcugg

SEQ ID NO: 3193621 - RNA, 23 nt, Human
ucagcauuagugggaaaaagugg

SEQ ID NO: 3193622 - RNA, 17 nt, Human
ucagcauuagugggaaa

SEQ ID NO: 3193623 - RNA, 20 nt, Human
ucagccuccugaguagcugg

SEQ ID NO: 3193624 - RNA, 18 nt, Human
ucagccugcuccagcugu

SEQ ID NO: 3193625 - RNA, 19 nt, Human
ucagccugcuccagcuguu

SEQ ID NO: 3193626 - RNA, 22 nt, Human
ucagccuccugaguagcuggga

SEQ ID NO: 3193627 - RNA, 21 nt, Human
ucagccucccaaagugcuggg

SEQ ID NO: 3193628 - RNA, 19 nt, Human
ucagccucccaaagugcug

SEQ ID NO: 3193629 - RNA, 14 nt, Human
ucagccucccaaag

SEQ ID NO: 3193630 - RNA, 13 nt, Human
ucagccucccaaa

SEQ ID NO: 3193631 - RNA, 22 nt, Human
ucagccucccgaauagcuggga

SEQ ID NO: 3193632 - RNA, 21 nt, Human
ucagccucccgaauagcuggg

SEQ ID NO: 3193633 - RNA, 18 nt, Human
ucagccucccgaguagcu

SEQ ID NO: 3193634 - RNA, 20 nt, Human
ucagccucccgaguagcugg

SEQ ID NO: 3193635 - RNA, 20 nt, Human
ucagcauucucacuccuacc

SEQ ID NO: 3193636 - RNA, 17 nt, Human
ucagcauucucacuccu

SEQ ID NO: 3193637 - RNA, 20 nt, Human
ucagcauuaccucuuuggaa

SEQ ID NO: 3193638 - RNA, 19 nt, Human
ucagcauuaccucuuugga

SEQ ID NO: 3193639 - RNA, 22 nt, Human
ucagaguauauuguugaagaga

SEQ ID NO: 3193640 - RNA, 14 nt, Human
ucagagguaucuua

SEQ ID NO: 3193641 - RNA, 22 nt, Human
ucugccagauguccuaauggug

SEQ ID NO: 3193642 - RNA, 23 nt, Human
ucugccagauguccuaaugguga

SEQ ID NO: 3193643 - RNA, 13 nt, Human
ucugccugcccag

SEQ ID NO: 3193644 - RNA, 14 nt, Human
ucugccugcccagg

SEQ ID NO: 3193645 - RNA, 17 nt, Human
ucugcugacagacacag

SEQ ID NO: 3193646 - RNA, 18 nt, Human
ucugcugacagacacagg

SEQ ID NO: 3193647 - RNA, 18 nt, Human
ucugcuccucuccccagc

SEQ ID NO: 3193648 - RNA, 15 nt, Human
ucugccugcccaggc

SEQ ID NO: 3193649 - RNA, 20 nt, Human
ucugcucccccuuuucccuc

SEQ ID NO: 3193650 - RNA, 16 nt, Human
ucugcucccccuuuuc

SEQ ID NO: 3193651 - RNA, 22 nt, Human
ucugcuccccuaaagccucaaa

SEQ ID NO: 3193652 - RNA, 22 nt, Human
ucugcugacagacacaggcccg

SEQ ID NO: 3193653 - RNA, 21 nt, Human
ucugcugacagacacaggccc

SEQ ID NO: 3193654 - RNA, 20 nt, Human
ucugcugacagacacaggcc

SEQ ID NO: 3193655 - RNA, 19 nt, Human
ucugcugacagacacaggc

SEQ ID NO: 3193656 - RNA, 12 nt, Human
ucugcugagggu

SEQ ID NO: 3193657 - RNA, 16 nt, Human
ucugcugaggguccag

SEQ ID NO: 3193658 - RNA, 19 nt, Human
ucuggaauaaggagaauga

SEQ ID NO: 3193659 - RNA, 15 nt, Human
ucuggaaugcagugg

SEQ ID NO: 3193660 - RNA, 21 nt, Human
ucugcuggucacuucuucugu

SEQ ID NO: 3193661 - RNA, 20 nt, Human
ucugcuggucacuucuucug

SEQ ID NO: 3193662 - RNA, 14 nt, Human
ucuggacaggcaug

SEQ ID NO: 3193663 - RNA, 21 nt, Human
ucuggacaggcauguucucug

SEQ ID NO: 3193664 - RNA, 23 nt, Human
ucuggaaucauuguccagagcug

SEQ ID NO: 3193665 - RNA, 14 nt, Human
ucugucgcccaguc

SEQ ID NO: 3193666 - RNA, 19 nt, Human
ucuguccuacucuguguca

SEQ ID NO: 3193667 - RNA, 15 nt, Human
ucuguccuacucugu

SEQ ID NO: 3193668 - RNA, 21 nt, Human
ucuguccugggagugagcugg

SEQ ID NO: 3193669 - RNA, 14 nt, Human
ucuguccuacucug

SEQ ID NO: 3193670 - RNA, 20 nt, Human
ucugguuccuccccuccucc

SEQ ID NO: 3193671 - RNA, 21 nt, Human
ucugguuccuccccuccuccu

SEQ ID NO: 3193672 - RNA, 13 nt, Human
ucugguuccuccc

SEQ ID NO: 3193673 - RNA, 18 nt, Human
ucuggcucuuccaggcug

SEQ ID NO: 3193674 - RNA, 23 nt, Human
ucuggcucuuccaggcugggaga

SEQ ID NO: 3193675 - RNA, 23 nt, Human
ucuggugacuuuccucuuugguc

SEQ ID NO: 3193676 - RNA, 13 nt, Human
ucugggacacagu

SEQ ID NO: 3193677 - RNA, 14 nt, Human
ucugggacacaguu

SEQ ID NO: 3193678 - RNA, 20 nt, Human
ucuggaccccaucugugaau

SEQ ID NO: 3193679 - RNA, 10 nt, Human
ucuggccuuc

SEQ ID NO: 3193680 - RNA, 15 nt, Human
ucuggcuccagcugg

SEQ ID NO: 3193681 - RNA, 17 nt, Human
ucuggccuucggccucc

SEQ ID NO: 3193682 - RNA, 19 nt, Human
ucuggaccccaucugugaa

SEQ ID NO: 3193683 - RNA, 18 nt, Human
ucuggaccccaucuguga

SEQ ID NO: 3193684 - RNA, 17 nt, Human
ucuggaccccaucugug

SEQ ID NO: 3193685 - RNA, 14 nt, Human
ucuggaccccaucu

SEQ ID NO: 3193686 - RNA, 18 nt, Human
ucuggccuucggccucca

SEQ ID NO: 3193687 - RNA, 22 nt, Human
ucuuaaauauguggaguucauc

SEQ ID NO: 3193688 - RNA, 16 nt, Human
ucuuaagaaauaaauc

SEQ ID NO: 3193689 - RNA, 14 nt, Human
ucuuaagaaauaaa

SEQ ID NO: 3193690 - RNA, 13 nt, Human
ucuuaagaaauaa

SEQ ID NO: 3193691 - RNA, 16 nt, Human
ucuuaagacagcaugu

SEQ ID NO: 3193692 - RNA, 21 nt, Human
ucuuaagacagcauguguuaa

SEQ ID NO: 3193693 - RNA, 24 nt, Human
ucuuaagacagcauguguuaaucu

SEQ ID NO: 3193694 - RNA, 15 nt, Human
ucugucuucacaaca

SEQ ID NO: 3193695 - RNA, 12 nt, Human
ucugucuuccuu

SEQ ID NO: 3193696 - RNA, 14 nt, Human
ucugucuuccuuug

SEQ ID NO: 3193697 - RNA, 12 nt, Human
ucugucugcugg

SEQ ID NO: 3193698 - RNA, 9 nt, Human
ucugucugc

SEQ ID NO: 3193699 - RNA, 22 nt, Human
ucugucugcuggucacuucuuc

SEQ ID NO: 3193700 - RNA, 13 nt, Human
ucugucugcuggu

SEQ ID NO: 3193701 - RNA, 13 nt, Human
ucugucuggucca

SEQ ID NO: 3193702 - RNA, 15 nt, Human
ucuguuuuuaaaaau

SEQ ID NO: 3193703 - RNA, 13 nt, Human
ucuuaaaaaguaa

SEQ ID NO: 3193704 - RNA, 12 nt, Human
ucuuaaaaagua

SEQ ID NO: 3193705 - RNA, 19 nt, Human
ucuguuuugugguuuggaa

SEQ ID NO: 3193706 - RNA, 20 nt, Human
ucuguuuugugguuuggaau

SEQ ID NO: 3193707 - RNA, 14 nt, Human
ucuguuuuuaaaaa

SEQ ID NO: 3193708 - RNA, 12 nt, Human
ucuugaacuccu

SEQ ID NO: 3193709 - RNA, 17 nt, Human
ucuugaacuccugaccu

SEQ ID NO: 3193710 - RNA, 19 nt, Human
ucuugaacuccugaccuca

SEQ ID NO: 3193711 - RNA, 13 nt, Human
ucuucuccuuuca

SEQ ID NO: 3193712 - RNA, 21 nt, Human
ucuucuccccuuccauuucug

SEQ ID NO: 3193713 - RNA, 16 nt, Human
ucuucuccccuuccau

SEQ ID NO: 3193714 - RNA, 14 nt, Human
ucuucuccuuucac

SEQ ID NO: 3193715 - RNA, 18 nt, Human
ucuucuuuuuuugugaug

SEQ ID NO: 3193716 - RNA, 17 nt, Human
ucuucuuuuuuugugau

SEQ ID NO: 3193717 - RNA, 16 nt, Human
ucuucuuuuuuuguga

SEQ ID NO: 3193718 - RNA, 15 nt, Human
ucuucuccaggcugu

SEQ ID NO: 3193719 - RNA, 12 nt, Human
ucuucuccccca

SEQ ID NO: 3193720 - RNA, 16 nt, Human
ucuucucccccauccu

SEQ ID NO: 3193721 - RNA, 13 nt, Human
ucuucucccccau

SEQ ID NO: 3193722 - RNA, 12 nt, Human
ucuucuccacug

SEQ ID NO: 3193723 - RNA, 15 nt, Human
ucuucucauuacuug

SEQ ID NO: 3193724 - RNA, 17 nt, Human
ucuucucauuacuuguu

SEQ ID NO: 3193725 - RNA, 13 nt, Human
ucuucaugaaaug

SEQ ID NO: 3193726 - RNA, 16 nt, Human
ucuucaugaaaugcua

SEQ ID NO: 3193727 - RNA, 20 nt, Human
ucuucaugaguagugggcua

SEQ ID NO: 3193728 - RNA, 14 nt, Human
ucuucaugaaaugc

SEQ ID NO: 3193729 - RNA, 13 nt, Human
ucuuccuggacag

SEQ ID NO: 3193730 - RNA, 12 nt, Human
ucuuccuggccg

SEQ ID NO: 3193731 - RNA, 19 nt, Human
ucuuccuggacaggccagg

SEQ ID NO: 3193732 - RNA, 17 nt, Human
ucuuccuggauuauuca

SEQ ID NO: 3193733 - RNA, 21 nt, Human
ucuuccuggucgaaaguuagu

SEQ ID NO: 3193734 - RNA, 20 nt, Human
ucuuccuggucgaaaguuag

SEQ ID NO: 3193735 - RNA, 16 nt, Human
ucuuccuggugacccu

SEQ ID NO: 3193736 - RNA, 13 nt, Human
ucuuccuguaauc

SEQ ID NO: 3193737 - RNA, 14 nt, Human
ucuuccuguaaucu

SEQ ID NO: 3193738 - RNA, 15 nt, Human
ucuuccuguaaucuu

SEQ ID NO: 3193739 - RNA, 17 nt, Human
ucuucagcacaaaagga

SEQ ID NO: 3193740 - RNA, 17 nt, Human
ucuuaggccaggcgugg

SEQ ID NO: 3193741 - RNA, 13 nt, Human
ucugacauaaucc

SEQ ID NO: 3193742 - RNA, 23 nt, Human
ucugacauaauccaguaaaauaa

SEQ ID NO: 3193743 - RNA, 19 nt, Human
ucugacauaauccaguaaa

SEQ ID NO: 3193744 - RNA, 13 nt, Human
ucugacccacugc

SEQ ID NO: 3193745 - RNA, 22 nt, Human
ucugacaggcaaugcuggcugu

SEQ ID NO: 3193746 - RNA, 21 nt, Human
ucugacaggcaaugcuggcug

SEQ ID NO: 3193747 - RNA, 12 nt, Human
ucugacaggcaa

SEQ ID NO: 3193748 - RNA, 19 nt, Human
ucugacacacagcucuguc

SEQ ID NO: 3193749 - RNA, 18 nt, Human
ucugacacacagcucugu

SEQ ID NO: 3193750 - RNA, 17 nt, Human
ucugacacacagcucug

SEQ ID NO: 3193751 - RNA, 16 nt, Human
ucugacacacagcucu

SEQ ID NO: 3193752 - RNA, 22 nt, Human
ucugaaagagucuuucuucuuc

SEQ ID NO: 3193753 - RNA, 18 nt, Human
ucugaaagagucuuucuu

SEQ ID NO: 3193754 - RNA, 16 nt, Human
ucugaaaccaaaugua

SEQ ID NO: 3193755 - RNA, 20 nt, Human
ucugaaacauuucauaauuu

SEQ ID NO: 3193756 - RNA, 13 nt, Human
ucugaaaauguau

SEQ ID NO: 3193757 - RNA, 16 nt, Human
ucucuuuuuuacaaag

SEQ ID NO: 3193758 - RNA, 15 nt, Human
ucucuuuuuuacaaa

SEQ ID NO: 3193759 - RNA, 17 nt, Human
ucucuuuuuuacaaagg

SEQ ID NO: 3193760 - RNA, 13 nt, Human
ucucuuaucugug

SEQ ID NO: 3193761 - RNA, 14 nt, Human
ucucuuuuuuaagu

SEQ ID NO: 3193762 - RNA, 16 nt, Human
ucucuuagaaaaggug

SEQ ID NO: 3193763 - RNA, 12 nt, Human
ucucuuagaaaa

SEQ ID NO: 3193764 - RNA, 22 nt, Human
ucucuuaagacagcauguguua

SEQ ID NO: 3193765 - RNA, 14 nt, Human
ucucuguuccauag

SEQ ID NO: 3193766 - RNA, 14 nt, Human
ucugcaucagcugc

SEQ ID NO: 3193767 - RNA, 20 nt, Human
ucugcacauaaacucuuuua

SEQ ID NO: 3193768 - RNA, 21 nt, Human
ucugcaucagcugcugaaaca

SEQ ID NO: 3193769 - RNA, 19 nt, Human
ucugcaucagcugcugaaa

SEQ ID NO: 3193770 - RNA, 17 nt, Human
ucugcauucaggaucaa

SEQ ID NO: 3193771 - RNA, 20 nt, Human
ucugccacagggacuugccu

SEQ ID NO: 3193772 - RNA, 17 nt, Human
ucugccacccugcugag

SEQ ID NO: 3193773 - RNA, 21 nt, Human
ucugaggaauggacauuucua

SEQ ID NO: 3193774 - RNA, 23 nt, Human
ucugaggaauccagacccggcug

SEQ ID NO: 3193775 - RNA, 14 nt, Human
ucugacccacugcu

SEQ ID NO: 3193776 - RNA, 20 nt, Human
ucugcaagaauugaagcagg

SEQ ID NO: 3193777 - RNA, 14 nt, Human
ucugcacacagcac

SEQ ID NO: 3193778 - RNA, 23 nt, Human
ucugcacaccuugaaucugccug

SEQ ID NO: 3193779 - RNA, 19 nt, Human
ucugcacauaaacucuuuu

SEQ ID NO: 3193780 - RNA, 17 nt, Human
ucugaggccguugcuga

SEQ ID NO: 3193781 - RNA, 21 nt, Human
ucugaggccguugcugacuua

SEQ ID NO: 3193782 - RNA, 22 nt, Human
ucugaggccguugcugacuuag

SEQ ID NO: 3193783 - RNA, 11 nt, Human
ucugaggcuga

SEQ ID NO: 3193784 - RNA, 23 nt, Human
ucugaggcugaaauucagaauau

SEQ ID NO: 3193785 - RNA, 21 nt, Human
ucuccuggaaauauuaagaaa

SEQ ID NO: 3193786 - RNA, 15 nt, Human
ucuccugccucagcc

SEQ ID NO: 3193787 - RNA, 17 nt, Human
ucuccugccucagccuc

SEQ ID NO: 3193788 - RNA, 20 nt, Human
ucucaaauaggcuauuaaaa

SEQ ID NO: 3193789 - RNA, 22 nt, Human
ucucaaauaggcuauuaaaaaa

SEQ ID NO: 3193790 - RNA, 23 nt, Human
ucucaaauuguaauuaauaauag

SEQ ID NO: 3193791 - RNA, 18 nt, Human
ucucaagagggcacuggu

SEQ ID NO: 3193792 - RNA, 17 nt, Human
ucucaagagggcacugg

SEQ ID NO: 3193793 - RNA, 19 nt, Human
ucucaagagggcacuggug

SEQ ID NO: 3193794 - RNA, 18 nt, Human
ucucaaguuuaugucuca

SEQ ID NO: 3193795 - RNA, 12 nt, Human
ucuccugccuca

SEQ ID NO: 3193796 - RNA, 13 nt, Human
ucucaaugaaaua

SEQ ID NO: 3193797 - RNA, 14 nt, Human
ucucaaugaaauag

SEQ ID NO: 3193798 - RNA, 23 nt, Human
ucucuaauauccacuuguccaug

SEQ ID NO: 3193799 - RNA, 20 nt, Human
ucucuaacaguggacaaagu

SEQ ID NO: 3193800 - RNA, 14 nt, Human
ucucuaacagugga

SEQ ID NO: 3193801 - RNA, 24 nt, Human
ucucguauagaagucuucaugaaa

SEQ ID NO: 3193802 - RNA, 23 nt, Human
ucucguguuauuuuaaucucaga

SEQ ID NO: 3193803 - RNA, 14 nt, Human
ucucgugauugaua

SEQ ID NO: 3193804 - RNA, 22 nt, Human
ucucgugauugauaagaaccuu

SEQ ID NO: 3193805 - RNA, 14 nt, Human
ucucguauagaagu

SEQ ID NO: 3193806 - RNA, 17 nt, Human
ucucugaggacacuaac

SEQ ID NO: 3193807 - RNA, 14 nt, Human
ucucugaggacacu

SEQ ID NO: 3193808 - RNA, 15 nt, Human
ucucugaaggaggcc

SEQ ID NO: 3193809 - RNA, 18 nt, Human
ucucugaaggaggccacc

SEQ ID NO: 3193810 - RNA, 21 nt, Human
ucucugaaggaggccaccucc

SEQ ID NO: 3193811 - RNA, 20 nt, Human
ucucugaaggaggccaccuc

SEQ ID NO: 3193812 - RNA, 23 nt, Human
ucucugaaggaggccaccuccua

SEQ ID NO: 3193813 - RNA, 14 nt, Human
ucucuagugcugug

SEQ ID NO: 3193814 - RNA, 19 nt, Human
ucucuagugcugugaaaaa

SEQ ID NO: 3193815 - RNA, 12 nt, Human
ucucucuccaag

SEQ ID NO: 3193816 - RNA, 17 nt, Human
ucucuagugcugugaaa

SEQ ID NO: 3193817 - RNA, 16 nt, Human
ucucuagugcugugaa

SEQ ID NO: 3193818 - RNA, 16 nt, Human
ucucucucucucaaaa

SEQ ID NO: 3193819 - RNA, 23 nt, Human
ucucuggccuucggccuccaucc

SEQ ID NO: 3193820 - RNA, 23 nt, Human
ucucugauacuuuuuugaaauca

SEQ ID NO: 3193821 - RNA, 22 nt, Human
ucucugaguucuguguauuuuc

SEQ ID NO: 3193822 - RNA, 14 nt, Human
ucucuguacauauu

SEQ ID NO: 3193823 - RNA, 17 nt, Human
ucuaaaucauauauaau

SEQ ID NO: 3193824 - RNA, 18 nt, Human
ucguuaggauacugccuc

SEQ ID NO: 3193825 - RNA, 18 nt, Human
ucguuaguaaucuguaua

SEQ ID NO: 3193826 - RNA, 17 nt, Human
ucuaaccacagcuccuu

SEQ ID NO: 3193827 - RNA, 16 nt, Human
ucuaaccacagcuccu

SEQ ID NO: 3193828 - RNA, 22 nt, Human
ucuaaccacagcuccuuuucca

SEQ ID NO: 3193829 - RNA, 20 nt, Human
ucuaaccacagcuccuuuuc

SEQ ID NO: 3193830 - RNA, 19 nt, Human
ucuaaccacagcuccuuuu

SEQ ID NO: 3193831 - RNA, 16 nt, Human
ucuaauauauccacac

SEQ ID NO: 3193832 - RNA, 21 nt, Human
ucgugaugcuaugauguuagu

SEQ ID NO: 3193833 - RNA, 18 nt, Human
ucggccuccauccugagg

SEQ ID NO: 3193834 - RNA, 17 nt, Human
ucggccuccauccugag

SEQ ID NO: 3193835 - RNA, 16 nt, Human
ucgugauugauaagaa

SEQ ID NO: 3193836 - RNA, 22 nt, Human
ucggccucccaaagugcuggga

SEQ ID NO: 3193837 - RNA, 22 nt, Human
ucuaugauuccagguggcauca

SEQ ID NO: 3193838 - RNA, 13 nt, Human
ucuaugccugucu

SEQ ID NO: 3193839 - RNA, 17 nt, Human
ucucaaauaacuaaaag

SEQ ID NO: 3193840 - RNA, 21 nt, Human
ucucaaagccccauuaacugc

SEQ ID NO: 3193841 - RNA, 17 nt, Human
ucucaaagaccuggggc

SEQ ID NO: 3193842 - RNA, 19 nt, Human
ucucaaagccccauuaacu

SEQ ID NO: 3193843 - RNA, 20 nt, Human
ucuagugcagcugaaauuga

SEQ ID NO: 3193844 - RNA, 19 nt, Human
ucuagugcagcugaaauug

SEQ ID NO: 3193845 - RNA, 14 nt, Human
ucuaaugugugaau

SEQ ID NO: 3193846 - RNA, 12 nt, Human
ucuaauguuuaa

SEQ ID NO: 3193847 - RNA, 11 nt, Human
ucuaauguuua

SEQ ID NO: 3193848 - RNA, 18 nt, Human
ucuaauguuuaagcagaa

SEQ ID NO: 3193849 - RNA, 16 nt, Human
ucuaauuccuguuugu

SEQ ID NO: 3193850 - RNA, 13 nt, Human
ucuaauuccuguu

SEQ ID NO: 3193851 - RNA, 13 nt, Human
ucuagaaagaaua

SEQ ID NO: 3193852 - RNA, 11 nt, Human
ucuagaaagaa

SEQ ID NO: 3193853 - RNA, 17 nt, Human
ucuagugcagcugaaau

SEQ ID NO: 3193854 - RNA, 21 nt, Human
ucuaggaagacuuuggaaaga

SEQ ID NO: 3193855 - RNA, 15 nt, Human
ucuaggaccuguguc

SEQ ID NO: 3193856 - RNA, 16 nt, Human
uccuuggacucauuuu

SEQ ID NO: 3193857 - RNA, 20 nt, Human
uccuuggaaaucaaauguaa

SEQ ID NO: 3193858 - RNA, 23 nt, Human
uccuuggaaaucaaauguaaagu

SEQ ID NO: 3193859 - RNA, 22 nt, Human
uccuuggaaaucaaauguaaag

SEQ ID NO: 3193860 - RNA, 23 nt, Human
uccuuuucacaguucucuccuuc

SEQ ID NO: 3193861 - RNA, 19 nt, Human
uccuuuuaaaacacuucca

SEQ ID NO: 3193862 - RNA, 15 nt, Human
ucgaacuccugaccu

SEQ ID NO: 3193863 - RNA, 20 nt, Human
ucgaaaguuaguaggauaug

SEQ ID NO: 3193864 - RNA, 23 nt, Human
uccuuuuccagagcauuccaguc

SEQ ID NO: 3193865 - RNA, 15 nt, Human
uccuuuuccagagca

SEQ ID NO: 3193866 - RNA, 14 nt, Human
uccuuuuccagagc

SEQ ID NO: 3193867 - RNA, 13 nt, Human
uccuuuuccagag

SEQ ID NO: 3193868 - RNA, 21 nt, Human
uccuucaccuuuguccccacc

SEQ ID NO: 3193869 - RNA, 22 nt, Human
uccuucaccuuuguccccaccg

SEQ ID NO: 3193870 - RNA, 12 nt, Human
uccuucacuguu

SEQ ID NO: 3193871 - RNA, 13 nt, Human
uccuucacuguuu

SEQ ID NO: 3193872 - RNA, 15 nt, Human
uccuucacuguuuca

SEQ ID NO: 3193873 - RNA, 22 nt, Human
uccuugaggggagccaggaggg

SEQ ID NO: 3193874 - RNA, 19 nt, Human
uccuugaggggagccagga

SEQ ID NO: 3193875 - RNA, 17 nt, Human
uccuugauaauauauug

SEQ ID NO: 3193876 - RNA, 19 nt, Human
uccuugauauuuguauuua

SEQ ID NO: 3193877 - RNA, 17 nt, Human
uccuugauauuuguauu

SEQ ID NO: 3193878 - RNA, 13 nt, Human
uccuugauauuug

SEQ ID NO: 3193879 - RNA, 16 nt, Human
uccuuaccagcagagc

SEQ ID NO: 3193880 - RNA, 17 nt, Human
uccuuaccagcagagca

SEQ ID NO: 3193881 - RNA, 18 nt, Human
uccuuaccagcagagcac

SEQ ID NO: 3193882 - RNA, 18 nt, Human
uccuucacagaugggugc

SEQ ID NO: 3193883 - RNA, 18 nt, Human
uccuucaccuuugucccc

SEQ ID NO: 3193884 - RNA, 20 nt, Human
uccuucaccuuuguccccac

SEQ ID NO: 3193885 - RNA, 19 nt, Human
uccuucacagaugggugcu

SEQ ID NO: 3193886 - RNA, 14 nt, Human
uccuggcacccggc

SEQ ID NO: 3193887 - RNA, 19 nt, Human
uccuggcacccggccccug

SEQ ID NO: 3193888 - RNA, 16 nt, Human
uccuggcacccggccc

SEQ ID NO: 3193889 - RNA, 15 nt, Human
uccugccucagccuc

SEQ ID NO: 3193890 - RNA, 13 nt, Human
uccugccucagcc

SEQ ID NO: 3193891 - RNA, 16 nt, Human
uccugccucagccucc

SEQ ID NO: 3193892 - RNA, 20 nt, Human
uccugccuaagugcagcccc

SEQ ID NO: 3193893 - RNA, 14 nt, Human
uccugccucagccu

SEQ ID NO: 3193894 - RNA, 13 nt, Human
uccugagccagau

SEQ ID NO: 3193895 - RNA, 18 nt, Human
uccuggcacugcuuccag

SEQ ID NO: 3193896 - RNA, 22 nt, Human
uccuggcacugcuuccagugag

SEQ ID NO: 3193897 - RNA, 17 nt, Human
uccuggcacugcuucca

SEQ ID NO: 3193898 - RNA, 21 nt, Human
uccuggcacccggccccugcu

SEQ ID NO: 3193899 - RNA, 20 nt, Human
uccuggcacccggccccugc

SEQ ID NO: 3193900 - RNA, 14 nt, Human
uccuuaccagcaga

SEQ ID NO: 3193901 - RNA, 13 nt, Human
uccuguaacuguu

SEQ ID NO: 3193902 - RNA, 18 nt, Human
uccuguaacuguuacagu

SEQ ID NO: 3193903 - RNA, 19 nt, Human
uccuguaacuguuacagua

SEQ ID NO: 3193904 - RNA, 21 nt, Human
uccuguaacuguuacaguaau

SEQ ID NO: 3193905 - RNA, 19 nt, Human
ucccuuccaguuuauucca

SEQ ID NO: 3193906 - RNA, 13 nt, Human
ucccuucccaccu

SEQ ID NO: 3193907 - RNA, 15 nt, Human
ucccuuccaccugcu

SEQ ID NO: 3193908 - RNA, 14 nt, Human
ucccuuccaccugc

SEQ ID NO: 3193909 - RNA, 21 nt, Human
ucccuuccaccugcucugcug

SEQ ID NO: 3193910 - RNA, 20 nt, Human
ucccuuccaccugcucugcu

SEQ ID NO: 3193911 - RNA, 19 nt, Human
ucccuuccaccugcucugc

SEQ ID NO: 3193912 - RNA, 17 nt, Human
ucccuuccaccugcucu

SEQ ID NO: 3193913 - RNA, 23 nt, Human
ucccuuccaguuuauuccagagc

SEQ ID NO: 3193914 - RNA, 22 nt, Human
ucccuuccaguuuauuccagag

SEQ ID NO: 3193915 - RNA, 23 nt, Human
ucccugccugguccucacacuca

SEQ ID NO: 3193916 - RNA, 20 nt, Human
ucccugccccucccuucaac

SEQ ID NO: 3193917 - RNA, 22 nt, Human
ucccugcugucauugcuucuuc

SEQ ID NO: 3193918 - RNA, 15 nt, Human
ucccugcucacugca

SEQ ID NO: 3193919 - RNA, 23 nt, Human
ucccugcugucauugcuucuucu

SEQ ID NO: 3193920 - RNA, 13 nt, Human
ucccugcacuugc

SEQ ID NO: 3193921 - RNA, 14 nt, Human
ucccugcacuugca

SEQ ID NO: 3193922 - RNA, 19 nt, Human
ucccugccccucccuucaa

SEQ ID NO: 3193923 - RNA, 15 nt, Human
ucccucuacugggag

SEQ ID NO: 3193924 - RNA, 17 nt, Human
ucccucuacugggagcc

SEQ ID NO: 3193925 - RNA, 16 nt, Human
ucccucgucuuuccca

SEQ ID NO: 3193926 - RNA, 20 nt, Human
ucccucggaguucuucuuga

SEQ ID NO: 3193927 - RNA, 14 nt, Human
ucccgggacucugc

SEQ ID NO: 3193928 - RNA, 21 nt, Human
uccccuguuuguuucugaaag

SEQ ID NO: 3193929 - RNA, 17 nt, Human
uccagguuuaagcuguu

SEQ ID NO: 3193930 - RNA, 18 nt, Human
uccccuguuuguuucuga

SEQ ID NO: 3193931 - RNA, 20 nt, Human
uccccuguuuguuucugaaa

SEQ ID NO: 3193932 - RNA, 20 nt, Human
uccuaauaaucauuggauuc

SEQ ID NO: 3193933 - RNA, 16 nt, Human
uccuaaucuucugaac

SEQ ID NO: 3193934 - RNA, 13 nt, Human
uccgaccagacac

SEQ ID NO: 3193935 - RNA, 18 nt, Human
uccuacccacccuccuuu

SEQ ID NO: 3193936 - RNA, 21 nt, Human
uccuaccacccgguccccacu

SEQ ID NO: 3193937 - RNA, 15 nt, Human
uccuacaagacacag

SEQ ID NO: 3193938 - RNA, 18 nt, Human
uccuaaucacucagagca

SEQ ID NO: 3193939 - RNA, 16 nt, Human
uccuaaucacucagag

SEQ ID NO: 3193940 - RNA, 15 nt, Human
uccuaaucacucaga

SEQ ID NO: 3193941 - RNA, 22 nt, Human
uccuaaugaaugcauaaaaugu

SEQ ID NO: 3193942 - RNA, 15 nt, Human
uccuaauuccacagc

SEQ ID NO: 3193943 - RNA, 14 nt, Human
uccuaauggugaug

SEQ ID NO: 3193944 - RNA, 17 nt, Human
uccuaauggugaugcag

SEQ ID NO: 3193945 - RNA, 16 nt, Human
uccuaauuccacagcu

SEQ ID NO: 3193946 - RNA, 17 nt, Human
uccuaauuccacagcug

SEQ ID NO: 3193947 - RNA, 18 nt, Human
uccuaauuccacagcugc

SEQ ID NO: 3193948 - RNA, 20 nt, Human
uccuaauggugaugcagucu

SEQ ID NO: 3193949 - RNA, 24 nt, Human
uccuaauggugaugcagucuuaga

SEQ ID NO: 3193950 - RNA, 18 nt, Human
uccuauauuguuuucagu

SEQ ID NO: 3193951 - RNA, 20 nt, Human
uccuauaccauuuccguaau

SEQ ID NO: 3193952 - RNA, 13 nt, Human
uccuauaccauuu

SEQ ID NO: 3193953 - RNA, 23 nt, Human
uccuauaauuuugauagugggac

SEQ ID NO: 3193954 - RNA, 22 nt, Human
uccuaguuccaccaucaagcca

SEQ ID NO: 3193955 - RNA, 13 nt, Human
uccuauuaguguu

SEQ ID NO: 3193956 - RNA, 14 nt, Human
uccuauuaguguua

SEQ ID NO: 3193957 - RNA, 17 nt, Human
uccuauuaguguuauau

SEQ ID NO: 3193958 - RNA, 19 nt, Human
uccuauuaguguuauauga

SEQ ID NO: 3193959 - RNA, 12 nt, Human
uccuauuagugu

SEQ ID NO: 3193960 - RNA, 12 nt, Human
uccucugcugcu

SEQ ID NO: 3193961 - RNA, 14 nt, Human
uccucugcugcugg

SEQ ID NO: 3193962 - RNA, 15 nt, Human
uccucugcugcuggc

SEQ ID NO: 3193963 - RNA, 16 nt, Human
uccucugcugcuggcu

SEQ ID NO: 3193964 - RNA, 16 nt, Human
uccucuguacagagcc

SEQ ID NO: 3193965 - RNA, 17 nt, Human
uccucuguacagagccc

SEQ ID NO: 3193966 - RNA, 18 nt, Human
uccucuguacagagccca

SEQ ID NO: 3193967 - RNA, 15 nt, Human
uccucuguacagagc

SEQ ID NO: 3193968 - RNA, 21 nt, Human
uccucuuccugaauuuuauuu

SEQ ID NO: 3193969 - RNA, 14 nt, Human
uccucuaggagguc

SEQ ID NO: 3193970 - RNA, 19 nt, Human
uccuccuuuucacaguucu

SEQ ID NO: 3193971 - RNA, 20 nt, Human
uccucggcuggcuguccacc

SEQ ID NO: 3193972 - RNA, 15 nt, Human
uccucgcuucuuuca

SEQ ID NO: 3193973 - RNA, 15 nt, Human
uccuccuucacuguu

SEQ ID NO: 3193974 - RNA, 16 nt, Human
uccuccuucacuguuu

SEQ ID NO: 3193975 - RNA, 21 nt, Human
uccuccagaacucuuccucca

SEQ ID NO: 3193976 - RNA, 18 nt, Human
uccuccagaacucuuccu

SEQ ID NO: 3193977 - RNA, 10 nt, Human
uccuccagaa

SEQ ID NO: 3193978 - RNA, 16 nt, Human
uccuccagaacucuuc

SEQ ID NO: 3193979 - RNA, 13 nt, Human
uccuccagaacuc

SEQ ID NO: 3193980 - RNA, 12 nt, Human
uccuccagaacu

SEQ ID NO: 3193981 - RNA, 11 nt, Human
uccuccagaac

SEQ ID NO: 3193982 - RNA, 18 nt, Human
ugcaacuuguaaaugugg

SEQ ID NO: 3193983 - RNA, 16 nt, Human
ugcaacuuguaaaugu

SEQ ID NO: 3193984 - RNA, 22 nt, Human
ugcaaccugauugugucucuug

SEQ ID NO: 3193985 - RNA, 18 nt, Human
ugcaaccuucgccaccug

SEQ ID NO: 3193986 - RNA, 21 nt, Human
ugcaaccuucgccaccugggu

SEQ ID NO: 3193987 - RNA, 19 nt, Human
ugcaaccuuguuuauuaaa

SEQ ID NO: 3193988 - RNA, 21 nt, Human
ugcaaccuccgccucuugggu

SEQ ID NO: 3193989 - RNA, 20 nt, Human
ugcaaccuccgccucuuggg

SEQ ID NO: 3193990 - RNA, 18 nt, Human
ugcaaccuccgccucuug

SEQ ID NO: 3193991 - RNA, 19 nt, Human
ugcaaccugauugugucuc

SEQ ID NO: 3193992 - RNA, 20 nt, Human
ugcaaccugauugugucucu

SEQ ID NO: 3193993 - RNA, 21 nt, Human
ugcaaccucuaccuccugggu

SEQ ID NO: 3193994 - RNA, 14 nt, Human
ugcaaccuccgccu

SEQ ID NO: 3193995 - RNA, 13 nt, Human
ugcaaccuccgcc

SEQ ID NO: 3193996 - RNA, 16 nt, Human
ugcaaccauuugaaac

SEQ ID NO: 3193997 - RNA, 20 nt, Human
ugcaacaggcugggcuucag

SEQ ID NO: 3193998 - RNA, 19 nt, Human
ugcaacaggcugggcuuca

SEQ ID NO: 3193999 - RNA, 13 nt, Human
ugcaaacauugga

SEQ ID NO: 3194000 - RNA, 20 nt, Human
ugcaaccaaacucccaucag

SEQ ID NO: 3194001 - RNA, 15 nt, Human
ugcaaccacugcaau

SEQ ID NO: 3194002 - RNA, 17 nt, Human
ugcaacaggcugggcuu

SEQ ID NO: 3194003 - RNA, 16 nt, Human
ugcaacaggcugggcu

SEQ ID NO: 3194004 - RNA, 15 nt, Human
ugcaacaggcugggc

SEQ ID NO: 3194005 - RNA, 14 nt, Human
ugcaacaggcuggg

SEQ ID NO: 3194006 - RNA, 13 nt, Human
ugcaacaggcugg

SEQ ID NO: 3194007 - RNA, 14 nt, Human
ugcaaaauuccuga

SEQ ID NO: 3194008 - RNA, 23 nt, Human
ugcaaaauacaugaugauuucag

SEQ ID NO: 3194009 - RNA, 21 nt, Human
ugauuuuugagcccuuguuuc

SEQ ID NO: 3194010 - RNA, 23 nt, Human
ugauuuuugagcccuuguuucag

SEQ ID NO: 3194011 - RNA, 14 nt, Human
ugauuuuuugaaag

SEQ ID NO: 3194012 - RNA, 18 nt, Human
ugauuuuuugaaaguuaa

SEQ ID NO: 3194013 - RNA, 23 nt, Human
ugauuuuuuuucccauuuagaau

SEQ ID NO: 3194014 - RNA, 22 nt, Human
ugauuuuuuuucccauuuagaa

SEQ ID NO: 3194015 - RNA, 16 nt, Human
ugauuuuuuuuuccuu

SEQ ID NO: 3194016 - RNA, 17 nt, Human
ugauuuuuuuuuccuuc

SEQ ID NO: 3194017 - RNA, 19 nt, Human
ugauuuuuuuuuccuucag

SEQ ID NO: 3194018 - RNA, 20 nt, Human
ugauuuuuuuuuccuucagu

SEQ ID NO: 3194019 - RNA, 22 nt, Human
ugauuuuuuuuuccuucagugc

SEQ ID NO: 3194020 - RNA, 23 nt, Human
ugauuuuuuuuuccuucagugcc

SEQ ID NO: 3194021 - RNA, 20 nt, Human
ugauuuuuuuuuuuaaucua

SEQ ID NO: 3194022 - RNA, 16 nt, Human
ugauuuuuuuuuuuca

SEQ ID NO: 3194023 - RNA, 22 nt, Human
ugcaaaaauccaaauauuguua

SEQ ID NO: 3194024 - RNA, 21 nt, Human
ugcaaaaauccaaauauuguu

SEQ ID NO: 3194025 - RNA, 18 nt, Human
ugcaaaaauccaaauauu

SEQ ID NO: 3194026 - RNA, 17 nt, Human
ugcaaaaauccaaauau

SEQ ID NO: 3194027 - RNA, 21 nt, Human
ugcaaaaaaucuuaauacugu

SEQ ID NO: 3194028 - RNA, 14 nt, Human
ugcaaaaaaucuua

SEQ ID NO: 3194029 - RNA, 19 nt, Human
ugcaaaaaaucuuaauacu

SEQ ID NO: 3194030 - RNA, 16 nt, Human
ugcaaaaaaucuuaau

SEQ ID NO: 3194031 - RNA, 21 nt, Human
ugcaaaaagcuagucaacagu

SEQ ID NO: 3194032 - RNA, 16 nt, Human
ugcaaaaagcuucugu

SEQ ID NO: 3194033 - RNA, 18 nt, Human
ugcaaaaagcuucugugg

SEQ ID NO: 3194034 - RNA, 14 nt, Human
ugcaaaaauaauca

SEQ ID NO: 3194035 - RNA, 17 nt, Human
ugcaaaaauaaucauga

SEQ ID NO: 3194036 - RNA, 13 nt, Human
ugauuuucauugc

SEQ ID NO: 3194037 - RNA, 15 nt, Human
ugauuuuauucuuga

SEQ ID NO: 3194038 - RNA, 14 nt, Human
ugauuuuauucuug

SEQ ID NO: 3194039 - RNA, 13 nt, Human
ugauuuuauucuu

SEQ ID NO: 3194040 - RNA, 12 nt, Human
ugauuuuauucu

SEQ ID NO: 3194041 - RNA, 15 nt, Human
ugauuuucauugcug

SEQ ID NO: 3194042 - RNA, 22 nt, Human
ugauuuuccaucuaaaaauaua

SEQ ID NO: 3194043 - RNA, 19 nt, Human
ugauuuuccaucuaaaaau

SEQ ID NO: 3194044 - RNA, 17 nt, Human
ugauuuuccaucuaaaa

SEQ ID NO: 3194045 - RNA, 16 nt, Human
ugauuuuauucuugau

SEQ ID NO: 3194046 - RNA, 17 nt, Human
ugauuuuaaauguguga

SEQ ID NO: 3194047 - RNA, 15 nt, Human
ugauuuuaaaugugu

SEQ ID NO: 3194048 - RNA, 13 nt, Human
ugauuuuaaaugu

SEQ ID NO: 3194049 - RNA, 13 nt, Human
ugaugugacauuu

SEQ ID NO: 3194050 - RNA, 12 nt, Human
ugaugugacauu

SEQ ID NO: 3194051 - RNA, 12 nt, Human
ugaugugaaacu

SEQ ID NO: 3194052 - RNA, 15 nt, Human
ugauguccuguaaac

SEQ ID NO: 3194053 - RNA, 19 nt, Human
ugauguccuguaaacacuc

SEQ ID NO: 3194054 - RNA, 21 nt, Human
ugauguccuguaaacacucag

SEQ ID NO: 3194055 - RNA, 18 nt, Human
ugaugugcucaucagaaa

SEQ ID NO: 3194056 - RNA, 19 nt, Human
ugaugugcucaucagaaac

SEQ ID NO: 3194057 - RNA, 16 nt, Human
ugaugugccugcuuca

SEQ ID NO: 3194058 - RNA, 20 nt, Human
ugaugugccuaaauaaguua

SEQ ID NO: 3194059 - RNA, 18 nt, Human
ugaugugacauuugucau

SEQ ID NO: 3194060 - RNA, 16 nt, Human
ugaugugacauuuguc

SEQ ID NO: 3194061 - RNA, 15 nt, Human
ugaugugacauuugu

SEQ ID NO: 3194062 - RNA, 14 nt, Human
ugaugugacauuug

SEQ ID NO: 3194063 - RNA, 22 nt, Human
ugcaauguagaggggaaaagag

SEQ ID NO: 3194064 - RNA, 15 nt, Human
ugcaaugugaaaaau

SEQ ID NO: 3194065 - RNA, 17 nt, Human
ugcaaugugaaaaaucu

SEQ ID NO: 3194066 - RNA, 19 nt, Human
ugcaauuaaacuuccaaag

SEQ ID NO: 3194067 - RNA, 20 nt, Human
ugcaauuaaacuuccaaaga

SEQ ID NO: 3194068 - RNA, 22 nt, Human
ugcaauuaaacuuccaaagaaa

SEQ ID NO: 3194069 - RNA, 23 nt, Human
ugcaauuaaacuuccaaagaaag

SEQ ID NO: 3194070 - RNA, 24 nt, Human
ugcaauuaaacuuccaaagaaagu

SEQ ID NO: 3194071 - RNA, 16 nt, Human
ugcaauggcagccuug

SEQ ID NO: 3194072 - RNA, 15 nt, Human
ugcaauggcagccuu

SEQ ID NO: 3194073 - RNA, 14 nt, Human
ugcaauggcagccu

SEQ ID NO: 3194074 - RNA, 13 nt, Human
ugcaauggcagcc

SEQ ID NO: 3194075 - RNA, 17 nt, Human
ugcaaugaccuuucaau

SEQ ID NO: 3194076 - RNA, 19 nt, Human
ugcaaugaccuuucaauag

SEQ ID NO: 3194077 - RNA, 22 nt, Human
ugcaaugaccuuucaauaggaa

SEQ ID NO: 3194078 - RNA, 23 nt, Human
ugcaaugaccuuucaauaggaaa

SEQ ID NO: 3194079 - RNA, 13 nt, Human
ugcaaugaccuuu

SEQ ID NO: 3194080 - RNA, 16 nt, Human
ugcaaugaccuuucaa

SEQ ID NO: 3194081 - RNA, 15 nt, Human
ugcacaaacagaggc

SEQ ID NO: 3194082 - RNA, 16 nt, Human
ugcacaaacagaggcc

SEQ ID NO: 3194083 - RNA, 17 nt, Human
ugcacaaacagaggccg

SEQ ID NO: 3194084 - RNA, 19 nt, Human
ugcacaaacagaggccgcc

SEQ ID NO: 3194085 - RNA, 20 nt, Human
ugcacaaacagaggccgcca

SEQ ID NO: 3194086 - RNA, 22 nt, Human
ugcaauuuuucuuucuuuuguu

SEQ ID NO: 3194087 - RNA, 22 nt, Human
ugcaauuuuauaaggacuuccu

SEQ ID NO: 3194088 - RNA, 17 nt, Human
ugcacaaagcccuucca

SEQ ID NO: 3194089 - RNA, 15 nt, Human
ugcacaaagcccuuc

SEQ ID NO: 3194090 - RNA, 13 nt, Human
ugcaccugggaca

SEQ ID NO: 3194091 - RNA, 21 nt, Human
ugcaccggcuggccuggcccc

SEQ ID NO: 3194092 - RNA, 19 nt, Human
ugcaccggcuggccuggcc

SEQ ID NO: 3194093 - RNA, 20 nt, Human
ugcaccggcuggccuggccc

SEQ ID NO: 3194094 - RNA, 18 nt, Human
ugcaccggcuggccuggc

SEQ ID NO: 3194095 - RNA, 17 nt, Human
ugcacagugcaucucag

SEQ ID NO: 3194096 - RNA, 16 nt, Human
ugcacagugcaucuca

SEQ ID NO: 3194097 - RNA, 15 nt, Human
ugcacagugcaucuc

SEQ ID NO: 3194098 - RNA, 21 nt, Human
ugcacaaauacggauccugca

SEQ ID NO: 3194099 - RNA, 16 nt, Human
ugcacugucaagauga

SEQ ID NO: 3194100 - RNA, 19 nt, Human
ugcacugaaguuugauaaa

SEQ ID NO: 3194101 - RNA, 16 nt, Human
ugcacugaaguuugau

SEQ ID NO: 3194102 - RNA, 24 nt, Human
ugcacugaaguuugauaaauagug

SEQ ID NO: 3194103 - RNA, 21 nt, Human
ugcacugacauuguuggccaa

SEQ ID NO: 3194104 - RNA, 18 nt, Human
ugcacugacauuguuggc

SEQ ID NO: 3194105 - RNA, 16 nt, Human
ugcacucucuuggcug

SEQ ID NO: 3194106 - RNA, 12 nt, Human
ugcacucuucua

SEQ ID NO: 3194107 - RNA, 23 nt, Human
ugcacucuuguuucucccgugcu

SEQ ID NO: 3194108 - RNA, 13 nt, Human
ugcacugaaguuu

SEQ ID NO: 3194109 - RNA, 10 nt, Human
ugcacugaag

SEQ ID NO: 3194110 - RNA, 15 nt, Human
ugcacuuaauuuguu

SEQ ID NO: 3194111 - RNA, 19 nt, Human
ugcagagguccacaacaca

SEQ ID NO: 3194112 - RNA, 22 nt, Human
ugccaucauguuuacagaggac

SEQ ID NO: 3194113 - RNA, 12 nt, Human
ugccauccaggu

SEQ ID NO: 3194114 - RNA, 15 nt, Human
ugccauccagguuca

SEQ ID NO: 3194115 - RNA, 17 nt, Human
ugccagguuuuuggucu

SEQ ID NO: 3194116 - RNA, 22 nt, Human
ugccaggugaaggaggcuccag

SEQ ID NO: 3194117 - RNA, 22 nt, Human
ugccaggucccuuucauuugcu

SEQ ID NO: 3194118 - RNA, 18 nt, Human
ugccaggucccuuucauu

SEQ ID NO: 3194119 - RNA, 12 nt, Human
ugccaggaagcc

SEQ ID NO: 3194120 - RNA, 16 nt, Human
ugccaggaagccagca

SEQ ID NO: 3194121 - RNA, 18 nt, Human
ugccaggaagccagcagg

SEQ ID NO: 3194122 - RNA, 19 nt, Human
ugccaggaagccagcaggc

SEQ ID NO: 3194123 - RNA, 20 nt, Human
ugccaugaggaacaaggcaa

SEQ ID NO: 3194124 - RNA, 23 nt, Human
ugccaugaggaacaaggcaaggc

SEQ ID NO: 3194125 - RNA, 14 nt, Human
ugccaugugccagg

SEQ ID NO: 3194126 - RNA, 18 nt, Human
ugccaugucagcgcucug

SEQ ID NO: 3194127 - RNA, 20 nt, Human
ugccaugucagcgcucuggu

SEQ ID NO: 3194128 - RNA, 15 nt, Human
ugccaugugccaggu

SEQ ID NO: 3194129 - RNA, 20 nt, Human
ugccaugugcuucugccacc

SEQ ID NO: 3194130 - RNA, 21 nt, Human
ugcccacucccugcaaccuga

SEQ ID NO: 3194131 - RNA, 20 nt, Human
ugcccacuccugcucugcuc

SEQ ID NO: 3194132 - RNA, 19 nt, Human
ugcccacuccugcucugcu

SEQ ID NO: 3194133 - RNA, 18 nt, Human
ugcccacuccugcucugc

SEQ ID NO: 3194134 - RNA, 14 nt, Human
ugcccacuccugcu

SEQ ID NO: 3194135 - RNA, 19 nt, Human
ugcccaccuggccucugca

SEQ ID NO: 3194136 - RNA, 18 nt, Human
ugcccacgcuggagugca

SEQ ID NO: 3194137 - RNA, 20 nt, Human
ugcccaccuggccucugcac

SEQ ID NO: 3194138 - RNA, 12 nt, Human
ugccauguuggc

SEQ ID NO: 3194139 - RNA, 15 nt, Human
ugccauguuggccag

SEQ ID NO: 3194140 - RNA, 21 nt, Human
ugcauuauauuuguaaauuua

SEQ ID NO: 3194141 - RNA, 14 nt, Human
ugcauuaaaagaaa

SEQ ID NO: 3194142 - RNA, 16 nt, Human
ugcauuaaaagaaaau

SEQ ID NO: 3194143 - RNA, 15 nt, Human
ugcauuaaaagaaaa

SEQ ID NO: 3194144 - RNA, 17 nt, Human
ugcauuaaaagaaaaua

SEQ ID NO: 3194145 - RNA, 15 nt, Human
ugccaccacgcccgg

SEQ ID NO: 3194146 - RNA, 16 nt, Human
ugccacauuuucuuaa

SEQ ID NO: 3194147 - RNA, 14 nt, Human
ugcauuuuaccauc

SEQ ID NO: 3194148 - RNA, 22 nt, Human
ugcauuugugcguaugcagugu

SEQ ID NO: 3194149 - RNA, 17 nt, Human
ugcaugguuuagaaagc

SEQ ID NO: 3194150 - RNA, 12 nt, Human
ugcauguaauca

SEQ ID NO: 3194151 - RNA, 16 nt, Human
ugcauguacuaucuua

SEQ ID NO: 3194152 - RNA, 15 nt, Human
ugcauguacuaucuu

SEQ ID NO: 3194153 - RNA, 21 nt, Human
ugcauguaaucaacauggcua

SEQ ID NO: 3194154 - RNA, 13 nt, Human
ugcauguaaucaa

SEQ ID NO: 3194155 - RNA, 19 nt, Human
ugcauguuacauaagauaa

SEQ ID NO: 3194156 - RNA, 19 nt, Human
ugcagauaaacaguaguga

SEQ ID NO: 3194157 - RNA, 14 nt, Human
ugcagaguauuucu

SEQ ID NO: 3194158 - RNA, 17 nt, Human
ugcagauaaacaguagu

SEQ ID NO: 3194159 - RNA, 23 nt, Human
ugcagauacuacugaccagacaa

SEQ ID NO: 3194160 - RNA, 19 nt, Human
ugcagauacuacugaccag

SEQ ID NO: 3194161 - RNA, 19 nt, Human
ugcagaguauuucuaaagu

SEQ ID NO: 3194162 - RNA, 14 nt, Human
ugcagaugccuggg

SEQ ID NO: 3194163 - RNA, 14 nt, Human
ugcauccuccgccu

SEQ ID NO: 3194164 - RNA, 16 nt, Human
ugccugguggcagcug

SEQ ID NO: 3194165 - RNA, 19 nt, Human
ugccugguggcagcugcgg

SEQ ID NO: 3194166 - RNA, 18 nt, Human
ugccugguggcagcugcg

SEQ ID NO: 3194167 - RNA, 17 nt, Human
ugccugguggcagcugc

SEQ ID NO: 3194168 - RNA, 21 nt, Human
ugccucuucucuacucuaggg

SEQ ID NO: 3194169 - RNA, 21 nt, Human
ugccucuggcucuacacauau

SEQ ID NO: 3194170 - RNA, 13 nt, Human
ugccucuuccucc

SEQ ID NO: 3194171 - RNA, 21 nt, Human
ugccuccuuugugaggaagcc

SEQ ID NO: 3194172 - RNA, 20 nt, Human
ugccuccuuugugaggaagc

SEQ ID NO: 3194173 - RNA, 22 nt, Human
ugccuccuuugugaggaagccg

SEQ ID NO: 3194174 - RNA, 13 nt, Human
ugccucugggacu

SEQ ID NO: 3194175 - RNA, 20 nt, Human
ugccucuggcucuacacaua

SEQ ID NO: 3194176 - RNA, 14 nt, Human
ugccucugccuguc

SEQ ID NO: 3194177 - RNA, 13 nt, Human
ugccucugccugu

SEQ ID NO: 3194178 - RNA, 18 nt, Human
ugccucugccugucuccc

SEQ ID NO: 3194179 - RNA, 12 nt, Human
ugccucugccug

SEQ ID NO: 3194180 - RNA, 18 nt, Human
ugcccagaaugaggcugc

SEQ ID NO: 3194181 - RNA, 17 nt, Human
ugcccagaaugaggcug

SEQ ID NO: 3194182 - RNA, 14 nt, Human
ugcccagaauacug

SEQ ID NO: 3194183 - RNA, 19 nt, Human
ugcccagaauacugaugga

SEQ ID NO: 3194184 - RNA, 16 nt, Human
ugcccagaauacugau

SEQ ID NO: 3194185 - RNA, 18 nt, Human
ugcccagaauacugaugg

SEQ ID NO: 3194186 - RNA, 22 nt, Human
ugcccugcccaccuggccucug

SEQ ID NO: 3194187 - RNA, 23 nt, Human
ugcccugcccaccuggccucugc

SEQ ID NO: 3194188 - RNA, 21 nt, Human
ugcccugcccaccuggccucu

SEQ ID NO: 3194189 - RNA, 19 nt, Human
ugcccugcgggucacagga

SEQ ID NO: 3194190 - RNA, 18 nt, Human
ugcccugcugagucccag

SEQ ID NO: 3194191 - RNA, 22 nt, Human
ugcccugcugagucccaggcug

SEQ ID NO: 3194192 - RNA, 23 nt, Human
ugcccugcugagucccaggcuga

SEQ ID NO: 3194193 - RNA, 13 nt, Human
ugcccugcuguuu

SEQ ID NO: 3194194 - RNA, 18 nt, Human
ugcccuggauccaucagg

SEQ ID NO: 3194195 - RNA, 14 nt, Human
ugcccugcuguuua

SEQ ID NO: 3194196 - RNA, 21 nt, Human
ugcccuggugcugccacacuu

SEQ ID NO: 3194197 - RNA, 18 nt, Human
ugcccuggugcugccaca

SEQ ID NO: 3194198 - RNA, 20 nt, Human
ugcccuggugcugccacacu

SEQ ID NO: 3194199 - RNA, 15 nt, Human
ugccgucuaccugag

SEQ ID NO: 3194200 - RNA, 16 nt, Human
ugccgucuaccugagg

SEQ ID NO: 3194201 - RNA, 17 nt, Human
ugccgucuaccugaggg

SEQ ID NO: 3194202 - RNA, 19 nt, Human
ugccgucuaccugaggggc

SEQ ID NO: 3194203 - RNA, 21 nt, Human
ugccggucuugacagcucagu

SEQ ID NO: 3194204 - RNA, 23 nt, Human
ugaggcugcuuuccaaagccaau

SEQ ID NO: 3194205 - RNA, 20 nt, Human
ugaggcugcuuuccaaagcc

SEQ ID NO: 3194206 - RNA, 16 nt, Human
ugaggcugcuuuccaa

SEQ ID NO: 3194207 - RNA, 11 nt, Human
ugaggcugggc

SEQ ID NO: 3194208 - RNA, 19 nt, Human
ugaggacauggcuucugaa

SEQ ID NO: 3194209 - RNA, 23 nt, Human
ugaggacuuaaaauauuccugca

SEQ ID NO: 3194210 - RNA, 19 nt, Human
ugagguggaagagggcugc

SEQ ID NO: 3194211 - RNA, 15 nt, Human
ugaggugcuauguuc

SEQ ID NO: 3194212 - RNA, 16 nt, Human
ugaggugcuauguucu

SEQ ID NO: 3194213 - RNA, 19 nt, Human
ugagguuucaaaccucccu

SEQ ID NO: 3194214 - RNA, 21 nt, Human
ugaguccccuguuuguuucug

SEQ ID NO: 3194215 - RNA, 19 nt, Human
ugaguccuggcaugggaau

SEQ ID NO: 3194216 - RNA, 22 nt, Human
ugaguccuggcaugggaaugaa

SEQ ID NO: 3194217 - RNA, 14 nt, Human
ugagucgaggacag

SEQ ID NO: 3194218 - RNA, 23 nt, Human
ugaguccuccagaacucuuccuc

SEQ ID NO: 3194219 - RNA, 11 nt, Human
ugaguccuggc

SEQ ID NO: 3194220 - RNA, 18 nt, Human
ugaguccuggcaugggaa

SEQ ID NO: 3194221 - RNA, 20 nt, Human
ugaguccccuguuuguuucu

SEQ ID NO: 3194222 - RNA, 12 nt, Human
ugaguccuccag

SEQ ID NO: 3194223 - RNA, 17 nt, Human
ugaguccuccagaacuc

SEQ ID NO: 3194224 - RNA, 16 nt, Human
ugaguccuccagaacu

SEQ ID NO: 3194225 - RNA, 15 nt, Human
ugaguccuccagaac

SEQ ID NO: 3194226 - RNA, 14 nt, Human
ugaguccuccagaa

SEQ ID NO: 3194227 - RNA, 14 nt, Human
ugaguuggcuggga

SEQ ID NO: 3194228 - RNA, 16 nt, Human
ugaguuggcugggaau

SEQ ID NO: 3194229 - RNA, 16 nt, Human
ugaguugauucagcuc

SEQ ID NO: 3194230 - RNA, 19 nt, Human
ugaguugauucagcucugc

SEQ ID NO: 3194231 - RNA, 21 nt, Human
ugaguugauagcacagacccu

SEQ ID NO: 3194232 - RNA, 23 nt, Human
ugaguugauagcacagacccugc

SEQ ID NO: 3194233 - RNA, 16 nt, Human
ugagucgaggacaggg

SEQ ID NO: 3194234 - RNA, 15 nt, Human
ugagucgaggacagg

SEQ ID NO: 3194235 - RNA, 17 nt, Human
ugaguuggcugggaaua

SEQ ID NO: 3194236 - RNA, 22 nt, Human
ugaguuguuaccccaagcgccc

SEQ ID NO: 3194237 - RNA, 15 nt, Human
ugaguuguuuuugua

SEQ ID NO: 3194238 - RNA, 16 nt, Human
ugaguuguuuuuguau

SEQ ID NO: 3194239 - RNA, 14 nt, Human
ugaguuguuuuugu

SEQ ID NO: 3194240 - RNA, 17 nt, Human
ugaguuguuuuuguaua

SEQ ID NO: 3194241 - RNA, 18 nt, Human
ugaguuguuuuuguauau

SEQ ID NO: 3194242 - RNA, 13 nt, Human
ugauaaaaucaua

SEQ ID NO: 3194243 - RNA, 12 nt, Human
ugauaaaaucau

SEQ ID NO: 3194244 - RNA, 20 nt, Human
ugaguuguuuuuguauauug

SEQ ID NO: 3194245 - RNA, 13 nt, Human
ugauaaaaauacu

SEQ ID NO: 3194246 - RNA, 17 nt, Human
ugauagcacagacccug

SEQ ID NO: 3194247 - RNA, 18 nt, Human
ugauagcacagacccugc

SEQ ID NO: 3194248 - RNA, 20 nt, Human
ugauagcacagacccugccc

SEQ ID NO: 3194249 - RNA, 21 nt, Human
ugauagcacagacccugcccu

SEQ ID NO: 3194250 - RNA, 14 nt, Human
ugauagcacagacc

SEQ ID NO: 3194251 - RNA, 14 nt, Human
ugauaaauaguguu

SEQ ID NO: 3194252 - RNA, 19 nt, Human
ugauaaauaguguuauuga

SEQ ID NO: 3194253 - RNA, 17 nt, Human
ugauaaauaguguuauu

SEQ ID NO: 3194254 - RNA, 21 nt, Human
ugauaaauauucacacuugaa

SEQ ID NO: 3194255 - RNA, 15 nt, Human
ugauagcacagaccc

SEQ ID NO: 3194256 - RNA, 16 nt, Human
ugauagcacagacccu

SEQ ID NO: 3194257 - RNA, 22 nt, Human
ugauagcacagacccugcccug

SEQ ID NO: 3194258 - RNA, 23 nt, Human
ugauagcacagacccugcccugu

SEQ ID NO: 3194259 - RNA, 21 nt, Human
ugauagccccucuccccgcag

SEQ ID NO: 3194260 - RNA, 14 nt, Human
ugauagcauuguaa

SEQ ID NO: 3194261 - RNA, 16 nt, Human
ugauagcauuguaagc

SEQ ID NO: 3194262 - RNA, 17 nt, Human
ugauaaauuugacuguu

SEQ ID NO: 3194263 - RNA, 23 nt, Human
ugauagcauaugacaaauguuuc

SEQ ID NO: 3194264 - RNA, 15 nt, Human
ugauagcauaugaca

SEQ ID NO: 3194265 - RNA, 14 nt, Human
ugauaguugaaugu

SEQ ID NO: 3194266 - RNA, 17 nt, Human
ugauaguugaauguugc

SEQ ID NO: 3194267 - RNA, 22 nt, Human
ugauagguuauuuugauguaaa

SEQ ID NO: 3194268 - RNA, 18 nt, Human
ugauagguauaaguggug

SEQ ID NO: 3194269 - RNA, 14 nt, Human
ugaugaaaauauuu

SEQ ID NO: 3194270 - RNA, 22 nt, Human
ugaugaucuuugcagacaggca

SEQ ID NO: 3194271 - RNA, 20 nt, Human
ugaugaugaaaugaggucag

SEQ ID NO: 3194272 - RNA, 23 nt, Human
ugaugaucuuugcagacaggcaa

SEQ ID NO: 3194273 - RNA, 14 nt, Human
ugaugccaugagga

SEQ ID NO: 3194274 - RNA, 20 nt, Human
ugaucuuugcagacaggcaa

SEQ ID NO: 3194275 - RNA, 19 nt, Human
ugaucuuugcagacaggca

SEQ ID NO: 3194276 - RNA, 21 nt, Human
ugaucugaugcaagcaagaaa

SEQ ID NO: 3194277 - RNA, 23 nt, Human
ugaucuuugcagacaggcaagca

SEQ ID NO: 3194278 - RNA, 21 nt, Human
ugaucuuugcagacaggcaag

SEQ ID NO: 3194279 - RNA, 18 nt, Human
ugaucuuugcagacaggc

SEQ ID NO: 3194280 - RNA, 16 nt, Human
ugaugaaaagcuuugu

SEQ ID NO: 3194281 - RNA, 14 nt, Human
ugaugaaaagcuuu

SEQ ID NO: 3194282 - RNA, 23 nt, Human
ugaugaaaagcuuuguuuguucu

SEQ ID NO: 3194283 - RNA, 22 nt, Human
ugaugaaaagcuuuguuuguuc

SEQ ID NO: 3194284 - RNA, 19 nt, Human
ugaugcuaucaguuuuaua

SEQ ID NO: 3194285 - RNA, 22 nt, Human
ugaugcucuuucccacccagcc

SEQ ID NO: 3194286 - RNA, 19 nt, Human
ugaugcucuuucccaccca

SEQ ID NO: 3194287 - RNA, 15 nt, Human
ugaugcucuuuccca

SEQ ID NO: 3194288 - RNA, 18 nt, Human
ugaugcuucuucagagac

SEQ ID NO: 3194289 - RNA, 22 nt, Human
ugaugcuggaacucuugacagc

SEQ ID NO: 3194290 - RNA, 18 nt, Human
ugaugcuggaacucuuga

SEQ ID NO: 3194291 - RNA, 19 nt, Human
ugaugcuucuucagagacu

SEQ ID NO: 3194292 - RNA, 21 nt, Human
ugaugcuucuucagagacucc

SEQ ID NO: 3194293 - RNA, 22 nt, Human
ugaugcuucuucagagacuccu

SEQ ID NO: 3194294 - RNA, 18 nt, Human
ugaugguuuccaauuuca

SEQ ID NO: 3194295 - RNA, 12 nt, Human
ugauguacugua

SEQ ID NO: 3194296 - RNA, 19 nt, Human
ugaugucccaacuuguaaa

SEQ ID NO: 3194297 - RNA, 24 nt, Human
ugauaguuguaccgcaaugugacu

SEQ ID NO: 3194298 - RNA, 14 nt, Human
ugauaguugugugu

SEQ ID NO: 3194299 - RNA, 15 nt, Human
ugauauaaacagcuu

SEQ ID NO: 3194300 - RNA, 13 nt, Human
ugauauaaacagc

SEQ ID NO: 3194301 - RNA, 17 nt, Human
ugauauauuuaaaaaca

SEQ ID NO: 3194302 - RNA, 21 nt, Human
ugauauaucucaaauuguaau

SEQ ID NO: 3194303 - RNA, 16 nt, Human
ugauauaucucaaauu

SEQ ID NO: 3194304 - RNA, 15 nt, Human
ugauauaucucaaau

SEQ ID NO: 3194305 - RNA, 16 nt, Human
ugauauaacuuuagaa

SEQ ID NO: 3194306 - RNA, 17 nt, Human
ugauauaacuuuagaaa

SEQ ID NO: 3194307 - RNA, 15 nt, Human
ugauauaccaaauua

SEQ ID NO: 3194308 - RNA, 16 nt, Human
ugauauaccaaauuaa

SEQ ID NO: 3194309 - RNA, 20 nt, Human
ugauauaccaaauuaaaaaa

SEQ ID NO: 3194310 - RNA, 22 nt, Human
ugaucacggcucacugcagccu

SEQ ID NO: 3194311 - RNA, 16 nt, Human
ugaucacugaaauaaa

SEQ ID NO: 3194312 - RNA, 14 nt, Human
ugaucacugaaaua

SEQ ID NO: 3194313 - RNA, 21 nt, Human
ugaucacggcucacugcagcc

SEQ ID NO: 3194314 - RNA, 16 nt, Human
ugaucacuuaucaguu

SEQ ID NO: 3194315 - RNA, 21 nt, Human
ugaucagaccaaacagugcug

SEQ ID NO: 3194316 - RNA, 24 nt, Human
ugaucacuuucugaaauucacaaa

SEQ ID NO: 3194317 - RNA, 19 nt, Human
ugauccacccaccucagcc

SEQ ID NO: 3194318 - RNA, 20 nt, Human
ugauccacccaccucagccu

SEQ ID NO: 3194319 - RNA, 15 nt, Human
ugauccacccaccuc

SEQ ID NO: 3194320 - RNA, 21 nt, Human
ugauccaagcuggucccacuc

SEQ ID NO: 3194321 - RNA, 17 nt, Human
ugauccaagcugguccc

SEQ ID NO: 3194322 - RNA, 24 nt, Human
ugaucauccacugugccaugugcc

SEQ ID NO: 3194323 - RNA, 13 nt, Human
ugaucauccacug

SEQ ID NO: 3194324 - RNA, 23 nt, Human
ugaucaguaguuugcauuucaga

SEQ ID NO: 3194325 - RNA, 22 nt, Human
ugaucaguaguuugcauuucag

SEQ ID NO: 3194326 - RNA, 21 nt, Human
ugaucaguaguuugcauuuca

SEQ ID NO: 3194327 - RNA, 15 nt, Human
ugaucuaggaagacu

SEQ ID NO: 3194328 - RNA, 17 nt, Human
ugaucucucgugauuga

SEQ ID NO: 3194329 - RNA, 20 nt, Human
ugaucugaugcaagcaagaa

SEQ ID NO: 3194330 - RNA, 19 nt, Human
ugaucuaggaagacuuugg

SEQ ID NO: 3194331 - RNA, 21 nt, Human
ugaucuaggaagacuuuggaa

SEQ ID NO: 3194332 - RNA, 22 nt, Human
ugauccacccaccucagccucc

SEQ ID NO: 3194333 - RNA, 21 nt, Human
ugauccacccaccucagccuc

SEQ ID NO: 3194334 - RNA, 23 nt, Human
ucuugaauggcaauguuuugcuu

SEQ ID NO: 3194335 - RNA, 22 nt, Human
ucuugaauggcaauguuuugcu

SEQ ID NO: 3194336 - RNA, 14 nt, Human
ucuugaauauaaaa

SEQ ID NO: 3194337 - RNA, 15 nt, Human
ucuugaauauaaaaa

SEQ ID NO: 3194338 - RNA, 16 nt, Human
ucuugaaccagaacca

SEQ ID NO: 3194339 - RNA, 15 nt, Human
ucuugaacuccuggc

SEQ ID NO: 3194340 - RNA, 20 nt, Human
ugaccauucuccaccugcca

SEQ ID NO: 3194341 - RNA, 21 nt, Human
ugaccauucuccaccugccag

SEQ ID NO: 3194342 - RNA, 22 nt, Human
ugaccauucuccaccugccagg

SEQ ID NO: 3194343 - RNA, 19 nt, Human
ugaccauucuccaccugcc

SEQ ID NO: 3194344 - RNA, 22 nt, Human
ucuugaauguugaagaacucau

SEQ ID NO: 3194345 - RNA, 23 nt, Human
ugaccucaauuucaauuuugucu

SEQ ID NO: 3194346 - RNA, 17 nt, Human
ugaccucaauuucaauu

SEQ ID NO: 3194347 - RNA, 21 nt, Human
ugaccucaaaugaugugccug

SEQ ID NO: 3194348 - RNA, 12 nt, Human
ugaccucugccu

SEQ ID NO: 3194349 - RNA, 15 nt, Human
ugaccuuucaauagg

SEQ ID NO: 3194350 - RNA, 16 nt, Human
ugaccuuucaauagga

SEQ ID NO: 3194351 - RNA, 14 nt, Human
ugaccuuucaauag

SEQ ID NO: 3194352 - RNA, 13 nt, Human
ugaccuuucaaua

SEQ ID NO: 3194353 - RNA, 20 nt, Human
ugaccucuagcccugcccgg

SEQ ID NO: 3194354 - RNA, 19 nt, Human
ugaccucuagcccugcccg

SEQ ID NO: 3194355 - RNA, 22 nt, Human
ugaccucaggugauccacccac

SEQ ID NO: 3194356 - RNA, 18 nt, Human
ugaccucaccuaggaagu

SEQ ID NO: 3194357 - RNA, 16 nt, Human
ugaccucacucagaag

SEQ ID NO: 3194358 - RNA, 14 nt, Human
ugaccucacgugca

SEQ ID NO: 3194359 - RNA, 15 nt, Human
ugaccuccggccagg

SEQ ID NO: 3194360 - RNA, 19 nt, Human
ugaccuccggccaggugcc

SEQ ID NO: 3194361 - RNA, 24 nt, Human
ugaccuccggccaggugccuccug

SEQ ID NO: 3194362 - RNA, 16 nt, Human
ugacucugcucuugca

SEQ ID NO: 3194363 - RNA, 12 nt, Human
ugacucugcucu

SEQ ID NO: 3194364 - RNA, 18 nt, Human
ugacguacaaguaguucu

SEQ ID NO: 3194365 - RNA, 23 nt, Human
ugacgguuccuacacaggacagg

SEQ ID NO: 3194366 - RNA, 19 nt, Human
ugacguacaaguaguucug

SEQ ID NO: 3194367 - RNA, 21 nt, Human
ugacguacaaguaguucugua

SEQ ID NO: 3194368 - RNA, 12 nt, Human
ugacgguuccua

SEQ ID NO: 3194369 - RNA, 20 nt, Human
ugacgguuccuacacaggac

SEQ ID NO: 3194370 - RNA, 18 nt, Human
ugacgguuccuacacagg

SEQ ID NO: 3194371 - RNA, 22 nt, Human
ugacguacaaguaguucuguau

SEQ ID NO: 3194372 - RNA, 23 nt, Human
ugacguacaaguaguucuguauu

SEQ ID NO: 3194373 - RNA, 19 nt, Human
ugacgucuagcuaugcugu

SEQ ID NO: 3194374 - RNA, 19 nt, Human
ugacugaggcaguuugagg

SEQ ID NO: 3194375 - RNA, 13 nt, Human
ugacugaggcagu

SEQ ID NO: 3194376 - RNA, 18 nt, Human
ugacugaggcaguuugag

SEQ ID NO: 3194377 - RNA, 13 nt, Human
ugacgccauccca

SEQ ID NO: 3194378 - RNA, 14 nt, Human
ugacgccaucccag

SEQ ID NO: 3194379 - RNA, 15 nt, Human
ugacgccaucccagc

SEQ ID NO: 3194380 - RNA, 16 nt, Human
ugacgccaucccagcc

SEQ ID NO: 3194381 - RNA, 18 nt, Human
ugaccuuucaauaggaaa

SEQ ID NO: 3194382 - RNA, 22 nt, Human
ugaccuuucaauaggaaaaacu

SEQ ID NO: 3194383 - RNA, 17 nt, Human
ugacgccaucccagccc

SEQ ID NO: 3194384 - RNA, 18 nt, Human
ugacgccaucccagcccc

SEQ ID NO: 3194385 - RNA, 19 nt, Human
ugacgccaucccagcccca

SEQ ID NO: 3194386 - RNA, 20 nt, Human
ugacgccaucccagccccaa

SEQ ID NO: 3194387 - RNA, 15 nt, Human
ugagaaagacuauuc

SEQ ID NO: 3194388 - RNA, 18 nt, Human
ugagaaagacuauucaaa

SEQ ID NO: 3194389 - RNA, 17 nt, Human
ugagaaagacuauucaa

SEQ ID NO: 3194390 - RNA, 16 nt, Human
ugagaaagacuauuca

SEQ ID NO: 3194391 - RNA, 22 nt, Human
ugacuguacuccucccaggcgc

SEQ ID NO: 3194392 - RNA, 18 nt, Human
ugacuguacuccucccag

SEQ ID NO: 3194393 - RNA, 17 nt, Human
ugacuguacuccuccca

SEQ ID NO: 3194394 - RNA, 16 nt, Human
ugacuguacuccuccc

SEQ ID NO: 3194395 - RNA, 14 nt, Human
ugagacagcucugc

SEQ ID NO: 3194396 - RNA, 16 nt, Human
ugagacagcucugcau

SEQ ID NO: 3194397 - RNA, 12 nt, Human
ugagacagcucu

SEQ ID NO: 3194398 - RNA, 14 nt, Human
ugagacagugaauu

SEQ ID NO: 3194399 - RNA, 15 nt, Human
ugagacagugaauuu

SEQ ID NO: 3194400 - RNA, 16 nt, Human
ugagacagugaauuug

SEQ ID NO: 3194401 - RNA, 17 nt, Human
ugagacagugaauuugg

SEQ ID NO: 3194402 - RNA, 12 nt, Human
ugagacccuguc

SEQ ID NO: 3194403 - RNA, 20 nt, Human
ugagaccgugaagauacuuu

SEQ ID NO: 3194404 - RNA, 23 nt, Human
ugagaccgugaagauacuuugua

SEQ ID NO: 3194405 - RNA, 12 nt, Human
ugagacucuguc

SEQ ID NO: 3194406 - RNA, 14 nt, Human
ugagacucugucuc

SEQ ID NO: 3194407 - RNA, 13 nt, Human
ugagacucugucu

SEQ ID NO: 3194408 - RNA, 23 nt, Human
ugagaggcauccaguaucuugaa

SEQ ID NO: 3194409 - RNA, 22 nt, Human
ugagaggcauccaguaucuuga

SEQ ID NO: 3194410 - RNA, 17 nt, Human
ugagaguagagucacug

SEQ ID NO: 3194411 - RNA, 17 nt, Human
ugagaggggaggccaag

SEQ ID NO: 3194412 - RNA, 21 nt, Human
ugagaggggagagcugaacag

SEQ ID NO: 3194413 - RNA, 19 nt, Human
ugagaggggagagcugaac

SEQ ID NO: 3194414 - RNA, 14 nt, Human
ugagaggggagagc

SEQ ID NO: 3194415 - RNA, 19 nt, Human
ugagaggggaacagacugg

SEQ ID NO: 3194416 - RNA, 13 nt, Human
ugagaggggagag

SEQ ID NO: 3194417 - RNA, 15 nt, Human
ugagaucagccuggg

SEQ ID NO: 3194418 - RNA, 17 nt, Human
ugagaugagaggggaga

SEQ ID NO: 3194419 - RNA, 12 nt, Human
ugagaucuaaaa

SEQ ID NO: 3194420 - RNA, 23 nt, Human
ugagaucuaaaaauaacuguaau

SEQ ID NO: 3194421 - RNA, 22 nt, Human
ugagaucuaaaaauaacuguaa

SEQ ID NO: 3194422 - RNA, 16 nt, Human
ugagaucuaaaaauaa

SEQ ID NO: 3194423 - RNA, 15 nt, Human
ugagaucuaaaaaua

SEQ ID NO: 3194424 - RNA, 14 nt, Human
ugagaugcuagaac

SEQ ID NO: 3194425 - RNA, 16 nt, Human
ugagaugauuuccaag

SEQ ID NO: 3194426 - RNA, 21 nt, Human
ugagaugauuuccaagccucu

SEQ ID NO: 3194427 - RNA, 16 nt, Human
ugagaugcuagaacuc

SEQ ID NO: 3194428 - RNA, 13 nt, Human
ugagcaucaggcc

SEQ ID NO: 3194429 - RNA, 14 nt, Human
ugagcaucaggcca

SEQ ID NO: 3194430 - RNA, 15 nt, Human
ugagcaucaggccag

SEQ ID NO: 3194431 - RNA, 22 nt, Human
ugagcccauguggagucagccu

SEQ ID NO: 3194432 - RNA, 21 nt, Human
ugagcccauguggagucagcc

SEQ ID NO: 3194433 - RNA, 19 nt, Human
ugagcccacugugcguggg

SEQ ID NO: 3194434 - RNA, 12 nt, Human
ugagcccacugu

SEQ ID NO: 3194435 - RNA, 20 nt, Human
ugagccuaaaaauaaagcac

SEQ ID NO: 3194436 - RNA, 18 nt, Human
ugagccuaaaaauaaagc

SEQ ID NO: 3194437 - RNA, 16 nt, Human
ugagccuaaaaauaaa

SEQ ID NO: 3194438 - RNA, 14 nt, Human
ugagccuaaaaaua

SEQ ID NO: 3194439 - RNA, 13 nt, Human
ugagccuaaaaau

SEQ ID NO: 3194440 - RNA, 13 nt, Human
ugagccucagcau

SEQ ID NO: 3194441 - RNA, 19 nt, Human
ugagcucccacuucugcca

SEQ ID NO: 3194442 - RNA, 20 nt, Human
ugagcucccacuucugccag

SEQ ID NO: 3194443 - RNA, 21 nt, Human
ugagcucccacuucugccaga

SEQ ID NO: 3194444 - RNA, 13 nt, Human
ugucaucucagcu

SEQ ID NO: 3194445 - RNA, 17 nt, Human
uguccccgcacugggcu

SEQ ID NO: 3194446 - RNA, 19 nt, Human
uguccccgcacugggcuug

SEQ ID NO: 3194447 - RNA, 13 nt, Human
uguccccuauccu

SEQ ID NO: 3194448 - RNA, 13 nt, Human
ugucaucugagaa

SEQ ID NO: 3194449 - RNA, 17 nt, Human
uguccccgacccuugcc

SEQ ID NO: 3194450 - RNA, 16 nt, Human
uguccuauuaguguua

SEQ ID NO: 3194451 - RNA, 17 nt, Human
uguccuauuaguguuau

SEQ ID NO: 3194452 - RNA, 22 nt, Human
uguccugccuaaggcugaacuu

SEQ ID NO: 3194453 - RNA, 20 nt, Human
uguccugggagugagcuggu

SEQ ID NO: 3194454 - RNA, 19 nt, Human
uguccugggagugagcugg

SEQ ID NO: 3194455 - RNA, 12 nt, Human
uguccugggagu

SEQ ID NO: 3194456 - RNA, 14 nt, Human
ugucuaaugaaacc

SEQ ID NO: 3194457 - RNA, 21 nt, Human
ugucucaaaaaaagaaaaaga

SEQ ID NO: 3194458 - RNA, 18 nt, Human
ugucucaagagggcacug

SEQ ID NO: 3194459 - RNA, 17 nt, Human
ugucucaagagggcacu

SEQ ID NO: 3194460 - RNA, 12 nt, Human
ugucuauugucc

SEQ ID NO: 3194461 - RNA, 18 nt, Human
ugucuauuguccaaaguu

SEQ ID NO: 3194462 - RNA, 21 nt, Human
ugucuagcacuuccuugccag

SEQ ID NO: 3194463 - RNA, 18 nt, Human
ugucuagcacuuccuugc

SEQ ID NO: 3194464 - RNA, 16 nt, Human
ugucuagcacuuccuu

SEQ ID NO: 3194465 - RNA, 15 nt, Human
ugucuagcacuuccu

SEQ ID NO: 3194466 - RNA, 15 nt, Human
ugucuaguuguuuga

SEQ ID NO: 3194467 - RNA, 23 nt, Human
ugucuaguuguuugauucagaca

SEQ ID NO: 3194468 - RNA, 16 nt, Human
ugucuaugggacucaa

SEQ ID NO: 3194469 - RNA, 15 nt, Human
ugucuaugggacuca

SEQ ID NO: 3194470 - RNA, 14 nt, Human
ugucuaugggacuc

SEQ ID NO: 3194471 - RNA, 23 nt, Human
ugucuuuggacccugaggcccag

SEQ ID NO: 3194472 - RNA, 18 nt, Human
ugucuuaauggaugaaau

SEQ ID NO: 3194473 - RNA, 16 nt, Human
ugucuuaauggaugaa

SEQ ID NO: 3194474 - RNA, 16 nt, Human
ugucuuuucuugcaug

SEQ ID NO: 3194475 - RNA, 16 nt, Human
ugucuguuguauucau

SEQ ID NO: 3194476 - RNA, 20 nt, Human
ugucugaagucacugcacag

SEQ ID NO: 3194477 - RNA, 15 nt, Human
ugucugaguuuggua

SEQ ID NO: 3194478 - RNA, 16 nt, Human
ugucugucugguccau

SEQ ID NO: 3194479 - RNA, 12 nt, Human
ugucugucuucc

SEQ ID NO: 3194480 - RNA, 14 nt, Human
ugucugucuuccuu

SEQ ID NO: 3194481 - RNA, 21 nt, Human
ugucugcacaccuugaaucug

SEQ ID NO: 3194482 - RNA, 19 nt, Human
uguaugcuucauacaggga

SEQ ID NO: 3194483 - RNA, 16 nt, Human
uguaugcuucauacag

SEQ ID NO: 3194484 - RNA, 14 nt, Human
uguaugcuucauac

SEQ ID NO: 3194485 - RNA, 13 nt, Human
uguaugcuucaua

SEQ ID NO: 3194486 - RNA, 13 nt, Human
uguaugcgugugu

SEQ ID NO: 3194487 - RNA, 22 nt, Human
uguaugguccauagcacuguau

SEQ ID NO: 3194488 - RNA, 15 nt, Human
uguauguaaauaggu

SEQ ID NO: 3194489 - RNA, 15 nt, Human
uguauggccaggaag

SEQ ID NO: 3194490 - RNA, 19 nt, Human
ugucaauuacaggaaguac

SEQ ID NO: 3194491 - RNA, 14 nt, Human
ugucacaggcaggu

SEQ ID NO: 3194492 - RNA, 21 nt, Human
ugucaauuacaggaaguacug

SEQ ID NO: 3194493 - RNA, 16 nt, Human
ugucagugugacugau

SEQ ID NO: 3194494 - RNA, 19 nt, Human
ugucagugugacugaucuc

SEQ ID NO: 3194495 - RNA, 15 nt, Human
ugucagugugacuga

SEQ ID NO: 3194496 - RNA, 14 nt, Human
ugucagugugacug

SEQ ID NO: 3194497 - RNA, 21 nt, Human
ugucacaggcagguccagggu

SEQ ID NO: 3194498 - RNA, 17 nt, Human
ugucacaggcaggucca

SEQ ID NO: 3194499 - RNA, 16 nt, Human
ugucacaggcaggucc

SEQ ID NO: 3194500 - RNA, 15 nt, Human
ugucacaggcagguc

SEQ ID NO: 3194501 - RNA, 13 nt, Human
ugucacaggcagg

SEQ ID NO: 3194502 - RNA, 18 nt, Human
ugucacaggguguucuuu

SEQ ID NO: 3194503 - RNA, 16 nt, Human
ugucacaguaaaaaua

SEQ ID NO: 3194504 - RNA, 17 nt, Human
ugucacaguaaaaauaa

SEQ ID NO: 3194505 - RNA, 18 nt, Human
ugucacaguaaaaauaaa

SEQ ID NO: 3194506 - RNA, 23 nt, Human
ugucacaguaaaaauaaaauacu

SEQ ID NO: 3194507 - RNA, 16 nt, Human
uguagcuucagucauu

SEQ ID NO: 3194508 - RNA, 18 nt, Human
uguagcuucagucauuaa

SEQ ID NO: 3194509 - RNA, 19 nt, Human
uguagcuucagucauuaaa

SEQ ID NO: 3194510 - RNA, 21 nt, Human
uguacagagcccacgccccca

SEQ ID NO: 3194511 - RNA, 12 nt, Human
uguacagagccc

SEQ ID NO: 3194512 - RNA, 22 nt, Human
uguacagagccguaaaaacuga

SEQ ID NO: 3194513 - RNA, 21 nt, Human
uguacagagccguaaaaacug

SEQ ID NO: 3194514 - RNA, 14 nt, Human
uguauaaggacagu

SEQ ID NO: 3194515 - RNA, 18 nt, Human
uguauagcucuuuuccua

SEQ ID NO: 3194516 - RNA, 23 nt, Human
uguauagccaaaugacugaaagc

SEQ ID NO: 3194517 - RNA, 15 nt, Human
uguauaaauugucuu

SEQ ID NO: 3194518 - RNA, 14 nt, Human
uguauaaauuuauu

SEQ ID NO: 3194519 - RNA, 19 nt, Human
uguauaaaggugugcugug

SEQ ID NO: 3194520 - RNA, 13 nt, Human
uguaucugagcag

SEQ ID NO: 3194521 - RNA, 15 nt, Human
uguaucugaaaguca

SEQ ID NO: 3194522 - RNA, 14 nt, Human
uguaucugugcuuu

SEQ ID NO: 3194523 - RNA, 22 nt, Human
uguaugaaagauggcugugccu

SEQ ID NO: 3194524 - RNA, 14 nt, Human
uguaugaaauauau

SEQ ID NO: 3194525 - RNA, 16 nt, Human
uguaugaaauauaugu

SEQ ID NO: 3194526 - RNA, 18 nt, Human
uguaugaaauauauguga

SEQ ID NO: 3194527 - RNA, 19 nt, Human
uguaugaaaacauggaaca

SEQ ID NO: 3194528 - RNA, 13 nt, Human
uguaugaaaacau

SEQ ID NO: 3194529 - RNA, 17 nt, Human
uguaacauucuauuuca

SEQ ID NO: 3194530 - RNA, 17 nt, Human
uguaaccacaacuuuca

SEQ ID NO: 3194531 - RNA, 18 nt, Human
uguaaccacaacuuucac

SEQ ID NO: 3194532 - RNA, 17 nt, Human
uguaaauuuaugugaug

SEQ ID NO: 3194533 - RNA, 14 nt, Human
uguaacaagccacc

SEQ ID NO: 3194534 - RNA, 17 nt, Human
uguaacaagccacccca

SEQ ID NO: 3194535 - RNA, 13 nt, Human
uguaacaagaaaa

SEQ ID NO: 3194536 - RNA, 14 nt, Human
uguaacaagaaaau

SEQ ID NO: 3194537 - RNA, 19 nt, Human
uguaauaauaaagaauagc

SEQ ID NO: 3194538 - RNA, 12 nt, Human
uguaauaaugga

SEQ ID NO: 3194539 - RNA, 14 nt, Human
uguacagacaacaa

SEQ ID NO: 3194540 - RNA, 11 nt, Human
uguacagagcc

SEQ ID NO: 3194541 - RNA, 14 nt, Human
ugguuguaucugug

SEQ ID NO: 3194542 - RNA, 13 nt, Human
ugguugcauccua

SEQ ID NO: 3194543 - RNA, 23 nt, Human
ugguugggacccaguggcagggc

SEQ ID NO: 3194544 - RNA, 21 nt, Human
ugguugggacccaguggcagg

SEQ ID NO: 3194545 - RNA, 14 nt, Human
ugguugggacccag

SEQ ID NO: 3194546 - RNA, 18 nt, Human
ugguuggcugggaaaucg

SEQ ID NO: 3194547 - RNA, 23 nt, Human
ugguuuuuaaaaaacugcugacu

SEQ ID NO: 3194548 - RNA, 17 nt, Human
ugguuuuuauuucuccu

SEQ ID NO: 3194549 - RNA, 19 nt, Human
ugguuuuuauuucuccuuu

SEQ ID NO: 3194550 - RNA, 16 nt, Human
ugguuuuucuuuucuu

SEQ ID NO: 3194551 - RNA, 19 nt, Human
ugguuuuucuuuucuugga

SEQ ID NO: 3194552 - RNA, 21 nt, Human
ugguuuuuaaaaaacugcuga

SEQ ID NO: 3194553 - RNA, 13 nt, Human
ugguuuucuguuu

SEQ ID NO: 3194554 - RNA, 19 nt, Human
ugguuuucuuguguguuua

SEQ ID NO: 3194555 - RNA, 22 nt, Human
ugguuuucuugggggaaaauac

SEQ ID NO: 3194556 - RNA, 20 nt, Human
ugguuguguguccccuugca

SEQ ID NO: 3194557 - RNA, 12 nt, Human
uguaaaauggug

SEQ ID NO: 3194558 - RNA, 13 nt, Human
uguaaaauguauu

SEQ ID NO: 3194559 - RNA, 14 nt, Human
uguaaaauguauua

SEQ ID NO: 3194560 - RNA, 15 nt, Human
uguaaaauguauuau

SEQ ID NO: 3194561 - RNA, 19 nt, Human
uguaaaauguauuaugucc

SEQ ID NO: 3194562 - RNA, 21 nt, Human
uguaaaaugcaaaaaaucuua

SEQ ID NO: 3194563 - RNA, 22 nt, Human
uguaaaauggaaaacuuaguuu

SEQ ID NO: 3194564 - RNA, 18 nt, Human
uguaaaaugcaaaaaauc

SEQ ID NO: 3194565 - RNA, 13 nt, Human
uguaaaaugcaaa

SEQ ID NO: 3194566 - RNA, 11 nt, Human
uguaaaauggu

SEQ ID NO: 3194567 - RNA, 20 nt, Human
uguaaaaaggaauaugaaag

SEQ ID NO: 3194568 - RNA, 12 nt, Human
uguaaaagcaag

SEQ ID NO: 3194569 - RNA, 19 nt, Human
uguaaaagcauuuuguaau

SEQ ID NO: 3194570 - RNA, 18 nt, Human
uguaaaagcaacaucagc

SEQ ID NO: 3194571 - RNA, 19 nt, Human
uguaaaagcaacaucagcu

SEQ ID NO: 3194572 - RNA, 22 nt, Human
uguaaaagcaacaucagcuuga

SEQ ID NO: 3194573 - RNA, 18 nt, Human
uguaaaagcauuuuguaa

SEQ ID NO: 3194574 - RNA, 17 nt, Human
uguaaaagcauuuugua

SEQ ID NO: 3194575 - RNA, 16 nt, Human
ugguuccagccugcca

SEQ ID NO: 3194576 - RNA, 15 nt, Human
ugguuccagccugcc

SEQ ID NO: 3194577 - RNA, 17 nt, Human
ugguucauuuucagauu

SEQ ID NO: 3194578 - RNA, 23 nt, Human
ugguucaggguuggccccugccc

SEQ ID NO: 3194579 - RNA, 18 nt, Human
uggugucgggcaugacac

SEQ ID NO: 3194580 - RNA, 20 nt, Human
ugguuccccuguucacucua

SEQ ID NO: 3194581 - RNA, 19 nt, Human
ugguuccccuguucacucu

SEQ ID NO: 3194582 - RNA, 18 nt, Human
ugguuccccuguucacuc

SEQ ID NO: 3194583 - RNA, 11 nt, Human
ugguuccccug

SEQ ID NO: 3194584 - RNA, 20 nt, Human
ugguuccaagucuuugcuau

SEQ ID NO: 3194585 - RNA, 15 nt, Human
uggugucgggcauga

SEQ ID NO: 3194586 - RNA, 17 nt, Human
uggugucauagaauagc

SEQ ID NO: 3194587 - RNA, 20 nt, Human
uggugucauagaauagcaug

SEQ ID NO: 3194588 - RNA, 16 nt, Human
uggugucaccugaaga

SEQ ID NO: 3194589 - RNA, 23 nt, Human
ugguuccccuguucacucuacuu

SEQ ID NO: 3194590 - RNA, 21 nt, Human
ugguuccuaggggaaugaggg

SEQ ID NO: 3194591 - RNA, 12 nt, Human
ugguuccucccc

SEQ ID NO: 3194592 - RNA, 18 nt, Human
ugguuccuccccuccucc

SEQ ID NO: 3194593 - RNA, 23 nt, Human
ugguuccuccccuccuccuggac

SEQ ID NO: 3194594 - RNA, 18 nt, Human
ugguuccuggggcaucca

SEQ ID NO: 3194595 - RNA, 14 nt, Human
ugguuccuggggca

SEQ ID NO: 3194596 - RNA, 18 nt, Human
ugguugaugaucuuugca

SEQ ID NO: 3194597 - RNA, 16 nt, Human
ugguugagugggggga

SEQ ID NO: 3194598 - RNA, 12 nt, Human
ugguugaauaug

SEQ ID NO: 3194599 - RNA, 18 nt, Human
ugguugaauaaacuagau

SEQ ID NO: 3194600 - RNA, 12 nt, Human
ugguugaauaaa

SEQ ID NO: 3194601 - RNA, 23 nt, Human
uggguacuuguggacacagcucu

SEQ ID NO: 3194602 - RNA, 20 nt, Human
uggguacuuguggacacagc

SEQ ID NO: 3194603 - RNA, 12 nt, Human
uggugauuuuaa

SEQ ID NO: 3194604 - RNA, 14 nt, Human
uggugagaggcauc

SEQ ID NO: 3194605 - RNA, 18 nt, Human
ugguggcagugggagcug

SEQ ID NO: 3194606 - RNA, 13 nt, Human
ugguggcaguggg

SEQ ID NO: 3194607 - RNA, 20 nt, Human
ugguggcagugggagcugcc

SEQ ID NO: 3194608 - RNA, 19 nt, Human
ugguggcccgacagccugg

SEQ ID NO: 3194609 - RNA, 14 nt, Human
uggugcaaugaccu

SEQ ID NO: 3194610 - RNA, 19 nt, Human
uggugauuuuaaaugugug

SEQ ID NO: 3194611 - RNA, 18 nt, Human
uggugauuuuaaaugugu

SEQ ID NO: 3194612 - RNA, 16 nt, Human
uggugauuuuaaaugu

SEQ ID NO: 3194613 - RNA, 15 nt, Human
uggugauuuuaaaug

SEQ ID NO: 3194614 - RNA, 19 nt, Human
uggugcaaugaccuuucaa

SEQ ID NO: 3194615 - RNA, 12 nt, Human
ugguggcagugg

SEQ ID NO: 3194616 - RNA, 17 nt, Human
ugguggggucuccucag

SEQ ID NO: 3194617 - RNA, 23 nt, Human
ugguggggucuccucaggaccag

SEQ ID NO: 3194618 - RNA, 18 nt, Human
ugguguaagguacuuuca

SEQ ID NO: 3194619 - RNA, 23 nt, Human
uggugguugggacccaguggcag

SEQ ID NO: 3194620 - RNA, 20 nt, Human
uggugguugggacccagugg

SEQ ID NO: 3194621 - RNA, 13 nt, Human
ugguggcuggguu

SEQ ID NO: 3194622 - RNA, 21 nt, Human
ugguggcccgacagccuggca

SEQ ID NO: 3194623 - RNA, 16 nt, Human
uggugggggccucggu

SEQ ID NO: 3194624 - RNA, 18 nt, Human
uggugggggccucggugu

SEQ ID NO: 3194625 - RNA, 23 nt, Human
uggugggcuugucauagccagug

SEQ ID NO: 3194626 - RNA, 17 nt, Human
uggugggcauucucucu

SEQ ID NO: 3194627 - RNA, 18 nt, Human
uggccuacaaaucaguaa

SEQ ID NO: 3194628 - RNA, 19 nt, Human
uggccuacaaaucaguaau

SEQ ID NO: 3194629 - RNA, 14 nt, Human
uggccccugagauc

SEQ ID NO: 3194630 - RNA, 21 nt, Human
uggccccucagggucccuggu

SEQ ID NO: 3194631 - RNA, 22 nt, Human
uggccccucagggucccuggug

SEQ ID NO: 3194632 - RNA, 13 nt, Human
uggccccucaggg

SEQ ID NO: 3194633 - RNA, 20 nt, Human
uggccccucagggucccugg

SEQ ID NO: 3194634 - RNA, 17 nt, Human
uggcagcugcgguccac

SEQ ID NO: 3194635 - RNA, 23 nt, Human
uggccucaagugauucuccugcc

SEQ ID NO: 3194636 - RNA, 18 nt, Human
uggccucaagugauucuc

SEQ ID NO: 3194637 - RNA, 11 nt, Human
uggccucccaa

SEQ ID NO: 3194638 - RNA, 14 nt, Human
uggccucccaacuc

SEQ ID NO: 3194639 - RNA, 19 nt, Human
uggccucccaacucacccc

SEQ ID NO: 3194640 - RNA, 20 nt, Human
uggccucccaacucacccca

SEQ ID NO: 3194641 - RNA, 21 nt, Human
uggccucccaacucaccccag

SEQ ID NO: 3194642 - RNA, 22 nt, Human
uggccucccaacucaccccagc

SEQ ID NO: 3194643 - RNA, 20 nt, Human
uggccucucacugccucccc

SEQ ID NO: 3194644 - RNA, 16 nt, Human
uggccucccugcucua

SEQ ID NO: 3194645 - RNA, 15 nt, Human
uggcuccaggccagg

SEQ ID NO: 3194646 - RNA, 15 nt, Human
uggcuccagccugga

SEQ ID NO: 3194647 - RNA, 13 nt, Human
uggcuccagccug

SEQ ID NO: 3194648 - RNA, 23 nt, Human
uggcuccacacacacaaaaaaag

SEQ ID NO: 3194649 - RNA, 18 nt, Human
uggcuccacacacacaaa

SEQ ID NO: 3194650 - RNA, 17 nt, Human
uggcuccagcuggccgg

SEQ ID NO: 3194651 - RNA, 22 nt, Human
uggccuucggccuccauccuga

SEQ ID NO: 3194652 - RNA, 20 nt, Human
uggccuucggccuccauccu

SEQ ID NO: 3194653 - RNA, 23 nt, Human
uggccuucggccuccauccugag

SEQ ID NO: 3194654 - RNA, 17 nt, Human
uggcuccacacacacaa

SEQ ID NO: 3194655 - RNA, 18 nt, Human
uggccucugcaaaggaaa

SEQ ID NO: 3194656 - RNA, 11 nt, Human
uggcugcugaa

SEQ ID NO: 3194657 - RNA, 13 nt, Human
uggcugcugaagg

SEQ ID NO: 3194658 - RNA, 14 nt, Human
uggcugcugaaggc

SEQ ID NO: 3194659 - RNA, 16 nt, Human
uggcugcugaaggcuc

SEQ ID NO: 3194660 - RNA, 12 nt, Human
uggcuccccugc

SEQ ID NO: 3194661 - RNA, 13 nt, Human
uggcuccccugca

SEQ ID NO: 3194662 - RNA, 14 nt, Human
uggcuccccugcag

SEQ ID NO: 3194663 - RNA, 15 nt, Human
uggcuccccugcagc

SEQ ID NO: 3194664 - RNA, 17 nt, Human
uggcuccccugcagccc

SEQ ID NO: 3194665 - RNA, 18 nt, Human
uggcuccccugcagcccu

SEQ ID NO: 3194666 - RNA, 19 nt, Human
uggcuccccugcagcccug

SEQ ID NO: 3194667 - RNA, 22 nt, Human
uggcuccccugcagcccuggcc

SEQ ID NO: 3194668 - RNA, 24 nt, Human
uggcuccccugcagcccuggccca

SEQ ID NO: 3194669 - RNA, 12 nt, Human
uggcuccccugg

SEQ ID NO: 3194670 - RNA, 13 nt, Human
uggcuccccuggg

SEQ ID NO: 3194671 - RNA, 14 nt, Human
uggcuccccugggg

SEQ ID NO: 3194672 - RNA, 15 nt, Human
uggcuccccuggggu

SEQ ID NO: 3194673 - RNA, 16 nt, Human
uggcuccccuggggug

SEQ ID NO: 3194674 - RNA, 21 nt, Human
uggcuccccuggggugcaggc

SEQ ID NO: 3194675 - RNA, 16 nt, Human
uggcucccuuacuuua

SEQ ID NO: 3194676 - RNA, 16 nt, Human
uggcucccucacucuc

SEQ ID NO: 3194677 - RNA, 14 nt, Human
uggcucccucacuc

SEQ ID NO: 3194678 - RNA, 20 nt, Human
uggcucccucacucucagga

SEQ ID NO: 3194679 - RNA, 19 nt, Human
uggcucccucacucucagg

SEQ ID NO: 3194680 - RNA, 18 nt, Human
uggcucccucacucucag

SEQ ID NO: 3194681 - RNA, 17 nt, Human
uggcucccucacucuca

SEQ ID NO: 3194682 - RNA, 15 nt, Human
uggcuuuucacugcu

SEQ ID NO: 3194683 - RNA, 22 nt, Human
uggcuuuucacugcuggcugcc

SEQ ID NO: 3194684 - RNA, 21 nt, Human
uggcuuuucacugcuggcugc

SEQ ID NO: 3194685 - RNA, 19 nt, Human
uggcuuuucacugcuggcu

SEQ ID NO: 3194686 - RNA, 18 nt, Human
uggcuuuucacugcuggc

SEQ ID NO: 3194687 - RNA, 19 nt, Human
uggcuuggcccuggcagcc

SEQ ID NO: 3194688 - RNA, 16 nt, Human
uggcuuggcccuggca

SEQ ID NO: 3194689 - RNA, 13 nt, Human
uggcuuggcccug

SEQ ID NO: 3194690 - RNA, 16 nt, Human
uggcuuuucacugcug

SEQ ID NO: 3194691 - RNA, 22 nt, Human
uggcuucccgcucagcccuccc

SEQ ID NO: 3194692 - RNA, 23 nt, Human
uggcuuggauuaauauucauagu

SEQ ID NO: 3194693 - RNA, 20 nt, Human
uggcuugccauuuuucaaaa

SEQ ID NO: 3194694 - RNA, 21 nt, Human
uggcuucccgcucagcccucc

SEQ ID NO: 3194695 - RNA, 20 nt, Human
uggcuucccgcucagcccuc

SEQ ID NO: 3194696 - RNA, 19 nt, Human
uggcuucccgcucagcccu

SEQ ID NO: 3194697 - RNA, 18 nt, Human
uggcuucccgcucagccc

SEQ ID NO: 3194698 - RNA, 18 nt, Human
uggcugggacugggaaca

SEQ ID NO: 3194699 - RNA, 17 nt, Human
uggcugggacugggaac

SEQ ID NO: 3194700 - RNA, 23 nt, Human
uggcuggccuugugguccaaaua

SEQ ID NO: 3194701 - RNA, 16 nt, Human
ugggggccucagugcc

SEQ ID NO: 3194702 - RNA, 23 nt, Human
ugggggccccgucucaggucuga

SEQ ID NO: 3194703 - RNA, 22 nt, Human
ugggggccccgucucaggucug

SEQ ID NO: 3194704 - RNA, 19 nt, Human
ugggggccccgucucaggu

SEQ ID NO: 3194705 - RNA, 18 nt, Human
ugggggccccgucucagg

SEQ ID NO: 3194706 - RNA, 17 nt, Human
uggggggcuucauacac

SEQ ID NO: 3194707 - RNA, 21 nt, Human
uggggggaacgcccacuuccc

SEQ ID NO: 3194708 - RNA, 19 nt, Human
uggggggcugaggugggag

SEQ ID NO: 3194709 - RNA, 19 nt, Human
ugggggcugggcagaggaa

SEQ ID NO: 3194710 - RNA, 16 nt, Human
uggggggagcacccug

SEQ ID NO: 3194711 - RNA, 20 nt, Human
uggggggagcacccugaggg

SEQ ID NO: 3194712 - RNA, 21 nt, Human
uggggggagcacccugagggc

SEQ ID NO: 3194713 - RNA, 11 nt, Human
uggggggaggc

SEQ ID NO: 3194714 - RNA, 13 nt, Human
uggggggaggcug

SEQ ID NO: 3194715 - RNA, 20 nt, Human
uggggggaugguaagagaaa

SEQ ID NO: 3194716 - RNA, 13 nt, Human
uggggggaacgcc

SEQ ID NO: 3194717 - RNA, 20 nt, Human
uggggggaacgcccacuucc

SEQ ID NO: 3194718 - RNA, 19 nt, Human
uggggggaacgcccacuuc

SEQ ID NO: 3194719 - RNA, 13 nt, Human
ugggggggcagag

SEQ ID NO: 3194720 - RNA, 17 nt, Human
ugggcuugucuguagau

SEQ ID NO: 3194721 - RNA, 23 nt, Human
ugggcuuggggaccagagcugcc

SEQ ID NO: 3194722 - RNA, 21 nt, Human
ugggcuugucuguagauuuua

SEQ ID NO: 3194723 - RNA, 22 nt, Human
ugggcuuggggaccagagcugc

SEQ ID NO: 3194724 - RNA, 19 nt, Human
uggggcagaaaucugagga

SEQ ID NO: 3194725 - RNA, 17 nt, Human
uggggcagaggagaacu

SEQ ID NO: 3194726 - RNA, 16 nt, Human
uggggcagaggagaac

SEQ ID NO: 3194727 - RNA, 18 nt, Human
uggggcagaaaucugagg

SEQ ID NO: 3194728 - RNA, 18 nt, Human
uggggcacagggagaggc

SEQ ID NO: 3194729 - RNA, 15 nt, Human
ugggcuucauccucc

SEQ ID NO: 3194730 - RNA, 21 nt, Human
ugggcuucaguggcagcugcu

SEQ ID NO: 3194731 - RNA, 22 nt, Human
ugggcuucaguggcagcugcuu

SEQ ID NO: 3194732 - RNA, 22 nt, Human
ugggccuccugugugugcgccu

SEQ ID NO: 3194733 - RNA, 13 nt, Human
ugggccugaguga

SEQ ID NO: 3194734 - RNA, 13 nt, Human
ugggaguguguaa

SEQ ID NO: 3194735 - RNA, 16 nt, Human
ugggauaggggcagag

SEQ ID NO: 3194736 - RNA, 18 nt, Human
ugggaugauuggaggggg

SEQ ID NO: 3194737 - RNA, 14 nt, Human
ugggaugauugaag

SEQ ID NO: 3194738 - RNA, 17 nt, Human
ugggaugauugaagaaa

SEQ ID NO: 3194739 - RNA, 16 nt, Human
ugggaugauugaagaa

SEQ ID NO: 3194740 - RNA, 23 nt, Human
ugggaugauugaagaaacagcua

SEQ ID NO: 3194741 - RNA, 18 nt, Human
ugggaugauugaagaaac

SEQ ID NO: 3194742 - RNA, 16 nt, Human
ugggaggaucucuuga

SEQ ID NO: 3194743 - RNA, 14 nt, Human
ugggacagggagga

SEQ ID NO: 3194744 - RNA, 19 nt, Human
ugggacagggagcagcccc

SEQ ID NO: 3194745 - RNA, 16 nt, Human
ugggaaugaaugucag

SEQ ID NO: 3194746 - RNA, 13 nt, Human
ugggacacccugu

SEQ ID NO: 3194747 - RNA, 14 nt, Human
ugggacacccugug

SEQ ID NO: 3194748 - RNA, 15 nt, Human
ugggacacccuguga

SEQ ID NO: 3194749 - RNA, 18 nt, Human
ugggccguagcuugucug

SEQ ID NO: 3194750 - RNA, 13 nt, Human
ugggcagagcaga

SEQ ID NO: 3194751 - RNA, 15 nt, Human
ugggcagagcagaga

SEQ ID NO: 3194752 - RNA, 17 nt, Human
ugggcagagcagagacc

SEQ ID NO: 3194753 - RNA, 14 nt, Human
ugggcagagcagag

SEQ ID NO: 3194754 - RNA, 18 nt, Human
uggauauauguuuuugaa

SEQ ID NO: 3194755 - RNA, 13 nt, Human
uggauaucuguua

SEQ ID NO: 3194756 - RNA, 14 nt, Human
uggauaucuguuag

SEQ ID NO: 3194757 - RNA, 16 nt, Human
uggauaucuguuagau

SEQ ID NO: 3194758 - RNA, 18 nt, Human
uggauaucuguuagaugc

SEQ ID NO: 3194759 - RNA, 13 nt, Human
uggaugcagccuc

SEQ ID NO: 3194760 - RNA, 21 nt, Human
uggaugcagccucacaguccu

SEQ ID NO: 3194761 - RNA, 22 nt, Human
uggaugcagccucacaguccuu

SEQ ID NO: 3194762 - RNA, 21 nt, Human
uggauuguccccgacccuugc

SEQ ID NO: 3194763 - RNA, 23 nt, Human
uggaggggggaggugggauccuc

SEQ ID NO: 3194764 - RNA, 18 nt, Human
uggcagcucagagagggu

SEQ ID NO: 3194765 - RNA, 22 nt, Human
uggcacugcuuccagugaggcu

SEQ ID NO: 3194766 - RNA, 19 nt, Human
uggcacugcuuccagugag

SEQ ID NO: 3194767 - RNA, 14 nt, Human
uggaucaaguauua

SEQ ID NO: 3194768 - RNA, 22 nt, Human
uggcacuauaauguaagcucua

SEQ ID NO: 3194769 - RNA, 21 nt, Human
uggcacuauaauguaagcucu

SEQ ID NO: 3194770 - RNA, 23 nt, Human
uggcaaggacgcuucacaggaca

SEQ ID NO: 3194771 - RNA, 18 nt, Human
uggagaggagcccugccu

SEQ ID NO: 3194772 - RNA, 17 nt, Human
uggagaggagcccugcc

SEQ ID NO: 3194773 - RNA, 16 nt, Human
uggagaggagcccugc

SEQ ID NO: 3194774 - RNA, 15 nt, Human
uggagaggagcccug

SEQ ID NO: 3194775 - RNA, 17 nt, Human
uggacaggcauguucuc

SEQ ID NO: 3194776 - RNA, 18 nt, Human
uggacauuucuaauuccu

SEQ ID NO: 3194777 - RNA, 17 nt, Human
uggacauuuagaagaaa

SEQ ID NO: 3194778 - RNA, 19 nt, Human
uggacauuuagaagaaaga

SEQ ID NO: 3194779 - RNA, 22 nt, Human
uggacaggcauguucucugagg

SEQ ID NO: 3194780 - RNA, 18 nt, Human
uggacaggcauguucucu

SEQ ID NO: 3194781 - RNA, 19 nt, Human
uggacuaacuugucuuugg

SEQ ID NO: 3194782 - RNA, 19 nt, Human
uggacguguuaugacucca

SEQ ID NO: 3194783 - RNA, 23 nt, Human
uggacguguuaugacuccagaau

SEQ ID NO: 3194784 - RNA, 21 nt, Human
uggacauuuggguugguucca

SEQ ID NO: 3194785 - RNA, 19 nt, Human
uggaaaagccaagaggcug

SEQ ID NO: 3194786 - RNA, 16 nt, Human
uggaaaagccaagagg

SEQ ID NO: 3194787 - RNA, 12 nt, Human
uggaaaagacag

SEQ ID NO: 3194788 - RNA, 16 nt, Human
uggaaaacuuaguuug

SEQ ID NO: 3194789 - RNA, 20 nt, Human
uggaaaacuuaguuugugaa

SEQ ID NO: 3194790 - RNA, 17 nt, Human
ugcuuugcccacaugcc

SEQ ID NO: 3194791 - RNA, 13 nt, Human
ugcuuugauauau

SEQ ID NO: 3194792 - RNA, 12 nt, Human
ugcuuugauaua

SEQ ID NO: 3194793 - RNA, 22 nt, Human
ugcuuugaggcucaccagaauu

SEQ ID NO: 3194794 - RNA, 14 nt, Human
ugcuuguuaacuga

SEQ ID NO: 3194795 - RNA, 18 nt, Human
ugcuugugaaaggaaaga

SEQ ID NO: 3194796 - RNA, 13 nt, Human
ugcuucuucagag

SEQ ID NO: 3194797 - RNA, 13 nt, Human
uggaagaaaguaa

SEQ ID NO: 3194798 - RNA, 14 nt, Human
uggaagaaaguaag

SEQ ID NO: 3194799 - RNA, 14 nt, Human
uggaacacucugag

SEQ ID NO: 3194800 - RNA, 12 nt, Human
uggaacagugcu

SEQ ID NO: 3194801 - RNA, 19 nt, Human
uggaacagugcuacugaaa

SEQ ID NO: 3194802 - RNA, 15 nt, Human
uggaacacucugaga

SEQ ID NO: 3194803 - RNA, 17 nt, Human
uggaacacucugagacu

SEQ ID NO: 3194804 - RNA, 19 nt, Human
uggaaaccugucugagguu

SEQ ID NO: 3194805 - RNA, 13 nt, Human
uggaaacuaauaa

SEQ ID NO: 3194806 - RNA, 14 nt, Human
uggaaacuaauaaa

SEQ ID NO: 3194807 - RNA, 15 nt, Human
uggaaacuaauaaaa

SEQ ID NO: 3194808 - RNA, 16 nt, Human
uggaaacuaauaaaau

SEQ ID NO: 3194809 - RNA, 17 nt, Human
uggaaacuaauaaaaua

SEQ ID NO: 3194810 - RNA, 19 nt, Human
uggaaacuaauaaaauauu

SEQ ID NO: 3194811 - RNA, 21 nt, Human
uggaaacuaauaaaauauuuu

SEQ ID NO: 3194812 - RNA, 22 nt, Human
uggaaacuaauaaaauauuuuc

SEQ ID NO: 3194813 - RNA, 23 nt, Human
uggaaacuaauaaaauauuuucu

SEQ ID NO: 3194814 - RNA, 18 nt, Human
uggaaacuauguguuuuu

SEQ ID NO: 3194815 - RNA, 21 nt, Human
uggaaacuauguguuuuucuc

SEQ ID NO: 3194816 - RNA, 14 nt, Human
uggaaaaggcauau

SEQ ID NO: 3194817 - RNA, 12 nt, Human
ugcuucucacug

SEQ ID NO: 3194818 - RNA, 13 nt, Human
ugcuuccuuucuu

SEQ ID NO: 3194819 - RNA, 20 nt, Human
ugcuucccuuuuuuccuuuc

SEQ ID NO: 3194820 - RNA, 23 nt, Human
ugcuucccuuuuuuccuuuccac

SEQ ID NO: 3194821 - RNA, 19 nt, Human
ugcuuccuauaauuuugau

SEQ ID NO: 3194822 - RNA, 18 nt, Human
ugcuuccuauaauuuuga

SEQ ID NO: 3194823 - RNA, 22 nt, Human
ugcuuccagugaggcucugccc

SEQ ID NO: 3194824 - RNA, 17 nt, Human
ugcuuaccuacuuucuu

SEQ ID NO: 3194825 - RNA, 19 nt, Human
ugcuuaccuacuuucuuca

SEQ ID NO: 3194826 - RNA, 23 nt, Human
ugcuuccagugaggcucugcccu

SEQ ID NO: 3194827 - RNA, 21 nt, Human
ugcuuccagugaggcucugcc

SEQ ID NO: 3194828 - RNA, 16 nt, Human
ugcuguuuugccagcc

SEQ ID NO: 3194829 - RNA, 22 nt, Human
ugcuguuuugccagcccauuug

SEQ ID NO: 3194830 - RNA, 13 nt, Human
ugcuuaaauguga

SEQ ID NO: 3194831 - RNA, 12 nt, Human
ugcuuaaaugug

SEQ ID NO: 3194832 - RNA, 22 nt, Human
ugcuuaaaguugguauuaauaa

SEQ ID NO: 3194833 - RNA, 13 nt, Human
ugcuuaaauuuua

SEQ ID NO: 3194834 - RNA, 16 nt, Human
ugcuuaaauuuuaacu

SEQ ID NO: 3194835 - RNA, 23 nt, Human
ugcuuaaaugugaauuacuaacu

SEQ ID NO: 3194836 - RNA, 20 nt, Human
ugcuuaaaugugaauuacua

SEQ ID NO: 3194837 - RNA, 17 nt, Human
ugcuuaaaugugaauua

SEQ ID NO: 3194838 - RNA, 16 nt, Human
ugcuuaaaugugaauu

SEQ ID NO: 3194839 - RNA, 15 nt, Human
ugcuuaaaugugaau

SEQ ID NO: 3194840 - RNA, 14 nt, Human
ugcuuaaaugugaa

SEQ ID NO: 3194841 - RNA, 20 nt, Human
ugcuuaauuacaauauuucu

SEQ ID NO: 3194842 - RNA, 20 nt, Human
ugcuuaaccuuuuuauuuca

SEQ ID NO: 3194843 - RNA, 20 nt, Human
ugcuuaauucaaauaauaau

SEQ ID NO: 3194844 - RNA, 18 nt, Human
ugcuuaauucaaauaaua

SEQ ID NO: 3194845 - RNA, 17 nt, Human
ugcuuaauucaaauaau

SEQ ID NO: 3194846 - RNA, 16 nt, Human
ugcuuaauucaaauaa

SEQ ID NO: 3194847 - RNA, 19 nt, Human
uuuccaagccucucuggca

SEQ ID NO: 3194848 - RNA, 18 nt, Human
uuucauuuaggugaggaa

SEQ ID NO: 3194849 - RNA, 14 nt, Human
uuucauuuagguga

SEQ ID NO: 3194850 - RNA, 14 nt, Human
uuucaguguacaug

SEQ ID NO: 3194851 - RNA, 13 nt, Human
uuucaguguacau

SEQ ID NO: 3194852 - RNA, 11 nt, Human
uuucagugagg

SEQ ID NO: 3194853 - RNA, 17 nt, Human
uuucaguucaaagucau

SEQ ID NO: 3194854 - RNA, 14 nt, Human
uuucaguucaaagu

SEQ ID NO: 3194855 - RNA, 13 nt, Human
uuucaguucaaag

SEQ ID NO: 3194856 - RNA, 20 nt, Human
uuucaguuauugucccuggc

SEQ ID NO: 3194857 - RNA, 15 nt, Human
uuucagauuugcaca

SEQ ID NO: 3194858 - RNA, 22 nt, Human
uuucagauuugcacaaaaagau

SEQ ID NO: 3194859 - RNA, 19 nt, Human
uuucagauuugcacaaaaa

SEQ ID NO: 3194860 - RNA, 17 nt, Human
uuucagauuugcacaaa

SEQ ID NO: 3194861 - RNA, 16 nt, Human
uuucagauuugcacaa

SEQ ID NO: 3194862 - RNA, 22 nt, Human
uuucacaaccuucuguggcuca

SEQ ID NO: 3194863 - RNA, 22 nt, Human
uuucacaaauauuaaaaagucu

SEQ ID NO: 3194864 - RNA, 16 nt, Human
uuucacaaccuucugu

SEQ ID NO: 3194865 - RNA, 20 nt, Human
uuucaauagcguguguagau

SEQ ID NO: 3194866 - RNA, 13 nt, Human
uuucacaaauauu

SEQ ID NO: 3194867 - RNA, 12 nt, Human
uuucacaaauau

SEQ ID NO: 3194868 - RNA, 20 nt, Human
uuucacaaauauuaaaaagu

SEQ ID NO: 3194869 - RNA, 18 nt, Human
uuucacaaauauuaaaaa

SEQ ID NO: 3194870 - RNA, 17 nt, Human
uuucacaaauauuaaaa

SEQ ID NO: 3194871 - RNA, 16 nt, Human
uuucacaaauauuaaa

SEQ ID NO: 3194872 - RNA, 17 nt, Human
uuucaauaggaaaaacu

SEQ ID NO: 3194873 - RNA, 12 nt, Human
uuucaauaggaa

SEQ ID NO: 3194874 - RNA, 14 nt, Human
uuucaauaggaaaa

SEQ ID NO: 3194875 - RNA, 18 nt, Human
uuucaaguacacugaauu

SEQ ID NO: 3194876 - RNA, 19 nt, Human
uuucaagggcuuuccugug

SEQ ID NO: 3194877 - RNA, 23 nt, Human
uuucaaguauuuaagccuaaaga

SEQ ID NO: 3194878 - RNA, 17 nt, Human
uuucaaguauuuaagcc

SEQ ID NO: 3194879 - RNA, 16 nt, Human
uuucaaguauuuaagc

SEQ ID NO: 3194880 - RNA, 15 nt, Human
uuucaaguauuuaag

SEQ ID NO: 3194881 - RNA, 21 nt, Human
uuucaauaaaguuugaucuuc

SEQ ID NO: 3194882 - RNA, 18 nt, Human
uuucaauaaaguuugauc

SEQ ID NO: 3194883 - RNA, 15 nt, Human
uuucaauaaaguuug

SEQ ID NO: 3194884 - RNA, 14 nt, Human
uuucaauaaaguuu

SEQ ID NO: 3194885 - RNA, 17 nt, Human
uuucaaguuuuaaaguu

SEQ ID NO: 3194886 - RNA, 18 nt, Human
uuucaaguuuuaaaguuc

SEQ ID NO: 3194887 - RNA, 13 nt, Human
uuucaauaaaguu

SEQ ID NO: 3194888 - RNA, 22 nt, Human
uuuauuguuuaaaaucauuucu

SEQ ID NO: 3194889 - RNA, 20 nt, Human
uuuauugaggaaaaauaugu

SEQ ID NO: 3194890 - RNA, 18 nt, Human
uuuauugaggaaaaauau

SEQ ID NO: 3194891 - RNA, 16 nt, Human
uuuauuuacugcuagu

SEQ ID NO: 3194892 - RNA, 12 nt, Human
uuuauucuugau

SEQ ID NO: 3194893 - RNA, 16 nt, Human
uuuauugacucuugag

SEQ ID NO: 3194894 - RNA, 18 nt, Human
uuucaacucauugcauca

SEQ ID NO: 3194895 - RNA, 21 nt, Human
uuucaacgcagcccugcuuug

SEQ ID NO: 3194896 - RNA, 16 nt, Human
uuucaacucauugcau

SEQ ID NO: 3194897 - RNA, 13 nt, Human
uuucaacucauug

SEQ ID NO: 3194898 - RNA, 20 nt, Human
uuucaacgcagcccugcuuu

SEQ ID NO: 3194899 - RNA, 16 nt, Human
uuucaacgcagcccug

SEQ ID NO: 3194900 - RNA, 15 nt, Human
uuucaacgcagcccu

SEQ ID NO: 3194901 - RNA, 22 nt, Human
uuucaaccucuagaauuuuaag

SEQ ID NO: 3194902 - RNA, 15 nt, Human
uuucaaccucuagaa

SEQ ID NO: 3194903 - RNA, 18 nt, Human
uuucaagcuuauuuugga

SEQ ID NO: 3194904 - RNA, 14 nt, Human
uuucaagcuuauuu

SEQ ID NO: 3194905 - RNA, 20 nt, Human
uuucaagcgucacuuuauuu

SEQ ID NO: 3194906 - RNA, 16 nt, Human
uuucaagaacuuguuu

SEQ ID NO: 3194907 - RNA, 13 nt, Human
uuucaagaacuug

SEQ ID NO: 3194908 - RNA, 22 nt, Human
uuucaagaucuaaaucauauau

SEQ ID NO: 3194909 - RNA, 18 nt, Human
uuucaagacugaauucca

SEQ ID NO: 3194910 - RNA, 17 nt, Human
uuuauaaggacuuccug

SEQ ID NO: 3194911 - RNA, 13 nt, Human
uuuauaaggucug

SEQ ID NO: 3194912 - RNA, 21 nt, Human
uuuauaauacagaaucuuguu

SEQ ID NO: 3194913 - RNA, 14 nt, Human
uuuaacuaaauuuu

SEQ ID NO: 3194914 - RNA, 17 nt, Human
uuuaacuaaauuuuaaa

SEQ ID NO: 3194915 - RNA, 11 nt, Human
uuuaacaugcc

SEQ ID NO: 3194916 - RNA, 23 nt, Human
uuuaacaacuaugauuuggaaaa

SEQ ID NO: 3194917 - RNA, 18 nt, Human
uuguuuggagacagaguc

SEQ ID NO: 3194918 - RNA, 14 nt, Human
uuuaaauuuaagua

SEQ ID NO: 3194919 - RNA, 23 nt, Human
uuuaacagggucucuagugcugu

SEQ ID NO: 3194920 - RNA, 14 nt, Human
uuuaacagggucuc

SEQ ID NO: 3194921 - RNA, 16 nt, Human
uuuaauaaaauaauaa

SEQ ID NO: 3194922 - RNA, 21 nt, Human
uuuaauaaagcgaaaaacuca

SEQ ID NO: 3194923 - RNA, 19 nt, Human
uuuaauaaagcgaaaaacu

SEQ ID NO: 3194924 - RNA, 17 nt, Human
uuuaaguguuggaaaaa

SEQ ID NO: 3194925 - RNA, 18 nt, Human
uuuaaguguacuggauuu

SEQ ID NO: 3194926 - RNA, 12 nt, Human
uuuaaguuugca

SEQ ID NO: 3194927 - RNA, 18 nt, Human
uuuaaguuugcacucaaa

SEQ ID NO: 3194928 - RNA, 14 nt, Human
uuuaaguuugcacu

SEQ ID NO: 3194929 - RNA, 13 nt, Human
uuuaaguuuugac

SEQ ID NO: 3194930 - RNA, 18 nt, Human
uuuaaguuuugacaagcu

SEQ ID NO: 3194931 - RNA, 23 nt, Human
uuuaaguuugcacucaaaucuua

SEQ ID NO: 3194932 - RNA, 19 nt, Human
uuuaaguuugcacucaaau

SEQ ID NO: 3194933 - RNA, 15 nt, Human
uuuaacuuguaauaa

SEQ ID NO: 3194934 - RNA, 14 nt, Human
uuuaacuuuaccau

SEQ ID NO: 3194935 - RNA, 23 nt, Human
uuuaacuuuaccaugcucaauga

SEQ ID NO: 3194936 - RNA, 20 nt, Human
uuuaacuuaguuuugcauag

SEQ ID NO: 3194937 - RNA, 17 nt, Human
uuuaacuuaguuuugca

SEQ ID NO: 3194938 - RNA, 12 nt, Human
uuuaagaaagaa

SEQ ID NO: 3194939 - RNA, 19 nt, Human
uuuaagacauuuuuggaag

SEQ ID NO: 3194940 - RNA, 17 nt, Human
uuuaagacacuuccguc

SEQ ID NO: 3194941 - RNA, 19 nt, Human
uuuaguuuuauuuucuaaa

SEQ ID NO: 3194942 - RNA, 17 nt, Human
uuuaguuuuauuuucua

SEQ ID NO: 3194943 - RNA, 13 nt, Human
uuuaguuuuauuu

SEQ ID NO: 3194944 - RNA, 14 nt, Human
uuuaguuuugcuuu

SEQ ID NO: 3194945 - RNA, 14 nt, Human
uuuauaaaaagaua

SEQ ID NO: 3194946 - RNA, 12 nt, Human
uuuaguuuuucu

SEQ ID NO: 3194947 - RNA, 12 nt, Human
uuuagacagagu

SEQ ID NO: 3194948 - RNA, 18 nt, Human
uuuagaauugaagguuuu

SEQ ID NO: 3194949 - RNA, 21 nt, Human
uuuagaauugaagguuuuuga

SEQ ID NO: 3194950 - RNA, 11 nt, Human
uuuagaauuga

SEQ ID NO: 3194951 - RNA, 13 nt, Human
uuuagaauugaag

SEQ ID NO: 3194952 - RNA, 15 nt, Human
uuuagaauugaaggu

SEQ ID NO: 3194953 - RNA, 17 nt, Human
uuuagaauugaagguuu

SEQ ID NO: 3194954 - RNA, 21 nt, Human
uuuagaauggugauuuuaaau

SEQ ID NO: 3194955 - RNA, 20 nt, Human
uuuagaauggugauuuuaaa

SEQ ID NO: 3194956 - RNA, 18 nt, Human
uuuagaauggugauuuua

SEQ ID NO: 3194957 - RNA, 14 nt, Human
uuuagaaauauaau

SEQ ID NO: 3194958 - RNA, 17 nt, Human
uuuagaaauaaaccuua

SEQ ID NO: 3194959 - RNA, 20 nt, Human
uuuagaaauaaaccuuaaua

SEQ ID NO: 3194960 - RNA, 11 nt, Human
uuuagaaauau

SEQ ID NO: 3194961 - RNA, 18 nt, Human
uuuacuugaauaguauug

SEQ ID NO: 3194962 - RNA, 22 nt, Human
uuuacuucuuauacauuugaua

SEQ ID NO: 3194963 - RNA, 19 nt, Human
uuuacuucuuauacauuug

SEQ ID NO: 3194964 - RNA, 15 nt, Human
uuuacuucuuauaca

SEQ ID NO: 3194965 - RNA, 16 nt, Human
uuuaccacuugcugca

SEQ ID NO: 3194966 - RNA, 14 nt, Human
uuuacuuggaaaua

SEQ ID NO: 3194967 - RNA, 17 nt, Human
uuuacagugaagaaagc

SEQ ID NO: 3194968 - RNA, 19 nt, Human
uuuacagugaagaaagccu

SEQ ID NO: 3194969 - RNA, 20 nt, Human
uuuacagugaagaaagccug

SEQ ID NO: 3194970 - RNA, 15 nt, Human
uuuacagcugccugc

SEQ ID NO: 3194971 - RNA, 16 nt, Human
uuuacagcugccugca

SEQ ID NO: 3194972 - RNA, 22 nt, Human
uuuacacggagcggauugcaaa

SEQ ID NO: 3194973 - RNA, 18 nt, Human
uuguacgacgucagaugu

SEQ ID NO: 3194974 - RNA, 21 nt, Human
uuguacgacgucagauguuua

SEQ ID NO: 3194975 - RNA, 13 nt, Human
uuguacaugaaca

SEQ ID NO: 3194976 - RNA, 16 nt, Human
uuguaugucaaagcuu

SEQ ID NO: 3194977 - RNA, 16 nt, Human
uugucuaagaaacauu

SEQ ID NO: 3194978 - RNA, 23 nt, Human
uugucuaagaaacauuggaagca

SEQ ID NO: 3194979 - RNA, 20 nt, Human
uugucuaagaaacauuggaa

SEQ ID NO: 3194980 - RNA, 18 nt, Human
uugucuaagaaacauugg

SEQ ID NO: 3194981 - RNA, 17 nt, Human
uugucuaagaaacauug

SEQ ID NO: 3194982 - RNA, 11 nt, Human
uugucucagau

SEQ ID NO: 3194983 - RNA, 20 nt, Human
uugucugaagucacugcaca

SEQ ID NO: 3194984 - RNA, 15 nt, Human
uugucuuaaaaagug

SEQ ID NO: 3194985 - RNA, 17 nt, Human
uugucugccccaaguuu

SEQ ID NO: 3194986 - RNA, 20 nt, Human
uugucugccccaaguuuugu

SEQ ID NO: 3194987 - RNA, 18 nt, Human
uugucugccccaaguuuu

SEQ ID NO: 3194988 - RNA, 21 nt, Human
uugucugaagucacugcacag

SEQ ID NO: 3194989 - RNA, 14 nt, Human
uugugaaaugaugg

SEQ ID NO: 3194990 - RNA, 20 nt, Human
uugugaaaggaaagaggcuc

SEQ ID NO: 3194991 - RNA, 16 nt, Human
uugugaaaauaauuga

SEQ ID NO: 3194992 - RNA, 19 nt, Human
uugugaaagaggucccaag

SEQ ID NO: 3194993 - RNA, 19 nt, Human
uugugaaacagacuuguau

SEQ ID NO: 3194994 - RNA, 21 nt, Human
uugucugccccaaguuuugug

SEQ ID NO: 3194995 - RNA, 13 nt, Human
uugucuguaaauc

SEQ ID NO: 3194996 - RNA, 17 nt, Human
uuguaaauagcucaggu

SEQ ID NO: 3194997 - RNA, 21 nt, Human
uuguaaaugugguaaagaguu

SEQ ID NO: 3194998 - RNA, 16 nt, Human
uuguaaaugugguaaa

SEQ ID NO: 3194999 - RNA, 14 nt, Human
uuguaaauauuaaa

SEQ ID NO: 3195000 - RNA, 23 nt, Human
uuguaaauauuaaaccauaagau

SEQ ID NO: 3195001 - RNA, 17 nt, Human
uuguaaaagcaacauca

SEQ ID NO: 3195002 - RNA, 20 nt, Human
uuguaaaagcaacaucagcu

SEQ ID NO: 3195003 - RNA, 23 nt, Human
uuguaaaagcaacaucagcuuga

SEQ ID NO: 3195004 - RNA, 17 nt, Human
uuguaaaagcauuuugu

SEQ ID NO: 3195005 - RNA, 20 nt, Human
uuguaaaagcauuuuguaau

SEQ ID NO: 3195006 - RNA, 19 nt, Human
uuguaaaagcauuuuguaa

SEQ ID NO: 3195007 - RNA, 18 nt, Human
uuguaaaagcauuuugua

SEQ ID NO: 3195008 - RNA, 15 nt, Human
uuguaaauucugauu

SEQ ID NO: 3195009 - RNA, 12 nt, Human
uuguaaauucug

SEQ ID NO: 3195010 - RNA, 13 nt, Human
uuguaaauucuga

SEQ ID NO: 3195011 - RNA, 14 nt, Human
uuguaaauucugau

SEQ ID NO: 3195012 - RNA, 15 nt, Human
uuggucugugagaug

SEQ ID NO: 3195013 - RNA, 13 nt, Human
uugguauccuuau

SEQ ID NO: 3195014 - RNA, 17 nt, Human
uugguccacuuuuccag

SEQ ID NO: 3195015 - RNA, 14 nt, Human
uugguccacuuuuc

SEQ ID NO: 3195016 - RNA, 20 nt, Human
uugguauuuggauaucuguu

SEQ ID NO: 3195017 - RNA, 13 nt, Human
uugguacuguaau

SEQ ID NO: 3195018 - RNA, 17 nt, Human
uugguauauccuuuucu

SEQ ID NO: 3195019 - RNA, 16 nt, Human
uugguauuaauaaaaa

SEQ ID NO: 3195020 - RNA, 18 nt, Human
uugguauuaauaaaaaga

SEQ ID NO: 3195021 - RNA, 16 nt, Human
uuggucugugagaugc

SEQ ID NO: 3195022 - RNA, 13 nt, Human
uuggucuguguga

SEQ ID NO: 3195023 - RNA, 22 nt, Human
uuguaaaaauuaaaaguuaugg

SEQ ID NO: 3195024 - RNA, 22 nt, Human
uuggguucaagcgauucuucug

SEQ ID NO: 3195025 - RNA, 17 nt, Human
uugguaccuugcacaca

SEQ ID NO: 3195026 - RNA, 16 nt, Human
uugguaccuugcacac

SEQ ID NO: 3195027 - RNA, 14 nt, Human
uugguaccuugcac

SEQ ID NO: 3195028 - RNA, 13 nt, Human
uugguaccuugca

SEQ ID NO: 3195029 - RNA, 16 nt, Human
uugcacucaaaucuua

SEQ ID NO: 3195030 - RNA, 21 nt, Human
uugcacuauugagucuucaug

SEQ ID NO: 3195031 - RNA, 21 nt, Human
uugcacucaaaucuuaagaaa

SEQ ID NO: 3195032 - RNA, 20 nt, Human
uugcacucaaaucuuaagaa

SEQ ID NO: 3195033 - RNA, 18 nt, Human
uugcacucaaaucuuaag

SEQ ID NO: 3195034 - RNA, 17 nt, Human
uugcacucaaaucuuaa

SEQ ID NO: 3195035 - RNA, 22 nt, Human
uuguguugacuuuauaaauuuc

SEQ ID NO: 3195036 - RNA, 12 nt, Human
uuguguugaaga

SEQ ID NO: 3195037 - RNA, 18 nt, Human
uuguguugaagagcagcu

SEQ ID NO: 3195038 - RNA, 13 nt, Human
uuguguugaagag

SEQ ID NO: 3195039 - RNA, 21 nt, Human
uuguguuuauauauaagccaa

SEQ ID NO: 3195040 - RNA, 14 nt, Human
uuguguuuauucuu

SEQ ID NO: 3195041 - RNA, 13 nt, Human
uuguguucaccuu

SEQ ID NO: 3195042 - RNA, 16 nt, Human
uuguggacacagcucu

SEQ ID NO: 3195043 - RNA, 21 nt, Human
uuguggaaaaugaaaauuagg

SEQ ID NO: 3195044 - RNA, 17 nt, Human
uuguggacacagcucuu

SEQ ID NO: 3195045 - RNA, 12 nt, Human
uugugccccugc

SEQ ID NO: 3195046 - RNA, 16 nt, Human
uugugccagaaugcuu

SEQ ID NO: 3195047 - RNA, 21 nt, Human
uugugccagaaugcuuuagga

SEQ ID NO: 3195048 - RNA, 18 nt, Human
uugugccaaacaaaauga

SEQ ID NO: 3195049 - RNA, 17 nt, Human
uugugccuuaaagacaa

SEQ ID NO: 3195050 - RNA, 13 nt, Human
uugugcugcuucu

SEQ ID NO: 3195051 - RNA, 20 nt, Human
uugugcaguaacuugggagu

SEQ ID NO: 3195052 - RNA, 17 nt, Human
uugugcaguaacuuggg

SEQ ID NO: 3195053 - RNA, 23 nt, Human
uugugcauuggauaacaccacca

SEQ ID NO: 3195054 - RNA, 15 nt, Human
uugugcacaggcaga

SEQ ID NO: 3195055 - RNA, 18 nt, Human
uuguguuuauucuugaug

SEQ ID NO: 3195056 - RNA, 16 nt, Human
uuguguuuauucuuga

SEQ ID NO: 3195057 - RNA, 21 nt, Human
uuguguuuauucuugaugaaa

SEQ ID NO: 3195058 - RNA, 17 nt, Human
uuguuaaguccuuggcu

SEQ ID NO: 3195059 - RNA, 18 nt, Human
uuguuaauaucacucauu

SEQ ID NO: 3195060 - RNA, 20 nt, Human
uuguuaauaucacucauuaa

SEQ ID NO: 3195061 - RNA, 22 nt, Human
uuguuaauaucacucauuaauu

SEQ ID NO: 3195062 - RNA, 12 nt, Human
uuguuagauguu

SEQ ID NO: 3195063 - RNA, 15 nt, Human
uuguuacucuuggga

SEQ ID NO: 3195064 - RNA, 16 nt, Human
uuguuagaaaaaugga

SEQ ID NO: 3195065 - RNA, 13 nt, Human
uuguuaauuugga

SEQ ID NO: 3195066 - RNA, 24 nt, Human
uuguuaccuuaaaacuaggcauuu

SEQ ID NO: 3195067 - RNA, 20 nt, Human
uuguuucagggcuguggccu

SEQ ID NO: 3195068 - RNA, 15 nt, Human
uuguuuccuuucacu

SEQ ID NO: 3195069 - RNA, 14 nt, Human
uuguuuaaaaucau

SEQ ID NO: 3195070 - RNA, 20 nt, Human
uuguuucuuucucugaggac

SEQ ID NO: 3195071 - RNA, 20 nt, Human
uuguuucuuugaauuuucau

SEQ ID NO: 3195072 - RNA, 14 nt, Human
uuguuucuuugaau

SEQ ID NO: 3195073 - RNA, 22 nt, Human
uuguuucuagacuauaaauguu

SEQ ID NO: 3195074 - RNA, 23 nt, Human
uuguuugaugcauuaaaagaaaa

SEQ ID NO: 3195075 - RNA, 15 nt, Human
uuguuguuuguaugu

SEQ ID NO: 3195076 - RNA, 21 nt, Human
uuguuguuucuuaauuuggaa

SEQ ID NO: 3195077 - RNA, 14 nt, Human
uuguugugugccuc

SEQ ID NO: 3195078 - RNA, 20 nt, Human
uuguuagugugucuuagugu

SEQ ID NO: 3195079 - RNA, 22 nt, Human
uuguuagcauuuucaaugugau

SEQ ID NO: 3195080 - RNA, 21 nt, Human
uuguuaggccaaagacaaaua

SEQ ID NO: 3195081 - RNA, 20 nt, Human
uuguuaggccaaagacaaau

SEQ ID NO: 3195082 - RNA, 22 nt, Human
uuguuaggccaaagacaaauag

SEQ ID NO: 3195083 - RNA, 21 nt, Human
uuccugaggaagagggacugu

SEQ ID NO: 3195084 - RNA, 20 nt, Human
uuccugaguuaggcuuucuc

SEQ ID NO: 3195085 - RNA, 20 nt, Human
uuccugaggcugggcucccu

SEQ ID NO: 3195086 - RNA, 15 nt, Human
uuccugaggcugggc

SEQ ID NO: 3195087 - RNA, 19 nt, Human
uuccugacgagauaagcag

SEQ ID NO: 3195088 - RNA, 23 nt, Human
uuccugaugcuucuucagagacu

SEQ ID NO: 3195089 - RNA, 20 nt, Human
uuccugauagcauaugacaa

SEQ ID NO: 3195090 - RNA, 22 nt, Human
uuccugaguuaggcuuucucuu

SEQ ID NO: 3195091 - RNA, 22 nt, Human
uuccugauagcauaugacaaau

SEQ ID NO: 3195092 - RNA, 19 nt, Human
uuccugauugguuucucuu

SEQ ID NO: 3195093 - RNA, 16 nt, Human
uuccugauugguuucu

SEQ ID NO: 3195094 - RNA, 20 nt, Human
uuccugauugguuucucuuc

SEQ ID NO: 3195095 - RNA, 18 nt, Human
uuccugaagaauugaaaa

SEQ ID NO: 3195096 - RNA, 14 nt, Human
uuccauguaugcau

SEQ ID NO: 3195097 - RNA, 15 nt, Human
uucgguacccaccac

SEQ ID NO: 3195098 - RNA, 20 nt, Human
uuccuugaguugauucagcu

SEQ ID NO: 3195099 - RNA, 21 nt, Human
uuccuugaguugauucagcuc

SEQ ID NO: 3195100 - RNA, 13 nt, Human
uuccuugcauaca

SEQ ID NO: 3195101 - RNA, 15 nt, Human
uuccuugccagucuu

SEQ ID NO: 3195102 - RNA, 14 nt, Human
uuccuugccagucu

SEQ ID NO: 3195103 - RNA, 17 nt, Human
uuccuugcauacaaaca

SEQ ID NO: 3195104 - RNA, 18 nt, Human
uuccugcuuccucagagg

SEQ ID NO: 3195105 - RNA, 17 nt, Human
uuccugcuuccucagag

SEQ ID NO: 3195106 - RNA, 16 nt, Human
uuccugcuuccucaga

SEQ ID NO: 3195107 - RNA, 16 nt, Human
uucuauaauuuuacaa

SEQ ID NO: 3195108 - RNA, 19 nt, Human
uucuauagcaucacuuaaa

SEQ ID NO: 3195109 - RNA, 20 nt, Human
uucuauagcaucacuuaaaa

SEQ ID NO: 3195110 - RNA, 22 nt, Human
uucuauagcaucacuuaaaaca

SEQ ID NO: 3195111 - RNA, 22 nt, Human
uucuacucgaguuacagacaaa

SEQ ID NO: 3195112 - RNA, 16 nt, Human
uucuacuuccaagacu

SEQ ID NO: 3195113 - RNA, 14 nt, Human
uucuacccaggugc

SEQ ID NO: 3195114 - RNA, 21 nt, Human
uucuacccagcgagcccuggu

SEQ ID NO: 3195115 - RNA, 20 nt, Human
uucuacccagcgagcccugg

SEQ ID NO: 3195116 - RNA, 13 nt, Human
uucuacgccaggg

SEQ ID NO: 3195117 - RNA, 20 nt, Human
uucuaccggcuuugccaugu

SEQ ID NO: 3195118 - RNA, 23 nt, Human
uucuaccuauaacacucuaggau

SEQ ID NO: 3195119 - RNA, 18 nt, Human
uucuaccggagagagaau

SEQ ID NO: 3195120 - RNA, 23 nt, Human
uucuaccggagagagaauguauu

SEQ ID NO: 3195121 - RNA, 13 nt, Human
uucuacuauuuau

SEQ ID NO: 3195122 - RNA, 19 nt, Human
uucuacccagcgagcccug

SEQ ID NO: 3195123 - RNA, 12 nt, Human
uucuacccagcg

SEQ ID NO: 3195124 - RNA, 15 nt, Human
uucuacauacuaugg

SEQ ID NO: 3195125 - RNA, 17 nt, Human
uucuacagaaaaacaau

SEQ ID NO: 3195126 - RNA, 15 nt, Human
uucuaauuugcugcu

SEQ ID NO: 3195127 - RNA, 16 nt, Human
uucuaauuugcugcug

SEQ ID NO: 3195128 - RNA, 17 nt, Human
uucuaauuugcugcuga

SEQ ID NO: 3195129 - RNA, 22 nt, Human
uucuaauuugcugcugauaaug

SEQ ID NO: 3195130 - RNA, 20 nt, Human
uucuaauuggcuuuacuauu

SEQ ID NO: 3195131 - RNA, 18 nt, Human
uucgugacaauguuuaca

SEQ ID NO: 3195132 - RNA, 18 nt, Human
uucguacauaauacugaa

SEQ ID NO: 3195133 - RNA, 23 nt, Human
uucuaaugugugaaucagagcac

SEQ ID NO: 3195134 - RNA, 20 nt, Human
uucguuaguaaucuguauaa

SEQ ID NO: 3195135 - RNA, 19 nt, Human
uucgugacaauguuuacaa

SEQ ID NO: 3195136 - RNA, 17 nt, Human
uucuaauuccuguuugu

SEQ ID NO: 3195137 - RNA, 16 nt, Human
uucuaauuagauuaac

SEQ ID NO: 3195138 - RNA, 18 nt, Human
uucuaauuggcuuuacua

SEQ ID NO: 3195139 - RNA, 19 nt, Human
uucugagagcugugcauca

SEQ ID NO: 3195140 - RNA, 13 nt, Human
uucugagagcugu

SEQ ID NO: 3195141 - RNA, 21 nt, Human
uucucugcccagcuuuucauu

SEQ ID NO: 3195142 - RNA, 21 nt, Human
uucugaggccugaauccaaaa

SEQ ID NO: 3195143 - RNA, 18 nt, Human
uucugauaaccauagcau

SEQ ID NO: 3195144 - RNA, 21 nt, Human
uucugagaaagacuauucaaa

SEQ ID NO: 3195145 - RNA, 16 nt, Human
uucugagaaagacuau

SEQ ID NO: 3195146 - RNA, 18 nt, Human
uucugacccugcuucaaa

SEQ ID NO: 3195147 - RNA, 15 nt, Human
uucugagaaagacua

SEQ ID NO: 3195148 - RNA, 16 nt, Human
uucucugcccuccaag

SEQ ID NO: 3195149 - RNA, 23 nt, Human
uucugacccaugcugcccuguga

SEQ ID NO: 3195150 - RNA, 22 nt, Human
uucugacccaugcugcccugug

SEQ ID NO: 3195151 - RNA, 16 nt, Human
uucugcuaaauuucaa

SEQ ID NO: 3195152 - RNA, 19 nt, Human
uucugcucacauaucuguc

SEQ ID NO: 3195153 - RNA, 19 nt, Human
uucugauccuaguuccacc

SEQ ID NO: 3195154 - RNA, 13 nt, Human
uucugauauuaau

SEQ ID NO: 3195155 - RNA, 14 nt, Human
uucugauauuaauu

SEQ ID NO: 3195156 - RNA, 15 nt, Human
uucugaucacugaaa

SEQ ID NO: 3195157 - RNA, 14 nt, Human
uucugaucuucacu

SEQ ID NO: 3195158 - RNA, 14 nt, Human
uucugaugaaaugu

SEQ ID NO: 3195159 - RNA, 18 nt, Human
uucugaugaaauguuaac

SEQ ID NO: 3195160 - RNA, 20 nt, Human
uucugaucacugaaauaaaa

SEQ ID NO: 3195161 - RNA, 19 nt, Human
uucugaucacugaaauaaa

SEQ ID NO: 3195162 - RNA, 15 nt, Human
uucugauucuucaaa

SEQ ID NO: 3195163 - RNA, 20 nt, Human
uucugauuucuuuucaccau

SEQ ID NO: 3195164 - RNA, 13 nt, Human
uucugauuucuuu

SEQ ID NO: 3195165 - RNA, 13 nt, Human
uucucugaggaca

SEQ ID NO: 3195166 - RNA, 20 nt, Human
uucucugaggacaagagaaa

SEQ ID NO: 3195167 - RNA, 16 nt, Human
uucucugaggacaaga

SEQ ID NO: 3195168 - RNA, 11 nt, Human
uucucugcccu

SEQ ID NO: 3195169 - RNA, 12 nt, Human
uucucugcccuc

SEQ ID NO: 3195170 - RNA, 14 nt, Human
uucucugaggacac

SEQ ID NO: 3195171 - RNA, 15 nt, Human
uucucuccagccccu

SEQ ID NO: 3195172 - RNA, 13 nt, Human
uucucuccagccc

SEQ ID NO: 3195173 - RNA, 14 nt, Human
uucucuccagcccc

SEQ ID NO: 3195174 - RNA, 15 nt, Human
uucuaucuacugauu

SEQ ID NO: 3195175 - RNA, 17 nt, Human
uucuaucuacugauuug

SEQ ID NO: 3195176 - RNA, 21 nt, Human
uucucaugccucagccuccug

SEQ ID NO: 3195177 - RNA, 16 nt, Human
uucuccacccugcucu

SEQ ID NO: 3195178 - RNA, 20 nt, Human
uucucauuugccaauaauaa

SEQ ID NO: 3195179 - RNA, 21 nt, Human
uucucauuacuuguugccuau

SEQ ID NO: 3195180 - RNA, 15 nt, Human
uucucauuacuuguu

SEQ ID NO: 3195181 - RNA, 21 nt, Human
uucuccaccucccacaaagga

SEQ ID NO: 3195182 - RNA, 12 nt, Human
uucuccaccugc

SEQ ID NO: 3195183 - RNA, 14 nt, Human
uucuccaccugcca

SEQ ID NO: 3195184 - RNA, 15 nt, Human
uucuccaccugccag

SEQ ID NO: 3195185 - RNA, 16 nt, Human
uucuccaccugccagg

SEQ ID NO: 3195186 - RNA, 18 nt, Human
uucuccaccugccaggga

SEQ ID NO: 3195187 - RNA, 20 nt, Human
uucuccaccugccagggaca

SEQ ID NO: 3195188 - RNA, 12 nt, Human
uucuccacugga

SEQ ID NO: 3195189 - RNA, 20 nt, Human
uugacaaagucaagccacau

SEQ ID NO: 3195190 - RNA, 19 nt, Human
uugacaaagucaagccaca

SEQ ID NO: 3195191 - RNA, 23 nt, Human
uugaauuuucauuuuacaguuac

SEQ ID NO: 3195192 - RNA, 17 nt, Human
uugaauuuucauuuuac

SEQ ID NO: 3195193 - RNA, 24 nt, Human
uugaauuuauuuuuaagaaagaaa

SEQ ID NO: 3195194 - RNA, 12 nt, Human
uugaauuuucau

SEQ ID NO: 3195195 - RNA, 11 nt, Human
uugaauuuuca

SEQ ID NO: 3195196 - RNA, 16 nt, Human
uugaauuuucauuuua

SEQ ID NO: 3195197 - RNA, 15 nt, Human
uugaauuuucauuuu

SEQ ID NO: 3195198 - RNA, 14 nt, Human
uugaauuuucauuu

SEQ ID NO: 3195199 - RNA, 13 nt, Human
uugaauuuucauu

SEQ ID NO: 3195200 - RNA, 23 nt, Human
uugaauuuauuuuuaagaaagaa

SEQ ID NO: 3195201 - RNA, 14 nt, Human
uugaauuguaagga

SEQ ID NO: 3195202 - RNA, 18 nt, Human
uugaacuguuagaaugua

SEQ ID NO: 3195203 - RNA, 17 nt, Human
uugaacuguuagaaugu

SEQ ID NO: 3195204 - RNA, 18 nt, Human
uugaacuggguacuugug

SEQ ID NO: 3195205 - RNA, 15 nt, Human
uugaacucugagaga

SEQ ID NO: 3195206 - RNA, 17 nt, Human
uugaacuccugaccuca

SEQ ID NO: 3195207 - RNA, 15 nt, Human
uugaacuguuagaau

SEQ ID NO: 3195208 - RNA, 14 nt, Human
uugaacuguuagaa

SEQ ID NO: 3195209 - RNA, 14 nt, Human
uugacccacaagaa

SEQ ID NO: 3195210 - RNA, 14 nt, Human
uugacaagcuggcu

SEQ ID NO: 3195211 - RNA, 17 nt, Human
uugacccacaagaaaug

SEQ ID NO: 3195212 - RNA, 17 nt, Human
uugaccgugaggccaga

SEQ ID NO: 3195213 - RNA, 21 nt, Human
uugaccucaggugauccaccc

SEQ ID NO: 3195214 - RNA, 15 nt, Human
uugacaagcuggcuu

SEQ ID NO: 3195215 - RNA, 15 nt, Human
uugaccgacagcuuu

SEQ ID NO: 3195216 - RNA, 17 nt, Human
uugacgccaucccagcc

SEQ ID NO: 3195217 - RNA, 18 nt, Human
uugacgccaucccagccc

SEQ ID NO: 3195218 - RNA, 19 nt, Human
uugacgccaucccagcccc

SEQ ID NO: 3195219 - RNA, 15 nt, Human
uugacgccaucccag

SEQ ID NO: 3195220 - RNA, 21 nt, Human
uugacucuaguacugugaauc

SEQ ID NO: 3195221 - RNA, 23 nt, Human
uugauauccucuuugagugaagc

SEQ ID NO: 3195222 - RNA, 13 nt, Human
uugauauaccaaa

SEQ ID NO: 3195223 - RNA, 19 nt, Human
uugauauaccaaauuaaaa

SEQ ID NO: 3195224 - RNA, 23 nt, Human
uugauagcacagacccugcccug

SEQ ID NO: 3195225 - RNA, 12 nt, Human
uugauaguggga

SEQ ID NO: 3195226 - RNA, 11 nt, Human
uugagccuggg

SEQ ID NO: 3195227 - RNA, 18 nt, Human
uugagcccuuguuucagg

SEQ ID NO: 3195228 - RNA, 20 nt, Human
uugacuguuauuuguugaga

SEQ ID NO: 3195229 - RNA, 16 nt, Human
uugaggguugggcugg

SEQ ID NO: 3195230 - RNA, 13 nt, Human
uugaggguugggc

SEQ ID NO: 3195231 - RNA, 14 nt, Human
uugagccuaaaaau

SEQ ID NO: 3195232 - RNA, 21 nt, Human
uugagccuaaaaauaaagcac

SEQ ID NO: 3195233 - RNA, 17 nt, Human
uugagccuaaaaauaaa

SEQ ID NO: 3195234 - RNA, 22 nt, Human
uugcaaaggagcucacuguggu

SEQ ID NO: 3195235 - RNA, 22 nt, Human
uugauuuuaaaauguacaugua

SEQ ID NO: 3195236 - RNA, 19 nt, Human
uugauuuuaaaauguacau

SEQ ID NO: 3195237 - RNA, 18 nt, Human
uugauuuuaaaauguaca

SEQ ID NO: 3195238 - RNA, 15 nt, Human
uugauuuuaaaaugu

SEQ ID NO: 3195239 - RNA, 18 nt, Human
uugauuuuccaucuaaaa

SEQ ID NO: 3195240 - RNA, 12 nt, Human
uugcaaagcaaa

SEQ ID NO: 3195241 - RNA, 11 nt, Human
uugcaaagcaa

SEQ ID NO: 3195242 - RNA, 19 nt, Human
uugauuugucacugcuuca

SEQ ID NO: 3195243 - RNA, 13 nt, Human
uugauuugauuuu

SEQ ID NO: 3195244 - RNA, 13 nt, Human
uugauuugagauu

SEQ ID NO: 3195245 - RNA, 16 nt, Human
uugaugaucuuugcag

SEQ ID NO: 3195246 - RNA, 17 nt, Human
uugaugacccccaacca

SEQ ID NO: 3195247 - RNA, 13 nt, Human
uugauucucucca

SEQ ID NO: 3195248 - RNA, 19 nt, Human
uugaugcauuaaaagaaaa

SEQ ID NO: 3195249 - RNA, 22 nt, Human
uugaugcaauccuuacaaauga

SEQ ID NO: 3195250 - RNA, 20 nt, Human
uugaugcaauccuuacaaau

SEQ ID NO: 3195251 - RNA, 16 nt, Human
uugaugcaugcuauuc

SEQ ID NO: 3195252 - RNA, 19 nt, Human
uugaugcaauccuuacaaa

SEQ ID NO: 3195253 - RNA, 17 nt, Human
uugaugcaauccuuaca

SEQ ID NO: 3195254 - RNA, 13 nt, Human
uugauugcuuuuu

SEQ ID NO: 3195255 - RNA, 12 nt, Human
uugauugcuuuu

SEQ ID NO: 3195256 - RNA, 14 nt, Human
uugauucucuccau

SEQ ID NO: 3195257 - RNA, 21 nt, Human
uugaaaagaggugugcaagag

SEQ ID NO: 3195258 - RNA, 14 nt, Human
uugaaaagaggugu

SEQ ID NO: 3195259 - RNA, 13 nt, Human
uugaaaagagaca

SEQ ID NO: 3195260 - RNA, 13 nt, Human
uugaaaagaggug

SEQ ID NO: 3195261 - RNA, 15 nt, Human
uugaaaacagaaauu

SEQ ID NO: 3195262 - RNA, 16 nt, Human
uugaacuccuggccuc

SEQ ID NO: 3195263 - RNA, 15 nt, Human
uugaacuccuggccu

SEQ ID NO: 3195264 - RNA, 22 nt, Human
uugaaaauaaccuaauuaauau

SEQ ID NO: 3195265 - RNA, 17 nt, Human
uugaaaaguaauauuua

SEQ ID NO: 3195266 - RNA, 22 nt, Human
uugaaaaguaauauuuauuaaa

SEQ ID NO: 3195267 - RNA, 22 nt, Human
uugaaaacacuguucucugccc

SEQ ID NO: 3195268 - RNA, 19 nt, Human
uugaaaaaauuuaaaagua

SEQ ID NO: 3195269 - RNA, 21 nt, Human
uugaaaaaauuuaaaaguaaa

SEQ ID NO: 3195270 - RNA, 23 nt, Human
uugaaaacacuguucucugcccu

SEQ ID NO: 3195271 - RNA, 24 nt, Human
uugaaaaccaacaccaucacagcu

SEQ ID NO: 3195272 - RNA, 20 nt, Human
uugaaaaaccauuuugcugu

SEQ ID NO: 3195273 - RNA, 17 nt, Human
uucuuauacagauaaaa

SEQ ID NO: 3195274 - RNA, 20 nt, Human
uucuuauacagauaaaacau

SEQ ID NO: 3195275 - RNA, 21 nt, Human
uucuuauacagauaaaacaug

SEQ ID NO: 3195276 - RNA, 21 nt, Human
uucuuauacauuugauaaagu

SEQ ID NO: 3195277 - RNA, 21 nt, Human
uucuuccacaagagcccaggc

SEQ ID NO: 3195278 - RNA, 14 nt, Human
uucuuccaaagcag

SEQ ID NO: 3195279 - RNA, 21 nt, Human
uucuucccacccccuugcccu

SEQ ID NO: 3195280 - RNA, 21 nt, Human
uucuucccaacuugccuuuga

SEQ ID NO: 3195281 - RNA, 19 nt, Human
uucuucccaacuugccuuu

SEQ ID NO: 3195282 - RNA, 22 nt, Human
uucuuccaguuacuuuccaauu

SEQ ID NO: 3195283 - RNA, 12 nt, Human
uucuuccaguua

SEQ ID NO: 3195284 - RNA, 11 nt, Human
uucuuccaguu

SEQ ID NO: 3195285 - RNA, 14 nt, Human
uucuuguguguuua

SEQ ID NO: 3195286 - RNA, 15 nt, Human
uucuuccucauuccc

SEQ ID NO: 3195287 - RNA, 13 nt, Human
uucuuccucccuc

SEQ ID NO: 3195288 - RNA, 21 nt, Human
uucuuguguguuuauugucaa

SEQ ID NO: 3195289 - RNA, 13 nt, Human
uucuuuaaacugu

SEQ ID NO: 3195290 - RNA, 15 nt, Human
uucuuuaaaauuaca

SEQ ID NO: 3195291 - RNA, 12 nt, Human
uucuuucagcca

SEQ ID NO: 3195292 - RNA, 16 nt, Human
uucuuguuuugcuucc

SEQ ID NO: 3195293 - RNA, 13 nt, Human
uucuuguuuugcu

SEQ ID NO: 3195294 - RNA, 19 nt, Human
uucugcuucagccucccga

SEQ ID NO: 3195295 - RNA, 16 nt, Human
uucugcuucagccucc

SEQ ID NO: 3195296 - RNA, 15 nt, Human
uucugcuucagccuc

SEQ ID NO: 3195297 - RNA, 14 nt, Human
uucugcuucagccu

SEQ ID NO: 3195298 - RNA, 17 nt, Human
uucuggacuauagcugu

SEQ ID NO: 3195299 - RNA, 20 nt, Human
uucuggacuauagcuguucu

SEQ ID NO: 3195300 - RNA, 22 nt, Human
uucuggaaucauuguccagagc

SEQ ID NO: 3195301 - RNA, 17 nt, Human
uucugcuuuagacuuga

SEQ ID NO: 3195302 - RNA, 13 nt, Human
uucugcuuuagac

SEQ ID NO: 3195303 - RNA, 18 nt, Human
uucugcuuuccucuuccu

SEQ ID NO: 3195304 - RNA, 19 nt, Human
uucugcuuuagacuugaaa

SEQ ID NO: 3195305 - RNA, 11 nt, Human
uucugcuuugu

SEQ ID NO: 3195306 - RNA, 19 nt, Human
uucugcuuuguugugugcc

SEQ ID NO: 3195307 - RNA, 12 nt, Human
uucugcuuuguu

SEQ ID NO: 3195308 - RNA, 23 nt, Human
uucugcuuuguugugugccucua

SEQ ID NO: 3195309 - RNA, 22 nt, Human
uucugcuuuguugugugccucu

SEQ ID NO: 3195310 - RNA, 20 nt, Human
uucugcuuuguugugugccu

SEQ ID NO: 3195311 - RNA, 21 nt, Human
uucugucuucauccccucaga

SEQ ID NO: 3195312 - RNA, 22 nt, Human
uucugucuucauccccucagaa

SEQ ID NO: 3195313 - RNA, 17 nt, Human
uucugucuucacaacag

SEQ ID NO: 3195314 - RNA, 12 nt, Human
uucuguguauuu

SEQ ID NO: 3195315 - RNA, 13 nt, Human
uucuguguguucc

SEQ ID NO: 3195316 - RNA, 14 nt, Human
uucuguguguuccu

SEQ ID NO: 3195317 - RNA, 15 nt, Human
uucuguguguuccug

SEQ ID NO: 3195318 - RNA, 16 nt, Human
uucuguguguuccugg

SEQ ID NO: 3195319 - RNA, 17 nt, Human
uucuguguguuccuggc

SEQ ID NO: 3195320 - RNA, 10 nt, Human
uucugugugu

SEQ ID NO: 3195321 - RNA, 17 nt, Human
uucuguguuuacagaga

SEQ ID NO: 3195322 - RNA, 14 nt, Human
uucuguguuuacag

SEQ ID NO: 3195323 - RNA, 18 nt, Human
uucuguauuuuguuuuug

SEQ ID NO: 3195324 - RNA, 16 nt, Human
uucuguauuugaaagu

SEQ ID NO: 3195325 - RNA, 17 nt, Human
uucuguauuugaaagug

SEQ ID NO: 3195326 - RNA, 19 nt, Human
uucuguauuugaaagugcc

SEQ ID NO: 3195327 - RNA, 23 nt, Human
uucugucaaagucagaacaaauu

SEQ ID NO: 3195328 - RNA, 22 nt, Human
uucugucaaagucagaacaaau

SEQ ID NO: 3195329 - RNA, 14 nt, Human
uucuggaugggaca

SEQ ID NO: 3195330 - RNA, 15 nt, Human
uucuguauuugaaag

SEQ ID NO: 3195331 - RNA, 14 nt, Human
uucuguauuugaaa

SEQ ID NO: 3195332 - RNA, 19 nt, Human
uucuguccuacucuguguc

SEQ ID NO: 3195333 - RNA, 19 nt, Human
uucugucacaguaaaaaua

SEQ ID NO: 3195334 - RNA, 14 nt, Human
uucugucucucccu

SEQ ID NO: 3195335 - RNA, 15 nt, Human
uucuguccuguaacu

SEQ ID NO: 3195336 - RNA, 18 nt, Human
uuauguuguuuuguacag

SEQ ID NO: 3195337 - RNA, 14 nt, Human
uuauggcugcauag

SEQ ID NO: 3195338 - RNA, 17 nt, Human
uuauggauaugaaaaau

SEQ ID NO: 3195339 - RNA, 18 nt, Human
uuauggcuauaggugcua

SEQ ID NO: 3195340 - RNA, 18 nt, Human
uuauggaacacucugaga

SEQ ID NO: 3195341 - RNA, 20 nt, Human
uuauggaacacucugagacu

SEQ ID NO: 3195342 - RNA, 21 nt, Human
uuauggacaaugacccagugg

SEQ ID NO: 3195343 - RNA, 16 nt, Human
uuauggaacacucuga

SEQ ID NO: 3195344 - RNA, 17 nt, Human
uuauggaacacucugag

SEQ ID NO: 3195345 - RNA, 18 nt, Human
uuaucuugaaggaaaaau

SEQ ID NO: 3195346 - RNA, 22 nt, Human
uuauuaaauuuuuuuguaugaa

SEQ ID NO: 3195347 - RNA, 19 nt, Human
uuauuaacuuaauaaucaa

SEQ ID NO: 3195348 - RNA, 14 nt, Human
uuauuaacuuaaua

SEQ ID NO: 3195349 - RNA, 17 nt, Human
uuauuaacuuaauaauc

SEQ ID NO: 3195350 - RNA, 20 nt, Human
uuauuaaauuuuuuuguaug

SEQ ID NO: 3195351 - RNA, 21 nt, Human
uuauuaaauuuuuuuguauga

SEQ ID NO: 3195352 - RNA, 12 nt, Human
uuauuaaaugua

SEQ ID NO: 3195353 - RNA, 15 nt, Human
uuauuaaauguagcu

SEQ ID NO: 3195354 - RNA, 18 nt, Human
uuauuaaauguagcuuca

SEQ ID NO: 3195355 - RNA, 24 nt, Human
uuauuaaauguagcuucagucauu

SEQ ID NO: 3195356 - RNA, 13 nt, Human
uuauuaaauugca

SEQ ID NO: 3195357 - RNA, 17 nt, Human
uuauuaaauuguaaaac

SEQ ID NO: 3195358 - RNA, 17 nt, Human
uuauguuuuuguacucu

SEQ ID NO: 3195359 - RNA, 18 nt, Human
uuauguuuuuguacucug

SEQ ID NO: 3195360 - RNA, 15 nt, Human
uuauuaaaugcuuca

SEQ ID NO: 3195361 - RNA, 17 nt, Human
uuauuaaaugcuucauu

SEQ ID NO: 3195362 - RNA, 19 nt, Human
uuauuaaaugcccagcccc

SEQ ID NO: 3195363 - RNA, 21 nt, Human
uuauuaaaugcccagccccuu

SEQ ID NO: 3195364 - RNA, 20 nt, Human
uuauguuugccacuuugcaa

SEQ ID NO: 3195365 - RNA, 11 nt, Human
uuauguuugcc

SEQ ID NO: 3195366 - RNA, 23 nt, Human
uuauguuuugguccacuuuucca

SEQ ID NO: 3195367 - RNA, 20 nt, Human
uuauguuuugguccacuuuu

SEQ ID NO: 3195368 - RNA, 18 nt, Human
uuauguuuugguccacuu

SEQ ID NO: 3195369 - RNA, 13 nt, Human
uuauuaaucacug

SEQ ID NO: 3195370 - RNA, 12 nt, Human
uuauuaaucacu

SEQ ID NO: 3195371 - RNA, 18 nt, Human
uuauuaagguuacagauu

SEQ ID NO: 3195372 - RNA, 15 nt, Human
uuauuaagcuuuuug

SEQ ID NO: 3195373 - RNA, 19 nt, Human
uuauuaagcuuuuuggaau

SEQ ID NO: 3195374 - RNA, 21 nt, Human
uuaucuucugcucuuucuucu

SEQ ID NO: 3195375 - RNA, 22 nt, Human
uuaucuucuggacuauagcugu

SEQ ID NO: 3195376 - RNA, 17 nt, Human
uuaucuugaaggaaaaa

SEQ ID NO: 3195377 - RNA, 11 nt, Human
uuaucucaaaa

SEQ ID NO: 3195378 - RNA, 18 nt, Human
uuaucucagauauuugca

SEQ ID NO: 3195379 - RNA, 19 nt, Human
uuaucucagauauuugcac

SEQ ID NO: 3195380 - RNA, 16 nt, Human
uuaucucagauguuaa

SEQ ID NO: 3195381 - RNA, 17 nt, Human
uuaucucagauguuaaa

SEQ ID NO: 3195382 - RNA, 22 nt, Human
uuaucucagauguuaaaauaaa

SEQ ID NO: 3195383 - RNA, 13 nt, Human
uuaucuauauaaa

SEQ ID NO: 3195384 - RNA, 15 nt, Human
uuaucuauauaaaau

SEQ ID NO: 3195385 - RNA, 16 nt, Human
uuaucuauauaaaaua

SEQ ID NO: 3195386 - RNA, 20 nt, Human
uuaucuaccaacuuucaaga

SEQ ID NO: 3195387 - RNA, 18 nt, Human
uuaucuaccaacuuucaa

SEQ ID NO: 3195388 - RNA, 17 nt, Human
uuaucuaccaacuuuca

SEQ ID NO: 3195389 - RNA, 14 nt, Human
uuaucuaccaacuu

SEQ ID NO: 3195390 - RNA, 19 nt, Human
uuaucgcccuggcaggcag

SEQ ID NO: 3195391 - RNA, 20 nt, Human
uuaucgcccuggcaggcagg

SEQ ID NO: 3195392 - RNA, 18 nt, Human
uuaucguccagugacuuu

SEQ ID NO: 3195393 - RNA, 17 nt, Human
uuaucguccagugacuu

SEQ ID NO: 3195394 - RNA, 14 nt, Human
uuauauuguaagaa

SEQ ID NO: 3195395 - RNA, 22 nt, Human
uuauauuguaagaaauacugua

SEQ ID NO: 3195396 - RNA, 16 nt, Human
uuauauuguaagaaau

SEQ ID NO: 3195397 - RNA, 24 nt, Human
uuauauuguaagaaauacuguaca

SEQ ID NO: 3195398 - RNA, 20 nt, Human
uuauauuuauugacucuuga

SEQ ID NO: 3195399 - RNA, 10 nt, Human
uuauauuuca

SEQ ID NO: 3195400 - RNA, 18 nt, Human
uuauauuucaaguacacu

SEQ ID NO: 3195401 - RNA, 11 nt, Human
uuauauuucaa

SEQ ID NO: 3195402 - RNA, 15 nt, Human
uuauauuuauugacu

SEQ ID NO: 3195403 - RNA, 14 nt, Human
uuaucccuuaagaa

SEQ ID NO: 3195404 - RNA, 16 nt, Human
uuaucccuuaagaaug

SEQ ID NO: 3195405 - RNA, 15 nt, Human
uuaucccuuaagaau

SEQ ID NO: 3195406 - RNA, 19 nt, Human
uuauauuucaaguacacug

SEQ ID NO: 3195407 - RNA, 15 nt, Human
uuauauggaagaaag

SEQ ID NO: 3195408 - RNA, 18 nt, Human
uuauauggaagaaaguaa

SEQ ID NO: 3195409 - RNA, 19 nt, Human
uuauauguauguguuuaga

SEQ ID NO: 3195410 - RNA, 20 nt, Human
uuauauguauguguuuagaa

SEQ ID NO: 3195411 - RNA, 21 nt, Human
uuauauguauguguuuagaau

SEQ ID NO: 3195412 - RNA, 12 nt, Human
uuauauguaugu

SEQ ID NO: 3195413 - RNA, 14 nt, Human
uuauauguaugugu

SEQ ID NO: 3195414 - RNA, 15 nt, Human
uuauauguauguguu

SEQ ID NO: 3195415 - RNA, 16 nt, Human
uuauauguauguguuu

SEQ ID NO: 3195416 - RNA, 17 nt, Human
uuauauguauguguuua

SEQ ID NO: 3195417 - RNA, 15 nt, Human
uuauaugaacauaca

SEQ ID NO: 3195418 - RNA, 17 nt, Human
uuauaugaacauacaaa

SEQ ID NO: 3195419 - RNA, 13 nt, Human
uuauaugaacaua

SEQ ID NO: 3195420 - RNA, 21 nt, Human
uuauaugaacauacaaaugca

SEQ ID NO: 3195421 - RNA, 23 nt, Human
uuauaucuccuuuguauucuguc

SEQ ID NO: 3195422 - RNA, 17 nt, Human
uuauacaguuauaaaau

SEQ ID NO: 3195423 - RNA, 21 nt, Human
uuauacaguuauaaaauuaaa

SEQ ID NO: 3195424 - RNA, 17 nt, Human
uuauauccauuuuuauc

SEQ ID NO: 3195425 - RNA, 18 nt, Human
uuauauccaguaacacau

SEQ ID NO: 3195426 - RNA, 22 nt, Human
uuauaucagacugcuuugagaa

SEQ ID NO: 3195427 - RNA, 17 nt, Human
uuauaucagacugcuuu

SEQ ID NO: 3195428 - RNA, 22 nt, Human
uuauacagaccgaacuguugua

SEQ ID NO: 3195429 - RNA, 16 nt, Human
uuauacaaccuucauu

SEQ ID NO: 3195430 - RNA, 19 nt, Human
uuauacaaccuucauuuaa

SEQ ID NO: 3195431 - RNA, 15 nt, Human
uuauaauuguugcau

SEQ ID NO: 3195432 - RNA, 14 nt, Human
uuauaauuguugca

SEQ ID NO: 3195433 - RNA, 15 nt, Human
uuauaaugaaugaaa

SEQ ID NO: 3195434 - RNA, 22 nt, Human
uuauaauguauucauauuugua

SEQ ID NO: 3195435 - RNA, 19 nt, Human
uuauaauguauucauauuu

SEQ ID NO: 3195436 - RNA, 13 nt, Human
uuauaauguauuc

SEQ ID NO: 3195437 - RNA, 12 nt, Human
uuauaauguauu

SEQ ID NO: 3195438 - RNA, 14 nt, Human
uuauaaugaaugac

SEQ ID NO: 3195439 - RNA, 16 nt, Human
uuauaaucagaaugga

SEQ ID NO: 3195440 - RNA, 23 nt, Human
uuauaaucagaauggaagagaga

SEQ ID NO: 3195441 - RNA, 15 nt, Human
uuauaauaauguuaa

SEQ ID NO: 3195442 - RNA, 18 nt, Human
uuauaauaauguuaacau

SEQ ID NO: 3195443 - RNA, 14 nt, Human
uuauaaucaccagg

SEQ ID NO: 3195444 - RNA, 21 nt, Human
uuaguggacccugaaaugugu

SEQ ID NO: 3195445 - RNA, 19 nt, Human
uuaguggacccugaaaugu

SEQ ID NO: 3195446 - RNA, 16 nt, Human
uuaguggacccugaaa

SEQ ID NO: 3195447 - RNA, 20 nt, Human
uuauaagaaaaaugugaauu

SEQ ID NO: 3195448 - RNA, 13 nt, Human
uuauaagaaaaau

SEQ ID NO: 3195449 - RNA, 16 nt, Human
uuagugagacauauuu

SEQ ID NO: 3195450 - RNA, 14 nt, Human
uuagucuuuauacu

SEQ ID NO: 3195451 - RNA, 19 nt, Human
uuagugaccucagcuuuga

SEQ ID NO: 3195452 - RNA, 13 nt, Human
ugugaaaagaaaa

SEQ ID NO: 3195453 - RNA, 15 nt, Human
ugugaaaagaaaaau

SEQ ID NO: 3195454 - RNA, 17 nt, Human
ugugaaaagaaaaauga

SEQ ID NO: 3195455 - RNA, 19 nt, Human
ugucuuaauggaugaaauc

SEQ ID NO: 3195456 - RNA, 13 nt, Human
uuauuuuaaaaga

SEQ ID NO: 3195457 - RNA, 19 nt, Human
uuauuugugauguacugua

SEQ ID NO: 3195458 - RNA, 15 nt, Human
uuauuugucagugua

SEQ ID NO: 3195459 - RNA, 15 nt, Human
uuauuucuuuuacuu

SEQ ID NO: 3195460 - RNA, 14 nt, Human
uuauuugaaugacu

SEQ ID NO: 3195461 - RNA, 21 nt, Human
uuauuagcagcugacuuucaa

SEQ ID NO: 3195462 - RNA, 18 nt, Human
uuauuagcccugcauuuu

SEQ ID NO: 3195463 - RNA, 23 nt, Human
uuauuagcccugcauuuucauag

SEQ ID NO: 3195464 - RNA, 23 nt, Human
uuauuagcagcugacuuucaaag

SEQ ID NO: 3195465 - RNA, 21 nt, Human
uucaauaaaguuugaucuucc

SEQ ID NO: 3195466 - RNA, 19 nt, Human
uucaauaaaguuugaucuu

SEQ ID NO: 3195467 - RNA, 18 nt, Human
uucaauaaaguuugaucu

SEQ ID NO: 3195468 - RNA, 16 nt, Human
uucaauaaaguuugau

SEQ ID NO: 3195469 - RNA, 15 nt, Human
uucaauaaaguuuga

SEQ ID NO: 3195470 - RNA, 21 nt, Human
uucaacagguuuuccugaaga

SEQ ID NO: 3195471 - RNA, 18 nt, Human
uucaaauguguuuugguc

SEQ ID NO: 3195472 - RNA, 21 nt, Human
uucaaauguguuuugguccug

SEQ ID NO: 3195473 - RNA, 17 nt, Human
uucaacaguuucaaaau

SEQ ID NO: 3195474 - RNA, 17 nt, Human
uucaaauggaguuggag

SEQ ID NO: 3195475 - RNA, 16 nt, Human
uuauuuuaaaauuuca

SEQ ID NO: 3195476 - RNA, 22 nt, Human
uuauuuuggaaaauaaauuauu

SEQ ID NO: 3195477 - RNA, 21 nt, Human
uuauuuuggagagauaggaag

SEQ ID NO: 3195478 - RNA, 13 nt, Human
uucacggaagagc

SEQ ID NO: 3195479 - RNA, 22 nt, Human
uucaccuuuguccccaccgcag

SEQ ID NO: 3195480 - RNA, 15 nt, Human
uucacgauucauuuu

SEQ ID NO: 3195481 - RNA, 17 nt, Human
uucacggaagagccuug

SEQ ID NO: 3195482 - RNA, 14 nt, Human
uucagacagcugcc

SEQ ID NO: 3195483 - RNA, 15 nt, Human
uucagacagcugccu

SEQ ID NO: 3195484 - RNA, 16 nt, Human
uucagacagcugccug

SEQ ID NO: 3195485 - RNA, 17 nt, Human
uucagacagcugccugg

SEQ ID NO: 3195486 - RNA, 14 nt, Human
uucagcucacugca

SEQ ID NO: 3195487 - RNA, 20 nt, Human
uucaauaggaaaaacugauu

SEQ ID NO: 3195488 - RNA, 18 nt, Human
uucaauaguaauauaaua

SEQ ID NO: 3195489 - RNA, 22 nt, Human
uucaauaggaaaaacugauuuu

SEQ ID NO: 3195490 - RNA, 21 nt, Human
uucaauaggaaaaacugauuu

SEQ ID NO: 3195491 - RNA, 16 nt, Human
uucaauauauuuguau

SEQ ID NO: 3195492 - RNA, 20 nt, Human
uucacaaauauuaaaaaguc

SEQ ID NO: 3195493 - RNA, 19 nt, Human
uucacaaauauuaaaaagu

SEQ ID NO: 3195494 - RNA, 15 nt, Human
uucacaaauauuaaa

SEQ ID NO: 3195495 - RNA, 14 nt, Human
uucacaaauauuaa

SEQ ID NO: 3195496 - RNA, 12 nt, Human
uucacaaauauu

SEQ ID NO: 3195497 - RNA, 11 nt, Human
uucacaaauau

SEQ ID NO: 3195498 - RNA, 19 nt, Human
uucaccuuuguccccaccg

SEQ ID NO: 3195499 - RNA, 20 nt, Human
uucaccuuuguccccaccgc

SEQ ID NO: 3195500 - RNA, 14 nt, Human
uucaccuuuguccc

SEQ ID NO: 3195501 - RNA, 13 nt, Human
uucacccuuuucu

SEQ ID NO: 3195502 - RNA, 21 nt, Human
uucacaaccuucuguggcuca

SEQ ID NO: 3195503 - RNA, 22 nt, Human
uucacaaauauuaaaaagucuu

SEQ ID NO: 3195504 - RNA, 18 nt, Human
uucauuuuuuuuaauuga

SEQ ID NO: 3195505 - RNA, 14 nt, Human
uuccaaaacaaaaa

SEQ ID NO: 3195506 - RNA, 20 nt, Human
uuccaaagcagagagcauua

SEQ ID NO: 3195507 - RNA, 17 nt, Human
uuccaaccauuuaucuu

SEQ ID NO: 3195508 - RNA, 19 nt, Human
uuccaaccauuuaucuuga

SEQ ID NO: 3195509 - RNA, 18 nt, Human
uuccaaccauuuaucuug

SEQ ID NO: 3195510 - RNA, 22 nt, Human
uucauuuuugaaacugcauuug

SEQ ID NO: 3195511 - RNA, 13 nt, Human
uucaucuggaagu

SEQ ID NO: 3195512 - RNA, 14 nt, Human
uucaucuggaaguu

SEQ ID NO: 3195513 - RNA, 15 nt, Human
uuccagagcugccag

SEQ ID NO: 3195514 - RNA, 21 nt, Human
uuccagagcauuccagucagg

SEQ ID NO: 3195515 - RNA, 13 nt, Human
uuccagagcauuc

SEQ ID NO: 3195516 - RNA, 11 nt, Human
uuccagagcau

SEQ ID NO: 3195517 - RNA, 19 nt, Human
uuccaacccucaucaccaa

SEQ ID NO: 3195518 - RNA, 21 nt, Human
uuccaaccauuuaucuugaag

SEQ ID NO: 3195519 - RNA, 20 nt, Human
uuccaaccauuuaucuugaa

SEQ ID NO: 3195520 - RNA, 14 nt, Human
uuccagaaucugua

SEQ ID NO: 3195521 - RNA, 14 nt, Human
uuccauggacuuug

SEQ ID NO: 3195522 - RNA, 15 nt, Human
uuccauggacuuugu

SEQ ID NO: 3195523 - RNA, 23 nt, Human
uuccauauuuuuuuccuuacaua

SEQ ID NO: 3195524 - RNA, 18 nt, Human
uuccauauuuuuuuccuu

SEQ ID NO: 3195525 - RNA, 21 nt, Human
uuccauauuagaaaacuuugu

SEQ ID NO: 3195526 - RNA, 18 nt, Human
uuccauauuagaaaacuu

SEQ ID NO: 3195527 - RNA, 17 nt, Human
uuccauauuagaaaacu

SEQ ID NO: 3195528 - RNA, 16 nt, Human
uuccauauuagaaaac

SEQ ID NO: 3195529 - RNA, 13 nt, Human
uucagcuugggga

SEQ ID NO: 3195530 - RNA, 13 nt, Human
uucaguggcagcu

SEQ ID NO: 3195531 - RNA, 14 nt, Human
uucaguggcagcug

SEQ ID NO: 3195532 - RNA, 22 nt, Human
uucagcuuguaaauagcucagg

SEQ ID NO: 3195533 - RNA, 15 nt, Human
uucagcuccagcuca

SEQ ID NO: 3195534 - RNA, 12 nt, Human
uucagcuccagc

SEQ ID NO: 3195535 - RNA, 21 nt, Human
uucagcugguugagguuucaa

SEQ ID NO: 3195536 - RNA, 16 nt, Human
uucaguggcagcugcu

SEQ ID NO: 3195537 - RNA, 15 nt, Human
uucaguggcagcugc

SEQ ID NO: 3195538 - RNA, 17 nt, Human
uucaguggcagcugcuu

SEQ ID NO: 3195539 - RNA, 12 nt, Human
uucaguguacau

SEQ ID NO: 3195540 - RNA, 16 nt, Human
uucaguguaaagugug

SEQ ID NO: 3195541 - RNA, 13 nt, Human
uucaguguacaug

SEQ ID NO: 3195542 - RNA, 20 nt, Human
uucaucugagagaggcuaaa

SEQ ID NO: 3195543 - RNA, 20 nt, Human
uucauccuuucacuucuuuc

SEQ ID NO: 3195544 - RNA, 16 nt, Human
uucaucccuucucuuc

SEQ ID NO: 3195545 - RNA, 15 nt, Human
uucauccuuucacuu

SEQ ID NO: 3195546 - RNA, 12 nt, Human
uucauccuuuca

SEQ ID NO: 3195547 - RNA, 18 nt, Human
uucaucccuucucuucca

SEQ ID NO: 3195548 - RNA, 17 nt, Human
uucauccuucccacucu

SEQ ID NO: 3195549 - RNA, 12 nt, Human
uucauccuuccc

SEQ ID NO: 3195550 - RNA, 15 nt, Human
uucauccuccucaga

SEQ ID NO: 3195551 - RNA, 19 nt, Human
uucauccuccucagaucuu

SEQ ID NO: 3195552 - RNA, 15 nt, Human
uucauaaccuagccu

SEQ ID NO: 3195553 - RNA, 16 nt, Human
uucaguuuuuguguuu

SEQ ID NO: 3195554 - RNA, 22 nt, Human
uucaguucaaagucaugauguu

SEQ ID NO: 3195555 - RNA, 17 nt, Human
uucaguucaaagucaug

SEQ ID NO: 3195556 - RNA, 16 nt, Human
uucaguucaaagucau

SEQ ID NO: 3195557 - RNA, 13 nt, Human
uucaguucaaagu

SEQ ID NO: 3195558 - RNA, 21 nt, Human
uucaguguuucuggggagcug

SEQ ID NO: 3195559 - RNA, 13 nt, Human
uucaguguuucug

SEQ ID NO: 3195560 - RNA, 10 nt, Human
uucaguguuu

SEQ ID NO: 3195561 - RNA, 21 nt, Human
uuuuauuuuucucaugaugag

SEQ ID NO: 3195562 - RNA, 18 nt, Human
uuuuauuuuuagacagag

SEQ ID NO: 3195563 - RNA, 17 nt, Human
uuuucaaaauaaaaaug

SEQ ID NO: 3195564 - RNA, 17 nt, Human
uuuuauuuuuagaauuu

SEQ ID NO: 3195565 - RNA, 13 nt, Human
uuuuaucucagau

SEQ ID NO: 3195566 - RNA, 18 nt, Human
uuuuauauuucaaguaca

SEQ ID NO: 3195567 - RNA, 16 nt, Human
uuuuauuuucuaaagu

SEQ ID NO: 3195568 - RNA, 14 nt, Human
uuuuaugaagaaaa

SEQ ID NO: 3195569 - RNA, 19 nt, Human
uuuuauagaaaaacaaauc

SEQ ID NO: 3195570 - RNA, 15 nt, Human
uuuuauauuucaagu

SEQ ID NO: 3195571 - RNA, 11 nt, Human
uuuuauauuuc

SEQ ID NO: 3195572 - RNA, 15 nt, Human
uuuuauaccuguuua

SEQ ID NO: 3195573 - RNA, 17 nt, Human
uuuuauaccuguuuaaa

SEQ ID NO: 3195574 - RNA, 16 nt, Human
uuuuauaccuguuuaa

SEQ ID NO: 3195575 - RNA, 13 nt, Human
uuuuauagugugu

SEQ ID NO: 3195576 - RNA, 19 nt, Human
uuuuacccuauaucuauaa

SEQ ID NO: 3195577 - RNA, 13 nt, Human
uuuuaaaggcauu

SEQ ID NO: 3195578 - RNA, 19 nt, Human
uuuuaaaggcauuagaguc

SEQ ID NO: 3195579 - RNA, 17 nt, Human
uuuuacaauaaaaucuu

SEQ ID NO: 3195580 - RNA, 23 nt, Human
uuuuacaaaggcuguauucagca

SEQ ID NO: 3195581 - RNA, 18 nt, Human
uuuuacaaaggcuguauu

SEQ ID NO: 3195582 - RNA, 19 nt, Human
uuuuacaaaaaagaaaaga

SEQ ID NO: 3195583 - RNA, 21 nt, Human
uuuuaaauaaaaauuacugug

SEQ ID NO: 3195584 - RNA, 12 nt, Human
uuuuaaaguuca

SEQ ID NO: 3195585 - RNA, 18 nt, Human
uuuuaaaguucauugcaa

SEQ ID NO: 3195586 - RNA, 20 nt, Human
uuuucagaagaaauaaauau

SEQ ID NO: 3195587 - RNA, 18 nt, Human
uuuucccuauuagagaag

SEQ ID NO: 3195588 - RNA, 22 nt, Human
uuuucccuauuagagaagagau

SEQ ID NO: 3195589 - RNA, 15 nt, Human
uuuucccaggaaaga

SEQ ID NO: 3195590 - RNA, 18 nt, Human
uuuucacauccuugacuu

SEQ ID NO: 3195591 - RNA, 15 nt, Human
uuuucacauccuuga

SEQ ID NO: 3195592 - RNA, 18 nt, Human
uuuucaaauggaguugga

SEQ ID NO: 3195593 - RNA, 17 nt, Human
uuuucacccuucuacuc

SEQ ID NO: 3195594 - RNA, 20 nt, Human
uuuucaccuuuucaggaaaa

SEQ ID NO: 3195595 - RNA, 23 nt, Human
uuuucaccauucguacauaauac

SEQ ID NO: 3195596 - RNA, 13 nt, Human
uuuucuuauuuca

SEQ ID NO: 3195597 - RNA, 20 nt, Human
uuuucuacucgaguuacaga

SEQ ID NO: 3195598 - RNA, 22 nt, Human
uuuucuacucgaguuacagaca

SEQ ID NO: 3195599 - RNA, 13 nt, Human
uuuucuacucgag

SEQ ID NO: 3195600 - RNA, 22 nt, Human
uuuucccugaaguuauguguau

SEQ ID NO: 3195601 - RNA, 18 nt, Human
uuuuccgcauucuuugua

SEQ ID NO: 3195602 - RNA, 21 nt, Human
uuuucccugaaguuaugugua

SEQ ID NO: 3195603 - RNA, 15 nt, Human
uuuucccugaaguua

SEQ ID NO: 3195604 - RNA, 16 nt, Human
uuuucccucagaaaau

SEQ ID NO: 3195605 - RNA, 22 nt, Human
uuuucuuguguguuuauuguca

SEQ ID NO: 3195606 - RNA, 13 nt, Human
uuuucuucaucaa

SEQ ID NO: 3195607 - RNA, 11 nt, Human
uuuucuuguau

SEQ ID NO: 3195608 - RNA, 19 nt, Human
uuuucuuguaucuggauuc

SEQ ID NO: 3195609 - RNA, 13 nt, Human
uuuucuucucccu

SEQ ID NO: 3195610 - RNA, 17 nt, Human
uuuucuucacucaaauu

SEQ ID NO: 3195611 - RNA, 16 nt, Human
uuuucuuucagccaag

SEQ ID NO: 3195612 - RNA, 22 nt, Human
uuuucuuuacaaacaaaagcau

SEQ ID NO: 3195613 - RNA, 12 nt, Human
uuuuaaaaucuu

SEQ ID NO: 3195614 - RNA, 20 nt, Human
uuuuaaacccuauugguaaa

SEQ ID NO: 3195615 - RNA, 19 nt, Human
uuuuaaaauacuguagaua

SEQ ID NO: 3195616 - RNA, 12 nt, Human
uuuuaaaauacu

SEQ ID NO: 3195617 - RNA, 21 nt, Human
uuuguuacucucuuccacaug

SEQ ID NO: 3195618 - RNA, 16 nt, Human
uuuguuacucuuggga

SEQ ID NO: 3195619 - RNA, 17 nt, Human
uuuguuaccuuaaaacu

SEQ ID NO: 3195620 - RNA, 18 nt, Human
uuuguuaccuuaaaacua

SEQ ID NO: 3195621 - RNA, 20 nt, Human
uuuguuaauuuggaccauuu

SEQ ID NO: 3195622 - RNA, 23 nt, Human
uuuguguguucacuaaacucuga

SEQ ID NO: 3195623 - RNA, 19 nt, Human
uuuguguguucacuaaacu

SEQ ID NO: 3195624 - RNA, 15 nt, Human
uuuguugucagcuga

SEQ ID NO: 3195625 - RNA, 19 nt, Human
uuuguugccagauuucaga

SEQ ID NO: 3195626 - RNA, 23 nt, Human
uuuguugcacugaaguuugauaa

SEQ ID NO: 3195627 - RNA, 20 nt, Human
uuuguugccagauuucagaa

SEQ ID NO: 3195628 - RNA, 10 nt, Human
uuuguugcac

SEQ ID NO: 3195629 - RNA, 16 nt, Human
uuuguugauucucucc

SEQ ID NO: 3195630 - RNA, 23 nt, Human
uuuguugagcugguaacaucguu

SEQ ID NO: 3195631 - RNA, 22 nt, Human
uuuguugcacugaaguuugaua

SEQ ID NO: 3195632 - RNA, 21 nt, Human
uuuguugcacugaaguuugau

SEQ ID NO: 3195633 - RNA, 18 nt, Human
uuuguugcacugaaguuu

SEQ ID NO: 3195634 - RNA, 17 nt, Human
uuuguugcacugaaguu

SEQ ID NO: 3195635 - RNA, 20 nt, Human
uuuggucaguuggguuuuua

SEQ ID NO: 3195636 - RNA, 19 nt, Human
uuugguccacuuuuccagu

SEQ ID NO: 3195637 - RNA, 18 nt, Human
uuugguccacuuuuccag

SEQ ID NO: 3195638 - RNA, 17 nt, Human
uuuggaccauuuuccug

SEQ ID NO: 3195639 - RNA, 12 nt, Human
uuuguauucugu

SEQ ID NO: 3195640 - RNA, 13 nt, Human
uuuguauuguccu

SEQ ID NO: 3195641 - RNA, 17 nt, Human
uuuguauucugucuuca

SEQ ID NO: 3195642 - RNA, 15 nt, Human
uuuguauuguccuau

SEQ ID NO: 3195643 - RNA, 22 nt, Human
uuuguauuguccuauuaguguu

SEQ ID NO: 3195644 - RNA, 16 nt, Human
uuuguauuuauucuuu

SEQ ID NO: 3195645 - RNA, 13 nt, Human
uuuguauuuauuc

SEQ ID NO: 3195646 - RNA, 18 nt, Human
uuugugugcuaaacgugu

SEQ ID NO: 3195647 - RNA, 20 nt, Human
uuuguguggagucauuucug

SEQ ID NO: 3195648 - RNA, 18 nt, Human
uuuguguguuacaaugua

SEQ ID NO: 3195649 - RNA, 14 nt, Human
uuuguauuuuuagu

SEQ ID NO: 3195650 - RNA, 13 nt, Human
uuugcauugucug

SEQ ID NO: 3195651 - RNA, 14 nt, Human
uuugcauugucugu

SEQ ID NO: 3195652 - RNA, 21 nt, Human
uuugguagcugggaaagcaua

SEQ ID NO: 3195653 - RNA, 20 nt, Human
uuuggacacauuuaaggugu

SEQ ID NO: 3195654 - RNA, 15 nt, Human
uuuggaaaucucuuu

SEQ ID NO: 3195655 - RNA, 12 nt, Human
uuuggaaaauaa

SEQ ID NO: 3195656 - RNA, 13 nt, Human
uuugcauuuaaga

SEQ ID NO: 3195657 - RNA, 21 nt, Human
uuugcauuuaagaauugccag

SEQ ID NO: 3195658 - RNA, 13 nt, Human
uuugcauuucaga

SEQ ID NO: 3195659 - RNA, 13 nt, Human
uuuggaaacuaau

SEQ ID NO: 3195660 - RNA, 15 nt, Human
uuuggaaacuaauaa

SEQ ID NO: 3195661 - RNA, 16 nt, Human
uuuggaaacuaauaaa

SEQ ID NO: 3195662 - RNA, 17 nt, Human
uuuggaaacuaauaaaa

SEQ ID NO: 3195663 - RNA, 18 nt, Human
uuuggaaacuaauaaaau

SEQ ID NO: 3195664 - RNA, 19 nt, Human
uuuggaaacuaauaaaaua

SEQ ID NO: 3195665 - RNA, 20 nt, Human
uuuggaaacuaauaaaauau

SEQ ID NO: 3195666 - RNA, 21 nt, Human
uuuggaaacuaauaaaauauu

SEQ ID NO: 3195667 - RNA, 16 nt, Human
uuuggaaaguagaaaa

SEQ ID NO: 3195668 - RNA, 16 nt, Human
uuuggaaagacuggac

SEQ ID NO: 3195669 - RNA, 15 nt, Human
uuuccaauaugugau

SEQ ID NO: 3195670 - RNA, 14 nt, Human
uuuccaauauguga

SEQ ID NO: 3195671 - RNA, 17 nt, Human
uuuccaauucuccuuua

SEQ ID NO: 3195672 - RNA, 15 nt, Human
uuuccaauucuccuu

SEQ ID NO: 3195673 - RNA, 14 nt, Human
uuuccaauucuccu

SEQ ID NO: 3195674 - RNA, 17 nt, Human
uuuccaauaugugauuu

SEQ ID NO: 3195675 - RNA, 13 nt, Human
uuucccuuugcca

SEQ ID NO: 3195676 - RNA, 17 nt, Human
uuuccgccacaucccuc

SEQ ID NO: 3195677 - RNA, 21 nt, Human
uuucccuuuagcuguguuauu

SEQ ID NO: 3195678 - RNA, 19 nt, Human
uuucccuuuagcuguguua

SEQ ID NO: 3195679 - RNA, 18 nt, Human
uuucccuuuagcuguguu

SEQ ID NO: 3195680 - RNA, 13 nt, Human
uuugagugccuua

SEQ ID NO: 3195681 - RNA, 21 nt, Human
uuugagugccuuacacaaugg

SEQ ID NO: 3195682 - RNA, 23 nt, Human
uuuccguuugauuugucacugcu

SEQ ID NO: 3195683 - RNA, 16 nt, Human
uuugcacucaaaucuu

SEQ ID NO: 3195684 - RNA, 21 nt, Human
uuugcacucaaaucuuaagaa

SEQ ID NO: 3195685 - RNA, 19 nt, Human
uuugcacucaaaucuuaag

SEQ ID NO: 3195686 - RNA, 23 nt, Human
uuugcacucuuguuucucccgug

SEQ ID NO: 3195687 - RNA, 15 nt, Human
uuugcacucuuguuu

SEQ ID NO: 3195688 - RNA, 17 nt, Human
uuuugaacucuucucau

SEQ ID NO: 3195689 - RNA, 19 nt, Human
uuuugaagugagaaaauga

SEQ ID NO: 3195690 - RNA, 18 nt, Human
uuuugaagugagaaaaug

SEQ ID NO: 3195691 - RNA, 15 nt, Human
uuuugacauggaaau

SEQ ID NO: 3195692 - RNA, 15 nt, Human
uuuugaccuuugaua

SEQ ID NO: 3195693 - RNA, 17 nt, Human
uuuuuaacuuuaccaug

SEQ ID NO: 3195694 - RNA, 21 nt, Human
uuuuuaacuuuaccaugcuca

SEQ ID NO: 3195695 - RNA, 17 nt, Human
uuuuuaaucaugaauau

SEQ ID NO: 3195696 - RNA, 16 nt, Human
uuuuuaagugaaauuu

SEQ ID NO: 3195697 - RNA, 17 nt, Human
uuuuuaaccucuguuca

SEQ ID NO: 3195698 - RNA, 21 nt, Human
uuuuuaaugcuaaucuuguga

SEQ ID NO: 3195699 - RNA, 22 nt, Human
uuuuuaaucuacugcauuuagg

SEQ ID NO: 3195700 - RNA, 20 nt, Human
uuuuuaaugcuaaucuugug

SEQ ID NO: 3195701 - RNA, 13 nt, Human
uuuuuaaugauau

SEQ ID NO: 3195702 - RNA, 18 nt, Human
uuuuucauuuuaaaaagu

SEQ ID NO: 3195703 - RNA, 12 nt, Human
uuuuucauauuu

SEQ ID NO: 3195704 - RNA, 16 nt, Human
uuuuucaguucaaagu

SEQ ID NO: 3195705 - RNA, 14 nt, Human
uuuuucaguucaaa

SEQ ID NO: 3195706 - RNA, 13 nt, Human
uuuuucaguucaa

SEQ ID NO: 3195707 - RNA, 23 nt, Human
uuuuucccaggcaaauaaaauuc

SEQ ID NO: 3195708 - RNA, 16 nt, Human
uuuuucccauuuagaa

SEQ ID NO: 3195709 - RNA, 15 nt, Human
uuuuucccauuuaga

SEQ ID NO: 3195710 - RNA, 18 nt, Human
uuuuuuaaucuacugcau

SEQ ID NO: 3195711 - RNA, 12 nt, Human
uuuuuuaaucua

SEQ ID NO: 3195712 - RNA, 13 nt, Human
uuuuuuacaaagg

SEQ ID NO: 3195713 - RNA, 14 nt, Human
uuuuuuuguacgac

SEQ ID NO: 3195714 - RNA, 11 nt, Human
uuuuuuuccuu

SEQ ID NO: 3195715 - RNA, 14 nt, Human
uuuuuuugaaacuu

SEQ ID NO: 3195716 - RNA, 12 nt, Human
uuuuuuuccuua

SEQ ID NO: 3195717 - RNA, 12 nt, Human
uuuuuuucuacc

SEQ ID NO: 3195718 - RNA, 12 nt, Human
uuuuuuuaagug

SEQ ID NO: 3195719 - RNA, 20 nt, Human
uuuuuuccuuacauaaacau

SEQ ID NO: 3195720 - RNA, 14 nt, Human
uuuuuuccuuacau

SEQ ID NO: 3195721 - RNA, 13 nt, Human
uuuuuuccacuua

SEQ ID NO: 3195722 - RNA, 12 nt, Human
uuuuuuccuguu

SEQ ID NO: 3195723 - RNA, 13 nt, Human
uuuuuuguuuguu

SEQ ID NO: 3195724 - RNA, 13 nt, Human
uuuuuuuucccau

SEQ ID NO: 3195725 - RNA, 14 nt, Human
cauuccagaggaag

SEQ ID NO: 3195726 - RNA, 16 nt, Human
cauuccagucaggcuc

SEQ ID NO: 3195727 - RNA, 17 nt, Human
cauuccaggcccgaagc

SEQ ID NO: 3195728 - RNA, 12 nt, Human
cauuccaggccc

SEQ ID NO: 3195729 - RNA, 15 nt, Human
cauuccccaggaggc

SEQ ID NO: 3195730 - RNA, 17 nt, Human
cauuccccaggaggcca

SEQ ID NO: 3195731 - RNA, 13 nt, Human
cauuccccaggag

SEQ ID NO: 3195732 - RNA, 17 nt, Human
cauuccccgucucuggu

SEQ ID NO: 3195733 - RNA, 18 nt, Human
cauucccucgucuuuccc

SEQ ID NO: 3195734 - RNA, 19 nt, Human
cauucccucgucuuuccca

SEQ ID NO: 3195735 - RNA, 18 nt, Human
cauuccccaggaggccag

SEQ ID NO: 3195736 - RNA, 19 nt, Human
cauuccccaggaggccagc

SEQ ID NO: 3195737 - RNA, 20 nt, Human
cauuccccaggaggccagcc

SEQ ID NO: 3195738 - RNA, 13 nt, Human
cauuccccauggg

SEQ ID NO: 3195739 - RNA, 19 nt, Human
cauucauauuacaauauuu

SEQ ID NO: 3195740 - RNA, 13 nt, Human
cauuccagaggaa

SEQ ID NO: 3195741 - RNA, 22 nt, Human
cauuccaccuucccaugcccug

SEQ ID NO: 3195742 - RNA, 17 nt, Human
cauuccaccuucccaug

SEQ ID NO: 3195743 - RNA, 18 nt, Human
cauucauauuacaauauu

SEQ ID NO: 3195744 - RNA, 17 nt, Human
cauucauauuacaauau

SEQ ID NO: 3195745 - RNA, 15 nt, Human
cauucauacuuaaaa

SEQ ID NO: 3195746 - RNA, 18 nt, Human
cauucauacuuaaaaauu

SEQ ID NO: 3195747 - RNA, 22 nt, Human
cauucauacuuaaaaauuuauu

SEQ ID NO: 3195748 - RNA, 11 nt, Human
cauuaccaaaa

SEQ ID NO: 3195749 - RNA, 20 nt, Human
cauuaccaaaauaauaaaaa

SEQ ID NO: 3195750 - RNA, 23 nt, Human
cauuaccaaaauaauaaaaauca

SEQ ID NO: 3195751 - RNA, 21 nt, Human
cauuacaagccuggaaaaaaa

SEQ ID NO: 3195752 - RNA, 20 nt, Human
cauuacaagccuggaaaaaa

SEQ ID NO: 3195753 - RNA, 12 nt, Human
cauuaauuuaaa

SEQ ID NO: 3195754 - RNA, 14 nt, Human
cauuaauuuaaaug

SEQ ID NO: 3195755 - RNA, 18 nt, Human
cauuaauuuaaaugauuu

SEQ ID NO: 3195756 - RNA, 22 nt, Human
cauuacaacugaccaaguuucu

SEQ ID NO: 3195757 - RNA, 18 nt, Human
cauuaaaauaugcacuaa

SEQ ID NO: 3195758 - RNA, 16 nt, Human
cauuaaaauaugcacu

SEQ ID NO: 3195759 - RNA, 13 nt, Human
cauuaacugcuuc

SEQ ID NO: 3195760 - RNA, 15 nt, Human
cauuaacugcuuccu

SEQ ID NO: 3195761 - RNA, 17 nt, Human
cauuaaggccacaucca

SEQ ID NO: 3195762 - RNA, 20 nt, Human
cauuacuguuuaagacacuu

SEQ ID NO: 3195763 - RNA, 18 nt, Human
cauuagaauuaccauuug

SEQ ID NO: 3195764 - RNA, 17 nt, Human
cauuacuuguugccuau

SEQ ID NO: 3195765 - RNA, 18 nt, Human
cauuacuuguugccuaua

SEQ ID NO: 3195766 - RNA, 13 nt, Human
cauucaaaaauuu

SEQ ID NO: 3195767 - RNA, 14 nt, Human
cauucaaaaauuuc

SEQ ID NO: 3195768 - RNA, 15 nt, Human
cauucacauuuagaa

SEQ ID NO: 3195769 - RNA, 23 nt, Human
cauucuucuguacgucugacagg

SEQ ID NO: 3195770 - RNA, 22 nt, Human
cauucuucugaucacugaaaua

SEQ ID NO: 3195771 - RNA, 19 nt, Human
cauucuucugaucacugaa

SEQ ID NO: 3195772 - RNA, 13 nt, Human
cauucuucugauc

SEQ ID NO: 3195773 - RNA, 20 nt, Human
cauucuggggaaacaacauu

SEQ ID NO: 3195774 - RNA, 11 nt, Human
cauucuguccu

SEQ ID NO: 3195775 - RNA, 21 nt, Human
cauucuucccaacuugccuuu

SEQ ID NO: 3195776 - RNA, 20 nt, Human
cauucugccugcccaggccc

SEQ ID NO: 3195777 - RNA, 19 nt, Human
cauucugccugcccaggcc

SEQ ID NO: 3195778 - RNA, 18 nt, Human
cauucugccugcccaggc

SEQ ID NO: 3195779 - RNA, 17 nt, Human
cauucugccugcccagg

SEQ ID NO: 3195780 - RNA, 16 nt, Human
cauucugccugcccag

SEQ ID NO: 3195781 - RNA, 15 nt, Human
cauucugccugccca

SEQ ID NO: 3195782 - RNA, 13 nt, Human
cauucugccugcc

SEQ ID NO: 3195783 - RNA, 12 nt, Human
cauucugccugc

SEQ ID NO: 3195784 - RNA, 14 nt, Human
cauuccugaugcuu

SEQ ID NO: 3195785 - RNA, 16 nt, Human
cauuccugaugcuucu

SEQ ID NO: 3195786 - RNA, 19 nt, Human
cauuccugaugcuucuuca

SEQ ID NO: 3195787 - RNA, 22 nt, Human
cauuccugaugcuucuucagag

SEQ ID NO: 3195788 - RNA, 23 nt, Human
cauuccugaugcuucuucagaga

SEQ ID NO: 3195789 - RNA, 15 nt, Human
cauucugacucauau

SEQ ID NO: 3195790 - RNA, 12 nt, Human
cauucugaauua

SEQ ID NO: 3195791 - RNA, 15 nt, Human
cauucugaauuaauu

SEQ ID NO: 3195792 - RNA, 20 nt, Human
cauucugaauuaauuaauuu

SEQ ID NO: 3195793 - RNA, 21 nt, Human
cauucugaauuaauuaauuug

SEQ ID NO: 3195794 - RNA, 23 nt, Human
cauucugaauuaauuaauuugga

SEQ ID NO: 3195795 - RNA, 17 nt, Human
ccaaaccaccagaagcc

SEQ ID NO: 3195796 - RNA, 22 nt, Human
ccaaacauuaauguugauuucu

SEQ ID NO: 3195797 - RNA, 21 nt, Human
ccaaacauuaauguugauuuc

SEQ ID NO: 3195798 - RNA, 18 nt, Human
ccaaacauuaauguugau

SEQ ID NO: 3195799 - RNA, 14 nt, Human
ccaaacacaggcaa

SEQ ID NO: 3195800 - RNA, 13 nt, Human
ccaaacacaggca

SEQ ID NO: 3195801 - RNA, 18 nt, Human
ccaaacacacagaagggg

SEQ ID NO: 3195802 - RNA, 15 nt, Human
ccaaacauuaauguu

SEQ ID NO: 3195803 - RNA, 15 nt, Human
ccaaaauuuuaaaaa

SEQ ID NO: 3195804 - RNA, 13 nt, Human
ccaaacacacaga

SEQ ID NO: 3195805 - RNA, 17 nt, Human
ccaaacacacagaaggg

SEQ ID NO: 3195806 - RNA, 15 nt, Human
ccaaacacacagaag

SEQ ID NO: 3195807 - RNA, 14 nt, Human
ccaaaauuaaggug

SEQ ID NO: 3195808 - RNA, 15 nt, Human
ccaaaauuaaggugu

SEQ ID NO: 3195809 - RNA, 17 nt, Human
cauuuuuaguagagaca

SEQ ID NO: 3195810 - RNA, 20 nt, Human
ccaaaaugugagugguugaa

SEQ ID NO: 3195811 - RNA, 16 nt, Human
cauuuuuagccugugu

SEQ ID NO: 3195812 - RNA, 14 nt, Human
cauuuuuacaaguu

SEQ ID NO: 3195813 - RNA, 12 nt, Human
cauuuucucuuu

SEQ ID NO: 3195814 - RNA, 16 nt, Human
cauuuucucuuagaaa

SEQ ID NO: 3195815 - RNA, 15 nt, Human
cauuuucucuuagaa

SEQ ID NO: 3195816 - RNA, 14 nt, Human
cauuuucucuuaga

SEQ ID NO: 3195817 - RNA, 12 nt, Human
cauuuucucuua

SEQ ID NO: 3195818 - RNA, 15 nt, Human
cauuuucauuagcaa

SEQ ID NO: 3195819 - RNA, 21 nt, Human
cauuuucagauucaggcauuu

SEQ ID NO: 3195820 - RNA, 19 nt, Human
cauuuucagauucaggcau

SEQ ID NO: 3195821 - RNA, 17 nt, Human
cauuuucauuagcaaaa

SEQ ID NO: 3195822 - RNA, 19 nt, Human
cauuuuacaguuacuuuuc

SEQ ID NO: 3195823 - RNA, 20 nt, Human
cauuuuacagagaaagaaau

SEQ ID NO: 3195824 - RNA, 22 nt, Human
cauuuuacaguuacuuuuccuu

SEQ ID NO: 3195825 - RNA, 22 nt, Human
cauuuuaccaucacacauguuc

SEQ ID NO: 3195826 - RNA, 13 nt, Human
cauuugcugaaua

SEQ ID NO: 3195827 - RNA, 15 nt, Human
cauuugcuuuggaag

SEQ ID NO: 3195828 - RNA, 14 nt, Human
cauuugcuuuggaa

SEQ ID NO: 3195829 - RNA, 13 nt, Human
cauuugauuugua

SEQ ID NO: 3195830 - RNA, 18 nt, Human
cauuucuuuuuaaaaaaa

SEQ ID NO: 3195831 - RNA, 13 nt, Human
cauugugggaagg

SEQ ID NO: 3195832 - RNA, 15 nt, Human
cauugugggaagggg

SEQ ID NO: 3195833 - RNA, 21 nt, Human
cauuguaaaugugcuuuuaaa

SEQ ID NO: 3195834 - RNA, 21 nt, Human
cauuguaagcguauggcuuua

SEQ ID NO: 3195835 - RNA, 13 nt, Human
cauuguaauguug

SEQ ID NO: 3195836 - RNA, 23 nt, Human
cauuguaauguugugaauaauua

SEQ ID NO: 3195837 - RNA, 19 nt, Human
cauuguaauguugugaaua

SEQ ID NO: 3195838 - RNA, 14 nt, Human
cauuguaauguugu

SEQ ID NO: 3195839 - RNA, 15 nt, Human
cauuuaaaaaaaauc

SEQ ID NO: 3195840 - RNA, 17 nt, Human
cauuguuuuucugauau

SEQ ID NO: 3195841 - RNA, 17 nt, Human
cauuuaaauuuuuuggc

SEQ ID NO: 3195842 - RNA, 18 nt, Human
cauuuaaauuuuuuggca

SEQ ID NO: 3195843 - RNA, 12 nt, Human
cauuuaaauuuu

SEQ ID NO: 3195844 - RNA, 22 nt, Human
cauuuaaaaagguuuaaaacua

SEQ ID NO: 3195845 - RNA, 12 nt, Human
cauuuaaaacau

SEQ ID NO: 3195846 - RNA, 19 nt, Human
cauuuaaaacauuaaaaua

SEQ ID NO: 3195847 - RNA, 18 nt, Human
cauuuaagaauugccagu

SEQ ID NO: 3195848 - RNA, 15 nt, Human
cauugaccugaggcc

SEQ ID NO: 3195849 - RNA, 17 nt, Human
cauugaccugaggcccu

SEQ ID NO: 3195850 - RNA, 14 nt, Human
cauugaccugaggc

SEQ ID NO: 3195851 - RNA, 18 nt, Human
cauugaccugaggcccuu

SEQ ID NO: 3195852 - RNA, 20 nt, Human
cauugauacaaucauagcau

SEQ ID NO: 3195853 - RNA, 17 nt, Human
cauugaaaaauguccac

SEQ ID NO: 3195854 - RNA, 17 nt, Human
cauucuuuuugcucuaa

SEQ ID NO: 3195855 - RNA, 23 nt, Human
cauucuuuuugcucuaaaauauu

SEQ ID NO: 3195856 - RNA, 19 nt, Human
cauucuuuuugcucuaaaa

SEQ ID NO: 3195857 - RNA, 15 nt, Human
cauugaacucugaga

SEQ ID NO: 3195858 - RNA, 22 nt, Human
cauuuacugcauucuucugauc

SEQ ID NO: 3195859 - RNA, 20 nt, Human
cauuuacugcauucuucuga

SEQ ID NO: 3195860 - RNA, 22 nt, Human
cauuuaauggggaggacaaaau

SEQ ID NO: 3195861 - RNA, 18 nt, Human
cauguuuuucuucucccu

SEQ ID NO: 3195862 - RNA, 20 nt, Human
cauguuuuucuucucccuca

SEQ ID NO: 3195863 - RNA, 19 nt, Human
cauguuuuucuucucccuc

SEQ ID NO: 3195864 - RNA, 23 nt, Human
cauguuugauguaucugagcagg

SEQ ID NO: 3195865 - RNA, 20 nt, Human
cauguuucuuugaucaugaa

SEQ ID NO: 3195866 - RNA, 11 nt, Human
cauguuucuuu

SEQ ID NO: 3195867 - RNA, 22 nt, Human
cauguuucuuugaucaugaaua

SEQ ID NO: 3195868 - RNA, 17 nt, Human
cauuaaaagaaaauaaa

SEQ ID NO: 3195869 - RNA, 14 nt, Human
cauuaaaagaaaau

SEQ ID NO: 3195870 - RNA, 13 nt, Human
cauuaaaagaaaa

SEQ ID NO: 3195871 - RNA, 12 nt, Human
cauuaaaagaaa

SEQ ID NO: 3195872 - RNA, 20 nt, Human
cauuaaaagaaaauaaaaaa

SEQ ID NO: 3195873 - RNA, 14 nt, Human
cauuaaaauauaau

SEQ ID NO: 3195874 - RNA, 11 nt, Human
cauuaaaauau

SEQ ID NO: 3195875 - RNA, 15 nt, Human
caugucuuauuuaaa

SEQ ID NO: 3195876 - RNA, 14 nt, Human
caugucuuauuuaa

SEQ ID NO: 3195877 - RNA, 12 nt, Human
caugucuggcua

SEQ ID NO: 3195878 - RNA, 14 nt, Human
caugucucgacuca

SEQ ID NO: 3195879 - RNA, 21 nt, Human
caugugaugagaggaaaucac

SEQ ID NO: 3195880 - RNA, 17 nt, Human
caugugaucucauuguu

SEQ ID NO: 3195881 - RNA, 18 nt, Human
caugugaugagaggaaau

SEQ ID NO: 3195882 - RNA, 20 nt, Human
caugugaugagaggaaauca

SEQ ID NO: 3195883 - RNA, 16 nt, Human
caugugaugagaggaa

SEQ ID NO: 3195884 - RNA, 17 nt, Human
caugugaugagaggaaa

SEQ ID NO: 3195885 - RNA, 15 nt, Human
caugugaugagagga

SEQ ID NO: 3195886 - RNA, 20 nt, Human
caugugagcugcugccauga

SEQ ID NO: 3195887 - RNA, 18 nt, Human
caugugagcugcugccau

SEQ ID NO: 3195888 - RNA, 14 nt, Human
caugugcacaugca

SEQ ID NO: 3195889 - RNA, 22 nt, Human
caugugccagguuuuuggucug

SEQ ID NO: 3195890 - RNA, 21 nt, Human
caugugcaaacccacucagag

SEQ ID NO: 3195891 - RNA, 18 nt, Human
caugugaucucauuguuc

SEQ ID NO: 3195892 - RNA, 18 nt, Human
cauguguuggcagccucu

SEQ ID NO: 3195893 - RNA, 15 nt, Human
cauguguuaaucuua

SEQ ID NO: 3195894 - RNA, 16 nt, Human
caugguuugacucugg

SEQ ID NO: 3195895 - RNA, 22 nt, Human
caugguuuaaaagaaaaaauga

SEQ ID NO: 3195896 - RNA, 22 nt, Human
cauggugguugggacccagugg

SEQ ID NO: 3195897 - RNA, 19 nt, Human
cauggugguugggacccag

SEQ ID NO: 3195898 - RNA, 23 nt, Human
caugguggggucuccucaggacc

SEQ ID NO: 3195899 - RNA, 21 nt, Human
caugguggggucuccucagga

SEQ ID NO: 3195900 - RNA, 15 nt, Human
caugguggggucucc

SEQ ID NO: 3195901 - RNA, 20 nt, Human
caugguggggucuccucagg

SEQ ID NO: 3195902 - RNA, 18 nt, Human
caugguggggucuccuca

SEQ ID NO: 3195903 - RNA, 14 nt, Human
cauguaaaagccua

SEQ ID NO: 3195904 - RNA, 20 nt, Human
caugucuccuacugaggaua

SEQ ID NO: 3195905 - RNA, 18 nt, Human
caugucuccuacugagga

SEQ ID NO: 3195906 - RNA, 16 nt, Human
caugucuccuacugag

SEQ ID NO: 3195907 - RNA, 13 nt, Human
caugucuauuguc

SEQ ID NO: 3195908 - RNA, 14 nt, Human
caugucuauugucc

SEQ ID NO: 3195909 - RNA, 14 nt, Human
cauguacuaucuua

SEQ ID NO: 3195910 - RNA, 21 nt, Human
cauguacuaucuuaucucaga

SEQ ID NO: 3195911 - RNA, 15 nt, Human
cauguacuaucuuau

SEQ ID NO: 3195912 - RNA, 15 nt, Human
cauggcagcccucgg

SEQ ID NO: 3195913 - RNA, 23 nt, Human
caugggacagggaggacgcucuc

SEQ ID NO: 3195914 - RNA, 12 nt, Human
caugggagggag

SEQ ID NO: 3195915 - RNA, 14 nt, Human
caugggagggagcu

SEQ ID NO: 3195916 - RNA, 20 nt, Human
caugggagggagcugagaag

SEQ ID NO: 3195917 - RNA, 18 nt, Human
caugggccuccugugugu

SEQ ID NO: 3195918 - RNA, 14 nt, Human
caugggccaccacg

SEQ ID NO: 3195919 - RNA, 14 nt, Human
caugggcaggagac

SEQ ID NO: 3195920 - RNA, 15 nt, Human
caugggucgcccaug

SEQ ID NO: 3195921 - RNA, 17 nt, Human
caugggucgcccaugag

SEQ ID NO: 3195922 - RNA, 19 nt, Human
caugggucgcccaugagag

SEQ ID NO: 3195923 - RNA, 21 nt, Human
caugggucgcccaugagagcg

SEQ ID NO: 3195924 - RNA, 18 nt, Human
cauggaaaugaagcaggg

SEQ ID NO: 3195925 - RNA, 14 nt, Human
caugagguaucuaa

SEQ ID NO: 3195926 - RNA, 15 nt, Human
cauggaaaaaugcca

SEQ ID NO: 3195927 - RNA, 16 nt, Human
cauggaaaaaugccau

SEQ ID NO: 3195928 - RNA, 21 nt, Human
cauggaaaaaugccaucaaau

SEQ ID NO: 3195929 - RNA, 22 nt, Human
cauggaaaaaugccaucaaaug

SEQ ID NO: 3195930 - RNA, 17 nt, Human
caugcuuugugaacaag

SEQ ID NO: 3195931 - RNA, 17 nt, Human
caugcuuuccauauuuu

SEQ ID NO: 3195932 - RNA, 16 nt, Human
caugcuuuccauauuu

SEQ ID NO: 3195933 - RNA, 19 nt, Human
caugcuuguguuucuuagu

SEQ ID NO: 3195934 - RNA, 18 nt, Human
caugcuuguguuucuuag

SEQ ID NO: 3195935 - RNA, 15 nt, Human
cauggacuuccacug

SEQ ID NO: 3195936 - RNA, 15 nt, Human
cauggacauuuagaa

SEQ ID NO: 3195937 - RNA, 18 nt, Human
cauggacauuuagaagaa

SEQ ID NO: 3195938 - RNA, 20 nt, Human
cauggacauuuagaagaaag

SEQ ID NO: 3195939 - RNA, 20 nt, Human
cauggaccaugcugucuggc

SEQ ID NO: 3195940 - RNA, 14 nt, Human
cauggaccaugcug

SEQ ID NO: 3195941 - RNA, 13 nt, Human
cauggaccaugcu

SEQ ID NO: 3195942 - RNA, 13 nt, Human
caugcugucccuu

SEQ ID NO: 3195943 - RNA, 15 nt, Human
caugcugucccuuac

SEQ ID NO: 3195944 - RNA, 12 nt, Human
caugcuguguaa

SEQ ID NO: 3195945 - RNA, 13 nt, Human
caugcuguguaag

SEQ ID NO: 3195946 - RNA, 18 nt, Human
caugcuguguaagcugug

SEQ ID NO: 3195947 - RNA, 19 nt, Human
caugcuguguaagcugugu

SEQ ID NO: 3195948 - RNA, 19 nt, Human
caugcagccacuuaggaca

SEQ ID NO: 3195949 - RNA, 14 nt, Human
caugcagcaucuaa

SEQ ID NO: 3195950 - RNA, 17 nt, Human
caugcagaguauuucua

SEQ ID NO: 3195951 - RNA, 19 nt, Human
caucauguuuacagaggac

SEQ ID NO: 3195952 - RNA, 21 nt, Human
caucauguuuacagaggacag

SEQ ID NO: 3195953 - RNA, 13 nt, Human
caucauguuuaca

SEQ ID NO: 3195954 - RNA, 14 nt, Human
caucaugucuauug

SEQ ID NO: 3195955 - RNA, 15 nt, Human
caucaugucuauugu

SEQ ID NO: 3195956 - RNA, 15 nt, Human
caucaugucuggcua

SEQ ID NO: 3195957 - RNA, 14 nt, Human
caucaugucuggcu

SEQ ID NO: 3195958 - RNA, 13 nt, Human
caucaugucuggc

SEQ ID NO: 3195959 - RNA, 21 nt, Human
caucauggggggagcacccug

SEQ ID NO: 3195960 - RNA, 16 nt, Human
caucauccuaagcuau

SEQ ID NO: 3195961 - RNA, 19 nt, Human
caucaucuguaagcuguuu

SEQ ID NO: 3195962 - RNA, 13 nt, Human
caucaucuguaag

SEQ ID NO: 3195963 - RNA, 13 nt, Human
caucauagaaacu

SEQ ID NO: 3195964 - RNA, 16 nt, Human
caucauauuauacaga

SEQ ID NO: 3195965 - RNA, 14 nt, Human
caucauauuauaca

SEQ ID NO: 3195966 - RNA, 15 nt, Human
caucaguacuuguuu

SEQ ID NO: 3195967 - RNA, 23 nt, Human
caucagguuaggcaguauaaaga

SEQ ID NO: 3195968 - RNA, 15 nt, Human
caucaggugaggugu

SEQ ID NO: 3195969 - RNA, 12 nt, Human
caucagugccaa

SEQ ID NO: 3195970 - RNA, 20 nt, Human
caucaccaacgucugugcca

SEQ ID NO: 3195971 - RNA, 12 nt, Human
caucacccgcua

SEQ ID NO: 3195972 - RNA, 17 nt, Human
cauccagguucagcuug

SEQ ID NO: 3195973 - RNA, 22 nt, Human
caucauuccuuuuuauuuauau

SEQ ID NO: 3195974 - RNA, 12 nt, Human
cauccauccagg

SEQ ID NO: 3195975 - RNA, 12 nt, Human
caucauuauuau

SEQ ID NO: 3195976 - RNA, 15 nt, Human
caucauuccaggccc

SEQ ID NO: 3195977 - RNA, 19 nt, Human
caucauuccuuuuuauuua

SEQ ID NO: 3195978 - RNA, 20 nt, Human
caucauuccuuuuuauuuau

SEQ ID NO: 3195979 - RNA, 15 nt, Human
caucauuccuuuuua

SEQ ID NO: 3195980 - RNA, 23 nt, Human
cauccacugugccaugugccagg

SEQ ID NO: 3195981 - RNA, 17 nt, Human
cauccacugugccaugu

SEQ ID NO: 3195982 - RNA, 14 nt, Human
cauccacugugcca

SEQ ID NO: 3195983 - RNA, 22 nt, Human
caucccugaaggccccgcccag

SEQ ID NO: 3195984 - RNA, 14 nt, Human
caucccuccuuaag

SEQ ID NO: 3195985 - RNA, 16 nt, Human
caucccuccuuaagag

SEQ ID NO: 3195986 - RNA, 20 nt, Human
cauccgaccagguugucacu

SEQ ID NO: 3195987 - RNA, 16 nt, Human
cauccgaccagguugu

SEQ ID NO: 3195988 - RNA, 16 nt, Human
caucccuucucuucca

SEQ ID NO: 3195989 - RNA, 15 nt, Human
caucccuucucuucc

SEQ ID NO: 3195990 - RNA, 23 nt, Human
caucccuucucuuccaggcagcc

SEQ ID NO: 3195991 - RNA, 22 nt, Human
caucccuucucuuccaggcagc

SEQ ID NO: 3195992 - RNA, 18 nt, Human
caucccuucucuuccagg

SEQ ID NO: 3195993 - RNA, 23 nt, Human
cauauuuggaauaaaaauuccag

SEQ ID NO: 3195994 - RNA, 23 nt, Human
cauauuuguacuuucuguuaaaa

SEQ ID NO: 3195995 - RNA, 21 nt, Human
cauauuuguacuuucuguuaa

SEQ ID NO: 3195996 - RNA, 20 nt, Human
cauauuuguacuuucuguua

SEQ ID NO: 3195997 - RNA, 18 nt, Human
cauauuuguacuuucugu

SEQ ID NO: 3195998 - RNA, 14 nt, Human
cauauuuguacuuu

SEQ ID NO: 3195999 - RNA, 18 nt, Human
cauauucuguuggccagu

SEQ ID NO: 3196000 - RNA, 12 nt, Human
cauauugacuuu

SEQ ID NO: 3196001 - RNA, 13 nt, Human
cauauugacuuuu

SEQ ID NO: 3196002 - RNA, 22 nt, Human
cauauucuguuggccaguguga

SEQ ID NO: 3196003 - RNA, 19 nt, Human
cauaugacaaauguuucua

SEQ ID NO: 3196004 - RNA, 17 nt, Human
cauaugacaaauguuuc

SEQ ID NO: 3196005 - RNA, 14 nt, Human
cauaugaacuuuca

SEQ ID NO: 3196006 - RNA, 14 nt, Human
cauaugacaaaugu

SEQ ID NO: 3196007 - RNA, 20 nt, Human
cauauugguauauccuuuuc

SEQ ID NO: 3196008 - RNA, 16 nt, Human
cagugcugaucuaaaa

SEQ ID NO: 3196009 - RNA, 18 nt, Human
cagugcugggauuacagg

SEQ ID NO: 3196010 - RNA, 14 nt, Human
cagugcuuagcaaa

SEQ ID NO: 3196011 - RNA, 16 nt, Human
cagugcuuagcaaaaa

SEQ ID NO: 3196012 - RNA, 24 nt, Human
cagugcuuagcaaaaaauaaugac

SEQ ID NO: 3196013 - RNA, 15 nt, Human
cauaguaugguggcu

SEQ ID NO: 3196014 - RNA, 20 nt, Human
cauaguaaauguaguucaua

SEQ ID NO: 3196015 - RNA, 19 nt, Human
cauaguaaauguaguucau

SEQ ID NO: 3196016 - RNA, 15 nt, Human
cauaguaaauguagu

SEQ ID NO: 3196017 - RNA, 16 nt, Human
cauaguaugguggcug

SEQ ID NO: 3196018 - RNA, 20 nt, Human
cauaguagaacuuuauaaaa

SEQ ID NO: 3196019 - RNA, 23 nt, Human
cauauaagauucauauuuacuuc

SEQ ID NO: 3196020 - RNA, 17 nt, Human
cauauaagcccuugauu

SEQ ID NO: 3196021 - RNA, 20 nt, Human
cauagucugaagugaaguac

SEQ ID NO: 3196022 - RNA, 20 nt, Human
cauagugacuuuucaaguau

SEQ ID NO: 3196023 - RNA, 19 nt, Human
cauagugaugguuccccug

SEQ ID NO: 3196024 - RNA, 18 nt, Human
cauagugaugguuccccu

SEQ ID NO: 3196025 - RNA, 21 nt, Human
cauauaaauugucuuaaugga

SEQ ID NO: 3196026 - RNA, 23 nt, Human
cauauaacuuauauuguaagaaa

SEQ ID NO: 3196027 - RNA, 22 nt, Human
cauauaacuuauauuguaagaa

SEQ ID NO: 3196028 - RNA, 20 nt, Human
cauauaacuuauauuguaag

SEQ ID NO: 3196029 - RNA, 17 nt, Human
cauauaaauugucuuaa

SEQ ID NO: 3196030 - RNA, 21 nt, Human
cauauccuuuuagucugcaua

SEQ ID NO: 3196031 - RNA, 23 nt, Human
cauauauauguuuuaagaggcag

SEQ ID NO: 3196032 - RNA, 21 nt, Human
cauauauguguccauuuccuu

SEQ ID NO: 3196033 - RNA, 15 nt, Human
cauauagaaagcuuu

SEQ ID NO: 3196034 - RNA, 16 nt, Human
cauauagacacauaca

SEQ ID NO: 3196035 - RNA, 14 nt, Human
caucaacaucuugg

SEQ ID NO: 3196036 - RNA, 23 nt, Human
caucaacuaaaguuguacuuuaa

SEQ ID NO: 3196037 - RNA, 22 nt, Human
caucaacuaaaguuguacuuua

SEQ ID NO: 3196038 - RNA, 19 nt, Human
caucaacuaaaguuguacu

SEQ ID NO: 3196039 - RNA, 16 nt, Human
caucaacuaaaguugu

SEQ ID NO: 3196040 - RNA, 17 nt, Human
cauauuuuaaacagagg

SEQ ID NO: 3196041 - RNA, 16 nt, Human
cauauuuuaaacagag

SEQ ID NO: 3196042 - RNA, 17 nt, Human
caucugaccucuaccuu

SEQ ID NO: 3196043 - RNA, 15 nt, Human
caucucuccuccuuu

SEQ ID NO: 3196044 - RNA, 13 nt, Human
caucucugcucca

SEQ ID NO: 3196045 - RNA, 12 nt, Human
caucucugcucc

SEQ ID NO: 3196046 - RNA, 13 nt, Human
caucucugacuuu

SEQ ID NO: 3196047 - RNA, 14 nt, Human
caucucugacuuuc

SEQ ID NO: 3196048 - RNA, 17 nt, Human
caucucccuuuuccaug

SEQ ID NO: 3196049 - RNA, 16 nt, Human
caucucuacaaaaagc

SEQ ID NO: 3196050 - RNA, 16 nt, Human
caucuccuuagaaaag

SEQ ID NO: 3196051 - RNA, 17 nt, Human
cauccuacaagacacag

SEQ ID NO: 3196052 - RNA, 19 nt, Human
cauccuacaagacacagug

SEQ ID NO: 3196053 - RNA, 18 nt, Human
cauccuacaagacacagu

SEQ ID NO: 3196054 - RNA, 17 nt, Human
caucuugcucugcugac

SEQ ID NO: 3196055 - RNA, 16 nt, Human
caucuugcucugcuga

SEQ ID NO: 3196056 - RNA, 15 nt, Human
caucuugcucugcug

SEQ ID NO: 3196057 - RNA, 16 nt, Human
caucuugaauuguaag

SEQ ID NO: 3196058 - RNA, 21 nt, Human
caucuugaauuguaaggaaug

SEQ ID NO: 3196059 - RNA, 23 nt, Human
caugaggaacaaggcaaggcugu

SEQ ID NO: 3196060 - RNA, 16 nt, Human
caugagguacugagag

SEQ ID NO: 3196061 - RNA, 19 nt, Human
caugagggaagaauaaaga

SEQ ID NO: 3196062 - RNA, 15 nt, Human
caugagggaagaaua

SEQ ID NO: 3196063 - RNA, 16 nt, Human
caugaggaacaaggca

SEQ ID NO: 3196064 - RNA, 17 nt, Human
caugaggaacaaggcaa

SEQ ID NO: 3196065 - RNA, 20 nt, Human
caugaggaacaaggcaaggc

SEQ ID NO: 3196066 - RNA, 21 nt, Human
caugaggaacaaggcaaggcu

SEQ ID NO: 3196067 - RNA, 23 nt, Human
caugagccucagcauccuggcac

SEQ ID NO: 3196068 - RNA, 22 nt, Human
caugagccucagcauccuggca

SEQ ID NO: 3196069 - RNA, 19 nt, Human
caugaguuggcugggaaua

SEQ ID NO: 3196070 - RNA, 16 nt, Human
caugaguuaucaugaa

SEQ ID NO: 3196071 - RNA, 18 nt, Human
caugaguuaucaugaauu

SEQ ID NO: 3196072 - RNA, 19 nt, Human
caugaguuaucaugaauuu

SEQ ID NO: 3196073 - RNA, 23 nt, Human
caugaguuaucaugaauuuuaaa

SEQ ID NO: 3196074 - RNA, 14 nt, Human
caugauauaacuuu

SEQ ID NO: 3196075 - RNA, 15 nt, Human
caugauauaacuuua

SEQ ID NO: 3196076 - RNA, 18 nt, Human
caugauauaacuuuagaa

SEQ ID NO: 3196077 - RNA, 19 nt, Human
caugauauaacuuuagaaa

SEQ ID NO: 3196078 - RNA, 17 nt, Human
caugaucacuuaucagu

SEQ ID NO: 3196079 - RNA, 14 nt, Human
caugaugauaguug

SEQ ID NO: 3196080 - RNA, 19 nt, Human
caugaugauaguugaaugu

SEQ ID NO: 3196081 - RNA, 16 nt, Human
caugaugauuucagaa

SEQ ID NO: 3196082 - RNA, 19 nt, Human
caugagguacugagaguga

SEQ ID NO: 3196083 - RNA, 23 nt, Human
caugaguagugggcuaugcagga

SEQ ID NO: 3196084 - RNA, 15 nt, Human
caugagguucucucu

SEQ ID NO: 3196085 - RNA, 13 nt, Human
caugaguccccug

SEQ ID NO: 3196086 - RNA, 14 nt, Human
caugaguccccugu

SEQ ID NO: 3196087 - RNA, 15 nt, Human
caugaguccccuguu

SEQ ID NO: 3196088 - RNA, 23 nt, Human
caugaguccccuguuuguuucug

SEQ ID NO: 3196089 - RNA, 18 nt, Human
caugagauaauaugcaga

SEQ ID NO: 3196090 - RNA, 18 nt, Human
caugagagcgcagcccgc

SEQ ID NO: 3196091 - RNA, 13 nt, Human
caugagcaucagg

SEQ ID NO: 3196092 - RNA, 22 nt, Human
caugagaauguuuuagcacagc

SEQ ID NO: 3196093 - RNA, 18 nt, Human
caugaagauguagaggag

SEQ ID NO: 3196094 - RNA, 19 nt, Human
caugaagauguagaggaga

SEQ ID NO: 3196095 - RNA, 20 nt, Human
caugaagauaaacacagcug

SEQ ID NO: 3196096 - RNA, 23 nt, Human
caugacucguauaugucucaggu

SEQ ID NO: 3196097 - RNA, 18 nt, Human
caugacucuugacucuug

SEQ ID NO: 3196098 - RNA, 17 nt, Human
caugacucuuuauuguc

SEQ ID NO: 3196099 - RNA, 18 nt, Human
caugacucuuuauugucu

SEQ ID NO: 3196100 - RNA, 19 nt, Human
caugacucuuuauugucug

SEQ ID NO: 3196101 - RNA, 20 nt, Human
caugacucguauaugucuca

SEQ ID NO: 3196102 - RNA, 15 nt, Human
caugagcaucaggcc

SEQ ID NO: 3196103 - RNA, 16 nt, Human
caugagcaucaggcca

SEQ ID NO: 3196104 - RNA, 17 nt, Human
caugagcaucaggccag

SEQ ID NO: 3196105 - RNA, 18 nt, Human
caugagcaucaggccagg

SEQ ID NO: 3196106 - RNA, 20 nt, Human
caugagcaucaggccaggcc

SEQ ID NO: 3196107 - RNA, 21 nt, Human
caugagcaucaggccaggccc

SEQ ID NO: 3196108 - RNA, 22 nt, Human
caugagcaucaggccaggcccu

SEQ ID NO: 3196109 - RNA, 23 nt, Human
caugagcaucaggccaggcccuc

SEQ ID NO: 3196110 - RNA, 21 nt, Human
caugagccucagcauccuggc

SEQ ID NO: 3196111 - RNA, 20 nt, Human
caugagccucagcauccugg

SEQ ID NO: 3196112 - RNA, 19 nt, Human
caugagccucagcauccug

SEQ ID NO: 3196113 - RNA, 18 nt, Human
caugagccucagcauccu

SEQ ID NO: 3196114 - RNA, 17 nt, Human
caugagccucagcaucc

SEQ ID NO: 3196115 - RNA, 15 nt, Human
caugagccucagcau

SEQ ID NO: 3196116 - RNA, 12 nt, Human
caugagccucag

SEQ ID NO: 3196117 - RNA, 13 nt, Human
caugaaaugaaca

SEQ ID NO: 3196118 - RNA, 20 nt, Human
caugaaaugaacacaaauua

SEQ ID NO: 3196119 - RNA, 19 nt, Human
caugaaaugaacacaaauu

SEQ ID NO: 3196120 - RNA, 15 nt, Human
caugaaaugaacaca

SEQ ID NO: 3196121 - RNA, 21 nt, Human
caugaaaugcuaugucauuuc

SEQ ID NO: 3196122 - RNA, 19 nt, Human
caugaaaugcuaugucauu

SEQ ID NO: 3196123 - RNA, 15 nt, Human
caugaaaauagcaau

SEQ ID NO: 3196124 - RNA, 12 nt, Human
caugaaagaaaa

SEQ ID NO: 3196125 - RNA, 15 nt, Human
caugaaaaugugugu

SEQ ID NO: 3196126 - RNA, 16 nt, Human
caugaaaauguguguu

SEQ ID NO: 3196127 - RNA, 17 nt, Human
caugaaaauguguguuu

SEQ ID NO: 3196128 - RNA, 23 nt, Human
caucuuuuguuacucuugggaca

SEQ ID NO: 3196129 - RNA, 21 nt, Human
caucuuuuguuacucuuggga

SEQ ID NO: 3196130 - RNA, 12 nt, Human
caucuuuuauuc

SEQ ID NO: 3196131 - RNA, 15 nt, Human
caucuuuuauucuuu

SEQ ID NO: 3196132 - RNA, 17 nt, Human
caucuuuuauucuuuuu

SEQ ID NO: 3196133 - RNA, 17 nt, Human
caucuuuauugaaauuc

SEQ ID NO: 3196134 - RNA, 21 nt, Human
caucuuuauugaaauucuauu

SEQ ID NO: 3196135 - RNA, 12 nt, Human
caucuuugaugu

SEQ ID NO: 3196136 - RNA, 13 nt, Human
caucuuugaugug

SEQ ID NO: 3196137 - RNA, 14 nt, Human
caucuuugaugugu

SEQ ID NO: 3196138 - RNA, 18 nt, Human
caucuuugauguguuguu

SEQ ID NO: 3196139 - RNA, 15 nt, Human
caucuuugauguguu

SEQ ID NO: 3196140 - RNA, 16 nt, Human
caucuuugauguguug

SEQ ID NO: 3196141 - RNA, 19 nt, Human
ccaggagccccgaggccuu

SEQ ID NO: 3196142 - RNA, 16 nt, Human
ccaggagccccgaggc

SEQ ID NO: 3196143 - RNA, 20 nt, Human
ccaggagccccgaggccuuc

SEQ ID NO: 3196144 - RNA, 16 nt, Human
ccaggagagcuuaggg

SEQ ID NO: 3196145 - RNA, 21 nt, Human
ccaggagagcuuagggucuca

SEQ ID NO: 3196146 - RNA, 22 nt, Human
ccaggagagcuuagggucucag

SEQ ID NO: 3196147 - RNA, 23 nt, Human
ccaggagagcuuagggucucagg

SEQ ID NO: 3196148 - RNA, 19 nt, Human
ccaggagccuccugcccuu

SEQ ID NO: 3196149 - RNA, 16 nt, Human
ccaggagccugcccag

SEQ ID NO: 3196150 - RNA, 17 nt, Human
ccaggagccugcccagc

SEQ ID NO: 3196151 - RNA, 17 nt, Human
ccaggcauuccccagga

SEQ ID NO: 3196152 - RNA, 18 nt, Human
ccaggcauuccccaggag

SEQ ID NO: 3196153 - RNA, 19 nt, Human
ccaggcauuccccaggagg

SEQ ID NO: 3196154 - RNA, 21 nt, Human
ccaggcauuccccaggaggcc

SEQ ID NO: 3196155 - RNA, 19 nt, Human
ccaggccagggggccaguc

SEQ ID NO: 3196156 - RNA, 20 nt, Human
ccaggcccucugcccacucc

SEQ ID NO: 3196157 - RNA, 21 nt, Human
ccaggcccucugcccacuccc

SEQ ID NO: 3196158 - RNA, 22 nt, Human
ccaggcccucugcccacucccu

SEQ ID NO: 3196159 - RNA, 23 nt, Human
ccaggcccucugcccacucccug

SEQ ID NO: 3196160 - RNA, 19 nt, Human
ccaggcgccccuucccccu

SEQ ID NO: 3196161 - RNA, 16 nt, Human
ccaggccuacuccugu

SEQ ID NO: 3196162 - RNA, 18 nt, Human
ccaggcgccccuuccccc

SEQ ID NO: 3196163 - RNA, 17 nt, Human
ccaggcuuagucacuga

SEQ ID NO: 3196164 - RNA, 24 nt, Human
ccaggcuguaucccaugagccuca

SEQ ID NO: 3196165 - RNA, 23 nt, Human
ccaggcgcuagcacagcucccuu

SEQ ID NO: 3196166 - RNA, 16 nt, Human
ccaggcgcuagcacag

SEQ ID NO: 3196167 - RNA, 16 nt, Human
ccagccuccaugcugc

SEQ ID NO: 3196168 - RNA, 15 nt, Human
ccagccuccaugcug

SEQ ID NO: 3196169 - RNA, 22 nt, Human
ccagggacagaggggguggccu

SEQ ID NO: 3196170 - RNA, 20 nt, Human
ccaggcuuagucacugagac

SEQ ID NO: 3196171 - RNA, 14 nt, Human
ccagggacagaggg

SEQ ID NO: 3196172 - RNA, 15 nt, Human
ccagggacagagggg

SEQ ID NO: 3196173 - RNA, 21 nt, Human
ccagggacagaggggguggcc

SEQ ID NO: 3196174 - RNA, 19 nt, Human
ccaggugcacaagcuccaa

SEQ ID NO: 3196175 - RNA, 20 nt, Human
ccaggugcacaagcuccaag

SEQ ID NO: 3196176 - RNA, 18 nt, Human
ccaggugcacaagcucca

SEQ ID NO: 3196177 - RNA, 21 nt, Human
ccaggguuggcaccuuccccc

SEQ ID NO: 3196178 - RNA, 19 nt, Human
ccaggguuggcaccuuccc

SEQ ID NO: 3196179 - RNA, 21 nt, Human
ccagggcuggaaugauuucag

SEQ ID NO: 3196180 - RNA, 13 nt, Human
ccagggccagaag

SEQ ID NO: 3196181 - RNA, 18 nt, Human
ccagucuggaaugcagug

SEQ ID NO: 3196182 - RNA, 20 nt, Human
ccagucgucaucagaugcuu

SEQ ID NO: 3196183 - RNA, 13 nt, Human
ccagugaggcucu

SEQ ID NO: 3196184 - RNA, 20 nt, Human
ccagucuggaaugcaguggu

SEQ ID NO: 3196185 - RNA, 19 nt, Human
ccagucuggaaugcagugg

SEQ ID NO: 3196186 - RNA, 17 nt, Human
ccagguuuuuggucuga

SEQ ID NO: 3196187 - RNA, 24 nt, Human
ccaggugcacaagcuccaagcucc

SEQ ID NO: 3196188 - RNA, 15 nt, Human
ccagguucagcuugu

SEQ ID NO: 3196189 - RNA, 18 nt, Human
ccagguuccacagaggac

SEQ ID NO: 3196190 - RNA, 15 nt, Human
ccagguuccacagag

SEQ ID NO: 3196191 - RNA, 18 nt, Human
ccaguguccauggacuca

SEQ ID NO: 3196192 - RNA, 23 nt, Human
ccaguuacuuuccaauucuccuu

SEQ ID NO: 3196193 - RNA, 14 nt, Human
ccaguuauggcuau

SEQ ID NO: 3196194 - RNA, 15 nt, Human
ccauagcuguggugu

SEQ ID NO: 3196195 - RNA, 23 nt, Human
ccauauucuguuggccaguguga

SEQ ID NO: 3196196 - RNA, 21 nt, Human
ccauaguaugggacuggccuc

SEQ ID NO: 3196197 - RNA, 12 nt, Human
ccauaggucacc

SEQ ID NO: 3196198 - RNA, 12 nt, Human
ccauaggcccuu

SEQ ID NO: 3196199 - RNA, 14 nt, Human
ccauaggcccuuuc

SEQ ID NO: 3196200 - RNA, 20 nt, Human
ccagugccgagaaggaagcc

SEQ ID NO: 3196201 - RNA, 22 nt, Human
ccagugguuccuaauccucuag

SEQ ID NO: 3196202 - RNA, 14 nt, Human
ccagugaggcucug

SEQ ID NO: 3196203 - RNA, 15 nt, Human
ccagugaggcucugc

SEQ ID NO: 3196204 - RNA, 16 nt, Human
ccagugaggcucugcc

SEQ ID NO: 3196205 - RNA, 23 nt, Human
ccagugcccacaggaucagucug

SEQ ID NO: 3196206 - RNA, 19 nt, Human
cccaaaacaccggguucca

SEQ ID NO: 3196207 - RNA, 15 nt, Human
ccauuuguuaauauc

SEQ ID NO: 3196208 - RNA, 17 nt, Human
ccauuuguuaauaucac

SEQ ID NO: 3196209 - RNA, 14 nt, Human
ccauuuguguuuau

SEQ ID NO: 3196210 - RNA, 17 nt, Human
ccauuugggcagagagg

SEQ ID NO: 3196211 - RNA, 19 nt, Human
ccauucuccaccugccagg

SEQ ID NO: 3196212 - RNA, 20 nt, Human
ccauucuccaccugccaggg

SEQ ID NO: 3196213 - RNA, 22 nt, Human
ccauucuccagggguuuacagu

SEQ ID NO: 3196214 - RNA, 21 nt, Human
ccauuuggagggccugggccu

SEQ ID NO: 3196215 - RNA, 21 nt, Human
cccaaaacaccggguuccagc

SEQ ID NO: 3196216 - RNA, 16 nt, Human
cccaaaacucuccucu

SEQ ID NO: 3196217 - RNA, 18 nt, Human
cccaaaacucuccucugc

SEQ ID NO: 3196218 - RNA, 15 nt, Human
cccaaagugcuggga

SEQ ID NO: 3196219 - RNA, 13 nt, Human
cccaaagugcugg

SEQ ID NO: 3196220 - RNA, 16 nt, Human
cccaaagugcugggau

SEQ ID NO: 3196221 - RNA, 18 nt, Human
cccaaauggaaaugggca

SEQ ID NO: 3196222 - RNA, 22 nt, Human
cccaaauggaaaugggcagagc

SEQ ID NO: 3196223 - RNA, 14 nt, Human
cccaaaugcuggcu

SEQ ID NO: 3196224 - RNA, 22 nt, Human
cccaaggcccccugccugcccu

SEQ ID NO: 3196225 - RNA, 19 nt, Human
cccaaggcccccugccugc

SEQ ID NO: 3196226 - RNA, 17 nt, Human
cccaaggcucugagcaa

SEQ ID NO: 3196227 - RNA, 12 nt, Human
cccaaucccuga

SEQ ID NO: 3196228 - RNA, 12 nt, Human
cccaaugaauua

SEQ ID NO: 3196229 - RNA, 23 nt, Human
cccaaccucuuccuccugacacc

SEQ ID NO: 3196230 - RNA, 21 nt, Human
cccaaccucuuccuccugaca

SEQ ID NO: 3196231 - RNA, 14 nt, Human
cccaaccucuuccu

SEQ ID NO: 3196232 - RNA, 19 nt, Human
cccaaccucuuccuccuga

SEQ ID NO: 3196233 - RNA, 18 nt, Human
cccaaccucuuccuccug

SEQ ID NO: 3196234 - RNA, 15 nt, Human
cccaacccuggcacc

SEQ ID NO: 3196235 - RNA, 13 nt, Human
cccaacccuucuu

SEQ ID NO: 3196236 - RNA, 15 nt, Human
cccaacccuucuuca

SEQ ID NO: 3196237 - RNA, 20 nt, Human
cccaacccuucuucauguuc

SEQ ID NO: 3196238 - RNA, 19 nt, Human
ccauauucuguuggccagu

SEQ ID NO: 3196239 - RNA, 14 nt, Human
ccaucuaaacugcc

SEQ ID NO: 3196240 - RNA, 21 nt, Human
ccauggccggcuuucaggagc

SEQ ID NO: 3196241 - RNA, 18 nt, Human
ccauggccggcuuucagg

SEQ ID NO: 3196242 - RNA, 22 nt, Human
ccauggccggcuuucaggagcu

SEQ ID NO: 3196243 - RNA, 21 nt, Human
ccaugggaaaugucaacaagu

SEQ ID NO: 3196244 - RNA, 15 nt, Human
ccaucuaaacugccc

SEQ ID NO: 3196245 - RNA, 16 nt, Human
ccaucuaaacugcccc

SEQ ID NO: 3196246 - RNA, 15 nt, Human
ccaucuaaaaauaua

SEQ ID NO: 3196247 - RNA, 16 nt, Human
ccaugggacagggagg

SEQ ID NO: 3196248 - RNA, 19 nt, Human
ccaugggacagggaggacg

SEQ ID NO: 3196249 - RNA, 17 nt, Human
ccaugggaggcuggagu

SEQ ID NO: 3196250 - RNA, 11 nt, Human
ccaugggaggg

SEQ ID NO: 3196251 - RNA, 13 nt, Human
ccaugggagggag

SEQ ID NO: 3196252 - RNA, 14 nt, Human
ccaugggagggagc

SEQ ID NO: 3196253 - RNA, 17 nt, Human
ccaugggagggagcuga

SEQ ID NO: 3196254 - RNA, 16 nt, Human
ccauguuggccaggcu

SEQ ID NO: 3196255 - RNA, 17 nt, Human
ccauguuggccaggcug

SEQ ID NO: 3196256 - RNA, 18 nt, Human
ccauguuggccaggcugc

SEQ ID NO: 3196257 - RNA, 20 nt, Human
ccauguuggccaggcugcuc

SEQ ID NO: 3196258 - RNA, 21 nt, Human
ccauguuggccaggcugcucu

SEQ ID NO: 3196259 - RNA, 23 nt, Human
ccauguuggccaggcugcucuca

SEQ ID NO: 3196260 - RNA, 12 nt, Human
ccauguuucugu

SEQ ID NO: 3196261 - RNA, 18 nt, Human
ccauucuccaccugccag

SEQ ID NO: 3196262 - RNA, 21 nt, Human
ccaccaagccuggucagccca

SEQ ID NO: 3196263 - RNA, 22 nt, Human
ccaccaagccuggucagcccaa

SEQ ID NO: 3196264 - RNA, 20 nt, Human
ccaccaacauacucccaucu

SEQ ID NO: 3196265 - RNA, 16 nt, Human
ccaccacacccagccc

SEQ ID NO: 3196266 - RNA, 14 nt, Human
ccaccacacccagc

SEQ ID NO: 3196267 - RNA, 17 nt, Human
ccacccaagggccuggc

SEQ ID NO: 3196268 - RNA, 19 nt, Human
ccacccaagggccuggccu

SEQ ID NO: 3196269 - RNA, 16 nt, Human
ccacccaagggccugg

SEQ ID NO: 3196270 - RNA, 20 nt, Human
ccacccaagggccuggccug

SEQ ID NO: 3196271 - RNA, 21 nt, Human
ccacccaagggccuggccuga

SEQ ID NO: 3196272 - RNA, 22 nt, Human
ccacccaagggccuggccugag

SEQ ID NO: 3196273 - RNA, 13 nt, Human
ccacccaccucag

SEQ ID NO: 3196274 - RNA, 15 nt, Human
ccacccaccucagcc

SEQ ID NO: 3196275 - RNA, 14 nt, Human
ccacccaccucagc

SEQ ID NO: 3196276 - RNA, 16 nt, Human
ccacccaccucagccu

SEQ ID NO: 3196277 - RNA, 19 nt, Human
ccacacugauccagcccug

SEQ ID NO: 3196278 - RNA, 22 nt, Human
ccacacugauccagcccugagu

SEQ ID NO: 3196279 - RNA, 22 nt, Human
ccacauagugaugguuccccug

SEQ ID NO: 3196280 - RNA, 21 nt, Human
ccacauagugaugguuccccu

SEQ ID NO: 3196281 - RNA, 19 nt, Human
ccacauagugaugguuccc

SEQ ID NO: 3196282 - RNA, 14 nt, Human
ccacaucuugcucu

SEQ ID NO: 3196283 - RNA, 23 nt, Human
ccacauagugaugguuccccugu

SEQ ID NO: 3196284 - RNA, 23 nt, Human
ccacaucuugcucugcugacaga

SEQ ID NO: 3196285 - RNA, 22 nt, Human
ccacaucuugcucugcugacag

SEQ ID NO: 3196286 - RNA, 20 nt, Human
ccacaucuugcucugcugac

SEQ ID NO: 3196287 - RNA, 16 nt, Human
ccacaucuugcucugc

SEQ ID NO: 3196288 - RNA, 14 nt, Human
ccaccaacauacuc

SEQ ID NO: 3196289 - RNA, 18 nt, Human
ccaccaacauacucccau

SEQ ID NO: 3196290 - RNA, 20 nt, Human
ccaaaccaccagaagcccag

SEQ ID NO: 3196291 - RNA, 16 nt, Human
ccaaacccacccuuuc

SEQ ID NO: 3196292 - RNA, 19 nt, Human
ccaaacccccauucugucc

SEQ ID NO: 3196293 - RNA, 16 nt, Human
ccaaacccccauucug

SEQ ID NO: 3196294 - RNA, 20 nt, Human
ccaaacccacccuuucuacu

SEQ ID NO: 3196295 - RNA, 12 nt, Human
ccacacccagcc

SEQ ID NO: 3196296 - RNA, 13 nt, Human
ccacaccuccugg

SEQ ID NO: 3196297 - RNA, 14 nt, Human
ccacaccuccuggg

SEQ ID NO: 3196298 - RNA, 15 nt, Human
ccacaccuccugggg

SEQ ID NO: 3196299 - RNA, 13 nt, Human
ccacacuccagcu

SEQ ID NO: 3196300 - RNA, 14 nt, Human
ccacacuccagcug

SEQ ID NO: 3196301 - RNA, 17 nt, Human
ccacacuccagcuggga

SEQ ID NO: 3196302 - RNA, 14 nt, Human
ccacacccagccca

SEQ ID NO: 3196303 - RNA, 13 nt, Human
ccacacccagccc

SEQ ID NO: 3196304 - RNA, 13 nt, Human
ccacguuuugaaa

SEQ ID NO: 3196305 - RNA, 17 nt, Human
ccacgugcguguuuucu

SEQ ID NO: 3196306 - RNA, 18 nt, Human
ccacucaguccauagcag

SEQ ID NO: 3196307 - RNA, 14 nt, Human
ccacuccaagccag

SEQ ID NO: 3196308 - RNA, 12 nt, Human
ccacucccugca

SEQ ID NO: 3196309 - RNA, 13 nt, Human
ccacucccugcaa

SEQ ID NO: 3196310 - RNA, 19 nt, Human
ccacuccagaccccuggcu

SEQ ID NO: 3196311 - RNA, 17 nt, Human
ccacuccagaccccugg

SEQ ID NO: 3196312 - RNA, 16 nt, Human
ccacuccaagccagca

SEQ ID NO: 3196313 - RNA, 22 nt, Human
ccacuccccagccagccuggcu

SEQ ID NO: 3196314 - RNA, 19 nt, Human
ccacuccccagccagccug

SEQ ID NO: 3196315 - RNA, 22 nt, Human
ccacuacggaauaguuggcuag

SEQ ID NO: 3196316 - RNA, 23 nt, Human
ccacuacggaauaguuggcuagg

SEQ ID NO: 3196317 - RNA, 16 nt, Human
ccacuaccccuugauu

SEQ ID NO: 3196318 - RNA, 20 nt, Human
ccacucaagaccaaauggaa

SEQ ID NO: 3196319 - RNA, 17 nt, Human
ccacucaagaccaaaug

SEQ ID NO: 3196320 - RNA, 15 nt, Human
ccacucaagaccaaa

SEQ ID NO: 3196321 - RNA, 13 nt, Human
ccacucaagacca

SEQ ID NO: 3196322 - RNA, 23 nt, Human
ccacucaagaccaaauggaaaca

SEQ ID NO: 3196323 - RNA, 11 nt, Human
ccacugccucu

SEQ ID NO: 3196324 - RNA, 16 nt, Human
ccacugcgaccacaag

SEQ ID NO: 3196325 - RNA, 20 nt, Human
ccacugcacuccagccuggg

SEQ ID NO: 3196326 - RNA, 19 nt, Human
ccacugcacuccagccugg

SEQ ID NO: 3196327 - RNA, 15 nt, Human
ccacucccugcaacc

SEQ ID NO: 3196328 - RNA, 18 nt, Human
ccacugcacuccagccug

SEQ ID NO: 3196329 - RNA, 15 nt, Human
ccacugcccacuggc

SEQ ID NO: 3196330 - RNA, 17 nt, Human
ccacugcccacuggccg

SEQ ID NO: 3196331 - RNA, 16 nt, Human
ccacugcccacuggcc

SEQ ID NO: 3196332 - RNA, 15 nt, Human
ccacccuccacucuc

SEQ ID NO: 3196333 - RNA, 19 nt, Human
ccacccgugguggcucaag

SEQ ID NO: 3196334 - RNA, 20 nt, Human
ccacccgguucaguguuucu

SEQ ID NO: 3196335 - RNA, 17 nt, Human
ccacccgguucaguguu

SEQ ID NO: 3196336 - RNA, 16 nt, Human
ccacccgccccugccc

SEQ ID NO: 3196337 - RNA, 15 nt, Human
ccaccucagccuccc

SEQ ID NO: 3196338 - RNA, 14 nt, Human
ccaccucagccucc

SEQ ID NO: 3196339 - RNA, 13 nt, Human
ccaccucagccuc

SEQ ID NO: 3196340 - RNA, 16 nt, Human
ccacccugaaagcccu

SEQ ID NO: 3196341 - RNA, 17 nt, Human
ccacccugaaagcccug

SEQ ID NO: 3196342 - RNA, 12 nt, Human
ccaccucagccu

SEQ ID NO: 3196343 - RNA, 14 nt, Human
ccacccaggagccc

SEQ ID NO: 3196344 - RNA, 12 nt, Human
ccacccaggagc

SEQ ID NO: 3196345 - RNA, 20 nt, Human
ccaccuccccuugccagcug

SEQ ID NO: 3196346 - RNA, 19 nt, Human
ccaccuccccuugccagcu

SEQ ID NO: 3196347 - RNA, 18 nt, Human
ccaccuccccuugccagc

SEQ ID NO: 3196348 - RNA, 17 nt, Human
ccaccuccccuugccag

SEQ ID NO: 3196349 - RNA, 17 nt, Human
ccaccucccacaaagga

SEQ ID NO: 3196350 - RNA, 18 nt, Human
ccaccucccccacuccca

SEQ ID NO: 3196351 - RNA, 15 nt, Human
ccaccuccccuugcc

SEQ ID NO: 3196352 - RNA, 14 nt, Human
ccaccuccccuugc

SEQ ID NO: 3196353 - RNA, 17 nt, Human
ccaccugccuguugggc

SEQ ID NO: 3196354 - RNA, 20 nt, Human
ccaccugccuguugggccag

SEQ ID NO: 3196355 - RNA, 16 nt, Human
ccaccugccagggaca

SEQ ID NO: 3196356 - RNA, 15 nt, Human
ccaccugaguuccug

SEQ ID NO: 3196357 - RNA, 14 nt, Human
ccaccugaguuccu

SEQ ID NO: 3196358 - RNA, 14 nt, Human
ccaccugcccaacc

SEQ ID NO: 3196359 - RNA, 17 nt, Human
ccaccugcagcucccuc

SEQ ID NO: 3196360 - RNA, 15 nt, Human
ccaccugcagcuccc

SEQ ID NO: 3196361 - RNA, 12 nt, Human
ccaccugcagcu

SEQ ID NO: 3196362 - RNA, 16 nt, Human
ccaccugaguuccuga

SEQ ID NO: 3196363 - RNA, 15 nt, Human
ccacggccaggccag

SEQ ID NO: 3196364 - RNA, 23 nt, Human
ccacgucuauuucaucagaacag

SEQ ID NO: 3196365 - RNA, 14 nt, Human
ccacggccaggcca

SEQ ID NO: 3196366 - RNA, 13 nt, Human
ccacggccaggcc

SEQ ID NO: 3196367 - RNA, 12 nt, Human
ccacggccaggc

SEQ ID NO: 3196368 - RNA, 17 nt, Human
ccaccuggccucugcac

SEQ ID NO: 3196369 - RNA, 14 nt, Human
ccaccuggccucug

SEQ ID NO: 3196370 - RNA, 19 nt, Human
ccacgcuggagugcaguga

SEQ ID NO: 3196371 - RNA, 22 nt, Human
ccaccugcggugcuaucucccc

SEQ ID NO: 3196372 - RNA, 14 nt, Human
ccaccugcucugcu

SEQ ID NO: 3196373 - RNA, 15 nt, Human
ccaccuggccucugc

SEQ ID NO: 3196374 - RNA, 16 nt, Human
ccaccuggccucugca

SEQ ID NO: 3196375 - RNA, 15 nt, Human
ccagccaaagccucc

SEQ ID NO: 3196376 - RNA, 21 nt, Human
ccagccaaacacacagaaggg

SEQ ID NO: 3196377 - RNA, 20 nt, Human
ccagccaaacacacagaagg

SEQ ID NO: 3196378 - RNA, 18 nt, Human
ccagccaaacacacagaa

SEQ ID NO: 3196379 - RNA, 16 nt, Human
ccagccaaacacacag

SEQ ID NO: 3196380 - RNA, 18 nt, Human
ccagccaaagccuccucc

SEQ ID NO: 3196381 - RNA, 19 nt, Human
ccagccaaagccuccucca

SEQ ID NO: 3196382 - RNA, 22 nt, Human
ccagccacuccccagccagccu

SEQ ID NO: 3196383 - RNA, 16 nt, Human
ccagccacuccccagc

SEQ ID NO: 3196384 - RNA, 16 nt, Human
ccagccagccuggcug

SEQ ID NO: 3196385 - RNA, 14 nt, Human
ccagccagccuggc

SEQ ID NO: 3196386 - RNA, 17 nt, Human
ccagcagucugccugga

SEQ ID NO: 3196387 - RNA, 18 nt, Human
ccagcaucgcacucuggc

SEQ ID NO: 3196388 - RNA, 18 nt, Human
ccagccgccaugcuccug

SEQ ID NO: 3196389 - RNA, 14 nt, Human
ccagccgccaugcu

SEQ ID NO: 3196390 - RNA, 23 nt, Human
ccagccgagauagccaaggccaa

SEQ ID NO: 3196391 - RNA, 18 nt, Human
ccagcccuuccucugcuc

SEQ ID NO: 3196392 - RNA, 21 nt, Human
ccagccuccaagcuccaucuc

SEQ ID NO: 3196393 - RNA, 20 nt, Human
ccagccucaaauccaggacc

SEQ ID NO: 3196394 - RNA, 19 nt, Human
ccagccucaaauccaggac

SEQ ID NO: 3196395 - RNA, 18 nt, Human
ccagccucaaauccagga

SEQ ID NO: 3196396 - RNA, 17 nt, Human
ccagccucaaauccagg

SEQ ID NO: 3196397 - RNA, 23 nt, Human
ccagccucaaauccaggacccug

SEQ ID NO: 3196398 - RNA, 17 nt, Human
ccagcccuuagcaggga

SEQ ID NO: 3196399 - RNA, 13 nt, Human
ccagcccuuccuc

SEQ ID NO: 3196400 - RNA, 17 nt, Human
ccagcccuuccucugcu

SEQ ID NO: 3196401 - RNA, 15 nt, Human
ccagcccuuccucug

SEQ ID NO: 3196402 - RNA, 16 nt, Human
ccagcccuuagcaggg

SEQ ID NO: 3196403 - RNA, 21 nt, Human
ccagcccuccuuaucaaagga

SEQ ID NO: 3196404 - RNA, 16 nt, Human
ccagccccagugccca

SEQ ID NO: 3196405 - RNA, 23 nt, Human
ccagccccaaaacucuccucugc

SEQ ID NO: 3196406 - RNA, 19 nt, Human
ccagccccaaaacucuccu

SEQ ID NO: 3196407 - RNA, 15 nt, Human
ccagccccagugccc

SEQ ID NO: 3196408 - RNA, 13 nt, Human
ccagccccagugc

SEQ ID NO: 3196409 - RNA, 19 nt, Human
ccagccccacccuguuuug

SEQ ID NO: 3196410 - RNA, 19 nt, Human
ccagcaauucuccugccuc

SEQ ID NO: 3196411 - RNA, 20 nt, Human
ccagcaauucuccugccuca

SEQ ID NO: 3196412 - RNA, 16 nt, Human
ccagcaauucuccugc

SEQ ID NO: 3196413 - RNA, 18 nt, Human
ccagcaauucuccugccu

SEQ ID NO: 3196414 - RNA, 22 nt, Human
ccagcaagugagagcugggugu

SEQ ID NO: 3196415 - RNA, 21 nt, Human
ccagcaagugagagcugggug

SEQ ID NO: 3196416 - RNA, 20 nt, Human
ccagcaagugagagcugggu

SEQ ID NO: 3196417 - RNA, 14 nt, Human
ccagauuucacucu

SEQ ID NO: 3196418 - RNA, 15 nt, Human
ccagcaagugagagc

SEQ ID NO: 3196419 - RNA, 12 nt, Human
ccagauuucacu

SEQ ID NO: 3196420 - RNA, 21 nt, Human
ccagauugcaacaggcugggc

SEQ ID NO: 3196421 - RNA, 18 nt, Human
ccagauugcaacaggcug

SEQ ID NO: 3196422 - RNA, 23 nt, Human
ccagauucuuuccugaggcuggg

SEQ ID NO: 3196423 - RNA, 20 nt, Human
ccagauugcaacaggcuggg

SEQ ID NO: 3196424 - RNA, 19 nt, Human
ccagauugcaacaggcugg

SEQ ID NO: 3196425 - RNA, 15 nt, Human
ccagagggccugcaa

SEQ ID NO: 3196426 - RNA, 16 nt, Human
ccagagggccugcaag

SEQ ID NO: 3196427 - RNA, 23 nt, Human
ccagaugcaccagcccuuagcag

SEQ ID NO: 3196428 - RNA, 23 nt, Human
ccagagggagugacagaggcagc

SEQ ID NO: 3196429 - RNA, 22 nt, Human
ccagagggagugacagaggcag

SEQ ID NO: 3196430 - RNA, 13 nt, Human
ccagagggccugc

SEQ ID NO: 3196431 - RNA, 19 nt, Human
ccagauucuuuccugaggc

SEQ ID NO: 3196432 - RNA, 20 nt, Human
ccagauucuuuccugaggcu

SEQ ID NO: 3196433 - RNA, 21 nt, Human
ccagauucuuuccugaggcug

SEQ ID NO: 3196434 - RNA, 22 nt, Human
ccagauucuuuccugaggcugg

SEQ ID NO: 3196435 - RNA, 18 nt, Human
ccagauucuuuccugagg

SEQ ID NO: 3196436 - RNA, 18 nt, Human
ccagaugugacaguguug

SEQ ID NO: 3196437 - RNA, 16 nt, Human
ccagacccccuggaga

SEQ ID NO: 3196438 - RNA, 12 nt, Human
ccagacccccug

SEQ ID NO: 3196439 - RNA, 18 nt, Human
ccagacccccuggagacu

SEQ ID NO: 3196440 - RNA, 13 nt, Human
ccagagagggugg

SEQ ID NO: 3196441 - RNA, 14 nt, Human
ccagagaggguggu

SEQ ID NO: 3196442 - RNA, 23 nt, Human
ccagagaggguggugaccucugc

SEQ ID NO: 3196443 - RNA, 21 nt, Human
ccagagaggguggugaccucu

SEQ ID NO: 3196444 - RNA, 19 nt, Human
ccagacaccuugacagggc

SEQ ID NO: 3196445 - RNA, 17 nt, Human
ccagacaccuugacagg

SEQ ID NO: 3196446 - RNA, 22 nt, Human
ccagaggagagaggacccccug

SEQ ID NO: 3196447 - RNA, 21 nt, Human
ccagaggagagaggacccccu

SEQ ID NO: 3196448 - RNA, 21 nt, Human
ccagagggagugacagaggca

SEQ ID NO: 3196449 - RNA, 20 nt, Human
ccagagggagugacagaggc

SEQ ID NO: 3196450 - RNA, 19 nt, Human
ccagagggagugacagagg

SEQ ID NO: 3196451 - RNA, 18 nt, Human
ccagagggagugacagag

SEQ ID NO: 3196452 - RNA, 17 nt, Human
ccagagggagugacaga

SEQ ID NO: 3196453 - RNA, 16 nt, Human
ccagagggagugacag

SEQ ID NO: 3196454 - RNA, 14 nt, Human
ccagagcugccacc

SEQ ID NO: 3196455 - RNA, 15 nt, Human
ccagagcugccaccu

SEQ ID NO: 3196456 - RNA, 16 nt, Human
ccagagcugccaccug

SEQ ID NO: 3196457 - RNA, 19 nt, Human
ccagagcugccaccugccu

SEQ ID NO: 3196458 - RNA, 23 nt, Human
ccagagcugcuuccccgucaccu

SEQ ID NO: 3196459 - RNA, 14 nt, Human
ccagagcugccagu

SEQ ID NO: 3196460 - RNA, 13 nt, Human
ccagagcugccag

SEQ ID NO: 3196461 - RNA, 12 nt, Human
ccagagcugcca

SEQ ID NO: 3196462 - RNA, 13 nt, Human
ccagagcugccac

SEQ ID NO: 3196463 - RNA, 11 nt, Human
ccagagcugcc

SEQ ID NO: 3196464 - RNA, 16 nt, Human
ccagaccccgacaccg

SEQ ID NO: 3196465 - RNA, 19 nt, Human
ccugaggaagagggacugu

SEQ ID NO: 3196466 - RNA, 16 nt, Human
ccugagcuuucugcua

SEQ ID NO: 3196467 - RNA, 21 nt, Human
ccugaggcccagagggccugc

SEQ ID NO: 3196468 - RNA, 18 nt, Human
ccugaggcccagagggcc

SEQ ID NO: 3196469 - RNA, 20 nt, Human
ccugaggacauggcuucuga

SEQ ID NO: 3196470 - RNA, 18 nt, Human
ccugaggacauggcuucu

SEQ ID NO: 3196471 - RNA, 11 nt, Human
ccugagcccca

SEQ ID NO: 3196472 - RNA, 16 nt, Human
ccugagcccacugugc

SEQ ID NO: 3196473 - RNA, 15 nt, Human
ccugagcccacugug

SEQ ID NO: 3196474 - RNA, 13 nt, Human
ccugagcccacug

SEQ ID NO: 3196475 - RNA, 12 nt, Human
ccugagcccacu

SEQ ID NO: 3196476 - RNA, 14 nt, Human
ccugagcuuucugc

SEQ ID NO: 3196477 - RNA, 20 nt, Human
ccugagccagauuucacucu

SEQ ID NO: 3196478 - RNA, 11 nt, Human
ccugagcccac

SEQ ID NO: 3196479 - RNA, 18 nt, Human
ccugacacaccugcagcc

SEQ ID NO: 3196480 - RNA, 18 nt, Human
ccugacaccccacuuagc

SEQ ID NO: 3196481 - RNA, 14 nt, Human
ccugacaccccacu

SEQ ID NO: 3196482 - RNA, 16 nt, Human
ccugacagaaggacuc

SEQ ID NO: 3196483 - RNA, 23 nt, Human
ccugacagagggauggaggaaga

SEQ ID NO: 3196484 - RNA, 13 nt, Human
ccugacagccaga

SEQ ID NO: 3196485 - RNA, 20 nt, Human
ccugacagccagaacucugu

SEQ ID NO: 3196486 - RNA, 14 nt, Human
ccugacagccagaa

SEQ ID NO: 3196487 - RNA, 20 nt, Human
ccugacagccccucccuccu

SEQ ID NO: 3196488 - RNA, 23 nt, Human
ccugacaacacucauugaccuga

SEQ ID NO: 3196489 - RNA, 14 nt, Human
ccugccacucaggc

SEQ ID NO: 3196490 - RNA, 14 nt, Human
ccugccagaccccc

SEQ ID NO: 3196491 - RNA, 23 nt, Human
ccugccacucaggcccaaagccu

SEQ ID NO: 3196492 - RNA, 22 nt, Human
ccugccacucaggcccaaagcc

SEQ ID NO: 3196493 - RNA, 22 nt, Human
ccugcaguuccccuggaagcag

SEQ ID NO: 3196494 - RNA, 14 nt, Human
ccugcaucaucuug

SEQ ID NO: 3196495 - RNA, 13 nt, Human
ccugcaguucccc

SEQ ID NO: 3196496 - RNA, 13 nt, Human
ccugccaggaagc

SEQ ID NO: 3196497 - RNA, 14 nt, Human
ccugccaggaagcc

SEQ ID NO: 3196498 - RNA, 15 nt, Human
ccugccaggaagcca

SEQ ID NO: 3196499 - RNA, 17 nt, Human
ccugccaggaagccagc

SEQ ID NO: 3196500 - RNA, 15 nt, Human
ccugccaggcauggu

SEQ ID NO: 3196501 - RNA, 23 nt, Human
ccugccaggaagccagcaggcuc

SEQ ID NO: 3196502 - RNA, 16 nt, Human
ccugccaggcauggug

SEQ ID NO: 3196503 - RNA, 11 nt, Human
ccugccaggga

SEQ ID NO: 3196504 - RNA, 18 nt, Human
ccugccaggaagccagca

SEQ ID NO: 3196505 - RNA, 19 nt, Human
ccugccaggaagccagcag

SEQ ID NO: 3196506 - RNA, 21 nt, Human
ccugccaggaagccagcaggc

SEQ ID NO: 3196507 - RNA, 22 nt, Human
ccugccaggaagccagcaggcu

SEQ ID NO: 3196508 - RNA, 12 nt, Human
ccugccagggac

SEQ ID NO: 3196509 - RNA, 13 nt, Human
ccugccagggaca

SEQ ID NO: 3196510 - RNA, 14 nt, Human
ccugccagggacag

SEQ ID NO: 3196511 - RNA, 15 nt, Human
ccugccagggacaga

SEQ ID NO: 3196512 - RNA, 16 nt, Human
ccugccagggacagag

SEQ ID NO: 3196513 - RNA, 14 nt, Human
ccugcaagaacaag

SEQ ID NO: 3196514 - RNA, 23 nt, Human
ccugcaggcagccaggccacaag

SEQ ID NO: 3196515 - RNA, 20 nt, Human
ccugcaguacuuuaccuccu

SEQ ID NO: 3196516 - RNA, 18 nt, Human
ccugcaguacuuuaccuc

SEQ ID NO: 3196517 - RNA, 15 nt, Human
ccugcagggccaagc

SEQ ID NO: 3196518 - RNA, 22 nt, Human
ccugcaaccugauugugucucu

SEQ ID NO: 3196519 - RNA, 21 nt, Human
ccugcaaccugauugugucuc

SEQ ID NO: 3196520 - RNA, 17 nt, Human
ccugauugugucucuug

SEQ ID NO: 3196521 - RNA, 20 nt, Human
ccugauugguuucucuucuc

SEQ ID NO: 3196522 - RNA, 18 nt, Human
ccugauugguuucucuuc

SEQ ID NO: 3196523 - RNA, 11 nt, Human
ccugaggcccu

SEQ ID NO: 3196524 - RNA, 12 nt, Human
ccugaggcccuu

SEQ ID NO: 3196525 - RNA, 19 nt, Human
ccugaugcuucuucagaga

SEQ ID NO: 3196526 - RNA, 20 nt, Human
ccugaugcuucuucagagac

SEQ ID NO: 3196527 - RNA, 21 nt, Human
ccugaugcuucuucagagacu

SEQ ID NO: 3196528 - RNA, 15 nt, Human
ccugauugugucucu

SEQ ID NO: 3196529 - RNA, 17 nt, Human
ccuggcuccaggccagg

SEQ ID NO: 3196530 - RNA, 16 nt, Human
ccuggcuccaggccag

SEQ ID NO: 3196531 - RNA, 15 nt, Human
ccuggcuccaggcca

SEQ ID NO: 3196532 - RNA, 17 nt, Human
ccuggcucccacaggcc

SEQ ID NO: 3196533 - RNA, 23 nt, Human
ccuggcucccacaggcccuuccu

SEQ ID NO: 3196534 - RNA, 22 nt, Human
ccuggcugcggggcgggcacac

SEQ ID NO: 3196535 - RNA, 15 nt, Human
ccuggccagaugcac

SEQ ID NO: 3196536 - RNA, 22 nt, Human
ccuggcagccgugccuucagcu

SEQ ID NO: 3196537 - RNA, 21 nt, Human
ccuggcagccgugccuucagc

SEQ ID NO: 3196538 - RNA, 19 nt, Human
ccuggagacuaaccccacc

SEQ ID NO: 3196539 - RNA, 17 nt, Human
ccuggaaggcccagcac

SEQ ID NO: 3196540 - RNA, 18 nt, Human
ccuggaaggcccagcacc

SEQ ID NO: 3196541 - RNA, 12 nt, Human
ccuggcagcccc

SEQ ID NO: 3196542 - RNA, 13 nt, Human
ccuggcagccccu

SEQ ID NO: 3196543 - RNA, 23 nt, Human
ccuggcacccggccccugcuggu

SEQ ID NO: 3196544 - RNA, 21 nt, Human
ccuggcacccggccccugcug

SEQ ID NO: 3196545 - RNA, 22 nt, Human
ccuggcacccggccccugcugg

SEQ ID NO: 3196546 - RNA, 12 nt, Human
ccuggucagccc

SEQ ID NO: 3196547 - RNA, 14 nt, Human
ccuggucagcccaa

SEQ ID NO: 3196548 - RNA, 20 nt, Human
ccuggucagggugagcccau

SEQ ID NO: 3196549 - RNA, 21 nt, Human
ccuggucacaggacucugccu

SEQ ID NO: 3196550 - RNA, 23 nt, Human
ccuggucacaggacucugccucc

SEQ ID NO: 3196551 - RNA, 22 nt, Human
ccuggucacaggacucugccuc

SEQ ID NO: 3196552 - RNA, 19 nt, Human
ccugguaagaaaaagcaaa

SEQ ID NO: 3196553 - RNA, 15 nt, Human
ccugguaagaaaaag

SEQ ID NO: 3196554 - RNA, 14 nt, Human
ccugguaagaaaaa

SEQ ID NO: 3196555 - RNA, 18 nt, Human
ccuggggguucuuucuuc

SEQ ID NO: 3196556 - RNA, 15 nt, Human
ccuggguccccagcc

SEQ ID NO: 3196557 - RNA, 23 nt, Human
ccuggggguucuuucuuccucug

SEQ ID NO: 3196558 - RNA, 22 nt, Human
ccuggggguucuuucuuccucu

SEQ ID NO: 3196559 - RNA, 21 nt, Human
ccuggggguucuuucuuccuc

SEQ ID NO: 3196560 - RNA, 24 nt, Human
ccuggcuuuucacugcuggcugcc

SEQ ID NO: 3196561 - RNA, 23 nt, Human
ccuggcuuuucacugcuggcugc

SEQ ID NO: 3196562 - RNA, 22 nt, Human
ccuggcuuuucacugcuggcug

SEQ ID NO: 3196563 - RNA, 21 nt, Human
ccuggcuuuucacugcuggcu

SEQ ID NO: 3196564 - RNA, 18 nt, Human
ccuggcuuuucacugcug

SEQ ID NO: 3196565 - RNA, 20 nt, Human
ccuggcuuuucacugcuggc

SEQ ID NO: 3196566 - RNA, 15 nt, Human
ccuggcuuccuuacu

SEQ ID NO: 3196567 - RNA, 13 nt, Human
ccuggcuuccuua

SEQ ID NO: 3196568 - RNA, 18 nt, Human
ccuggcugggacugggaa

SEQ ID NO: 3196569 - RNA, 21 nt, Human
ccuggcugggacugggaacag

SEQ ID NO: 3196570 - RNA, 18 nt, Human
ccugccugguccucacac

SEQ ID NO: 3196571 - RNA, 23 nt, Human
ccugccuguugggccaggagccu

SEQ ID NO: 3196572 - RNA, 14 nt, Human
ccugccuuaaguga

SEQ ID NO: 3196573 - RNA, 22 nt, Human
ccugccccucaacucuccucca

SEQ ID NO: 3196574 - RNA, 16 nt, Human
ccugcggugcuaucuc

SEQ ID NO: 3196575 - RNA, 17 nt, Human
ccugcggugcuaucucc

SEQ ID NO: 3196576 - RNA, 18 nt, Human
ccugcgggucacaggagg

SEQ ID NO: 3196577 - RNA, 22 nt, Human
ccugcgggucacaggagggagg

SEQ ID NO: 3196578 - RNA, 21 nt, Human
ccugcgcgggaccaucuggaa

SEQ ID NO: 3196579 - RNA, 21 nt, Human
ccugccuugcccacuccugcu

SEQ ID NO: 3196580 - RNA, 17 nt, Human
ccugcgaggcuaugagu

SEQ ID NO: 3196581 - RNA, 23 nt, Human
ccuggaagcagugcccagguggc

SEQ ID NO: 3196582 - RNA, 20 nt, Human
ccuggaagcagugcccaggu

SEQ ID NO: 3196583 - RNA, 15 nt, Human
ccuggaagcagugcc

SEQ ID NO: 3196584 - RNA, 19 nt, Human
ccuggaagcagugcccagg

SEQ ID NO: 3196585 - RNA, 18 nt, Human
ccuggaagcagugcccag

SEQ ID NO: 3196586 - RNA, 17 nt, Human
ccuggaagcagugccca

SEQ ID NO: 3196587 - RNA, 16 nt, Human
ccuggaagcagugccc

SEQ ID NO: 3196588 - RNA, 14 nt, Human
ccugcuucaaauau

SEQ ID NO: 3196589 - RNA, 20 nt, Human
ccugcuucagccucccacag

SEQ ID NO: 3196590 - RNA, 17 nt, Human
ccugcuucagccuccca

SEQ ID NO: 3196591 - RNA, 21 nt, Human
ccugcuguuuaucccuuaaga

SEQ ID NO: 3196592 - RNA, 19 nt, Human
ccugcuuugggcugcccug

SEQ ID NO: 3196593 - RNA, 20 nt, Human
ccugcuuugggcugcccugg

SEQ ID NO: 3196594 - RNA, 23 nt, Human
ccugcuucagccucccacagugc

SEQ ID NO: 3196595 - RNA, 22 nt, Human
ccugcuuugggcugcccuggug

SEQ ID NO: 3196596 - RNA, 21 nt, Human
ccugcuuugggcugcccuggu

SEQ ID NO: 3196597 - RNA, 23 nt, Human
ccugcuuugggcugcccuggugc

SEQ ID NO: 3196598 - RNA, 22 nt, Human
ccugcuuugucuccucuauccu

SEQ ID NO: 3196599 - RNA, 22 nt, Human
ccugcucuccgaccagacaccu

SEQ ID NO: 3196600 - RNA, 21 nt, Human
ccugcucuccucuugccacug

SEQ ID NO: 3196601 - RNA, 19 nt, Human
ccugcucuccucuugccac

SEQ ID NO: 3196602 - RNA, 18 nt, Human
ccugcucuccucuugcca

SEQ ID NO: 3196603 - RNA, 16 nt, Human
ccugcucuccucuugc

SEQ ID NO: 3196604 - RNA, 22 nt, Human
ccugcucuccucuugccacugc

SEQ ID NO: 3196605 - RNA, 12 nt, Human
ccugcucugcug

SEQ ID NO: 3196606 - RNA, 12 nt, Human
ccugcucugcuc

SEQ ID NO: 3196607 - RNA, 15 nt, Human
ccugcucuuuggccu

SEQ ID NO: 3196608 - RNA, 13 nt, Human
ccugcucugcuga

SEQ ID NO: 3196609 - RNA, 22 nt, Human
ccugcggugcuaucucccccag

SEQ ID NO: 3196610 - RNA, 22 nt, Human
ccugcucagcagugagagcaga

SEQ ID NO: 3196611 - RNA, 21 nt, Human
ccugcucagcagugagagcag

SEQ ID NO: 3196612 - RNA, 21 nt, Human
ccugcucuccgaccagacacc

SEQ ID NO: 3196613 - RNA, 13 nt, Human
ccugcuccuuccc

SEQ ID NO: 3196614 - RNA, 21 nt, Human
ccugcucgaugcucacagggc

SEQ ID NO: 3196615 - RNA, 18 nt, Human
ccugcuccuucccuugcu

SEQ ID NO: 3196616 - RNA, 16 nt, Human
ccugcuccuucccuug

SEQ ID NO: 3196617 - RNA, 16 nt, Human
cgaaguucaagaucaa

SEQ ID NO: 3196618 - RNA, 17 nt, Human
cgaaguucaagaucaaa

SEQ ID NO: 3196619 - RNA, 18 nt, Human
cgaaguucaagaucaaaa

SEQ ID NO: 3196620 - RNA, 21 nt, Human
cgaacugggcauauuucuaau

SEQ ID NO: 3196621 - RNA, 16 nt, Human
cgaacuguuguauaaa

SEQ ID NO: 3196622 - RNA, 14 nt, Human
cgaacuggcugcaa

SEQ ID NO: 3196623 - RNA, 12 nt, Human
cgaacuggcugc

SEQ ID NO: 3196624 - RNA, 14 nt, Human
cgaacuccugaccu

SEQ ID NO: 3196625 - RNA, 18 nt, Human
cgaaagaaaacucuauuu

SEQ ID NO: 3196626 - RNA, 23 nt, Human
cgaaagaggcacccuuccaucug

SEQ ID NO: 3196627 - RNA, 12 nt, Human
cgaaagaggcac

SEQ ID NO: 3196628 - RNA, 20 nt, Human
cgaaagaggcacccuuccau

SEQ ID NO: 3196629 - RNA, 19 nt, Human
cgaaagaggcacccuucca

SEQ ID NO: 3196630 - RNA, 22 nt, Human
cgaaagggacuuggaagcuccg

SEQ ID NO: 3196631 - RNA, 20 nt, Human
cgaaaggaugaaagugacca

SEQ ID NO: 3196632 - RNA, 19 nt, Human
cgaaagggacuuggaagcu

SEQ ID NO: 3196633 - RNA, 16 nt, Human
ccuuuucacccuucua

SEQ ID NO: 3196634 - RNA, 20 nt, Human
ccuuuucacccuucuacucu

SEQ ID NO: 3196635 - RNA, 23 nt, Human
ccuuuuauuauaagucuuacaua

SEQ ID NO: 3196636 - RNA, 14 nt, Human
ccuuuucaggaaaa

SEQ ID NO: 3196637 - RNA, 20 nt, Human
ccuuugacgccaucccagcc

SEQ ID NO: 3196638 - RNA, 21 nt, Human
ccuuugacgccaucccagccc

SEQ ID NO: 3196639 - RNA, 22 nt, Human
ccuuugacgccaucccagcccc

SEQ ID NO: 3196640 - RNA, 18 nt, Human
cgaaaacguggcugcuuc

SEQ ID NO: 3196641 - RNA, 19 nt, Human
cgaaaacguggcugcuuca

SEQ ID NO: 3196642 - RNA, 15 nt, Human
cgaaaacguggcugc

SEQ ID NO: 3196643 - RNA, 12 nt, Human
ccuuuuuuuuga

SEQ ID NO: 3196644 - RNA, 19 nt, Human
cgaaaaaauaauuauuuau

SEQ ID NO: 3196645 - RNA, 20 nt, Human
cgaaaacguggcugcuucaa

SEQ ID NO: 3196646 - RNA, 12 nt, Human
cgaaaacauugu

SEQ ID NO: 3196647 - RNA, 12 nt, Human
cgaaaaucauug

SEQ ID NO: 3196648 - RNA, 22 nt, Human
cgaaacucuaaguguuugcugc

SEQ ID NO: 3196649 - RNA, 20 nt, Human
cgagaucacgccacugcacu

SEQ ID NO: 3196650 - RNA, 18 nt, Human
cgagaucacgccacugca

SEQ ID NO: 3196651 - RNA, 20 nt, Human
cgagauugcaccacugcacu

SEQ ID NO: 3196652 - RNA, 21 nt, Human
cgagcagacacccuuggagcu

SEQ ID NO: 3196653 - RNA, 18 nt, Human
cgagcaggcuacugucag

SEQ ID NO: 3196654 - RNA, 20 nt, Human
cgagcaggcuucuucccccc

SEQ ID NO: 3196655 - RNA, 14 nt, Human
cgagcaugccugga

SEQ ID NO: 3196656 - RNA, 13 nt, Human
cgagcaugccugg

SEQ ID NO: 3196657 - RNA, 16 nt, Human
cgagcaugccuggaug

SEQ ID NO: 3196658 - RNA, 17 nt, Human
cgagcaugccuggaugg

SEQ ID NO: 3196659 - RNA, 18 nt, Human
cgagauagccaaggccaa

SEQ ID NO: 3196660 - RNA, 17 nt, Human
cgagaucacgccacugc

SEQ ID NO: 3196661 - RNA, 14 nt, Human
cgaauagcugggac

SEQ ID NO: 3196662 - RNA, 13 nt, Human
cgaauagcuggga

SEQ ID NO: 3196663 - RNA, 16 nt, Human
cgacuugcauuuuugc

SEQ ID NO: 3196664 - RNA, 19 nt, Human
cgacuugugcacaggcaga

SEQ ID NO: 3196665 - RNA, 18 nt, Human
cgacuugugcacaggcag

SEQ ID NO: 3196666 - RNA, 17 nt, Human
cgccaugcuccuggccc

SEQ ID NO: 3196667 - RNA, 17 nt, Human
cgccagauucuuuccug

SEQ ID NO: 3196668 - RNA, 19 nt, Human
cgccagauucuuuccugag

SEQ ID NO: 3196669 - RNA, 20 nt, Human
cgccagauucuuuccugagg

SEQ ID NO: 3196670 - RNA, 21 nt, Human
cgccagauucuuuccugaggc

SEQ ID NO: 3196671 - RNA, 22 nt, Human
cgccaggggaaaaucagccugc

SEQ ID NO: 3196672 - RNA, 17 nt, Human
cgccagggaccccagaa

SEQ ID NO: 3196673 - RNA, 16 nt, Human
cgccagggaccccaga

SEQ ID NO: 3196674 - RNA, 15 nt, Human
cgcagacaggaccag

SEQ ID NO: 3196675 - RNA, 16 nt, Human
cgcagacaggaccagg

SEQ ID NO: 3196676 - RNA, 21 nt, Human
cgcagagaagugacgguuccu

SEQ ID NO: 3196677 - RNA, 14 nt, Human
cgcagcccugcaga

SEQ ID NO: 3196678 - RNA, 10 nt, Human
cgcagcccug

SEQ ID NO: 3196679 - RNA, 22 nt, Human
cgcagagaagugacgguuccua

SEQ ID NO: 3196680 - RNA, 17 nt, Human
cgcaaccaagugugcua

SEQ ID NO: 3196681 - RNA, 21 nt, Human
cgcaagcaccauccccuccgg

SEQ ID NO: 3196682 - RNA, 19 nt, Human
cgcaagcaccauccccucc

SEQ ID NO: 3196683 - RNA, 13 nt, Human
cgcacagcugcuc

SEQ ID NO: 3196684 - RNA, 17 nt, Human
cgcaccagcccagaagu

SEQ ID NO: 3196685 - RNA, 18 nt, Human
cgagcaugccuggauggg

SEQ ID NO: 3196686 - RNA, 16 nt, Human
cgagcccugguggcag

SEQ ID NO: 3196687 - RNA, 15 nt, Human
cgagcccugguggca

SEQ ID NO: 3196688 - RNA, 14 nt, Human
ccuuaagcugcagg

SEQ ID NO: 3196689 - RNA, 15 nt, Human
ccuuaagcugcagga

SEQ ID NO: 3196690 - RNA, 15 nt, Human
ccuuaagaaugccaa

SEQ ID NO: 3196691 - RNA, 20 nt, Human
ccuuaagaaugaguuucuua

SEQ ID NO: 3196692 - RNA, 12 nt, Human
ccuuaagaauga

SEQ ID NO: 3196693 - RNA, 14 nt, Human
ccuuacacaauggu

SEQ ID NO: 3196694 - RNA, 20 nt, Human
ccuuacacaaugguuuucuu

SEQ ID NO: 3196695 - RNA, 19 nt, Human
ccuuaagugaggaaaucaa

SEQ ID NO: 3196696 - RNA, 22 nt, Human
ccuuaagugaggaaaucaaagu

SEQ ID NO: 3196697 - RNA, 11 nt, Human
ccuuaauauuu

SEQ ID NO: 3196698 - RNA, 12 nt, Human
ccuuaauauuuc

SEQ ID NO: 3196699 - RNA, 15 nt, Human
ccuuaauauuucuuc

SEQ ID NO: 3196700 - RNA, 19 nt, Human
ccuuaauauuucuucaaau

SEQ ID NO: 3196701 - RNA, 20 nt, Human
ccuuaagugaggaaaucaaa

SEQ ID NO: 3196702 - RNA, 13 nt, Human
ccuuaaaacuagg

SEQ ID NO: 3196703 - RNA, 23 nt, Human
ccuuaaaacuaggcauuuguaaa

SEQ ID NO: 3196704 - RNA, 16 nt, Human
ccuuaaaauuugaaac

SEQ ID NO: 3196705 - RNA, 15 nt, Human
ccuuaaaauuugaaa

SEQ ID NO: 3196706 - RNA, 18 nt, Human
ccuuaaaauuugaaacau

SEQ ID NO: 3196707 - RNA, 17 nt, Human
ccuuaaaauuugaaaca

SEQ ID NO: 3196708 - RNA, 16 nt, Human
ccuguuuugagcccug

SEQ ID NO: 3196709 - RNA, 20 nt, Human
ccuuaaaacaucauuccuuu

SEQ ID NO: 3196710 - RNA, 13 nt, Human
ccuuaccagcaga

SEQ ID NO: 3196711 - RNA, 17 nt, Human
ccuuaccacugcucuga

SEQ ID NO: 3196712 - RNA, 23 nt, Human
ccuuacaaaugauugcuuuuaaa

SEQ ID NO: 3196713 - RNA, 21 nt, Human
ccuuacaaaugauugcuuuua

SEQ ID NO: 3196714 - RNA, 17 nt, Human
ccuuacaaaugauugcu

SEQ ID NO: 3196715 - RNA, 17 nt, Human
ccuuaccagcagagcac

SEQ ID NO: 3196716 - RNA, 20 nt, Human
ccuuaccacugcucugauga

SEQ ID NO: 3196717 - RNA, 20 nt, Human
ccuuaccagcagagcaccuu

SEQ ID NO: 3196718 - RNA, 14 nt, Human
ccuuaccugccagg

SEQ ID NO: 3196719 - RNA, 19 nt, Human
ccuuaccugccaggaagcc

SEQ ID NO: 3196720 - RNA, 18 nt, Human
ccuuagaagucacacagu

SEQ ID NO: 3196721 - RNA, 17 nt, Human
ccuuagaagucacacag

SEQ ID NO: 3196722 - RNA, 23 nt, Human
ccuuacugaccucaccuaggaag

SEQ ID NO: 3196723 - RNA, 23 nt, Human
ccuguugggccaggagccuccug

SEQ ID NO: 3196724 - RNA, 21 nt, Human
ccuguuaaaagaugaaaauau

SEQ ID NO: 3196725 - RNA, 20 nt, Human
ccuguuaaaagaugaaaaua

SEQ ID NO: 3196726 - RNA, 13 nt, Human
ccuguguuaauuu

SEQ ID NO: 3196727 - RNA, 14 nt, Human
ccuguguuaauuua

SEQ ID NO: 3196728 - RNA, 17 nt, Human
ccuguguuaauuuaagu

SEQ ID NO: 3196729 - RNA, 23 nt, Human
ccuguguuaauuuaaguuuugac

SEQ ID NO: 3196730 - RNA, 14 nt, Human
ccuguuuguuucug

SEQ ID NO: 3196731 - RNA, 22 nt, Human
ccuguuugggaagagcuuagaa

SEQ ID NO: 3196732 - RNA, 18 nt, Human
ccuguuuguuucugaaag

SEQ ID NO: 3196733 - RNA, 23 nt, Human
ccuguuugggaagagcuuagaaa

SEQ ID NO: 3196734 - RNA, 16 nt, Human
ccuguuucugcagcca

SEQ ID NO: 3196735 - RNA, 23 nt, Human
ccuguuucaaguucacaccugca

SEQ ID NO: 3196736 - RNA, 18 nt, Human
ccuguuucagaggcucag

SEQ ID NO: 3196737 - RNA, 21 nt, Human
ccugugugugcgccuacagga

SEQ ID NO: 3196738 - RNA, 20 nt, Human
ccugugugugcgccuacagg

SEQ ID NO: 3196739 - RNA, 22 nt, Human
ccugugucuugcaauggcagcc

SEQ ID NO: 3196740 - RNA, 21 nt, Human
ccugugucuugcaauggcagc

SEQ ID NO: 3196741 - RNA, 19 nt, Human
ccugugucuugcaauggca

SEQ ID NO: 3196742 - RNA, 17 nt, Human
ccugugucuugcaaugg

SEQ ID NO: 3196743 - RNA, 21 nt, Human
ccuguguccaugugaucucau

SEQ ID NO: 3196744 - RNA, 22 nt, Human
ccugugucaguuuauguuuugg

SEQ ID NO: 3196745 - RNA, 17 nt, Human
ccugugucaguuuaugu

SEQ ID NO: 3196746 - RNA, 17 nt, Human
ccuugucauuuuggucu

SEQ ID NO: 3196747 - RNA, 13 nt, Human
ccuuguuccaguu

SEQ ID NO: 3196748 - RNA, 16 nt, Human
ccuuugacgccauccc

SEQ ID NO: 3196749 - RNA, 17 nt, Human
ccuuugacgccauccca

SEQ ID NO: 3196750 - RNA, 18 nt, Human
ccuuugacgccaucccag

SEQ ID NO: 3196751 - RNA, 16 nt, Human
ccuuucuacuuccaag

SEQ ID NO: 3196752 - RNA, 11 nt, Human
ccuuguuucag

SEQ ID NO: 3196753 - RNA, 16 nt, Human
ccuuucuauaauuuua

SEQ ID NO: 3196754 - RNA, 17 nt, Human
ccuuucuauaauuuuac

SEQ ID NO: 3196755 - RNA, 22 nt, Human
ccuugauuggaagggcuuuuca

SEQ ID NO: 3196756 - RNA, 13 nt, Human
ccuugauuggaag

SEQ ID NO: 3196757 - RNA, 19 nt, Human
ccuugauucccuuguuauu

SEQ ID NO: 3196758 - RNA, 12 nt, Human
ccuugggacccc

SEQ ID NO: 3196759 - RNA, 21 nt, Human
ccuuggcuuggcccuggcagc

SEQ ID NO: 3196760 - RNA, 20 nt, Human
ccuuggcuuggcccuggcag

SEQ ID NO: 3196761 - RNA, 19 nt, Human
ccuuggcuuggcccuggca

SEQ ID NO: 3196762 - RNA, 14 nt, Human
ccuugggauccagg

SEQ ID NO: 3196763 - RNA, 22 nt, Human
ccuuggcuuggcccuggcagcc

SEQ ID NO: 3196764 - RNA, 22 nt, Human
ccuuggggucagguugacagga

SEQ ID NO: 3196765 - RNA, 21 nt, Human
ccuugguuaggcauuguggga

SEQ ID NO: 3196766 - RNA, 22 nt, Human
ccuugguuaggcauugugggaa

SEQ ID NO: 3196767 - RNA, 22 nt, Human
ccuuggugucgggcaugacacg

SEQ ID NO: 3196768 - RNA, 21 nt, Human
ccuuggugucgggcaugacac

SEQ ID NO: 3196769 - RNA, 14 nt, Human
ccuucuguggcuca

SEQ ID NO: 3196770 - RNA, 21 nt, Human
ccuucuguggcucacagaacc

SEQ ID NO: 3196771 - RNA, 17 nt, Human
ccuucuguugaugcugu

SEQ ID NO: 3196772 - RNA, 14 nt, Human
ccuucuucauguuc

SEQ ID NO: 3196773 - RNA, 15 nt, Human
ccuucuucauguuca

SEQ ID NO: 3196774 - RNA, 20 nt, Human
ccuucuucauguucaauuau

SEQ ID NO: 3196775 - RNA, 15 nt, Human
ccuucuccuucaccu

SEQ ID NO: 3196776 - RNA, 19 nt, Human
ccuucuccuucaccuuugu

SEQ ID NO: 3196777 - RNA, 19 nt, Human
ccuucuauagcaucacuua

SEQ ID NO: 3196778 - RNA, 21 nt, Human
ccuucuauagcaucacuuaaa

SEQ ID NO: 3196779 - RNA, 15 nt, Human
ccuucggcgccuuaa

SEQ ID NO: 3196780 - RNA, 20 nt, Human
ccuugaaaacuuuaugcuaa

SEQ ID NO: 3196781 - RNA, 13 nt, Human
ccuugacucuuuc

SEQ ID NO: 3196782 - RNA, 22 nt, Human
ccuugaccauucuccaccugcc

SEQ ID NO: 3196783 - RNA, 23 nt, Human
ccuugaccauucuccaccugcca

SEQ ID NO: 3196784 - RNA, 13 nt, Human
ccuugacuuuuua

SEQ ID NO: 3196785 - RNA, 22 nt, Human
ccuugaggggagccaggagggg

SEQ ID NO: 3196786 - RNA, 21 nt, Human
ccuugaggggagccaggaggg

SEQ ID NO: 3196787 - RNA, 18 nt, Human
ccuugaggggagccagga

SEQ ID NO: 3196788 - RNA, 16 nt, Human
ccuugaggggagccag

SEQ ID NO: 3196789 - RNA, 15 nt, Human
ccuuccaagagccug

SEQ ID NO: 3196790 - RNA, 17 nt, Human
ccuuccaagagccugag

SEQ ID NO: 3196791 - RNA, 16 nt, Human
ccuuccaagagccuga

SEQ ID NO: 3196792 - RNA, 22 nt, Human
ccuucauuuggcauuccccacu

SEQ ID NO: 3196793 - RNA, 15 nt, Human
ccuuccucugagccu

SEQ ID NO: 3196794 - RNA, 16 nt, Human
ccuuccucugagccuu

SEQ ID NO: 3196795 - RNA, 21 nt, Human
ccuuccucuccacugccuucg

SEQ ID NO: 3196796 - RNA, 20 nt, Human
ccuuccucugagccuuggga

SEQ ID NO: 3196797 - RNA, 13 nt, Human
ccuuccucugagg

SEQ ID NO: 3196798 - RNA, 14 nt, Human
ccuucggccuccau

SEQ ID NO: 3196799 - RNA, 19 nt, Human
ccuucggccuccauccuga

SEQ ID NO: 3196800 - RNA, 20 nt, Human
ccuucggccuccauccugag

SEQ ID NO: 3196801 - RNA, 19 nt, Human
ccuucauuuggcauucccc

SEQ ID NO: 3196802 - RNA, 14 nt, Human
ccuucagugccaaa

SEQ ID NO: 3196803 - RNA, 11 nt, Human
ccuucagugcc

SEQ ID NO: 3196804 - RNA, 10 nt, Human
ccuucagugc

SEQ ID NO: 3196805 - RNA, 21 nt, Human
ccuucaccuuuguccccaccg

SEQ ID NO: 3196806 - RNA, 14 nt, Human
ccuucacuuaggaa

SEQ ID NO: 3196807 - RNA, 19 nt, Human
ccuucaccuuuguccccac

SEQ ID NO: 3196808 - RNA, 20 nt, Human
ccuucaccuuuguccccacc

SEQ ID NO: 3196809 - RNA, 17 nt, Human
ccuucacagaugggugc

SEQ ID NO: 3196810 - RNA, 18 nt, Human
ccucucauuccagaggaa

SEQ ID NO: 3196811 - RNA, 16 nt, Human
ccucuaggaggucucu

SEQ ID NO: 3196812 - RNA, 12 nt, Human
ccucuagcugaa

SEQ ID NO: 3196813 - RNA, 11 nt, Human
ccucuagcuga

SEQ ID NO: 3196814 - RNA, 23 nt, Human
ccucuagcugaauugagccuaaa

SEQ ID NO: 3196815 - RNA, 16 nt, Human
ccucggugccuuccuc

SEQ ID NO: 3196816 - RNA, 14 nt, Human
ccucgguguggaga

SEQ ID NO: 3196817 - RNA, 12 nt, Human
ccuccuucccac

SEQ ID NO: 3196818 - RNA, 17 nt, Human
ccuccuguggccugcca

SEQ ID NO: 3196819 - RNA, 14 nt, Human
ccuccuguggccug

SEQ ID NO: 3196820 - RNA, 10 nt, Human
ccucuagcug

SEQ ID NO: 3196821 - RNA, 18 nt, Human
ccucuagcccugcccgga

SEQ ID NO: 3196822 - RNA, 17 nt, Human
ccucuagcccugcccgg

SEQ ID NO: 3196823 - RNA, 13 nt, Human
ccucuagcccugc

SEQ ID NO: 3196824 - RNA, 19 nt, Human
ccucuagaauuuuaagccu

SEQ ID NO: 3196825 - RNA, 21 nt, Human
ccucccugccccucccuucaa

SEQ ID NO: 3196826 - RNA, 18 nt, Human
ccucccugccccucccuu

SEQ ID NO: 3196827 - RNA, 10 nt, Human
ccucccuccc

SEQ ID NO: 3196828 - RNA, 14 nt, Human
ccuccucagaucuu

SEQ ID NO: 3196829 - RNA, 24 nt, Human
ccucccugccccucccuucaacca

SEQ ID NO: 3196830 - RNA, 22 nt, Human
ccucccugccccucccuucaac

SEQ ID NO: 3196831 - RNA, 13 nt, Human
ccucccugccccu

SEQ ID NO: 3196832 - RNA, 14 nt, Human
ccucccugcuguca

SEQ ID NO: 3196833 - RNA, 21 nt, Human
ccucccgaguagcugggacua

SEQ ID NO: 3196834 - RNA, 20 nt, Human
ccucccgaguagcugggacu

SEQ ID NO: 3196835 - RNA, 19 nt, Human
ccucccgaguagcugggac

SEQ ID NO: 3196836 - RNA, 14 nt, Human
ccucccggcccugc

SEQ ID NO: 3196837 - RNA, 14 nt, Human
ccuccccuucccag

SEQ ID NO: 3196838 - RNA, 14 nt, Human
ccuccccuugccag

SEQ ID NO: 3196839 - RNA, 22 nt, Human
ccuccccuugccagcugcugag

SEQ ID NO: 3196840 - RNA, 18 nt, Human
ccucccccagccacuccc

SEQ ID NO: 3196841 - RNA, 19 nt, Human
ccuccugacacaccugcag

SEQ ID NO: 3196842 - RNA, 20 nt, Human
ccuccugacacaccugcagc

SEQ ID NO: 3196843 - RNA, 15 nt, Human
ccuccugacacccca

SEQ ID NO: 3196844 - RNA, 19 nt, Human
ccuccugcugccaguacca

SEQ ID NO: 3196845 - RNA, 21 nt, Human
ccuccuggggcgcgugaggcc

SEQ ID NO: 3196846 - RNA, 22 nt, Human
ccuccuggggcgcgugaggccc

SEQ ID NO: 3196847 - RNA, 14 nt, Human
ccuccugggcuaag

SEQ ID NO: 3196848 - RNA, 16 nt, Human
ccuccugcugccagua

SEQ ID NO: 3196849 - RNA, 14 nt, Human
ccuccugcugccag

SEQ ID NO: 3196850 - RNA, 23 nt, Human
ccuccugccucgaacuggcugca

SEQ ID NO: 3196851 - RNA, 17 nt, Human
ccuccugacaccccacu

SEQ ID NO: 3196852 - RNA, 13 nt, Human
ccuccugccucga

SEQ ID NO: 3196853 - RNA, 17 nt, Human
ccucccgaauagcuggg

SEQ ID NO: 3196854 - RNA, 13 nt, Human
ccucauccucaua

SEQ ID NO: 3196855 - RNA, 20 nt, Human
ccucauccucauacccaccc

SEQ ID NO: 3196856 - RNA, 19 nt, Human
ccuccacacccgcgccccg

SEQ ID NO: 3196857 - RNA, 22 nt, Human
ccuccaaucccaccaacccuca

SEQ ID NO: 3196858 - RNA, 23 nt, Human
ccuccaaucccaccaacccucag

SEQ ID NO: 3196859 - RNA, 13 nt, Human
ccucaucaccaac

SEQ ID NO: 3196860 - RNA, 14 nt, Human
ccucaucaccaacg

SEQ ID NO: 3196861 - RNA, 22 nt, Human
ccucauaguaugguggcugggu

SEQ ID NO: 3196862 - RNA, 21 nt, Human
ccucauaguaugguggcuggg

SEQ ID NO: 3196863 - RNA, 13 nt, Human
ccucauacccacc

SEQ ID NO: 3196864 - RNA, 17 nt, Human
ccucauagcccucaccc

SEQ ID NO: 3196865 - RNA, 18 nt, Human
ccucauagcccucacccu

SEQ ID NO: 3196866 - RNA, 20 nt, Human
ccucauaguaugguggcugg

SEQ ID NO: 3196867 - RNA, 21 nt, Human
ccucauagcccucacccuggg

SEQ ID NO: 3196868 - RNA, 22 nt, Human
ccucauagcccucacccugggg

SEQ ID NO: 3196869 - RNA, 20 nt, Human
ccucagucuggcccuuccuu

SEQ ID NO: 3196870 - RNA, 12 nt, Human
ccucauacccac

SEQ ID NO: 3196871 - RNA, 11 nt, Human
ccucagugcca

SEQ ID NO: 3196872 - RNA, 19 nt, Human
ccucagucuggcccuuccu

SEQ ID NO: 3196873 - RNA, 19 nt, Human
ccuaugcagagguccacaa

SEQ ID NO: 3196874 - RNA, 22 nt, Human
ccuccagagcugcggugucucc

SEQ ID NO: 3196875 - RNA, 14 nt, Human
ccuccauccugagg

SEQ ID NO: 3196876 - RNA, 18 nt, Human
ccuccaucuaaacugccc

SEQ ID NO: 3196877 - RNA, 22 nt, Human
ccuccaggugcacaagcuccaa

SEQ ID NO: 3196878 - RNA, 22 nt, Human
ccuccagggcucaacacuguga

SEQ ID NO: 3196879 - RNA, 19 nt, Human
ccuccaggugcacaagcuc

SEQ ID NO: 3196880 - RNA, 21 nt, Human
ccuccaggugcacaagcucca

SEQ ID NO: 3196881 - RNA, 15 nt, Human
ccucccaaagugcug

SEQ ID NO: 3196882 - RNA, 15 nt, Human
ccuccaugcugccuc

SEQ ID NO: 3196883 - RNA, 23 nt, Human
ccuccaugugggcuaguugggcu

SEQ ID NO: 3196884 - RNA, 14 nt, Human
ccuccaugcugccu

SEQ ID NO: 3196885 - RNA, 18 nt, Human
cccugguuuccugcccug

SEQ ID NO: 3196886 - RNA, 19 nt, Human
cccugguuuccugcccugg

SEQ ID NO: 3196887 - RNA, 14 nt, Human
ccgaggccuucucu

SEQ ID NO: 3196888 - RNA, 16 nt, Human
cccugguuuccugccc

SEQ ID NO: 3196889 - RNA, 17 nt, Human
cccugguuuccugcccu

SEQ ID NO: 3196890 - RNA, 17 nt, Human
ccgaguagcugggacua

SEQ ID NO: 3196891 - RNA, 16 nt, Human
ccgaguagcugggacu

SEQ ID NO: 3196892 - RNA, 20 nt, Human
ccgaguagcugggacuacag

SEQ ID NO: 3196893 - RNA, 12 nt, Human
ccgauuuuucca

SEQ ID NO: 3196894 - RNA, 14 nt, Human
ccgcaagcaccauc

SEQ ID NO: 3196895 - RNA, 11 nt, Human
ccgcucagccc

SEQ ID NO: 3196896 - RNA, 13 nt, Human
ccgcucagcccuc

SEQ ID NO: 3196897 - RNA, 12 nt, Human
ccgcucagcccu

SEQ ID NO: 3196898 - RNA, 23 nt, Human
ccgcuaagagggagggagggcuc

SEQ ID NO: 3196899 - RNA, 21 nt, Human
ccgcuaagagggagggagggc

SEQ ID NO: 3196900 - RNA, 15 nt, Human
ccgcggcgggcccug

SEQ ID NO: 3196901 - RNA, 19 nt, Human
ccgcggcgggcccugccca

SEQ ID NO: 3196902 - RNA, 16 nt, Human
ccgcgggcacugccgc

SEQ ID NO: 3196903 - RNA, 14 nt, Human
ccgcacugggcuug

SEQ ID NO: 3196904 - RNA, 17 nt, Human
ccgcgcgcgccccgaaa

SEQ ID NO: 3196905 - RNA, 15 nt, Human
ccggcuuucaggagc

SEQ ID NO: 3196906 - RNA, 20 nt, Human
ccgggaagggggcugggaca

SEQ ID NO: 3196907 - RNA, 17 nt, Human
ccggcuggccuggcccc

SEQ ID NO: 3196908 - RNA, 18 nt, Human
ccggcuggccuggccccu

SEQ ID NO: 3196909 - RNA, 15 nt, Human
ccggcuggccuggcc

SEQ ID NO: 3196910 - RNA, 19 nt, Human
ccgcuuucuacccagcgag

SEQ ID NO: 3196911 - RNA, 12 nt, Human
ccgcuuucuacc

SEQ ID NO: 3196912 - RNA, 15 nt, Human
ccgcuccagagucag

SEQ ID NO: 3196913 - RNA, 12 nt, Human
ccgcuccagagu

SEQ ID NO: 3196914 - RNA, 11 nt, Human
ccgcuccagag

SEQ ID NO: 3196915 - RNA, 21 nt, Human
ccgcucuuggggacauggguc

SEQ ID NO: 3196916 - RNA, 22 nt, Human
ccgcucagcccucccugccccu

SEQ ID NO: 3196917 - RNA, 21 nt, Human
ccgcucagcccucccugcccc

SEQ ID NO: 3196918 - RNA, 19 nt, Human
ccgcucagcccucccugcc

SEQ ID NO: 3196919 - RNA, 15 nt, Human
ccgcucagcccuccc

SEQ ID NO: 3196920 - RNA, 15 nt, Human
ccggguuccagcacc

SEQ ID NO: 3196921 - RNA, 12 nt, Human
ccggguuccagc

SEQ ID NO: 3196922 - RNA, 22 nt, Human
ccgggucaucuguaccucugcc

SEQ ID NO: 3196923 - RNA, 21 nt, Human
ccgggucuuccuacucuucuc

SEQ ID NO: 3196924 - RNA, 13 nt, Human
ccgggucuuccua

SEQ ID NO: 3196925 - RNA, 16 nt, Human
ccgggcguggugguga

SEQ ID NO: 3196926 - RNA, 19 nt, Human
ccgggacguggcaccuccu

SEQ ID NO: 3196927 - RNA, 20 nt, Human
ccgggcuacccgugagcccu

SEQ ID NO: 3196928 - RNA, 20 nt, Human
ccgggcgcgguggcucacgc

SEQ ID NO: 3196929 - RNA, 22 nt, Human
ccgggcucugccucccaucacc

SEQ ID NO: 3196930 - RNA, 19 nt, Human
ccgggcugggagcucugca

SEQ ID NO: 3196931 - RNA, 18 nt, Human
ccgggcugggagcucugc

SEQ ID NO: 3196932 - RNA, 13 nt, Human
ccgggcugggagc

SEQ ID NO: 3196933 - RNA, 15 nt, Human
ccuacaagacacagu

SEQ ID NO: 3196934 - RNA, 14 nt, Human
ccuacaaaucagua

SEQ ID NO: 3196935 - RNA, 15 nt, Human
ccuacaaaucaguaa

SEQ ID NO: 3196936 - RNA, 11 nt, Human
ccuacacagga

SEQ ID NO: 3196937 - RNA, 23 nt, Human
ccuacacaggacagggguuccuu

SEQ ID NO: 3196938 - RNA, 17 nt, Human
ccuacacaggacagggg

SEQ ID NO: 3196939 - RNA, 15 nt, Human
ccuacacaggacagg

SEQ ID NO: 3196940 - RNA, 15 nt, Human
ccuaaaauaagaaua

SEQ ID NO: 3196941 - RNA, 13 nt, Human
ccuaaaaggccca

SEQ ID NO: 3196942 - RNA, 17 nt, Human
ccuaaaaggcccagaga

SEQ ID NO: 3196943 - RNA, 15 nt, Human
ccuaaaaggcccaga

SEQ ID NO: 3196944 - RNA, 14 nt, Human
ccuaaaaggcccag

SEQ ID NO: 3196945 - RNA, 18 nt, Human
ccguguaggaaccugcac

SEQ ID NO: 3196946 - RNA, 20 nt, Human
ccguggggccggggcuucug

SEQ ID NO: 3196947 - RNA, 14 nt, Human
ccuaggcuggaagg

SEQ ID NO: 3196948 - RNA, 16 nt, Human
ccuaggcuggaaggag

SEQ ID NO: 3196949 - RNA, 19 nt, Human
ccuaggcuggaaggaggaa

SEQ ID NO: 3196950 - RNA, 22 nt, Human
ccuaggcuggaaggaggaagaa

SEQ ID NO: 3196951 - RNA, 13 nt, Human
ccuaggggaauga

SEQ ID NO: 3196952 - RNA, 16 nt, Human
ccuaggggaaugaggg

SEQ ID NO: 3196953 - RNA, 22 nt, Human
ccuaggggaaugagggggcuca

SEQ ID NO: 3196954 - RNA, 23 nt, Human
ccuaggggaaugagggggcucag

SEQ ID NO: 3196955 - RNA, 13 nt, Human
ccuacuuucuuca

SEQ ID NO: 3196956 - RNA, 15 nt, Human
ccuacuuccugugac

SEQ ID NO: 3196957 - RNA, 21 nt, Human
ccuaaauccacucugcaggaa

SEQ ID NO: 3196958 - RNA, 19 nt, Human
ccuaccuaacccagaaaau

SEQ ID NO: 3196959 - RNA, 21 nt, Human
ccuacuuccccuuccuaauuc

SEQ ID NO: 3196960 - RNA, 13 nt, Human
ccuacuuccugug

SEQ ID NO: 3196961 - RNA, 20 nt, Human
ccuaccacccgguccccacu

SEQ ID NO: 3196962 - RNA, 21 nt, Human
ccuaccgagucucuucuccac

SEQ ID NO: 3196963 - RNA, 23 nt, Human
ccuaccgagucucuucuccacug

SEQ ID NO: 3196964 - RNA, 22 nt, Human
ccuaccgagucucuucuccacu

SEQ ID NO: 3196965 - RNA, 13 nt, Human
ccuaguuccacca

SEQ ID NO: 3196966 - RNA, 15 nt, Human
ccuaguuaaagaaag

SEQ ID NO: 3196967 - RNA, 19 nt, Human
ccuaguuaaagaaaggaaa

SEQ ID NO: 3196968 - RNA, 20 nt, Human
ccuaguuaaagaaaggaaaa

SEQ ID NO: 3196969 - RNA, 18 nt, Human
ccuaguucaucccuucuc

SEQ ID NO: 3196970 - RNA, 21 nt, Human
ccuaguuccaccaucaagcca

SEQ ID NO: 3196971 - RNA, 23 nt, Human
ccuaguuccaccaucaagccacc

SEQ ID NO: 3196972 - RNA, 22 nt, Human
ccuaguucaucccuucucuucc

SEQ ID NO: 3196973 - RNA, 21 nt, Human
ccuaguucaucccuucucuuc

SEQ ID NO: 3196974 - RNA, 18 nt, Human
ccuauauuguuuucagug

SEQ ID NO: 3196975 - RNA, 22 nt, Human
ccuauauuguuuucaguguaca

SEQ ID NO: 3196976 - RNA, 23 nt, Human
ccuauaccauuuccguaauucuu

SEQ ID NO: 3196977 - RNA, 12 nt, Human
ccuauaccauuu

SEQ ID NO: 3196978 - RNA, 18 nt, Human
ccuauaacacugugaaga

SEQ ID NO: 3196979 - RNA, 20 nt, Human
ccuauaacacugugaagagc

SEQ ID NO: 3196980 - RNA, 18 nt, Human
ccuauaauccuugauaau

SEQ ID NO: 3196981 - RNA, 23 nt, Human
cccuccacucuccucuuccaggc

SEQ ID NO: 3196982 - RNA, 13 nt, Human
cccuccaccugcu

SEQ ID NO: 3196983 - RNA, 15 nt, Human
cccucccccagccac

SEQ ID NO: 3196984 - RNA, 13 nt, Human
cccucccagggag

SEQ ID NO: 3196985 - RNA, 14 nt, Human
cccucccagggagc

SEQ ID NO: 3196986 - RNA, 19 nt, Human
cccuauaucuauaaacacu

SEQ ID NO: 3196987 - RNA, 23 nt, Human
cccucucugaaggaggccaccuc

SEQ ID NO: 3196988 - RNA, 18 nt, Human
cccucucugaaggaggcc

SEQ ID NO: 3196989 - RNA, 12 nt, Human
cccucuggggcu

SEQ ID NO: 3196990 - RNA, 16 nt, Human
cccucuggggcuguuc

SEQ ID NO: 3196991 - RNA, 13 nt, Human
cccugaggcccag

SEQ ID NO: 3196992 - RNA, 15 nt, Human
cccugaaagcccuga

SEQ ID NO: 3196993 - RNA, 14 nt, Human
cccugaggcccaga

SEQ ID NO: 3196994 - RNA, 15 nt, Human
cccugaggcccagag

SEQ ID NO: 3196995 - RNA, 16 nt, Human
cccugaggcccagagg

SEQ ID NO: 3196996 - RNA, 17 nt, Human
cccugaggcccagaggg

SEQ ID NO: 3196997 - RNA, 18 nt, Human
cccugaggcccagagggc

SEQ ID NO: 3196998 - RNA, 19 nt, Human
cccugaggcccagagggcc

SEQ ID NO: 3196999 - RNA, 20 nt, Human
cccugaggcccagagggccu

SEQ ID NO: 3197000 - RNA, 23 nt, Human
cccugaggcccagagggccugca

SEQ ID NO: 3197001 - RNA, 19 nt, Human
cccugcacuugcagacucu

SEQ ID NO: 3197002 - RNA, 12 nt, Human
cccugcacuugc

SEQ ID NO: 3197003 - RNA, 23 nt, Human
cccugcacaaagcccuuccaugu

SEQ ID NO: 3197004 - RNA, 16 nt, Human
cccugcaaagcccagc

SEQ ID NO: 3197005 - RNA, 17 nt, Human
cccugcaaagcccagcu

SEQ ID NO: 3197006 - RNA, 19 nt, Human
cccugcaaagcccagcuug

SEQ ID NO: 3197007 - RNA, 20 nt, Human
cccugcaaagcccagcuuga

SEQ ID NO: 3197008 - RNA, 23 nt, Human
cccugagggcggggugucugucu

SEQ ID NO: 3197009 - RNA, 15 nt, Human
cccugcaaagcccag

SEQ ID NO: 3197010 - RNA, 21 nt, Human
cccugccagacccccuggaga

SEQ ID NO: 3197011 - RNA, 13 nt, Human
cccugccagaccc

SEQ ID NO: 3197012 - RNA, 13 nt, Human
cccugcccaccug

SEQ ID NO: 3197013 - RNA, 14 nt, Human
cccugcccaccugg

SEQ ID NO: 3197014 - RNA, 17 nt, Human
cccugcccaccuggccu

SEQ ID NO: 3197015 - RNA, 18 nt, Human
cccugcccaccuggccuc

SEQ ID NO: 3197016 - RNA, 16 nt, Human
cccugcuggguguggc

SEQ ID NO: 3197017 - RNA, 21 nt, Human
cccugcuggguguggcgcagc

SEQ ID NO: 3197018 - RNA, 17 nt, Human
cccugcuuugggcugcc

SEQ ID NO: 3197019 - RNA, 19 nt, Human
cccugcuuugggcugcccu

SEQ ID NO: 3197020 - RNA, 18 nt, Human
cccugcuuugggcugccc

SEQ ID NO: 3197021 - RNA, 16 nt, Human
cccugcuggccggaca

SEQ ID NO: 3197022 - RNA, 14 nt, Human
cccuggaccccagc

SEQ ID NO: 3197023 - RNA, 18 nt, Human
cccuggaccccagccuca

SEQ ID NO: 3197024 - RNA, 17 nt, Human
cccuggaccccagccuc

SEQ ID NO: 3197025 - RNA, 16 nt, Human
cccuggaccccagccu

SEQ ID NO: 3197026 - RNA, 15 nt, Human
cccuggaccccagcc

SEQ ID NO: 3197027 - RNA, 20 nt, Human
cccugcuuugggcugcccug

SEQ ID NO: 3197028 - RNA, 17 nt, Human
cccuggcuuuucacugc

SEQ ID NO: 3197029 - RNA, 18 nt, Human
cccuggcuuuucacugcu

SEQ ID NO: 3197030 - RNA, 18 nt, Human
cccugggaggcagugaug

SEQ ID NO: 3197031 - RNA, 19 nt, Human
cccuggaccccagccucaa

SEQ ID NO: 3197032 - RNA, 22 nt, Human
cccuggcuuuucacugcuggcu

SEQ ID NO: 3197033 - RNA, 19 nt, Human
cccuggcuuuucacugcug

SEQ ID NO: 3197034 - RNA, 15 nt, Human
cccugguaagaaaaa

SEQ ID NO: 3197035 - RNA, 23 nt, Human
cccuggguuagacugccagcucu

SEQ ID NO: 3197036 - RNA, 22 nt, Human
cccuggguuagacugccagcuc

SEQ ID NO: 3197037 - RNA, 20 nt, Human
cccugguaagaaaaagcaaa

SEQ ID NO: 3197038 - RNA, 16 nt, Human
cccugguggcagcuca

SEQ ID NO: 3197039 - RNA, 17 nt, Human
cccugguggcagcucac

SEQ ID NO: 3197040 - RNA, 15 nt, Human
cccugguggcagcuc

SEQ ID NO: 3197041 - RNA, 23 nt, Human
cccuaaugcgcaggcuggcccug

SEQ ID NO: 3197042 - RNA, 20 nt, Human
cccuacaguugaaaaacagc

SEQ ID NO: 3197043 - RNA, 20 nt, Human
cccguguaggaaccugcaca

SEQ ID NO: 3197044 - RNA, 17 nt, Human
cccuaaugcgcaggcug

SEQ ID NO: 3197045 - RNA, 21 nt, Human
cccuaaugcgcaggcuggccc

SEQ ID NO: 3197046 - RNA, 22 nt, Human
cccuaaugcgcaggcuggcccu

SEQ ID NO: 3197047 - RNA, 18 nt, Human
cccuaccgagucucuucu

SEQ ID NO: 3197048 - RNA, 21 nt, Human
cccuaccgagucucuucucca

SEQ ID NO: 3197049 - RNA, 22 nt, Human
cccgucucugguuccuccccuc

SEQ ID NO: 3197050 - RNA, 15 nt, Human
cccgugggguuccuc

SEQ ID NO: 3197051 - RNA, 14 nt, Human
cccguggggccggg

SEQ ID NO: 3197052 - RNA, 21 nt, Human
cccguggggccggggcuucug

SEQ ID NO: 3197053 - RNA, 12 nt, Human
cccgucucaggu

SEQ ID NO: 3197054 - RNA, 16 nt, Human
cccgggcucugccucc

SEQ ID NO: 3197055 - RNA, 18 nt, Human
cccggugcccaagaauag

SEQ ID NO: 3197056 - RNA, 14 nt, Human
cccgggcucugccu

SEQ ID NO: 3197057 - RNA, 15 nt, Human
cccgggcucugccuc

SEQ ID NO: 3197058 - RNA, 12 nt, Human
cccgggcucugc

SEQ ID NO: 3197059 - RNA, 17 nt, Human
cccgccgcccagcccac

SEQ ID NO: 3197060 - RNA, 22 nt, Human
cccgaguagcugggacuacagg

SEQ ID NO: 3197061 - RNA, 22 nt, Human
cccgcccaggcuuagucacuga

SEQ ID NO: 3197062 - RNA, 19 nt, Human
cccgcugucagccauuccu

SEQ ID NO: 3197063 - RNA, 20 nt, Human
cccgcugucagccauuccug

SEQ ID NO: 3197064 - RNA, 19 nt, Human
cccgccuccaaccccucgc

SEQ ID NO: 3197065 - RNA, 14 nt, Human
cccgccuccaaccc

SEQ ID NO: 3197066 - RNA, 21 nt, Human
cccgaguagcugggacuacag

SEQ ID NO: 3197067 - RNA, 18 nt, Human
cccgaguagcugggacua

SEQ ID NO: 3197068 - RNA, 17 nt, Human
cccgaguagcugggacu

SEQ ID NO: 3197069 - RNA, 16 nt, Human
cccgaguagcugggac

SEQ ID NO: 3197070 - RNA, 15 nt, Human
cccgaguagcuggga

SEQ ID NO: 3197071 - RNA, 14 nt, Human
cccgaguagcuggg

SEQ ID NO: 3197072 - RNA, 13 nt, Human
cccgaguagcugg

SEQ ID NO: 3197073 - RNA, 15 nt, Human
cccagagggccugca

SEQ ID NO: 3197074 - RNA, 21 nt, Human
cccgaggccuucucugaagga

SEQ ID NO: 3197075 - RNA, 14 nt, Human
cccagagggccugc

SEQ ID NO: 3197076 - RNA, 21 nt, Human
cccagaacucugccugcccuu

SEQ ID NO: 3197077 - RNA, 17 nt, Human
cccagaacucugccugc

SEQ ID NO: 3197078 - RNA, 14 nt, Human
cccagaacucugcc

SEQ ID NO: 3197079 - RNA, 16 nt, Human
cccagaggcuggguga

SEQ ID NO: 3197080 - RNA, 17 nt, Human
cccaccacacccucccu

SEQ ID NO: 3197081 - RNA, 19 nt, Human
cccaccgcagacaggacca

SEQ ID NO: 3197082 - RNA, 20 nt, Human
cccaccgcagacaggaccag

SEQ ID NO: 3197083 - RNA, 16 nt, Human
cccaccugcagcuccc

SEQ ID NO: 3197084 - RNA, 19 nt, Human
cccaccucucucacuccuu

SEQ ID NO: 3197085 - RNA, 22 nt, Human
cccaccucucucacuccuugaa

SEQ ID NO: 3197086 - RNA, 19 nt, Human
cccaccucccccacuccca

SEQ ID NO: 3197087 - RNA, 17 nt, Human
cccaccucagccucccg

SEQ ID NO: 3197088 - RNA, 23 nt, Human
cccaccgggcugggagcucugca

SEQ ID NO: 3197089 - RNA, 20 nt, Human
cccacgcuggagugcaguga

SEQ ID NO: 3197090 - RNA, 19 nt, Human
cccacgcuggagugcagug

SEQ ID NO: 3197091 - RNA, 14 nt, Human
cccacgcuggagug

SEQ ID NO: 3197092 - RNA, 23 nt, Human
cccacuugagaauuacccuuuug

SEQ ID NO: 3197093 - RNA, 12 nt, Human
cccacuucugcc

SEQ ID NO: 3197094 - RNA, 14 nt, Human
cccacuucugccag

SEQ ID NO: 3197095 - RNA, 17 nt, Human
cccacuugguuagauga

SEQ ID NO: 3197096 - RNA, 20 nt, Human
cccacgacugcccggcaggg

SEQ ID NO: 3197097 - RNA, 21 nt, Human
cccacgacugcccggcagggu

SEQ ID NO: 3197098 - RNA, 20 nt, Human
cccaccuuggcugcagggag

SEQ ID NO: 3197099 - RNA, 16 nt, Human
cccaccuggccucugc

SEQ ID NO: 3197100 - RNA, 19 nt, Human
cccaccuggccucugcacu

SEQ ID NO: 3197101 - RNA, 21 nt, Human
cccaccuggccucugcacucc

SEQ ID NO: 3197102 - RNA, 17 nt, Human
cccaccuggccucugca

SEQ ID NO: 3197103 - RNA, 16 nt, Human
cccacaggaggugguc

SEQ ID NO: 3197104 - RNA, 21 nt, Human
cccacaggagguggucuggga

SEQ ID NO: 3197105 - RNA, 14 nt, Human
cccaccacacaaca

SEQ ID NO: 3197106 - RNA, 13 nt, Human
cccaccacacaac

SEQ ID NO: 3197107 - RNA, 20 nt, Human
cccacaagaaaugaaagcag

SEQ ID NO: 3197108 - RNA, 13 nt, Human
cccacaagaaaug

SEQ ID NO: 3197109 - RNA, 21 nt, Human
cccacaaaggagagcuagcag

SEQ ID NO: 3197110 - RNA, 16 nt, Human
cccaaugcacuuuguu

SEQ ID NO: 3197111 - RNA, 20 nt, Human
cccaaugcacuuuguucugg

SEQ ID NO: 3197112 - RNA, 23 nt, Human
cuguggagacugcuccugagccc

SEQ ID NO: 3197113 - RNA, 18 nt, Human
cuguggaaggcagagaaa

SEQ ID NO: 3197114 - RNA, 19 nt, Human
cuguggaaggcagagaaau

SEQ ID NO: 3197115 - RNA, 14 nt, Human
cuguggagacugcu

SEQ ID NO: 3197116 - RNA, 22 nt, Human
cuguggagacugcuccugagcc

SEQ ID NO: 3197117 - RNA, 21 nt, Human
cuguggagacugcuccugagc

SEQ ID NO: 3197118 - RNA, 19 nt, Human
cuguggagacugcuccuga

SEQ ID NO: 3197119 - RNA, 17 nt, Human
cuguggagacugcuccu

SEQ ID NO: 3197120 - RNA, 16 nt, Human
cugugccucugccugu

SEQ ID NO: 3197121 - RNA, 11 nt, Human
cugugccucug

SEQ ID NO: 3197122 - RNA, 15 nt, Human
cugugccucugccug

SEQ ID NO: 3197123 - RNA, 14 nt, Human
cugugccucugccu

SEQ ID NO: 3197124 - RNA, 13 nt, Human
cugugccucugcc

SEQ ID NO: 3197125 - RNA, 12 nt, Human
cugugccucugc

SEQ ID NO: 3197126 - RNA, 16 nt, Human
cuguggccugccaguc

SEQ ID NO: 3197127 - RNA, 14 nt, Human
cuguggccugccag

SEQ ID NO: 3197128 - RNA, 19 nt, Human
cuguggccucccugcucua

SEQ ID NO: 3197129 - RNA, 21 nt, Human
cuguggguuucuaaagcugcc

SEQ ID NO: 3197130 - RNA, 21 nt, Human
cugugggcacaggucaggcua

SEQ ID NO: 3197131 - RNA, 18 nt, Human
cugugggcaaaagagugu

SEQ ID NO: 3197132 - RNA, 17 nt, Human
cugugggcacaggucag

SEQ ID NO: 3197133 - RNA, 19 nt, Human
cuguggucggugccagagg

SEQ ID NO: 3197134 - RNA, 22 nt, Human
cuguggguuucuaaagcugcca

SEQ ID NO: 3197135 - RNA, 22 nt, Human
cuguggguuuguggggggaggc

SEQ ID NO: 3197136 - RNA, 18 nt, Human
cuguguguguguaugugg

SEQ ID NO: 3197137 - RNA, 20 nt, Human
cuguguguguguaugugggg

SEQ ID NO: 3197138 - RNA, 18 nt, Human
cuguguguuuaugugugu

SEQ ID NO: 3197139 - RNA, 20 nt, Human
cuguguguuuaugugugugu

SEQ ID NO: 3197140 - RNA, 15 nt, Human
cuguguguguguaug

SEQ ID NO: 3197141 - RNA, 16 nt, Human
cuguguguguguaugu

SEQ ID NO: 3197142 - RNA, 14 nt, Human
cuguguguguguau

SEQ ID NO: 3197143 - RNA, 15 nt, Human
cuguguuaauuuaag

SEQ ID NO: 3197144 - RNA, 16 nt, Human
cuguguuaauuuaagu

SEQ ID NO: 3197145 - RNA, 21 nt, Human
cuguguuaauuuaaguuuuga

SEQ ID NO: 3197146 - RNA, 21 nt, Human
cuguguuauuauagagcagaa

SEQ ID NO: 3197147 - RNA, 22 nt, Human
cuguguuauuauagagcagaaa

SEQ ID NO: 3197148 - RNA, 23 nt, Human
cuguguuauuauagagcagaaau

SEQ ID NO: 3197149 - RNA, 19 nt, Human
cuguuaaaagaugaaaaua

SEQ ID NO: 3197150 - RNA, 16 nt, Human
cuguuaaaagaugaaa

SEQ ID NO: 3197151 - RNA, 15 nt, Human
cuguuaaaagaugaa

SEQ ID NO: 3197152 - RNA, 14 nt, Human
cugugugauuaaaa

SEQ ID NO: 3197153 - RNA, 16 nt, Human
cugugugugaguguga

SEQ ID NO: 3197154 - RNA, 18 nt, Human
cugugugugagugugaau

SEQ ID NO: 3197155 - RNA, 17 nt, Human
cugugguuggcugggaa

SEQ ID NO: 3197156 - RNA, 18 nt, Human
cugugguuggcugggaaa

SEQ ID NO: 3197157 - RNA, 19 nt, Human
cugugguuggcugggaaau

SEQ ID NO: 3197158 - RNA, 20 nt, Human
cugugguuugggggagaaga

SEQ ID NO: 3197159 - RNA, 20 nt, Human
cugugucuuuuuucacuaca

SEQ ID NO: 3197160 - RNA, 23 nt, Human
cugugucuugcaauggcagccuu

SEQ ID NO: 3197161 - RNA, 23 nt, Human
cugugcccacccuccacucuccu

SEQ ID NO: 3197162 - RNA, 17 nt, Human
cugugcccacccuccac

SEQ ID NO: 3197163 - RNA, 19 nt, Human
cugugcccagaauacugau

SEQ ID NO: 3197164 - RNA, 22 nt, Human
cugugccauuuuguauuuuacu

SEQ ID NO: 3197165 - RNA, 15 nt, Human
cugugccaugugcca

SEQ ID NO: 3197166 - RNA, 22 nt, Human
cugugccccuggccuugggauc

SEQ ID NO: 3197167 - RNA, 18 nt, Human
cugugccccuggccuugg

SEQ ID NO: 3197168 - RNA, 15 nt, Human
cugugccccuggccu

SEQ ID NO: 3197169 - RNA, 14 nt, Human
cugugccaugugcc

SEQ ID NO: 3197170 - RNA, 14 nt, Human
cugugccaggugaa

SEQ ID NO: 3197171 - RNA, 16 nt, Human
cugugccagcccagag

SEQ ID NO: 3197172 - RNA, 14 nt, Human
cugugccagcccag

SEQ ID NO: 3197173 - RNA, 23 nt, Human
cugugcagaagggagcuggcucc

SEQ ID NO: 3197174 - RNA, 19 nt, Human
cugugaaaaaaaaaaugcu

SEQ ID NO: 3197175 - RNA, 21 nt, Human
cugucuuuucuuugccaucuc

SEQ ID NO: 3197176 - RNA, 17 nt, Human
cugucuuuucuuugcca

SEQ ID NO: 3197177 - RNA, 14 nt, Human
cugugaaauaucau

SEQ ID NO: 3197178 - RNA, 15 nt, Human
cugugaaauaucauc

SEQ ID NO: 3197179 - RNA, 23 nt, Human
cugugaaauaucaucacguaugu

SEQ ID NO: 3197180 - RNA, 16 nt, Human
cugugaaaggaaagag

SEQ ID NO: 3197181 - RNA, 22 nt, Human
cugugaaaggaaagagggaggu

SEQ ID NO: 3197182 - RNA, 13 nt, Human
cugugagcugcac

SEQ ID NO: 3197183 - RNA, 15 nt, Human
cugugauggggcccu

SEQ ID NO: 3197184 - RNA, 16 nt, Human
cugugauggggcccug

SEQ ID NO: 3197185 - RNA, 21 nt, Human
cugugauggggcccugccucc

SEQ ID NO: 3197186 - RNA, 23 nt, Human
cugugauggggcccugccuccuu

SEQ ID NO: 3197187 - RNA, 20 nt, Human
cugugauggggcccugccuc

SEQ ID NO: 3197188 - RNA, 15 nt, Human
cugugaaaggaaaga

SEQ ID NO: 3197189 - RNA, 23 nt, Human
cugucuuucuugcucccugacug

SEQ ID NO: 3197190 - RNA, 22 nt, Human
cugucuuucuugcucccugacu

SEQ ID NO: 3197191 - RNA, 14 nt, Human
cugucuuucuugcu

SEQ ID NO: 3197192 - RNA, 20 nt, Human
cugucuuucuugcucccuga

SEQ ID NO: 3197193 - RNA, 18 nt, Human
cugucuuucuugcucccu

SEQ ID NO: 3197194 - RNA, 17 nt, Human
cugucuuucuugcuccc

SEQ ID NO: 3197195 - RNA, 15 nt, Human
cugucuuucuugcuc

SEQ ID NO: 3197196 - RNA, 18 nt, Human
cugucuucugcuuuguug

SEQ ID NO: 3197197 - RNA, 16 nt, Human
cugucuucugcuuugu

SEQ ID NO: 3197198 - RNA, 23 nt, Human
cugucuucugcuuuguugugugc

SEQ ID NO: 3197199 - RNA, 18 nt, Human
cugucuucacaacagauu

SEQ ID NO: 3197200 - RNA, 19 nt, Human
cugucuguuguauucauug

SEQ ID NO: 3197201 - RNA, 18 nt, Human
cugucuguuguauucauu

SEQ ID NO: 3197202 - RNA, 18 nt, Human
cugucuucaguaagccgu

SEQ ID NO: 3197203 - RNA, 14 nt, Human
cugucuuaauuuuc

SEQ ID NO: 3197204 - RNA, 20 nt, Human
cugucuucauccccucagaa

SEQ ID NO: 3197205 - RNA, 11 nt, Human
cugucuuccuu

SEQ ID NO: 3197206 - RNA, 12 nt, Human
cugucuuccuuu

SEQ ID NO: 3197207 - RNA, 13 nt, Human
cugucuuccuuug

SEQ ID NO: 3197208 - RNA, 16 nt, Human
cugucuuccuuugcuu

SEQ ID NO: 3197209 - RNA, 19 nt, Human
cugucuuccuuugcuuccc

SEQ ID NO: 3197210 - RNA, 15 nt, Human
cugucuucugcuuug

SEQ ID NO: 3197211 - RNA, 14 nt, Human
cugucuucugcuuu

SEQ ID NO: 3197212 - RNA, 13 nt, Human
cugucuucugcuu

SEQ ID NO: 3197213 - RNA, 18 nt, Human
cugucugagguugggaga

SEQ ID NO: 3197214 - RNA, 18 nt, Human
cugucaauuacaggaagu

SEQ ID NO: 3197215 - RNA, 20 nt, Human
cugucauuugagcagggcuc

SEQ ID NO: 3197216 - RNA, 22 nt, Human
cugucauuugagcagggcucag

SEQ ID NO: 3197217 - RNA, 21 nt, Human
cugucauuugagcagggcuca

SEQ ID NO: 3197218 - RNA, 17 nt, Human
cugucugugaagagcaa

SEQ ID NO: 3197219 - RNA, 16 nt, Human
cugucugucuggucca

SEQ ID NO: 3197220 - RNA, 19 nt, Human
cugucugucccaguuaacu

SEQ ID NO: 3197221 - RNA, 14 nt, Human
cugucugcuccagc

SEQ ID NO: 3197222 - RNA, 12 nt, Human
cugucugcucca

SEQ ID NO: 3197223 - RNA, 19 nt, Human
cugucugcuccagcucugg

SEQ ID NO: 3197224 - RNA, 17 nt, Human
cugucugcuccagcucu

SEQ ID NO: 3197225 - RNA, 19 nt, Human
cugucugcuggucacuucu

SEQ ID NO: 3197226 - RNA, 15 nt, Human
cugucuggcacagcc

SEQ ID NO: 3197227 - RNA, 13 nt, Human
cugucuggcacag

SEQ ID NO: 3197228 - RNA, 18 nt, Human
cugucuggcacagccugc

SEQ ID NO: 3197229 - RNA, 23 nt, Human
cuggugguucacucuuggagccu

SEQ ID NO: 3197230 - RNA, 21 nt, Human
cuggugguucacucuuggagc

SEQ ID NO: 3197231 - RNA, 20 nt, Human
cuggugguucacucuuggag

SEQ ID NO: 3197232 - RNA, 12 nt, Human
cuggugguucac

SEQ ID NO: 3197233 - RNA, 14 nt, Human
cugguggcagcugc

SEQ ID NO: 3197234 - RNA, 18 nt, Human
cugguggcagugggagcu

SEQ ID NO: 3197235 - RNA, 14 nt, Human
cugguggcaguggg

SEQ ID NO: 3197236 - RNA, 20 nt, Human
cugguggcagcucaccucuc

SEQ ID NO: 3197237 - RNA, 15 nt, Human
cugguggcagcugcg

SEQ ID NO: 3197238 - RNA, 17 nt, Human
cugguggcagcucaccu

SEQ ID NO: 3197239 - RNA, 18 nt, Human
cugguggcagcucaccuc

SEQ ID NO: 3197240 - RNA, 16 nt, Human
cugguggcagcucacc

SEQ ID NO: 3197241 - RNA, 11 nt, Human
cugguauuaaa

SEQ ID NO: 3197242 - RNA, 12 nt, Human
cugguauuaaau

SEQ ID NO: 3197243 - RNA, 13 nt, Human
cugguauuaaaug

SEQ ID NO: 3197244 - RNA, 15 nt, Human
cugguauuaaaugcc

SEQ ID NO: 3197245 - RNA, 16 nt, Human
cugguauuaaaugcca

SEQ ID NO: 3197246 - RNA, 19 nt, Human
cugguauuaaaugccaagg

SEQ ID NO: 3197247 - RNA, 21 nt, Human
cugguuagagguucccuuuga

SEQ ID NO: 3197248 - RNA, 23 nt, Human
cugguuaauauuuauaggucacu

SEQ ID NO: 3197249 - RNA, 22 nt, Human
cugguuagagguucccuuugac

SEQ ID NO: 3197250 - RNA, 15 nt, Human
cuguaauuauuugaa

SEQ ID NO: 3197251 - RNA, 14 nt, Human
cuguacagagccca

SEQ ID NO: 3197252 - RNA, 15 nt, Human
cuguacagagcccac

SEQ ID NO: 3197253 - RNA, 18 nt, Human
cuguacagagcccacgcc

SEQ ID NO: 3197254 - RNA, 22 nt, Human
cuguacagagcccacgccccca

SEQ ID NO: 3197255 - RNA, 17 nt, Human
cuguaauuauuugaaug

SEQ ID NO: 3197256 - RNA, 16 nt, Human
cuguaauuauuugaau

SEQ ID NO: 3197257 - RNA, 18 nt, Human
cuguacgucugacaggca

SEQ ID NO: 3197258 - RNA, 16 nt, Human
cuguacgucugacagg

SEQ ID NO: 3197259 - RNA, 15 nt, Human
cuguacgucugacag

SEQ ID NO: 3197260 - RNA, 14 nt, Human
cuguacgucugaca

SEQ ID NO: 3197261 - RNA, 20 nt, Human
cuguacgucugacaggcaau

SEQ ID NO: 3197262 - RNA, 19 nt, Human
cuguacgucugacaggcaa

SEQ ID NO: 3197263 - RNA, 14 nt, Human
cuguacuccuccca

SEQ ID NO: 3197264 - RNA, 21 nt, Human
cuguacuccucccaggcgccc

SEQ ID NO: 3197265 - RNA, 19 nt, Human
cuguacuccucccaggcgc

SEQ ID NO: 3197266 - RNA, 16 nt, Human
cuguacuccucccagg

SEQ ID NO: 3197267 - RNA, 15 nt, Human
cuguacuccucccag

SEQ ID NO: 3197268 - RNA, 19 nt, Human
cuguaucccaugagccuca

SEQ ID NO: 3197269 - RNA, 20 nt, Human
cuguaucccaugagccucag

SEQ ID NO: 3197270 - RNA, 21 nt, Human
cuguauaaaggugugcugugu

SEQ ID NO: 3197271 - RNA, 20 nt, Human
cuguauaaaggugugcugug

SEQ ID NO: 3197272 - RNA, 19 nt, Human
cuguauaaaggugugcugu

SEQ ID NO: 3197273 - RNA, 21 nt, Human
cuguaucccaugagccucagc

SEQ ID NO: 3197274 - RNA, 19 nt, Human
cuguauuagucacagagau

SEQ ID NO: 3197275 - RNA, 17 nt, Human
cuguauuagucacagag

SEQ ID NO: 3197276 - RNA, 12 nt, Human
cuguauucagca

SEQ ID NO: 3197277 - RNA, 18 nt, Human
cuguauucccauaucaaa

SEQ ID NO: 3197278 - RNA, 15 nt, Human
cugucaauuacagga

SEQ ID NO: 3197279 - RNA, 16 nt, Human
cugucaauuacaggaa

SEQ ID NO: 3197280 - RNA, 13 nt, Human
cugucaauuacag

SEQ ID NO: 3197281 - RNA, 20 nt, Human
cuguauuuuguuuuugucuu

SEQ ID NO: 3197282 - RNA, 14 nt, Human
cuguauuguaacua

SEQ ID NO: 3197283 - RNA, 21 nt, Human
cugggauuacaagcgugagcc

SEQ ID NO: 3197284 - RNA, 18 nt, Human
cugggauuacaggcguga

SEQ ID NO: 3197285 - RNA, 23 nt, Human
cugcuccaaccgggaugggagcc

SEQ ID NO: 3197286 - RNA, 17 nt, Human
cugggcccgauuuggua

SEQ ID NO: 3197287 - RNA, 12 nt, Human
cugggccuggcu

SEQ ID NO: 3197288 - RNA, 23 nt, Human
cugggccuggcucccucacucuc

SEQ ID NO: 3197289 - RNA, 22 nt, Human
cugggccuggcucccucacucu

SEQ ID NO: 3197290 - RNA, 20 nt, Human
cugggccuggcucccucacu

SEQ ID NO: 3197291 - RNA, 14 nt, Human
cugggccuggcucc

SEQ ID NO: 3197292 - RNA, 19 nt, Human
cugggcucucgcggccucu

SEQ ID NO: 3197293 - RNA, 20 nt, Human
cugggcucucgcggccucuu

SEQ ID NO: 3197294 - RNA, 20 nt, Human
cugggcugacugggccaggg

SEQ ID NO: 3197295 - RNA, 18 nt, Human
cugggggccucagugcca

SEQ ID NO: 3197296 - RNA, 20 nt, Human
cuggggaaacaacauuuaua

SEQ ID NO: 3197297 - RNA, 21 nt, Human
cugggcuuuuguuuugcuuuu

SEQ ID NO: 3197298 - RNA, 20 nt, Human
cugggcuuuuguuuugcuuu

SEQ ID NO: 3197299 - RNA, 14 nt, Human
cugggggcugggca

SEQ ID NO: 3197300 - RNA, 18 nt, Human
cugggcuugucuguagau

SEQ ID NO: 3197301 - RNA, 22 nt, Human
cugggcuuggggaccagagcug

SEQ ID NO: 3197302 - RNA, 15 nt, Human
cugggcuucaguggc

SEQ ID NO: 3197303 - RNA, 12 nt, Human
cugggcugggca

SEQ ID NO: 3197304 - RNA, 22 nt, Human
cugggcugggcacugcucucac

SEQ ID NO: 3197305 - RNA, 13 nt, Human
cugggcugggcac

SEQ ID NO: 3197306 - RNA, 14 nt, Human
cugguaagaaaaag

SEQ ID NO: 3197307 - RNA, 16 nt, Human
cugguaaaaugaagaa

SEQ ID NO: 3197308 - RNA, 17 nt, Human
cugguaaaaugaagaau

SEQ ID NO: 3197309 - RNA, 19 nt, Human
cugguaaaaugaagaauuu

SEQ ID NO: 3197310 - RNA, 22 nt, Human
cugguaaaaugaagaauuuaaa

SEQ ID NO: 3197311 - RNA, 13 nt, Human
cugguaaaaugaa

SEQ ID NO: 3197312 - RNA, 15 nt, Human
cugguaaaaugaaga

SEQ ID NO: 3197313 - RNA, 23 nt, Human
cugguaagaaaaagcaaaaggca

SEQ ID NO: 3197314 - RNA, 15 nt, Human
cugguaagauuguua

SEQ ID NO: 3197315 - RNA, 17 nt, Human
cugguaagauuguuauu

SEQ ID NO: 3197316 - RNA, 20 nt, Human
cugguaagauuguuauuaaa

SEQ ID NO: 3197317 - RNA, 22 nt, Human
cugguaagauuguuauuaaaug

SEQ ID NO: 3197318 - RNA, 23 nt, Human
cugguaagauuguuauuaaaugu

SEQ ID NO: 3197319 - RNA, 18 nt, Human
cugguaagaaaaagcaaa

SEQ ID NO: 3197320 - RNA, 17 nt, Human
cugguaagaaaaagcaa

SEQ ID NO: 3197321 - RNA, 16 nt, Human
cuggguccccagcccu

SEQ ID NO: 3197322 - RNA, 23 nt, Human
cuggggguucuuucuuccucugc

SEQ ID NO: 3197323 - RNA, 20 nt, Human
cuggggguucuuucuuccuc

SEQ ID NO: 3197324 - RNA, 22 nt, Human
cuuaagcugcaggauucucacc

SEQ ID NO: 3197325 - RNA, 15 nt, Human
cuuaagcugcaggau

SEQ ID NO: 3197326 - RNA, 14 nt, Human
cuuaagcugcagga

SEQ ID NO: 3197327 - RNA, 13 nt, Human
cuuaagcugcagg

SEQ ID NO: 3197328 - RNA, 12 nt, Human
cuuaagcugcag

SEQ ID NO: 3197329 - RNA, 21 nt, Human
cuuaauacuguuauucuuugc

SEQ ID NO: 3197330 - RNA, 19 nt, Human
cuuaauacuguuauucuuu

SEQ ID NO: 3197331 - RNA, 17 nt, Human
cuuaauacuguuauucu

SEQ ID NO: 3197332 - RNA, 21 nt, Human
cuuaauaaucaagagccuuaa

SEQ ID NO: 3197333 - RNA, 13 nt, Human
cuuaauaaucaag

SEQ ID NO: 3197334 - RNA, 14 nt, Human
cuuaauaaucaaga

SEQ ID NO: 3197335 - RNA, 15 nt, Human
cuuaauaaucaagag

SEQ ID NO: 3197336 - RNA, 20 nt, Human
cuuaauaaucaagagccuua

SEQ ID NO: 3197337 - RNA, 18 nt, Human
cuuaagaauuuugagcag

SEQ ID NO: 3197338 - RNA, 15 nt, Human
cuuaagacagcaugu

SEQ ID NO: 3197339 - RNA, 18 nt, Human
cuuaagacagcauguguu

SEQ ID NO: 3197340 - RNA, 19 nt, Human
cuuaagacagcauguguua

SEQ ID NO: 3197341 - RNA, 22 nt, Human
cuuaagaaugaguuucuuagac

SEQ ID NO: 3197342 - RNA, 19 nt, Human
cuuaagaaugaguuucuua

SEQ ID NO: 3197343 - RNA, 14 nt, Human
cuuaaaaaguaacu

SEQ ID NO: 3197344 - RNA, 11 nt, Human
cuuaaaaagua

SEQ ID NO: 3197345 - RNA, 20 nt, Human
cuuaacacuaccaauuuccc

SEQ ID NO: 3197346 - RNA, 15 nt, Human
cuuaacauagccaaa

SEQ ID NO: 3197347 - RNA, 19 nt, Human
cuuaacauagccaaaaugu

SEQ ID NO: 3197348 - RNA, 11 nt, Human
cuuaacaugcu

SEQ ID NO: 3197349 - RNA, 13 nt, Human
cuuaacaugcugu

SEQ ID NO: 3197350 - RNA, 15 nt, Human
cuuaacaugcugugu

SEQ ID NO: 3197351 - RNA, 17 nt, Human
cuuaacaugcuguguaa

SEQ ID NO: 3197352 - RNA, 21 nt, Human
cuuaacaugcuguguaagcug

SEQ ID NO: 3197353 - RNA, 22 nt, Human
cuuaacaugcuguguaagcugu

SEQ ID NO: 3197354 - RNA, 20 nt, Human
cuuaacauagccaaaaugug

SEQ ID NO: 3197355 - RNA, 20 nt, Human
cuuaauuaaaagaauauuuu

SEQ ID NO: 3197356 - RNA, 19 nt, Human
cuuaauuaaaagaauauuu

SEQ ID NO: 3197357 - RNA, 14 nt, Human
cuuaauuauuauaa

SEQ ID NO: 3197358 - RNA, 17 nt, Human
cuuaauuauuauaaaaa

SEQ ID NO: 3197359 - RNA, 19 nt, Human
cuuaauuauuauaaaaaua

SEQ ID NO: 3197360 - RNA, 20 nt, Human
cuuaauuauuauaaaaauau

SEQ ID NO: 3197361 - RNA, 21 nt, Human
cuuaauuauuauaaaaauauu

SEQ ID NO: 3197362 - RNA, 13 nt, Human
cuuaauucaaaua

SEQ ID NO: 3197363 - RNA, 12 nt, Human
cuuaauuuggaa

SEQ ID NO: 3197364 - RNA, 13 nt, Human
cuuaauuuggaaa

SEQ ID NO: 3197365 - RNA, 15 nt, Human
cuuaauuuggaaacu

SEQ ID NO: 3197366 - RNA, 16 nt, Human
cuuaauuuggaaacua

SEQ ID NO: 3197367 - RNA, 18 nt, Human
cuuaauuuggaaacuaau

SEQ ID NO: 3197368 - RNA, 19 nt, Human
cuuaauuuggaaacuaaua

SEQ ID NO: 3197369 - RNA, 20 nt, Human
cuuaauuuggaaacuaauaa

SEQ ID NO: 3197370 - RNA, 21 nt, Human
cuuaauuuggaaacuaauaaa

SEQ ID NO: 3197371 - RNA, 22 nt, Human
cuuaauuuggaaacuaauaaaa

SEQ ID NO: 3197372 - RNA, 23 nt, Human
cuuaauuuggaaacuaauaaaau

SEQ ID NO: 3197373 - RNA, 12 nt, Human
cuuaauucuguu

SEQ ID NO: 3197374 - RNA, 13 nt, Human
cuuaauucuguuc

SEQ ID NO: 3197375 - RNA, 22 nt, Human
cuuaauucuguucugauauuaa

SEQ ID NO: 3197376 - RNA, 23 nt, Human
cuuaauucuguucugauauuaau

SEQ ID NO: 3197377 - RNA, 17 nt, Human
cuuaauuaaaagaauau

SEQ ID NO: 3197378 - RNA, 16 nt, Human
cuuaauuaaaagaaua

SEQ ID NO: 3197379 - RNA, 19 nt, Human
cuuaauauauagcauuuau

SEQ ID NO: 3197380 - RNA, 20 nt, Human
cuuaauauauagcauuuaug

SEQ ID NO: 3197381 - RNA, 18 nt, Human
cuuagacucuaguauuua

SEQ ID NO: 3197382 - RNA, 21 nt, Human
cuuagacucuaguauuuaugg

SEQ ID NO: 3197383 - RNA, 22 nt, Human
cuuagacuuuuccaauauguga

SEQ ID NO: 3197384 - RNA, 21 nt, Human
cuuagacuuuuccaauaugug

SEQ ID NO: 3197385 - RNA, 23 nt, Human
cuuagguuggcaaaaaggcagga

SEQ ID NO: 3197386 - RNA, 21 nt, Human
cuuagguuggcaaaaaggcag

SEQ ID NO: 3197387 - RNA, 21 nt, Human
cuuagaggcaugggcuugcug

SEQ ID NO: 3197388 - RNA, 14 nt, Human
cuuagagcuuuuuu

SEQ ID NO: 3197389 - RNA, 23 nt, Human
cuuaguaagcggcucaagcccag

SEQ ID NO: 3197390 - RNA, 19 nt, Human
cuuagaaucccuguguuaa

SEQ ID NO: 3197391 - RNA, 20 nt, Human
cuuagaaucccuguguuaau

SEQ ID NO: 3197392 - RNA, 18 nt, Human
cuuagaauuauuugcacu

SEQ ID NO: 3197393 - RNA, 16 nt, Human
cuuagaauuauuugca

SEQ ID NO: 3197394 - RNA, 18 nt, Human
cuuagaaguuuguuguga

SEQ ID NO: 3197395 - RNA, 15 nt, Human
cuuagaaucccugug

SEQ ID NO: 3197396 - RNA, 18 nt, Human
cuuagaaucccuguguua

SEQ ID NO: 3197397 - RNA, 20 nt, Human
cuuagaagucacacaguauu

SEQ ID NO: 3197398 - RNA, 17 nt, Human
cuuagaagucacacagu

SEQ ID NO: 3197399 - RNA, 20 nt, Human
cuuagaaaaaccaccaccau

SEQ ID NO: 3197400 - RNA, 23 nt, Human
cuuagaaaaggugauaaaaucau

SEQ ID NO: 3197401 - RNA, 22 nt, Human
cuuagaaaaggugauaaaauca

SEQ ID NO: 3197402 - RNA, 21 nt, Human
cuuagaaaaggugauaaaauc

SEQ ID NO: 3197403 - RNA, 13 nt, Human
cuuaccugccagg

SEQ ID NO: 3197404 - RNA, 20 nt, Human
cuuaccugccaggaagccag

SEQ ID NO: 3197405 - RNA, 18 nt, Human
cuuaccuugguuggaagg

SEQ ID NO: 3197406 - RNA, 19 nt, Human
cuuaccuugaacugaaggc

SEQ ID NO: 3197407 - RNA, 15 nt, Human
cuuacugauuaacuc

SEQ ID NO: 3197408 - RNA, 22 nt, Human
cuguuuuacaaaaaagaaaaga

SEQ ID NO: 3197409 - RNA, 21 nt, Human
cuguuugguuuuaaaauacug

SEQ ID NO: 3197410 - RNA, 17 nt, Human
cuguuugguuuuaaaau

SEQ ID NO: 3197411 - RNA, 22 nt, Human
cuguuugggaagagcuuagaaa

SEQ ID NO: 3197412 - RNA, 20 nt, Human
cuguuugggaagagcuuaga

SEQ ID NO: 3197413 - RNA, 21 nt, Human
cuguuugggaagagcuuagaa

SEQ ID NO: 3197414 - RNA, 21 nt, Human
cuguuuuauuuuaauucaguu

SEQ ID NO: 3197415 - RNA, 16 nt, Human
cuuaaaaaguggaaaa

SEQ ID NO: 3197416 - RNA, 17 nt, Human
cuuaaaaaguggaaaaa

SEQ ID NO: 3197417 - RNA, 16 nt, Human
cuguuuuuaaaaauua

SEQ ID NO: 3197418 - RNA, 14 nt, Human
cuguuuuuaaaaau

SEQ ID NO: 3197419 - RNA, 17 nt, Human
cuguuugcuaagugagg

SEQ ID NO: 3197420 - RNA, 19 nt, Human
cuguuugcuaagugaggau

SEQ ID NO: 3197421 - RNA, 11 nt, Human
cuguuuggaaa

SEQ ID NO: 3197422 - RNA, 17 nt, Human
cuguuuggaaaagacag

SEQ ID NO: 3197423 - RNA, 22 nt, Human
cuguuugcuguugcugauuuua

SEQ ID NO: 3197424 - RNA, 18 nt, Human
cuguuugauauaccaaau

SEQ ID NO: 3197425 - RNA, 21 nt, Human
cuguuugauauaccaaauuaa

SEQ ID NO: 3197426 - RNA, 23 nt, Human
cuguuugauauaccaaauuaaaa

SEQ ID NO: 3197427 - RNA, 15 nt, Human
cuguuugcuguugcu

SEQ ID NO: 3197428 - RNA, 16 nt, Human
cuguuucagaggcuca

SEQ ID NO: 3197429 - RNA, 21 nt, Human
cuguuucaaguucacaccugc

SEQ ID NO: 3197430 - RNA, 21 nt, Human
cuguuuagauuugccauagag

SEQ ID NO: 3197431 - RNA, 22 nt, Human
cuguuuagauuugccauagagu

SEQ ID NO: 3197432 - RNA, 19 nt, Human
cuguuuagauuugccauag

SEQ ID NO: 3197433 - RNA, 17 nt, Human
cuguugcccaggcuggc

SEQ ID NO: 3197434 - RNA, 13 nt, Human
cuguucuuccugg

SEQ ID NO: 3197435 - RNA, 12 nt, Human
cuguucuuccug

SEQ ID NO: 3197436 - RNA, 14 nt, Human
cuguugaccaggca

SEQ ID NO: 3197437 - RNA, 11 nt, Human
cuguugacucu

SEQ ID NO: 3197438 - RNA, 17 nt, Human
cuguugaccaggcaccu

SEQ ID NO: 3197439 - RNA, 15 nt, Human
cuguugaccaggcac

SEQ ID NO: 3197440 - RNA, 22 nt, Human
cuguugacucuaguacugugaa

SEQ ID NO: 3197441 - RNA, 19 nt, Human
cuguugacucuaguacugu

SEQ ID NO: 3197442 - RNA, 23 nt, Human
cuguugaugggaugauugaagaa

SEQ ID NO: 3197443 - RNA, 13 nt, Human
cuguugauuaauu

SEQ ID NO: 3197444 - RNA, 19 nt, Human
cuguugauuaauuucugcc

SEQ ID NO: 3197445 - RNA, 21 nt, Human
cuguugauuaauuucugccau

SEQ ID NO: 3197446 - RNA, 16 nt, Human
cuguugcccaggcugg

SEQ ID NO: 3197447 - RNA, 15 nt, Human
cuguugcccaggcug

SEQ ID NO: 3197448 - RNA, 14 nt, Human
cuguugcccaggcu

SEQ ID NO: 3197449 - RNA, 13 nt, Human
cuguugcccaggc

SEQ ID NO: 3197450 - RNA, 12 nt, Human
cuguugcccagg

SEQ ID NO: 3197451 - RNA, 16 nt, Human
cuguuaauaguucagg

SEQ ID NO: 3197452 - RNA, 15 nt, Human
cuguuacaaaaugua

SEQ ID NO: 3197453 - RNA, 13 nt, Human
cuguuacaaaaug

SEQ ID NO: 3197454 - RNA, 11 nt, Human
cuguuacaaaa

SEQ ID NO: 3197455 - RNA, 21 nt, Human
cuguuaaggcauccacuucac

SEQ ID NO: 3197456 - RNA, 15 nt, Human
cuguuaacuuauuca

SEQ ID NO: 3197457 - RNA, 19 nt, Human
cuguuaacuuauucaaaga

SEQ ID NO: 3197458 - RNA, 19 nt, Human
cuucauuuuuuuuaauuga

SEQ ID NO: 3197459 - RNA, 11 nt, Human
cuucauuugua

SEQ ID NO: 3197460 - RNA, 14 nt, Human
cuuccacaagagcc

SEQ ID NO: 3197461 - RNA, 15 nt, Human
cuuccacaagagccc

SEQ ID NO: 3197462 - RNA, 13 nt, Human
cuuccacaagagc

SEQ ID NO: 3197463 - RNA, 12 nt, Human
cuuccaaagaaa

SEQ ID NO: 3197464 - RNA, 12 nt, Human
cuuccaaagcag

SEQ ID NO: 3197465 - RNA, 14 nt, Human
cuucagugccaaaa

SEQ ID NO: 3197466 - RNA, 13 nt, Human
cuucagucauuaa

SEQ ID NO: 3197467 - RNA, 15 nt, Human
cuucagucauuaaau

SEQ ID NO: 3197468 - RNA, 16 nt, Human
cuucagucauuaaauu

SEQ ID NO: 3197469 - RNA, 12 nt, Human
cuucauguaaau

SEQ ID NO: 3197470 - RNA, 13 nt, Human
cuucauguaaauu

SEQ ID NO: 3197471 - RNA, 22 nt, Human
cuucauguaaauugacuguacu

SEQ ID NO: 3197472 - RNA, 16 nt, Human
cuucauguaauuuuau

SEQ ID NO: 3197473 - RNA, 21 nt, Human
cuucauguaauuuuauuuuaa

SEQ ID NO: 3197474 - RNA, 20 nt, Human
cuucauguucccacuucaaa

SEQ ID NO: 3197475 - RNA, 15 nt, Human
cuucauguucccacu

SEQ ID NO: 3197476 - RNA, 22 nt, Human
cuucauguucaauuauuucccc

SEQ ID NO: 3197477 - RNA, 15 nt, Human
cuucagccugaaaga

SEQ ID NO: 3197478 - RNA, 17 nt, Human
cuucagccucccacagu

SEQ ID NO: 3197479 - RNA, 15 nt, Human
cuucagccucccaca

SEQ ID NO: 3197480 - RNA, 20 nt, Human
cuucagccucccgaguagcu

SEQ ID NO: 3197481 - RNA, 16 nt, Human
cuucagccucccgagu

SEQ ID NO: 3197482 - RNA, 14 nt, Human
cuucagccucccga

SEQ ID NO: 3197483 - RNA, 14 nt, Human
cuucagccucccac

SEQ ID NO: 3197484 - RNA, 13 nt, Human
cuucagccuccca

SEQ ID NO: 3197485 - RNA, 14 nt, Human
cuucaguaagccgu

SEQ ID NO: 3197486 - RNA, 21 nt, Human
cuucaggaaagcagcaguuuu

SEQ ID NO: 3197487 - RNA, 15 nt, Human
cuucagcugacuuuu

SEQ ID NO: 3197488 - RNA, 19 nt, Human
cuucagcugacuuuucugu

SEQ ID NO: 3197489 - RNA, 15 nt, Human
cuucaaauauuuccc

SEQ ID NO: 3197490 - RNA, 12 nt, Human
cuucaacaaggc

SEQ ID NO: 3197491 - RNA, 21 nt, Human
cuucaacaaggcuugcugcag

SEQ ID NO: 3197492 - RNA, 19 nt, Human
cuucaacaaggcuugcugc

SEQ ID NO: 3197493 - RNA, 21 nt, Human
cuuagucacugagacagcccg

SEQ ID NO: 3197494 - RNA, 20 nt, Human
cuuagucacugagacagccc

SEQ ID NO: 3197495 - RNA, 22 nt, Human
cuuagucacugagacagcccgg

SEQ ID NO: 3197496 - RNA, 17 nt, Human
cuuagucaaauguaaug

SEQ ID NO: 3197497 - RNA, 17 nt, Human
cuucaaggauccugagc

SEQ ID NO: 3197498 - RNA, 18 nt, Human
cuucaaggauccugagcc

SEQ ID NO: 3197499 - RNA, 19 nt, Human
cuucaaggauccugagcca

SEQ ID NO: 3197500 - RNA, 20 nt, Human
cuucaaggauccugagccag

SEQ ID NO: 3197501 - RNA, 16 nt, Human
cuucaaggauccugag

SEQ ID NO: 3197502 - RNA, 22 nt, Human
cuucaacaaggcuugcugcaga

SEQ ID NO: 3197503 - RNA, 16 nt, Human
cuucaacucccugccc

SEQ ID NO: 3197504 - RNA, 17 nt, Human
cuucaacugaccagccu

SEQ ID NO: 3197505 - RNA, 23 nt, Human
cuucaacugaccagccuccaugc

SEQ ID NO: 3197506 - RNA, 20 nt, Human
cuucaacugaccagccucca

SEQ ID NO: 3197507 - RNA, 14 nt, Human
cuucacaacagauu

SEQ ID NO: 3197508 - RNA, 12 nt, Human
cuucacaacaga

SEQ ID NO: 3197509 - RNA, 21 nt, Human
cuucaaggauccugagccaga

SEQ ID NO: 3197510 - RNA, 22 nt, Human
cuucaaggauccugagccagau

SEQ ID NO: 3197511 - RNA, 23 nt, Human
cuucaaggauccugagccagauu

SEQ ID NO: 3197512 - RNA, 24 nt, Human
cuucagagacuccugcaggcagcc

SEQ ID NO: 3197513 - RNA, 19 nt, Human
cuucggccuccauccugag

SEQ ID NO: 3197514 - RNA, 14 nt, Human
cuucggacaaaaua

SEQ ID NO: 3197515 - RNA, 15 nt, Human
cuucggacaaaauau

SEQ ID NO: 3197516 - RNA, 22 nt, Human
cuucggagaugaggaguaaaau

SEQ ID NO: 3197517 - RNA, 20 nt, Human
cuucggccuccauccugagg

SEQ ID NO: 3197518 - RNA, 19 nt, Human
cuucgggaggucgaggcag

SEQ ID NO: 3197519 - RNA, 17 nt, Human
cuucggaggaccagggc

SEQ ID NO: 3197520 - RNA, 16 nt, Human
cuucggaggaccaggg

SEQ ID NO: 3197521 - RNA, 19 nt, Human
cuucgguacccaccacaca

SEQ ID NO: 3197522 - RNA, 16 nt, Human
cuucgguacccaccac

SEQ ID NO: 3197523 - RNA, 19 nt, Human
cuucgugacaauguuuaca

SEQ ID NO: 3197524 - RNA, 21 nt, Human
cuucucacugccaugccagcu

SEQ ID NO: 3197525 - RNA, 16 nt, Human
cuucucacugccaugc

SEQ ID NO: 3197526 - RNA, 21 nt, Human
cuucguuaguaaucuguauaa

SEQ ID NO: 3197527 - RNA, 14 nt, Human
cuucucauuacuug

SEQ ID NO: 3197528 - RNA, 22 nt, Human
cuucucauuacuuguugccuau

SEQ ID NO: 3197529 - RNA, 17 nt, Human
cuucucaucuugacaga

SEQ ID NO: 3197530 - RNA, 23 nt, Human
cuucucaucuugacagagccugc

SEQ ID NO: 3197531 - RNA, 20 nt, Human
cuucucaucuugacagagcc

SEQ ID NO: 3197532 - RNA, 20 nt, Human
cuuccuuggacucauuuuaa

SEQ ID NO: 3197533 - RNA, 17 nt, Human
cuucgcuccugugucuu

SEQ ID NO: 3197534 - RNA, 15 nt, Human
cuucgccaccugggu

SEQ ID NO: 3197535 - RNA, 22 nt, Human
cuucgccaagguuguagcaugg

SEQ ID NO: 3197536 - RNA, 16 nt, Human
cuucgcuccugugucu

SEQ ID NO: 3197537 - RNA, 15 nt, Human
cuuccuuugcuuccc

SEQ ID NO: 3197538 - RNA, 13 nt, Human
cuuccuuucuuga

SEQ ID NO: 3197539 - RNA, 16 nt, Human
cuucgauacaccgggc

SEQ ID NO: 3197540 - RNA, 21 nt, Human
cuucgauacaccgggccugga

SEQ ID NO: 3197541 - RNA, 14 nt, Human
cuucgccaccuggg

SEQ ID NO: 3197542 - RNA, 23 nt, Human
cuucccugaacuuccugcuuccu

SEQ ID NO: 3197543 - RNA, 22 nt, Human
cuucccuggguuagacugccag

SEQ ID NO: 3197544 - RNA, 18 nt, Human
cuucccugguaagaaaaa

SEQ ID NO: 3197545 - RNA, 23 nt, Human
cuucccuggguuagacugccagc

SEQ ID NO: 3197546 - RNA, 24 nt, Human
cuuccuaguucaucccuucucuuc

SEQ ID NO: 3197547 - RNA, 17 nt, Human
cuuccuaguucaucccu

SEQ ID NO: 3197548 - RNA, 13 nt, Human
cuucccugguuca

SEQ ID NO: 3197549 - RNA, 12 nt, Human
cuucccugguuc

SEQ ID NO: 3197550 - RNA, 20 nt, Human
cuuccuauaauuuugauagu

SEQ ID NO: 3197551 - RNA, 18 nt, Human
cuuccuauaauuuugaua

SEQ ID NO: 3197552 - RNA, 21 nt, Human
cuuccuauaauuuugauagug

SEQ ID NO: 3197553 - RNA, 14 nt, Human
cuuccuauuucaga

SEQ ID NO: 3197554 - RNA, 16 nt, Human
cuuccuauuucagaag

SEQ ID NO: 3197555 - RNA, 13 nt, Human
cuuccugugacuu

SEQ ID NO: 3197556 - RNA, 16 nt, Human
cuuccugugacuucag

SEQ ID NO: 3197557 - RNA, 14 nt, Human
cuuccucagagggc

SEQ ID NO: 3197558 - RNA, 18 nt, Human
cuuccugcuuccucagag

SEQ ID NO: 3197559 - RNA, 19 nt, Human
cuuccugcuuccucagagg

SEQ ID NO: 3197560 - RNA, 17 nt, Human
cuucccuacaguugaaa

SEQ ID NO: 3197561 - RNA, 15 nt, Human
cuucccccuccaauc

SEQ ID NO: 3197562 - RNA, 12 nt, Human
cuucccccucca

SEQ ID NO: 3197563 - RNA, 16 nt, Human
cuucccauuccauggc

SEQ ID NO: 3197564 - RNA, 12 nt, Human
cuucccauucca

SEQ ID NO: 3197565 - RNA, 14 nt, Human
gaaugccuccugca

SEQ ID NO: 3197566 - RNA, 19 nt, Human
gaaugaaagggcccagaga

SEQ ID NO: 3197567 - RNA, 14 nt, Human
gaaugaaagggccc

SEQ ID NO: 3197568 - RNA, 16 nt, Human
gaaucucaaauaacua

SEQ ID NO: 3197569 - RNA, 21 nt, Human
gaaucucaacaugucuccuac

SEQ ID NO: 3197570 - RNA, 17 nt, Human
gaaucucaacaugucuc

SEQ ID NO: 3197571 - RNA, 16 nt, Human
gaaucuguaugauucu

SEQ ID NO: 3197572 - RNA, 18 nt, Human
gaaucuguaugauucuau

SEQ ID NO: 3197573 - RNA, 17 nt, Human
gaaucuguaugauucua

SEQ ID NO: 3197574 - RNA, 15 nt, Human
gaaucucaaaauuag

SEQ ID NO: 3197575 - RNA, 14 nt, Human
gaauagcugggacu

SEQ ID NO: 3197576 - RNA, 15 nt, Human
gaauagaugcugacu

SEQ ID NO: 3197577 - RNA, 18 nt, Human
gaauagcauguuguagau

SEQ ID NO: 3197578 - RNA, 18 nt, Human
gaauagaagcuaagguuu

SEQ ID NO: 3197579 - RNA, 15 nt, Human
gaauagcugggacua

SEQ ID NO: 3197580 - RNA, 14 nt, Human
gaauagcugaugug

SEQ ID NO: 3197581 - RNA, 12 nt, Human
gaaucacaggcu

SEQ ID NO: 3197582 - RNA, 11 nt, Human
gaaucacaggc

SEQ ID NO: 3197583 - RNA, 23 nt, Human
gaaucaccuaauuaauuucagua

SEQ ID NO: 3197584 - RNA, 20 nt, Human
gaaucaccuaauuaauuuca

SEQ ID NO: 3197585 - RNA, 19 nt, Human
gaaucaccuaauuaauuuc

SEQ ID NO: 3197586 - RNA, 18 nt, Human
gaaucaccuaauuaauuu

SEQ ID NO: 3197587 - RNA, 22 nt, Human
gaaucacaggcugggcugggca

SEQ ID NO: 3197588 - RNA, 18 nt, Human
gaaucacaggcugggcug

SEQ ID NO: 3197589 - RNA, 17 nt, Human
gaaucacaggcugggcu

SEQ ID NO: 3197590 - RNA, 15 nt, Human
gaaucacaggcuggg

SEQ ID NO: 3197591 - RNA, 14 nt, Human
gaaucacaggcugg

SEQ ID NO: 3197592 - RNA, 19 nt, Human
gaaucauuguccagagcug

SEQ ID NO: 3197593 - RNA, 22 nt, Human
gaaucagaagauagucuuggaa

SEQ ID NO: 3197594 - RNA, 12 nt, Human
gaauccaagauu

SEQ ID NO: 3197595 - RNA, 15 nt, Human
gaauccaagauuggu

SEQ ID NO: 3197596 - RNA, 17 nt, Human
gaauccaaaagaaaaac

SEQ ID NO: 3197597 - RNA, 16 nt, Human
gaauccaaaagaaaaa

SEQ ID NO: 3197598 - RNA, 23 nt, Human
gaaucauuuguucaaagcuguug

SEQ ID NO: 3197599 - RNA, 14 nt, Human
gaaucauuuguuca

SEQ ID NO: 3197600 - RNA, 21 nt, Human
gaaucauuguccagagcugcu

SEQ ID NO: 3197601 - RNA, 17 nt, Human
gaaucccuguguuaauu

SEQ ID NO: 3197602 - RNA, 20 nt, Human
gaauaagugccaggauggaa

SEQ ID NO: 3197603 - RNA, 14 nt, Human
gaauaauaaaauca

SEQ ID NO: 3197604 - RNA, 22 nt, Human
gaauaagccauucugacucaua

SEQ ID NO: 3197605 - RNA, 21 nt, Human
gaauaagccauucugacucau

SEQ ID NO: 3197606 - RNA, 20 nt, Human
gaauaagccauucugacuca

SEQ ID NO: 3197607 - RNA, 15 nt, Human
gaauaaauugcuccu

SEQ ID NO: 3197608 - RNA, 16 nt, Human
gaauaaugccuuugua

SEQ ID NO: 3197609 - RNA, 17 nt, Human
gaauaaugccuuuguaa

SEQ ID NO: 3197610 - RNA, 14 nt, Human
gaauaauuacagug

SEQ ID NO: 3197611 - RNA, 24 nt, Human
gaauacuuugcagcacagcugaga

SEQ ID NO: 3197612 - RNA, 17 nt, Human
gaauagaagcuaagguu

SEQ ID NO: 3197613 - RNA, 16 nt, Human
gaauacugauggaauu

SEQ ID NO: 3197614 - RNA, 15 nt, Human
gaauacugauggaau

SEQ ID NO: 3197615 - RNA, 13 nt, Human
gaauacugcuuga

SEQ ID NO: 3197616 - RNA, 14 nt, Human
gaauacugcuugaa

SEQ ID NO: 3197617 - RNA, 17 nt, Human
gaauacugcuugaauaa

SEQ ID NO: 3197618 - RNA, 15 nt, Human
gaauacuugaaccau

SEQ ID NO: 3197619 - RNA, 22 nt, Human
gaauacuugaaccauaaaaugu

SEQ ID NO: 3197620 - RNA, 12 nt, Human
gaauacuugaac

SEQ ID NO: 3197621 - RNA, 14 nt, Human
gaauacuugaacca

SEQ ID NO: 3197622 - RNA, 12 nt, Human
gaaguuucugcc

SEQ ID NO: 3197623 - RNA, 15 nt, Human
gaaguuucaaguuuu

SEQ ID NO: 3197624 - RNA, 21 nt, Human
gaaguuucaaguuuuaaaguu

SEQ ID NO: 3197625 - RNA, 22 nt, Human
gaaguuucaaguuuuaaaguuc

SEQ ID NO: 3197626 - RNA, 14 nt, Human
gaagguuuuugaua

SEQ ID NO: 3197627 - RNA, 19 nt, Human
gaagguuuuuguaaagauu

SEQ ID NO: 3197628 - RNA, 14 nt, Human
gaauaaagacaccu

SEQ ID NO: 3197629 - RNA, 19 nt, Human
gaauaaacuagauuacauu

SEQ ID NO: 3197630 - RNA, 16 nt, Human
gaauaaacuagauuac

SEQ ID NO: 3197631 - RNA, 14 nt, Human
gaauaaacaccacu

SEQ ID NO: 3197632 - RNA, 12 nt, Human
gaauaaacuaga

SEQ ID NO: 3197633 - RNA, 18 nt, Human
gaauaaaggcagcuguug

SEQ ID NO: 3197634 - RNA, 14 nt, Human
gaauaaaggcagcu

SEQ ID NO: 3197635 - RNA, 23 nt, Human
gaaggacccggaggggccuggca

SEQ ID NO: 3197636 - RNA, 18 nt, Human
gaaggaaacccagcucug

SEQ ID NO: 3197637 - RNA, 14 nt, Human
gaaggaaacccagc

SEQ ID NO: 3197638 - RNA, 17 nt, Human
gaaggaaacccagcucu

SEQ ID NO: 3197639 - RNA, 24 nt, Human
gaaggaccuucacucuaagauguu

SEQ ID NO: 3197640 - RNA, 16 nt, Human
gaaggaccuucacucu

SEQ ID NO: 3197641 - RNA, 14 nt, Human
gaaggccccgccca

SEQ ID NO: 3197642 - RNA, 15 nt, Human
gaaggccccgcccag

SEQ ID NO: 3197643 - RNA, 16 nt, Human
gaaggccccgcccagg

SEQ ID NO: 3197644 - RNA, 14 nt, Human
gaagggguuuucuu

SEQ ID NO: 3197645 - RNA, 13 nt, Human
gaagguaaaaagu

SEQ ID NO: 3197646 - RNA, 14 nt, Human
gaaggcagggaggg

SEQ ID NO: 3197647 - RNA, 14 nt, Human
gaaggcccagcacc

SEQ ID NO: 3197648 - RNA, 23 nt, Human
gaaggcccagcaccacccuccuu

SEQ ID NO: 3197649 - RNA, 22 nt, Human
gaaggcccagcaccacccuccu

SEQ ID NO: 3197650 - RNA, 13 nt, Human
gaaggcagggagg

SEQ ID NO: 3197651 - RNA, 13 nt, Human
gaaggcagagaaa

SEQ ID NO: 3197652 - RNA, 14 nt, Human
gaaggcagagaaau

SEQ ID NO: 3197653 - RNA, 18 nt, Human
gaaggcagagaaaucuaa

SEQ ID NO: 3197654 - RNA, 18 nt, Human
gaaggcagaaagcaaaau

SEQ ID NO: 3197655 - RNA, 15 nt, Human
gaaggcagaaagcaa

SEQ ID NO: 3197656 - RNA, 15 nt, Human
gaagccagcaggcuc

SEQ ID NO: 3197657 - RNA, 16 nt, Human
gaagccagcaggcucu

SEQ ID NO: 3197658 - RNA, 21 nt, Human
gaagacucauucuucuguacg

SEQ ID NO: 3197659 - RNA, 19 nt, Human
gaagacucauucuucugua

SEQ ID NO: 3197660 - RNA, 15 nt, Human
gaagacuccagaaau

SEQ ID NO: 3197661 - RNA, 14 nt, Human
gaagacuccagaaa

SEQ ID NO: 3197662 - RNA, 12 nt, Human
gaagcccagaau

SEQ ID NO: 3197663 - RNA, 10 nt, Human
gaagcccaga

SEQ ID NO: 3197664 - RNA, 14 nt, Human
gaagccagggcccg

SEQ ID NO: 3197665 - RNA, 23 nt, Human
gaagccagcaggcucucaggcca

SEQ ID NO: 3197666 - RNA, 23 nt, Human
gaagccagcugccuaggauucac

SEQ ID NO: 3197667 - RNA, 18 nt, Human
gaagccagcugccuagga

SEQ ID NO: 3197668 - RNA, 11 nt, Human
gaaggaaaaau

SEQ ID NO: 3197669 - RNA, 15 nt, Human
gaaggaaaaauucaa

SEQ ID NO: 3197670 - RNA, 13 nt, Human
gaaggaaaaauuc

SEQ ID NO: 3197671 - RNA, 22 nt, Human
gaagcuucuggugaccuuccaa

SEQ ID NO: 3197672 - RNA, 10 nt, Human
gaagccuuug

SEQ ID NO: 3197673 - RNA, 11 nt, Human
gaagccuuugu

SEQ ID NO: 3197674 - RNA, 20 nt, Human
gaagcccaggaaaggcucca

SEQ ID NO: 3197675 - RNA, 19 nt, Human
gaagcccaggaaaggcucc

SEQ ID NO: 3197676 - RNA, 21 nt, Human
gaagcccaggaaaggcuccag

SEQ ID NO: 3197677 - RNA, 22 nt, Human
gaagcccaggaaaggcuccagg

SEQ ID NO: 3197678 - RNA, 21 nt, Human
gaagccgcuggggccaguugg

SEQ ID NO: 3197679 - RNA, 13 nt, Human
gaacuauuagagc

SEQ ID NO: 3197680 - RNA, 16 nt, Human
gaacuaucuucaucug

SEQ ID NO: 3197681 - RNA, 14 nt, Human
gaacuaucuucauc

SEQ ID NO: 3197682 - RNA, 20 nt, Human
gaacuaggaaggcacuucug

SEQ ID NO: 3197683 - RNA, 13 nt, Human
gaacuaucuucau

SEQ ID NO: 3197684 - RNA, 12 nt, Human
gaacuaucuuca

SEQ ID NO: 3197685 - RNA, 13 nt, Human
gaacguucucuuu

SEQ ID NO: 3197686 - RNA, 23 nt, Human
gaacguagucggcacagccuggu

SEQ ID NO: 3197687 - RNA, 17 nt, Human
gaaccugugagcugcac

SEQ ID NO: 3197688 - RNA, 19 nt, Human
gaaccugugagcugcacca

SEQ ID NO: 3197689 - RNA, 23 nt, Human
gaaccugggaaagagauuuaaac

SEQ ID NO: 3197690 - RNA, 22 nt, Human
gaaccugggaaagagauuuaaa

SEQ ID NO: 3197691 - RNA, 17 nt, Human
gaaccugcacacgagca

SEQ ID NO: 3197692 - RNA, 22 nt, Human
gaacagaacucgguguccccac

SEQ ID NO: 3197693 - RNA, 21 nt, Human
gaaccacaucuugcucugcug

SEQ ID NO: 3197694 - RNA, 20 nt, Human
gaaccacaucuugcucugcu

SEQ ID NO: 3197695 - RNA, 16 nt, Human
gaacagacuggaagca

SEQ ID NO: 3197696 - RNA, 15 nt, Human
gaacagacuggaagc

SEQ ID NO: 3197697 - RNA, 17 nt, Human
gaaccaccacacccagc

SEQ ID NO: 3197698 - RNA, 16 nt, Human
gaaccaccacacccag

SEQ ID NO: 3197699 - RNA, 12 nt, Human
gaaccugacccc

SEQ ID NO: 3197700 - RNA, 11 nt, Human
gaaccugaccc

SEQ ID NO: 3197701 - RNA, 23 nt, Human
gaacuugguucccauuugcuccu

SEQ ID NO: 3197702 - RNA, 12 nt, Human
gaacuugguucc

SEQ ID NO: 3197703 - RNA, 15 nt, Human
gaacuuggcgcugcc

SEQ ID NO: 3197704 - RNA, 16 nt, Human
gaacuuggcgcugccc

SEQ ID NO: 3197705 - RNA, 13 nt, Human
gaacuuggcgcug

SEQ ID NO: 3197706 - RNA, 14 nt, Human
gaacuugcugccuc

SEQ ID NO: 3197707 - RNA, 13 nt, Human
gaacuugcugccu

SEQ ID NO: 3197708 - RNA, 12 nt, Human
gaacuugcugcc

SEQ ID NO: 3197709 - RNA, 20 nt, Human
gaagaaacagcuaugagagg

SEQ ID NO: 3197710 - RNA, 16 nt, Human
gaagaaacagcuauga

SEQ ID NO: 3197711 - RNA, 12 nt, Human
gaagaaaauacu

SEQ ID NO: 3197712 - RNA, 17 nt, Human
gaagaaaauacuuaaau

SEQ ID NO: 3197713 - RNA, 13 nt, Human
gaagaaaauacuu

SEQ ID NO: 3197714 - RNA, 20 nt, Human
gaagaaaauacuuaaauguu

SEQ ID NO: 3197715 - RNA, 19 nt, Human
gaagaaaauacuuaaaugu

SEQ ID NO: 3197716 - RNA, 21 nt, Human
gaagaaaauguucuuccaguu

SEQ ID NO: 3197717 - RNA, 19 nt, Human
gaagaaaacacuguuauca

SEQ ID NO: 3197718 - RNA, 18 nt, Human
gaagaaaacacuguuauc

SEQ ID NO: 3197719 - RNA, 17 nt, Human
gaagaaaacacuguuau

SEQ ID NO: 3197720 - RNA, 13 nt, Human
gaacuuggaagca

SEQ ID NO: 3197721 - RNA, 15 nt, Human
gaacuuggaagcaca

SEQ ID NO: 3197722 - RNA, 14 nt, Human
gaacucccuuucaa

SEQ ID NO: 3197723 - RNA, 16 nt, Human
gaacucaugugauuua

SEQ ID NO: 3197724 - RNA, 22 nt, Human
gaacuggguacuuguggacaca

SEQ ID NO: 3197725 - RNA, 20 nt, Human
gaacuuaacaugcuguguaa

SEQ ID NO: 3197726 - RNA, 22 nt, Human
gaacuuaacaugcuguguaagc

SEQ ID NO: 3197727 - RNA, 20 nt, Human
gaaauugguaccuugcacac

SEQ ID NO: 3197728 - RNA, 16 nt, Human
gaaauugguaccuugc

SEQ ID NO: 3197729 - RNA, 19 nt, Human
gaaauugcauuuccugaca

SEQ ID NO: 3197730 - RNA, 17 nt, Human
gaaauugagcugcuuuu

SEQ ID NO: 3197731 - RNA, 23 nt, Human
gaaauugagcugcuuuuuuugaa

SEQ ID NO: 3197732 - RNA, 18 nt, Human
gaaauucuguuuuuaaaa

SEQ ID NO: 3197733 - RNA, 18 nt, Human
gaaauucuuguuauggua

SEQ ID NO: 3197734 - RNA, 22 nt, Human
gaaauucuuguuaugguagaaa

SEQ ID NO: 3197735 - RNA, 16 nt, Human
gaaauucuguuuuuaa

SEQ ID NO: 3197736 - RNA, 15 nt, Human
gaaauucuguuuuua

SEQ ID NO: 3197737 - RNA, 14 nt, Human
gaaauucuguuuuu

SEQ ID NO: 3197738 - RNA, 13 nt, Human
gaaauucuguuuu

SEQ ID NO: 3197739 - RNA, 12 nt, Human
gaaauucuguuu

SEQ ID NO: 3197740 - RNA, 17 nt, Human
gaaauugaaaaguuauu

SEQ ID NO: 3197741 - RNA, 15 nt, Human
gaaauugaaaaguua

SEQ ID NO: 3197742 - RNA, 17 nt, Human
gaaauuuguuauaauga

SEQ ID NO: 3197743 - RNA, 14 nt, Human
gaaauuuuagaaau

SEQ ID NO: 3197744 - RNA, 21 nt, Human
gaaauugguaccuugcacaca

SEQ ID NO: 3197745 - RNA, 20 nt, Human
gaaaugggcagagcagagac

SEQ ID NO: 3197746 - RNA, 17 nt, Human
gaaaugguauccagaau

SEQ ID NO: 3197747 - RNA, 14 nt, Human
gaaaugggcagagc

SEQ ID NO: 3197748 - RNA, 23 nt, Human
gaaauuaacuuacccuguauauc

SEQ ID NO: 3197749 - RNA, 13 nt, Human
gaaauuaagaaga

SEQ ID NO: 3197750 - RNA, 16 nt, Human
gaaauuaagaagaaac

SEQ ID NO: 3197751 - RNA, 15 nt, Human
gaaauuaagaagaaa

SEQ ID NO: 3197752 - RNA, 20 nt, Human
gaaauucuauuuauaauaca

SEQ ID NO: 3197753 - RNA, 16 nt, Human
gaaauguuugcugaac

SEQ ID NO: 3197754 - RNA, 18 nt, Human
gaaacauuggaagcaggu

SEQ ID NO: 3197755 - RNA, 20 nt, Human
gaaacaugacucguauaugu

SEQ ID NO: 3197756 - RNA, 21 nt, Human
gaaacauguugccaaaauggu

SEQ ID NO: 3197757 - RNA, 14 nt, Human
gaaacauuggaagc

SEQ ID NO: 3197758 - RNA, 13 nt, Human
gaaacauuggaag

SEQ ID NO: 3197759 - RNA, 21 nt, Human
gaaacauugcuuuuaaaacua

SEQ ID NO: 3197760 - RNA, 18 nt, Human
gaaacauugcuuuuaaaa

SEQ ID NO: 3197761 - RNA, 17 nt, Human
gaaacauugcuuuuaaa

SEQ ID NO: 3197762 - RNA, 16 nt, Human
gaaacauugcuuuuaa

SEQ ID NO: 3197763 - RNA, 13 nt, Human
gaaacauugcuuu

SEQ ID NO: 3197764 - RNA, 23 nt, Human
gaaacauguugccaaaauggugg

SEQ ID NO: 3197765 - RNA, 15 nt, Human
gaaacaucauagaaa

SEQ ID NO: 3197766 - RNA, 17 nt, Human
gaaauaacacagcaguu

SEQ ID NO: 3197767 - RNA, 20 nt, Human
gaaauaauaaaaaauuucag

SEQ ID NO: 3197768 - RNA, 19 nt, Human
gaaauaauaaaaaauuuca

SEQ ID NO: 3197769 - RNA, 15 nt, Human
gaaauaauaaaaaau

SEQ ID NO: 3197770 - RNA, 13 nt, Human
gaaauaauaaaaa

SEQ ID NO: 3197771 - RNA, 18 nt, Human
gaaauaauuuuauuccag

SEQ ID NO: 3197772 - RNA, 21 nt, Human
gaaauaucugaaaauguaugu

SEQ ID NO: 3197773 - RNA, 15 nt, Human
gaaauaucugugaaa

SEQ ID NO: 3197774 - RNA, 16 nt, Human
gaaauaucugugaaau

SEQ ID NO: 3197775 - RNA, 18 nt, Human
gaaauaucugugaaauau

SEQ ID NO: 3197776 - RNA, 20 nt, Human
gaaauaucugugaaauauca

SEQ ID NO: 3197777 - RNA, 21 nt, Human
gaaauaucugugaaauaucau

SEQ ID NO: 3197778 - RNA, 11 nt, Human
gaaauauuaaa

SEQ ID NO: 3197779 - RNA, 15 nt, Human
gaaauauuaaaagaa

SEQ ID NO: 3197780 - RNA, 20 nt, Human
gaaauauguauucuguaaaa

SEQ ID NO: 3197781 - RNA, 16 nt, Human
gaaauauguauucugu

SEQ ID NO: 3197782 - RNA, 13 nt, Human
gaaauauaauuga

SEQ ID NO: 3197783 - RNA, 22 nt, Human
gaaauaguguggaaauuaagaa

SEQ ID NO: 3197784 - RNA, 20 nt, Human
gaaauagucauuugugaauu

SEQ ID NO: 3197785 - RNA, 19 nt, Human
gaaauagucauuugugaau

SEQ ID NO: 3197786 - RNA, 20 nt, Human
gaaauaucugaaaauguaug

SEQ ID NO: 3197787 - RNA, 23 nt, Human
gaaauaguucugugacuaggaaa

SEQ ID NO: 3197788 - RNA, 17 nt, Human
gaaauaguucugugacu

SEQ ID NO: 3197789 - RNA, 13 nt, Human
gaaauaguucugu

SEQ ID NO: 3197790 - RNA, 22 nt, Human
gaaauacagauaaaugauucaa

SEQ ID NO: 3197791 - RNA, 19 nt, Human
gaaauacagauaaaugauu

SEQ ID NO: 3197792 - RNA, 17 nt, Human
gaaauacagacuggaug

SEQ ID NO: 3197793 - RNA, 20 nt, Human
gaaauacuagauuugggaga

SEQ ID NO: 3197794 - RNA, 20 nt, Human
gaaauaggagggaaaccuuu

SEQ ID NO: 3197795 - RNA, 13 nt, Human
gaaauagacaaaa

SEQ ID NO: 3197796 - RNA, 19 nt, Human
gaaauagacaaaaaguaua

SEQ ID NO: 3197797 - RNA, 21 nt, Human
gaaauagacaaaaaguauauu

SEQ ID NO: 3197798 - RNA, 18 nt, Human
gaaauagacagcaugaga

SEQ ID NO: 3197799 - RNA, 13 nt, Human
cuuuccaaauuau

SEQ ID NO: 3197800 - RNA, 15 nt, Human
cuuuccaaauuauuu

SEQ ID NO: 3197801 - RNA, 20 nt, Human
cuuuccaaauuauuucuuaa

SEQ ID NO: 3197802 - RNA, 16 nt, Human
cuuuccaauucuccuu

SEQ ID NO: 3197803 - RNA, 15 nt, Human
cuuuccaauucuccu

SEQ ID NO: 3197804 - RNA, 18 nt, Human
cuuuccaauucuccuuua

SEQ ID NO: 3197805 - RNA, 17 nt, Human
cuuuccaauucuccuuu

SEQ ID NO: 3197806 - RNA, 22 nt, Human
cuuuccaaaugcccagcuuaaa

SEQ ID NO: 3197807 - RNA, 18 nt, Human
cuuuccaaaugcccagcu

SEQ ID NO: 3197808 - RNA, 19 nt, Human
cuuuccaaaugcccagcuu

SEQ ID NO: 3197809 - RNA, 16 nt, Human
cuuuccaaaugcccag

SEQ ID NO: 3197810 - RNA, 21 nt, Human
cuuucauuuugcuuuaauuuu

SEQ ID NO: 3197811 - RNA, 14 nt, Human
cuuucauuuugcuu

SEQ ID NO: 3197812 - RNA, 19 nt, Human
cuuucauuuugcuuuaauu

SEQ ID NO: 3197813 - RNA, 17 nt, Human
cuuucauuuugcuuuaa

SEQ ID NO: 3197814 - RNA, 16 nt, Human
cuuucauuuugcuuua

SEQ ID NO: 3197815 - RNA, 15 nt, Human
cuuucauuuugcuuu

SEQ ID NO: 3197816 - RNA, 18 nt, Human
cuuucauuugcuuuggaa

SEQ ID NO: 3197817 - RNA, 14 nt, Human
cuuucauuugcuuu

SEQ ID NO: 3197818 - RNA, 16 nt, Human
cuuucauauuuuaaac

SEQ ID NO: 3197819 - RNA, 23 nt, Human
cuuucauauuuuaaacagaggau

SEQ ID NO: 3197820 - RNA, 19 nt, Human
cuuucauauuuuaaacaga

SEQ ID NO: 3197821 - RNA, 14 nt, Human
cuuucauuugcuau

SEQ ID NO: 3197822 - RNA, 19 nt, Human
cuuuaguuauaaaggaauc

SEQ ID NO: 3197823 - RNA, 20 nt, Human
cuuuauucuggcagaggagg

SEQ ID NO: 3197824 - RNA, 13 nt, Human
cuuuauuauuuau

SEQ ID NO: 3197825 - RNA, 14 nt, Human
cuuuauuauuuauu

SEQ ID NO: 3197826 - RNA, 12 nt, Human
cuuuauuauuua

SEQ ID NO: 3197827 - RNA, 23 nt, Human
cuuuauuuguguucuuuuuuccc

SEQ ID NO: 3197828 - RNA, 20 nt, Human
cuuuauuuguacuuuuuccu

SEQ ID NO: 3197829 - RNA, 23 nt, Human
cuuuauugccaaaacccagcugc

SEQ ID NO: 3197830 - RNA, 22 nt, Human
cuuuauugccaaaacccagcug

SEQ ID NO: 3197831 - RNA, 21 nt, Human
cuuuauugccaaaacccagcu

SEQ ID NO: 3197832 - RNA, 19 nt, Human
cuuuauugccaaaacccag

SEQ ID NO: 3197833 - RNA, 14 nt, Human
cuuuauugaaauuc

SEQ ID NO: 3197834 - RNA, 17 nt, Human
cuuuauugauaucucca

SEQ ID NO: 3197835 - RNA, 13 nt, Human
cuuuauugucugu

SEQ ID NO: 3197836 - RNA, 14 nt, Human
cuuuauugucugua

SEQ ID NO: 3197837 - RNA, 15 nt, Human
cuuuauugucuguaa

SEQ ID NO: 3197838 - RNA, 18 nt, Human
cuuuauugucuguaaauc

SEQ ID NO: 3197839 - RNA, 21 nt, Human
cuuguguguuuauugucaaag

SEQ ID NO: 3197840 - RNA, 21 nt, Human
cuuguuguuuguaacaagaaa

SEQ ID NO: 3197841 - RNA, 22 nt, Human
cuuguugguucaccauugagac

SEQ ID NO: 3197842 - RNA, 20 nt, Human
cuuguguguuuauugucaaa

SEQ ID NO: 3197843 - RNA, 22 nt, Human
cuuguggcuccacacacacaaa

SEQ ID NO: 3197844 - RNA, 21 nt, Human
cuuguggacacagcucuucuc

SEQ ID NO: 3197845 - RNA, 21 nt, Human
cuugggggcucagcaaggcca

SEQ ID NO: 3197846 - RNA, 20 nt, Human
cuugggggcucagcaaggcc

SEQ ID NO: 3197847 - RNA, 17 nt, Human
cuugggggcucagcaag

SEQ ID NO: 3197848 - RNA, 15 nt, Human
cuugggggcucagca

SEQ ID NO: 3197849 - RNA, 18 nt, Human
cuuuaaagggauggcaag

SEQ ID NO: 3197850 - RNA, 14 nt, Human
cuuuaaacugucgu

SEQ ID NO: 3197851 - RNA, 20 nt, Human
cuuuaaacugucgugucaua

SEQ ID NO: 3197852 - RNA, 18 nt, Human
cuuuacuugucuuucugg

SEQ ID NO: 3197853 - RNA, 16 nt, Human
cuuuacuugucuuucu

SEQ ID NO: 3197854 - RNA, 22 nt, Human
cuuuagaaauaaaccuuaauau

SEQ ID NO: 3197855 - RNA, 23 nt, Human
cuuuagaaauaaaccuuaauauu

SEQ ID NO: 3197856 - RNA, 20 nt, Human
cuuuagaaacacauaauuaa

SEQ ID NO: 3197857 - RNA, 15 nt, Human
cuuuagaaaaggcau

SEQ ID NO: 3197858 - RNA, 18 nt, Human
cuuuagaaacacauaauu

SEQ ID NO: 3197859 - RNA, 14 nt, Human
cuuuagaaaaggca

SEQ ID NO: 3197860 - RNA, 20 nt, Human
cuuuacuugucuuucugggg

SEQ ID NO: 3197861 - RNA, 21 nt, Human
cuuguuuuuuuuuuccacuua

SEQ ID NO: 3197862 - RNA, 23 nt, Human
cuuguuuuuguuuuuguuuuguu

SEQ ID NO: 3197863 - RNA, 20 nt, Human
cuuguuuuuuuuuuccacuu

SEQ ID NO: 3197864 - RNA, 19 nt, Human
cuuguuuuuuuuuuccacu

SEQ ID NO: 3197865 - RNA, 17 nt, Human
cuuguuuuuguuuuugu

SEQ ID NO: 3197866 - RNA, 23 nt, Human
cuuguuuuuguaaagaaaaauau

SEQ ID NO: 3197867 - RNA, 22 nt, Human
cuuguuuuuguaaagaaaaaua

SEQ ID NO: 3197868 - RNA, 21 nt, Human
cuuguuuuuguaaagaaaaau

SEQ ID NO: 3197869 - RNA, 20 nt, Human
cuuguuuuuguaaagaaaaa

SEQ ID NO: 3197870 - RNA, 16 nt, Human
cuuguuuuuguaaaga

SEQ ID NO: 3197871 - RNA, 15 nt, Human
cuuguuuuuguaaag

SEQ ID NO: 3197872 - RNA, 14 nt, Human
cuuguuuuuguaaa

SEQ ID NO: 3197873 - RNA, 20 nt, Human
cuuguuuuuaaguuugcacu

SEQ ID NO: 3197874 - RNA, 16 nt, Human
cuuguuuuuaaguuug

SEQ ID NO: 3197875 - RNA, 14 nt, Human
cuuguuuuuaaguu

SEQ ID NO: 3197876 - RNA, 12 nt, Human
cuuguuuuuaag

SEQ ID NO: 3197877 - RNA, 14 nt, Human
cuuguuuucuggga

SEQ ID NO: 3197878 - RNA, 17 nt, Human
cuuguuuugcuuccccu

SEQ ID NO: 3197879 - RNA, 15 nt, Human
cuuguuuugcuuccc

SEQ ID NO: 3197880 - RNA, 14 nt, Human
cuuguuuugcuucc

SEQ ID NO: 3197881 - RNA, 13 nt, Human
cuuguuuugcuuc

SEQ ID NO: 3197882 - RNA, 23 nt, Human
cuuguuuugcuuccccucccccc

SEQ ID NO: 3197883 - RNA, 14 nt, Human
cuuguuuuggacuu

SEQ ID NO: 3197884 - RNA, 19 nt, Human
cuuguuuuggacuuuguua

SEQ ID NO: 3197885 - RNA, 21 nt, Human
cuuguuuuggacuuuguuaca

SEQ ID NO: 3197886 - RNA, 17 nt, Human
cuuggagguagcuuuga

SEQ ID NO: 3197887 - RNA, 16 nt, Human
cuuggcugcagggagu

SEQ ID NO: 3197888 - RNA, 22 nt, Human
cuuggaggaaggaaacccagcu

SEQ ID NO: 3197889 - RNA, 17 nt, Human
cuuggcugcagggaguc

SEQ ID NO: 3197890 - RNA, 14 nt, Human
cuuggcugcaggga

SEQ ID NO: 3197891 - RNA, 15 nt, Human
cuugggacauccugu

SEQ ID NO: 3197892 - RNA, 13 nt, Human
cuugggaauuuua

SEQ ID NO: 3197893 - RNA, 20 nt, Human
cuuggggacaggggcaggag

SEQ ID NO: 3197894 - RNA, 22 nt, Human
cuugggcuucauccuccucaga

SEQ ID NO: 3197895 - RNA, 20 nt, Human
cuuggggaccagagcugcca

SEQ ID NO: 3197896 - RNA, 21 nt, Human
cuuggggaccagagcugccac

SEQ ID NO: 3197897 - RNA, 14 nt, Human
cuugggccacugug

SEQ ID NO: 3197898 - RNA, 14 nt, Human
cuugggcagaucuc

SEQ ID NO: 3197899 - RNA, 23 nt, Human
cuugggcagaucucccacaugcc

SEQ ID NO: 3197900 - RNA, 19 nt, Human
cuugggcagaucucccaca

SEQ ID NO: 3197901 - RNA, 13 nt, Human
cuugggcuucauc

SEQ ID NO: 3197902 - RNA, 16 nt, Human
cuuggggggcugaggu

SEQ ID NO: 3197903 - RNA, 15 nt, Human
cuuggggggcugagg

SEQ ID NO: 3197904 - RNA, 22 nt, Human
cuuggggaccagagcugccacc

SEQ ID NO: 3197905 - RNA, 22 nt, Human
cuuggggacaaccuuggcuugg

SEQ ID NO: 3197906 - RNA, 15 nt, Human
cuugccacugccucu

SEQ ID NO: 3197907 - RNA, 14 nt, Human
cuugccacugccuc

SEQ ID NO: 3197908 - RNA, 21 nt, Human
cuugccagcugcugagccgca

SEQ ID NO: 3197909 - RNA, 19 nt, Human
cuugccagcugcugagccg

SEQ ID NO: 3197910 - RNA, 18 nt, Human
cuugccagcugcugagcc

SEQ ID NO: 3197911 - RNA, 16 nt, Human
cuugccagcugcugag

SEQ ID NO: 3197912 - RNA, 12 nt, Human
cuugccagcugc

SEQ ID NO: 3197913 - RNA, 21 nt, Human
cuucuccacccugcucuccga

SEQ ID NO: 3197914 - RNA, 16 nt, Human
cuucuccacccugcuc

SEQ ID NO: 3197915 - RNA, 13 nt, Human
cuugccacugccu

SEQ ID NO: 3197916 - RNA, 18 nt, Human
cuucuccacccugcucuc

SEQ ID NO: 3197917 - RNA, 17 nt, Human
cuucuccacccugcucu

SEQ ID NO: 3197918 - RNA, 17 nt, Human
cuugccauuccaaaaua

SEQ ID NO: 3197919 - RNA, 23 nt, Human
cuugcccacuccugcucugcucg

SEQ ID NO: 3197920 - RNA, 15 nt, Human
cuugcccacuccugc

SEQ ID NO: 3197921 - RNA, 22 nt, Human
cuugcccacuccugcucugcuc

SEQ ID NO: 3197922 - RNA, 16 nt, Human
cuugcccacuccugcu

SEQ ID NO: 3197923 - RNA, 17 nt, Human
cuugccccaacccuucu

SEQ ID NO: 3197924 - RNA, 18 nt, Human
cuugccccaacccuucuu

SEQ ID NO: 3197925 - RNA, 14 nt, Human
cuugcucugcugac

SEQ ID NO: 3197926 - RNA, 13 nt, Human
cuugcucugcuga

SEQ ID NO: 3197927 - RNA, 16 nt, Human
cuuggaaaugggagac

SEQ ID NO: 3197928 - RNA, 20 nt, Human
cuuggaaaucaaauguaaag

SEQ ID NO: 3197929 - RNA, 14 nt, Human
cuuggaaauauuaa

SEQ ID NO: 3197930 - RNA, 15 nt, Human
cuuggaaauauuaaa

SEQ ID NO: 3197931 - RNA, 18 nt, Human
cuuggaaauauuaaaaga

SEQ ID NO: 3197932 - RNA, 19 nt, Human
cuuggaaauauuaaaagaa

SEQ ID NO: 3197933 - RNA, 13 nt, Human
cuuggaggaagga

SEQ ID NO: 3197934 - RNA, 13 nt, Human
cuuggaagcuccg

SEQ ID NO: 3197935 - RNA, 21 nt, Human
cuuggaaaucaaauguaaagu

SEQ ID NO: 3197936 - RNA, 16 nt, Human
cuugcucugcugacag

SEQ ID NO: 3197937 - RNA, 15 nt, Human
cuugcugugacuuau

SEQ ID NO: 3197938 - RNA, 13 nt, Human
cuugcuuaaaugu

SEQ ID NO: 3197939 - RNA, 22 nt, Human
cuugcuuaaaugugaauuacua

SEQ ID NO: 3197940 - RNA, 16 nt, Human
cuugcuuaaaugugaa

SEQ ID NO: 3197941 - RNA, 15 nt, Human
cuugcuuaaauguga

SEQ ID NO: 3197942 - RNA, 14 nt, Human
cuugcuuaaaugug

SEQ ID NO: 3197943 - RNA, 15 nt, Human
cuuuuacccuuuuuc

SEQ ID NO: 3197944 - RNA, 11 nt, Human
cuuuuaauuuu

SEQ ID NO: 3197945 - RNA, 21 nt, Human
cuuuguuuguucuuguuuuua

SEQ ID NO: 3197946 - RNA, 18 nt, Human
cuuuguuuguugucagcu

SEQ ID NO: 3197947 - RNA, 13 nt, Human
cuuuguuuguucu

SEQ ID NO: 3197948 - RNA, 15 nt, Human
cuuuguuuguucuug

SEQ ID NO: 3197949 - RNA, 14 nt, Human
cuuuguuuguucuu

SEQ ID NO: 3197950 - RNA, 20 nt, Human
cuuuucauaaccuagccuua

SEQ ID NO: 3197951 - RNA, 20 nt, Human
cuuuucacugcuggcugccu

SEQ ID NO: 3197952 - RNA, 18 nt, Human
cuuuucacugcuggcugc

SEQ ID NO: 3197953 - RNA, 17 nt, Human
cuuuucacugcuggcug

SEQ ID NO: 3197954 - RNA, 16 nt, Human
cuuuucacugcuggcu

SEQ ID NO: 3197955 - RNA, 22 nt, Human
cuuuucauaaccuagccuuaga

SEQ ID NO: 3197956 - RNA, 14 nt, Human
cuuuucaggaaaau

SEQ ID NO: 3197957 - RNA, 14 nt, Human
cuuuucauaucauu

SEQ ID NO: 3197958 - RNA, 15 nt, Human
cuuuucauaucauuu

SEQ ID NO: 3197959 - RNA, 16 nt, Human
cuuuucauaucauuuc

SEQ ID NO: 3197960 - RNA, 22 nt, Human
cuuuucccucggaguucuucuu

SEQ ID NO: 3197961 - RNA, 18 nt, Human
cuuuucuguccgagcuuu

SEQ ID NO: 3197962 - RNA, 18 nt, Human
cuuuucuugcaugaggcu

SEQ ID NO: 3197963 - RNA, 23 nt, Human
cuuuucuugcaugaggcuagugu

SEQ ID NO: 3197964 - RNA, 11 nt, Human
cuuuucuugua

SEQ ID NO: 3197965 - RNA, 16 nt, Human
cuuuucuuguaucugg

SEQ ID NO: 3197966 - RNA, 11 nt, Human
cuuuucuugga

SEQ ID NO: 3197967 - RNA, 13 nt, Human
cuuuucuuggaca

SEQ ID NO: 3197968 - RNA, 14 nt, Human
cuuuucuuggacac

SEQ ID NO: 3197969 - RNA, 20 nt, Human
cuuuucuuggacacuuaauu

SEQ ID NO: 3197970 - RNA, 19 nt, Human
cuuuggacccugaggccca

SEQ ID NO: 3197971 - RNA, 21 nt, Human
cuuuggcuuaauuccaaucau

SEQ ID NO: 3197972 - RNA, 16 nt, Human
cuuuggcuuaauucca

SEQ ID NO: 3197973 - RNA, 17 nt, Human
cuuuggacccugaggcc

SEQ ID NO: 3197974 - RNA, 18 nt, Human
cuuuggacccugaggccc

SEQ ID NO: 3197975 - RNA, 15 nt, Human
cuuuggacccugagg

SEQ ID NO: 3197976 - RNA, 16 nt, Human
cuuuggacccugaggc

SEQ ID NO: 3197977 - RNA, 16 nt, Human
cuuucccaucuuccaa

SEQ ID NO: 3197978 - RNA, 18 nt, Human
cuuucccacccagccugg

SEQ ID NO: 3197979 - RNA, 17 nt, Human
cuuucccacccagccug

SEQ ID NO: 3197980 - RNA, 19 nt, Human
cuuucccacccagccuggg

SEQ ID NO: 3197981 - RNA, 12 nt, Human
cuuugcucuggu

SEQ ID NO: 3197982 - RNA, 21 nt, Human
cuuuguccuccugcugccagu

SEQ ID NO: 3197983 - RNA, 18 nt, Human
cuuugucuaagaaacauu

SEQ ID NO: 3197984 - RNA, 17 nt, Human
cuuugucuaagaaacau

SEQ ID NO: 3197985 - RNA, 19 nt, Human
cuuugucuaagaaacauug

SEQ ID NO: 3197986 - RNA, 14 nt, Human
cuuuguucuggcuc

SEQ ID NO: 3197987 - RNA, 19 nt, Human
cuuuguuuagucuuuauac

SEQ ID NO: 3197988 - RNA, 13 nt, Human
cuuugggaggcca

SEQ ID NO: 3197989 - RNA, 18 nt, Human
cuuuguccccaccgcaga

SEQ ID NO: 3197990 - RNA, 22 nt, Human
cuuuguccccaccgcagacagg

SEQ ID NO: 3197991 - RNA, 18 nt, Human
cuuuguccuccugcugcc

SEQ ID NO: 3197992 - RNA, 17 nt, Human
cuuuguccuccugcugc

SEQ ID NO: 3197993 - RNA, 13 nt, Human
cuuuguccuccug

SEQ ID NO: 3197994 - RNA, 16 nt, Human
cuuuguccuccugcug

SEQ ID NO: 3197995 - RNA, 15 nt, Human
cuuuguccuccugcu

SEQ ID NO: 3197996 - RNA, 19 nt, Human
gaaaauauguauuaacacu

SEQ ID NO: 3197997 - RNA, 18 nt, Human
gaaaauauguauuaacac

SEQ ID NO: 3197998 - RNA, 13 nt, Human
gaaaauauguauu

SEQ ID NO: 3197999 - RNA, 14 nt, Human
gaaaaucagccugc

SEQ ID NO: 3198000 - RNA, 16 nt, Human
gaaaaucagccugcuc

SEQ ID NO: 3198001 - RNA, 17 nt, Human
gaaaagcugcugacagu

SEQ ID NO: 3198002 - RNA, 13 nt, Human
gaaaagcugcuga

SEQ ID NO: 3198003 - RNA, 13 nt, Human
gaaaauaacugaa

SEQ ID NO: 3198004 - RNA, 15 nt, Human
gaaaauaacugaauu

SEQ ID NO: 3198005 - RNA, 17 nt, Human
gaaaauaacugaauuug

SEQ ID NO: 3198006 - RNA, 18 nt, Human
gaaaauaacugaauuugg

SEQ ID NO: 3198007 - RNA, 20 nt, Human
gaaaauaauugacaggcgaa

SEQ ID NO: 3198008 - RNA, 19 nt, Human
gaaaauaagccaugagaau

SEQ ID NO: 3198009 - RNA, 15 nt, Human
gaaaauaauugacag

SEQ ID NO: 3198010 - RNA, 11 nt, Human
gaaaauaauug

SEQ ID NO: 3198011 - RNA, 22 nt, Human
gaaacagacuuguauauucuau

SEQ ID NO: 3198012 - RNA, 21 nt, Human
gaaacagaggaccagcacacu

SEQ ID NO: 3198013 - RNA, 23 nt, Human
gaaacagaggaccagcacacucc

SEQ ID NO: 3198014 - RNA, 18 nt, Human
gaaacagcuaaugggaca

SEQ ID NO: 3198015 - RNA, 15 nt, Human
gaaacagcucgacuu

SEQ ID NO: 3198016 - RNA, 20 nt, Human
gaaacagcucgacuuuaaaa

SEQ ID NO: 3198017 - RNA, 17 nt, Human
gaaaauaugucccagaa

SEQ ID NO: 3198018 - RNA, 15 nt, Human
gaaacacauaauuaa

SEQ ID NO: 3198019 - RNA, 23 nt, Human
gaaacaccaaaaaaauccagaaa

SEQ ID NO: 3198020 - RNA, 16 nt, Human
gaaacaccaaaaaaau

SEQ ID NO: 3198021 - RNA, 20 nt, Human
gaaacacauaauuaacacuu

SEQ ID NO: 3198022 - RNA, 19 nt, Human
gaaacacauaauuaacacu

SEQ ID NO: 3198023 - RNA, 22 nt, Human
gaaacacugggcuucuagaacc

SEQ ID NO: 3198024 - RNA, 16 nt, Human
gaaacacugaaaagaa

SEQ ID NO: 3198025 - RNA, 16 nt, Human
gaaacacuaaauguua

SEQ ID NO: 3198026 - RNA, 15 nt, Human
gaaacacuaaauguu

SEQ ID NO: 3198027 - RNA, 23 nt, Human
gaaacacuaaauguuaaagaugu

SEQ ID NO: 3198028 - RNA, 19 nt, Human
gaaacacuaaauguuaaag

SEQ ID NO: 3198029 - RNA, 18 nt, Human
gaaacacuaaauguuaaa

SEQ ID NO: 3198030 - RNA, 17 nt, Human
gaaacacuaaauguuaa

SEQ ID NO: 3198031 - RNA, 17 nt, Human
gaaacacccacaggcau

SEQ ID NO: 3198032 - RNA, 18 nt, Human
cuuuuuuccuuuccaccu

SEQ ID NO: 3198033 - RNA, 19 nt, Human
cuuuuuuccuuuccaccuu

SEQ ID NO: 3198034 - RNA, 15 nt, Human
cuuuuuucacuacau

SEQ ID NO: 3198035 - RNA, 14 nt, Human
cuuuugauaagaaa

SEQ ID NO: 3198036 - RNA, 16 nt, Human
cuuuugagcauuuaga

SEQ ID NO: 3198037 - RNA, 21 nt, Human
cuuuugagugccuuacacaau

SEQ ID NO: 3198038 - RNA, 14 nt, Human
cuuuuuuggcugcu

SEQ ID NO: 3198039 - RNA, 15 nt, Human
cuuuuuuggcugcug

SEQ ID NO: 3198040 - RNA, 15 nt, Human
cuuuuuugaaaucag

SEQ ID NO: 3198041 - RNA, 14 nt, Human
gaaaacaucuccuu

SEQ ID NO: 3198042 - RNA, 19 nt, Human
gaaaacaucuccuuagaaa

SEQ ID NO: 3198043 - RNA, 15 nt, Human
gaaaacaucuccuua

SEQ ID NO: 3198044 - RNA, 23 nt, Human
gaaaacaucucaucaugucuauu

SEQ ID NO: 3198045 - RNA, 15 nt, Human
gaaaacguggcugcu

SEQ ID NO: 3198046 - RNA, 16 nt, Human
gaaaacguggcugcuu

SEQ ID NO: 3198047 - RNA, 18 nt, Human
gaaaacguggcugcuuca

SEQ ID NO: 3198048 - RNA, 14 nt, Human
gaaaacguggcugc

SEQ ID NO: 3198049 - RNA, 21 nt, Human
gaaaaccaagccguggcuucc

SEQ ID NO: 3198050 - RNA, 13 nt, Human
gaaaaccaaacaa

SEQ ID NO: 3198051 - RNA, 15 nt, Human
gaaaaccaacaccau

SEQ ID NO: 3198052 - RNA, 21 nt, Human
gaaaaccaacaccaucacagc

SEQ ID NO: 3198053 - RNA, 19 nt, Human
gaaaaccaagccguggcuu

SEQ ID NO: 3198054 - RNA, 18 nt, Human
gaaaaccaagccguggcu

SEQ ID NO: 3198055 - RNA, 14 nt, Human
cucaaauuuugagu

SEQ ID NO: 3198056 - RNA, 20 nt, Human
cucaaaugaugugccugcuu

SEQ ID NO: 3198057 - RNA, 20 nt, Human
cucaacaaggcaaaaacaaa

SEQ ID NO: 3198058 - RNA, 21 nt, Human
cucaacaccucugcacaagcu

SEQ ID NO: 3198059 - RNA, 15 nt, Human
cucaaccuccugggc

SEQ ID NO: 3198060 - RNA, 13 nt, Human
cucaaccuccugg

SEQ ID NO: 3198061 - RNA, 21 nt, Human
cuauuucccccuuucuuccuc

SEQ ID NO: 3198062 - RNA, 19 nt, Human
cuauuucccccuuucuucc

SEQ ID NO: 3198063 - RNA, 18 nt, Human
cuauuucccccuuucuuc

SEQ ID NO: 3198064 - RNA, 16 nt, Human
cuauuucccccuuucu

SEQ ID NO: 3198065 - RNA, 23 nt, Human
cuauuucaucagaacagcuguug

SEQ ID NO: 3198066 - RNA, 19 nt, Human
cuauuucagaaguuuaaau

SEQ ID NO: 3198067 - RNA, 12 nt, Human
cuauuucagaag

SEQ ID NO: 3198068 - RNA, 11 nt, Human
cuauuucagaa

SEQ ID NO: 3198069 - RNA, 20 nt, Human
cucaaauaggcuauuaaaaa

SEQ ID NO: 3198070 - RNA, 21 nt, Human
cucaaauaggcuauuaaaaaa

SEQ ID NO: 3198071 - RNA, 14 nt, Human
cucaaauccaggac

SEQ ID NO: 3198072 - RNA, 13 nt, Human
cucaaauccagga

SEQ ID NO: 3198073 - RNA, 23 nt, Human
cucaaauccaggacccugccagg

SEQ ID NO: 3198074 - RNA, 22 nt, Human
cucaaauccaggacccugccag

SEQ ID NO: 3198075 - RNA, 20 nt, Human
cucaaauccaggacccugcc

SEQ ID NO: 3198076 - RNA, 16 nt, Human
cucaaauccaggaccc

SEQ ID NO: 3198077 - RNA, 15 nt, Human
cucaaauccaggacc

SEQ ID NO: 3198078 - RNA, 16 nt, Human
cucaaaucuuaagaaa

SEQ ID NO: 3198079 - RNA, 15 nt, Human
cucaaaucuuaagaa

SEQ ID NO: 3198080 - RNA, 14 nt, Human
cuauuguagagcca

SEQ ID NO: 3198081 - RNA, 12 nt, Human
cuauuguaauau

SEQ ID NO: 3198082 - RNA, 19 nt, Human
cuauuguaauauagaaaaa

SEQ ID NO: 3198083 - RNA, 20 nt, Human
cuauuguaauauagaaaaaa

SEQ ID NO: 3198084 - RNA, 19 nt, Human
cuauugucaccagggcugg

SEQ ID NO: 3198085 - RNA, 21 nt, Human
cuauuuauaauacagaaucuu

SEQ ID NO: 3198086 - RNA, 12 nt, Human
cuauuuaauuuu

SEQ ID NO: 3198087 - RNA, 15 nt, Human
cuauuuagaugcaua

SEQ ID NO: 3198088 - RNA, 15 nt, Human
cuauuuagacaugua

SEQ ID NO: 3198089 - RNA, 23 nt, Human
cuauuccccacccuccccuuccc

SEQ ID NO: 3198090 - RNA, 22 nt, Human
cucacaguccuuaccagcagag

SEQ ID NO: 3198091 - RNA, 17 nt, Human
cucacaguccuuaccag

SEQ ID NO: 3198092 - RNA, 19 nt, Human
cucacaguccuuaccagca

SEQ ID NO: 3198093 - RNA, 22 nt, Human
cucacauuuauucugcucacau

SEQ ID NO: 3198094 - RNA, 14 nt, Human
cucacauuuuuaua

SEQ ID NO: 3198095 - RNA, 15 nt, Human
cucacauuuuuuucu

SEQ ID NO: 3198096 - RNA, 19 nt, Human
cucacauuuauucugcuca

SEQ ID NO: 3198097 - RNA, 15 nt, Human
cucacauuuauucug

SEQ ID NO: 3198098 - RNA, 18 nt, Human
cucaccagccccagugcc

SEQ ID NO: 3198099 - RNA, 17 nt, Human
cucaccagccccagugc

SEQ ID NO: 3198100 - RNA, 13 nt, Human
cucaccagcugug

SEQ ID NO: 3198101 - RNA, 15 nt, Human
cucaccagccccagu

SEQ ID NO: 3198102 - RNA, 14 nt, Human
cucaccagccccag

SEQ ID NO: 3198103 - RNA, 13 nt, Human
cucaccagcccca

SEQ ID NO: 3198104 - RNA, 16 nt, Human
cucaccagaauuauuu

SEQ ID NO: 3198105 - RNA, 22 nt, Human
cucacacaugagcaucaggcca

SEQ ID NO: 3198106 - RNA, 24 nt, Human
cucacacaugagcaucaggccagg

SEQ ID NO: 3198107 - RNA, 21 nt, Human
cucacacaugagcaucaggcc

SEQ ID NO: 3198108 - RNA, 15 nt, Human
cucacaguccuuacc

SEQ ID NO: 3198109 - RNA, 12 nt, Human
cucacagccagc

SEQ ID NO: 3198110 - RNA, 15 nt, Human
cucacagcuaugcaa

SEQ ID NO: 3198111 - RNA, 16 nt, Human
cucacagcuaugcaaa

SEQ ID NO: 3198112 - RNA, 22 nt, Human
cucacagcuaugcaaaaagcua

SEQ ID NO: 3198113 - RNA, 14 nt, Human
cucaaguccucuuu

SEQ ID NO: 3198114 - RNA, 21 nt, Human
cucaaguccucuuuucugaga

SEQ ID NO: 3198115 - RNA, 17 nt, Human
cucaagugauucuccug

SEQ ID NO: 3198116 - RNA, 18 nt, Human
cucaagaccaaauggaaa

SEQ ID NO: 3198117 - RNA, 21 nt, Human
cucaagaccaaauggaaacag

SEQ ID NO: 3198118 - RNA, 22 nt, Human
cucagauuguaauauguaaaug

SEQ ID NO: 3198119 - RNA, 15 nt, Human
cucagauuguaauau

SEQ ID NO: 3198120 - RNA, 15 nt, Human
cucagaucuucugug

SEQ ID NO: 3198121 - RNA, 21 nt, Human
cucagcaaaagaugcuucuca

SEQ ID NO: 3198122 - RNA, 13 nt, Human
cucagcaaggcca

SEQ ID NO: 3198123 - RNA, 16 nt, Human
cucagcaaggccaccu

SEQ ID NO: 3198124 - RNA, 15 nt, Human
cucagcaaggccacc

SEQ ID NO: 3198125 - RNA, 22 nt, Human
cucagcaaggccaccucuuccu

SEQ ID NO: 3198126 - RNA, 21 nt, Human
cucagcaaggccaccucuucc

SEQ ID NO: 3198127 - RNA, 18 nt, Human
cucagcaaggccaccucu

SEQ ID NO: 3198128 - RNA, 17 nt, Human
cucagcaaggccaccuc

SEQ ID NO: 3198129 - RNA, 13 nt, Human
cucagcaccacuc

SEQ ID NO: 3198130 - RNA, 16 nt, Human
cucagcaccacucaag

SEQ ID NO: 3198131 - RNA, 14 nt, Human
cucagcaccacuca

SEQ ID NO: 3198132 - RNA, 17 nt, Human
cucagcauccuggcacc

SEQ ID NO: 3198133 - RNA, 16 nt, Human
cucagcauccuggcac

SEQ ID NO: 3198134 - RNA, 22 nt, Human
cucagcaccacucaagaccaaa

SEQ ID NO: 3198135 - RNA, 21 nt, Human
cucagcaccacucaagaccaa

SEQ ID NO: 3198136 - RNA, 18 nt, Human
cucagcaccacucaagac

SEQ ID NO: 3198137 - RNA, 17 nt, Human
cucagcaccacucaaga

SEQ ID NO: 3198138 - RNA, 14 nt, Human
cucagagagggugg

SEQ ID NO: 3198139 - RNA, 22 nt, Human
cucagaucccacuuuugccaga

SEQ ID NO: 3198140 - RNA, 20 nt, Human
cucagaucccacuuuugcca

SEQ ID NO: 3198141 - RNA, 16 nt, Human
cucagauauuugcacc

SEQ ID NO: 3198142 - RNA, 22 nt, Human
cucacuguugcccaggcuggcg

SEQ ID NO: 3198143 - RNA, 21 nt, Human
cucacuguugcccaggcuggc

SEQ ID NO: 3198144 - RNA, 19 nt, Human
cucacuguugcccaggcug

SEQ ID NO: 3198145 - RNA, 19 nt, Human
cucacugccaugccagcuu

SEQ ID NO: 3198146 - RNA, 22 nt, Human
cucacugccaugccagcuuauc

SEQ ID NO: 3198147 - RNA, 20 nt, Human
cucacuguugcccaggcugg

SEQ ID NO: 3198148 - RNA, 15 nt, Human
cucacuccuaccugg

SEQ ID NO: 3198149 - RNA, 13 nt, Human
cucacuccuaccu

SEQ ID NO: 3198150 - RNA, 16 nt, Human
cucacucagcaccacu

SEQ ID NO: 3198151 - RNA, 15 nt, Human
cucacucagcaccac

SEQ ID NO: 3198152 - RNA, 14 nt, Human
cucacucagcacca

SEQ ID NO: 3198153 - RNA, 13 nt, Human
cucacucagcacc

SEQ ID NO: 3198154 - RNA, 18 nt, Human
cucacucagcaccacuca

SEQ ID NO: 3198155 - RNA, 22 nt, Human
cucacuauguugcccaggcagg

SEQ ID NO: 3198156 - RNA, 21 nt, Human
cucacuauguugcccaggcag

SEQ ID NO: 3198157 - RNA, 23 nt, Human
cucacuauguugcccaggcaggu

SEQ ID NO: 3198158 - RNA, 21 nt, Human
cucacucagaaguccagaguc

SEQ ID NO: 3198159 - RNA, 20 nt, Human
cucacucagaaguccagagu

SEQ ID NO: 3198160 - RNA, 20 nt, Human
cucacuauguugcccaggca

SEQ ID NO: 3198161 - RNA, 19 nt, Human
cucacuauguugcccaggc

SEQ ID NO: 3198162 - RNA, 15 nt, Human
cucaccccagcccca

SEQ ID NO: 3198163 - RNA, 14 nt, Human
cucaccccagcccc

SEQ ID NO: 3198164 - RNA, 21 nt, Human
cucaccauuuccccagggcac

SEQ ID NO: 3198165 - RNA, 20 nt, Human
cucaccauuuccccagggca

SEQ ID NO: 3198166 - RNA, 19 nt, Human
cucaccauuuccccagggc

SEQ ID NO: 3198167 - RNA, 18 nt, Human
cucaccauuuccccaggg

SEQ ID NO: 3198168 - RNA, 16 nt, Human
cucaccauuuccccag

SEQ ID NO: 3198169 - RNA, 21 nt, Human
cucacucugucgcccagucug

SEQ ID NO: 3198170 - RNA, 13 nt, Human
cucacucugucgc

SEQ ID NO: 3198171 - RNA, 22 nt, Human
cucacucugucgcccagucugg

SEQ ID NO: 3198172 - RNA, 12 nt, Human
cucacugcagcc

SEQ ID NO: 3198173 - RNA, 13 nt, Human
cucacugcagccu

SEQ ID NO: 3198174 - RNA, 13 nt, Human
cucacuccuugaa

SEQ ID NO: 3198175 - RNA, 19 nt, Human
cucacuccuaccugguaau

SEQ ID NO: 3198176 - RNA, 17 nt, Human
cucacuccuaccuggua

SEQ ID NO: 3198177 - RNA, 16 nt, Human
cucacuccuaccuggu

SEQ ID NO: 3198178 - RNA, 12 nt, Human
cucacucugucg

SEQ ID NO: 3198179 - RNA, 11 nt, Human
cucacucuguc

SEQ ID NO: 3198180 - RNA, 11 nt, Human
cucacucugcu

SEQ ID NO: 3198181 - RNA, 17 nt, Human
cucacucugcuaccuug

SEQ ID NO: 3198182 - RNA, 19 nt, Human
cucacucugcuaccuugcc

SEQ ID NO: 3198183 - RNA, 21 nt, Human
cucacucugcuaccuugcccc

SEQ ID NO: 3198184 - RNA, 22 nt, Human
cucacucugcuaccuugcccca

SEQ ID NO: 3198185 - RNA, 21 nt, Human
cucacucucaggaaaugcuga

SEQ ID NO: 3198186 - RNA, 12 nt, Human
cucacucucagg

SEQ ID NO: 3198187 - RNA, 14 nt, Human
cucacucucaggaa

SEQ ID NO: 3198188 - RNA, 13 nt, Human
cucacucucagga

SEQ ID NO: 3198189 - RNA, 10 nt, Human
cucacucuca

SEQ ID NO: 3198190 - RNA, 21 nt, Human
cuauaauguaagcucuacuga

SEQ ID NO: 3198191 - RNA, 22 nt, Human
cuauaauuuaccugaagucuuu

SEQ ID NO: 3198192 - RNA, 11 nt, Human
cuauaauguga

SEQ ID NO: 3198193 - RNA, 13 nt, Human
cuauaaugugaaa

SEQ ID NO: 3198194 - RNA, 14 nt, Human
cuauaauuuugaua

SEQ ID NO: 3198195 - RNA, 14 nt, Human
cuauaauuuuacaa

SEQ ID NO: 3198196 - RNA, 23 nt, Human
cuauaauuuugauagugggacca

SEQ ID NO: 3198197 - RNA, 20 nt, Human
cuauaauuuugauaguggga

SEQ ID NO: 3198198 - RNA, 16 nt, Human
cuauaauuuugauagu

SEQ ID NO: 3198199 - RNA, 17 nt, Human
cuauagaaaguguucug

SEQ ID NO: 3198200 - RNA, 16 nt, Human
cuauagaaaguguucu

SEQ ID NO: 3198201 - RNA, 15 nt, Human
cuauagaaaguguuc

SEQ ID NO: 3198202 - RNA, 14 nt, Human
cuauagaaaguguu

SEQ ID NO: 3198203 - RNA, 13 nt, Human
cuauagaaagugu

SEQ ID NO: 3198204 - RNA, 22 nt, Human
cuauagaaaguguucuguuaca

SEQ ID NO: 3198205 - RNA, 20 nt, Human
cuauagaaaguguucuguua

SEQ ID NO: 3198206 - RNA, 19 nt, Human
cuauagaaaguguucuguu

SEQ ID NO: 3198207 - RNA, 20 nt, Human
cuauagcaucacuuaaaaca

SEQ ID NO: 3198208 - RNA, 15 nt, Human
cuauagcaucacuua

SEQ ID NO: 3198209 - RNA, 17 nt, Human
cuauagcaucacuuaaa

SEQ ID NO: 3198210 - RNA, 17 nt, Human
cuauagcaaaguaguac

SEQ ID NO: 3198211 - RNA, 16 nt, Human
cuauaauguaagcucu

SEQ ID NO: 3198212 - RNA, 17 nt, Human
cuauaagccaaaauuaa

SEQ ID NO: 3198213 - RNA, 21 nt, Human
cuauaagcaaauugcuuuuuu

SEQ ID NO: 3198214 - RNA, 14 nt, Human
cuauaaucuguuuu

SEQ ID NO: 3198215 - RNA, 13 nt, Human
cuagugcugugaa

SEQ ID NO: 3198216 - RNA, 17 nt, Human
cuagugcugugaaaaaa

SEQ ID NO: 3198217 - RNA, 14 nt, Human
cuagugcugugaaa

SEQ ID NO: 3198218 - RNA, 22 nt, Human
cuagugcugugaaaaaaaaaau

SEQ ID NO: 3198219 - RNA, 15 nt, Human
cuauaggugcuacaa

SEQ ID NO: 3198220 - RNA, 17 nt, Human
cuauauuagaucaaaua

SEQ ID NO: 3198221 - RNA, 22 nt, Human
cuauauuccagguuuaaguaga

SEQ ID NO: 3198222 - RNA, 22 nt, Human
cuauaggugcuacaaaaacaca

SEQ ID NO: 3198223 - RNA, 21 nt, Human
cuauaggugcuacaaaaacac

SEQ ID NO: 3198224 - RNA, 20 nt, Human
cuauaggugcuacaaaaaca

SEQ ID NO: 3198225 - RNA, 17 nt, Human
cuauagccuaggugaca

SEQ ID NO: 3198226 - RNA, 16 nt, Human
cuaucuggugauuucu

SEQ ID NO: 3198227 - RNA, 17 nt, Human
cuaucuggugauuucua

SEQ ID NO: 3198228 - RNA, 16 nt, Human
cuaucugguauuaaau

SEQ ID NO: 3198229 - RNA, 17 nt, Human
cuaucugguauuaaaug

SEQ ID NO: 3198230 - RNA, 20 nt, Human
cuaucugguauuaaaugcca

SEQ ID NO: 3198231 - RNA, 21 nt, Human
cuaucugguauuaaaugccaa

SEQ ID NO: 3198232 - RNA, 17 nt, Human
cuaugagggccuugagu

SEQ ID NO: 3198233 - RNA, 15 nt, Human
cuaugagggccuuga

SEQ ID NO: 3198234 - RNA, 16 nt, Human
cuaucuguuuacagug

SEQ ID NO: 3198235 - RNA, 13 nt, Human
cuaugagggccuu

SEQ ID NO: 3198236 - RNA, 20 nt, Human
cuaugcagagguccacaaca

SEQ ID NO: 3198237 - RNA, 14 nt, Human
cuauggccugugcg

SEQ ID NO: 3198238 - RNA, 14 nt, Human
cuaugcuguaucug

SEQ ID NO: 3198239 - RNA, 15 nt, Human
cuaugcuguaucugu

SEQ ID NO: 3198240 - RNA, 21 nt, Human
cuauggacagcauugccagua

SEQ ID NO: 3198241 - RNA, 23 nt, Human
cuauucaaacagucucaggaaau

SEQ ID NO: 3198242 - RNA, 16 nt, Human
cuauucacaauuauuc

SEQ ID NO: 3198243 - RNA, 17 nt, Human
cuauucacaauuauucc

SEQ ID NO: 3198244 - RNA, 16 nt, Human
cuauucaaacagucuc

SEQ ID NO: 3198245 - RNA, 18 nt, Human
cuauucaaacagucucag

SEQ ID NO: 3198246 - RNA, 15 nt, Human
cuauuagagaagaga

SEQ ID NO: 3198247 - RNA, 11 nt, Human
cuauuaauauu

SEQ ID NO: 3198248 - RNA, 12 nt, Human
cuauuaauauuu

SEQ ID NO: 3198249 - RNA, 13 nt, Human
cuauuaauauuug

SEQ ID NO: 3198250 - RNA, 22 nt, Human
cuauuaauauuuguuuaguuca

SEQ ID NO: 3198251 - RNA, 18 nt, Human
cuauuacgaaguucaaga

SEQ ID NO: 3198252 - RNA, 22 nt, Human
cuauuacgaaguucaagaucaa

SEQ ID NO: 3198253 - RNA, 23 nt, Human
cuauuacgaaguucaagaucaaa

SEQ ID NO: 3198254 - RNA, 21 nt, Human
cuauuagcuuacugauuaacu

SEQ ID NO: 3198255 - RNA, 14 nt, Human
cuauuaguguuaua

SEQ ID NO: 3198256 - RNA, 15 nt, Human
cuauuaguguuauau

SEQ ID NO: 3198257 - RNA, 16 nt, Human
cuauuaguguuauaug

SEQ ID NO: 3198258 - RNA, 23 nt, Human
cuaugggacucaaugcacugaca

SEQ ID NO: 3198259 - RNA, 22 nt, Human
cuaugggacucaaugcacugac

SEQ ID NO: 3198260 - RNA, 18 nt, Human
cuaugggacucaaugcac

SEQ ID NO: 3198261 - RNA, 19 nt, Human
cuaugggggcacugaggac

SEQ ID NO: 3198262 - RNA, 22 nt, Human
cuaugguguaaucaugaaggag

SEQ ID NO: 3198263 - RNA, 17 nt, Human
cuauggucuuauauuua

SEQ ID NO: 3198264 - RNA, 11 nt, Human
cuauggucuua

SEQ ID NO: 3198265 - RNA, 23 nt, Human
cgcccaguuggguggaugccugg

SEQ ID NO: 3198266 - RNA, 19 nt, Human
cgcccaugagagcgcagcc

SEQ ID NO: 3198267 - RNA, 20 nt, Human
cgcccaugagagcgcagccc

SEQ ID NO: 3198268 - RNA, 21 nt, Human
cgcccaugagagcgcagcccg

SEQ ID NO: 3198269 - RNA, 15 nt, Human
cgccaugcuccuggc

SEQ ID NO: 3198270 - RNA, 20 nt, Human
cgccaucccagccccaauga

SEQ ID NO: 3198271 - RNA, 17 nt, Human
cgccaucccagccccaa

SEQ ID NO: 3198272 - RNA, 19 nt, Human
cgccagggaccccagaauc

SEQ ID NO: 3198273 - RNA, 22 nt, Human
cgcccaguuggguggaugccug

SEQ ID NO: 3198274 - RNA, 18 nt, Human
cuaggugacagagugaga

SEQ ID NO: 3198275 - RNA, 14 nt, Human
cuaggugacagagu

SEQ ID NO: 3198276 - RNA, 17 nt, Human
cuagguagagucugagg

SEQ ID NO: 3198277 - RNA, 19 nt, Human
cuagguagcccccucuucc

SEQ ID NO: 3198278 - RNA, 16 nt, Human
cuagguagagucugag

SEQ ID NO: 3198279 - RNA, 20 nt, Human
cuagguagcccccucuuccc

SEQ ID NO: 3198280 - RNA, 24 nt, Human
cuaggugacagagugagacucugu

SEQ ID NO: 3198281 - RNA, 12 nt, Human
cuaggucugaua

SEQ ID NO: 3198282 - RNA, 20 nt, Human
cuaguaauauauuuaaaggg

SEQ ID NO: 3198283 - RNA, 16 nt, Human
cuaguaauauauuuaa

SEQ ID NO: 3198284 - RNA, 21 nt, Human
cuagucaacaguacccugguu

SEQ ID NO: 3198285 - RNA, 12 nt, Human
cuaguaauauau

SEQ ID NO: 3198286 - RNA, 16 nt, Human
cuaguaauaaagacuc

SEQ ID NO: 3198287 - RNA, 19 nt, Human
cuagugaaagaggcagcuu

SEQ ID NO: 3198288 - RNA, 18 nt, Human
cuagugaaagaggcagcu

SEQ ID NO: 3198289 - RNA, 17 nt, Human
cuccuugguuauauuuu

SEQ ID NO: 3198290 - RNA, 13 nt, Human
cucgagcaugccu

SEQ ID NO: 3198291 - RNA, 15 nt, Human
cucgagcaugccugg

SEQ ID NO: 3198292 - RNA, 16 nt, Human
cucgagcaugccugga

SEQ ID NO: 3198293 - RNA, 19 nt, Human
cucgagcaugccuggaugg

SEQ ID NO: 3198294 - RNA, 23 nt, Human
cuccuuggugucgggcaugacac

SEQ ID NO: 3198295 - RNA, 20 nt, Human
cuccuuccuaguucaucccu

SEQ ID NO: 3198296 - RNA, 17 nt, Human
cuccuucccuugcuacc

SEQ ID NO: 3198297 - RNA, 16 nt, Human
cucgcuccaacuccaa

SEQ ID NO: 3198298 - RNA, 22 nt, Human
cucgcuauugucaccagggcug

SEQ ID NO: 3198299 - RNA, 24 nt, Human
cucgcuccaacuccaacauccacu

SEQ ID NO: 3198300 - RNA, 17 nt, Human
cucgcuccaacuccaac

SEQ ID NO: 3198301 - RNA, 23 nt, Human
cucgcucugucgcccaggcugga

SEQ ID NO: 3198302 - RNA, 16 nt, Human
cucgcucuguugccca

SEQ ID NO: 3198303 - RNA, 20 nt, Human
cucgcucuguugcccaggcu

SEQ ID NO: 3198304 - RNA, 18 nt, Human
cucgcaggccucccugcc

SEQ ID NO: 3198305 - RNA, 15 nt, Human
cucgccuucaucucc

SEQ ID NO: 3198306 - RNA, 18 nt, Human
cucgccucggaucagcug

SEQ ID NO: 3198307 - RNA, 22 nt, Human
cucgagcaugccuggauggggc

SEQ ID NO: 3198308 - RNA, 20 nt, Human
cuccugugugugcgccuaca

SEQ ID NO: 3198309 - RNA, 17 nt, Human
cuccuuaucaaaggaca

SEQ ID NO: 3198310 - RNA, 22 nt, Human
cuccuuaucaaaggacaccauu

SEQ ID NO: 3198311 - RNA, 20 nt, Human
cuccuuaggguuuucucucu

SEQ ID NO: 3198312 - RNA, 18 nt, Human
cuccuuaggguuuucucu

SEQ ID NO: 3198313 - RNA, 14 nt, Human
cuccuucccuugcu

SEQ ID NO: 3198314 - RNA, 20 nt, Human
cuccuucccacucuucucau

SEQ ID NO: 3198315 - RNA, 22 nt, Human
cuccuucaacaaggcuugcugc

SEQ ID NO: 3198316 - RNA, 23 nt, Human
cuccuuauggguagggcucugac

SEQ ID NO: 3198317 - RNA, 10 nt, Human
cuccuuccca

SEQ ID NO: 3198318 - RNA, 15 nt, Human
cuccuucccacucuu

SEQ ID NO: 3198319 - RNA, 19 nt, Human
cuccuucccacucuucuca

SEQ ID NO: 3198320 - RNA, 18 nt, Human
cuccuucccacucuucuc

SEQ ID NO: 3198321 - RNA, 17 nt, Human
cuccuucccacucuucu

SEQ ID NO: 3198322 - RNA, 16 nt, Human
cuccuucccacucuuc

SEQ ID NO: 3198323 - RNA, 24 nt, Human
cuccugugugugcgccuacaggag

SEQ ID NO: 3198324 - RNA, 23 nt, Human
cuccugugugugcgccuacagga

SEQ ID NO: 3198325 - RNA, 21 nt, Human
cuccugugugugcgccuacag

SEQ ID NO: 3198326 - RNA, 11 nt, Human
cuccuggacuc

SEQ ID NO: 3198327 - RNA, 14 nt, Human
cuccuggaaauauu

SEQ ID NO: 3198328 - RNA, 15 nt, Human
cuccucuccccagca

SEQ ID NO: 3198329 - RNA, 13 nt, Human
cuccucuccccag

SEQ ID NO: 3198330 - RNA, 11 nt, Human
cuccugccuca

SEQ ID NO: 3198331 - RNA, 12 nt, Human
cuccugccucag

SEQ ID NO: 3198332 - RNA, 16 nt, Human
cuccugccucagccuc

SEQ ID NO: 3198333 - RNA, 17 nt, Human
cuccugccucagccucc

SEQ ID NO: 3198334 - RNA, 21 nt, Human
cuccugccucgaacuggcugc

SEQ ID NO: 3198335 - RNA, 20 nt, Human
cuccugccucgaacuggcug

SEQ ID NO: 3198336 - RNA, 18 nt, Human
cuccugccucgaacuggc

SEQ ID NO: 3198337 - RNA, 19 nt, Human
cuccugccucagccucccg

SEQ ID NO: 3198338 - RNA, 14 nt, Human
cuccugcucugcuc

SEQ ID NO: 3198339 - RNA, 15 nt, Human
cuccugcucugcucg

SEQ ID NO: 3198340 - RNA, 13 nt, Human
cuccugcugccag

SEQ ID NO: 3198341 - RNA, 14 nt, Human
cuccugcugccagu

SEQ ID NO: 3198342 - RNA, 12 nt, Human
cuccugcugcca

SEQ ID NO: 3198343 - RNA, 12 nt, Human
cuccuccuagcc

SEQ ID NO: 3198344 - RNA, 23 nt, Human
cuccucccaggcgccccuucccc

SEQ ID NO: 3198345 - RNA, 22 nt, Human
cuccucccaggcgccccuuccc

SEQ ID NO: 3198346 - RNA, 18 nt, Human
cuccucccacugcccacu

SEQ ID NO: 3198347 - RNA, 17 nt, Human
cuccucccacugcccac

SEQ ID NO: 3198348 - RNA, 17 nt, Human
cuccucccaggcgcccc

SEQ ID NO: 3198349 - RNA, 15 nt, Human
cuccucccacugccc

SEQ ID NO: 3198350 - RNA, 14 nt, Human
cuccucccacugcc

SEQ ID NO: 3198351 - RNA, 13 nt, Human
cuccucccacugc

SEQ ID NO: 3198352 - RNA, 12 nt, Human
cuccucccacug

SEQ ID NO: 3198353 - RNA, 14 nt, Human
cuccuccuggacuc

SEQ ID NO: 3198354 - RNA, 15 nt, Human
cuccuccuggacucc

SEQ ID NO: 3198355 - RNA, 19 nt, Human
cuccuccuggacuccugca

SEQ ID NO: 3198356 - RNA, 15 nt, Human
cuccuccagccgcca

SEQ ID NO: 3198357 - RNA, 13 nt, Human
cuccuccagaguc

SEQ ID NO: 3198358 - RNA, 15 nt, Human
cuccuccagagucag

SEQ ID NO: 3198359 - RNA, 13 nt, Human
cuccucaggacca

SEQ ID NO: 3198360 - RNA, 12 nt, Human
cuccucaggacc

SEQ ID NO: 3198361 - RNA, 15 nt, Human
cuccgaccagacacc

SEQ ID NO: 3198362 - RNA, 19 nt, Human
cucccuuggggccuaugca

SEQ ID NO: 3198363 - RNA, 20 nt, Human
cucccuuggauuguccccga

SEQ ID NO: 3198364 - RNA, 18 nt, Human
cuccucagaucuucugug

SEQ ID NO: 3198365 - RNA, 18 nt, Human
cuccuaugcuuuagcuua

SEQ ID NO: 3198366 - RNA, 13 nt, Human
cuccuaugcuuua

SEQ ID NO: 3198367 - RNA, 22 nt, Human
cuccuaucagaaguuucucagc

SEQ ID NO: 3198368 - RNA, 22 nt, Human
cuccgacuugugcacaggcaga

SEQ ID NO: 3198369 - RNA, 12 nt, Human
cuccccuccucc

SEQ ID NO: 3198370 - RNA, 20 nt, Human
cuccccuccuccuggacucc

SEQ ID NO: 3198371 - RNA, 21 nt, Human
cuccccagcaagugagagcug

SEQ ID NO: 3198372 - RNA, 13 nt, Human
cuccauccugagg

SEQ ID NO: 3198373 - RNA, 23 nt, Human
cuccccagcaagugagagcuggg

SEQ ID NO: 3198374 - RNA, 22 nt, Human
cuccccagcaagugagagcugg

SEQ ID NO: 3198375 - RNA, 14 nt, Human
cuccccuuccauuu

SEQ ID NO: 3198376 - RNA, 23 nt, Human
cuccccugugccagcccagaggc

SEQ ID NO: 3198377 - RNA, 16 nt, Human
cuccccugugccagcc

SEQ ID NO: 3198378 - RNA, 18 nt, Human
cuccccugugccagccca

SEQ ID NO: 3198379 - RNA, 16 nt, Human
cuccccuuccauuucu

SEQ ID NO: 3198380 - RNA, 18 nt, Human
cuccccuucccagggcaa

SEQ ID NO: 3198381 - RNA, 12 nt, Human
cuccccuuccca

SEQ ID NO: 3198382 - RNA, 23 nt, Human
cuccccuuccccuuccuucuuug

SEQ ID NO: 3198383 - RNA, 19 nt, Human
cuccccuuccccuuccuuc

SEQ ID NO: 3198384 - RNA, 17 nt, Human
cuccccuuccccuuccu

SEQ ID NO: 3198385 - RNA, 12 nt, Human
cuccccuucccc

SEQ ID NO: 3198386 - RNA, 15 nt, Human
cucccggugcccaag

SEQ ID NO: 3198387 - RNA, 21 nt, Human
cucccggugcccaagaauaga

SEQ ID NO: 3198388 - RNA, 23 nt, Human
cucccgcccaaaccuuuccccca

SEQ ID NO: 3198389 - RNA, 21 nt, Human
cucccgcccaaaccuuucccc

SEQ ID NO: 3198390 - RNA, 16 nt, Human
cucccgccuccaaccc

SEQ ID NO: 3198391 - RNA, 20 nt, Human
cucccgaguagcugggacua

SEQ ID NO: 3198392 - RNA, 19 nt, Human
cucccgaguagcugggacu

SEQ ID NO: 3198393 - RNA, 18 nt, Human
cucccgaguagcugggac

SEQ ID NO: 3198394 - RNA, 17 nt, Human
cuccccuugccagcugc

SEQ ID NO: 3198395 - RNA, 16 nt, Human
cuccccuugccagcug

SEQ ID NO: 3198396 - RNA, 15 nt, Human
cuccccuugccagcu

SEQ ID NO: 3198397 - RNA, 14 nt, Human
cuccccuugccagc

SEQ ID NO: 3198398 - RNA, 13 nt, Human
cuccccuugccag

SEQ ID NO: 3198399 - RNA, 17 nt, Human
cucccugccccccagcc

SEQ ID NO: 3198400 - RNA, 23 nt, Human
cucccugccccccagcccuccuu

SEQ ID NO: 3198401 - RNA, 14 nt, Human
cucccugccccucc

SEQ ID NO: 3198402 - RNA, 13 nt, Human
cucccugccccuc

SEQ ID NO: 3198403 - RNA, 21 nt, Human
cucccguguaucuggacacug

SEQ ID NO: 3198404 - RNA, 22 nt, Human
cucccguguaggaaccugcaca

SEQ ID NO: 3198405 - RNA, 12 nt, Human
cucccugccagu

SEQ ID NO: 3198406 - RNA, 21 nt, Human
cucccugccccucccuucaac

SEQ ID NO: 3198407 - RNA, 20 nt, Human
cucccugccccucccuucaa

SEQ ID NO: 3198408 - RNA, 18 nt, Human
cucccugccccucccuuc

SEQ ID NO: 3198409 - RNA, 17 nt, Human
cucccugccccucccuu

SEQ ID NO: 3198410 - RNA, 21 nt, Human
cuccaaugcuguuaucccugc

SEQ ID NO: 3198411 - RNA, 22 nt, Human
cuccaaucccaccaacccucag

SEQ ID NO: 3198412 - RNA, 23 nt, Human
cuccaauuuuuuaagugaaaaua

SEQ ID NO: 3198413 - RNA, 15 nt, Human
cuccaauuuuuuaag

SEQ ID NO: 3198414 - RNA, 21 nt, Human
cuccacacacacaaaaaaaga

SEQ ID NO: 3198415 - RNA, 15 nt, Human
cuccacacacacaaa

SEQ ID NO: 3198416 - RNA, 14 nt, Human
cuccacacacacaa

SEQ ID NO: 3198417 - RNA, 13 nt, Human
cuccacacccgcg

SEQ ID NO: 3198418 - RNA, 19 nt, Human
cuccacacccgcgccccgc

SEQ ID NO: 3198419 - RNA, 23 nt, Human
cuccaccaagccuggucagccca

SEQ ID NO: 3198420 - RNA, 13 nt, Human
cuccacccugcuc

SEQ ID NO: 3198421 - RNA, 15 nt, Human
cuccacccugcucuc

SEQ ID NO: 3198422 - RNA, 19 nt, Human
cucauuacuuguugccuau

SEQ ID NO: 3198423 - RNA, 19 nt, Human
cucauuagaauuaccauuu

SEQ ID NO: 3198424 - RNA, 17 nt, Human
cucauuugucacacacu

SEQ ID NO: 3198425 - RNA, 12 nt, Human
cuccaaagaaau

SEQ ID NO: 3198426 - RNA, 13 nt, Human
cuccaaagaaaug

SEQ ID NO: 3198427 - RNA, 21 nt, Human
cuccaaaaaaaaaaaaaauac

SEQ ID NO: 3198428 - RNA, 23 nt, Human
cuccaaaaaaaaaaaaaauacaa

SEQ ID NO: 3198429 - RNA, 13 nt, Human
cuccaccugcucu

SEQ ID NO: 3198430 - RNA, 15 nt, Human
cuccagccccuggau

SEQ ID NO: 3198431 - RNA, 12 nt, Human
cuccaccugcca

SEQ ID NO: 3198432 - RNA, 13 nt, Human
cuccaccugccag

SEQ ID NO: 3198433 - RNA, 14 nt, Human
cuccaccugccagg

SEQ ID NO: 3198434 - RNA, 20 nt, Human
cuccagccccuggaugcagc

SEQ ID NO: 3198435 - RNA, 16 nt, Human
cuccagccccuggaug

SEQ ID NO: 3198436 - RNA, 17 nt, Human
cuccagccccuggaugc

SEQ ID NO: 3198437 - RNA, 12 nt, Human
cuccagccuggg

SEQ ID NO: 3198438 - RNA, 12 nt, Human
cuccauccugag

SEQ ID NO: 3198439 - RNA, 11 nt, Human
cuccauccuga

SEQ ID NO: 3198440 - RNA, 18 nt, Human
cuccaggagcagccacau

SEQ ID NO: 3198441 - RNA, 23 nt, Human
cuccaggagcagccacauuccug

SEQ ID NO: 3198442 - RNA, 12 nt, Human
cuccaggcagca

SEQ ID NO: 3198443 - RNA, 11 nt, Human
cuccaggcagc

SEQ ID NO: 3198444 - RNA, 14 nt, Human
cuccaggagcagcc

SEQ ID NO: 3198445 - RNA, 15 nt, Human
cuccaggagcagcca

SEQ ID NO: 3198446 - RNA, 16 nt, Human
cuccaggagcagccac

SEQ ID NO: 3198447 - RNA, 17 nt, Human
cuccaggagcagccaca

SEQ ID NO: 3198448 - RNA, 11 nt, Human
cuccaggagca

SEQ ID NO: 3198449 - RNA, 13 nt, Human
cuccaggagcagc

SEQ ID NO: 3198450 - RNA, 20 nt, Human
cucauaguaugguggcuggg

SEQ ID NO: 3198451 - RNA, 23 nt, Human
cucauaguaugguggcuggguug

SEQ ID NO: 3198452 - RNA, 21 nt, Human
cucaucaccaacgucugugcc

SEQ ID NO: 3198453 - RNA, 20 nt, Human
cucauauccccuauuuaaca

SEQ ID NO: 3198454 - RNA, 22 nt, Human
cucaucaccaacgucugugcca

SEQ ID NO: 3198455 - RNA, 20 nt, Human
cucaucagaaacaauuucug

SEQ ID NO: 3198456 - RNA, 17 nt, Human
cucaucaugucuauugu

SEQ ID NO: 3198457 - RNA, 15 nt, Human
cucauccucauaccc

SEQ ID NO: 3198458 - RNA, 16 nt, Human
cucauacccaccccca

SEQ ID NO: 3198459 - RNA, 18 nt, Human
cucauacccacccccacc

SEQ ID NO: 3198460 - RNA, 19 nt, Human
cucauacccacccccaccc

SEQ ID NO: 3198461 - RNA, 21 nt, Human
cucauacccacccccacccaa

SEQ ID NO: 3198462 - RNA, 19 nt, Human
cucaggugauccacccacc

SEQ ID NO: 3198463 - RNA, 18 nt, Human
cucaggugauccacccac

SEQ ID NO: 3198464 - RNA, 14 nt, Human
cucagggucccugg

SEQ ID NO: 3198465 - RNA, 20 nt, Human
cucaggugauccacccaccu

SEQ ID NO: 3198466 - RNA, 22 nt, Human
cucauacucaccucaccccacu

SEQ ID NO: 3198467 - RNA, 14 nt, Human
cucauacucaccuc

SEQ ID NO: 3198468 - RNA, 15 nt, Human
cucauacccaccccc

SEQ ID NO: 3198469 - RNA, 21 nt, Human
cucauaguaugguggcugggu

SEQ ID NO: 3198470 - RNA, 20 nt, Human
cucauagcccucacccuggg

SEQ ID NO: 3198471 - RNA, 21 nt, Human
cucauagcccucacccugggg

SEQ ID NO: 3198472 - RNA, 13 nt, Human
cucauagcccuca

SEQ ID NO: 3198473 - RNA, 17 nt, Human
cucauagcccucacccu

SEQ ID NO: 3198474 - RNA, 16 nt, Human
cucaggugagaagcag

SEQ ID NO: 3198475 - RNA, 14 nt, Human
cucaggugagaagc

SEQ ID NO: 3198476 - RNA, 19 nt, Human
cucaggugagaagcagagg

SEQ ID NO: 3198477 - RNA, 20 nt, Human
cucaggugagaagcagagga

SEQ ID NO: 3198478 - RNA, 15 nt, Human
cucagggucccuggu

SEQ ID NO: 3198479 - RNA, 16 nt, Human
cucagggucccuggug

SEQ ID NO: 3198480 - RNA, 17 nt, Human
cucagggucccuggugg

SEQ ID NO: 3198481 - RNA, 14 nt, Human
cucagggccugguc

SEQ ID NO: 3198482 - RNA, 15 nt, Human
cucagggccuggucg

SEQ ID NO: 3198483 - RNA, 16 nt, Human
cucagggccuggcuca

SEQ ID NO: 3198484 - RNA, 14 nt, Human
cucagggccuggcu

SEQ ID NO: 3198485 - RNA, 15 nt, Human
cucagggccuggcuc

SEQ ID NO: 3198486 - RNA, 13 nt, Human
cucagggccuggc

SEQ ID NO: 3198487 - RNA, 18 nt, Human
cucaggaguuugagacca

SEQ ID NO: 3198488 - RNA, 23 nt, Human
cucaggaguuugagaccaaccug

SEQ ID NO: 3198489 - RNA, 19 nt, Human
cucagcccacauagugaug

SEQ ID NO: 3198490 - RNA, 18 nt, Human
cucagcauccuggcaccc

SEQ ID NO: 3198491 - RNA, 15 nt, Human
cucagcauccuggca

SEQ ID NO: 3198492 - RNA, 20 nt, Human
cugccuucgguacccaccac

SEQ ID NO: 3198493 - RNA, 19 nt, Human
cugccuucgguacccacca

SEQ ID NO: 3198494 - RNA, 18 nt, Human
cugccuucgguacccacc

SEQ ID NO: 3198495 - RNA, 21 nt, Human
cugccucugacacacagcucu

SEQ ID NO: 3198496 - RNA, 18 nt, Human
cugccucugacacacagc

SEQ ID NO: 3198497 - RNA, 15 nt, Human
cugccucugacacac

SEQ ID NO: 3198498 - RNA, 17 nt, Human
cugccucugacacacag

SEQ ID NO: 3198499 - RNA, 22 nt, Human
cugccugcccaggccccugcca

SEQ ID NO: 3198500 - RNA, 21 nt, Human
cugccugcccaggccccugcc

SEQ ID NO: 3198501 - RNA, 11 nt, Human
cugccugcccu

SEQ ID NO: 3198502 - RNA, 18 nt, Human
cugcgguccacccaggag

SEQ ID NO: 3198503 - RNA, 17 nt, Human
cugcgguccacccagga

SEQ ID NO: 3198504 - RNA, 20 nt, Human
cugcgguccacccaggagcc

SEQ ID NO: 3198505 - RNA, 19 nt, Human
cugcgguccacccaggagc

SEQ ID NO: 3198506 - RNA, 21 nt, Human
cugccuuuggcacucugacuu

SEQ ID NO: 3198507 - RNA, 13 nt, Human
cugccuuuuguuc

SEQ ID NO: 3198508 - RNA, 14 nt, Human
cugccuccagaaug

SEQ ID NO: 3198509 - RNA, 22 nt, Human
cugccuccagaauggucuuucu

SEQ ID NO: 3198510 - RNA, 23 nt, Human
cugccuaggauucacaccccacc

SEQ ID NO: 3198511 - RNA, 21 nt, Human
cugccuaggauucacacccca

SEQ ID NO: 3198512 - RNA, 14 nt, Human
cugccucagccucc

SEQ ID NO: 3198513 - RNA, 15 nt, Human
cugccucagccuccc

SEQ ID NO: 3198514 - RNA, 19 nt, Human
cugccucagccucccaaag

SEQ ID NO: 3198515 - RNA, 17 nt, Human
cugccucagccucccga

SEQ ID NO: 3198516 - RNA, 19 nt, Human
cugccgcagcccugcagag

SEQ ID NO: 3198517 - RNA, 20 nt, Human
cugccgcagcccugcagagg

SEQ ID NO: 3198518 - RNA, 21 nt, Human
cugccgcagcccugcagaggg

SEQ ID NO: 3198519 - RNA, 22 nt, Human
cugccgcagcccugcagagggc

SEQ ID NO: 3198520 - RNA, 23 nt, Human
cugccgcagcccugcagagggca

SEQ ID NO: 3198521 - RNA, 20 nt, Human
cugccgccgcuagguagagu

SEQ ID NO: 3198522 - RNA, 12 nt, Human
cugccgcagccc

SEQ ID NO: 3198523 - RNA, 13 nt, Human
cugccgcagcccu

SEQ ID NO: 3198524 - RNA, 22 nt, Human
cugccccugccuuggggucagg

SEQ ID NO: 3198525 - RNA, 12 nt, Human
cugccccugccu

SEQ ID NO: 3198526 - RNA, 18 nt, Human
cugccccugcuacugcca

SEQ ID NO: 3198527 - RNA, 13 nt, Human
cugccccugcccc

SEQ ID NO: 3198528 - RNA, 20 nt, Human
cugccccuccucucugcccu

SEQ ID NO: 3198529 - RNA, 21 nt, Human
cugccccuccucucugcccua

SEQ ID NO: 3198530 - RNA, 23 nt, Human
cugccacucaggcccaaagccuc

SEQ ID NO: 3198531 - RNA, 16 nt, Human
cugccacucaggccca

SEQ ID NO: 3198532 - RNA, 11 nt, Human
cugccaggcau

SEQ ID NO: 3198533 - RNA, 13 nt, Human
cugccaggcaugg

SEQ ID NO: 3198534 - RNA, 14 nt, Human
cugcccaccuggcc

SEQ ID NO: 3198535 - RNA, 15 nt, Human
cugcccaccuggccu

SEQ ID NO: 3198536 - RNA, 13 nt, Human
cugcccaccuggc

SEQ ID NO: 3198537 - RNA, 14 nt, Human
cugccaugccagcu

SEQ ID NO: 3198538 - RNA, 17 nt, Human
cugcccaccuggccucu

SEQ ID NO: 3198539 - RNA, 18 nt, Human
cugcccaccuggccucug

SEQ ID NO: 3198540 - RNA, 19 nt, Human
cugcccaccuggccucugc

SEQ ID NO: 3198541 - RNA, 20 nt, Human
cugcccaccuggccucugca

SEQ ID NO: 3198542 - RNA, 22 nt, Human
cugcccaccuggccucugcacu

SEQ ID NO: 3198543 - RNA, 14 nt, Human
cugcccacucccug

SEQ ID NO: 3198544 - RNA, 15 nt, Human
cugcccacucccugc

SEQ ID NO: 3198545 - RNA, 16 nt, Human
cugcccacucccugca

SEQ ID NO: 3198546 - RNA, 18 nt, Human
cugcccacucccugcaac

SEQ ID NO: 3198547 - RNA, 16 nt, Human
cugcccacuggccggc

SEQ ID NO: 3198548 - RNA, 17 nt, Human
cugcccagccuccaagc

SEQ ID NO: 3198549 - RNA, 18 nt, Human
cugcccagaucagccaga

SEQ ID NO: 3198550 - RNA, 21 nt, Human
cugcccagaucagccagaagc

SEQ ID NO: 3198551 - RNA, 20 nt, Human
cugcccagaucagccagaag

SEQ ID NO: 3198552 - RNA, 17 nt, Human
cugcccagcccccuggu

SEQ ID NO: 3198553 - RNA, 22 nt, Human
cugcccagaucagccagaagcc

SEQ ID NO: 3198554 - RNA, 20 nt, Human
cugcaucagcugcugaaaca

SEQ ID NO: 3198555 - RNA, 17 nt, Human
cugcaguugccagucac

SEQ ID NO: 3198556 - RNA, 12 nt, Human
cugcaucaucuu

SEQ ID NO: 3198557 - RNA, 21 nt, Human
cugcaguugccagucaccccg

SEQ ID NO: 3198558 - RNA, 22 nt, Human
cugcaguugccagucaccccgg

SEQ ID NO: 3198559 - RNA, 19 nt, Human
cugcaguugccagucaccc

SEQ ID NO: 3198560 - RNA, 24 nt, Human
cugcacuugggggcucagcaaggc

SEQ ID NO: 3198561 - RNA, 23 nt, Human
cugcacuugggggcucagcaagg

SEQ ID NO: 3198562 - RNA, 17 nt, Human
cugcagaacagcuucau

SEQ ID NO: 3198563 - RNA, 23 nt, Human
cugcacuugcagacucuacagag

SEQ ID NO: 3198564 - RNA, 17 nt, Human
cugcacuugcagacucu

SEQ ID NO: 3198565 - RNA, 15 nt, Human
cugcacuugggggcu

SEQ ID NO: 3198566 - RNA, 21 nt, Human
cugcacuugggggcucagcaa

SEQ ID NO: 3198567 - RNA, 20 nt, Human
cugcacuugggggcucagca

SEQ ID NO: 3198568 - RNA, 19 nt, Human
cugcacuugggggcucagc

SEQ ID NO: 3198569 - RNA, 16 nt, Human
cugcaucguuucaucu

SEQ ID NO: 3198570 - RNA, 20 nt, Human
cugcauccuccgccucccgg

SEQ ID NO: 3198571 - RNA, 19 nt, Human
cugcauccuccgccucccg

SEQ ID NO: 3198572 - RNA, 22 nt, Human
cugcaucguuucaucuuccaac

SEQ ID NO: 3198573 - RNA, 17 nt, Human
cugccaaugggagcuca

SEQ ID NO: 3198574 - RNA, 18 nt, Human
cugccaaugggagcucau

SEQ ID NO: 3198575 - RNA, 19 nt, Human
cugccaaugggagcucaug

SEQ ID NO: 3198576 - RNA, 19 nt, Human
cugccacaaggaagaaauu

SEQ ID NO: 3198577 - RNA, 18 nt, Human
cugccacaaggaagaaau

SEQ ID NO: 3198578 - RNA, 18 nt, Human
cugcaugcgggcuuccuc

SEQ ID NO: 3198579 - RNA, 22 nt, Human
cugcaugcgggcuuccuccugg

SEQ ID NO: 3198580 - RNA, 18 nt, Human
cugcaucuugguuauuuc

SEQ ID NO: 3198581 - RNA, 13 nt, Human
cugauuguauuua

SEQ ID NO: 3198582 - RNA, 17 nt, Human
cugauugugucucuugg

SEQ ID NO: 3198583 - RNA, 21 nt, Human
cugauugguuucucuucuccc

SEQ ID NO: 3198584 - RNA, 19 nt, Human
cugauugguuucucuucuc

SEQ ID NO: 3198585 - RNA, 18 nt, Human
cugauugguuucucuucu

SEQ ID NO: 3198586 - RNA, 16 nt, Human
cugauugguuucucuu

SEQ ID NO: 3198587 - RNA, 17 nt, Human
cugauggugcaaugacc

SEQ ID NO: 3198588 - RNA, 19 nt, Human
cugauggugcaaugaccuu

SEQ ID NO: 3198589 - RNA, 20 nt, Human
cugauggugcaaugaccuuu

SEQ ID NO: 3198590 - RNA, 21 nt, Human
cugauggugcaaugaccuuuc

SEQ ID NO: 3198591 - RNA, 14 nt, Human
cugauuucuccugc

SEQ ID NO: 3198592 - RNA, 13 nt, Human
cugauuucuuuuc

SEQ ID NO: 3198593 - RNA, 21 nt, Human
cugauugugucucuugguccu

SEQ ID NO: 3198594 - RNA, 14 nt, Human
cugauuuauuuugu

SEQ ID NO: 3198595 - RNA, 17 nt, Human
cugauuuauuuuguaug

SEQ ID NO: 3198596 - RNA, 18 nt, Human
cugauuuauuuuguauga

SEQ ID NO: 3198597 - RNA, 23 nt, Human
cugauuuauuuuguaugaaauau

SEQ ID NO: 3198598 - RNA, 16 nt, Human
cugauuuuuuuuuccu

SEQ ID NO: 3198599 - RNA, 18 nt, Human
cugauuuuuuuuuccuuc

SEQ ID NO: 3198600 - RNA, 19 nt, Human
cugauuuuuuuuuccuuca

SEQ ID NO: 3198601 - RNA, 20 nt, Human
cugauuuuuuuuuccuucag

SEQ ID NO: 3198602 - RNA, 10 nt, Human
cugauuuuau

SEQ ID NO: 3198603 - RNA, 15 nt, Human
cugauuuuauucuug

SEQ ID NO: 3198604 - RNA, 12 nt, Human
cugauuuuauuc

SEQ ID NO: 3198605 - RNA, 17 nt, Human
cugauuuuauucuugau

SEQ ID NO: 3198606 - RNA, 16 nt, Human
cugauuuuauucuuga

SEQ ID NO: 3198607 - RNA, 19 nt, Human
cugauuugggcugaaugua

SEQ ID NO: 3198608 - RNA, 20 nt, Human
cugauuugggcugaauguau

SEQ ID NO: 3198609 - RNA, 23 nt, Human
cugauuugggcugaauguaugua

SEQ ID NO: 3198610 - RNA, 16 nt, Human
cugauuuguuccuucu

SEQ ID NO: 3198611 - RNA, 21 nt, Human
cugauuuuuuuuuccuucagu

SEQ ID NO: 3198612 - RNA, 22 nt, Human
cugauuuuuuuuuccuucagug

SEQ ID NO: 3198613 - RNA, 23 nt, Human
cugauuuuuuuuuccuucagugc

SEQ ID NO: 3198614 - RNA, 18 nt, Human
cugauuuuauucuugauc

SEQ ID NO: 3198615 - RNA, 13 nt, Human
cugcaaagcccag

SEQ ID NO: 3198616 - RNA, 15 nt, Human
cugcaaagcccagcu

SEQ ID NO: 3198617 - RNA, 16 nt, Human
cugcaaaaccagguuu

SEQ ID NO: 3198618 - RNA, 14 nt, Human
cugcaaaaccaggu

SEQ ID NO: 3198619 - RNA, 13 nt, Human
cugcaaagcaugu

SEQ ID NO: 3198620 - RNA, 18 nt, Human
cugcaauaaggggagagu

SEQ ID NO: 3198621 - RNA, 22 nt, Human
cugcacaagcugcacccucagg

SEQ ID NO: 3198622 - RNA, 18 nt, Human
cugcacaagcugcacccu

SEQ ID NO: 3198623 - RNA, 13 nt, Human
cugcacacagcac

SEQ ID NO: 3198624 - RNA, 14 nt, Human
cugcacacaaauau

SEQ ID NO: 3198625 - RNA, 22 nt, Human
cugcacagugcaucucagccca

SEQ ID NO: 3198626 - RNA, 14 nt, Human
cugcacacagcacg

SEQ ID NO: 3198627 - RNA, 20 nt, Human
cugcacacgcuccuuccucu

SEQ ID NO: 3198628 - RNA, 22 nt, Human
cugcacacgcuccuuccucuga

SEQ ID NO: 3198629 - RNA, 21 nt, Human
cugcacaccuugaaucugccu

SEQ ID NO: 3198630 - RNA, 14 nt, Human
cugcaccccuuccu

SEQ ID NO: 3198631 - RNA, 16 nt, Human
cugcaccccuuccugg

SEQ ID NO: 3198632 - RNA, 15 nt, Human
cugcaccccuuccug

SEQ ID NO: 3198633 - RNA, 22 nt, Human
cugcacaugauuucacaaauau

SEQ ID NO: 3198634 - RNA, 21 nt, Human
cugcacaugauuucacaaaua

SEQ ID NO: 3198635 - RNA, 18 nt, Human
cugcacaugauuucacaa

SEQ ID NO: 3198636 - RNA, 17 nt, Human
cugcacaugauuucaca

SEQ ID NO: 3198637 - RNA, 16 nt, Human
cugcacaugauuucac

SEQ ID NO: 3198638 - RNA, 15 nt, Human
cugcacaugauuuca

SEQ ID NO: 3198639 - RNA, 16 nt, Human
cugcacuccccugcug

SEQ ID NO: 3198640 - RNA, 17 nt, Human
cugcacuccccugcugg

SEQ ID NO: 3198641 - RNA, 15 nt, Human
cugcacucucauugu

SEQ ID NO: 3198642 - RNA, 18 nt, Human
cugcacuugcagacucua

SEQ ID NO: 3198643 - RNA, 15 nt, Human
cugcacugacucugg

SEQ ID NO: 3198644 - RNA, 14 nt, Human
cugcacugacucug

SEQ ID NO: 3198645 - RNA, 18 nt, Human
cugcacugacucuggaaa

SEQ ID NO: 3198646 - RNA, 16 nt, Human
cugcacugacucugga

SEQ ID NO: 3198647 - RNA, 13 nt, Human
cugcacccucagg

SEQ ID NO: 3198648 - RNA, 14 nt, Human
cugcacccucaggc

SEQ ID NO: 3198649 - RNA, 20 nt, Human
cugcaccggcuggccuggcc

SEQ ID NO: 3198650 - RNA, 22 nt, Human
cugcaccggcuggccuggcccc

SEQ ID NO: 3198651 - RNA, 14 nt, Human
cugcacuccccugc

SEQ ID NO: 3198652 - RNA, 21 nt, Human
cugcaccccuuccugggcaca

SEQ ID NO: 3198653 - RNA, 20 nt, Human
cugcaccccuuccugggcac

SEQ ID NO: 3198654 - RNA, 19 nt, Human
cugcaccccuuccugggca

SEQ ID NO: 3198655 - RNA, 17 nt, Human
cugcaccccuuccuggg

SEQ ID NO: 3198656 - RNA, 15 nt, Human
cugcacuccccugcu

SEQ ID NO: 3198657 - RNA, 23 nt, Human
cugcaccggcuggccuggccccu

SEQ ID NO: 3198658 - RNA, 12 nt, Human
cugcaccgggcc

SEQ ID NO: 3198659 - RNA, 18 nt, Human
cugaguuccuagccaccg

SEQ ID NO: 3198660 - RNA, 17 nt, Human
cugaguuccuagccacc

SEQ ID NO: 3198661 - RNA, 16 nt, Human
cugaguuccuagccac

SEQ ID NO: 3198662 - RNA, 15 nt, Human
cugaguuccuagcca

SEQ ID NO: 3198663 - RNA, 22 nt, Human
cugagugggggaucacagccuc

SEQ ID NO: 3198664 - RNA, 20 nt, Human
cugagucuguucugguaauc

SEQ ID NO: 3198665 - RNA, 18 nt, Human
cugagucugaaggcuggg

SEQ ID NO: 3198666 - RNA, 19 nt, Human
cugagucugaaggcugggu

SEQ ID NO: 3198667 - RNA, 17 nt, Human
cugagucugaaggcugg

SEQ ID NO: 3198668 - RNA, 22 nt, Human
cugauaaauauucacacuugaa

SEQ ID NO: 3198669 - RNA, 19 nt, Human
cugaguuaggcuuucucuu

SEQ ID NO: 3198670 - RNA, 13 nt, Human
cugaguuccugag

SEQ ID NO: 3198671 - RNA, 19 nt, Human
cugaguuccggcaccagua

SEQ ID NO: 3198672 - RNA, 21 nt, Human
cugaguucuguguauuuucag

SEQ ID NO: 3198673 - RNA, 17 nt, Human
cugaguugaagagggga

SEQ ID NO: 3198674 - RNA, 14 nt, Human
cugaguugaagagg

SEQ ID NO: 3198675 - RNA, 22 nt, Human
cugaguugaagucaugcucccc

SEQ ID NO: 3198676 - RNA, 17 nt, Human
cugaguuguuaccccaa

SEQ ID NO: 3198677 - RNA, 16 nt, Human
cugaguuguuacccca

SEQ ID NO: 3198678 - RNA, 20 nt, Human
cugauccuaguuccaccauc

SEQ ID NO: 3198679 - RNA, 21 nt, Human
cugauccuaguuccaccauca

SEQ ID NO: 3198680 - RNA, 18 nt, Human
cugaucccuuccaccugc

SEQ ID NO: 3198681 - RNA, 14 nt, Human
cugaucccuuccac

SEQ ID NO: 3198682 - RNA, 20 nt, Human
cugaucccugaucccuucca

SEQ ID NO: 3198683 - RNA, 17 nt, Human
cugaucccugaucccuu

SEQ ID NO: 3198684 - RNA, 15 nt, Human
cugauggugcaauga

SEQ ID NO: 3198685 - RNA, 16 nt, Human
cugauggugcaaugac

SEQ ID NO: 3198686 - RNA, 14 nt, Human
cugauggugcaaug

SEQ ID NO: 3198687 - RNA, 21 nt, Human
cugaucccuuccaccugcucu

SEQ ID NO: 3198688 - RNA, 14 nt, Human
cugauauauuuaaa

SEQ ID NO: 3198689 - RNA, 16 nt, Human
cugauauugaaguaaa

SEQ ID NO: 3198690 - RNA, 14 nt, Human
cugauauugaagua

SEQ ID NO: 3198691 - RNA, 20 nt, Human
cugauauucaaauggacaaa

SEQ ID NO: 3198692 - RNA, 13 nt, Human
cugauauguuugu

SEQ ID NO: 3198693 - RNA, 20 nt, Human
cugauauuaauuuaucagau

SEQ ID NO: 3198694 - RNA, 23 nt, Human
cugauauuaauuuaucagauugc

SEQ ID NO: 3198695 - RNA, 15 nt, Human
cugaucaccugcccu

SEQ ID NO: 3198696 - RNA, 15 nt, Human
cugaucacugaaaua

SEQ ID NO: 3198697 - RNA, 15 nt, Human
cugaggcuccacuug

SEQ ID NO: 3198698 - RNA, 21 nt, Human
cugaggcuccacuuggucugu

SEQ ID NO: 3198699 - RNA, 24 nt, Human
cugaggcccuucucuccagccccu

SEQ ID NO: 3198700 - RNA, 20 nt, Human
cugaggccguugcugacuua

SEQ ID NO: 3198701 - RNA, 15 nt, Human
cugagcccccagcuu

SEQ ID NO: 3198702 - RNA, 14 nt, Human
cugagcccccagcu

SEQ ID NO: 3198703 - RNA, 23 nt, Human
cugagcccccagcuuccagcagg

SEQ ID NO: 3198704 - RNA, 22 nt, Human
cugagcccccagcuuccagcag

SEQ ID NO: 3198705 - RNA, 18 nt, Human
cugagcccccagcuucca

SEQ ID NO: 3198706 - RNA, 17 nt, Human
cugagcccccagcuucc

SEQ ID NO: 3198707 - RNA, 15 nt, Human
cugaggcugggcucc

SEQ ID NO: 3198708 - RNA, 16 nt, Human
cugaggcugggcuccc

SEQ ID NO: 3198709 - RNA, 17 nt, Human
cugaggcugggcucccu

SEQ ID NO: 3198710 - RNA, 22 nt, Human
cugaggcugggcucccuuccca

SEQ ID NO: 3198711 - RNA, 13 nt, Human
cugaggcugggcu

SEQ ID NO: 3198712 - RNA, 16 nt, Human
cucugauacuuuuuug

SEQ ID NO: 3198713 - RNA, 14 nt, Human
cucugauacuuuuu

SEQ ID NO: 3198714 - RNA, 14 nt, Human
cucugcacaagcug

SEQ ID NO: 3198715 - RNA, 15 nt, Human
cucugcacaagcugc

SEQ ID NO: 3198716 - RNA, 10 nt, Human
cucugcacaa

SEQ ID NO: 3198717 - RNA, 23 nt, Human
cucugaguuccggcaccaguagc

SEQ ID NO: 3198718 - RNA, 13 nt, Human
cucugcacaagcu

SEQ ID NO: 3198719 - RNA, 21 nt, Human
cucugaguuccggcaccagua

SEQ ID NO: 3198720 - RNA, 20 nt, Human
cucugaguuccggcaccagu

SEQ ID NO: 3198721 - RNA, 19 nt, Human
cucugaguuccggcaccag

SEQ ID NO: 3198722 - RNA, 18 nt, Human
cucugcccacucccugca

SEQ ID NO: 3198723 - RNA, 20 nt, Human
cucugcccacucccugcaac

SEQ ID NO: 3198724 - RNA, 13 nt, Human
cucugcccacucc

SEQ ID NO: 3198725 - RNA, 15 nt, Human
cucugcccacucccu

SEQ ID NO: 3198726 - RNA, 16 nt, Human
cucugcccacucccug

SEQ ID NO: 3198727 - RNA, 17 nt, Human
cucugcccacucccugc

SEQ ID NO: 3198728 - RNA, 20 nt, Human
cucugcccuaaugcgcaggc

SEQ ID NO: 3198729 - RNA, 12 nt, Human
cucugcccuugg

SEQ ID NO: 3198730 - RNA, 13 nt, Human
cucugccucccau

SEQ ID NO: 3198731 - RNA, 14 nt, Human
cucugccucccauc

SEQ ID NO: 3198732 - RNA, 16 nt, Human
cucugccucccaucac

SEQ ID NO: 3198733 - RNA, 17 nt, Human
cucugccucccaucacc

SEQ ID NO: 3198734 - RNA, 14 nt, Human
cucugaggacacua

SEQ ID NO: 3198735 - RNA, 12 nt, Human
cucugaggacac

SEQ ID NO: 3198736 - RNA, 22 nt, Human
cucugaguagggcaauggaaau

SEQ ID NO: 3198737 - RNA, 20 nt, Human
cucugagacucgcgacaaug

SEQ ID NO: 3198738 - RNA, 23 nt, Human
cucugagacucgcgacaaugcaa

SEQ ID NO: 3198739 - RNA, 12 nt, Human
cucugaggacaa

SEQ ID NO: 3198740 - RNA, 21 nt, Human
cucugagacucgcgacaaugc

SEQ ID NO: 3198741 - RNA, 15 nt, Human
cucugaccccugccu

SEQ ID NO: 3198742 - RNA, 13 nt, Human
cucugacaaagcu

SEQ ID NO: 3198743 - RNA, 14 nt, Human
cucugaauuuuaaa

SEQ ID NO: 3198744 - RNA, 23 nt, Human
cucugacagaagaaccccagggu

SEQ ID NO: 3198745 - RNA, 19 nt, Human
cucugacacacagcucugu

SEQ ID NO: 3198746 - RNA, 18 nt, Human
cucugacacacagcucug

SEQ ID NO: 3198747 - RNA, 17 nt, Human
cucugacacacagcucu

SEQ ID NO: 3198748 - RNA, 16 nt, Human
cucugacacacagcuc

SEQ ID NO: 3198749 - RNA, 15 nt, Human
cucugacacacagcu

SEQ ID NO: 3198750 - RNA, 14 nt, Human
cucugacacacagc

SEQ ID NO: 3198751 - RNA, 21 nt, Human
cucugacaacagacuucugaa

SEQ ID NO: 3198752 - RNA, 22 nt, Human
cucugacaacagacuucugaaa

SEQ ID NO: 3198753 - RNA, 22 nt, Human
cucugaaggacauugcggacag

SEQ ID NO: 3198754 - RNA, 21 nt, Human
cucugaaggaggccaccuccu

SEQ ID NO: 3198755 - RNA, 20 nt, Human
cucugaaggaggccaccucc

SEQ ID NO: 3198756 - RNA, 19 nt, Human
cucugaaggaggccaccuc

SEQ ID NO: 3198757 - RNA, 18 nt, Human
cucugaaggaggccaccu

SEQ ID NO: 3198758 - RNA, 17 nt, Human
cucugaaggaggccacc

SEQ ID NO: 3198759 - RNA, 16 nt, Human
cucugaaggaggccac

SEQ ID NO: 3198760 - RNA, 15 nt, Human
cucugaaggaggcca

SEQ ID NO: 3198761 - RNA, 14 nt, Human
cucugaaggaggcc

SEQ ID NO: 3198762 - RNA, 19 nt, Human
cucugaauaagcacuuuuu

SEQ ID NO: 3198763 - RNA, 16 nt, Human
cucugacaacagacuu

SEQ ID NO: 3198764 - RNA, 22 nt, Human
cucugaauuuaucuuugauaac

SEQ ID NO: 3198765 - RNA, 15 nt, Human
cucugaauuuaucuu

SEQ ID NO: 3198766 - RNA, 21 nt, Human
cucugaauaagcacuuuuuaa

SEQ ID NO: 3198767 - RNA, 20 nt, Human
cucugccucugacacacagc

SEQ ID NO: 3198768 - RNA, 19 nt, Human
cucugccucugacacacag

SEQ ID NO: 3198769 - RNA, 21 nt, Human
cucugccucccaucacccgcu

SEQ ID NO: 3198770 - RNA, 16 nt, Human
cucugccucugacaca

SEQ ID NO: 3198771 - RNA, 21 nt, Human
cucuggccuucggccuccauc

SEQ ID NO: 3198772 - RNA, 19 nt, Human
cucuggccuucggccucca

SEQ ID NO: 3198773 - RNA, 22 nt, Human
cucuggccuucggccuccaucc

SEQ ID NO: 3198774 - RNA, 23 nt, Human
cucuggcagcucagagagggugg

SEQ ID NO: 3198775 - RNA, 20 nt, Human
cucuggcagcucagagaggg

SEQ ID NO: 3198776 - RNA, 23 nt, Human
cucuggcagcaccgccucuuccc

SEQ ID NO: 3198777 - RNA, 22 nt, Human
cucuggcagcaccgccucuucc

SEQ ID NO: 3198778 - RNA, 13 nt, Human
cucuggcagcacc

SEQ ID NO: 3198779 - RNA, 16 nt, Human
cucuggcagcaccgcc

SEQ ID NO: 3198780 - RNA, 14 nt, Human
cucuggcagcaccg

SEQ ID NO: 3198781 - RNA, 13 nt, Human
cucugucgcccag

SEQ ID NO: 3198782 - RNA, 15 nt, Human
cucugucgcccaggc

SEQ ID NO: 3198783 - RNA, 17 nt, Human
cucugucgcccagucug

SEQ ID NO: 3198784 - RNA, 18 nt, Human
cucugucgcccaggcugg

SEQ ID NO: 3198785 - RNA, 22 nt, Human
cucugucgcccaggcuggagug

SEQ ID NO: 3198786 - RNA, 19 nt, Human
cucugucgcccagucugga

SEQ ID NO: 3198787 - RNA, 18 nt, Human
cucugucgcccagucugg

SEQ ID NO: 3198788 - RNA, 16 nt, Human
cucugucgagccuggg

SEQ ID NO: 3198789 - RNA, 19 nt, Human
cucugucuugguagguuug

SEQ ID NO: 3198790 - RNA, 22 nt, Human
cucuguccugggagugagcugg

SEQ ID NO: 3198791 - RNA, 15 nt, Human
cucuguccugggagu

SEQ ID NO: 3198792 - RNA, 13 nt, Human
cucuguccuggga

SEQ ID NO: 3198793 - RNA, 14 nt, Human
cucuguccugggag

SEQ ID NO: 3198794 - RNA, 14 nt, Human
cucugggaacuucu

SEQ ID NO: 3198795 - RNA, 22 nt, Human
cucuguugcccaggcuggagug

SEQ ID NO: 3198796 - RNA, 17 nt, Human
cucuguugcccaggcug

SEQ ID NO: 3198797 - RNA, 23 nt, Human
cucugugucagguggggcagcuu

SEQ ID NO: 3198798 - RNA, 22 nt, Human
cucugugucagguggggcagcu

SEQ ID NO: 3198799 - RNA, 21 nt, Human
cucugugucagguggggcagc

SEQ ID NO: 3198800 - RNA, 20 nt, Human
cucugugucagguggggcag

SEQ ID NO: 3198801 - RNA, 19 nt, Human
cucugugucagguggggca

SEQ ID NO: 3198802 - RNA, 13 nt, Human
cucuucuccaggc

SEQ ID NO: 3198803 - RNA, 15 nt, Human
cucuucuccaggcug

SEQ ID NO: 3198804 - RNA, 13 nt, Human
cucuucuccacug

SEQ ID NO: 3198805 - RNA, 12 nt, Human
cucuucuccacu

SEQ ID NO: 3198806 - RNA, 21 nt, Human
cucuucuagaugauuuuuuga

SEQ ID NO: 3198807 - RNA, 19 nt, Human
cucuuccuggacaggccag

SEQ ID NO: 3198808 - RNA, 15 nt, Human
cucuuccuggacagg

SEQ ID NO: 3198809 - RNA, 23 nt, Human
cucuuccuccugacaccccacuu

SEQ ID NO: 3198810 - RNA, 23 nt, Human
cucuucccgccgcccagcccacc

SEQ ID NO: 3198811 - RNA, 21 nt, Human
cucuucccgccgcccagccca

SEQ ID NO: 3198812 - RNA, 12 nt, Human
cugagcaggugu

SEQ ID NO: 3198813 - RNA, 22 nt, Human
cugagcagugauauucuuuguu

SEQ ID NO: 3198814 - RNA, 17 nt, Human
cugagcagugauauucu

SEQ ID NO: 3198815 - RNA, 13 nt, Human
cugagccagauuu

SEQ ID NO: 3198816 - RNA, 14 nt, Human
cugagccagauuuc

SEQ ID NO: 3198817 - RNA, 13 nt, Human
cugagcccacugu

SEQ ID NO: 3198818 - RNA, 12 nt, Human
cugagcccacug

SEQ ID NO: 3198819 - RNA, 11 nt, Human
cugagcccacu

SEQ ID NO: 3198820 - RNA, 10 nt, Human
cugagcccac

SEQ ID NO: 3198821 - RNA, 16 nt, Human
cugagcaggauuuuaa

SEQ ID NO: 3198822 - RNA, 20 nt, Human
cugagcacccagcucugucu

SEQ ID NO: 3198823 - RNA, 21 nt, Human
cugagaugugaacacaucagc

SEQ ID NO: 3198824 - RNA, 23 nt, Human
cugagauuauaggcaccuaccac

SEQ ID NO: 3198825 - RNA, 21 nt, Human
cugagcaaauguggcuccugg

SEQ ID NO: 3198826 - RNA, 20 nt, Human
cugagcaaauguggcuccug

SEQ ID NO: 3198827 - RNA, 17 nt, Human
cugagcaaauguggcuc

SEQ ID NO: 3198828 - RNA, 15 nt, Human
cugagcaaauguggc

SEQ ID NO: 3198829 - RNA, 20 nt, Human
cugagaaagacuauucaaac

SEQ ID NO: 3198830 - RNA, 19 nt, Human
cugagaaagacuauucaaa

SEQ ID NO: 3198831 - RNA, 20 nt, Human
cugagacagcccgggcucug

SEQ ID NO: 3198832 - RNA, 19 nt, Human
cugagacagcccgggcucu

SEQ ID NO: 3198833 - RNA, 20 nt, Human
cugagaugugaacacaucag

SEQ ID NO: 3198834 - RNA, 16 nt, Human
cugagaugugaacaca

SEQ ID NO: 3198835 - RNA, 21 nt, Human
cugagacagcccgggcucugc

SEQ ID NO: 3198836 - RNA, 15 nt, Human
cugacuacagggccg

SEQ ID NO: 3198837 - RNA, 14 nt, Human
cugacuacagggcc

SEQ ID NO: 3198838 - RNA, 11 nt, Human
cugacugaggc

SEQ ID NO: 3198839 - RNA, 13 nt, Human
cugacugacauga

SEQ ID NO: 3198840 - RNA, 14 nt, Human
cugacugaggcagu

SEQ ID NO: 3198841 - RNA, 17 nt, Human
cugacugaggcaguuug

SEQ ID NO: 3198842 - RNA, 14 nt, Human
cugacucuucccca

SEQ ID NO: 3198843 - RNA, 17 nt, Human
cugacucccccaguccc

SEQ ID NO: 3198844 - RNA, 13 nt, Human
cugacuccugguc

SEQ ID NO: 3198845 - RNA, 14 nt, Human
cugacuccuggucc

SEQ ID NO: 3198846 - RNA, 15 nt, Human
cugacuccugguccu

SEQ ID NO: 3198847 - RNA, 18 nt, Human
cugagaaagacuauucaa

SEQ ID NO: 3198848 - RNA, 15 nt, Human
cugagaaagacuauu

SEQ ID NO: 3198849 - RNA, 13 nt, Human
cugagaaagacua

SEQ ID NO: 3198850 - RNA, 12 nt, Human
cugagaaagacu

SEQ ID NO: 3198851 - RNA, 17 nt, Human
cugacuguacuccuccc

SEQ ID NO: 3198852 - RNA, 15 nt, Human
cugacugggggcaga

SEQ ID NO: 3198853 - RNA, 14 nt, Human
cugacugggggcag

SEQ ID NO: 3198854 - RNA, 15 nt, Human
cugacugggccaggg

SEQ ID NO: 3198855 - RNA, 14 nt, Human
cugacugggccagg

SEQ ID NO: 3198856 - RNA, 18 nt, Human
cugacugucacaacuccu

SEQ ID NO: 3198857 - RNA, 17 nt, Human
cugacugggggcagaca

SEQ ID NO: 3198858 - RNA, 23 nt, Human
cugaccagccuccaugcugccuc

SEQ ID NO: 3198859 - RNA, 21 nt, Human
cugaccagccuccaugcugcc

SEQ ID NO: 3198860 - RNA, 18 nt, Human
cugacagacacaggcccg

SEQ ID NO: 3198861 - RNA, 17 nt, Human
cugacagacacaggccc

SEQ ID NO: 3198862 - RNA, 15 nt, Human
cugacagacacaggc

SEQ ID NO: 3198863 - RNA, 17 nt, Human
cugaccagccuccaugc

SEQ ID NO: 3198864 - RNA, 12 nt, Human
cugaauuuggag

SEQ ID NO: 3198865 - RNA, 16 nt, Human
cugacagacacaggcc

SEQ ID NO: 3198866 - RNA, 14 nt, Human
cugaauuaauuaau

SEQ ID NO: 3198867 - RNA, 16 nt, Human
cugaauuaauuaauuu

SEQ ID NO: 3198868 - RNA, 20 nt, Human
cugaaugguuuucaaaauaa

SEQ ID NO: 3198869 - RNA, 19 nt, Human
cugaaugguuuucaaaaua

SEQ ID NO: 3198870 - RNA, 13 nt, Human
cugaauguaugua

SEQ ID NO: 3198871 - RNA, 15 nt, Human
cugaauguauguaaa

SEQ ID NO: 3198872 - RNA, 16 nt, Human
cugaauguauguaaau

SEQ ID NO: 3198873 - RNA, 23 nt, Human
cugaauggcuugcaguuguuccu

SEQ ID NO: 3198874 - RNA, 14 nt, Human
cugaaugaagcagu

SEQ ID NO: 3198875 - RNA, 14 nt, Human
cugaaguuaugugu

SEQ ID NO: 3198876 - RNA, 20 nt, Human
cugaaguuauauuuccuaua

SEQ ID NO: 3198877 - RNA, 17 nt, Human
cugaaguuauauuuccu

SEQ ID NO: 3198878 - RNA, 14 nt, Human
cugaaguuauauuu

SEQ ID NO: 3198879 - RNA, 19 nt, Human
cugaaguucugccucugau

SEQ ID NO: 3198880 - RNA, 23 nt, Human
cugaaguucugccucugauguau

SEQ ID NO: 3198881 - RNA, 20 nt, Human
cugaaguucugccucugaug

SEQ ID NO: 3198882 - RNA, 13 nt, Human
cugaaguuugaua

SEQ ID NO: 3198883 - RNA, 22 nt, Human
cugaaguuugauaaauaguguu

SEQ ID NO: 3198884 - RNA, 21 nt, Human
cugaaguuugauaaauagugu

SEQ ID NO: 3198885 - RNA, 14 nt, Human
cugaagucaguucu

SEQ ID NO: 3198886 - RNA, 14 nt, Human
cugaagucuguauu

SEQ ID NO: 3198887 - RNA, 22 nt, Human
cugaagucccagauacuugggg

SEQ ID NO: 3198888 - RNA, 17 nt, Human
cugaagucuuuguacag

SEQ ID NO: 3198889 - RNA, 20 nt, Human
cugaagucuuuguacagaca

SEQ ID NO: 3198890 - RNA, 17 nt, Human
cugaagucacacaguga

SEQ ID NO: 3198891 - RNA, 19 nt, Human
cugaagucacacagugagu

SEQ ID NO: 3198892 - RNA, 18 nt, Human
cugaagucacacagugag

SEQ ID NO: 3198893 - RNA, 21 nt, Human
cugaagucacacagugagucg

SEQ ID NO: 3198894 - RNA, 16 nt, Human
cugaagucacacagug

SEQ ID NO: 3198895 - RNA, 15 nt, Human
cugaagucacugcac

SEQ ID NO: 3198896 - RNA, 14 nt, Human
cugaagucacugca

SEQ ID NO: 3198897 - RNA, 13 nt, Human
cugaagucacugc

SEQ ID NO: 3198898 - RNA, 22 nt, Human
cugaacacauuucuuuuuaaaa

SEQ ID NO: 3198899 - RNA, 17 nt, Human
cugaacacauuucuuuu

SEQ ID NO: 3198900 - RNA, 14 nt, Human
cugaacacauuucu

SEQ ID NO: 3198901 - RNA, 13 nt, Human
cugaacacauuuc

SEQ ID NO: 3198902 - RNA, 14 nt, Human
cugaacauuggaga

SEQ ID NO: 3198903 - RNA, 14 nt, Human
cugaaccacuugua

SEQ ID NO: 3198904 - RNA, 15 nt, Human
cugaaccacuuguag

SEQ ID NO: 3198905 - RNA, 14 nt, Human
cugaacauugcaua

SEQ ID NO: 3198906 - RNA, 12 nt, Human
cugaacauugga

SEQ ID NO: 3198907 - RNA, 17 nt, Human
cugaaccacuuguagau

SEQ ID NO: 3198908 - RNA, 18 nt, Human
cugaaccacuuguagauu

SEQ ID NO: 3198909 - RNA, 22 nt, Human
cugaaccacuuguagauuugau

SEQ ID NO: 3198910 - RNA, 15 nt, Human
cugaaauaaaagcua

SEQ ID NO: 3198911 - RNA, 13 nt, Human
cugaaauaaaagc

SEQ ID NO: 3198912 - RNA, 11 nt, Human
cugaaaugugu

SEQ ID NO: 3198913 - RNA, 16 nt, Human
cugaaauguguuuccu

SEQ ID NO: 3198914 - RNA, 22 nt, Human
cugaaaugugugugaugugaca

SEQ ID NO: 3198915 - RNA, 20 nt, Human
cugaaaugugugugauguga

SEQ ID NO: 3198916 - RNA, 19 nt, Human
cugaaaugugugugaugug

SEQ ID NO: 3198917 - RNA, 18 nt, Human
cugaaaugugugugaugu

SEQ ID NO: 3198918 - RNA, 17 nt, Human
cugaaaugugugugaug

SEQ ID NO: 3198919 - RNA, 16 nt, Human
cugaaaugugugugau

SEQ ID NO: 3198920 - RNA, 13 nt, Human
cugaaaugugugu

SEQ ID NO: 3198921 - RNA, 17 nt, Human
cucuuuuaucuccugaa

SEQ ID NO: 3198922 - RNA, 16 nt, Human
cucuuuuagauauugu

SEQ ID NO: 3198923 - RNA, 23 nt, Human
cugaaagggacgcuacccgggaa

SEQ ID NO: 3198924 - RNA, 14 nt, Human
cucuuuucaaaaca

SEQ ID NO: 3198925 - RNA, 17 nt, Human
cugaaagguagacuuuu

SEQ ID NO: 3198926 - RNA, 19 nt, Human
cugaaaggcaguagucauu

SEQ ID NO: 3198927 - RNA, 20 nt, Human
cucuuuuccaaacacaggca

SEQ ID NO: 3198928 - RNA, 16 nt, Human
cucuuuuccaaacaca

SEQ ID NO: 3198929 - RNA, 22 nt, Human
cucuuuuaucuccugaaaaaag

SEQ ID NO: 3198930 - RNA, 12 nt, Human
cugaaagugaug

SEQ ID NO: 3198931 - RNA, 22 nt, Human
cucuuuggucuacacugugcug

SEQ ID NO: 3198932 - RNA, 23 nt, Human
cucuuuggucuacacugugcuga

SEQ ID NO: 3198933 - RNA, 21 nt, Human
cucuuuggucuacacugugcu

SEQ ID NO: 3198934 - RNA, 16 nt, Human
cucuucuccaggcugu

SEQ ID NO: 3198935 - RNA, 19 nt, Human
cucuucucucugcucugac

SEQ ID NO: 3198936 - RNA, 18 nt, Human
cucuucucauuacuuguu

SEQ ID NO: 3198937 - RNA, 22 nt, Human
gauuaagaucucagugguuaag

SEQ ID NO: 3198938 - RNA, 18 nt, Human
gauuaacuuggaugaguu

SEQ ID NO: 3198939 - RNA, 12 nt, Human
gauuaacuugga

SEQ ID NO: 3198940 - RNA, 20 nt, Human
gauuaacugaaauaaaaaau

SEQ ID NO: 3198941 - RNA, 19 nt, Human
gauucaacagguuuuccug

SEQ ID NO: 3198942 - RNA, 19 nt, Human
gauuaaccacuucagcuga

SEQ ID NO: 3198943 - RNA, 21 nt, Human
gauuaaccacuucagcugacu

SEQ ID NO: 3198944 - RNA, 18 nt, Human
gauuaaccacuucagcug

SEQ ID NO: 3198945 - RNA, 15 nt, Human
gauguuuuccaugag

SEQ ID NO: 3198946 - RNA, 23 nt, Human
gauguuuuccaugaguccccugu

SEQ ID NO: 3198947 - RNA, 14 nt, Human
gauguuuuccauga

SEQ ID NO: 3198948 - RNA, 17 nt, Human
gauguuaaaauaaaugg

SEQ ID NO: 3198949 - RNA, 20 nt, Human
gauguuaaaauaaaugguuu

SEQ ID NO: 3198950 - RNA, 21 nt, Human
gauguucuuucacccuuuucu

SEQ ID NO: 3198951 - RNA, 23 nt, Human
gauguggaaaagccaagaggcug

SEQ ID NO: 3198952 - RNA, 21 nt, Human
gauguggaaaagccaagaggc

SEQ ID NO: 3198953 - RNA, 20 nt, Human
gaugugcuuguuaacugagu

SEQ ID NO: 3198954 - RNA, 15 nt, Human
gauguguaucagugu

SEQ ID NO: 3198955 - RNA, 20 nt, Human
gauguguaauuuuucuguau

SEQ ID NO: 3198956 - RNA, 19 nt, Human
gauguguaauuuuucugua

SEQ ID NO: 3198957 - RNA, 17 nt, Human
gauguguaauuuuucug

SEQ ID NO: 3198958 - RNA, 13 nt, Human
gauguguaauuuu

SEQ ID NO: 3198959 - RNA, 21 nt, Human
gauguguccugauaagcugag

SEQ ID NO: 3198960 - RNA, 14 nt, Human
gauguguucuuauu

SEQ ID NO: 3198961 - RNA, 16 nt, Human
gauguucugggacaca

SEQ ID NO: 3198962 - RNA, 14 nt, Human
gauguucugggaca

SEQ ID NO: 3198963 - RNA, 23 nt, Human
gauggugcaaugaccuuucaaua

SEQ ID NO: 3198964 - RNA, 19 nt, Human
gaugugcuuguuaacugag

SEQ ID NO: 3198965 - RNA, 19 nt, Human
gaugugcuauaaucuguuu

SEQ ID NO: 3198966 - RNA, 15 nt, Human
gaugugcugcuuuga

SEQ ID NO: 3198967 - RNA, 15 nt, Human
gaugugcugcagugc

SEQ ID NO: 3198968 - RNA, 12 nt, Human
gaugugccuaaa

SEQ ID NO: 3198969 - RNA, 20 nt, Human
gauggugcaaugaccuuuca

SEQ ID NO: 3198970 - RNA, 18 nt, Human
gaugggccugagugagag

SEQ ID NO: 3198971 - RNA, 13 nt, Human
gaugggccugagu

SEQ ID NO: 3198972 - RNA, 12 nt, Human
gaugggccugag

SEQ ID NO: 3198973 - RNA, 10 nt, Human
gaugggccug

SEQ ID NO: 3198974 - RNA, 13 nt, Human
gauugugccccug

SEQ ID NO: 3198975 - RNA, 20 nt, Human
gauuguccccgacccuugcc

SEQ ID NO: 3198976 - RNA, 20 nt, Human
gauugucaaugcuggagaaa

SEQ ID NO: 3198977 - RNA, 21 nt, Human
gauugucaaugcuggagaaaa

SEQ ID NO: 3198978 - RNA, 21 nt, Human
gauugucaccaugaucacuua

SEQ ID NO: 3198979 - RNA, 15 nt, Human
gauuguccccgaccc

SEQ ID NO: 3198980 - RNA, 23 nt, Human
gauuguaauauguaaaugguaug

SEQ ID NO: 3198981 - RNA, 18 nt, Human
gauugcuugagcucagga

SEQ ID NO: 3198982 - RNA, 13 nt, Human
gauugcuuuuaaa

SEQ ID NO: 3198983 - RNA, 16 nt, Human
gauugcuuuuaaaauu

SEQ ID NO: 3198984 - RNA, 14 nt, Human
gauugcuuuuaaaa

SEQ ID NO: 3198985 - RNA, 18 nt, Human
gauugcuuuuaaaauuuu

SEQ ID NO: 3198986 - RNA, 23 nt, Human
gauuggacauaacugacuuaguu

SEQ ID NO: 3198987 - RNA, 13 nt, Human
gauucuaggaccu

SEQ ID NO: 3198988 - RNA, 17 nt, Human
gauugaaaauaaugcug

SEQ ID NO: 3198989 - RNA, 17 nt, Human
gauugaagaaacagcua

SEQ ID NO: 3198990 - RNA, 12 nt, Human
gauucagacagc

SEQ ID NO: 3198991 - RNA, 22 nt, Human
gauucccaagcucugcuccucu

SEQ ID NO: 3198992 - RNA, 21 nt, Human
gauucccaagcucugcuccuc

SEQ ID NO: 3198993 - RNA, 10 nt, Human
gauucaaauu

SEQ ID NO: 3198994 - RNA, 14 nt, Human
gauucaaauuuauu

SEQ ID NO: 3198995 - RNA, 19 nt, Human
gauucacaccccaccugcg

SEQ ID NO: 3198996 - RNA, 22 nt, Human
gauucacauguuuucaaaugga

SEQ ID NO: 3198997 - RNA, 20 nt, Human
gauucacauguuuucaaaug

SEQ ID NO: 3198998 - RNA, 19 nt, Human
gauucacauguuuucaaau

SEQ ID NO: 3198999 - RNA, 18 nt, Human
gauucacauguuuucaaa

SEQ ID NO: 3199000 - RNA, 17 nt, Human
gauucacauguuuucaa

SEQ ID NO: 3199001 - RNA, 16 nt, Human
gauucacauguuuuca

SEQ ID NO: 3199002 - RNA, 13 nt, Human
gauucacauguuu

SEQ ID NO: 3199003 - RNA, 13 nt, Human
gauucccuuguua

SEQ ID NO: 3199004 - RNA, 16 nt, Human
gauuccuguuucaagu

SEQ ID NO: 3199005 - RNA, 22 nt, Human
gauuccuaaucacucagagcag

SEQ ID NO: 3199006 - RNA, 16 nt, Human
gauucccuuguuauuc

SEQ ID NO: 3199007 - RNA, 19 nt, Human
gauucccuuguuauucaac

SEQ ID NO: 3199008 - RNA, 15 nt, Human
gauccuuuuggaguc

SEQ ID NO: 3199009 - RNA, 17 nt, Human
gauccuuuuggagucag

SEQ ID NO: 3199010 - RNA, 18 nt, Human
gauccucccaccucagcc

SEQ ID NO: 3199011 - RNA, 13 nt, Human
gauccuucaaagu

SEQ ID NO: 3199012 - RNA, 16 nt, Human
gauccuucaaagucuc

SEQ ID NO: 3199013 - RNA, 21 nt, Human
gauccuucaaagucucaauga

SEQ ID NO: 3199014 - RNA, 23 nt, Human
gauccuucaaagucucaaugaaa

SEQ ID NO: 3199015 - RNA, 20 nt, Human
gauccuuguguuuaucagaa

SEQ ID NO: 3199016 - RNA, 22 nt, Human
gaucuguuuugugguuuggaau

SEQ ID NO: 3199017 - RNA, 13 nt, Human
gaucuuuaaaaua

SEQ ID NO: 3199018 - RNA, 14 nt, Human
gaucuuuaaaauac

SEQ ID NO: 3199019 - RNA, 16 nt, Human
gaucuuugcagacagg

SEQ ID NO: 3199020 - RNA, 18 nt, Human
gaucuucauuaccaauag

SEQ ID NO: 3199021 - RNA, 15 nt, Human
gaugaaaaaauaaca

SEQ ID NO: 3199022 - RNA, 17 nt, Human
gaugaaaagcuuuguuu

SEQ ID NO: 3199023 - RNA, 13 nt, Human
gauccugagccag

SEQ ID NO: 3199024 - RNA, 14 nt, Human
gauccugagccaga

SEQ ID NO: 3199025 - RNA, 15 nt, Human
gauccugagccagau

SEQ ID NO: 3199026 - RNA, 19 nt, Human
gauccugagccagauuuca

SEQ ID NO: 3199027 - RNA, 20 nt, Human
gauccucccaccucagccuc

SEQ ID NO: 3199028 - RNA, 19 nt, Human
gauccucccaccucagccu

SEQ ID NO: 3199029 - RNA, 11 nt, Human
gauccuccagg

SEQ ID NO: 3199030 - RNA, 18 nt, Human
gauccuaggcauuugcug

SEQ ID NO: 3199031 - RNA, 18 nt, Human
gauccuaguuccaccauc

SEQ ID NO: 3199032 - RNA, 15 nt, Human
gaucacgccacugca

SEQ ID NO: 3199033 - RNA, 14 nt, Human
gaucacgccacugc

SEQ ID NO: 3199034 - RNA, 13 nt, Human
gaucacgccacug

SEQ ID NO: 3199035 - RNA, 23 nt, Human
gaucaaccccuucgcuccugugu

SEQ ID NO: 3199036 - RNA, 20 nt, Human
gaugaccuugaaugaugcca

SEQ ID NO: 3199037 - RNA, 21 nt, Human
gaugacguacaaguaguucug

SEQ ID NO: 3199038 - RNA, 11 nt, Human
gaugagaaagg

SEQ ID NO: 3199039 - RNA, 22 nt, Human
gaugagaaagguugaagcacca

SEQ ID NO: 3199040 - RNA, 18 nt, Human
gaugauuuuuugaaaguu

SEQ ID NO: 3199041 - RNA, 17 nt, Human
gaugcaauguagagggg

SEQ ID NO: 3199042 - RNA, 20 nt, Human
gaugcaauccuuacaaauga

SEQ ID NO: 3199043 - RNA, 19 nt, Human
gaugcaauccuuacaaaug

SEQ ID NO: 3199044 - RNA, 18 nt, Human
gaugcaauccuuacaaau

SEQ ID NO: 3199045 - RNA, 20 nt, Human
gaugcauggagauagcccca

SEQ ID NO: 3199046 - RNA, 15 nt, Human
gaugcauuaaaagaa

SEQ ID NO: 3199047 - RNA, 17 nt, Human
gaugcauuaaaagaaaa

SEQ ID NO: 3199048 - RNA, 16 nt, Human
gaugcauuaaaagaaa

SEQ ID NO: 3199049 - RNA, 13 nt, Human
gaugcauggagau

SEQ ID NO: 3199050 - RNA, 22 nt, Human
gaugcuagaacucccuuucaac

SEQ ID NO: 3199051 - RNA, 21 nt, Human
gaugccccgucccccucuggc

SEQ ID NO: 3199052 - RNA, 18 nt, Human
gaugcauuaaaagaaaau

SEQ ID NO: 3199053 - RNA, 20 nt, Human
gauggcaaagaaggagagca

SEQ ID NO: 3199054 - RNA, 14 nt, Human
gaugcucacagggc

SEQ ID NO: 3199055 - RNA, 16 nt, Human
gaugggaaagcauugu

SEQ ID NO: 3199056 - RNA, 22 nt, Human
gauggcacagggcaugaaauga

SEQ ID NO: 3199057 - RNA, 22 nt, Human
gaugggcaacccccagccugcu

SEQ ID NO: 3199058 - RNA, 13 nt, Human
gaguauuuuugua

SEQ ID NO: 3199059 - RNA, 21 nt, Human
gagucccaccuuggcugcagg

SEQ ID NO: 3199060 - RNA, 14 nt, Human
gaguagcugggacu

SEQ ID NO: 3199061 - RNA, 12 nt, Human
gaguagcuggga

SEQ ID NO: 3199062 - RNA, 14 nt, Human
gagucccugccauc

SEQ ID NO: 3199063 - RNA, 14 nt, Human
gaguccccuguuug

SEQ ID NO: 3199064 - RNA, 23 nt, Human
gaguccccuguuuguuucugaaa

SEQ ID NO: 3199065 - RNA, 12 nt, Human
gaguccccuguu

SEQ ID NO: 3199066 - RNA, 22 nt, Human
gaguccccccacucccagcauc

SEQ ID NO: 3199067 - RNA, 18 nt, Human
gagucccaggcugagccu

SEQ ID NO: 3199068 - RNA, 19 nt, Human
gagucccaggcugagccuc

SEQ ID NO: 3199069 - RNA, 17 nt, Human
gagucgaggacagggag

SEQ ID NO: 3199070 - RNA, 16 nt, Human
gagucgaggacaggga

SEQ ID NO: 3199071 - RNA, 21 nt, Human
gagucucacuguugcccaggc

SEQ ID NO: 3199072 - RNA, 20 nt, Human
gagucucacuguugcccagg

SEQ ID NO: 3199073 - RNA, 19 nt, Human
gagucucacuguugcccag

SEQ ID NO: 3199074 - RNA, 23 nt, Human
gagucucacuguugcccaggcug

SEQ ID NO: 3199075 - RNA, 22 nt, Human
gagucucacuguugcccaggcu

SEQ ID NO: 3199076 - RNA, 23 nt, Human
gagucucgcuauugucaccaggg

SEQ ID NO: 3199077 - RNA, 12 nt, Human
gagucucuucuc

SEQ ID NO: 3199078 - RNA, 21 nt, Human
gagucucgcucuguugcccag

SEQ ID NO: 3199079 - RNA, 21 nt, Human
gagucugaaggcuggguucug

SEQ ID NO: 3199080 - RNA, 18 nt, Human
gagucucuucuccacugg

SEQ ID NO: 3199081 - RNA, 17 nt, Human
gagucucuucuccacug

SEQ ID NO: 3199082 - RNA, 16 nt, Human
gagucucuucuccacu

SEQ ID NO: 3199083 - RNA, 15 nt, Human
gagucucuucuccac

SEQ ID NO: 3199084 - RNA, 14 nt, Human
gagucucuucucca

SEQ ID NO: 3199085 - RNA, 22 nt, Human
gagguuuguuuagaagaagugu

SEQ ID NO: 3199086 - RNA, 14 nt, Human
gagguucccuuuga

SEQ ID NO: 3199087 - RNA, 21 nt, Human
gagguuacagguaccaguucu

SEQ ID NO: 3199088 - RNA, 16 nt, Human
gaguaaaaagaaaaca

SEQ ID NO: 3199089 - RNA, 19 nt, Human
gagguuuuaaaaaaauccc

SEQ ID NO: 3199090 - RNA, 16 nt, Human
gagguuuucuccccca

SEQ ID NO: 3199091 - RNA, 15 nt, Human
gagguuuucuccccc

SEQ ID NO: 3199092 - RNA, 15 nt, Human
gaguacuacaguccu

SEQ ID NO: 3199093 - RNA, 18 nt, Human
gaguacuacaguccuccc

SEQ ID NO: 3199094 - RNA, 19 nt, Human
gaguacuacaguccuccca

SEQ ID NO: 3199095 - RNA, 21 nt, Human
gaggugggauccuccaggugc

SEQ ID NO: 3199096 - RNA, 22 nt, Human
gaggugggauccuccaggugca

SEQ ID NO: 3199097 - RNA, 18 nt, Human
gaggugggauccuccagg

SEQ ID NO: 3199098 - RNA, 20 nt, Human
gaggucccaagguucugggu

SEQ ID NO: 3199099 - RNA, 15 nt, Human
gaggggggagguggg

SEQ ID NO: 3199100 - RNA, 22 nt, Human
gaggggggaggugggauccucc

SEQ ID NO: 3199101 - RNA, 21 nt, Human
gagggggugaccuccggccag

SEQ ID NO: 3199102 - RNA, 18 nt, Human
gagguccacaacacacag

SEQ ID NO: 3199103 - RNA, 16 nt, Human
gauaaucucagugcuu

SEQ ID NO: 3199104 - RNA, 19 nt, Human
gauaaucucagugcuuucc

SEQ ID NO: 3199105 - RNA, 20 nt, Human
gauaaucucagugcuuuccu

SEQ ID NO: 3199106 - RNA, 14 nt, Human
gauaauuaaccaag

SEQ ID NO: 3199107 - RNA, 14 nt, Human
gauacaaucagcug

SEQ ID NO: 3199108 - RNA, 15 nt, Human
gauacaaucagcugc

SEQ ID NO: 3199109 - RNA, 16 nt, Human
gauacaaucagcugcu

SEQ ID NO: 3199110 - RNA, 17 nt, Human
gauacaaucagcugcuu

SEQ ID NO: 3199111 - RNA, 16 nt, Human
gauaaaaaaacagcuu

SEQ ID NO: 3199112 - RNA, 21 nt, Human
gaguuuugggaaguuaaaggg

SEQ ID NO: 3199113 - RNA, 20 nt, Human
gauagaguaaaaagaaaaca

SEQ ID NO: 3199114 - RNA, 15 nt, Human
gauagaguaaaaaga

SEQ ID NO: 3199115 - RNA, 17 nt, Human
gauagcacagacccugc

SEQ ID NO: 3199116 - RNA, 18 nt, Human
gauagcacagacccugcc

SEQ ID NO: 3199117 - RNA, 14 nt, Human
gauauaaugaacaa

SEQ ID NO: 3199118 - RNA, 18 nt, Human
gauauaaugaacaaaauu

SEQ ID NO: 3199119 - RNA, 13 nt, Human
gauagccaaggcc

SEQ ID NO: 3199120 - RNA, 15 nt, Human
gauagcauuguaagc

SEQ ID NO: 3199121 - RNA, 13 nt, Human
gauagcagggcau

SEQ ID NO: 3199122 - RNA, 19 nt, Human
gauagcacagacccugccc

SEQ ID NO: 3199123 - RNA, 16 nt, Human
gauagcacagacccug

SEQ ID NO: 3199124 - RNA, 16 nt, Human
gauagcauaugacaaa

SEQ ID NO: 3199125 - RNA, 21 nt, Human
gauagaguaaaaagaaaacaa

SEQ ID NO: 3199126 - RNA, 12 nt, Human
gauagccaaggc

SEQ ID NO: 3199127 - RNA, 22 nt, Human
gaucaaccccuucgcuccugug

SEQ ID NO: 3199128 - RNA, 21 nt, Human
gaucaaccccuucgcuccugu

SEQ ID NO: 3199129 - RNA, 20 nt, Human
gauauauuuuauuuuuagaa

SEQ ID NO: 3199130 - RNA, 23 nt, Human
gauauauuuaaaaacaaaaggca

SEQ ID NO: 3199131 - RNA, 23 nt, Human
gauauaugcucugcauguuacau

SEQ ID NO: 3199132 - RNA, 19 nt, Human
gauauauguuuuugaaggc

SEQ ID NO: 3199133 - RNA, 14 nt, Human
gauauagagucauu

SEQ ID NO: 3199134 - RNA, 22 nt, Human
gauauacuuguuuuuguaaaga

SEQ ID NO: 3199135 - RNA, 17 nt, Human
gauauacuuguuuuugu

SEQ ID NO: 3199136 - RNA, 15 nt, Human
gauauacuuguuuuu

SEQ ID NO: 3199137 - RNA, 13 nt, Human
gauauacuuguuu

SEQ ID NO: 3199138 - RNA, 13 nt, Human
gauauaccaaauu

SEQ ID NO: 3199139 - RNA, 16 nt, Human
gauauaccaaauuaaa

SEQ ID NO: 3199140 - RNA, 13 nt, Human
gaguuccuagcca

SEQ ID NO: 3199141 - RNA, 17 nt, Human
gaguuccuaccauggag

SEQ ID NO: 3199142 - RNA, 15 nt, Human
gaguucccaagaaag

SEQ ID NO: 3199143 - RNA, 15 nt, Human
gaguuccaguugaag

SEQ ID NO: 3199144 - RNA, 18 nt, Human
gaguucauucauauuaca

SEQ ID NO: 3199145 - RNA, 16 nt, Human
gaguucauucauauua

SEQ ID NO: 3199146 - RNA, 13 nt, Human
gaguucugguucc

SEQ ID NO: 3199147 - RNA, 15 nt, Human
gaguucuuccuguaa

SEQ ID NO: 3199148 - RNA, 21 nt, Human
gaguucuuccuguaaucuugu

SEQ ID NO: 3199149 - RNA, 21 nt, Human
gaguucuguguauuuucaguc

SEQ ID NO: 3199150 - RNA, 12 nt, Human
gaguuuguuucu

SEQ ID NO: 3199151 - RNA, 18 nt, Human
gaguuuguuucuuugaau

SEQ ID NO: 3199152 - RNA, 14 nt, Human
gaguuuguuucuuu

SEQ ID NO: 3199153 - RNA, 18 nt, Human
gagugugaauauaaaugu

SEQ ID NO: 3199154 - RNA, 20 nt, Human
gagugugaauauaaaugugu

SEQ ID NO: 3199155 - RNA, 22 nt, Human
gagugugaauauaaaugugugu

SEQ ID NO: 3199156 - RNA, 23 nt, Human
gaguucaucuugaauuguaagga

SEQ ID NO: 3199157 - RNA, 20 nt, Human
gaguucaucuugaauuguaa

SEQ ID NO: 3199158 - RNA, 15 nt, Human
gaguucauucauauu

SEQ ID NO: 3199159 - RNA, 11 nt, Human
gaguuaggaac

SEQ ID NO: 3199160 - RNA, 17 nt, Human
gaguuaucaugaauuuu

SEQ ID NO: 3199161 - RNA, 18 nt, Human
gaguuaucaugaauuuua

SEQ ID NO: 3199162 - RNA, 19 nt, Human
gaguuaucaugaauuuuaa

SEQ ID NO: 3199163 - RNA, 20 nt, Human
gaguuaucaugaauuuuaaa

SEQ ID NO: 3199164 - RNA, 23 nt, Human
gaguuaucaugaauuuuaaagua

SEQ ID NO: 3199165 - RNA, 19 nt, Human
gagugucuuaauuaaaaga

SEQ ID NO: 3199166 - RNA, 12 nt, Human
gagugggcccaa

SEQ ID NO: 3199167 - RNA, 13 nt, Human
gaguggcuccucc

SEQ ID NO: 3199168 - RNA, 15 nt, Human
gaguggcuccucccg

SEQ ID NO: 3199169 - RNA, 21 nt, Human
gaguggccccaccuggcccuc

SEQ ID NO: 3199170 - RNA, 22 nt, Human
gagugaacaaauuuacagagac

SEQ ID NO: 3199171 - RNA, 20 nt, Human
gaguggccccaccuggcccu

SEQ ID NO: 3199172 - RNA, 19 nt, Human
gaguggccccaccuggccc

SEQ ID NO: 3199173 - RNA, 17 nt, Human
gaguggccccaccuggc

SEQ ID NO: 3199174 - RNA, 13 nt, Human
gaguggccccacc

SEQ ID NO: 3199175 - RNA, 19 nt, Human
gagugaacaaauuuacaga

SEQ ID NO: 3199176 - RNA, 15 nt, Human
gagucugaaggcugg

SEQ ID NO: 3199177 - RNA, 12 nt, Human
gagucugaggcc

SEQ ID NO: 3199178 - RNA, 19 nt, Human
gagucugaggccguugcug

SEQ ID NO: 3199179 - RNA, 23 nt, Human
gagucugaggccguugcugacuu

SEQ ID NO: 3199180 - RNA, 20 nt, Human
gagucugagggcuuguaguu

SEQ ID NO: 3199181 - RNA, 23 nt, Human
gagcuacacaggggaaaagagga

SEQ ID NO: 3199182 - RNA, 17 nt, Human
gagcguucaccagugac

SEQ ID NO: 3199183 - RNA, 17 nt, Human
gagcuccccccaggucu

SEQ ID NO: 3199184 - RNA, 21 nt, Human
gagcugccaguggggccugag

SEQ ID NO: 3199185 - RNA, 11 nt, Human
gagcugccagu

SEQ ID NO: 3199186 - RNA, 15 nt, Human
gagcugccaccugcc

SEQ ID NO: 3199187 - RNA, 16 nt, Human
gagcugccaccugccu

SEQ ID NO: 3199188 - RNA, 13 nt, Human
gagcugccaccug

SEQ ID NO: 3199189 - RNA, 16 nt, Human
gagcugcaccagguag

SEQ ID NO: 3199190 - RNA, 16 nt, Human
gagcucugcagagcag

SEQ ID NO: 3199191 - RNA, 15 nt, Human
gagcuuaacagugug

SEQ ID NO: 3199192 - RNA, 18 nt, Human
gagcuucuguugcugccu

SEQ ID NO: 3199193 - RNA, 14 nt, Human
gagcuucuggcacu

SEQ ID NO: 3199194 - RNA, 13 nt, Human
gagcuuagggucu

SEQ ID NO: 3199195 - RNA, 17 nt, Human
gagcuuagggucucagg

SEQ ID NO: 3199196 - RNA, 12 nt, Human
gagcuuagaaac

SEQ ID NO: 3199197 - RNA, 15 nt, Human
gagccugcagagcug

SEQ ID NO: 3199198 - RNA, 12 nt, Human
gagccugcagag

SEQ ID NO: 3199199 - RNA, 20 nt, Human
gagccuccugcccuuaccug

SEQ ID NO: 3199200 - RNA, 22 nt, Human
gagccuccugcccuuaccugcc

SEQ ID NO: 3199201 - RNA, 17 nt, Human
gagcccugguggcagug

SEQ ID NO: 3199202 - RNA, 19 nt, Human
gagccucagcauccuggca

SEQ ID NO: 3199203 - RNA, 16 nt, Human
gagcccugguggcagu

SEQ ID NO: 3199204 - RNA, 15 nt, Human
gagcccugguggcag

SEQ ID NO: 3199205 - RNA, 14 nt, Human
gagccuccugcccu

SEQ ID NO: 3199206 - RNA, 21 nt, Human
gagccucagcauccuggcacc

SEQ ID NO: 3199207 - RNA, 20 nt, Human
gagccucagcauccuggcac

SEQ ID NO: 3199208 - RNA, 13 nt, Human
gagccugggaggu

SEQ ID NO: 3199209 - RNA, 21 nt, Human
gagccugggaggucaaggcug

SEQ ID NO: 3199210 - RNA, 10 nt, Human
gagccuggca

SEQ ID NO: 3199211 - RNA, 15 nt, Human
gagccuggcaagaau

SEQ ID NO: 3199212 - RNA, 21 nt, Human
gagcaggcuacugucagcucc

SEQ ID NO: 3199213 - RNA, 14 nt, Human
gagccaccgugccu

SEQ ID NO: 3199214 - RNA, 20 nt, Human
gagccacugcaccgggccac

SEQ ID NO: 3199215 - RNA, 20 nt, Human
gagccaccgugccuggccac

SEQ ID NO: 3199216 - RNA, 18 nt, Human
gagcagccacauuccuga

SEQ ID NO: 3199217 - RNA, 22 nt, Human
gagcagaugaggugaaaaggcc

SEQ ID NO: 3199218 - RNA, 17 nt, Human
gagcagcacccauccac

SEQ ID NO: 3199219 - RNA, 21 nt, Human
gagcagcaaggucuugcucuc

SEQ ID NO: 3199220 - RNA, 17 nt, Human
gagcagaaauucuguuu

SEQ ID NO: 3199221 - RNA, 14 nt, Human
gagcagaaauucug

SEQ ID NO: 3199222 - RNA, 20 nt, Human
gagcagacacccuuggagcu

SEQ ID NO: 3199223 - RNA, 12 nt, Human
gagcccacgccc

SEQ ID NO: 3199224 - RNA, 15 nt, Human
gagcccacgccccca

SEQ ID NO: 3199225 - RNA, 16 nt, Human
gagcccacgcccccac

SEQ ID NO: 3199226 - RNA, 12 nt, Human
gagcccaggccu

SEQ ID NO: 3199227 - RNA, 13 nt, Human
gagcccaggccuc

SEQ ID NO: 3199228 - RNA, 14 nt, Human
gagcccaggccucc

SEQ ID NO: 3199229 - RNA, 11 nt, Human
gagcccacgcc

SEQ ID NO: 3199230 - RNA, 22 nt, Human
gagccacugcaccgggccacag

SEQ ID NO: 3199231 - RNA, 17 nt, Human
gagcaccuuagacaguc

SEQ ID NO: 3199232 - RNA, 13 nt, Human
gagcacccugagg

SEQ ID NO: 3199233 - RNA, 14 nt, Human
gagcacccugaggg

SEQ ID NO: 3199234 - RNA, 15 nt, Human
gagcacccugagggc

SEQ ID NO: 3199235 - RNA, 17 nt, Human
gagcaccgaauauugag

SEQ ID NO: 3199236 - RNA, 20 nt, Human
gagcaaaaugcauguaauca

SEQ ID NO: 3199237 - RNA, 19 nt, Human
gagcaaaaucgaugcagug

SEQ ID NO: 3199238 - RNA, 18 nt, Human
gagcaaaaugcauguaau

SEQ ID NO: 3199239 - RNA, 21 nt, Human
gagcaagacgcugugcugccc

SEQ ID NO: 3199240 - RNA, 18 nt, Human
gagcaagacgcugugcug

SEQ ID NO: 3199241 - RNA, 22 nt, Human
gagcaagacgcugugcugcccu

SEQ ID NO: 3199242 - RNA, 20 nt, Human
gagaucaaccccuucgcucc

SEQ ID NO: 3199243 - RNA, 14 nt, Human
gagauauuuuguaa

SEQ ID NO: 3199244 - RNA, 17 nt, Human
gagauauuuuguaaaau

SEQ ID NO: 3199245 - RNA, 20 nt, Human
gagauauuuuguaaaaugua

SEQ ID NO: 3199246 - RNA, 22 nt, Human
gagauauuuuguaaaauguauu

SEQ ID NO: 3199247 - RNA, 14 nt, Human
gagaucagccuggg

SEQ ID NO: 3199248 - RNA, 16 nt, Human
gagaucagccugggca

SEQ ID NO: 3199249 - RNA, 13 nt, Human
gagaucagccugg

SEQ ID NO: 3199250 - RNA, 18 nt, Human
gagauccuuguguuuauc

SEQ ID NO: 3199251 - RNA, 15 nt, Human
gagaucuaaaaauaa

SEQ ID NO: 3199252 - RNA, 15 nt, Human
gaggaugucugggcc

SEQ ID NO: 3199253 - RNA, 12 nt, Human
gaggauguucug

SEQ ID NO: 3199254 - RNA, 14 nt, Human
gaggauggcccagg

SEQ ID NO: 3199255 - RNA, 14 nt, Human
gaggauuaguuuag

SEQ ID NO: 3199256 - RNA, 20 nt, Human
gaggauguucugggacacag

SEQ ID NO: 3199257 - RNA, 17 nt, Human
gaggauguucugggaca

SEQ ID NO: 3199258 - RNA, 14 nt, Human
gaggaguaaaauuc

SEQ ID NO: 3199259 - RNA, 21 nt, Human
gaggaguaaaauucaguuuuu

SEQ ID NO: 3199260 - RNA, 21 nt, Human
gaggagggucuagaggccuga

SEQ ID NO: 3199261 - RNA, 23 nt, Human
gaggaguuugggguaugggagag

SEQ ID NO: 3199262 - RNA, 17 nt, Human
gaggagugguuuuucuu

SEQ ID NO: 3199263 - RNA, 16 nt, Human
gaggcacagagccaaa

SEQ ID NO: 3199264 - RNA, 19 nt, Human
gaggcagagguugcaguga

SEQ ID NO: 3199265 - RNA, 13 nt, Human
gaggcagccccau

SEQ ID NO: 3199266 - RNA, 22 nt, Human
gaggcagccccauucugccugc

SEQ ID NO: 3199267 - RNA, 21 nt, Human
gaggcagccccauucugccug

SEQ ID NO: 3199268 - RNA, 23 nt, Human
gaggcagccccauucugccugcc

SEQ ID NO: 3199269 - RNA, 13 nt, Human
gaggccagccuug

SEQ ID NO: 3199270 - RNA, 12 nt, Human
gaggccagccuu

SEQ ID NO: 3199271 - RNA, 22 nt, Human
gaggaggccuugggcucugcug

SEQ ID NO: 3199272 - RNA, 21 nt, Human
gaggaggccuugggcucugcu

SEQ ID NO: 3199273 - RNA, 18 nt, Human
gaggagcccugccucucc

SEQ ID NO: 3199274 - RNA, 15 nt, Human
gaggagcccugccuc

SEQ ID NO: 3199275 - RNA, 13 nt, Human
gaggagcccugcc

SEQ ID NO: 3199276 - RNA, 22 nt, Human
gaggacagggaggugaccccag

SEQ ID NO: 3199277 - RNA, 13 nt, Human
gaggacagggagg

SEQ ID NO: 3199278 - RNA, 13 nt, Human
gaggacacucccg

SEQ ID NO: 3199279 - RNA, 18 nt, Human
gaggacaagagaaaaaag

SEQ ID NO: 3199280 - RNA, 13 nt, Human
gaggacacagaga

SEQ ID NO: 3199281 - RNA, 18 nt, Human
gaggaauggacauuucua

SEQ ID NO: 3199282 - RNA, 15 nt, Human
gaggaauccagaccc

SEQ ID NO: 3199283 - RNA, 22 nt, Human
gaggaaggaaacccagcucugg

SEQ ID NO: 3199284 - RNA, 21 nt, Human
gagcuucuguugcugccucau

SEQ ID NO: 3199285 - RNA, 16 nt, Human
gaggaaggaugcaaag

SEQ ID NO: 3199286 - RNA, 17 nt, Human
gaggaaggaugcaaagu

SEQ ID NO: 3199287 - RNA, 20 nt, Human
gagcuuccaauuuuccuuca

SEQ ID NO: 3199288 - RNA, 21 nt, Human
gaggaaggaaacccagcucug

SEQ ID NO: 3199289 - RNA, 14 nt, Human
gaggaauccagacc

SEQ ID NO: 3199290 - RNA, 23 nt, Human
gagggacagucucaccauuuccc

SEQ ID NO: 3199291 - RNA, 16 nt, Human
gagggacagucucacc

SEQ ID NO: 3199292 - RNA, 12 nt, Human
gagggaaaccuu

SEQ ID NO: 3199293 - RNA, 13 nt, Human
gagggaaaccuuu

SEQ ID NO: 3199294 - RNA, 22 nt, Human
gagggaaagccuuaagcugcag

SEQ ID NO: 3199295 - RNA, 15 nt, Human
gagggagggagggcu

SEQ ID NO: 3199296 - RNA, 15 nt, Human
gagggagggcuccag

SEQ ID NO: 3199297 - RNA, 14 nt, Human
gagggagggagggc

SEQ ID NO: 3199298 - RNA, 14 nt, Human
gagggagugacaga

SEQ ID NO: 3199299 - RNA, 14 nt, Human
gagggagguaagga

SEQ ID NO: 3199300 - RNA, 13 nt, Human
gagggagugacag

SEQ ID NO: 3199301 - RNA, 14 nt, Human
gagggcacagaaaa

SEQ ID NO: 3199302 - RNA, 22 nt, Human
gagggcacagaaaauggaagac

SEQ ID NO: 3199303 - RNA, 23 nt, Human
gagggcacagaaaauggaagaca

SEQ ID NO: 3199304 - RNA, 12 nt, Human
gagggcacuggu

SEQ ID NO: 3199305 - RNA, 22 nt, Human
gaggggccucuuaugggcuggg

SEQ ID NO: 3199306 - RNA, 20 nt, Human
gaggggccuggcagccgugc

SEQ ID NO: 3199307 - RNA, 18 nt, Human
gaggggccuggcagccgu

SEQ ID NO: 3199308 - RNA, 14 nt, Human
gaggggccuggcag

SEQ ID NO: 3199309 - RNA, 13 nt, Human
gaggggccuggca

SEQ ID NO: 3199310 - RNA, 12 nt, Human
gaggggccucuu

SEQ ID NO: 3199311 - RNA, 18 nt, Human
gagggcacugguggcccg

SEQ ID NO: 3199312 - RNA, 16 nt, Human
gagggcacugguggcc

SEQ ID NO: 3199313 - RNA, 20 nt, Human
gaggcugggacgcucugcug

SEQ ID NO: 3199314 - RNA, 19 nt, Human
gaggcugggacgcucugcu

SEQ ID NO: 3199315 - RNA, 18 nt, Human
gaggcugggacgcucugc

SEQ ID NO: 3199316 - RNA, 18 nt, Human
gaggcuaaaauguuuuca

SEQ ID NO: 3199317 - RNA, 16 nt, Human
gaggcuaaaauguuuu

SEQ ID NO: 3199318 - RNA, 14 nt, Human
gaggcuaaaauguu

SEQ ID NO: 3199319 - RNA, 13 nt, Human
gaggcuaaaaugu

SEQ ID NO: 3199320 - RNA, 13 nt, Human
gaggcugggcucc

SEQ ID NO: 3199321 - RNA, 14 nt, Human
gaggcugggcuccc

SEQ ID NO: 3199322 - RNA, 15 nt, Human
gaggcugggcucccu

SEQ ID NO: 3199323 - RNA, 17 nt, Human
gaggcuuauauuugugu

SEQ ID NO: 3199324 - RNA, 21 nt, Human
gaggcugggacgcucugcugu

SEQ ID NO: 3199325 - RNA, 21 nt, Human
gaggcggagagugcugacugu

SEQ ID NO: 3199326 - RNA, 23 nt, Human
gaggcccuucucuccagccccug

SEQ ID NO: 3199327 - RNA, 24 nt, Human
gaggcccuucucuccagccccugg

SEQ ID NO: 3199328 - RNA, 22 nt, Human
gaggcccuucucuccagccccu

SEQ ID NO: 3199329 - RNA, 13 nt, Human
gaggcccggccuc

SEQ ID NO: 3199330 - RNA, 20 nt, Human
gaggcccguggggccggggc

SEQ ID NO: 3199331 - RNA, 15 nt, Human
gccacgauugcagga

SEQ ID NO: 3199332 - RNA, 11 nt, Human
gccaccugggu

SEQ ID NO: 3199333 - RNA, 14 nt, Human
gccaccugcggugc

SEQ ID NO: 3199334 - RNA, 20 nt, Human
gccaccugcggugcuaucuc

SEQ ID NO: 3199335 - RNA, 22 nt, Human
gccaccugcggugcuaucuccc

SEQ ID NO: 3199336 - RNA, 19 nt, Human
gccacggccaggccagagg

SEQ ID NO: 3199337 - RNA, 17 nt, Human
gccacggccaggccaga

SEQ ID NO: 3199338 - RNA, 18 nt, Human
gccacggccaggccagag

SEQ ID NO: 3199339 - RNA, 20 nt, Human
gccacgcccaacuaauuuuu

SEQ ID NO: 3199340 - RNA, 19 nt, Human
gccaccgccuccuacagcc

SEQ ID NO: 3199341 - RNA, 13 nt, Human
gccacaucccucu

SEQ ID NO: 3199342 - RNA, 12 nt, Human
gccacaguuguu

SEQ ID NO: 3199343 - RNA, 14 nt, Human
gccacaucccccaa

SEQ ID NO: 3199344 - RNA, 23 nt, Human
gccacauccacagucucccccac

SEQ ID NO: 3199345 - RNA, 17 nt, Human
gccaccgugccuggcca

SEQ ID NO: 3199346 - RNA, 22 nt, Human
gccaccgugccuggccacgccc

SEQ ID NO: 3199347 - RNA, 14 nt, Human
gccaccucuuccug

SEQ ID NO: 3199348 - RNA, 18 nt, Human
gccaccucuuccuggccg

SEQ ID NO: 3199349 - RNA, 15 nt, Human
gccaccucuuccugg

SEQ ID NO: 3199350 - RNA, 16 nt, Human
gccaccugaguuccug

SEQ ID NO: 3199351 - RNA, 17 nt, Human
gccaccugccuguuggg

SEQ ID NO: 3199352 - RNA, 21 nt, Human
gccaccugaguuccugaggug

SEQ ID NO: 3199353 - RNA, 17 nt, Human
gccaccugaguuccuga

SEQ ID NO: 3199354 - RNA, 20 nt, Human
gccaccuccuaaaaggccca

SEQ ID NO: 3199355 - RNA, 24 nt, Human
gccaccuccccuugccagcugcug

SEQ ID NO: 3199356 - RNA, 22 nt, Human
gccaccuccccuugccagcugc

SEQ ID NO: 3199357 - RNA, 18 nt, Human
gccaccuccccuugccag

SEQ ID NO: 3199358 - RNA, 21 nt, Human
gccaccuccccuugccagcug

SEQ ID NO: 3199359 - RNA, 20 nt, Human
gccaccuccccuugccagcu

SEQ ID NO: 3199360 - RNA, 22 nt, Human
gccaccuccuaaaaggcccaga

SEQ ID NO: 3199361 - RNA, 21 nt, Human
gccaccuccuaaaaggcccag

SEQ ID NO: 3199362 - RNA, 23 nt, Human
gccaccuccuaaaaggcccagag

SEQ ID NO: 3199363 - RNA, 10 nt, Human
gccagaggag

SEQ ID NO: 3199364 - RNA, 19 nt, Human
gccagacuggcacaguuuu

SEQ ID NO: 3199365 - RNA, 16 nt, Human
gccagagacacaagcc

SEQ ID NO: 3199366 - RNA, 17 nt, Human
gccagagacacaagccu

SEQ ID NO: 3199367 - RNA, 19 nt, Human
gccagagacacaagccuuc

SEQ ID NO: 3199368 - RNA, 18 nt, Human
gccagacuggcacaguuu

SEQ ID NO: 3199369 - RNA, 15 nt, Human
gccagacuggcacag

SEQ ID NO: 3199370 - RNA, 11 nt, Human
gccacugaaga

SEQ ID NO: 3199371 - RNA, 13 nt, Human
gccacugaagagg

SEQ ID NO: 3199372 - RNA, 18 nt, Human
gccacugaagaggaggag

SEQ ID NO: 3199373 - RNA, 18 nt, Human
gccagaugcaccagcccu

SEQ ID NO: 3199374 - RNA, 17 nt, Human
gccagaugcaccagccc

SEQ ID NO: 3199375 - RNA, 16 nt, Human
gccagaugcaccagcc

SEQ ID NO: 3199376 - RNA, 23 nt, Human
gccagagggagugacagaggcag

SEQ ID NO: 3199377 - RNA, 12 nt, Human
gccagaggagag

SEQ ID NO: 3199378 - RNA, 13 nt, Human
gccagaggagaga

SEQ ID NO: 3199379 - RNA, 15 nt, Human
gccagaggagagagg

SEQ ID NO: 3199380 - RNA, 17 nt, Human
gccagaggagagaggac

SEQ ID NO: 3199381 - RNA, 19 nt, Human
gccagaggagagaggaccc

SEQ ID NO: 3199382 - RNA, 22 nt, Human
gccagaggagagaggacccccu

SEQ ID NO: 3199383 - RNA, 22 nt, Human
gccagagggagugacagaggca

SEQ ID NO: 3199384 - RNA, 21 nt, Human
gccagagggagugacagaggc

SEQ ID NO: 3199385 - RNA, 20 nt, Human
gccaaugugaacagcggcug

SEQ ID NO: 3199386 - RNA, 20 nt, Human
gccaauuucucuuaaguacu

SEQ ID NO: 3199387 - RNA, 16 nt, Human
gccacaagacccuugu

SEQ ID NO: 3199388 - RNA, 22 nt, Human
gccacaagacccuugugguccc

SEQ ID NO: 3199389 - RNA, 15 nt, Human
gccacaaggaagaaa

SEQ ID NO: 3199390 - RNA, 22 nt, Human
gccacaaggaagaaauuaacuu

SEQ ID NO: 3199391 - RNA, 17 nt, Human
gccacaaggaagaaauu

SEQ ID NO: 3199392 - RNA, 23 nt, Human
gccacaaggaagaaauuaacuua

SEQ ID NO: 3199393 - RNA, 20 nt, Human
gccacagagaaaguacuucu

SEQ ID NO: 3199394 - RNA, 14 nt, Human
gccacagagaaagu

SEQ ID NO: 3199395 - RNA, 13 nt, Human
gccacagagaaag

SEQ ID NO: 3199396 - RNA, 23 nt, Human
gccacacuucaggcucuucuccu

SEQ ID NO: 3199397 - RNA, 22 nt, Human
gccacacuucaggcucuucucc

SEQ ID NO: 3199398 - RNA, 20 nt, Human
gccacacuucaggcucuucu

SEQ ID NO: 3199399 - RNA, 23 nt, Human
gccacagagaaaguacuucucca

SEQ ID NO: 3199400 - RNA, 20 nt, Human
gccaauaauaauaccucccu

SEQ ID NO: 3199401 - RNA, 15 nt, Human
gccaaucagaagcua

SEQ ID NO: 3199402 - RNA, 21 nt, Human
gccaauggagacugucucaag

SEQ ID NO: 3199403 - RNA, 19 nt, Human
gccaauggagacugucuca

SEQ ID NO: 3199404 - RNA, 16 nt, Human
gccaauggagacuguc

SEQ ID NO: 3199405 - RNA, 21 nt, Human
gccaaggcugggggaagaagc

SEQ ID NO: 3199406 - RNA, 13 nt, Human
gcauuuguaaaua

SEQ ID NO: 3199407 - RNA, 17 nt, Human
gcauuuguaaauauuaa

SEQ ID NO: 3199408 - RNA, 18 nt, Human
gcauuuguaaauauuaaa

SEQ ID NO: 3199409 - RNA, 20 nt, Human
gcauuuguaaauauuaaacc

SEQ ID NO: 3199410 - RNA, 21 nt, Human
gcauuuguaaauauuaaacca

SEQ ID NO: 3199411 - RNA, 23 nt, Human
gccaaggugggaggauugcuuga

SEQ ID NO: 3199412 - RNA, 14 nt, Human
gccaaggugggagg

SEQ ID NO: 3199413 - RNA, 15 nt, Human
gccaaggugggagga

SEQ ID NO: 3199414 - RNA, 22 nt, Human
gccaggcugcucuugaacuccu

SEQ ID NO: 3199415 - RNA, 13 nt, Human
gccaggcugcucu

SEQ ID NO: 3199416 - RNA, 14 nt, Human
gccaggcugcucuu

SEQ ID NO: 3199417 - RNA, 15 nt, Human
gccagaugcaccagc

SEQ ID NO: 3199418 - RNA, 16 nt, Human
gccagauuucacucuc

SEQ ID NO: 3199419 - RNA, 18 nt, Human
gccagauuucacucuccu

SEQ ID NO: 3199420 - RNA, 21 nt, Human
gccagauuucacucuccuugg

SEQ ID NO: 3199421 - RNA, 23 nt, Human
gccagggacagaggggguggccu

SEQ ID NO: 3199422 - RNA, 15 nt, Human
gccaggcuggucuca

SEQ ID NO: 3199423 - RNA, 19 nt, Human
gccagggaaagacuggcaa

SEQ ID NO: 3199424 - RNA, 20 nt, Human
gccagggaaagacuggcaag

SEQ ID NO: 3199425 - RNA, 22 nt, Human
gccagggaccccagaaucaugu

SEQ ID NO: 3199426 - RNA, 16 nt, Human
gccagggaccccagaa

SEQ ID NO: 3199427 - RNA, 16 nt, Human
gccagggacagagggg

SEQ ID NO: 3199428 - RNA, 18 nt, Human
gccagggacagagggggu

SEQ ID NO: 3199429 - RNA, 13 nt, Human
gccagggacagag

SEQ ID NO: 3199430 - RNA, 22 nt, Human
gccaggcuggucucgaacuccu

SEQ ID NO: 3199431 - RNA, 17 nt, Human
gccagucaccccggcca

SEQ ID NO: 3199432 - RNA, 18 nt, Human
gccagucaccccggccac

SEQ ID NO: 3199433 - RNA, 20 nt, Human
gccagucaccccggccaccu

SEQ ID NO: 3199434 - RNA, 17 nt, Human
gccagguuuuuggucug

SEQ ID NO: 3199435 - RNA, 18 nt, Human
gccagguugcuaagaaac

SEQ ID NO: 3199436 - RNA, 14 nt, Human
gccagguugcuaag

SEQ ID NO: 3199437 - RNA, 18 nt, Human
gccagguggccacuccag

SEQ ID NO: 3199438 - RNA, 22 nt, Human
gccaggggagguuacagguacc

SEQ ID NO: 3199439 - RNA, 17 nt, Human
gccaggggaccuccugg

SEQ ID NO: 3199440 - RNA, 23 nt, Human
gcccaaaccaccagaagcccaga

SEQ ID NO: 3199441 - RNA, 19 nt, Human
gcccaaaccuuucccccau

SEQ ID NO: 3199442 - RNA, 16 nt, Human
gcccaaaccuuucccc

SEQ ID NO: 3199443 - RNA, 22 nt, Human
gcccaaaccaccagaagcccag

SEQ ID NO: 3199444 - RNA, 21 nt, Human
gcccaaaccaccagaagccca

SEQ ID NO: 3199445 - RNA, 23 nt, Human
gcccaaccucuuccuccugacac

SEQ ID NO: 3199446 - RNA, 21 nt, Human
gcccaaccucuuccuccugac

SEQ ID NO: 3199447 - RNA, 15 nt, Human
gcccaaccucuuccu

SEQ ID NO: 3199448 - RNA, 10 nt, Human
gcccaaccuc

SEQ ID NO: 3199449 - RNA, 13 nt, Human
gcccaaccacacu

SEQ ID NO: 3199450 - RNA, 22 nt, Human
gcccaacaggggcuccaugcca

SEQ ID NO: 3199451 - RNA, 21 nt, Human
gcccaacaggggcuccaugcc

SEQ ID NO: 3199452 - RNA, 13 nt, Human
gcccaacaggggc

SEQ ID NO: 3199453 - RNA, 22 nt, Human
gccaugggacagggaggacgcu

SEQ ID NO: 3199454 - RNA, 23 nt, Human
gccaugggacagggaggacgcuc

SEQ ID NO: 3199455 - RNA, 16 nt, Human
gccauuuguguuuaua

SEQ ID NO: 3199456 - RNA, 18 nt, Human
gccaugaggaacaaggca

SEQ ID NO: 3199457 - RNA, 22 nt, Human
gccaugagaauguuuuagcaca

SEQ ID NO: 3199458 - RNA, 20 nt, Human
gccaugagaauguuuuagca

SEQ ID NO: 3199459 - RNA, 13 nt, Human
gccaugccagcuu

SEQ ID NO: 3199460 - RNA, 18 nt, Human
gccaugccagcuuaucuc

SEQ ID NO: 3199461 - RNA, 19 nt, Human
gccaugccagcuuaucuca

SEQ ID NO: 3199462 - RNA, 24 nt, Human
gccaugcuccuggcccacugcauc

SEQ ID NO: 3199463 - RNA, 17 nt, Human
gccaguauuuuuaaagg

SEQ ID NO: 3199464 - RNA, 15 nt, Human
gccaucucugcucca

SEQ ID NO: 3199465 - RNA, 14 nt, Human
gccaucucugcucc

SEQ ID NO: 3199466 - RNA, 13 nt, Human
gccaucucugcuc

SEQ ID NO: 3199467 - RNA, 12 nt, Human
gccaucucugcu

SEQ ID NO: 3199468 - RNA, 20 nt, Human
gcccagagggccugcaaggg

SEQ ID NO: 3199469 - RNA, 21 nt, Human
gcccagagggccugcaaggga

SEQ ID NO: 3199470 - RNA, 22 nt, Human
gcccagagggccugcaagggag

SEQ ID NO: 3199471 - RNA, 16 nt, Human
gcccagagucccccca

SEQ ID NO: 3199472 - RNA, 23 nt, Human
gcccagaguccccccacucccag

SEQ ID NO: 3199473 - RNA, 18 nt, Human
gcccagaguccccccacu

SEQ ID NO: 3199474 - RNA, 18 nt, Human
gcccagaucagccagaag

SEQ ID NO: 3199475 - RNA, 16 nt, Human
gcccagaucagccaga

SEQ ID NO: 3199476 - RNA, 21 nt, Human
gcccagcaccacccuccuucc

SEQ ID NO: 3199477 - RNA, 11 nt, Human
gcccagccccu

SEQ ID NO: 3199478 - RNA, 16 nt, Human
gcccagcccaccccau

SEQ ID NO: 3199479 - RNA, 12 nt, Human
gcccagccccuu

SEQ ID NO: 3199480 - RNA, 9 nt, Human
gcccagccc

SEQ ID NO: 3199481 - RNA, 14 nt, Human
gcccagagggccug

SEQ ID NO: 3199482 - RNA, 15 nt, Human
gcccagagggccugc

SEQ ID NO: 3199483 - RNA, 18 nt, Human
gcccagagggccugcaag

SEQ ID NO: 3199484 - RNA, 19 nt, Human
gcccagagggccugcaagg

SEQ ID NO: 3199485 - RNA, 12 nt, Human
gcccagagggcc

SEQ ID NO: 3199486 - RNA, 23 nt, Human
gcccagagagaagagccccacuc

SEQ ID NO: 3199487 - RNA, 21 nt, Human
gcccaaugcacuuuguucugg

SEQ ID NO: 3199488 - RNA, 18 nt, Human
gcccagacccuggaggaa

SEQ ID NO: 3199489 - RNA, 17 nt, Human
gcccagacccuggagga

SEQ ID NO: 3199490 - RNA, 14 nt, Human
gcccagacccugga

SEQ ID NO: 3199491 - RNA, 14 nt, Human
gcccaaugaauaau

SEQ ID NO: 3199492 - RNA, 14 nt, Human
gcccaaugaauuau

SEQ ID NO: 3199493 - RNA, 20 nt, Human
gcccagagagaagagcccca

SEQ ID NO: 3199494 - RNA, 19 nt, Human
gcccagagagaagagcccc

SEQ ID NO: 3199495 - RNA, 17 nt, Human
gcccagagagaagagcc

SEQ ID NO: 3199496 - RNA, 22 nt, Human
gcccagagagaagagccccacu

SEQ ID NO: 3199497 - RNA, 21 nt, Human
gcccagagagaagagccccac

SEQ ID NO: 3199498 - RNA, 18 nt, Human
gcccaggaaaggcuccag

SEQ ID NO: 3199499 - RNA, 19 nt, Human
gcccaggaaaggcuccagg

SEQ ID NO: 3199500 - RNA, 20 nt, Human
gcccaggaaaggcuccagga

SEQ ID NO: 3199501 - RNA, 20 nt, Human
gcccaggcuggcgugcagug

SEQ ID NO: 3199502 - RNA, 19 nt, Human
gcccaggcuggcgugcagu

SEQ ID NO: 3199503 - RNA, 22 nt, Human
gcccaggcuggcgugcaguggu

SEQ ID NO: 3199504 - RNA, 19 nt, Human
gcccaggcuuagucacuga

SEQ ID NO: 3199505 - RNA, 21 nt, Human
gcccaggcuuagucacugaga

SEQ ID NO: 3199506 - RNA, 23 nt, Human
gcccaggcuuagucacugagaca

SEQ ID NO: 3199507 - RNA, 19 nt, Human
gcccagucuggaaugcagu

SEQ ID NO: 3199508 - RNA, 15 nt, Human
gcccaguugggugga

SEQ ID NO: 3199509 - RNA, 13 nt, Human
gcccagccccuuc

SEQ ID NO: 3199510 - RNA, 14 nt, Human
gcccagccccuucu

SEQ ID NO: 3199511 - RNA, 16 nt, Human
gcccagccccuucuga

SEQ ID NO: 3199512 - RNA, 17 nt, Human
gcccagccccuucugac

SEQ ID NO: 3199513 - RNA, 20 nt, Human
gcccagccccuucugaccca

SEQ ID NO: 3199514 - RNA, 24 nt, Human
gcccagccccuucugacccaugcu

SEQ ID NO: 3199515 - RNA, 17 nt, Human
gcccagcgcggacaucc

SEQ ID NO: 3199516 - RNA, 19 nt, Human
gcccagcgcggacaucccc

SEQ ID NO: 3199517 - RNA, 21 nt, Human
gcccagccucuuucccuucca

SEQ ID NO: 3199518 - RNA, 15 nt, Human
gcccagccucuuucc

SEQ ID NO: 3199519 - RNA, 21 nt, Human
gcccagcuugaaaccuucacu

SEQ ID NO: 3199520 - RNA, 13 nt, Human
gcaggcagccuug

SEQ ID NO: 3199521 - RNA, 12 nt, Human
gcaggcaggcug

SEQ ID NO: 3199522 - RNA, 18 nt, Human
gcaggcagccaggccaca

SEQ ID NO: 3199523 - RNA, 17 nt, Human
gcaggcagccaggccac

SEQ ID NO: 3199524 - RNA, 11 nt, Human
gcaggcagggg

SEQ ID NO: 3199525 - RNA, 23 nt, Human
gcaggcauugccucggcuggcuc

SEQ ID NO: 3199526 - RNA, 22 nt, Human
gcaggcccaugggaggcuggag

SEQ ID NO: 3199527 - RNA, 17 nt, Human
gcaggcccaugggaggc

SEQ ID NO: 3199528 - RNA, 14 nt, Human
gcaggcccauggga

SEQ ID NO: 3199529 - RNA, 20 nt, Human
gcaggcccacccugcuuggc

SEQ ID NO: 3199530 - RNA, 16 nt, Human
gcaggcccacccugcu

SEQ ID NO: 3199531 - RNA, 15 nt, Human
gcaggcccacccugc

SEQ ID NO: 3199532 - RNA, 14 nt, Human
gcaggcccacccug

SEQ ID NO: 3199533 - RNA, 11 nt, Human
gcaggcccacc

SEQ ID NO: 3199534 - RNA, 19 nt, Human
gcaggguccuagaaauucc

SEQ ID NO: 3199535 - RNA, 16 nt, Human
gcagggucucacucug

SEQ ID NO: 3199536 - RNA, 21 nt, Human
gcaggggaggccaucuggaga

SEQ ID NO: 3199537 - RNA, 14 nt, Human
gcagggcuuuaaaa

SEQ ID NO: 3199538 - RNA, 17 nt, Human
gcagggcuuuaaaauuc

SEQ ID NO: 3199539 - RNA, 17 nt, Human
gcaggggaggccaucug

SEQ ID NO: 3199540 - RNA, 15 nt, Human
gcaggggaggccauc

SEQ ID NO: 3199541 - RNA, 19 nt, Human
gcaggggaggccaucugga

SEQ ID NO: 3199542 - RNA, 18 nt, Human
gcaggggaggccaucugg

SEQ ID NO: 3199543 - RNA, 22 nt, Human
gcagggcucagcggggacagcu

SEQ ID NO: 3199544 - RNA, 19 nt, Human
gcagggcaggaccagccca

SEQ ID NO: 3199545 - RNA, 18 nt, Human
gcagggcaggaccagccc

SEQ ID NO: 3199546 - RNA, 17 nt, Human
gcagggcaggaccagcc

SEQ ID NO: 3199547 - RNA, 22 nt, Human
gcagggcacagggccuggccca

SEQ ID NO: 3199548 - RNA, 19 nt, Human
gcagggcacagggccuggc

SEQ ID NO: 3199549 - RNA, 16 nt, Human
gcagggcacagggccu

SEQ ID NO: 3199550 - RNA, 16 nt, Human
gcagggcaggaccagc

SEQ ID NO: 3199551 - RNA, 15 nt, Human
gcagggcaggaccag

SEQ ID NO: 3199552 - RNA, 14 nt, Human
gcagggcaggacca

SEQ ID NO: 3199553 - RNA, 12 nt, Human
gcagggcacagg

SEQ ID NO: 3199554 - RNA, 14 nt, Human
gcagggcacagggc

SEQ ID NO: 3199555 - RNA, 13 nt, Human
gcagggcacaggg

SEQ ID NO: 3199556 - RNA, 22 nt, Human
gcaggcgcaagggaggcccagc

SEQ ID NO: 3199557 - RNA, 18 nt, Human
gcaggccucccugccagu

SEQ ID NO: 3199558 - RNA, 17 nt, Human
gcaggccucccugccag

SEQ ID NO: 3199559 - RNA, 13 nt, Human
gcaggccucccug

SEQ ID NO: 3199560 - RNA, 17 nt, Human
gcagugggccuggccag

SEQ ID NO: 3199561 - RNA, 19 nt, Human
gcaguggugcgaucugggu

SEQ ID NO: 3199562 - RNA, 18 nt, Human
gcaguggugcgaucuggg

SEQ ID NO: 3199563 - RNA, 15 nt, Human
gcagugggccuggcc

SEQ ID NO: 3199564 - RNA, 16 nt, Human
gcagugggccuggcca

SEQ ID NO: 3199565 - RNA, 11 nt, Human
gcagugggagc

SEQ ID NO: 3199566 - RNA, 21 nt, Human
gcagugggacagggcauggcc

SEQ ID NO: 3199567 - RNA, 15 nt, Human
gcaguugaaaagacu

SEQ ID NO: 3199568 - RNA, 19 nt, Human
gcaguugaaaagacuccaa

SEQ ID NO: 3199569 - RNA, 16 nt, Human
gcaguugaaaagacuc

SEQ ID NO: 3199570 - RNA, 21 nt, Human
gcaguugaaaagacuccaaag

SEQ ID NO: 3199571 - RNA, 21 nt, Human
gcaguggugcgaucuggguuc

SEQ ID NO: 3199572 - RNA, 20 nt, Human
gcaguggugcgaucuggguu

SEQ ID NO: 3199573 - RNA, 22 nt, Human
gcaguggugcgaucuggguuca

SEQ ID NO: 3199574 - RNA, 18 nt, Human
gcaucuaucuggugauuu

SEQ ID NO: 3199575 - RNA, 20 nt, Human
gcaucuaucuggugauuucu

SEQ ID NO: 3199576 - RNA, 14 nt, Human
gcaucucagcccac

SEQ ID NO: 3199577 - RNA, 13 nt, Human
gcaucucagccca

SEQ ID NO: 3199578 - RNA, 12 nt, Human
gcaucucagccc

SEQ ID NO: 3199579 - RNA, 17 nt, Human
gcaucauuccaggcccg

SEQ ID NO: 3199580 - RNA, 15 nt, Human
gcaucauuccaggcc

SEQ ID NO: 3199581 - RNA, 16 nt, Human
gcaucauucucuaaua

SEQ ID NO: 3199582 - RNA, 23 nt, Human
gcaucagugcccuccaggauaga

SEQ ID NO: 3199583 - RNA, 19 nt, Human
gcaucaucuugaacauuaa

SEQ ID NO: 3199584 - RNA, 21 nt, Human
gcaucaucuugaacauuaauc

SEQ ID NO: 3199585 - RNA, 23 nt, Human
gcaucaucaauaaaacaguuggc

SEQ ID NO: 3199586 - RNA, 22 nt, Human
gcaucagcugcugaaacaacaa

SEQ ID NO: 3199587 - RNA, 23 nt, Human
gcaucagcugcugaaacaacaaa

SEQ ID NO: 3199588 - RNA, 12 nt, Human
gcaucaggccag

SEQ ID NO: 3199589 - RNA, 12 nt, Human
gcaucagcugcu

SEQ ID NO: 3199590 - RNA, 19 nt, Human
gcaucagcugcucagaucc

SEQ ID NO: 3199591 - RNA, 18 nt, Human
gcaucaggccaggcccuc

SEQ ID NO: 3199592 - RNA, 23 nt, Human
gcaucaggccaggcccucugccc

SEQ ID NO: 3199593 - RNA, 15 nt, Human
gcaucagugcccucc

SEQ ID NO: 3199594 - RNA, 23 nt, Human
gcaucuggaagagcuaggcaggg

SEQ ID NO: 3199595 - RNA, 15 nt, Human
gcaucucagcccaca

SEQ ID NO: 3199596 - RNA, 21 nt, Human
gcaucucacagcuaugcaaaa

SEQ ID NO: 3199597 - RNA, 20 nt, Human
gcaugacacgaauauugcug

SEQ ID NO: 3199598 - RNA, 21 nt, Human
gcaugacacgaauauugcuga

SEQ ID NO: 3199599 - RNA, 15 nt, Human
gcaugacagaaaaua

SEQ ID NO: 3199600 - RNA, 22 nt, Human
gcaugacacgaauauugcugau

SEQ ID NO: 3199601 - RNA, 17 nt, Human
gcaucuggguagcugua

SEQ ID NO: 3199602 - RNA, 13 nt, Human
gcauguuacauaa

SEQ ID NO: 3199603 - RNA, 15 nt, Human
gcauuaaaagaaaau

SEQ ID NO: 3199604 - RNA, 22 nt, Human
gcauguguuaaucuuaauguau

SEQ ID NO: 3199605 - RNA, 14 nt, Human
gcaugccuggaugg

SEQ ID NO: 3199606 - RNA, 21 nt, Human
gcaugacagaaaauauguauu

SEQ ID NO: 3199607 - RNA, 19 nt, Human
gcaugacagaaaauaugua

SEQ ID NO: 3199608 - RNA, 18 nt, Human
gcaugacagaaaauaugu

SEQ ID NO: 3199609 - RNA, 17 nt, Human
gcaugacagaaaauaug

SEQ ID NO: 3199610 - RNA, 18 nt, Human
gcauuaccucuuuggaaa

SEQ ID NO: 3199611 - RNA, 16 nt, Human
gcauuaccucuuugga

SEQ ID NO: 3199612 - RNA, 12 nt, Human
gcauuccccagg

SEQ ID NO: 3199613 - RNA, 13 nt, Human
gcauuacaggcaa

SEQ ID NO: 3199614 - RNA, 14 nt, Human
gcauuccccaggag

SEQ ID NO: 3199615 - RNA, 15 nt, Human
gcauuccccaggagg

SEQ ID NO: 3199616 - RNA, 16 nt, Human
gcauuccccaggaggc

SEQ ID NO: 3199617 - RNA, 17 nt, Human
gcauuccccaggaggcc

SEQ ID NO: 3199618 - RNA, 18 nt, Human
gcauuccccaggaggcca

SEQ ID NO: 3199619 - RNA, 19 nt, Human
gcauuccccaggaggccag

SEQ ID NO: 3199620 - RNA, 20 nt, Human
gcauuccccaggaggccagc

SEQ ID NO: 3199621 - RNA, 21 nt, Human
gcauuccccaggaggccagcc

SEQ ID NO: 3199622 - RNA, 22 nt, Human
gcauuccccaggaggccagccu

SEQ ID NO: 3199623 - RNA, 18 nt, Human
gcaggaaauggcugugga

SEQ ID NO: 3199624 - RNA, 20 nt, Human
gcagcucagaaccacagcaa

SEQ ID NO: 3199625 - RNA, 18 nt, Human
gcagcucagagagggugg

SEQ ID NO: 3199626 - RNA, 19 nt, Human
gcagcucagagaggguggg

SEQ ID NO: 3199627 - RNA, 13 nt, Human
gcaggacgacugu

SEQ ID NO: 3199628 - RNA, 17 nt, Human
gcagcucaccucucccu

SEQ ID NO: 3199629 - RNA, 20 nt, Human
gcagcucaccucucccuugg

SEQ ID NO: 3199630 - RNA, 21 nt, Human
gcagcucaccucucccuugga

SEQ ID NO: 3199631 - RNA, 14 nt, Human
gcagcucagagagg

SEQ ID NO: 3199632 - RNA, 16 nt, Human
gcagcucaccucuccc

SEQ ID NO: 3199633 - RNA, 13 nt, Human
gcagccucugggc

SEQ ID NO: 3199634 - RNA, 19 nt, Human
gcagccuccgcuucccugg

SEQ ID NO: 3199635 - RNA, 17 nt, Human
gcagccuccgcuucccu

SEQ ID NO: 3199636 - RNA, 18 nt, Human
gcagcagggagggcuucu

SEQ ID NO: 3199637 - RNA, 19 nt, Human
gcagcagggagggcuucug

SEQ ID NO: 3199638 - RNA, 24 nt, Human
gcagcccugcuuugggcugcccug

SEQ ID NO: 3199639 - RNA, 14 nt, Human
gcagcccugcuuug

SEQ ID NO: 3199640 - RNA, 19 nt, Human
gcagccucacaguccuuac

SEQ ID NO: 3199641 - RNA, 14 nt, Human
gcagccucccuccg

SEQ ID NO: 3199642 - RNA, 15 nt, Human
gcagccucacagucc

SEQ ID NO: 3199643 - RNA, 17 nt, Human
gcagccucacaguccuu

SEQ ID NO: 3199644 - RNA, 19 nt, Human
gcagccgccuucacagcag

SEQ ID NO: 3199645 - RNA, 18 nt, Human
gcagccgccuucacagca

SEQ ID NO: 3199646 - RNA, 14 nt, Human
gcagccgccuucac

SEQ ID NO: 3199647 - RNA, 14 nt, Human
gcagcccuggccca

SEQ ID NO: 3199648 - RNA, 17 nt, Human
gcagcccuggcccauca

SEQ ID NO: 3199649 - RNA, 18 nt, Human
gcagcccuggcccaucau

SEQ ID NO: 3199650 - RNA, 18 nt, Human
gcagauggagaccccuug

SEQ ID NO: 3199651 - RNA, 23 nt, Human
gcagaugaggugaaaaggccaag

SEQ ID NO: 3199652 - RNA, 18 nt, Human
gcagauguccuugaugcu

SEQ ID NO: 3199653 - RNA, 23 nt, Human
gcagagguugcagugagccgaga

SEQ ID NO: 3199654 - RNA, 22 nt, Human
gcagaucucccacaugccaggg

SEQ ID NO: 3199655 - RNA, 18 nt, Human
gcagagguugcagugagc

SEQ ID NO: 3199656 - RNA, 21 nt, Human
gcagagguccacaacacacag

SEQ ID NO: 3199657 - RNA, 22 nt, Human
gcagagaccaucccugaaggcc

SEQ ID NO: 3199658 - RNA, 20 nt, Human
gcagagaccaucccugaagg

SEQ ID NO: 3199659 - RNA, 21 nt, Human
gcagagaccaucccugaaggc

SEQ ID NO: 3199660 - RNA, 19 nt, Human
gcagagaccaucccugaag

SEQ ID NO: 3199661 - RNA, 20 nt, Human
gcagagaagugacgguuccu

SEQ ID NO: 3199662 - RNA, 20 nt, Human
gcagacuuuuaaagacuugc

SEQ ID NO: 3199663 - RNA, 19 nt, Human
gcagacuuuuaaagacuug

SEQ ID NO: 3199664 - RNA, 17 nt, Human
gcagacuuuuaaagacu

SEQ ID NO: 3199665 - RNA, 22 nt, Human
gcagacucuacagaggccaugg

SEQ ID NO: 3199666 - RNA, 19 nt, Human
gcagacucuacagaggcca

SEQ ID NO: 3199667 - RNA, 18 nt, Human
gcagacucuacagaggcc

SEQ ID NO: 3199668 - RNA, 17 nt, Human
gcagacucuacagaggc

SEQ ID NO: 3199669 - RNA, 14 nt, Human
gcacuugcagacuc

SEQ ID NO: 3199670 - RNA, 22 nt, Human
gcacuucgggaggucgaggcag

SEQ ID NO: 3199671 - RNA, 14 nt, Human
gcacuucugccuga

SEQ ID NO: 3199672 - RNA, 21 nt, Human
gcacuucugccugaggggcag

SEQ ID NO: 3199673 - RNA, 17 nt, Human
gcaccacacucagcccu

SEQ ID NO: 3199674 - RNA, 14 nt, Human
gcaccacaaaauau

SEQ ID NO: 3199675 - RNA, 15 nt, Human
gcaccacaaaauaua

SEQ ID NO: 3199676 - RNA, 15 nt, Human
gcaccacacucagcc

SEQ ID NO: 3199677 - RNA, 18 nt, Human
gcaccaaaauaagaaaag

SEQ ID NO: 3199678 - RNA, 13 nt, Human
gcacaggucaggc

SEQ ID NO: 3199679 - RNA, 19 nt, Human
gcacagggccuggcccaug

SEQ ID NO: 3199680 - RNA, 18 nt, Human
gcacagggccuggcccau

SEQ ID NO: 3199681 - RNA, 17 nt, Human
gcacagggccuggccca

SEQ ID NO: 3199682 - RNA, 16 nt, Human
gcacagggccuggccc

SEQ ID NO: 3199683 - RNA, 14 nt, Human
gcacagggccuggc

SEQ ID NO: 3199684 - RNA, 20 nt, Human
gcaccaaaauaagaaaagau

SEQ ID NO: 3199685 - RNA, 19 nt, Human
gcaccaaaauaagaaaaga

SEQ ID NO: 3199686 - RNA, 17 nt, Human
gcaccaucucuccuccu

SEQ ID NO: 3199687 - RNA, 14 nt, Human
gcaccaucucuccu

SEQ ID NO: 3199688 - RNA, 15 nt, Human
gcaccaucucuccuc

SEQ ID NO: 3199689 - RNA, 13 nt, Human
gcaccagcagccu

SEQ ID NO: 3199690 - RNA, 23 nt, Human
gcacagcuucauuuccugugucu

SEQ ID NO: 3199691 - RNA, 21 nt, Human
gcacagcuucauuuccugugu

SEQ ID NO: 3199692 - RNA, 16 nt, Human
gcacagggcaguggga

SEQ ID NO: 3199693 - RNA, 16 nt, Human
gcacagggcaugaaau

SEQ ID NO: 3199694 - RNA, 11 nt, Human
gcacagggccu

SEQ ID NO: 3199695 - RNA, 23 nt, Human
gcacagggcaugaaaugaacaca

SEQ ID NO: 3199696 - RNA, 22 nt, Human
gcacagggcaugaaaugaacac

SEQ ID NO: 3199697 - RNA, 18 nt, Human
gcacagggcaugaaauga

SEQ ID NO: 3199698 - RNA, 22 nt, Human
gcacaggcugagugcaggccca

SEQ ID NO: 3199699 - RNA, 23 nt, Human
gcacaggcugagugcaggcccac

SEQ ID NO: 3199700 - RNA, 16 nt, Human
gcacagggagaggccg

SEQ ID NO: 3199701 - RNA, 20 nt, Human
gauugugucucuugguccug

SEQ ID NO: 3199702 - RNA, 21 nt, Human
gauugugugguguuuuggauu

SEQ ID NO: 3199703 - RNA, 19 nt, Human
gcacuguuuuauuuuaauu

SEQ ID NO: 3199704 - RNA, 12 nt, Human
gcacugggcuug

SEQ ID NO: 3199705 - RNA, 16 nt, Human
gcacuggccuucugau

SEQ ID NO: 3199706 - RNA, 17 nt, Human
gcacuggccuucugaug

SEQ ID NO: 3199707 - RNA, 21 nt, Human
gcacuggccuucugaugaaau

SEQ ID NO: 3199708 - RNA, 12 nt, Human
gcacugcuucca

SEQ ID NO: 3199709 - RNA, 13 nt, Human
gcacugcuuccag

SEQ ID NO: 3199710 - RNA, 14 nt, Human
gcacugcuuccagu

SEQ ID NO: 3199711 - RNA, 15 nt, Human
gcacuauaauguaag

SEQ ID NO: 3199712 - RNA, 14 nt, Human
gcacuauaauguaa

SEQ ID NO: 3199713 - RNA, 20 nt, Human
gcacuauaauguaagcucua

SEQ ID NO: 3199714 - RNA, 16 nt, Human
gcacccucaggcaggu

SEQ ID NO: 3199715 - RNA, 19 nt, Human
gcacccucaggcagguggg

SEQ ID NO: 3199716 - RNA, 23 nt, Human
gcaccccuuccugggcacacgcu

SEQ ID NO: 3199717 - RNA, 15 nt, Human
gcaccccuuccuggg

SEQ ID NO: 3199718 - RNA, 14 nt, Human
gcaccccuuccugg

SEQ ID NO: 3199719 - RNA, 14 nt, Human
gcacgugugugcac

SEQ ID NO: 3199720 - RNA, 20 nt, Human
gcacuaaggugugcucugau

SEQ ID NO: 3199721 - RNA, 19 nt, Human
gcacuaaggugugcucuga

SEQ ID NO: 3199722 - RNA, 22 nt, Human
gcacuaagucucuuuuuuacaa

SEQ ID NO: 3199723 - RNA, 20 nt, Human
gcacuaagucucuuuuuuac

SEQ ID NO: 3199724 - RNA, 19 nt, Human
gcacuaagucucuuuuuua

SEQ ID NO: 3199725 - RNA, 15 nt, Human
gcacuaagucucuuu

SEQ ID NO: 3199726 - RNA, 23 nt, Human
gcacuaagucucuuuuuuacaaa

SEQ ID NO: 3199727 - RNA, 14 nt, Human
gcuguguguggcuu

SEQ ID NO: 3199728 - RNA, 16 nt, Human
gcuguguuugcucccc

SEQ ID NO: 3199729 - RNA, 14 nt, Human
gcuguguuugcucc

SEQ ID NO: 3199730 - RNA, 17 nt, Human
gcuguguuugcuccccu

SEQ ID NO: 3199731 - RNA, 22 nt, Human
gcuguguuuauauggaagaaag

SEQ ID NO: 3199732 - RNA, 23 nt, Human
gcuguuagggguuauugguguaa

SEQ ID NO: 3199733 - RNA, 19 nt, Human
gcuguuacaguuuucuuca

SEQ ID NO: 3199734 - RNA, 17 nt, Human
gcuguuacaguuuucuu

SEQ ID NO: 3199735 - RNA, 16 nt, Human
gcugugugcucuccaa

SEQ ID NO: 3199736 - RNA, 21 nt, Human
gcugugucugcccaaugaaua

SEQ ID NO: 3199737 - RNA, 15 nt, Human
gcugugucucccuuc

SEQ ID NO: 3199738 - RNA, 15 nt, Human
gcugucauugcuucu

SEQ ID NO: 3199739 - RNA, 14 nt, Human
gcuguccacccgcc

SEQ ID NO: 3199740 - RNA, 20 nt, Human
gcugucauugcuucuucuga

SEQ ID NO: 3199741 - RNA, 18 nt, Human
gcugucauugcuucuucu

SEQ ID NO: 3199742 - RNA, 16 nt, Human
gcugucauugcuucuu

SEQ ID NO: 3199743 - RNA, 23 nt, Human
gcugucccuuacgugaguccugg

SEQ ID NO: 3199744 - RNA, 22 nt, Human
gcugucccuuacgugaguccug

SEQ ID NO: 3199745 - RNA, 16 nt, Human
gcugucccuuuuccuu

SEQ ID NO: 3199746 - RNA, 15 nt, Human
gcuggugucaccuga

SEQ ID NO: 3199747 - RNA, 14 nt, Human
gcuggugucaccug

SEQ ID NO: 3199748 - RNA, 17 nt, Human
gcugucagccauuccug

SEQ ID NO: 3199749 - RNA, 16 nt, Human
gcugucacugcugcuu

SEQ ID NO: 3199750 - RNA, 13 nt, Human
gcugucaucucag

SEQ ID NO: 3199751 - RNA, 15 nt, Human
gcugucaguguuugg

SEQ ID NO: 3199752 - RNA, 22 nt, Human
gcugggcuuggcagcccggguc

SEQ ID NO: 3199753 - RNA, 14 nt, Human
gcugggcugggcac

SEQ ID NO: 3199754 - RNA, 13 nt, Human
gcugggcugggca

SEQ ID NO: 3199755 - RNA, 19 nt, Human
gcugggcuucaguggcagc

SEQ ID NO: 3199756 - RNA, 13 nt, Human
gcuggggaagaau

SEQ ID NO: 3199757 - RNA, 23 nt, Human
gcuggggaagaauuuacuuugga

SEQ ID NO: 3199758 - RNA, 22 nt, Human
gcugggcuucaguggcagcugc

SEQ ID NO: 3199759 - RNA, 21 nt, Human
gcugggcuucaguggcagcug

SEQ ID NO: 3199760 - RNA, 20 nt, Human
gcugggcuucaguggcagcu

SEQ ID NO: 3199761 - RNA, 15 nt, Human
gcuggccggacaccc

SEQ ID NO: 3199762 - RNA, 19 nt, Human
gcugggaugauuggagggg

SEQ ID NO: 3199763 - RNA, 21 nt, Human
gcugggcucccuucccaccuc

SEQ ID NO: 3199764 - RNA, 13 nt, Human
gcuggccuggccc

SEQ ID NO: 3199765 - RNA, 12 nt, Human
gcuggccuggcc

SEQ ID NO: 3199766 - RNA, 14 nt, Human
gcuggccuggcccc

SEQ ID NO: 3199767 - RNA, 15 nt, Human
gcuggccuggccccu

SEQ ID NO: 3199768 - RNA, 14 nt, Human
gcuggggaugucuc

SEQ ID NO: 3199769 - RNA, 15 nt, Human
gcugggggccucagu

SEQ ID NO: 3199770 - RNA, 14 nt, Human
gcugggggccucag

SEQ ID NO: 3199771 - RNA, 13 nt, Human
gcugggggccuca

SEQ ID NO: 3199772 - RNA, 18 nt, Human
gcugggggccucagugcc

SEQ ID NO: 3199773 - RNA, 22 nt, Human
gcuggucacuucuucuguccaa

SEQ ID NO: 3199774 - RNA, 21 nt, Human
gcuggucacuucuucugucca

SEQ ID NO: 3199775 - RNA, 20 nt, Human
gcuggucacuucuucugucc

SEQ ID NO: 3199776 - RNA, 14 nt, Human
gcuggucacuucuu

SEQ ID NO: 3199777 - RNA, 22 nt, Human
gcuggucguaaacaucucagag

SEQ ID NO: 3199778 - RNA, 19 nt, Human
gcuggucucgaacuccuga

SEQ ID NO: 3199779 - RNA, 22 nt, Human
gcuggucucgaacuccugaccu

SEQ ID NO: 3199780 - RNA, 23 nt, Human
gcuggucucgaacuccugaccuu

SEQ ID NO: 3199781 - RNA, 23 nt, Human
gcuggucguaaacaucucagaga

SEQ ID NO: 3199782 - RNA, 14 nt, Human
gcuuuccaaagcca

SEQ ID NO: 3199783 - RNA, 20 nt, Human
gcuuuaaaauucucuuccaa

SEQ ID NO: 3199784 - RNA, 14 nt, Human
gcuuuaaaauucuc

SEQ ID NO: 3199785 - RNA, 16 nt, Human
gcuuguuuuggacuuu

SEQ ID NO: 3199786 - RNA, 20 nt, Human
gcuuuuaguuuuucuguccc

SEQ ID NO: 3199787 - RNA, 19 nt, Human
gcuuuuaguuuuucugucc

SEQ ID NO: 3199788 - RNA, 15 nt, Human
gcuuuuaguuuuucu

SEQ ID NO: 3199789 - RNA, 17 nt, Human
gcuuuggucacuuuuag

SEQ ID NO: 3199790 - RNA, 19 nt, Human
gcuuugggcugcccuggug

SEQ ID NO: 3199791 - RNA, 18 nt, Human
gcuuugggcugcccuggu

SEQ ID NO: 3199792 - RNA, 14 nt, Human
gcuuuccauauuuu

SEQ ID NO: 3199793 - RNA, 21 nt, Human
gcuuuccauauuuuuuuccuu

SEQ ID NO: 3199794 - RNA, 13 nt, Human
gcuuguugacaga

SEQ ID NO: 3199795 - RNA, 22 nt, Human
gcuuguggcuccacacacacaa

SEQ ID NO: 3199796 - RNA, 19 nt, Human
gcuuguggcuccacacaca

SEQ ID NO: 3199797 - RNA, 13 nt, Human
gcuuguggcucca

SEQ ID NO: 3199798 - RNA, 18 nt, Human
gcuugcccuguuaaaaga

SEQ ID NO: 3199799 - RNA, 18 nt, Human
gcuugcggcaaaaggaaa

SEQ ID NO: 3199800 - RNA, 10 nt, Human
gcuucauaca

SEQ ID NO: 3199801 - RNA, 21 nt, Human
gcuucauccuccucagaucuu

SEQ ID NO: 3199802 - RNA, 22 nt, Human
gcuucauguucccaaaaucacc

SEQ ID NO: 3199803 - RNA, 20 nt, Human
gcuucaguggcagcugcuuu

SEQ ID NO: 3199804 - RNA, 19 nt, Human
gcuucaguggcagcugcuu

SEQ ID NO: 3199805 - RNA, 15 nt, Human
gcuuagaaacuggaa

SEQ ID NO: 3199806 - RNA, 14 nt, Human
gcuuacguaguucu

SEQ ID NO: 3199807 - RNA, 15 nt, Human
gcuuacguaguucua

SEQ ID NO: 3199808 - RNA, 22 nt, Human
gcuuacguaguucuaccggcuu

SEQ ID NO: 3199809 - RNA, 20 nt, Human
gcuuauacacuuacacuuua

SEQ ID NO: 3199810 - RNA, 15 nt, Human
gcuuauauuugugua

SEQ ID NO: 3199811 - RNA, 19 nt, Human
gcuucuguugcugccucau

SEQ ID NO: 3199812 - RNA, 16 nt, Human
gcuucuggaugggaca

SEQ ID NO: 3199813 - RNA, 17 nt, Human
gcuucuguugcugccuc

SEQ ID NO: 3199814 - RNA, 18 nt, Human
gcuucuguugcugccuca

SEQ ID NO: 3199815 - RNA, 16 nt, Human
gcuucucagcucgcug

SEQ ID NO: 3199816 - RNA, 18 nt, Human
gcuucauuuccugugucu

SEQ ID NO: 3199817 - RNA, 16 nt, Human
gcuuccaauuuuccuu

SEQ ID NO: 3199818 - RNA, 22 nt, Human
gcuucucacugccaugccagcu

SEQ ID NO: 3199819 - RNA, 17 nt, Human
gcuucucacugccaugc

SEQ ID NO: 3199820 - RNA, 14 nt, Human
gcugauuguauuua

SEQ ID NO: 3199821 - RNA, 21 nt, Human
gcugaugacccccccagcuuc

SEQ ID NO: 3199822 - RNA, 14 nt, Human
gcugaucuaaaaau

SEQ ID NO: 3199823 - RNA, 21 nt, Human
gcugauuaaaccaaggcuaga

SEQ ID NO: 3199824 - RNA, 22 nt, Human
gcugcaaaggguaucaggugcu

SEQ ID NO: 3199825 - RNA, 12 nt, Human
gcugauuuuauu

SEQ ID NO: 3199826 - RNA, 17 nt, Human
gcugauuuuauucuuga

SEQ ID NO: 3199827 - RNA, 16 nt, Human
gcugauuuuauucuug

SEQ ID NO: 3199828 - RNA, 22 nt, Human
gcugauaauguauaugaacuua

SEQ ID NO: 3199829 - RNA, 12 nt, Human
gcugagaagacu

SEQ ID NO: 3199830 - RNA, 12 nt, Human
gcugccaccugc

SEQ ID NO: 3199831 - RNA, 20 nt, Human
gcugccaaugggagcucaug

SEQ ID NO: 3199832 - RNA, 17 nt, Human
gcugccacacuucaggc

SEQ ID NO: 3199833 - RNA, 15 nt, Human
gcugccacacuucag

SEQ ID NO: 3199834 - RNA, 23 nt, Human
gcugccacacuucaggcucuucu

SEQ ID NO: 3199835 - RNA, 22 nt, Human
gcugccacacuucaggcucuuc

SEQ ID NO: 3199836 - RNA, 21 nt, Human
gcugccacacuucaggcucuu

SEQ ID NO: 3199837 - RNA, 18 nt, Human
gcugccacacuucaggcu

SEQ ID NO: 3199838 - RNA, 13 nt, Human
gcugcaguugcca

SEQ ID NO: 3199839 - RNA, 14 nt, Human
gcugcaguugccag

SEQ ID NO: 3199840 - RNA, 20 nt, Human
gcugauuuuauucuugauca

SEQ ID NO: 3199841 - RNA, 18 nt, Human
gcugauuuuauucuugau

SEQ ID NO: 3199842 - RNA, 22 nt, Human
gcucuugcauaguaaauguagu

SEQ ID NO: 3199843 - RNA, 19 nt, Human
gcucuuggcagguacucag

SEQ ID NO: 3199844 - RNA, 23 nt, Human
gcucuugggcaauauucucugua

SEQ ID NO: 3199845 - RNA, 10 nt, Human
gcucuuucuu

SEQ ID NO: 3199846 - RNA, 21 nt, Human
gcucuuucuucuuccacacau

SEQ ID NO: 3199847 - RNA, 24 nt, Human
gcucuuuggccugaugaccaauuu

SEQ ID NO: 3199848 - RNA, 15 nt, Human
gcucuccaagcccag

SEQ ID NO: 3199849 - RNA, 14 nt, Human
gcucuugaacuccu

SEQ ID NO: 3199850 - RNA, 16 nt, Human
gcucuugaacuccuga

SEQ ID NO: 3199851 - RNA, 19 nt, Human
gcucuugaacuccugaccu

SEQ ID NO: 3199852 - RNA, 21 nt, Human
gcucuugaacuccugaccuca

SEQ ID NO: 3199853 - RNA, 20 nt, Human
gcucucaggccagcugcuug

SEQ ID NO: 3199854 - RNA, 16 nt, Human
gcucgccacagugggc

SEQ ID NO: 3199855 - RNA, 16 nt, Human
gcucgaugcagacagg

SEQ ID NO: 3199856 - RNA, 19 nt, Human
gcuccuuucugaucuucac

SEQ ID NO: 3199857 - RNA, 17 nt, Human
gcucgaugcagacaggg

SEQ ID NO: 3199858 - RNA, 21 nt, Human
gcucucaggccagcugcuugg

SEQ ID NO: 3199859 - RNA, 17 nt, Human
gcucucaugcugccccu

SEQ ID NO: 3199860 - RNA, 13 nt, Human
gcugacuuagaau

SEQ ID NO: 3199861 - RNA, 22 nt, Human
gcugacuguuuucucuugagag

SEQ ID NO: 3199862 - RNA, 19 nt, Human
gcugacagacacaggcccg

SEQ ID NO: 3199863 - RNA, 18 nt, Human
gcugacagacacaggccc

SEQ ID NO: 3199864 - RNA, 17 nt, Human
gcugacagacacaggcc

SEQ ID NO: 3199865 - RNA, 12 nt, Human
gcugcccugccc

SEQ ID NO: 3199866 - RNA, 13 nt, Human
gcugcccugccca

SEQ ID NO: 3199867 - RNA, 14 nt, Human
gcugcccugcccac

SEQ ID NO: 3199868 - RNA, 16 nt, Human
gcugcccugcccaccu

SEQ ID NO: 3199869 - RNA, 18 nt, Human
gcugcccugcccaccugg

SEQ ID NO: 3199870 - RNA, 20 nt, Human
gcugcccugcccaccuggcc

SEQ ID NO: 3199871 - RNA, 21 nt, Human
gcugcccugcccaccuggccu

SEQ ID NO: 3199872 - RNA, 22 nt, Human
gcugcccugcccaccuggccuc

SEQ ID NO: 3199873 - RNA, 23 nt, Human
gcugcccugcccaccuggccucu

SEQ ID NO: 3199874 - RNA, 24 nt, Human
gcugcccugcccaccuggccucug

SEQ ID NO: 3199875 - RNA, 22 nt, Human
gcugcgguccacccaggagccc

SEQ ID NO: 3199876 - RNA, 21 nt, Human
gcugcgguccacccaggagcc

SEQ ID NO: 3199877 - RNA, 19 nt, Human
gcugcgguccacccaggag

SEQ ID NO: 3199878 - RNA, 15 nt, Human
gcugcgguccaccca

SEQ ID NO: 3199879 - RNA, 14 nt, Human
gcugcgguccaccc

SEQ ID NO: 3199880 - RNA, 20 nt, Human
gcugccuucgguacccacca

SEQ ID NO: 3199881 - RNA, 21 nt, Human
gcugccuucgguacccaccac

SEQ ID NO: 3199882 - RNA, 19 nt, Human
gcugccuguucagcuccag

SEQ ID NO: 3199883 - RNA, 18 nt, Human
gcugccuguucagcucca

SEQ ID NO: 3199884 - RNA, 15 nt, Human
gcugcccuggugcug

SEQ ID NO: 3199885 - RNA, 14 nt, Human
gcugcccuggugcu

SEQ ID NO: 3199886 - RNA, 13 nt, Human
gcugcccuggugc

SEQ ID NO: 3199887 - RNA, 12 nt, Human
gcugcccuggug

SEQ ID NO: 3199888 - RNA, 22 nt, Human
gcugccuguucagcuccagcuc

SEQ ID NO: 3199889 - RNA, 20 nt, Human
gcugccuguucagcuccagc

SEQ ID NO: 3199890 - RNA, 15 nt, Human
gcugccuuagaaccu

SEQ ID NO: 3199891 - RNA, 17 nt, Human
gcugcccuggugcugcc

SEQ ID NO: 3199892 - RNA, 20 nt, Human
gcugccuuagaaccuuucuu

SEQ ID NO: 3199893 - RNA, 22 nt, Human
gcugcuuuuuuugaaacuuuga

SEQ ID NO: 3199894 - RNA, 14 nt, Human
gcugcuuuuuuuga

SEQ ID NO: 3199895 - RNA, 23 nt, Human
gcuggaaugauuucagcucacug

SEQ ID NO: 3199896 - RNA, 12 nt, Human
gcuggaaggagg

SEQ ID NO: 3199897 - RNA, 16 nt, Human
gcuggaaggaggaaga

SEQ ID NO: 3199898 - RNA, 18 nt, Human
gcuggaaggaggaagaau

SEQ ID NO: 3199899 - RNA, 14 nt, Human
gcuggaacucuuga

SEQ ID NO: 3199900 - RNA, 21 nt, Human
gcuggaacucuugacagcuau

SEQ ID NO: 3199901 - RNA, 22 nt, Human
gcugcuugggcuucauccuccu

SEQ ID NO: 3199902 - RNA, 22 nt, Human
gcugcuuuugucuaugggacuc

SEQ ID NO: 3199903 - RNA, 15 nt, Human
gcugcuuugauauau

SEQ ID NO: 3199904 - RNA, 12 nt, Human
gcugcuuuguua

SEQ ID NO: 3199905 - RNA, 19 nt, Human
gcugcuuuguuaccuuaaa

SEQ ID NO: 3199906 - RNA, 20 nt, Human
gcugcuuuguuaccuuaaaa

SEQ ID NO: 3199907 - RNA, 22 nt, Human
gcugcuuuguuaccuuaaaacu

SEQ ID NO: 3199908 - RNA, 23 nt, Human
gcugcuuuguuaccuuaaaacua

SEQ ID NO: 3199909 - RNA, 13 nt, Human
gcugcuuucuucu

SEQ ID NO: 3199910 - RNA, 17 nt, Human
gcugcuaauucuuugca

SEQ ID NO: 3199911 - RNA, 16 nt, Human
gcugcuaauucuuugc

SEQ ID NO: 3199912 - RNA, 15 nt, Human
gcuggaccuugaacu

SEQ ID NO: 3199913 - RNA, 13 nt, Human
gcuggcccugccc

SEQ ID NO: 3199914 - RNA, 14 nt, Human
gcuggcccugcccu

SEQ ID NO: 3199915 - RNA, 15 nt, Human
gcuggcccugcccug

SEQ ID NO: 3199916 - RNA, 16 nt, Human
gcuggcccugcccugg

SEQ ID NO: 3199917 - RNA, 14 nt, Human
gcuggccggacacc

SEQ ID NO: 3199918 - RNA, 19 nt, Human
gcuggcccuggcucccaca

SEQ ID NO: 3199919 - RNA, 14 nt, Human
gcgaauuuuaaaag

SEQ ID NO: 3199920 - RNA, 14 nt, Human
gcgaaucauuuguu

SEQ ID NO: 3199921 - RNA, 16 nt, Human
gcgaauuuuaaaagau

SEQ ID NO: 3199922 - RNA, 15 nt, Human
gcgaauuuuaaaaga

SEQ ID NO: 3199923 - RNA, 15 nt, Human
gccuuucuguguuua

SEQ ID NO: 3199924 - RNA, 22 nt, Human
gccuuucauuuugcuuuaauuu

SEQ ID NO: 3199925 - RNA, 18 nt, Human
gccuuucauuuugcuuua

SEQ ID NO: 3199926 - RNA, 15 nt, Human
gccuuucauuuugcu

SEQ ID NO: 3199927 - RNA, 12 nt, Human
gcgacaaugcaa

SEQ ID NO: 3199928 - RNA, 13 nt, Human
gcgacaaugcaaa

SEQ ID NO: 3199929 - RNA, 20 nt, Human
gcgacaaugcaaaccaucau

SEQ ID NO: 3199930 - RNA, 21 nt, Human
gcgacaaugcaaaccaucauu

SEQ ID NO: 3199931 - RNA, 18 nt, Human
gcgcaggcuggcccugcc

SEQ ID NO: 3199932 - RNA, 19 nt, Human
gcgcaggcuggcccugccc

SEQ ID NO: 3199933 - RNA, 17 nt, Human
gcgcaggcuggcccugc

SEQ ID NO: 3199934 - RNA, 13 nt, Human
gcgacaacagauu

SEQ ID NO: 3199935 - RNA, 20 nt, Human
gcgcaggcuggcccugcccu

SEQ ID NO: 3199936 - RNA, 21 nt, Human
gcgcaggcuggcccugcccug

SEQ ID NO: 3199937 - RNA, 22 nt, Human
gcgcaggcuggcccugcccugg

SEQ ID NO: 3199938 - RNA, 14 nt, Human
gccuugugguccaa

SEQ ID NO: 3199939 - RNA, 17 nt, Human
gccuugugguccaaaua

SEQ ID NO: 3199940 - RNA, 17 nt, Human
gccuuggggucagguug

SEQ ID NO: 3199941 - RNA, 19 nt, Human
gccuuguauaauauugaaa

SEQ ID NO: 3199942 - RNA, 21 nt, Human
gccuuguauaauauugaaaau

SEQ ID NO: 3199943 - RNA, 22 nt, Human
gccuuguauaauauugaaaauu

SEQ ID NO: 3199944 - RNA, 22 nt, Human
gccuuaagugaggaaaucaaag

SEQ ID NO: 3199945 - RNA, 15 nt, Human
gccuuacacaauggu

SEQ ID NO: 3199946 - RNA, 22 nt, Human
gccuuaaagacaagacagcauu

SEQ ID NO: 3199947 - RNA, 13 nt, Human
gccuuaaagacaa

SEQ ID NO: 3199948 - RNA, 14 nt, Human
gccuuaagcugcag

SEQ ID NO: 3199949 - RNA, 20 nt, Human
gccuuaagugaggaaaucaa

SEQ ID NO: 3199950 - RNA, 21 nt, Human
gccuuaagugaggaaaucaaa

SEQ ID NO: 3199951 - RNA, 17 nt, Human
gccugucuuaauuuucu

SEQ ID NO: 3199952 - RNA, 19 nt, Human
gccugucugugaagagcaa

SEQ ID NO: 3199953 - RNA, 16 nt, Human
gccugucuuaauuuuc

SEQ ID NO: 3199954 - RNA, 23 nt, Human
gcgcccaguuggguggaugccug

SEQ ID NO: 3199955 - RNA, 13 nt, Human
gcgccccuucccc

SEQ ID NO: 3199956 - RNA, 22 nt, Human
gcgccccgaaaggucaccucac

SEQ ID NO: 3199957 - RNA, 23 nt, Human
gcgcauaggccugcuuugucucc

SEQ ID NO: 3199958 - RNA, 16 nt, Human
gcgcaguugcugucag

SEQ ID NO: 3199959 - RNA, 21 nt, Human
gcgccuuaaggauguucuagc

SEQ ID NO: 3199960 - RNA, 16 nt, Human
gcgcccuggcccccac

SEQ ID NO: 3199961 - RNA, 15 nt, Human
gcgcccuggccccca

SEQ ID NO: 3199962 - RNA, 14 nt, Human
gcgcccuggccccc

SEQ ID NO: 3199963 - RNA, 13 nt, Human
gcgcccuggcccc

SEQ ID NO: 3199964 - RNA, 12 nt, Human
gcgcccuggccc

SEQ ID NO: 3199965 - RNA, 14 nt, Human
gcggggacagcucc

SEQ ID NO: 3199966 - RNA, 19 nt, Human
gcggagacggagucccacc

SEQ ID NO: 3199967 - RNA, 16 nt, Human
gcggagaaaggaaggg

SEQ ID NO: 3199968 - RNA, 22 nt, Human
gcggacauccccugcuggccgg

SEQ ID NO: 3199969 - RNA, 20 nt, Human
gcggacauccccugcuggcc

SEQ ID NO: 3199970 - RNA, 17 nt, Human
gcgcugccccuggcagc

SEQ ID NO: 3199971 - RNA, 18 nt, Human
gcgcugccccuggcagcc

SEQ ID NO: 3199972 - RNA, 21 nt, Human
gcgcugccccuggcagccccu

SEQ ID NO: 3199973 - RNA, 14 nt, Human
gcgguccacccagg

SEQ ID NO: 3199974 - RNA, 13 nt, Human
gcgguccacccag

SEQ ID NO: 3199975 - RNA, 19 nt, Human
gcggugagaggggaacaga

SEQ ID NO: 3199976 - RNA, 18 nt, Human
gcggugcccaaccacacu

SEQ ID NO: 3199977 - RNA, 17 nt, Human
gcggggacagcuccuuc

SEQ ID NO: 3199978 - RNA, 15 nt, Human
gcggggacagcuccu

SEQ ID NO: 3199979 - RNA, 19 nt, Human
gcggguuauaaugaaugac

SEQ ID NO: 3199980 - RNA, 13 nt, Human
gccuggucagccc

SEQ ID NO: 3199981 - RNA, 15 nt, Human
gccuggucagcccaa

SEQ ID NO: 3199982 - RNA, 14 nt, Human
gccuggucagccca

SEQ ID NO: 3199983 - RNA, 17 nt, Human
gccugggccuggcuccc

SEQ ID NO: 3199984 - RNA, 16 nt, Human
gccugggccuggcucc

SEQ ID NO: 3199985 - RNA, 15 nt, Human
gccugggccuggcuc

SEQ ID NO: 3199986 - RNA, 14 nt, Human
gccugggccuggcu

SEQ ID NO: 3199987 - RNA, 13 nt, Human
gccugggccuggc

SEQ ID NO: 3199988 - RNA, 11 nt, Human
gccugggccug

SEQ ID NO: 3199989 - RNA, 21 nt, Human
gccugggccguagcuugucug

SEQ ID NO: 3199990 - RNA, 15 nt, Human
gccuguaauccuagc

SEQ ID NO: 3199991 - RNA, 20 nt, Human
gccuguaauccuagcacuuu

SEQ ID NO: 3199992 - RNA, 20 nt, Human
gccugucucggaaccuguga

SEQ ID NO: 3199993 - RNA, 18 nt, Human
gccugggcagaaggaaga

SEQ ID NO: 3199994 - RNA, 13 nt, Human
gccuggccccuca

SEQ ID NO: 3199995 - RNA, 14 nt, Human
gccuggccccucag

SEQ ID NO: 3199996 - RNA, 22 nt, Human
gccuggcccauguauggccagg

SEQ ID NO: 3199997 - RNA, 12 nt, Human
gccuggcccaug

SEQ ID NO: 3199998 - RNA, 21 nt, Human
gccuggccagaugcaccagcc

SEQ ID NO: 3199999 - RNA, 16 nt, Human
gccuggccagaugcac

SEQ ID NO: 3200000 - RNA, 20 nt, Human
gccuggccagaugcaccagc

SEQ ID NO: 3200001 - RNA, 21 nt, Human
gccuggcagccgugccuucag

SEQ ID NO: 3200002 - RNA, 20 nt, Human
gccuggcagccgugccuuca

SEQ ID NO: 3200003 - RNA, 12 nt, Human
gccuggcagccg

SEQ ID NO: 3200004 - RNA, 19 nt, Human
gccuggcacagggcagugg

SEQ ID NO: 3200005 - RNA, 18 nt, Human
gccuggcacagggcagug

SEQ ID NO: 3200006 - RNA, 16 nt, Human
gccuggauggggcugc

SEQ ID NO: 3200007 - RNA, 18 nt, Human
gccuggauggggcugcac

SEQ ID NO: 3200008 - RNA, 20 nt, Human
gccuggauggggcugcaccg

SEQ ID NO: 3200009 - RNA, 20 nt, Human
gccuggcaauagaccgagac

SEQ ID NO: 3200010 - RNA, 14 nt, Human
gccuggcacagggc

SEQ ID NO: 3200011 - RNA, 13 nt, Human
gccuggcacaggg

SEQ ID NO: 3200012 - RNA, 20 nt, Human
gccugcuccuucccuugcua

SEQ ID NO: 3200013 - RNA, 18 nt, Human
gccugcucuuuggccuga

SEQ ID NO: 3200014 - RNA, 15 nt, Human
gccugcuccuucccu

SEQ ID NO: 3200015 - RNA, 14 nt, Human
gccugcuccuuccc

SEQ ID NO: 3200016 - RNA, 13 nt, Human
gccugcuccuucc

SEQ ID NO: 3200017 - RNA, 12 nt, Human
gccugcuccuuc

SEQ ID NO: 3200018 - RNA, 18 nt, Human
gccuggaaaccugucuga

SEQ ID NO: 3200019 - RNA, 17 nt, Human
gccuggaaaccugucug

SEQ ID NO: 3200020 - RNA, 16 nt, Human
gccugcuuuuuggaaa

SEQ ID NO: 3200021 - RNA, 21 nt, Human
gccugcuuuuuggaaagucag

SEQ ID NO: 3200022 - RNA, 17 nt, Human
gccugagcgacagugag

SEQ ID NO: 3200023 - RNA, 20 nt, Human
gccugagcgacagugagacu

SEQ ID NO: 3200024 - RNA, 18 nt, Human
gccugaagucacacagug

SEQ ID NO: 3200025 - RNA, 17 nt, Human
gccugaagucacacagu

SEQ ID NO: 3200026 - RNA, 16 nt, Human
gccugaagucacacag

SEQ ID NO: 3200027 - RNA, 15 nt, Human
gccugaagucacaca

SEQ ID NO: 3200028 - RNA, 21 nt, Human
gcccaguuggguggaugccug

SEQ ID NO: 3200029 - RNA, 19 nt, Human
gcccaguuggguggaugcc

SEQ ID NO: 3200030 - RNA, 12 nt, Human
gccugagcuggg

SEQ ID NO: 3200031 - RNA, 13 nt, Human
gccugaggcuccu

SEQ ID NO: 3200032 - RNA, 13 nt, Human
gcuccugugucuu

SEQ ID NO: 3200033 - RNA, 12 nt, Human
gcuccugugucu

SEQ ID NO: 3200034 - RNA, 18 nt, Human
gcuccuuccucugaggcu

SEQ ID NO: 3200035 - RNA, 19 nt, Human
gcuccuucccuugcuacca

SEQ ID NO: 3200036 - RNA, 15 nt, Human
gcuccuucccuugcu

SEQ ID NO: 3200037 - RNA, 22 nt, Human
gcuccuucaacaaggcuugcug

SEQ ID NO: 3200038 - RNA, 21 nt, Human
gcuccuucaacaaggcuugcu

SEQ ID NO: 3200039 - RNA, 22 nt, Human
gcuccuuaggguuuucucucua

SEQ ID NO: 3200040 - RNA, 21 nt, Human
gcuccuuaggguuuucucucu

SEQ ID NO: 3200041 - RNA, 19 nt, Human
gcuccuuaggguuuucucu

SEQ ID NO: 3200042 - RNA, 20 nt, Human
gcuccuuccucugaggcuga

SEQ ID NO: 3200043 - RNA, 22 nt, Human
gcuccuuccucugaggcugaaa

SEQ ID NO: 3200044 - RNA, 19 nt, Human
gcucgagcaugccuggaug

SEQ ID NO: 3200045 - RNA, 21 nt, Human
gcucgagcaugccuggauggg

SEQ ID NO: 3200046 - RNA, 17 nt, Human
gcucgagcaugccugga

SEQ ID NO: 3200047 - RNA, 12 nt, Human
gcuccuuucuga

SEQ ID NO: 3200048 - RNA, 17 nt, Human
gcuccuuuagcgcccag

SEQ ID NO: 3200049 - RNA, 13 nt, Human
gcuccuucugucc

SEQ ID NO: 3200050 - RNA, 14 nt, Human
gcuccucccggugc

SEQ ID NO: 3200051 - RNA, 23 nt, Human
gcuccuggggguucuuucuuccu

SEQ ID NO: 3200052 - RNA, 12 nt, Human
gcuccgucugac

SEQ ID NO: 3200053 - RNA, 15 nt, Human
gcuccgggcuccgac

SEQ ID NO: 3200054 - RNA, 22 nt, Human
gcuccgggacguggcaccuccu

SEQ ID NO: 3200055 - RNA, 21 nt, Human
gcuccgggacguggcaccucc

SEQ ID NO: 3200056 - RNA, 23 nt, Human
gcuccggcguguguucaguguua

SEQ ID NO: 3200057 - RNA, 24 nt, Human
gcuccgcuuucuacccagcgagcc

SEQ ID NO: 3200058 - RNA, 22 nt, Human
gcuccggcguguguucaguguu

SEQ ID NO: 3200059 - RNA, 17 nt, Human
gcuccaggccagggggc

SEQ ID NO: 3200060 - RNA, 12 nt, Human
gcuccaggcagc

SEQ ID NO: 3200061 - RNA, 20 nt, Human
gcuccaggcagcacccaggu

SEQ ID NO: 3200062 - RNA, 15 nt, Human
gcuccaggcagcacc

SEQ ID NO: 3200063 - RNA, 18 nt, Human
gcuccaggccagggggcc

SEQ ID NO: 3200064 - RNA, 22 nt, Human
gcuccaggcagcacccagguuu

SEQ ID NO: 3200065 - RNA, 24 nt, Human
gcuccaggcuccuuuagcgcccag

SEQ ID NO: 3200066 - RNA, 12 nt, Human
gcuccaggcucc

SEQ ID NO: 3200067 - RNA, 15 nt, Human
gcuccaggagcagcc

SEQ ID NO: 3200068 - RNA, 16 nt, Human
gcuccaggagcagcca

SEQ ID NO: 3200069 - RNA, 17 nt, Human
gcuccaggagcagccac

SEQ ID NO: 3200070 - RNA, 18 nt, Human
gcuccaggagcagccaca

SEQ ID NO: 3200071 - RNA, 12 nt, Human
gcuccaggagca

SEQ ID NO: 3200072 - RNA, 14 nt, Human
gcuccaggagcagc

SEQ ID NO: 3200073 - RNA, 11 nt, Human
gcuccaggagc

SEQ ID NO: 3200074 - RNA, 21 nt, Human
gcuccagcuguucagcugguu

SEQ ID NO: 3200075 - RNA, 20 nt, Human
gcuccagcuguucagcuggu

SEQ ID NO: 3200076 - RNA, 22 nt, Human
gcucauucagcaucugaccucu

SEQ ID NO: 3200077 - RNA, 18 nt, Human
gcucauucagcaucugac

SEQ ID NO: 3200078 - RNA, 16 nt, Human
gcucauucagcaucug

SEQ ID NO: 3200079 - RNA, 18 nt, Human
gcuccaguccccagaacu

SEQ ID NO: 3200080 - RNA, 19 nt, Human
gcucccuucccaccucucu

SEQ ID NO: 3200081 - RNA, 23 nt, Human
gcuccgcuuucuacccagcgagc

SEQ ID NO: 3200082 - RNA, 22 nt, Human
gcuccgcuuucuacccagcgag

SEQ ID NO: 3200083 - RNA, 21 nt, Human
gcuccgcuuucuacccagcga

SEQ ID NO: 3200084 - RNA, 18 nt, Human
gcuccgcuuucuacccag

SEQ ID NO: 3200085 - RNA, 20 nt, Human
gcucccuucccaccucucuc

SEQ ID NO: 3200086 - RNA, 23 nt, Human
gcuccgacuugugcacaggcaga

SEQ ID NO: 3200087 - RNA, 22 nt, Human
gcuccgacuugugcacaggcag

SEQ ID NO: 3200088 - RNA, 18 nt, Human
gcucccuugaccugcuga

SEQ ID NO: 3200089 - RNA, 22 nt, Human
gcucaucagaaacaauuucugu

SEQ ID NO: 3200090 - RNA, 15 nt, Human
gcucaucagaaacaa

SEQ ID NO: 3200091 - RNA, 19 nt, Human
gcucagcugucaaggcuca

SEQ ID NO: 3200092 - RNA, 23 nt, Human
gcucagcggggacagcuccuucu

SEQ ID NO: 3200093 - RNA, 18 nt, Human
gcucagcggggacagcuc

SEQ ID NO: 3200094 - RNA, 17 nt, Human
gcucagcggggacagcu

SEQ ID NO: 3200095 - RNA, 16 nt, Human
gcucagcggggacagc

SEQ ID NO: 3200096 - RNA, 21 nt, Human
gcucagcccucccugccccuc

SEQ ID NO: 3200097 - RNA, 19 nt, Human
gcucagcccucccugcccc

SEQ ID NO: 3200098 - RNA, 18 nt, Human
gcucagcccucccugccc

SEQ ID NO: 3200099 - RNA, 17 nt, Human
gcucagcccucccugcc

SEQ ID NO: 3200100 - RNA, 15 nt, Human
gcucaccagccccag

SEQ ID NO: 3200101 - RNA, 14 nt, Human
gcucaccagcccca

SEQ ID NO: 3200102 - RNA, 13 nt, Human
gcucaccagcccc

SEQ ID NO: 3200103 - RNA, 12 nt, Human
gcucaccagccc

SEQ ID NO: 3200104 - RNA, 16 nt, Human
gcucacauaucuguca

SEQ ID NO: 3200105 - RNA, 22 nt, Human
gcucacagaacccuuggagcca

SEQ ID NO: 3200106 - RNA, 14 nt, Human
gcucaccucucccu

SEQ ID NO: 3200107 - RNA, 16 nt, Human
gcucaccucucccuug

SEQ ID NO: 3200108 - RNA, 17 nt, Human
gcucaccucucccuugg

SEQ ID NO: 3200109 - RNA, 18 nt, Human
gcucaccucucccuugga

SEQ ID NO: 3200110 - RNA, 12 nt, Human
gcucagcccucc

SEQ ID NO: 3200111 - RNA, 16 nt, Human
gcucagcccucccugc

SEQ ID NO: 3200112 - RNA, 15 nt, Human
gcucagcccucccug

SEQ ID NO: 3200113 - RNA, 13 nt, Human
gcuaucuccccca

SEQ ID NO: 3200114 - RNA, 18 nt, Human
gcucaaguccucuuuucu

SEQ ID NO: 3200115 - RNA, 17 nt, Human
gcucaagcccaggaggg

SEQ ID NO: 3200116 - RNA, 16 nt, Human
gcucaagcccaggagg

SEQ ID NO: 3200117 - RNA, 14 nt, Human
gcuaucucccccag

SEQ ID NO: 3200118 - RNA, 22 nt, Human
gcucaaguccucuuuucugaga

SEQ ID NO: 3200119 - RNA, 19 nt, Human
gcucaaguccucuuuucug

SEQ ID NO: 3200120 - RNA, 21 nt, Human
gcuaguugggcuuccucauag

SEQ ID NO: 3200121 - RNA, 17 nt, Human
gcuauaaauuauauucc

SEQ ID NO: 3200122 - RNA, 19 nt, Human
gcggugcuaucucccccag

SEQ ID NO: 3200123 - RNA, 22 nt, Human
gcggugcuaucucccccagccc

SEQ ID NO: 3200124 - RNA, 19 nt, Human
gcuauaggugcuacaaaaa

SEQ ID NO: 3200125 - RNA, 21 nt, Human
gcuauaggugcuacaaaaaca

SEQ ID NO: 3200126 - RNA, 20 nt, Human
gcuauaacuauguugauaaa

SEQ ID NO: 3200127 - RNA, 23 nt, Human
gcuauaguuacuguccuguugau

SEQ ID NO: 3200128 - RNA, 16 nt, Human
ggccugacucucagca

SEQ ID NO: 3200129 - RNA, 22 nt, Human
ggccucugcacuccccugcugg

SEQ ID NO: 3200130 - RNA, 18 nt, Human
ggccucugcacuccccug

SEQ ID NO: 3200131 - RNA, 19 nt, Human
ggccucugcacuccccugc

SEQ ID NO: 3200132 - RNA, 13 nt, Human
ggccuggccccuc

SEQ ID NO: 3200133 - RNA, 12 nt, Human
ggccuggcccau

SEQ ID NO: 3200134 - RNA, 14 nt, Human
ggccuggccccuca

SEQ ID NO: 3200135 - RNA, 15 nt, Human
ggccuggccccucag

SEQ ID NO: 3200136 - RNA, 17 nt, Human
ggccuggccccucaggg

SEQ ID NO: 3200137 - RNA, 18 nt, Human
ggccuggccccucagggu

SEQ ID NO: 3200138 - RNA, 23 nt, Human
ggccuggccccucagggucccug

SEQ ID NO: 3200139 - RNA, 10 nt, Human
ggccuggccu

SEQ ID NO: 3200140 - RNA, 13 nt, Human
ggccuggccugag

SEQ ID NO: 3200141 - RNA, 14 nt, Human
ggccuggccugagc

SEQ ID NO: 3200142 - RNA, 15 nt, Human
ggccuggcccaugua

SEQ ID NO: 3200143 - RNA, 15 nt, Human
ggccuggccugagcu

SEQ ID NO: 3200144 - RNA, 16 nt, Human
ggccuggccugagcug

SEQ ID NO: 3200145 - RNA, 11 nt, Human
ggccugggccc

SEQ ID NO: 3200146 - RNA, 12 nt, Human
ggccugggccug

SEQ ID NO: 3200147 - RNA, 23 nt, Human
ggccugggggcugggcagaggaa

SEQ ID NO: 3200148 - RNA, 18 nt, Human
ggccugggccuggcuccc

SEQ ID NO: 3200149 - RNA, 17 nt, Human
ggccugggccuggcucc

SEQ ID NO: 3200150 - RNA, 15 nt, Human
ggccugggccuggcu

SEQ ID NO: 3200151 - RNA, 22 nt, Human
ggccugggggcugggcagagga

SEQ ID NO: 3200152 - RNA, 23 nt, Human
ggcgcagcauauucaggaagcuc

SEQ ID NO: 3200153 - RNA, 24 nt, Human
ggcgcagcauauucaggaagcuca

SEQ ID NO: 3200154 - RNA, 18 nt, Human
ggcgcaagggaggcccag

SEQ ID NO: 3200155 - RNA, 20 nt, Human
ggcgcaagggaggcccagcg

SEQ ID NO: 3200156 - RNA, 14 nt, Human
ggccuacuccuguc

SEQ ID NO: 3200157 - RNA, 12 nt, Human
ggccuacuccug

SEQ ID NO: 3200158 - RNA, 16 nt, Human
ggccguugcugacuua

SEQ ID NO: 3200159 - RNA, 18 nt, Human
ggccggcggccucagagu

SEQ ID NO: 3200160 - RNA, 12 nt, Human
ggccgggcagag

SEQ ID NO: 3200161 - RNA, 15 nt, Human
ggccgggagccugau

SEQ ID NO: 3200162 - RNA, 19 nt, Human
ggccggcuuucaggagcuc

SEQ ID NO: 3200163 - RNA, 18 nt, Human
ggccggcuuucaggagcu

SEQ ID NO: 3200164 - RNA, 14 nt, Human
ggcccagagggccu

SEQ ID NO: 3200165 - RNA, 17 nt, Human
ggcccagagggccugca

SEQ ID NO: 3200166 - RNA, 19 nt, Human
ggcccagagggccugcaag

SEQ ID NO: 3200167 - RNA, 20 nt, Human
ggcccagagggccugcaagg

SEQ ID NO: 3200168 - RNA, 20 nt, Human
ggccucucauuccagaggaa

SEQ ID NO: 3200169 - RNA, 16 nt, Human
ggccucugcacucccc

SEQ ID NO: 3200170 - RNA, 14 nt, Human
ggccuccugugugu

SEQ ID NO: 3200171 - RNA, 20 nt, Human
ggccucgguguggagaagcg

SEQ ID NO: 3200172 - RNA, 22 nt, Human
ggccucaagugauucuccugcc

SEQ ID NO: 3200173 - RNA, 14 nt, Human
ggccucaagugauu

SEQ ID NO: 3200174 - RNA, 23 nt, Human
ggccuacuccugucuucugcuuu

SEQ ID NO: 3200175 - RNA, 18 nt, Human
ggccuacuggggaucaga

SEQ ID NO: 3200176 - RNA, 20 nt, Human
ggccuacuccugucuucugc

SEQ ID NO: 3200177 - RNA, 17 nt, Human
ggccuacuccugucuuc

SEQ ID NO: 3200178 - RNA, 15 nt, Human
ggccuacuccugucu

SEQ ID NO: 3200179 - RNA, 16 nt, Human
ggcucugccucccauc

SEQ ID NO: 3200180 - RNA, 14 nt, Human
ggcucugcccuugg

SEQ ID NO: 3200181 - RNA, 15 nt, Human
ggcucugcccuuggu

SEQ ID NO: 3200182 - RNA, 13 nt, Human
ggcucugccuccc

SEQ ID NO: 3200183 - RNA, 15 nt, Human
ggcucugccucccau

SEQ ID NO: 3200184 - RNA, 12 nt, Human
ggcucugcccuu

SEQ ID NO: 3200185 - RNA, 16 nt, Human
ggcucucugggcugac

SEQ ID NO: 3200186 - RNA, 20 nt, Human
ggcucugacaaagcuucccg

SEQ ID NO: 3200187 - RNA, 19 nt, Human
ggcucugacaaagcuuccc

SEQ ID NO: 3200188 - RNA, 14 nt, Human
ggcucucaggccag

SEQ ID NO: 3200189 - RNA, 21 nt, Human
ggcucucgcggccucuucucu

SEQ ID NO: 3200190 - RNA, 17 nt, Human
ggcucucaggccagcug

SEQ ID NO: 3200191 - RNA, 18 nt, Human
ggcucucaggccagcugc

SEQ ID NO: 3200192 - RNA, 19 nt, Human
ggcucucaggccagcugcu

SEQ ID NO: 3200193 - RNA, 20 nt, Human
ggcucucaggccagcugcuu

SEQ ID NO: 3200194 - RNA, 15 nt, Human
ggcucucaggccagc

SEQ ID NO: 3200195 - RNA, 16 nt, Human
ggcucucaggccagcu

SEQ ID NO: 3200196 - RNA, 15 nt, Human
ggcuccccugcagcc

SEQ ID NO: 3200197 - RNA, 16 nt, Human
ggcuccccugcagccc

SEQ ID NO: 3200198 - RNA, 18 nt, Human
ggcuccccugcagcccug

SEQ ID NO: 3200199 - RNA, 23 nt, Human
ggcuccccugcagcccuggccca

SEQ ID NO: 3200200 - RNA, 11 nt, Human
ggcuccccugg

SEQ ID NO: 3200201 - RNA, 12 nt, Human
ggcuccccuggg

SEQ ID NO: 3200202 - RNA, 14 nt, Human
ggcuccaggcuccu

SEQ ID NO: 3200203 - RNA, 20 nt, Human
ggcucccaggagccugccca

SEQ ID NO: 3200204 - RNA, 21 nt, Human
ggcucccaggagccugcccag

SEQ ID NO: 3200205 - RNA, 22 nt, Human
ggcucccaggagccugcccagc

SEQ ID NO: 3200206 - RNA, 16 nt, Human
ggcuccacuuggucug

SEQ ID NO: 3200207 - RNA, 9 nt, Human
ggcuccaga

SEQ ID NO: 3200208 - RNA, 13 nt, Human
ggcucaccagaau

SEQ ID NO: 3200209 - RNA, 21 nt, Human
ggcucacacuuggcucugagg

SEQ ID NO: 3200210 - RNA, 10 nt, Human
ggcuccagac

SEQ ID NO: 3200211 - RNA, 14 nt, Human
ggcuccaggagcag

SEQ ID NO: 3200212 - RNA, 16 nt, Human
ggcuccaggagcagcc

SEQ ID NO: 3200213 - RNA, 17 nt, Human
ggcuccaggagcagcca

SEQ ID NO: 3200214 - RNA, 13 nt, Human
ggcuccaggagca

SEQ ID NO: 3200215 - RNA, 13 nt, Human
ggcuccaggcucc

SEQ ID NO: 3200216 - RNA, 12 nt, Human
ggcuccaggcuc

SEQ ID NO: 3200217 - RNA, 23 nt, Human
ggcuauaggugcuacaaaaacac

SEQ ID NO: 3200218 - RNA, 20 nt, Human
ggcuaguaucaaaagaaaga

SEQ ID NO: 3200219 - RNA, 20 nt, Human
ggcgggcacaccuccuccca

SEQ ID NO: 3200220 - RNA, 15 nt, Human
ggcgcgguggcucac

SEQ ID NO: 3200221 - RNA, 14 nt, Human
ggcgcgugaggccc

SEQ ID NO: 3200222 - RNA, 18 nt, Human
ggcgcgugaggcccgugg

SEQ ID NO: 3200223 - RNA, 11 nt, Human
ggcgcugcccc

SEQ ID NO: 3200224 - RNA, 23 nt, Human
ggcgcucgaaguugaucucccca

SEQ ID NO: 3200225 - RNA, 22 nt, Human
ggcgcuagcacagcucccuucu

SEQ ID NO: 3200226 - RNA, 19 nt, Human
ggcgcuagcacagcucccu

SEQ ID NO: 3200227 - RNA, 12 nt, Human
ggcgcuaacuug

SEQ ID NO: 3200228 - RNA, 21 nt, Human
ggcgcuagaggccauggaggc

SEQ ID NO: 3200229 - RNA, 23 nt, Human
ggcgcuaacuugcuuaaauguga

SEQ ID NO: 3200230 - RNA, 17 nt, Human
ggcgcugccccuggcag

SEQ ID NO: 3200231 - RNA, 21 nt, Human
gggagccugaucaccugcccu

SEQ ID NO: 3200232 - RNA, 20 nt, Human
gggagccgggcaaacuggcc

SEQ ID NO: 3200233 - RNA, 12 nt, Human
gggagcucugca

SEQ ID NO: 3200234 - RNA, 22 nt, Human
gggagcugccuguucagcucca

SEQ ID NO: 3200235 - RNA, 21 nt, Human
gggagcugccuguucagcucc

SEQ ID NO: 3200236 - RNA, 13 nt, Human
gggagcugccugu

SEQ ID NO: 3200237 - RNA, 14 nt, Human
gggagcugagaaga

SEQ ID NO: 3200238 - RNA, 22 nt, Human
gggagcuggcuccagccuggaa

SEQ ID NO: 3200239 - RNA, 11 nt, Human
gggagcuggag

SEQ ID NO: 3200240 - RNA, 23 nt, Human
gggaggaucucuugagccuggga

SEQ ID NO: 3200241 - RNA, 21 nt, Human
gggaggauugcuugagcucag

SEQ ID NO: 3200242 - RNA, 22 nt, Human
gggaggauguucugggacacag

SEQ ID NO: 3200243 - RNA, 23 nt, Human
gggaggagaagaaaauguucuuc

SEQ ID NO: 3200244 - RNA, 12 nt, Human
gggaggagaaga

SEQ ID NO: 3200245 - RNA, 17 nt, Human
gggaggacgcucucugg

SEQ ID NO: 3200246 - RNA, 20 nt, Human
gggaggacgcucucuggccu

SEQ ID NO: 3200247 - RNA, 21 nt, Human
gggagugaguugauagcacag

SEQ ID NO: 3200248 - RNA, 17 nt, Human
gggaguagacuugcuuu

SEQ ID NO: 3200249 - RNA, 19 nt, Human
gggagguuuucucccccag

SEQ ID NO: 3200250 - RNA, 23 nt, Human
gggaggauugcuugagcucagga

SEQ ID NO: 3200251 - RNA, 20 nt, Human
gggaggugggauccuccagg

SEQ ID NO: 3200252 - RNA, 20 nt, Human
gggacaccaagccuuggcuc

SEQ ID NO: 3200253 - RNA, 19 nt, Human
gggacacacuuagcuggag

SEQ ID NO: 3200254 - RNA, 14 nt, Human
gggacacccuguga

SEQ ID NO: 3200255 - RNA, 14 nt, Human
gggacacccagaaa

SEQ ID NO: 3200256 - RNA, 21 nt, Human
gggaauguuugccucugccuc

SEQ ID NO: 3200257 - RNA, 19 nt, Human
gggaauguuugccucugcc

SEQ ID NO: 3200258 - RNA, 18 nt, Human
ggcuuugccauuaaaaug

SEQ ID NO: 3200259 - RNA, 22 nt, Human
gggaaguuaaagggaagaaaac

SEQ ID NO: 3200260 - RNA, 17 nt, Human
gggaaguuaaagggaag

SEQ ID NO: 3200261 - RNA, 14 nt, Human
gggaaguuaaaggg

SEQ ID NO: 3200262 - RNA, 23 nt, Human
gggacucaaugcacugacauugu

SEQ ID NO: 3200263 - RNA, 21 nt, Human
gggacugaggggaggggagca

SEQ ID NO: 3200264 - RNA, 16 nt, Human
gggacucaaugcacug

SEQ ID NO: 3200265 - RNA, 22 nt, Human
gggacugccaccuccccuugcc

SEQ ID NO: 3200266 - RNA, 18 nt, Human
gggacugccaccuccccu

SEQ ID NO: 3200267 - RNA, 16 nt, Human
gggacugccaccuccc

SEQ ID NO: 3200268 - RNA, 14 nt, Human
gggacugccaccuc

SEQ ID NO: 3200269 - RNA, 19 nt, Human
gggacucaaugcacugaca

SEQ ID NO: 3200270 - RNA, 17 nt, Human
gggacucaaugcacuga

SEQ ID NO: 3200271 - RNA, 20 nt, Human
gggacgcggccggcggccuc

SEQ ID NO: 3200272 - RNA, 20 nt, Human
gggacccaguggcagggcac

SEQ ID NO: 3200273 - RNA, 17 nt, Human
gggacccaguggcaggg

SEQ ID NO: 3200274 - RNA, 15 nt, Human
gggacccaguggcag

SEQ ID NO: 3200275 - RNA, 18 nt, Human
ggcuggacuuggagguag

SEQ ID NO: 3200276 - RNA, 17 nt, Human
ggcuggaguaaucagau

SEQ ID NO: 3200277 - RNA, 13 nt, Human
ggcuggacuugga

SEQ ID NO: 3200278 - RNA, 20 nt, Human
ggcugcuucaaggauccuga

SEQ ID NO: 3200279 - RNA, 15 nt, Human
ggcugcuucaaggau

SEQ ID NO: 3200280 - RNA, 19 nt, Human
ggcugcuucaaggauccug

SEQ ID NO: 3200281 - RNA, 15 nt, Human
ggcugggagcucugc

SEQ ID NO: 3200282 - RNA, 20 nt, Human
ggcugggcucccuucccacc

SEQ ID NO: 3200283 - RNA, 21 nt, Human
ggcugggcucccuucccaccu

SEQ ID NO: 3200284 - RNA, 18 nt, Human
ggcugggcucccuuccca

SEQ ID NO: 3200285 - RNA, 14 nt, Human
ggcugggcacugcu

SEQ ID NO: 3200286 - RNA, 20 nt, Human
ggcugggcacugcucucacc

SEQ ID NO: 3200287 - RNA, 19 nt, Human
ggcugggcacugcucucac

SEQ ID NO: 3200288 - RNA, 16 nt, Human
ggcuggaguuggggca

SEQ ID NO: 3200289 - RNA, 18 nt, Human
ggcugggcuucaguggca

SEQ ID NO: 3200290 - RNA, 18 nt, Human
ggcugggcugggcacugc

SEQ ID NO: 3200291 - RNA, 15 nt, Human
ggcugggcugggcac

SEQ ID NO: 3200292 - RNA, 14 nt, Human
ggcugggcugggca

SEQ ID NO: 3200293 - RNA, 22 nt, Human
ggcugggcuucaguggcagcug

SEQ ID NO: 3200294 - RNA, 21 nt, Human
ggcugggcuucaguggcagcu

SEQ ID NO: 3200295 - RNA, 11 nt, Human
ggcugggcuuc

SEQ ID NO: 3200296 - RNA, 14 nt, Human
ggcugggggccuca

SEQ ID NO: 3200297 - RNA, 19 nt, Human
ggcugggggaugggccuga

SEQ ID NO: 3200298 - RNA, 18 nt, Human
ggcugggggaugggccug

SEQ ID NO: 3200299 - RNA, 16 nt, Human
ggcugggggaagaagc

SEQ ID NO: 3200300 - RNA, 12 nt, Human
ggcuggggcagc

SEQ ID NO: 3200301 - RNA, 23 nt, Human
ggcuggggcagccucugggccca

SEQ ID NO: 3200302 - RNA, 20 nt, Human
ggcuggggcagccucugggc

SEQ ID NO: 3200303 - RNA, 14 nt, Human
ggcuggggcagccu

SEQ ID NO: 3200304 - RNA, 21 nt, Human
ggcuguggccucccugcucua

SEQ ID NO: 3200305 - RNA, 17 nt, Human
ggcugucuguuguauuc

SEQ ID NO: 3200306 - RNA, 16 nt, Human
ggcugugccucugccu

SEQ ID NO: 3200307 - RNA, 13 nt, Human
ggcugugccucug

SEQ ID NO: 3200308 - RNA, 20 nt, Human
ggcuguuggcugggggccuc

SEQ ID NO: 3200309 - RNA, 16 nt, Human
ggcuguuggcuggggg

SEQ ID NO: 3200310 - RNA, 15 nt, Human
ggcuguuggcugggg

SEQ ID NO: 3200311 - RNA, 14 nt, Human
ggcuguuggcuggg

SEQ ID NO: 3200312 - RNA, 14 nt, Human
ggcuuagucacuga

SEQ ID NO: 3200313 - RNA, 20 nt, Human
ggcuucacggaagagccuug

SEQ ID NO: 3200314 - RNA, 14 nt, Human
ggcuuaaaaaaaac

SEQ ID NO: 3200315 - RNA, 21 nt, Human
ggcuucacggaagagccuugc

SEQ ID NO: 3200316 - RNA, 12 nt, Human
ggcuucacagau

SEQ ID NO: 3200317 - RNA, 15 nt, Human
ggcuugcacucucuu

SEQ ID NO: 3200318 - RNA, 17 nt, Human
ggcuuggggaccagagc

SEQ ID NO: 3200319 - RNA, 18 nt, Human
ggcuuggggaccagagcu

SEQ ID NO: 3200320 - RNA, 11 nt, Human
ggcuugcugcc

SEQ ID NO: 3200321 - RNA, 16 nt, Human
ggcuuggcccuggcag

SEQ ID NO: 3200322 - RNA, 15 nt, Human
ggcuuggcccuggca

SEQ ID NO: 3200323 - RNA, 13 nt, Human
ggcuugcugcaga

SEQ ID NO: 3200324 - RNA, 13 nt, Human
ggcuuggcccugg

SEQ ID NO: 3200325 - RNA, 12 nt, Human
ggcuuggcccug

SEQ ID NO: 3200326 - RNA, 12 nt, Human
ggagggagggcu

SEQ ID NO: 3200327 - RNA, 17 nt, Human
ggagggagggcuccaga

SEQ ID NO: 3200328 - RNA, 13 nt, Human
ggagggagggcuc

SEQ ID NO: 3200329 - RNA, 16 nt, Human
ggagggagggcuccag

SEQ ID NO: 3200330 - RNA, 16 nt, Human
ggaggacgcucucugg

SEQ ID NO: 3200331 - RNA, 15 nt, Human
ggaggauguucuggg

SEQ ID NO: 3200332 - RNA, 14 nt, Human
ggaggaccugcccg

SEQ ID NO: 3200333 - RNA, 21 nt, Human
ggaggauguucugggacacag

SEQ ID NO: 3200334 - RNA, 18 nt, Human
ggaggauguucugggaca

SEQ ID NO: 3200335 - RNA, 19 nt, Human
ggaggggagcaugggaagu

SEQ ID NO: 3200336 - RNA, 13 nt, Human
ggagggccugggc

SEQ ID NO: 3200337 - RNA, 16 nt, Human
ggagggccugggccug

SEQ ID NO: 3200338 - RNA, 23 nt, Human
ggagggccugggccuggcucccu

SEQ ID NO: 3200339 - RNA, 22 nt, Human
ggagggccugggccuggcuccc

SEQ ID NO: 3200340 - RNA, 13 nt, Human
ggaggggccuggc

SEQ ID NO: 3200341 - RNA, 22 nt, Human
ggagucccaccuuggcugcagg

SEQ ID NO: 3200342 - RNA, 21 nt, Human
ggagucccaccuuggcugcag

SEQ ID NO: 3200343 - RNA, 20 nt, Human
ggaguagugaagacuccaga

SEQ ID NO: 3200344 - RNA, 21 nt, Human
ggaggggccuggcagccgugc

SEQ ID NO: 3200345 - RNA, 18 nt, Human
ggaggggccuggcagccg

SEQ ID NO: 3200346 - RNA, 14 nt, Human
ggaggggccuggca

SEQ ID NO: 3200347 - RNA, 17 nt, Human
ggagguuggagggaaag

SEQ ID NO: 3200348 - RNA, 17 nt, Human
ggagccugcagagcugc

SEQ ID NO: 3200349 - RNA, 15 nt, Human
ggagccuccugcccu

SEQ ID NO: 3200350 - RNA, 17 nt, Human
ggagccugacagccaga

SEQ ID NO: 3200351 - RNA, 16 nt, Human
ggagccugacagccag

SEQ ID NO: 3200352 - RNA, 13 nt, Human
ggagccugacagc

SEQ ID NO: 3200353 - RNA, 23 nt, Human
ggagcucacuguggugucugugu

SEQ ID NO: 3200354 - RNA, 20 nt, Human
ggagcucacuguggugucug

SEQ ID NO: 3200355 - RNA, 12 nt, Human
ggagcuauuuua

SEQ ID NO: 3200356 - RNA, 19 nt, Human
ggagcggauugcaaagcaa

SEQ ID NO: 3200357 - RNA, 13 nt, Human
ggagcacccugag

SEQ ID NO: 3200358 - RNA, 14 nt, Human
ggagcacccugagg

SEQ ID NO: 3200359 - RNA, 16 nt, Human
ggagcacccugagggc

SEQ ID NO: 3200360 - RNA, 16 nt, Human
ggagccuacccacccc

SEQ ID NO: 3200361 - RNA, 14 nt, Human
ggagccuccugccc

SEQ ID NO: 3200362 - RNA, 22 nt, Human
gcuuuuaucucagauguuaaaa

SEQ ID NO: 3200363 - RNA, 22 nt, Human
ggacacucaaaagcugggcagg

SEQ ID NO: 3200364 - RNA, 21 nt, Human
ggacacuguaacgugugcugu

SEQ ID NO: 3200365 - RNA, 19 nt, Human
ggacacuuaauucuguucu

SEQ ID NO: 3200366 - RNA, 19 nt, Human
ggacacuuauccacgagag

SEQ ID NO: 3200367 - RNA, 16 nt, Human
ggacagaggggguggc

SEQ ID NO: 3200368 - RNA, 20 nt, Human
ggacagaaggcuccugcccc

SEQ ID NO: 3200369 - RNA, 18 nt, Human
ggacagaaggcuccugcc

SEQ ID NO: 3200370 - RNA, 22 nt, Human
ggacacuuauccacgagagcgc

SEQ ID NO: 3200371 - RNA, 15 nt, Human
ggaccagcccacgcu

SEQ ID NO: 3200372 - RNA, 13 nt, Human
ggaccagcccacg

SEQ ID NO: 3200373 - RNA, 12 nt, Human
ggaccagcccac

SEQ ID NO: 3200374 - RNA, 16 nt, Human
ggaccagcccacgcug

SEQ ID NO: 3200375 - RNA, 19 nt, Human
ggaccagagcugccaccug

SEQ ID NO: 3200376 - RNA, 15 nt, Human
ggaccagcacacucc

SEQ ID NO: 3200377 - RNA, 14 nt, Human
ggaccagagcugcc

SEQ ID NO: 3200378 - RNA, 16 nt, Human
ggacagcuccuucugu

SEQ ID NO: 3200379 - RNA, 15 nt, Human
ggacagcuccuucug

SEQ ID NO: 3200380 - RNA, 11 nt, Human
ggacagcuccu

SEQ ID NO: 3200381 - RNA, 22 nt, Human
ggacagccacggccaggccaga

SEQ ID NO: 3200382 - RNA, 15 nt, Human
ggacagccccuccuc

SEQ ID NO: 3200383 - RNA, 16 nt, Human
ggacagccccuccucc

SEQ ID NO: 3200384 - RNA, 19 nt, Human
ggagaaucacaggcugggc

SEQ ID NO: 3200385 - RNA, 18 nt, Human
ggagaaucacaggcuggg

SEQ ID NO: 3200386 - RNA, 17 nt, Human
ggagaaucacaggcugg

SEQ ID NO: 3200387 - RNA, 16 nt, Human
ggagaaucacaggcug

SEQ ID NO: 3200388 - RNA, 15 nt, Human
ggagaaucacaggcu

SEQ ID NO: 3200389 - RNA, 13 nt, Human
ggagaaucacagg

SEQ ID NO: 3200390 - RNA, 23 nt, Human
ggagaagagcuguucacagccag

SEQ ID NO: 3200391 - RNA, 11 nt, Human
ggacugacuga

SEQ ID NO: 3200392 - RNA, 15 nt, Human
ggacugacugaggca

SEQ ID NO: 3200393 - RNA, 16 nt, Human
ggacugacugaggcag

SEQ ID NO: 3200394 - RNA, 17 nt, Human
ggacugacugaggcagu

SEQ ID NO: 3200395 - RNA, 13 nt, Human
ggagaacuagaga

SEQ ID NO: 3200396 - RNA, 12 nt, Human
ggagaagaaaau

SEQ ID NO: 3200397 - RNA, 18 nt, Human
ggagaacuugcugccucg

SEQ ID NO: 3200398 - RNA, 19 nt, Human
ggagaagaaagaacuaucu

SEQ ID NO: 3200399 - RNA, 15 nt, Human
ggagaagagcuguuc

SEQ ID NO: 3200400 - RNA, 15 nt, Human
ggacgcucucuggcc

SEQ ID NO: 3200401 - RNA, 16 nt, Human
ggacgcucucuggccu

SEQ ID NO: 3200402 - RNA, 19 nt, Human
ggacgcucucuggccuucg

SEQ ID NO: 3200403 - RNA, 13 nt, Human
ggacgcucugcug

SEQ ID NO: 3200404 - RNA, 18 nt, Human
ggaccuugaacuggguac

SEQ ID NO: 3200405 - RNA, 23 nt, Human
ggaccaugcugucuggcacagcc

SEQ ID NO: 3200406 - RNA, 16 nt, Human
ggaccauuuuccugca

SEQ ID NO: 3200407 - RNA, 14 nt, Human
ggaccauuuuccug

SEQ ID NO: 3200408 - RNA, 16 nt, Human
ggaccaugcugucugg

SEQ ID NO: 3200409 - RNA, 22 nt, Human
ggaccaugcugucuggcacagc

SEQ ID NO: 3200410 - RNA, 21 nt, Human
ggaccaugcugucuggcacag

SEQ ID NO: 3200411 - RNA, 20 nt, Human
ggaccaugcugucuggcaca

SEQ ID NO: 3200412 - RNA, 19 nt, Human
ggaccaugcugucuggcac

SEQ ID NO: 3200413 - RNA, 17 nt, Human
ggaccaggguuggcacc

SEQ ID NO: 3200414 - RNA, 18 nt, Human
ggaugcccaaagaugcag

SEQ ID NO: 3200415 - RNA, 17 nt, Human
ggaugccugguggcagc

SEQ ID NO: 3200416 - RNA, 13 nt, Human
ggaugccuggugg

SEQ ID NO: 3200417 - RNA, 19 nt, Human
ggaugcccaaagaugcagc

SEQ ID NO: 3200418 - RNA, 17 nt, Human
ggaugccccgucccccu

SEQ ID NO: 3200419 - RNA, 14 nt, Human
ggaugauugaagaa

SEQ ID NO: 3200420 - RNA, 23 nt, Human
ggagucccaccuuggcugcaggg

SEQ ID NO: 3200421 - RNA, 20 nt, Human
ggagucccacuccaagccag

SEQ ID NO: 3200422 - RNA, 18 nt, Human
ggaugaucuaggaagacu

SEQ ID NO: 3200423 - RNA, 22 nt, Human
ggaugaucuaggaagacuuugg

SEQ ID NO: 3200424 - RNA, 16 nt, Human
ggaugaucuaggaaga

SEQ ID NO: 3200425 - RNA, 16 nt, Human
ggauucugagagcugu

SEQ ID NO: 3200426 - RNA, 16 nt, Human
ggauucucaccagcug

SEQ ID NO: 3200427 - RNA, 23 nt, Human
ggauuccuaaucacucagagcag

SEQ ID NO: 3200428 - RNA, 11 nt, Human
ggauucaaauu

SEQ ID NO: 3200429 - RNA, 19 nt, Human
ggauucacaccccaccugc

SEQ ID NO: 3200430 - RNA, 17 nt, Human
ggauucacaccccaccu

SEQ ID NO: 3200431 - RNA, 20 nt, Human
ggauucacaccccaccugcg

SEQ ID NO: 3200432 - RNA, 20 nt, Human
ggauucaguuucuaaaauug

SEQ ID NO: 3200433 - RNA, 17 nt, Human
ggauuagggagagaaga

SEQ ID NO: 3200434 - RNA, 19 nt, Human
ggauuagucccuggccucu

SEQ ID NO: 3200435 - RNA, 14 nt, Human
ggauuaguuuagaa

SEQ ID NO: 3200436 - RNA, 17 nt, Human
ggauuaguuuagaacag

SEQ ID NO: 3200437 - RNA, 18 nt, Human
ggauuaguuuagaacagg

SEQ ID NO: 3200438 - RNA, 15 nt, Human
ggauuauaaucagaa

SEQ ID NO: 3200439 - RNA, 21 nt, Human
ggaugccugguggcagcugcg

SEQ ID NO: 3200440 - RNA, 20 nt, Human
ggaugccugguggcagcugc

SEQ ID NO: 3200441 - RNA, 19 nt, Human
ggaugccugguggcagcug

SEQ ID NO: 3200442 - RNA, 18 nt, Human
ggaugccugguggcagcu

SEQ ID NO: 3200443 - RNA, 21 nt, Human
ggcagagguugcagugagccg

SEQ ID NO: 3200444 - RNA, 22 nt, Human
ggcagagcagagaccaucccug

SEQ ID NO: 3200445 - RNA, 14 nt, Human
ggcagagcccugcu

SEQ ID NO: 3200446 - RNA, 20 nt, Human
ggcagagcccugcucccucc

SEQ ID NO: 3200447 - RNA, 19 nt, Human
ggcacucagaagacacuga

SEQ ID NO: 3200448 - RNA, 18 nt, Human
ggcacucagaagacacug

SEQ ID NO: 3200449 - RNA, 17 nt, Human
ggcacccggccccugcu

SEQ ID NO: 3200450 - RNA, 20 nt, Human
ggcacccggccccugcuggu

SEQ ID NO: 3200451 - RNA, 19 nt, Human
ggcacccggccccugcugg

SEQ ID NO: 3200452 - RNA, 18 nt, Human
ggcacccggccccugcug

SEQ ID NO: 3200453 - RNA, 19 nt, Human
ggcaagaaaagaguuaagg

SEQ ID NO: 3200454 - RNA, 17 nt, Human
ggcaagcaccuccugcc

SEQ ID NO: 3200455 - RNA, 16 nt, Human
ggauucuuccucccuc

SEQ ID NO: 3200456 - RNA, 21 nt, Human
ggauucuuccucccucccucu

SEQ ID NO: 3200457 - RNA, 19 nt, Human
ggauucuuguuuugcuucc

SEQ ID NO: 3200458 - RNA, 18 nt, Human
ggauucuuguuuugcuuc

SEQ ID NO: 3200459 - RNA, 17 nt, Human
ggcaccagcagccugga

SEQ ID NO: 3200460 - RNA, 24 nt, Human
ggcaaggacgcuucacaggacagg

SEQ ID NO: 3200461 - RNA, 19 nt, Human
ggcaccaguagcaggcccg

SEQ ID NO: 3200462 - RNA, 19 nt, Human
ggcaagcaccuccugccuc

SEQ ID NO: 3200463 - RNA, 18 nt, Human
ggcaagcaccuccugccu

SEQ ID NO: 3200464 - RNA, 23 nt, Human
ggcaaggacgcuucacaggacag

SEQ ID NO: 3200465 - RNA, 22 nt, Human
ggcaugacacgaauauugcuga

SEQ ID NO: 3200466 - RNA, 18 nt, Human
ggcaugugaugagaggaa

SEQ ID NO: 3200467 - RNA, 23 nt, Human
ggcaugugaugagaggaaaucac

SEQ ID NO: 3200468 - RNA, 17 nt, Human
ggcagguuggugggggc

SEQ ID NO: 3200469 - RNA, 17 nt, Human
ggcagggucucacucug

SEQ ID NO: 3200470 - RNA, 12 nt, Human
ggcaggguccua

SEQ ID NO: 3200471 - RNA, 24 nt, Human
ggcagcugcgguccacccaggagc

SEQ ID NO: 3200472 - RNA, 23 nt, Human
ggcagcugcgguccacccaggag

SEQ ID NO: 3200473 - RNA, 14 nt, Human
ggcagaguuacuug

SEQ ID NO: 3200474 - RNA, 21 nt, Human
ggcagcugcgguccacccagg

SEQ ID NO: 3200475 - RNA, 13 nt, Human
ggcagaguuacuu

SEQ ID NO: 3200476 - RNA, 17 nt, Human
ggcagaguugaagacag

SEQ ID NO: 3200477 - RNA, 19 nt, Human
ggcagaguugaagacagag

SEQ ID NO: 3200478 - RNA, 20 nt, Human
ggcccacccaagcaggaggc

SEQ ID NO: 3200479 - RNA, 18 nt, Human
ggcccaccaggccccccu

SEQ ID NO: 3200480 - RNA, 12 nt, Human
ggcccagagagg

SEQ ID NO: 3200481 - RNA, 23 nt, Human
ggcccacccugcuuggcccaggg

SEQ ID NO: 3200482 - RNA, 22 nt, Human
ggcccacccugcuuggcccagg

SEQ ID NO: 3200483 - RNA, 21 nt, Human
ggcccacccugcuuggcccag

SEQ ID NO: 3200484 - RNA, 12 nt, Human
ggcccacccugc

SEQ ID NO: 3200485 - RNA, 21 nt, Human
ggcccacccgguucaguguuu

SEQ ID NO: 3200486 - RNA, 11 nt, Human
ggccaggagcc

SEQ ID NO: 3200487 - RNA, 13 nt, Human
ggccaggagccuc

SEQ ID NO: 3200488 - RNA, 14 nt, Human
ggccaggcccucug

SEQ ID NO: 3200489 - RNA, 15 nt, Human
ggccaggcccucugc

SEQ ID NO: 3200490 - RNA, 16 nt, Human
ggccaggcccucugcc

SEQ ID NO: 3200491 - RNA, 17 nt, Human
ggccaggcccucugccc

SEQ ID NO: 3200492 - RNA, 20 nt, Human
ggccacugugaagagaacca

SEQ ID NO: 3200493 - RNA, 16 nt, Human
ggccaccucuuccugg

SEQ ID NO: 3200494 - RNA, 15 nt, Human
ggccaccucuuccug

SEQ ID NO: 3200495 - RNA, 22 nt, Human
ggccaccucuuccuggccggug

SEQ ID NO: 3200496 - RNA, 20 nt, Human
ggccaccucuuccuggccgg

SEQ ID NO: 3200497 - RNA, 19 nt, Human
ggccaccucuuccuggccg

SEQ ID NO: 3200498 - RNA, 17 nt, Human
ggccagaaguagcuuug

SEQ ID NO: 3200499 - RNA, 15 nt, Human
ggccagaaguagcuu

SEQ ID NO: 3200500 - RNA, 23 nt, Human
ggccaggaaguagcacaggcuga

SEQ ID NO: 3200501 - RNA, 22 nt, Human
ggccaggaaguagcacaggcug

SEQ ID NO: 3200502 - RNA, 21 nt, Human
ggccaggaaguagcacaggcu

SEQ ID NO: 3200503 - RNA, 20 nt, Human
ggccaggaaguagcacaggc

SEQ ID NO: 3200504 - RNA, 19 nt, Human
ggccagaaguagcuuugca

SEQ ID NO: 3200505 - RNA, 19 nt, Human
ggccaggaaguagcacagg

SEQ ID NO: 3200506 - RNA, 22 nt, Human
ggccacagaaaauucuucucca

SEQ ID NO: 3200507 - RNA, 20 nt, Human
ggcauguucucugaggacac

SEQ ID NO: 3200508 - RNA, 21 nt, Human
ggccaccuccuaaaaggccca

SEQ ID NO: 3200509 - RNA, 11 nt, Human
ggccaccuccu

SEQ ID NO: 3200510 - RNA, 23 nt, Human
ggccaccuccuaaaaggcccaga

SEQ ID NO: 3200511 - RNA, 22 nt, Human
ggccaccuccuaaaaggcccag

SEQ ID NO: 3200512 - RNA, 14 nt, Human
ggccacaguuguuu

SEQ ID NO: 3200513 - RNA, 16 nt, Human
ggccacaguuguuuga

SEQ ID NO: 3200514 - RNA, 21 nt, Human
cacgcugcucugccccagcuu

SEQ ID NO: 3200515 - RNA, 17 nt, Human
cacgcugcucugcccca

SEQ ID NO: 3200516 - RNA, 15 nt, Human
cacgggggccaagga

SEQ ID NO: 3200517 - RNA, 21 nt, Human
cacggguaaaucuaguaccau

SEQ ID NO: 3200518 - RNA, 20 nt, Human
cacggcucacugcagccuca

SEQ ID NO: 3200519 - RNA, 19 nt, Human
cacggcucacugcagccuc

SEQ ID NO: 3200520 - RNA, 17 nt, Human
cacggcucacugcagcc

SEQ ID NO: 3200521 - RNA, 16 nt, Human
cacggcucacugcagc

SEQ ID NO: 3200522 - RNA, 17 nt, Human
cacgcuggaccuugaac

SEQ ID NO: 3200523 - RNA, 14 nt, Human
cacgcuccuuccuc

SEQ ID NO: 3200524 - RNA, 15 nt, Human
cacgcuccuuucuga

SEQ ID NO: 3200525 - RNA, 12 nt, Human
cacgcuccuuuc

SEQ ID NO: 3200526 - RNA, 22 nt, Human
cacgcuccuuucugaucuucac

SEQ ID NO: 3200527 - RNA, 20 nt, Human
cacgcuggaccuugaacugg

SEQ ID NO: 3200528 - RNA, 15 nt, Human
cacggcucacugcag

SEQ ID NO: 3200529 - RNA, 16 nt, Human
cacgcugcucugcccc

SEQ ID NO: 3200530 - RNA, 22 nt, Human
cacgcugccuucgguacccacc

SEQ ID NO: 3200531 - RNA, 19 nt, Human
cacgcugacuacagggccg

SEQ ID NO: 3200532 - RNA, 23 nt, Human
cacgcgugcacacaccagagccc

SEQ ID NO: 3200533 - RNA, 21 nt, Human
cacgcgugcacacaccagagc

SEQ ID NO: 3200534 - RNA, 16 nt, Human
cacgcgugcacacacc

SEQ ID NO: 3200535 - RNA, 15 nt, Human
cacgcgugcacacac

SEQ ID NO: 3200536 - RNA, 19 nt, Human
cacgccuguaauccuagca

SEQ ID NO: 3200537 - RNA, 20 nt, Human
cacgccuguaauccuagcac

SEQ ID NO: 3200538 - RNA, 18 nt, Human
cacgccuagccucacgcu

SEQ ID NO: 3200539 - RNA, 15 nt, Human
cacgccuagccucac

SEQ ID NO: 3200540 - RNA, 17 nt, Human
cacgccuagccucacgc

SEQ ID NO: 3200541 - RNA, 16 nt, Human
cacgccuagccucacg

SEQ ID NO: 3200542 - RNA, 19 nt, Human
cacguaaugaaacuuggau

SEQ ID NO: 3200543 - RNA, 16 nt, Human
cacguaaugaaacuug

SEQ ID NO: 3200544 - RNA, 14 nt, Human
cacguacacacaca

SEQ ID NO: 3200545 - RNA, 19 nt, Human
cacguacacacacauacac

SEQ ID NO: 3200546 - RNA, 18 nt, Human
cacguacacacacauaca

SEQ ID NO: 3200547 - RNA, 16 nt, Human
cacguccucgcucccg

SEQ ID NO: 3200548 - RNA, 23 nt, Human
cacgucuauuucaucagaacagc

SEQ ID NO: 3200549 - RNA, 19 nt, Human
cacgucuauuucaucagaa

SEQ ID NO: 3200550 - RNA, 13 nt, Human
cacgugacagccg

SEQ ID NO: 3200551 - RNA, 19 nt, Human
cacguguggccuguucuuc

SEQ ID NO: 3200552 - RNA, 16 nt, Human
cacgugguccuaaucu

SEQ ID NO: 3200553 - RNA, 19 nt, Human
cacgugguccuaaucuucu

SEQ ID NO: 3200554 - RNA, 22 nt, Human
cacguucuuacuaguuucccuu

SEQ ID NO: 3200555 - RNA, 12 nt, Human
cacuaaacucug

SEQ ID NO: 3200556 - RNA, 22 nt, Human
cacuaaacucugaauaagcacu

SEQ ID NO: 3200557 - RNA, 21 nt, Human
cacuaaacuuggugcuuauug

SEQ ID NO: 3200558 - RNA, 16 nt, Human
cacuaaacucugaaua

SEQ ID NO: 3200559 - RNA, 22 nt, Human
cacguuuuaaggacugacugag

SEQ ID NO: 3200560 - RNA, 18 nt, Human
cacguuuucaucucuagg

SEQ ID NO: 3200561 - RNA, 14 nt, Human
cacguuuugaaaua

SEQ ID NO: 3200562 - RNA, 13 nt, Human
cacguuuuaagga

SEQ ID NO: 3200563 - RNA, 14 nt, Human
cacguuuuaaggac

SEQ ID NO: 3200564 - RNA, 15 nt, Human
cacguuuuaaggacu

SEQ ID NO: 3200565 - RNA, 16 nt, Human
cacguuuuaaggacug

SEQ ID NO: 3200566 - RNA, 22 nt, Human
cacgagcaggcuacugucagcu

SEQ ID NO: 3200567 - RNA, 18 nt, Human
cacgagucagucgccuuu

SEQ ID NO: 3200568 - RNA, 15 nt, Human
cacgauucauuuuug

SEQ ID NO: 3200569 - RNA, 17 nt, Human
cacgagcaggcuacugu

SEQ ID NO: 3200570 - RNA, 17 nt, Human
cacgacuucuguuucac

SEQ ID NO: 3200571 - RNA, 23 nt, Human
cacgagcagacacccuuggagcu

SEQ ID NO: 3200572 - RNA, 18 nt, Human
cacgagagcgcagcaucc

SEQ ID NO: 3200573 - RNA, 15 nt, Human
cacgagagcgcagca

SEQ ID NO: 3200574 - RNA, 20 nt, Human
cacgagcaggcuacugucag

SEQ ID NO: 3200575 - RNA, 19 nt, Human
cacgagcaggcuacuguca

SEQ ID NO: 3200576 - RNA, 17 nt, Human
cacgcacuucgggaggu

SEQ ID NO: 3200577 - RNA, 20 nt, Human
cacgccagauucuuuccuga

SEQ ID NO: 3200578 - RNA, 22 nt, Human
cacgccagauucuuuccugagg

SEQ ID NO: 3200579 - RNA, 19 nt, Human
cacgccagauucuuuccug

SEQ ID NO: 3200580 - RNA, 15 nt, Human
cacgccacugcacua

SEQ ID NO: 3200581 - RNA, 13 nt, Human
cacgccacugcac

SEQ ID NO: 3200582 - RNA, 13 nt, Human
cacgcccccacug

SEQ ID NO: 3200583 - RNA, 15 nt, Human
cacgcccccacuggu

SEQ ID NO: 3200584 - RNA, 23 nt, Human
cacgccagauucuuuccugaggc

SEQ ID NO: 3200585 - RNA, 17 nt, Human
cacgcccccacugguga

SEQ ID NO: 3200586 - RNA, 18 nt, Human
cacgcccccacuggugac

SEQ ID NO: 3200587 - RNA, 14 nt, Human
caccuuagacaguc

SEQ ID NO: 3200588 - RNA, 16 nt, Human
caccuuagacaguccc

SEQ ID NO: 3200589 - RNA, 18 nt, Human
caccuuagacagucccug

SEQ ID NO: 3200590 - RNA, 19 nt, Human
caccuuagacagucccugc

SEQ ID NO: 3200591 - RNA, 21 nt, Human
caccuuagacagucccugcca

SEQ ID NO: 3200592 - RNA, 23 nt, Human
caccuuagacagucccugccaau

SEQ ID NO: 3200593 - RNA, 22 nt, Human
caccuuagccugcccuccuuuc

SEQ ID NO: 3200594 - RNA, 19 nt, Human
caccuucaguuuuuguguu

SEQ ID NO: 3200595 - RNA, 16 nt, Human
cacgaauauugcugau

SEQ ID NO: 3200596 - RNA, 19 nt, Human
cacgaauauugcugauggu

SEQ ID NO: 3200597 - RNA, 22 nt, Human
cacgaauauugcugauggugca

SEQ ID NO: 3200598 - RNA, 16 nt, Human
cacgacugcccggcag

SEQ ID NO: 3200599 - RNA, 17 nt, Human
cacgacugcccggcagg

SEQ ID NO: 3200600 - RNA, 13 nt, Human
caccuugacaggg

SEQ ID NO: 3200601 - RNA, 19 nt, Human
caccuucccccucccccag

SEQ ID NO: 3200602 - RNA, 14 nt, Human
caccuucccaugcc

SEQ ID NO: 3200603 - RNA, 13 nt, Human
caccuucccaugc

SEQ ID NO: 3200604 - RNA, 16 nt, Human
caccuugacagggcac

SEQ ID NO: 3200605 - RNA, 15 nt, Human
caccuugacagggca

SEQ ID NO: 3200606 - RNA, 21 nt, Human
caccuucuauagcaucacuua

SEQ ID NO: 3200607 - RNA, 14 nt, Human
caccuucucacaug

SEQ ID NO: 3200608 - RNA, 17 nt, Human
caccuugaaucugccug

SEQ ID NO: 3200609 - RNA, 13 nt, Human
cacuccuccuagc

SEQ ID NO: 3200610 - RNA, 18 nt, Human
cacuccuccuagccaccc

SEQ ID NO: 3200611 - RNA, 14 nt, Human
cacuccuucacaga

SEQ ID NO: 3200612 - RNA, 21 nt, Human
cacuccuucacagaugggugc

SEQ ID NO: 3200613 - RNA, 11 nt, Human
cacuccugcuc

SEQ ID NO: 3200614 - RNA, 16 nt, Human
cacuccugcucugcuc

SEQ ID NO: 3200615 - RNA, 15 nt, Human
cacuccugcucugcu

SEQ ID NO: 3200616 - RNA, 14 nt, Human
cacuccugcucugc

SEQ ID NO: 3200617 - RNA, 12 nt, Human
cacuccugcucu

SEQ ID NO: 3200618 - RNA, 17 nt, Human
cacucccugcaaccuga

SEQ ID NO: 3200619 - RNA, 16 nt, Human
cacucccguuuucggu

SEQ ID NO: 3200620 - RNA, 14 nt, Human
cacuccuaccuggu

SEQ ID NO: 3200621 - RNA, 13 nt, Human
cacuccuaccugg

SEQ ID NO: 3200622 - RNA, 18 nt, Human
cacucauucugaauuaau

SEQ ID NO: 3200623 - RNA, 15 nt, Human
cacucauugaccuga

SEQ ID NO: 3200624 - RNA, 16 nt, Human
cacucaguccauagca

SEQ ID NO: 3200625 - RNA, 11 nt, Human
cacucagcugu

SEQ ID NO: 3200626 - RNA, 12 nt, Human
cacucagcuguu

SEQ ID NO: 3200627 - RNA, 13 nt, Human
cacucagcuguuc

SEQ ID NO: 3200628 - RNA, 21 nt, Human
cacucagcuguucagauugga

SEQ ID NO: 3200629 - RNA, 18 nt, Human
cacucauugaccugaggc

SEQ ID NO: 3200630 - RNA, 19 nt, Human
cacucauugaccugaggcc

SEQ ID NO: 3200631 - RNA, 20 nt, Human
cacucauugaccugaggccc

SEQ ID NO: 3200632 - RNA, 22 nt, Human
cacucauugaccugaggcccuu

SEQ ID NO: 3200633 - RNA, 13 nt, Human
cacucccugcaac

SEQ ID NO: 3200634 - RNA, 16 nt, Human
cacucccugcaaccug

SEQ ID NO: 3200635 - RNA, 12 nt, Human
cacucccugcaa

SEQ ID NO: 3200636 - RNA, 15 nt, Human
cacuccccugcuggg

SEQ ID NO: 3200637 - RNA, 19 nt, Human
cacucccgagacggcacug

SEQ ID NO: 3200638 - RNA, 22 nt, Human
cacucccgagacggcacugaga

SEQ ID NO: 3200639 - RNA, 22 nt, Human
cacucucaggaaaugcugaccc

SEQ ID NO: 3200640 - RNA, 17 nt, Human
cacucucagaggcccca

SEQ ID NO: 3200641 - RNA, 16 nt, Human
cacucucagaggcccc

SEQ ID NO: 3200642 - RNA, 15 nt, Human
cacucucagaggccc

SEQ ID NO: 3200643 - RNA, 14 nt, Human
cacucucagaggcc

SEQ ID NO: 3200644 - RNA, 13 nt, Human
cacucucagaggc

SEQ ID NO: 3200645 - RNA, 14 nt, Human
cacucuacuuagca

SEQ ID NO: 3200646 - RNA, 23 nt, Human
cacuccuuuagauagcagccugg

SEQ ID NO: 3200647 - RNA, 21 nt, Human
cacucuaagauguuauauuuu

SEQ ID NO: 3200648 - RNA, 19 nt, Human
cacucuaagauguuauauu

SEQ ID NO: 3200649 - RNA, 13 nt, Human
cacucuaagaugu

SEQ ID NO: 3200650 - RNA, 18 nt, Human
cacucuaagauguuauau

SEQ ID NO: 3200651 - RNA, 16 nt, Human
cacucuaagauguuau

SEQ ID NO: 3200652 - RNA, 16 nt, Human
cacucuaacuguauau

SEQ ID NO: 3200653 - RNA, 18 nt, Human
cacucuaacuguauauuu

SEQ ID NO: 3200654 - RNA, 12 nt, Human
cacucugagacu

SEQ ID NO: 3200655 - RNA, 23 nt, Human
cacucugagacucgcgacaaugc

SEQ ID NO: 3200656 - RNA, 12 nt, Human
cacucuccuugg

SEQ ID NO: 3200657 - RNA, 15 nt, Human
cacucugcaggaaau

SEQ ID NO: 3200658 - RNA, 14 nt, Human
cacucucucuuguu

SEQ ID NO: 3200659 - RNA, 17 nt, Human
cacucugcuaccuugcc

SEQ ID NO: 3200660 - RNA, 12 nt, Human
cacucuggcagc

SEQ ID NO: 3200661 - RNA, 22 nt, Human
cacucuggcagcaccgccucuu

SEQ ID NO: 3200662 - RNA, 16 nt, Human
cacucuggcagcaccg

SEQ ID NO: 3200663 - RNA, 14 nt, Human
cacucuggcagcac

SEQ ID NO: 3200664 - RNA, 13 nt, Human
cacucuggcagca

SEQ ID NO: 3200665 - RNA, 13 nt, Human
cacucuggcagcu

SEQ ID NO: 3200666 - RNA, 14 nt, Human
cacucuggcagcuc

SEQ ID NO: 3200667 - RNA, 21 nt, Human
cacuaaauugacacuuaaaaa

SEQ ID NO: 3200668 - RNA, 14 nt, Human
cacuaaauguuaaa

SEQ ID NO: 3200669 - RNA, 13 nt, Human
cacuaaauguuaa

SEQ ID NO: 3200670 - RNA, 12 nt, Human
cacuaaauguua

SEQ ID NO: 3200671 - RNA, 11 nt, Human
cacuaaauguu

SEQ ID NO: 3200672 - RNA, 16 nt, Human
cacuaaccacgcugga

SEQ ID NO: 3200673 - RNA, 15 nt, Human
cacuaaccacgcugg

SEQ ID NO: 3200674 - RNA, 14 nt, Human
cacuaaccacgcug

SEQ ID NO: 3200675 - RNA, 23 nt, Human
cacuaaauguuaaagauguagca

SEQ ID NO: 3200676 - RNA, 20 nt, Human
cacuaaauguuaaagaugua

SEQ ID NO: 3200677 - RNA, 19 nt, Human
cacuaaauguuaaagaugu

SEQ ID NO: 3200678 - RNA, 16 nt, Human
cacuaaauguuaaaga

SEQ ID NO: 3200679 - RNA, 20 nt, Human
cacuaagaacaaaagaagca

SEQ ID NO: 3200680 - RNA, 13 nt, Human
cacuaagaacaaa

SEQ ID NO: 3200681 - RNA, 18 nt, Human
cacuaaccacgcuggacc

SEQ ID NO: 3200682 - RNA, 18 nt, Human
cacuaaggugugcucuga

SEQ ID NO: 3200683 - RNA, 22 nt, Human
cacuaagucucuuuuuuacaaa

SEQ ID NO: 3200684 - RNA, 21 nt, Human
cacuaagucucuuuuuuacaa

SEQ ID NO: 3200685 - RNA, 20 nt, Human
cacuaagucucuuuuuuaca

SEQ ID NO: 3200686 - RNA, 16 nt, Human
cacuaagucucuuuuu

SEQ ID NO: 3200687 - RNA, 17 nt, Human
cacuaaggugugcucug

SEQ ID NO: 3200688 - RNA, 18 nt, Human
cacuaucccggcugcccu

SEQ ID NO: 3200689 - RNA, 19 nt, Human
cacuaucccggcugcccuu

SEQ ID NO: 3200690 - RNA, 15 nt, Human
cacuauguugcccag

SEQ ID NO: 3200691 - RNA, 19 nt, Human
cacuauguugcccaggcag

SEQ ID NO: 3200692 - RNA, 18 nt, Human
cacuauguugcccaggca

SEQ ID NO: 3200693 - RNA, 17 nt, Human
cacuauguugcccaggc

SEQ ID NO: 3200694 - RNA, 16 nt, Human
cacuauguugcccagg

SEQ ID NO: 3200695 - RNA, 14 nt, Human
cacuauaauguaag

SEQ ID NO: 3200696 - RNA, 21 nt, Human
cacuauagccuaggugacaga

SEQ ID NO: 3200697 - RNA, 16 nt, Human
cacuauaaugugaaau

SEQ ID NO: 3200698 - RNA, 17 nt, Human
cacuauaaugugaaaug

SEQ ID NO: 3200699 - RNA, 18 nt, Human
cacuauaauguaagcucu

SEQ ID NO: 3200700 - RNA, 14 nt, Human
cacuauagccuagg

SEQ ID NO: 3200701 - RNA, 16 nt, Human
cacucaaaucaagaaa

SEQ ID NO: 3200702 - RNA, 20 nt, Human
cacucaaaagcugggcaggu

SEQ ID NO: 3200703 - RNA, 18 nt, Human
cacucaaaucuuaagaaa

SEQ ID NO: 3200704 - RNA, 17 nt, Human
cacucaaaucuuaagaa

SEQ ID NO: 3200705 - RNA, 16 nt, Human
cacucaaaucuuaaga

SEQ ID NO: 3200706 - RNA, 14 nt, Human
cacucaagaccaaa

SEQ ID NO: 3200707 - RNA, 22 nt, Human
cacucaagaccaaauggaaaca

SEQ ID NO: 3200708 - RNA, 15 nt, Human
cacucaaaagcuggg

SEQ ID NO: 3200709 - RNA, 17 nt, Human
cacucaaaagcugggca

SEQ ID NO: 3200710 - RNA, 18 nt, Human
cacucaaaagcugggcag

SEQ ID NO: 3200711 - RNA, 19 nt, Human
cacucaaaagcugggcagg

SEQ ID NO: 3200712 - RNA, 21 nt, Human
cacuauguugcccaggcaggu

SEQ ID NO: 3200713 - RNA, 20 nt, Human
cacuauguugcccaggcagg

SEQ ID NO: 3200714 - RNA, 19 nt, Human
cacucagaagacacugaug

SEQ ID NO: 3200715 - RNA, 18 nt, Human
cacucagaagacacugau

SEQ ID NO: 3200716 - RNA, 22 nt, Human
cacucagaagacacugaugggc

SEQ ID NO: 3200717 - RNA, 21 nt, Human
cacucagaaaagacgcaccag

SEQ ID NO: 3200718 - RNA, 24 nt, Human
cacucagaaaagacgcaccagccc

SEQ ID NO: 3200719 - RNA, 21 nt, Human
cacucagagcagucugugacu

SEQ ID NO: 3200720 - RNA, 17 nt, Human
cacucagagcagucugu

SEQ ID NO: 3200721 - RNA, 12 nt, Human
cacucagagcag

SEQ ID NO: 3200722 - RNA, 13 nt, Human
cacucagcaccac

SEQ ID NO: 3200723 - RNA, 18 nt, Human
cacucagcaccacucaag

SEQ ID NO: 3200724 - RNA, 16 nt, Human
cacucagcaccacuca

SEQ ID NO: 3200725 - RNA, 15 nt, Human
cacucagcaccacuc

SEQ ID NO: 3200726 - RNA, 14 nt, Human
cacucagcaccacu

SEQ ID NO: 3200727 - RNA, 20 nt, Human
cacucacauuuauucugcuc

SEQ ID NO: 3200728 - RNA, 19 nt, Human
cacucacauuuauucugcu

SEQ ID NO: 3200729 - RNA, 17 nt, Human
cacucagaagacacuga

SEQ ID NO: 3200730 - RNA, 16 nt, Human
cacucagaagacacug

SEQ ID NO: 3200731 - RNA, 12 nt, Human
cacucagaagac

SEQ ID NO: 3200732 - RNA, 13 nt, Human
cacuucaaaacaa

SEQ ID NO: 3200733 - RNA, 22 nt, Human
cacuucagggcagauuuuaguu

SEQ ID NO: 3200734 - RNA, 21 nt, Human
cacuucagggcagauuuuagu

SEQ ID NO: 3200735 - RNA, 23 nt, Human
cacuucagggcagauuuuaguuu

SEQ ID NO: 3200736 - RNA, 23 nt, Human
cacuucaggcucuucuccuuuca

SEQ ID NO: 3200737 - RNA, 17 nt, Human
cacuucagggcagauuu

SEQ ID NO: 3200738 - RNA, 19 nt, Human
cacuucagggcagauuuua

SEQ ID NO: 3200739 - RNA, 18 nt, Human
cacuucagggcagauuuu

SEQ ID NO: 3200740 - RNA, 13 nt, Human
cacuucauugaaa

SEQ ID NO: 3200741 - RNA, 12 nt, Human
cacuucagcuga

SEQ ID NO: 3200742 - RNA, 21 nt, Human
cacuucagcugacuuuucugu

SEQ ID NO: 3200743 - RNA, 20 nt, Human
cacuucaggcucuucuccuu

SEQ ID NO: 3200744 - RNA, 16 nt, Human
cacuucaggcucuucu

SEQ ID NO: 3200745 - RNA, 15 nt, Human
cacuucaggcucuuc

SEQ ID NO: 3200746 - RNA, 14 nt, Human
cacuucaggcucuu

SEQ ID NO: 3200747 - RNA, 17 nt, Human
cacuuccgucacauccc

SEQ ID NO: 3200748 - RNA, 16 nt, Human
cacuucccuacaugga

SEQ ID NO: 3200749 - RNA, 20 nt, Human
cacuuccauaaucuggacuc

SEQ ID NO: 3200750 - RNA, 22 nt, Human
cacuucugccauauucuguugg

SEQ ID NO: 3200751 - RNA, 13 nt, Human
cacuucugccaga

SEQ ID NO: 3200752 - RNA, 17 nt, Human
cacuucugccagauguc

SEQ ID NO: 3200753 - RNA, 17 nt, Human
cacuucugacucuuccc

SEQ ID NO: 3200754 - RNA, 21 nt, Human
cacuucgggaggucgaggcag

SEQ ID NO: 3200755 - RNA, 23 nt, Human
cacuucgggaggucgaggcagga

SEQ ID NO: 3200756 - RNA, 23 nt, Human
cacuucuaaguugaguauauuau

SEQ ID NO: 3200757 - RNA, 21 nt, Human
cacuucuaaguugaguauauu

SEQ ID NO: 3200758 - RNA, 20 nt, Human
cacuucuaaguugaguauau

SEQ ID NO: 3200759 - RNA, 12 nt, Human
cacuuccuugcc

SEQ ID NO: 3200760 - RNA, 16 nt, Human
cacuucuucuguccaa

SEQ ID NO: 3200761 - RNA, 15 nt, Human
cacuucuucugucca

SEQ ID NO: 3200762 - RNA, 14 nt, Human
cacuucuucugucc

SEQ ID NO: 3200763 - RNA, 12 nt, Human
cacuucuucugu

SEQ ID NO: 3200764 - RNA, 13 nt, Human
cacuucuuucccu

SEQ ID NO: 3200765 - RNA, 20 nt, Human
cacuucuucuguccaagcag

SEQ ID NO: 3200766 - RNA, 21 nt, Human
cacuucuuucccuuccuccau

SEQ ID NO: 3200767 - RNA, 19 nt, Human
cacuucuuucccuuccucc

SEQ ID NO: 3200768 - RNA, 17 nt, Human
cacuucuuucccuuccu

SEQ ID NO: 3200769 - RNA, 15 nt, Human
cacuucuuucccuuc

SEQ ID NO: 3200770 - RNA, 20 nt, Human
cacuugaacccgggaggcag

SEQ ID NO: 3200771 - RNA, 21 nt, Human
cacuugaacccgggaggcaga

SEQ ID NO: 3200772 - RNA, 23 nt, Human
cacuugaacccgggaggcagagg

SEQ ID NO: 3200773 - RNA, 16 nt, Human
cacuugacaucaacug

SEQ ID NO: 3200774 - RNA, 13 nt, Human
cacuugcagacuc

SEQ ID NO: 3200775 - RNA, 23 nt, Human
cacuugaguggagguuuauaguu

SEQ ID NO: 3200776 - RNA, 13 nt, Human
cacuugaguccag

SEQ ID NO: 3200777 - RNA, 19 nt, Human
cacuugaugacccccaacc

SEQ ID NO: 3200778 - RNA, 17 nt, Human
cacuugagaauuacccu

SEQ ID NO: 3200779 - RNA, 19 nt, Human
cacuugacaucaacugcau

SEQ ID NO: 3200780 - RNA, 20 nt, Human
cacuugagaauuacccuuuu

SEQ ID NO: 3200781 - RNA, 21 nt, Human
cacuugaaccauaguuacugu

SEQ ID NO: 3200782 - RNA, 15 nt, Human
cacuugagaugauuu

SEQ ID NO: 3200783 - RNA, 21 nt, Human
cacuugggggcucagcaaggc

SEQ ID NO: 3200784 - RNA, 20 nt, Human
cacuugggggcucagcaagg

SEQ ID NO: 3200785 - RNA, 19 nt, Human
cacuuggguccaggccuac

SEQ ID NO: 3200786 - RNA, 19 nt, Human
cacuugggggcucagcaag

SEQ ID NO: 3200787 - RNA, 18 nt, Human
cacuugggggcucagcaa

SEQ ID NO: 3200788 - RNA, 17 nt, Human
cacuugggggcucagca

SEQ ID NO: 3200789 - RNA, 15 nt, Human
cacuuggucugugag

SEQ ID NO: 3200790 - RNA, 18 nt, Human
cacuuucuagccagagga

SEQ ID NO: 3200791 - RNA, 19 nt, Human
cacuuucuagccagaggag

SEQ ID NO: 3200792 - RNA, 20 nt, Human
cacuuucuagccagaggaga

SEQ ID NO: 3200793 - RNA, 24 nt, Human
cacuugcagacucuacagaggcca

SEQ ID NO: 3200794 - RNA, 20 nt, Human
cacuugccauuccaaaauau

SEQ ID NO: 3200795 - RNA, 20 nt, Human
cacuugcugcacucuugcac

SEQ ID NO: 3200796 - RNA, 22 nt, Human
cacuugcagacucuacagaggc

SEQ ID NO: 3200797 - RNA, 19 nt, Human
cacuugcagacucuacaga

SEQ ID NO: 3200798 - RNA, 18 nt, Human
cacuugcagacucuacag

SEQ ID NO: 3200799 - RNA, 14 nt, Human
cacuugcagacucu

SEQ ID NO: 3200800 - RNA, 17 nt, Human
cacuggccccugagauc

SEQ ID NO: 3200801 - RNA, 20 nt, Human
cacuggccuucugaugaaau

SEQ ID NO: 3200802 - RNA, 21 nt, Human
cacuggccuucugaugaaaug

SEQ ID NO: 3200803 - RNA, 23 nt, Human
cacuggccuucugaugaaauguu

SEQ ID NO: 3200804 - RNA, 20 nt, Human
cacuguacccagucucaaag

SEQ ID NO: 3200805 - RNA, 14 nt, Human
cacugucaagauga

SEQ ID NO: 3200806 - RNA, 14 nt, Human
cacugugccaugug

SEQ ID NO: 3200807 - RNA, 13 nt, Human
cacugugaagaga

SEQ ID NO: 3200808 - RNA, 13 nt, Human
cacugugaagagc

SEQ ID NO: 3200809 - RNA, 10 nt, Human
cacugucugu

SEQ ID NO: 3200810 - RNA, 18 nt, Human
cacugucugucuggucca

SEQ ID NO: 3200811 - RNA, 13 nt, Human
cacugucugucug

SEQ ID NO: 3200812 - RNA, 14 nt, Human
cacuguggugucug

SEQ ID NO: 3200813 - RNA, 14 nt, Human
cacuguguauauuu

SEQ ID NO: 3200814 - RNA, 15 nt, Human
cacuguguauauuug

SEQ ID NO: 3200815 - RNA, 16 nt, Human
cacuguguauauuuga

SEQ ID NO: 3200816 - RNA, 17 nt, Human
cacuguguauauuugau

SEQ ID NO: 3200817 - RNA, 13 nt, Human
cacuguguauauu

SEQ ID NO: 3200818 - RNA, 15 nt, Human
cacuguggugucugu

SEQ ID NO: 3200819 - RNA, 18 nt, Human
cacuguguauauuugauu

SEQ ID NO: 3200820 - RNA, 20 nt, Human
cacuguguauauuugauuua

SEQ ID NO: 3200821 - RNA, 21 nt, Human
cacuguguauauuugauuuau

SEQ ID NO: 3200822 - RNA, 14 nt, Human
cacuguguauuguu

SEQ ID NO: 3200823 - RNA, 21 nt, Human
cacuguuaucauuuuuuccug

SEQ ID NO: 3200824 - RNA, 14 nt, Human
cacuguuauuuuca

SEQ ID NO: 3200825 - RNA, 19 nt, Human
cacuguuauuuucagcaug

SEQ ID NO: 3200826 - RNA, 13 nt, Human
cacuguucucugc

SEQ ID NO: 3200827 - RNA, 14 nt, Human
cacuguucucugcc

SEQ ID NO: 3200828 - RNA, 15 nt, Human
cacuguucucugccc

SEQ ID NO: 3200829 - RNA, 16 nt, Human
cacuguucucugcccu

SEQ ID NO: 3200830 - RNA, 17 nt, Human
cacuguucucugcccuc

SEQ ID NO: 3200831 - RNA, 19 nt, Human
cacuguucucugcccucca

SEQ ID NO: 3200832 - RNA, 21 nt, Human
cacuguucucugcccuccaag

SEQ ID NO: 3200833 - RNA, 22 nt, Human
cacuguucucugcccuccaaga

SEQ ID NO: 3200834 - RNA, 21 nt, Human
cacuguggaacugcuauuuuc

SEQ ID NO: 3200835 - RNA, 17 nt, Human
cacugugcugagucuga

SEQ ID NO: 3200836 - RNA, 20 nt, Human
cacugugcugagucugaagg

SEQ ID NO: 3200837 - RNA, 21 nt, Human
cacugugcugagucugaaggc

SEQ ID NO: 3200838 - RNA, 22 nt, Human
cacugugcugagucugaaggcu

SEQ ID NO: 3200839 - RNA, 16 nt, Human
cacugugccaugugcc

SEQ ID NO: 3200840 - RNA, 15 nt, Human
cacugugccaugugc

SEQ ID NO: 3200841 - RNA, 18 nt, Human
cacugugccaugugccag

SEQ ID NO: 3200842 - RNA, 13 nt, Human
cacugugcugagu

SEQ ID NO: 3200843 - RNA, 15 nt, Human
cacugugcugagucu

SEQ ID NO: 3200844 - RNA, 22 nt, Human
cacugugcguggggcucccgcc

SEQ ID NO: 3200845 - RNA, 18 nt, Human
cacugcuaagaauauuug

SEQ ID NO: 3200846 - RNA, 22 nt, Human
cacugccuucgauacaccgggc

SEQ ID NO: 3200847 - RNA, 20 nt, Human
cacugccuucgauacaccgg

SEQ ID NO: 3200848 - RNA, 16 nt, Human
cacugccugccuuaag

SEQ ID NO: 3200849 - RNA, 20 nt, Human
cacugccugccuuaagugag

SEQ ID NO: 3200850 - RNA, 14 nt, Human
cacugccugccuua

SEQ ID NO: 3200851 - RNA, 15 nt, Human
cacugccugccuuaa

SEQ ID NO: 3200852 - RNA, 14 nt, Human
cacugcucucaccu

SEQ ID NO: 3200853 - RNA, 13 nt, Human
cacugcucucacc

SEQ ID NO: 3200854 - RNA, 12 nt, Human
cacugcucuggu

SEQ ID NO: 3200855 - RNA, 20 nt, Human
cacugcucugaugaagagga

SEQ ID NO: 3200856 - RNA, 23 nt, Human
cacugcucucaccuugguuccug

SEQ ID NO: 3200857 - RNA, 15 nt, Human
cacugcucucaccuu

SEQ ID NO: 3200858 - RNA, 17 nt, Human
cacugcugcccagccuc

SEQ ID NO: 3200859 - RNA, 15 nt, Human
cacugcugcccagcc

SEQ ID NO: 3200860 - RNA, 16 nt, Human
cacugccucuuccucc

SEQ ID NO: 3200861 - RNA, 23 nt, Human
cacugccuccccaaggcccccug

SEQ ID NO: 3200862 - RNA, 18 nt, Human
cacugcacguuuucaucu

SEQ ID NO: 3200863 - RNA, 17 nt, Human
cacugcacguuuucauc

SEQ ID NO: 3200864 - RNA, 13 nt, Human
cacugcccacugg

SEQ ID NO: 3200865 - RNA, 18 nt, Human
cacugcacuauagccuag

SEQ ID NO: 3200866 - RNA, 19 nt, Human
cacugcaccgggccacaga

SEQ ID NO: 3200867 - RNA, 18 nt, Human
cacugcaccgggccacag

SEQ ID NO: 3200868 - RNA, 16 nt, Human
cacugcaccgggccac

SEQ ID NO: 3200869 - RNA, 15 nt, Human
cacugcaccgggcca

SEQ ID NO: 3200870 - RNA, 14 nt, Human
cacugcaccgggcc

SEQ ID NO: 3200871 - RNA, 23 nt, Human
cacugcacagugcaucucagccc

SEQ ID NO: 3200872 - RNA, 18 nt, Human
cacugcuuccagugaggc

SEQ ID NO: 3200873 - RNA, 19 nt, Human
cacugcuuccagugaggcu

SEQ ID NO: 3200874 - RNA, 20 nt, Human
cacugcuuccagugaggcuc

SEQ ID NO: 3200875 - RNA, 21 nt, Human
cacugcuuccagugaggcucu

SEQ ID NO: 3200876 - RNA, 22 nt, Human
cacugcuuccagugaggcucug

SEQ ID NO: 3200877 - RNA, 20 nt, Human
cacugcuuuuggucugugug

SEQ ID NO: 3200878 - RNA, 14 nt, Human
cacugcuuccagug

SEQ ID NO: 3200879 - RNA, 15 nt, Human
cacugcuuccaguga

SEQ ID NO: 3200880 - RNA, 16 nt, Human
cacugcuuccagugag

SEQ ID NO: 3200881 - RNA, 21 nt, Human
cacugcuggcugccuuagaac

SEQ ID NO: 3200882 - RNA, 16 nt, Human
cacugcuggcugccuu

SEQ ID NO: 3200883 - RNA, 15 nt, Human
cacugcuggcugccu

SEQ ID NO: 3200884 - RNA, 14 nt, Human
cacugcuggcugcc

SEQ ID NO: 3200885 - RNA, 13 nt, Human
cacugcuggcugc

SEQ ID NO: 3200886 - RNA, 12 nt, Human
cacugcuggcug

SEQ ID NO: 3200887 - RNA, 17 nt, Human
cacuggaacacuaauga

SEQ ID NO: 3200888 - RNA, 21 nt, Human
cacugcuuuuggucuguguga

SEQ ID NO: 3200889 - RNA, 18 nt, Human
cacuggacucaccucccc

SEQ ID NO: 3200890 - RNA, 15 nt, Human
cacuggacucaccuc

SEQ ID NO: 3200891 - RNA, 18 nt, Human
cacuggcaaugguaguuu

SEQ ID NO: 3200892 - RNA, 17 nt, Human
cacuggccacaguuguu

SEQ ID NO: 3200893 - RNA, 16 nt, Human
cacugauccagcccug

SEQ ID NO: 3200894 - RNA, 15 nt, Human
cacugauccagcccu

SEQ ID NO: 3200895 - RNA, 14 nt, Human
cacugauccagccc

SEQ ID NO: 3200896 - RNA, 16 nt, Human
cacugauauauuuaaa

SEQ ID NO: 3200897 - RNA, 24 nt, Human
cacugaugggcaacccccagccug

SEQ ID NO: 3200898 - RNA, 18 nt, Human
cacugaugggcaaccccc

SEQ ID NO: 3200899 - RNA, 14 nt, Human
cacugaugggcaac

SEQ ID NO: 3200900 - RNA, 23 nt, Human
cacugagacagcccgggcucugc

SEQ ID NO: 3200901 - RNA, 21 nt, Human
cacugagagccuuuuugaaag

SEQ ID NO: 3200902 - RNA, 17 nt, Human
cacugagagccuuuuug

SEQ ID NO: 3200903 - RNA, 18 nt, Human
cacugagagagcgcagcc

SEQ ID NO: 3200904 - RNA, 23 nt, Human
cacugagaccccaggcuguuagg

SEQ ID NO: 3200905 - RNA, 22 nt, Human
cacugauuauaguacugacaga

SEQ ID NO: 3200906 - RNA, 13 nt, Human
cacugcaaccucc

SEQ ID NO: 3200907 - RNA, 22 nt, Human
cacugcaaaaccagguuuuguu

SEQ ID NO: 3200908 - RNA, 23 nt, Human
cacugcaaccuccgccucuuggg

SEQ ID NO: 3200909 - RNA, 16 nt, Human
cacugcaaccuccgcc

SEQ ID NO: 3200910 - RNA, 14 nt, Human
cacugcaaccuccg

SEQ ID NO: 3200911 - RNA, 22 nt, Human
cacugcacagugcaucucagcc

SEQ ID NO: 3200912 - RNA, 21 nt, Human
cacugcacagugcaucucagc

SEQ ID NO: 3200913 - RNA, 19 nt, Human
cacugcacagugcaucuca

SEQ ID NO: 3200914 - RNA, 18 nt, Human
cacugcacagugcaucuc

SEQ ID NO: 3200915 - RNA, 15 nt, Human
cacugcaauaucuuc

SEQ ID NO: 3200916 - RNA, 14 nt, Human
cacugcaaccuucg

SEQ ID NO: 3200917 - RNA, 22 nt, Human
cacugcaaccuucgccaccugg

SEQ ID NO: 3200918 - RNA, 23 nt, Human
cacugcaaccuucgccaccuggg

SEQ ID NO: 3200919 - RNA, 23 nt, Human
cacugacauuguuggccaaagcc

SEQ ID NO: 3200920 - RNA, 18 nt, Human
cacucugucgagccuggg

SEQ ID NO: 3200921 - RNA, 19 nt, Human
cacucugucgcccagucug

SEQ ID NO: 3200922 - RNA, 16 nt, Human
cacucugucgcccagu

SEQ ID NO: 3200923 - RNA, 15 nt, Human
cacucugucgcccag

SEQ ID NO: 3200924 - RNA, 15 nt, Human
cacucuggcagcuca

SEQ ID NO: 3200925 - RNA, 16 nt, Human
cacucuggcagcucag

SEQ ID NO: 3200926 - RNA, 17 nt, Human
cacucuggcagcucaga

SEQ ID NO: 3200927 - RNA, 19 nt, Human
cacucuggcagcucagaga

SEQ ID NO: 3200928 - RNA, 20 nt, Human
cacucuggcagcucagagag

SEQ ID NO: 3200929 - RNA, 21 nt, Human
cacucuggcagcucagagagg

SEQ ID NO: 3200930 - RNA, 23 nt, Human
cacucuggcagcucagagagggu

SEQ ID NO: 3200931 - RNA, 20 nt, Human
cacugacuucuaaguaaaac

SEQ ID NO: 3200932 - RNA, 16 nt, Human
cacugacuucuaagua

SEQ ID NO: 3200933 - RNA, 15 nt, Human
cacugacuucuaagu

SEQ ID NO: 3200934 - RNA, 14 nt, Human
cacugacuucuaag

SEQ ID NO: 3200935 - RNA, 12 nt, Human
cacugacucugg

SEQ ID NO: 3200936 - RNA, 14 nt, Human
cacugacucuggaa

SEQ ID NO: 3200937 - RNA, 13 nt, Human
cacugacucugga

SEQ ID NO: 3200938 - RNA, 21 nt, Human
cacugacuucuaaguaaaacc

SEQ ID NO: 3200939 - RNA, 20 nt, Human
cacugacugaacuguaaugu

SEQ ID NO: 3200940 - RNA, 12 nt, Human
cacugagacagc

SEQ ID NO: 3200941 - RNA, 13 nt, Human
cacugagacagcc

SEQ ID NO: 3200942 - RNA, 14 nt, Human
cacugagacagccc

SEQ ID NO: 3200943 - RNA, 17 nt, Human
cacugagacagcccggg

SEQ ID NO: 3200944 - RNA, 19 nt, Human
cacugagacagcccgggcu

SEQ ID NO: 3200945 - RNA, 22 nt, Human
cacugagacagcccgggcucug

SEQ ID NO: 3200946 - RNA, 17 nt, Human
caccgccuccuacagcc

SEQ ID NO: 3200947 - RNA, 15 nt, Human
caccgccucuucccg

SEQ ID NO: 3200948 - RNA, 13 nt, Human
caccgccucuucc

SEQ ID NO: 3200949 - RNA, 17 nt, Human
caccgccucuucccgcc

SEQ ID NO: 3200950 - RNA, 16 nt, Human
caccgccucuucccgc

SEQ ID NO: 3200951 - RNA, 21 nt, Human
caccgcagacaggaccaggga

SEQ ID NO: 3200952 - RNA, 15 nt, Human
caccggcuggccugg

SEQ ID NO: 3200953 - RNA, 16 nt, Human
caccggcuggccuggc

SEQ ID NO: 3200954 - RNA, 14 nt, Human
caccggcuggccug

SEQ ID NO: 3200955 - RNA, 17 nt, Human
caccggcuggccuggcc

SEQ ID NO: 3200956 - RNA, 18 nt, Human
caccggcuggccuggccc

SEQ ID NO: 3200957 - RNA, 20 nt, Human
caccggcuggccuggccccu

SEQ ID NO: 3200958 - RNA, 14 nt, Human
caccgggcacucag

SEQ ID NO: 3200959 - RNA, 13 nt, Human
caccgggccugga

SEQ ID NO: 3200960 - RNA, 15 nt, Human
caccggggccucgga

SEQ ID NO: 3200961 - RNA, 18 nt, Human
caccgggccacagagaaa

SEQ ID NO: 3200962 - RNA, 15 nt, Human
caccgggccacagag

SEQ ID NO: 3200963 - RNA, 22 nt, Human
caccgggcacucagaagacacu

SEQ ID NO: 3200964 - RNA, 15 nt, Human
caccgggcacucaga

SEQ ID NO: 3200965 - RNA, 15 nt, Human
caccgugccuggcca

SEQ ID NO: 3200966 - RNA, 16 nt, Human
caccguccccucccag

SEQ ID NO: 3200967 - RNA, 13 nt, Human
caccguccccucc

SEQ ID NO: 3200968 - RNA, 20 nt, Human
caccgugccuggccacgccc

SEQ ID NO: 3200969 - RNA, 15 nt, Human
caccuccccuugcca

SEQ ID NO: 3200970 - RNA, 14 nt, Human
caccuccccuugcc

SEQ ID NO: 3200971 - RNA, 19 nt, Human
caccuccccuugccagcug

SEQ ID NO: 3200972 - RNA, 18 nt, Human
caccuccccuugccagcu

SEQ ID NO: 3200973 - RNA, 17 nt, Human
caccuccccuugccagc

SEQ ID NO: 3200974 - RNA, 16 nt, Human
caccuccccuugccag

SEQ ID NO: 3200975 - RNA, 22 nt, Human
caccuccccuugccagcugcug

SEQ ID NO: 3200976 - RNA, 20 nt, Human
caccuccccuugccagcugc

SEQ ID NO: 3200977 - RNA, 11 nt, Human
caccuccccca

SEQ ID NO: 3200978 - RNA, 14 nt, Human
caccucccccaucu

SEQ ID NO: 3200979 - RNA, 21 nt, Human
caccucccccaucucuucugg

SEQ ID NO: 3200980 - RNA, 21 nt, Human
caccucccccacucccaacca

SEQ ID NO: 3200981 - RNA, 17 nt, Human
caccucccccacuccca

SEQ ID NO: 3200982 - RNA, 18 nt, Human
caccuccuaaaaggccca

SEQ ID NO: 3200983 - RNA, 17 nt, Human
caccuccuaaaaggccc

SEQ ID NO: 3200984 - RNA, 16 nt, Human
caccuccucccacugc

SEQ ID NO: 3200985 - RNA, 20 nt, Human
caccuccuaaaaggcccaga

SEQ ID NO: 3200986 - RNA, 19 nt, Human
caccuccuaaaaggcccag

SEQ ID NO: 3200987 - RNA, 22 nt, Human
caccuccuaaaaggcccagaga

SEQ ID NO: 3200988 - RNA, 22 nt, Human
caccuccucggcuggcugucca

SEQ ID NO: 3200989 - RNA, 14 nt, Human
caccuccugccucg

SEQ ID NO: 3200990 - RNA, 11 nt, Human
caccuccugcc

SEQ ID NO: 3200991 - RNA, 13 nt, Human
caccuccugccuc

SEQ ID NO: 3200992 - RNA, 13 nt, Human
caccucucccuug

SEQ ID NO: 3200993 - RNA, 14 nt, Human
caccucucccuugg

SEQ ID NO: 3200994 - RNA, 17 nt, Human
caccucucccuuggauu

SEQ ID NO: 3200995 - RNA, 18 nt, Human
caccugacagccccuccc

SEQ ID NO: 3200996 - RNA, 11 nt, Human
caccugacagc

SEQ ID NO: 3200997 - RNA, 19 nt, Human
caccugacagccccucccu

SEQ ID NO: 3200998 - RNA, 15 nt, Human
caccugaguuccuga

SEQ ID NO: 3200999 - RNA, 11 nt, Human
caccugcagcu

SEQ ID NO: 3201000 - RNA, 14 nt, Human
caccugcagcuccc

SEQ ID NO: 3201001 - RNA, 12 nt, Human
caccugcagcuc

SEQ ID NO: 3201002 - RNA, 23 nt, Human
caccugcagauucuaggaccugu

SEQ ID NO: 3201003 - RNA, 16 nt, Human
caccugcagccucccu

SEQ ID NO: 3201004 - RNA, 19 nt, Human
caccugcagccucccuccg

SEQ ID NO: 3201005 - RNA, 18 nt, Human
caccugcuucucugccca

SEQ ID NO: 3201006 - RNA, 16 nt, Human
caccugcuucucugcc

SEQ ID NO: 3201007 - RNA, 19 nt, Human
caccugcuucucugcccag

SEQ ID NO: 3201008 - RNA, 12 nt, Human
caccugcugcuu

SEQ ID NO: 3201009 - RNA, 23 nt, Human
caccugcggugcuaucuccccca

SEQ ID NO: 3201010 - RNA, 12 nt, Human
caccugcucugc

SEQ ID NO: 3201011 - RNA, 14 nt, Human
caccugcucugcug

SEQ ID NO: 3201012 - RNA, 13 nt, Human
caccugcucugcu

SEQ ID NO: 3201013 - RNA, 20 nt, Human
caccugcggugcuaucuccc

SEQ ID NO: 3201014 - RNA, 16 nt, Human
caccugcagcucccuc

SEQ ID NO: 3201015 - RNA, 15 nt, Human
caccugcagcucccu

SEQ ID NO: 3201016 - RNA, 23 nt, Human
caccugaagacucauucuucugu

SEQ ID NO: 3201017 - RNA, 15 nt, Human
caccugaagacucau

SEQ ID NO: 3201018 - RNA, 14 nt, Human
caccugaagacuca

SEQ ID NO: 3201019 - RNA, 15 nt, Human
caccucuuccuggcc

SEQ ID NO: 3201020 - RNA, 17 nt, Human
caccucuuccuggccgg

SEQ ID NO: 3201021 - RNA, 16 nt, Human
caccucuuccuggccg

SEQ ID NO: 3201022 - RNA, 15 nt, Human
caccucucucacucc

SEQ ID NO: 3201023 - RNA, 17 nt, Human
caccucucucacuccuu

SEQ ID NO: 3201024 - RNA, 18 nt, Human
caccucucucacuccuug

SEQ ID NO: 3201025 - RNA, 19 nt, Human
caccucucucacuccuuga

SEQ ID NO: 3201026 - RNA, 18 nt, Human
caccucugcacaagcugc

SEQ ID NO: 3201027 - RNA, 19 nt, Human
caccucugcacaagcugca

SEQ ID NO: 3201028 - RNA, 12 nt, Human
caccuggccucu

SEQ ID NO: 3201029 - RNA, 13 nt, Human
caccuggccucug

SEQ ID NO: 3201030 - RNA, 14 nt, Human
caccuggccucugc

SEQ ID NO: 3201031 - RNA, 15 nt, Human
caccuggccucugca

SEQ ID NO: 3201032 - RNA, 17 nt, Human
caccuggcccucucuga

SEQ ID NO: 3201033 - RNA, 16 nt, Human
caccuggcccucucug

SEQ ID NO: 3201034 - RNA, 19 nt, Human
caccuggcccucucugaag

SEQ ID NO: 3201035 - RNA, 17 nt, Human
caccuggccucugcacu

SEQ ID NO: 3201036 - RNA, 18 nt, Human
caccuggccucugcacuc

SEQ ID NO: 3201037 - RNA, 19 nt, Human
caccuggccucugcacucc

SEQ ID NO: 3201038 - RNA, 20 nt, Human
caccuggccucugcacuccc

SEQ ID NO: 3201039 - RNA, 23 nt, Human
caccuggccucugcacuccccug

SEQ ID NO: 3201040 - RNA, 21 nt, Human
caccugggacagggagcagcc

SEQ ID NO: 3201041 - RNA, 20 nt, Human
caccuguaauuccagcacuu

SEQ ID NO: 3201042 - RNA, 16 nt, Human
caccugggggccuggc

SEQ ID NO: 3201043 - RNA, 18 nt, Human
caccugggcgucaucugg

SEQ ID NO: 3201044 - RNA, 14 nt, Human
caccugucugcucc

SEQ ID NO: 3201045 - RNA, 11 nt, Human
caccugucugc

SEQ ID NO: 3201046 - RNA, 23 nt, Human
caccugucugcuccagcucuggc

SEQ ID NO: 3201047 - RNA, 21 nt, Human
caccugucugcuccagcucug

SEQ ID NO: 3201048 - RNA, 20 nt, Human
caccugucugcuccagcucu

SEQ ID NO: 3201049 - RNA, 15 nt, Human
caccugucugcucca

SEQ ID NO: 3201050 - RNA, 17 nt, Human
cacccgugguggcucaa

SEQ ID NO: 3201051 - RNA, 16 nt, Human
cacccguguuuguaaa

SEQ ID NO: 3201052 - RNA, 22 nt, Human
cacccggugaccucuagcccug

SEQ ID NO: 3201053 - RNA, 19 nt, Human
cacccggugaccucuagcc

SEQ ID NO: 3201054 - RNA, 23 nt, Human
cacccgguccccacuuuauugcc

SEQ ID NO: 3201055 - RNA, 21 nt, Human
cacccggccccugcugguuca

SEQ ID NO: 3201056 - RNA, 18 nt, Human
cacccggccccugcuggu

SEQ ID NO: 3201057 - RNA, 17 nt, Human
cacccggccccugcugg

SEQ ID NO: 3201058 - RNA, 16 nt, Human
cacccggccccugcug

SEQ ID NO: 3201059 - RNA, 14 nt, Human
cacccggccccugc

SEQ ID NO: 3201060 - RNA, 13 nt, Human
cacccggccccug

SEQ ID NO: 3201061 - RNA, 19 nt, Human
cacccgcuaagagggaggg

SEQ ID NO: 3201062 - RNA, 12 nt, Human
cacccggccccu

SEQ ID NO: 3201063 - RNA, 15 nt, Human
caccccuaaagagau

SEQ ID NO: 3201064 - RNA, 20 nt, Human
caccccucaacaccucugca

SEQ ID NO: 3201065 - RNA, 19 nt, Human
caccccuuccugggcacac

SEQ ID NO: 3201066 - RNA, 16 nt, Human
caccccuuccugggca

SEQ ID NO: 3201067 - RNA, 15 nt, Human
caccccuuccugggc

SEQ ID NO: 3201068 - RNA, 16 nt, Human
cacccgacuccagucc

SEQ ID NO: 3201069 - RNA, 14 nt, Human
cacccgacuccagu

SEQ ID NO: 3201070 - RNA, 11 nt, Human
cacccugugau

SEQ ID NO: 3201071 - RNA, 12 nt, Human
cacccugugaug

SEQ ID NO: 3201072 - RNA, 15 nt, Human
cacccugugaugggg

SEQ ID NO: 3201073 - RNA, 18 nt, Human
cacccugugauggggccc

SEQ ID NO: 3201074 - RNA, 20 nt, Human
cacccugugauggggcccug

SEQ ID NO: 3201075 - RNA, 21 nt, Human
cacccugugauggggcccugc

SEQ ID NO: 3201076 - RNA, 22 nt, Human
cacccugugauggggcccugcc

SEQ ID NO: 3201077 - RNA, 23 nt, Human
cacccugugauggggcccugccu

SEQ ID NO: 3201078 - RNA, 15 nt, Human
cacccuuggagcucu

SEQ ID NO: 3201079 - RNA, 20 nt, Human
cacccuuggagcucugaguu

SEQ ID NO: 3201080 - RNA, 16 nt, Human
cacccuuggagcucug

SEQ ID NO: 3201081 - RNA, 15 nt, Human
cacccugugcagaag

SEQ ID NO: 3201082 - RNA, 19 nt, Human
cacccuuccaucugauucc

SEQ ID NO: 3201083 - RNA, 15 nt, Human
caccgaaaacguggc

SEQ ID NO: 3201084 - RNA, 18 nt, Human
caccgaaaacguggcugc

SEQ ID NO: 3201085 - RNA, 22 nt, Human
cacccuuucuacuuccaagacu

SEQ ID NO: 3201086 - RNA, 13 nt, Human
cacccuuguucca

SEQ ID NO: 3201087 - RNA, 19 nt, Human
caccgaaaacguggcugcu

SEQ ID NO: 3201088 - RNA, 21 nt, Human
caccgaaaacguggcugcuuc

SEQ ID NO: 3201089 - RNA, 22 nt, Human
caccgaaaacguggcugcuuca

SEQ ID NO: 3201090 - RNA, 14 nt, Human
caccgcagacagga

SEQ ID NO: 3201091 - RNA, 15 nt, Human
caccgcagacaggac

SEQ ID NO: 3201092 - RNA, 17 nt, Human
caccgcagacaggacca

SEQ ID NO: 3201093 - RNA, 18 nt, Human
caccgcagacaggaccag

SEQ ID NO: 3201094 - RNA, 12 nt, Human
caccgcagacag

SEQ ID NO: 3201095 - RNA, 13 nt, Human
caccgcagacagg

SEQ ID NO: 3201096 - RNA, 20 nt, Human
caccgacuagacacacaaag

SEQ ID NO: 3201097 - RNA, 16 nt, Human
cacgccagauucuuuc

SEQ ID NO: 3201098 - RNA, 15 nt, Human
cagacccccuggaga

SEQ ID NO: 3201099 - RNA, 19 nt, Human
cagaccccgacaccggcca

SEQ ID NO: 3201100 - RNA, 13 nt, Human
cagaccccuggcu

SEQ ID NO: 3201101 - RNA, 18 nt, Human
cagaccccuggcuuuuca

SEQ ID NO: 3201102 - RNA, 16 nt, Human
cagaccccuggcuuuu

SEQ ID NO: 3201103 - RNA, 15 nt, Human
cagaccccuggcuuu

SEQ ID NO: 3201104 - RNA, 14 nt, Human
cagaccccuggcuu

SEQ ID NO: 3201105 - RNA, 14 nt, Human
cagaccacaaaacu

SEQ ID NO: 3201106 - RNA, 20 nt, Human
cagaccacaaaacuuuucua

SEQ ID NO: 3201107 - RNA, 22 nt, Human
cagacccugcccugugggcccc

SEQ ID NO: 3201108 - RNA, 14 nt, Human
cagacccuggagga

SEQ ID NO: 3201109 - RNA, 20 nt, Human
cagaccgcgggcacugccgc

SEQ ID NO: 3201110 - RNA, 15 nt, Human
cagaccgucuuccuc

SEQ ID NO: 3201111 - RNA, 19 nt, Human
cagaccgucuuccuccaac

SEQ ID NO: 3201112 - RNA, 20 nt, Human
cagaccgucuuccuccaacc

SEQ ID NO: 3201113 - RNA, 21 nt, Human
cagaccgaacuguuguauaaa

SEQ ID NO: 3201114 - RNA, 15 nt, Human
cagacccugcccugu

SEQ ID NO: 3201115 - RNA, 16 nt, Human
cagacccugcccugug

SEQ ID NO: 3201116 - RNA, 17 nt, Human
cagacccugcccugugg

SEQ ID NO: 3201117 - RNA, 21 nt, Human
cagacccugcccugugggccc

SEQ ID NO: 3201118 - RNA, 14 nt, Human
cagacccggcugcg

SEQ ID NO: 3201119 - RNA, 12 nt, Human
cagacccggcug

SEQ ID NO: 3201120 - RNA, 22 nt, Human
cagaccccuggcuuuucacugc

SEQ ID NO: 3201121 - RNA, 21 nt, Human
cagaccccuggcuuuucacug

SEQ ID NO: 3201122 - RNA, 23 nt, Human
cagaccccuggcuuuucacugcu

SEQ ID NO: 3201123 - RNA, 13 nt, Human
cagacccugcccu

SEQ ID NO: 3201124 - RNA, 14 nt, Human
cagacccugcccug

SEQ ID NO: 3201125 - RNA, 12 nt, Human
cagacccugccc

SEQ ID NO: 3201126 - RNA, 16 nt, Human
cagacccggcugcgug

SEQ ID NO: 3201127 - RNA, 20 nt, Human
cagacuuuuuuuaaauagua

SEQ ID NO: 3201128 - RNA, 19 nt, Human
cagacuuuuaaagacuugc

SEQ ID NO: 3201129 - RNA, 21 nt, Human
cagacuuuuuuaaacaucaaa

SEQ ID NO: 3201130 - RNA, 23 nt, Human
cagagaaaguacuucuccacccu

SEQ ID NO: 3201131 - RNA, 19 nt, Human
cagagaaaguacuucucca

SEQ ID NO: 3201132 - RNA, 17 nt, Human
cagacuuuuaaagacuu

SEQ ID NO: 3201133 - RNA, 16 nt, Human
cagacuuguauauucu

SEQ ID NO: 3201134 - RNA, 15 nt, Human
cagacuuguauauuc

SEQ ID NO: 3201135 - RNA, 23 nt, Human
cagacuuguauauucuauuuuac

SEQ ID NO: 3201136 - RNA, 17 nt, Human
cagacuuguauauucua

SEQ ID NO: 3201137 - RNA, 22 nt, Human
cagacgcucauucagcaucuga

SEQ ID NO: 3201138 - RNA, 21 nt, Human
cagacgcucauucagcaucug

SEQ ID NO: 3201139 - RNA, 20 nt, Human
cagacgcucauucagcaucu

SEQ ID NO: 3201140 - RNA, 19 nt, Human
cagacgcucauucagcauc

SEQ ID NO: 3201141 - RNA, 15 nt, Human
cagaaugaggcugcu

SEQ ID NO: 3201142 - RNA, 14 nt, Human
cagaaugaggcugc

SEQ ID NO: 3201143 - RNA, 18 nt, Human
cagaaucuguaugauucu

SEQ ID NO: 3201144 - RNA, 13 nt, Human
cagaaucuuguuu

SEQ ID NO: 3201145 - RNA, 17 nt, Human
cagaaucuuguuuugaa

SEQ ID NO: 3201146 - RNA, 19 nt, Human
cagaaucuuguuuugaaaa

SEQ ID NO: 3201147 - RNA, 20 nt, Human
cagaaucuuguuuugaaaau

SEQ ID NO: 3201148 - RNA, 16 nt, Human
cagaaucuguaugauu

SEQ ID NO: 3201149 - RNA, 12 nt, Human
cagaaucuguau

SEQ ID NO: 3201150 - RNA, 15 nt, Human
cagaaucucgcucug

SEQ ID NO: 3201151 - RNA, 16 nt, Human
cagaaucucugaauuu

SEQ ID NO: 3201152 - RNA, 13 nt, Human
cagaauggcauuu

SEQ ID NO: 3201153 - RNA, 15 nt, Human
cagaauggaagagag

SEQ ID NO: 3201154 - RNA, 19 nt, Human
cagaauggaagagagaaag

SEQ ID NO: 3201155 - RNA, 14 nt, Human
cagaauuucccaaa

SEQ ID NO: 3201156 - RNA, 14 nt, Human
cagaauuggaaaag

SEQ ID NO: 3201157 - RNA, 13 nt, Human
cagaauuggaaaa

SEQ ID NO: 3201158 - RNA, 17 nt, Human
cagaauuggaaaagacu

SEQ ID NO: 3201159 - RNA, 11 nt, Human
cagaauucuca

SEQ ID NO: 3201160 - RNA, 14 nt, Human
cagaauucauucau

SEQ ID NO: 3201161 - RNA, 22 nt, Human
cagaauucauucauacuuaaaa

SEQ ID NO: 3201162 - RNA, 17 nt, Human
cagaauuucccaaagca

SEQ ID NO: 3201163 - RNA, 18 nt, Human
cagaauuucccaaagcag

SEQ ID NO: 3201164 - RNA, 19 nt, Human
cagaauuucccaaagcagu

SEQ ID NO: 3201165 - RNA, 20 nt, Human
cagaauuucccaaagcagug

SEQ ID NO: 3201166 - RNA, 24 nt, Human
cagaauuucccaaagcagugcaug

SEQ ID NO: 3201167 - RNA, 13 nt, Human
cagaauuugaauu

SEQ ID NO: 3201168 - RNA, 15 nt, Human
cagaauuugaauuau

SEQ ID NO: 3201169 - RNA, 12 nt, Human
cagacaaagcgu

SEQ ID NO: 3201170 - RNA, 20 nt, Human
cagacaacaaaccuguuucu

SEQ ID NO: 3201171 - RNA, 16 nt, Human
cagacaacaaaccugu

SEQ ID NO: 3201172 - RNA, 22 nt, Human
cagacaaagcgugguggacaug

SEQ ID NO: 3201173 - RNA, 15 nt, Human
cagacaaucuucugu

SEQ ID NO: 3201174 - RNA, 14 nt, Human
cagacaaucuucug

SEQ ID NO: 3201175 - RNA, 19 nt, Human
cagacaagcuguugaccag

SEQ ID NO: 3201176 - RNA, 15 nt, Human
cagacaagcuguuga

SEQ ID NO: 3201177 - RNA, 23 nt, Human
cagacaugguggggucuccucag

SEQ ID NO: 3201178 - RNA, 22 nt, Human
cagacaugguggggucuccuca

SEQ ID NO: 3201179 - RNA, 17 nt, Human
cagacaugguggggucu

SEQ ID NO: 3201180 - RNA, 17 nt, Human
cagacauagaauuaaca

SEQ ID NO: 3201181 - RNA, 19 nt, Human
cagacauagaauuaacaca

SEQ ID NO: 3201182 - RNA, 22 nt, Human
cagacaccuugacagggcacac

SEQ ID NO: 3201183 - RNA, 20 nt, Human
cagacaccuugacagggcac

SEQ ID NO: 3201184 - RNA, 19 nt, Human
cagacaccuugacagggca

SEQ ID NO: 3201185 - RNA, 15 nt, Human
cagacacccuuggag

SEQ ID NO: 3201186 - RNA, 20 nt, Human
cagacaguuaagagaaauga

SEQ ID NO: 3201187 - RNA, 14 nt, Human
cagacacaugucca

SEQ ID NO: 3201188 - RNA, 17 nt, Human
cagacacauguccaaga

SEQ ID NO: 3201189 - RNA, 21 nt, Human
cagacacauguccaagaagcc

SEQ ID NO: 3201190 - RNA, 22 nt, Human
cagacacauguccaagaagccc

SEQ ID NO: 3201191 - RNA, 23 nt, Human
cagacacauguccaagaagccca

SEQ ID NO: 3201192 - RNA, 23 nt, Human
cagacacaggcccggcuccaggc

SEQ ID NO: 3201193 - RNA, 22 nt, Human
cagacacaggcccggcuccagg

SEQ ID NO: 3201194 - RNA, 21 nt, Human
cagacacaggcccggcuccag

SEQ ID NO: 3201195 - RNA, 18 nt, Human
cagacacaggcccggcuc

SEQ ID NO: 3201196 - RNA, 17 nt, Human
cagacacaggcccggcu

SEQ ID NO: 3201197 - RNA, 15 nt, Human
cagacacaggcccgg

SEQ ID NO: 3201198 - RNA, 14 nt, Human
cagacacaggcccg

SEQ ID NO: 3201199 - RNA, 13 nt, Human
cagacacaggccc

SEQ ID NO: 3201200 - RNA, 16 nt, Human
cagaaggcuccugccc

SEQ ID NO: 3201201 - RNA, 15 nt, Human
cagaaggcuccugcc

SEQ ID NO: 3201202 - RNA, 14 nt, Human
cagaaggcuccugc

SEQ ID NO: 3201203 - RNA, 12 nt, Human
cagaaggcuccu

SEQ ID NO: 3201204 - RNA, 19 nt, Human
cagaaggaagacuucaucc

SEQ ID NO: 3201205 - RNA, 16 nt, Human
cagaaggaagacuuca

SEQ ID NO: 3201206 - RNA, 17 nt, Human
cagaaggaagacuucau

SEQ ID NO: 3201207 - RNA, 18 nt, Human
cagaaggaagacuucauc

SEQ ID NO: 3201208 - RNA, 23 nt, Human
cagaaguaggggaagaauaauuu

SEQ ID NO: 3201209 - RNA, 22 nt, Human
cagaaguaggggaagaauaauu

SEQ ID NO: 3201210 - RNA, 18 nt, Human
cagaaguaggggaagaau

SEQ ID NO: 3201211 - RNA, 13 nt, Human
cagaaguagggga

SEQ ID NO: 3201212 - RNA, 16 nt, Human
cagaaguagcuuugca

SEQ ID NO: 3201213 - RNA, 18 nt, Human
cagaaucucaaauaacua

SEQ ID NO: 3201214 - RNA, 17 nt, Human
cagaaucucaaauaacu

SEQ ID NO: 3201215 - RNA, 19 nt, Human
cagaaggcuccugccccca

SEQ ID NO: 3201216 - RNA, 17 nt, Human
cagaaggcuccugcccc

SEQ ID NO: 3201217 - RNA, 21 nt, Human
cagaagggagcuggcuccagc

SEQ ID NO: 3201218 - RNA, 20 nt, Human
cagaagggagcuggcuccag

SEQ ID NO: 3201219 - RNA, 19 nt, Human
cagaagggagcuggcucca

SEQ ID NO: 3201220 - RNA, 17 nt, Human
cagaaggggacugccac

SEQ ID NO: 3201221 - RNA, 16 nt, Human
cagaaggggacugcca

SEQ ID NO: 3201222 - RNA, 15 nt, Human
cagaaggggacugcc

SEQ ID NO: 3201223 - RNA, 15 nt, Human
cagaaggucuguuuu

SEQ ID NO: 3201224 - RNA, 23 nt, Human
cagaaggggacugccaccucccc

SEQ ID NO: 3201225 - RNA, 22 nt, Human
cagaaggggacugccaccuccc

SEQ ID NO: 3201226 - RNA, 21 nt, Human
cagaaggggacugccaccucc

SEQ ID NO: 3201227 - RNA, 20 nt, Human
cagaaggggacugccaccuc

SEQ ID NO: 3201228 - RNA, 19 nt, Human
cagaaggggacugccaccu

SEQ ID NO: 3201229 - RNA, 23 nt, Human
cagaaccccuggcuccaggccag

SEQ ID NO: 3201230 - RNA, 22 nt, Human
cagaacccuuggagccaaugga

SEQ ID NO: 3201231 - RNA, 16 nt, Human
cagaaccagucuuuca

SEQ ID NO: 3201232 - RNA, 17 nt, Human
cagaaccagucuuucaa

SEQ ID NO: 3201233 - RNA, 22 nt, Human
cagaacucuuccuccaaggaca

SEQ ID NO: 3201234 - RNA, 19 nt, Human
cagaacuugaagccugcuc

SEQ ID NO: 3201235 - RNA, 18 nt, Human
cagaacuugaagccugcu

SEQ ID NO: 3201236 - RNA, 22 nt, Human
cagaacuugaagccugcuccuu

SEQ ID NO: 3201237 - RNA, 21 nt, Human
cagaacuugaagccugcuccu

SEQ ID NO: 3201238 - RNA, 20 nt, Human
cagaacuugaagccugcucc

SEQ ID NO: 3201239 - RNA, 19 nt, Human
cagaacugcagucacugca

SEQ ID NO: 3201240 - RNA, 18 nt, Human
cagaacuuagcaauuucc

SEQ ID NO: 3201241 - RNA, 14 nt, Human
cagaacucuguguc

SEQ ID NO: 3201242 - RNA, 13 nt, Human
cagaacucugugu

SEQ ID NO: 3201243 - RNA, 22 nt, Human
cagaacucugccugcccuuugu

SEQ ID NO: 3201244 - RNA, 18 nt, Human
cagaacucugccugcccu

SEQ ID NO: 3201245 - RNA, 17 nt, Human
cagaacucugccugccc

SEQ ID NO: 3201246 - RNA, 16 nt, Human
cagaacucugccugcc

SEQ ID NO: 3201247 - RNA, 15 nt, Human
cagaacucugccugc

SEQ ID NO: 3201248 - RNA, 16 nt, Human
cagaacucuuccucca

SEQ ID NO: 3201249 - RNA, 15 nt, Human
cagaacucuuccucc

SEQ ID NO: 3201250 - RNA, 14 nt, Human
cagaacucuuccuc

SEQ ID NO: 3201251 - RNA, 13 nt, Human
cagaacucuuccu

SEQ ID NO: 3201252 - RNA, 22 nt, Human
cagaacucgguguccccaccau

SEQ ID NO: 3201253 - RNA, 21 nt, Human
cagaacucgguguccccacca

SEQ ID NO: 3201254 - RNA, 19 nt, Human
cagaacucgguguccccac

SEQ ID NO: 3201255 - RNA, 18 nt, Human
cagaacucggugucccca

SEQ ID NO: 3201256 - RNA, 11 nt, Human
cagaagcccag

SEQ ID NO: 3201257 - RNA, 19 nt, Human
cagaagccacccaaagcag

SEQ ID NO: 3201258 - RNA, 18 nt, Human
cagaagccacccaaagca

SEQ ID NO: 3201259 - RNA, 14 nt, Human
cagaagcccagaau

SEQ ID NO: 3201260 - RNA, 12 nt, Human
cagaagcccaga

SEQ ID NO: 3201261 - RNA, 19 nt, Human
cagaagcaacccaaauguu

SEQ ID NO: 3201262 - RNA, 20 nt, Human
cagaagcaacccaaauguuc

SEQ ID NO: 3201263 - RNA, 21 nt, Human
cagaagacacugaugggcaac

SEQ ID NO: 3201264 - RNA, 15 nt, Human
cagaagaaauaaaua

SEQ ID NO: 3201265 - RNA, 17 nt, Human
cagaagaaauaaauaua

SEQ ID NO: 3201266 - RNA, 22 nt, Human
cacuuucuagccagaggagaga

SEQ ID NO: 3201267 - RNA, 22 nt, Human
cacuuggguccaggccuacucc

SEQ ID NO: 3201268 - RNA, 13 nt, Human
cacuuugacacuu

SEQ ID NO: 3201269 - RNA, 13 nt, Human
cacuuuguucugg

SEQ ID NO: 3201270 - RNA, 14 nt, Human
cacuuuguucuggc

SEQ ID NO: 3201271 - RNA, 16 nt, Human
cacuuuguucuggcuc

SEQ ID NO: 3201272 - RNA, 23 nt, Human
cacuuuguucuggcucuuccagg

SEQ ID NO: 3201273 - RNA, 12 nt, Human
cacuuugggagg

SEQ ID NO: 3201274 - RNA, 13 nt, Human
cacuuugggaggc

SEQ ID NO: 3201275 - RNA, 16 nt, Human
cacuuugggaggccaa

SEQ ID NO: 3201276 - RNA, 20 nt, Human
cacuuuuuaaaaaacuuucu

SEQ ID NO: 3201277 - RNA, 17 nt, Human
cacuuuuuaaaaaacuu

SEQ ID NO: 3201278 - RNA, 12 nt, Human
cacuuuugccag

SEQ ID NO: 3201279 - RNA, 18 nt, Human
cacuuuuauuuagcacca

SEQ ID NO: 3201280 - RNA, 11 nt, Human
cacuuuuccag

SEQ ID NO: 3201281 - RNA, 15 nt, Human
cacuuuucauaucau

SEQ ID NO: 3201282 - RNA, 17 nt, Human
cacuuuucauaucauuu

SEQ ID NO: 3201283 - RNA, 18 nt, Human
cacuuuucauaucauuuc

SEQ ID NO: 3201284 - RNA, 16 nt, Human
cacuuuuccaguauuu

SEQ ID NO: 3201285 - RNA, 15 nt, Human
cacuuuuccaguauu

SEQ ID NO: 3201286 - RNA, 17 nt, Human
cacuuuuccaguauuuu

SEQ ID NO: 3201287 - RNA, 22 nt, Human
cagaaaaacaaugguaacauuu

SEQ ID NO: 3201288 - RNA, 11 nt, Human
cagaaaaaagg

SEQ ID NO: 3201289 - RNA, 22 nt, Human
cagaaaaaagguucuuugugua

SEQ ID NO: 3201290 - RNA, 12 nt, Human
cagaaaaaaggu

SEQ ID NO: 3201291 - RNA, 21 nt, Human
cacuuuuucuuuacaaacaaa

SEQ ID NO: 3201292 - RNA, 20 nt, Human
cacuuuuucuuuacaaacaa

SEQ ID NO: 3201293 - RNA, 11 nt, Human
cagaaaaugag

SEQ ID NO: 3201294 - RNA, 23 nt, Human
cagaaaauggaagacagcucuua

SEQ ID NO: 3201295 - RNA, 15 nt, Human
cagaaacacccacag

SEQ ID NO: 3201296 - RNA, 16 nt, Human
cagaaaauggaagaca

SEQ ID NO: 3201297 - RNA, 20 nt, Human
cagaaaauggaagacagcuc

SEQ ID NO: 3201298 - RNA, 21 nt, Human
cagaaaauggaagacagcucu

SEQ ID NO: 3201299 - RNA, 22 nt, Human
cagaaaauggaagacagcucuu

SEQ ID NO: 3201300 - RNA, 22 nt, Human
cagaaaauauguauuaacacua

SEQ ID NO: 3201301 - RNA, 21 nt, Human
cagaaaauauguauuaacacu

SEQ ID NO: 3201302 - RNA, 20 nt, Human
cagaaaauauguauuaacac

SEQ ID NO: 3201303 - RNA, 16 nt, Human
cagaaaauauguauua

SEQ ID NO: 3201304 - RNA, 15 nt, Human
cagaaaauauguauu

SEQ ID NO: 3201305 - RNA, 14 nt, Human
cagaaaauauguau

SEQ ID NO: 3201306 - RNA, 18 nt, Human
cagaaagcagaacaguga

SEQ ID NO: 3201307 - RNA, 24 nt, Human
cagaaagaaguggggacagagcag

SEQ ID NO: 3201308 - RNA, 18 nt, Human
cagaaacuuguucuucca

SEQ ID NO: 3201309 - RNA, 22 nt, Human
cagaaacccucauuguguuucu

SEQ ID NO: 3201310 - RNA, 16 nt, Human
cagaaacuuguucuuc

SEQ ID NO: 3201311 - RNA, 17 nt, Human
cagaaacgccacauccc

SEQ ID NO: 3201312 - RNA, 19 nt, Human
cagaaacacccacaggcau

SEQ ID NO: 3201313 - RNA, 18 nt, Human
cagaaacacccacaggca

SEQ ID NO: 3201314 - RNA, 17 nt, Human
cagaaacacccacaggc

SEQ ID NO: 3201315 - RNA, 19 nt, Human
cagaaagcagaacagugau

SEQ ID NO: 3201316 - RNA, 18 nt, Human
cagaacagugauuaccag

SEQ ID NO: 3201317 - RNA, 23 nt, Human
cagaacagugauuaccagggacu

SEQ ID NO: 3201318 - RNA, 22 nt, Human
cagagcagugggccuggccagc

SEQ ID NO: 3201319 - RNA, 19 nt, Human
cagagcaguugagaggaca

SEQ ID NO: 3201320 - RNA, 12 nt, Human
cagagcagucug

SEQ ID NO: 3201321 - RNA, 17 nt, Human
cagagcauuccagucag

SEQ ID NO: 3201322 - RNA, 19 nt, Human
cagagcauuccagucaggc

SEQ ID NO: 3201323 - RNA, 18 nt, Human
cagagcauuccagucagg

SEQ ID NO: 3201324 - RNA, 22 nt, Human
cagagcauuccagucaggcucu

SEQ ID NO: 3201325 - RNA, 18 nt, Human
cagagccaaauugguaga

SEQ ID NO: 3201326 - RNA, 21 nt, Human
cagagcauuccagucaggcuc

SEQ ID NO: 3201327 - RNA, 20 nt, Human
cagagcauuccagucaggcu

SEQ ID NO: 3201328 - RNA, 22 nt, Human
cagagccaccccuaaagagaua

SEQ ID NO: 3201329 - RNA, 21 nt, Human
cagagcagugggccuggccag

SEQ ID NO: 3201330 - RNA, 20 nt, Human
cagagcagugggccuggcca

SEQ ID NO: 3201331 - RNA, 17 nt, Human
cagagcagugggccugg

SEQ ID NO: 3201332 - RNA, 15 nt, Human
cagagcagugggccu

SEQ ID NO: 3201333 - RNA, 16 nt, Human
cagagcccacgccccc

SEQ ID NO: 3201334 - RNA, 20 nt, Human
cagagcccaccuuggcucaa

SEQ ID NO: 3201335 - RNA, 19 nt, Human
cagagcccaccuuggcuca

SEQ ID NO: 3201336 - RNA, 17 nt, Human
cagagcccaccuuggcu

SEQ ID NO: 3201337 - RNA, 15 nt, Human
cagagcccaccuugg

SEQ ID NO: 3201338 - RNA, 13 nt, Human
cagagcagagacc

SEQ ID NO: 3201339 - RNA, 14 nt, Human
cagagcagagacca

SEQ ID NO: 3201340 - RNA, 15 nt, Human
cagagcagagaccau

SEQ ID NO: 3201341 - RNA, 17 nt, Human
cagagcagagaccaucc

SEQ ID NO: 3201342 - RNA, 18 nt, Human
cagagcagagaccauccc

SEQ ID NO: 3201343 - RNA, 19 nt, Human
cagagcagagaccaucccu

SEQ ID NO: 3201344 - RNA, 21 nt, Human
cagagcagagaccaucccuga

SEQ ID NO: 3201345 - RNA, 18 nt, Human
cagagcaccuuagacagu

SEQ ID NO: 3201346 - RNA, 19 nt, Human
cagagcaccuuagacaguc

SEQ ID NO: 3201347 - RNA, 21 nt, Human
cagagcaccuuagacaguccc

SEQ ID NO: 3201348 - RNA, 22 nt, Human
cagagcaccuuagacagucccu

SEQ ID NO: 3201349 - RNA, 11 nt, Human
cagagcagaga

SEQ ID NO: 3201350 - RNA, 12 nt, Human
cagagcagagac

SEQ ID NO: 3201351 - RNA, 23 nt, Human
cagagcaccuuagacagucccug

SEQ ID NO: 3201352 - RNA, 22 nt, Human
cagaggacaguauuugugggga

SEQ ID NO: 3201353 - RNA, 13 nt, Human
cagaggaccagca

SEQ ID NO: 3201354 - RNA, 17 nt, Human
cagaggacacagagaag

SEQ ID NO: 3201355 - RNA, 15 nt, Human
cagaggacacagaga

SEQ ID NO: 3201356 - RNA, 15 nt, Human
cagaggagagaggac

SEQ ID NO: 3201357 - RNA, 19 nt, Human
cagaggagagaggaccccc

SEQ ID NO: 3201358 - RNA, 13 nt, Human
cagaggagagagg

SEQ ID NO: 3201359 - RNA, 20 nt, Human
cagaggaccagcacacuccc

SEQ ID NO: 3201360 - RNA, 16 nt, Human
cagaggaccagcacac

SEQ ID NO: 3201361 - RNA, 20 nt, Human
cagaggagagaggacccccu

SEQ ID NO: 3201362 - RNA, 21 nt, Human
cagaggagaacuugcugccuc

SEQ ID NO: 3201363 - RNA, 20 nt, Human
cagaggagaacuugcugccu

SEQ ID NO: 3201364 - RNA, 11 nt, Human
cagaggcagcc

SEQ ID NO: 3201365 - RNA, 18 nt, Human
cagaggaggcgaggaggc

SEQ ID NO: 3201366 - RNA, 20 nt, Human
cagagccguaaaaacugaag

SEQ ID NO: 3201367 - RNA, 17 nt, Human
cagagcccugcucccuc

SEQ ID NO: 3201368 - RNA, 15 nt, Human
cagagcccugcuccc

SEQ ID NO: 3201369 - RNA, 14 nt, Human
cagagcccugcucc

SEQ ID NO: 3201370 - RNA, 10 nt, Human
cagagcccug

SEQ ID NO: 3201371 - RNA, 12 nt, Human
cagagccugcag

SEQ ID NO: 3201372 - RNA, 21 nt, Human
cagagccguaaaaacugaagu

SEQ ID NO: 3201373 - RNA, 20 nt, Human
cagaggaaagcaaaggagau

SEQ ID NO: 3201374 - RNA, 23 nt, Human
cagagccguaaaaacugaaguuc

SEQ ID NO: 3201375 - RNA, 13 nt, Human
cagagccugcagu

SEQ ID NO: 3201376 - RNA, 13 nt, Human
cagaggaaggaga

SEQ ID NO: 3201377 - RNA, 23 nt, Human
cagagcccacgcccccacuggug

SEQ ID NO: 3201378 - RNA, 14 nt, Human
cagagcccagaccc

SEQ ID NO: 3201379 - RNA, 20 nt, Human
cagagcccagacccuggagg

SEQ ID NO: 3201380 - RNA, 17 nt, Human
cagagcccacgccccca

SEQ ID NO: 3201381 - RNA, 19 nt, Human
cagagcccacgcccccacu

SEQ ID NO: 3201382 - RNA, 20 nt, Human
cagagcccacgcccccacug

SEQ ID NO: 3201383 - RNA, 21 nt, Human
cagagcccacgcccccacugg

SEQ ID NO: 3201384 - RNA, 21 nt, Human
cagagaccaucccugaaggcc

SEQ ID NO: 3201385 - RNA, 17 nt, Human
cagagaccaucccugaa

SEQ ID NO: 3201386 - RNA, 18 nt, Human
cagagaccaucccugaag

SEQ ID NO: 3201387 - RNA, 19 nt, Human
cagagaccaucccugaagg

SEQ ID NO: 3201388 - RNA, 20 nt, Human
cagagaccaucccugaaggc

SEQ ID NO: 3201389 - RNA, 13 nt, Human
cagagacuccugc

SEQ ID NO: 3201390 - RNA, 14 nt, Human
cagagacuccugca

SEQ ID NO: 3201391 - RNA, 15 nt, Human
cagagacuccugcag

SEQ ID NO: 3201392 - RNA, 16 nt, Human
cagagacuccugcagg

SEQ ID NO: 3201393 - RNA, 17 nt, Human
cagagacuccugcaggc

SEQ ID NO: 3201394 - RNA, 18 nt, Human
cagagacuccugcaggca

SEQ ID NO: 3201395 - RNA, 14 nt, Human
cagagcaagugaga

SEQ ID NO: 3201396 - RNA, 20 nt, Human
cagagcaagugagacccugu

SEQ ID NO: 3201397 - RNA, 16 nt, Human
cagagcaccuuagaca

SEQ ID NO: 3201398 - RNA, 18 nt, Human
cagagcacagcagccccu

SEQ ID NO: 3201399 - RNA, 23 nt, Human
cagagcaaccccuggaccccagc

SEQ ID NO: 3201400 - RNA, 22 nt, Human
cagagcaaccccuggaccccag

SEQ ID NO: 3201401 - RNA, 21 nt, Human
cagagcaaccccuggacccca

SEQ ID NO: 3201402 - RNA, 18 nt, Human
cagagcaaccccuggacc

SEQ ID NO: 3201403 - RNA, 15 nt, Human
cagagcaaccccugg

SEQ ID NO: 3201404 - RNA, 14 nt, Human
cagagaguggcucc

SEQ ID NO: 3201405 - RNA, 13 nt, Human
cagagaguggcuc

SEQ ID NO: 3201406 - RNA, 18 nt, Human
cagagaguggcuccuccc

SEQ ID NO: 3201407 - RNA, 15 nt, Human
cagagaguggcuccu

SEQ ID NO: 3201408 - RNA, 22 nt, Human
cagagauguccauuuuuacaag

SEQ ID NO: 3201409 - RNA, 20 nt, Human
cagagauggucauauuuaaa

SEQ ID NO: 3201410 - RNA, 16 nt, Human
cagagacacaagccuu

SEQ ID NO: 3201411 - RNA, 17 nt, Human
cagagacacaagccuuc

SEQ ID NO: 3201412 - RNA, 15 nt, Human
cagagacaaguaauu

SEQ ID NO: 3201413 - RNA, 14 nt, Human
cagagacacaagcc

SEQ ID NO: 3201414 - RNA, 15 nt, Human
cagagacacaagccu

SEQ ID NO: 3201415 - RNA, 22 nt, Human
cagagacaaauauuucuagaca

SEQ ID NO: 3201416 - RNA, 14 nt, Human
cagagaccaucccu

SEQ ID NO: 3201417 - RNA, 16 nt, Human
cagagaccaucccuga

SEQ ID NO: 3201418 - RNA, 13 nt, Human
cagagaccauccc

SEQ ID NO: 3201419 - RNA, 21 nt, Human
cagagaaugaaagggcccaga

SEQ ID NO: 3201420 - RNA, 20 nt, Human
cagagaaugaaagggcccag

SEQ ID NO: 3201421 - RNA, 15 nt, Human
cagagaauucucuua

SEQ ID NO: 3201422 - RNA, 20 nt, Human
cagagaagugacgguuccua

SEQ ID NO: 3201423 - RNA, 19 nt, Human
cagagaaugaaagggccca

SEQ ID NO: 3201424 - RNA, 16 nt, Human
cagagaaaugucuguc

SEQ ID NO: 3201425 - RNA, 20 nt, Human
cagagaaaucuaagcugugu

SEQ ID NO: 3201426 - RNA, 21 nt, Human
cagaggccuccuguggccugc

SEQ ID NO: 3201427 - RNA, 16 nt, Human
cagaggccuccugugg

SEQ ID NO: 3201428 - RNA, 13 nt, Human
cagaggcugccuc

SEQ ID NO: 3201429 - RNA, 21 nt, Human
cagaggcucagauuguaauau

SEQ ID NO: 3201430 - RNA, 23 nt, Human
cagaggccccaauaccccaugga

SEQ ID NO: 3201431 - RNA, 13 nt, Human
cagaggccuccug

SEQ ID NO: 3201432 - RNA, 12 nt, Human
cagaggccuccu

SEQ ID NO: 3201433 - RNA, 23 nt, Human
cagaggcugccucucccaucacu

SEQ ID NO: 3201434 - RNA, 19 nt, Human
cagagggagugacagaggc

SEQ ID NO: 3201435 - RNA, 18 nt, Human
cagagggagugacagagg

SEQ ID NO: 3201436 - RNA, 16 nt, Human
cagagggagugacaga

SEQ ID NO: 3201437 - RNA, 14 nt, Human
cagagggagugaca

SEQ ID NO: 3201438 - RNA, 22 nt, Human
cagaggcagccccauucugccu

SEQ ID NO: 3201439 - RNA, 20 nt, Human
cagaggcagccccauucugc

SEQ ID NO: 3201440 - RNA, 19 nt, Human
cagaggcagccccauucug

SEQ ID NO: 3201441 - RNA, 18 nt, Human
cagaggcagccccauucu

SEQ ID NO: 3201442 - RNA, 15 nt, Human
cagaggcagccccau

SEQ ID NO: 3201443 - RNA, 14 nt, Human
cagaggcagcccca

SEQ ID NO: 3201444 - RNA, 13 nt, Human
cagaggcagcccc

SEQ ID NO: 3201445 - RNA, 12 nt, Human
cagaggcagccc

SEQ ID NO: 3201446 - RNA, 16 nt, Human
cagaggccaugggccu

SEQ ID NO: 3201447 - RNA, 19 nt, Human
cagaggccaugggccuccu

SEQ ID NO: 3201448 - RNA, 23 nt, Human
cagaggcagccccauucugccug

SEQ ID NO: 3201449 - RNA, 21 nt, Human
cagaggccaugggccuccugu

SEQ ID NO: 3201450 - RNA, 20 nt, Human
cagaggccaugggccuccug

SEQ ID NO: 3201451 - RNA, 22 nt, Human
cagaggccccaauaccccaugg

SEQ ID NO: 3201452 - RNA, 11 nt, Human
cagaggcccca

SEQ ID NO: 3201453 - RNA, 13 nt, Human
cagagucucacug

SEQ ID NO: 3201454 - RNA, 22 nt, Human
cagaguccccccacucccagca

SEQ ID NO: 3201455 - RNA, 15 nt, Human
cagaguccccccacu

SEQ ID NO: 3201456 - RNA, 14 nt, Human
cagaguccccccac

SEQ ID NO: 3201457 - RNA, 13 nt, Human
cagagucccccca

SEQ ID NO: 3201458 - RNA, 23 nt, Human
cagagggccauugaacucugaga

SEQ ID NO: 3201459 - RNA, 21 nt, Human
cagagucucacuguugcccag

SEQ ID NO: 3201460 - RNA, 20 nt, Human
cagagucucacuguugccca

SEQ ID NO: 3201461 - RNA, 19 nt, Human
cagagucucacuguugccc

SEQ ID NO: 3201462 - RNA, 17 nt, Human
cagagucucacuguugc

SEQ ID NO: 3201463 - RNA, 23 nt, Human
cagagggagugacagaggcagcc

SEQ ID NO: 3201464 - RNA, 22 nt, Human
cagagggagugacagaggcagc

SEQ ID NO: 3201465 - RNA, 21 nt, Human
cagagggagugacagaggcag

SEQ ID NO: 3201466 - RNA, 20 nt, Human
cagagggagugacagaggca

SEQ ID NO: 3201467 - RNA, 15 nt, Human
cagagggccugcaag

SEQ ID NO: 3201468 - RNA, 19 nt, Human
cagagggccugcaagggag

SEQ ID NO: 3201469 - RNA, 18 nt, Human
cagagugagacucugucu

SEQ ID NO: 3201470 - RNA, 17 nt, Human
cagagugagacucuguc

SEQ ID NO: 3201471 - RNA, 16 nt, Human
cagagugagacucugu

SEQ ID NO: 3201472 - RNA, 23 nt, Human
cagagucucacuguugcccaggc

SEQ ID NO: 3201473 - RNA, 22 nt, Human
cagagucucacuguugcccagg

SEQ ID NO: 3201474 - RNA, 20 nt, Human
cagagucuagcguagugcag

SEQ ID NO: 3201475 - RNA, 20 nt, Human
cagagugagacucugucuca

SEQ ID NO: 3201476 - RNA, 19 nt, Human
cagagugagacucugucuc

SEQ ID NO: 3201477 - RNA, 21 nt, Human
cagauaaaugauucaaaaagu

SEQ ID NO: 3201478 - RNA, 17 nt, Human
cagauaaagauugugug

SEQ ID NO: 3201479 - RNA, 23 nt, Human
cagauaaaugauucaaaaaguca

SEQ ID NO: 3201480 - RNA, 23 nt, Human
cagauaaauaguuuaugauucca

SEQ ID NO: 3201481 - RNA, 14 nt, Human
cagauaaacaguag

SEQ ID NO: 3201482 - RNA, 21 nt, Human
cagauaaaccuagauaaagag

SEQ ID NO: 3201483 - RNA, 16 nt, Human
cagauaaagauugugu

SEQ ID NO: 3201484 - RNA, 12 nt, Human
cagauaaagauu

SEQ ID NO: 3201485 - RNA, 12 nt, Human
cagaguuacuug

SEQ ID NO: 3201486 - RNA, 17 nt, Human
cagaguuaaaucucaaa

SEQ ID NO: 3201487 - RNA, 15 nt, Human
cagaguugaagacag

SEQ ID NO: 3201488 - RNA, 16 nt, Human
cagaguugaagacaga

SEQ ID NO: 3201489 - RNA, 14 nt, Human
cagaguugaagaca

SEQ ID NO: 3201490 - RNA, 17 nt, Human
cagaguugaagacagag

SEQ ID NO: 3201491 - RNA, 18 nt, Human
cagaguugaagacagagc

SEQ ID NO: 3201492 - RNA, 19 nt, Human
cagaguugaagacagagcu

SEQ ID NO: 3201493 - RNA, 20 nt, Human
cagaguugaagacagagcua

SEQ ID NO: 3201494 - RNA, 22 nt, Human
cagaguugaagacagagcuaca

SEQ ID NO: 3201495 - RNA, 13 nt, Human
cagaugcaccagc

SEQ ID NO: 3201496 - RNA, 16 nt, Human
cagaugcaccagcccu

SEQ ID NO: 3201497 - RNA, 14 nt, Human
cagaugcaccagcc

SEQ ID NO: 3201498 - RNA, 22 nt, Human
cagaugcaccagcccuuagcag

SEQ ID NO: 3201499 - RNA, 17 nt, Human
cagaugcaccagcccuu

SEQ ID NO: 3201500 - RNA, 12 nt, Human
cagaugcagcuc

SEQ ID NO: 3201501 - RNA, 15 nt, Human
cagaugcagcucuuc

SEQ ID NO: 3201502 - RNA, 14 nt, Human
cagaugcagcucuu

SEQ ID NO: 3201503 - RNA, 13 nt, Human
cagaugcagcucu

SEQ ID NO: 3201504 - RNA, 23 nt, Human
cagaugcagcucuuccuggacag

SEQ ID NO: 3201505 - RNA, 19 nt, Human
cagaugcagcucuuccugg

SEQ ID NO: 3201506 - RNA, 18 nt, Human
cagaugcagcucuuccug

SEQ ID NO: 3201507 - RNA, 17 nt, Human
cagaugcagcucuuccu

SEQ ID NO: 3201508 - RNA, 19 nt, Human
cagaugaccccugcccaga

SEQ ID NO: 3201509 - RNA, 18 nt, Human
cagaugaccccugcccag

SEQ ID NO: 3201510 - RNA, 17 nt, Human
cagaugaccccugccca

SEQ ID NO: 3201511 - RNA, 16 nt, Human
cagaugaccccugccc

SEQ ID NO: 3201512 - RNA, 19 nt, Human
cagaugaggugaaaaggcc

SEQ ID NO: 3201513 - RNA, 23 nt, Human
cagaugaccccugcccagaucag

SEQ ID NO: 3201514 - RNA, 12 nt, Human
cagaucuguuuu

SEQ ID NO: 3201515 - RNA, 13 nt, Human
cagaucuguuuug

SEQ ID NO: 3201516 - RNA, 23 nt, Human
cagaucuguuuugugguuuggaa

SEQ ID NO: 3201517 - RNA, 22 nt, Human
cagauacaggaaaagcugcuga

SEQ ID NO: 3201518 - RNA, 21 nt, Human
cagauacaggaaaagcugcug

SEQ ID NO: 3201519 - RNA, 20 nt, Human
cagauacaggaaaagcugcu

SEQ ID NO: 3201520 - RNA, 23 nt, Human
cagaucucccacaugccaggggc

SEQ ID NO: 3201521 - RNA, 13 nt, Human
cagaucucccaca

SEQ ID NO: 3201522 - RNA, 19 nt, Human
cagcccaaaccaccagaag

SEQ ID NO: 3201523 - RNA, 16 nt, Human
cagcccaaaccaccag

SEQ ID NO: 3201524 - RNA, 23 nt, Human
cagcccaaaccaccagaagccca

SEQ ID NO: 3201525 - RNA, 21 nt, Human
cagcccaaaccaccagaagcc

SEQ ID NO: 3201526 - RNA, 20 nt, Human
cagcccaaaccaccagaagc

SEQ ID NO: 3201527 - RNA, 14 nt, Human
cagccaucaacuaa

SEQ ID NO: 3201528 - RNA, 16 nt, Human
cagcccaccuggcuuu

SEQ ID NO: 3201529 - RNA, 15 nt, Human
cagcccacuucugcc

SEQ ID NO: 3201530 - RNA, 22 nt, Human
cagcccacgcugacuacagggc

SEQ ID NO: 3201531 - RNA, 15 nt, Human
cagcccacgcugacu

SEQ ID NO: 3201532 - RNA, 13 nt, Human
cagcccacgcuga

SEQ ID NO: 3201533 - RNA, 15 nt, Human
cagcccaccccucaa

SEQ ID NO: 3201534 - RNA, 17 nt, Human
cagcccaccccauggcc

SEQ ID NO: 3201535 - RNA, 19 nt, Human
cagcccacauagugauggu

SEQ ID NO: 3201536 - RNA, 11 nt, Human
cagcccacccc

SEQ ID NO: 3201537 - RNA, 17 nt, Human
cagcccaaucccugauc

SEQ ID NO: 3201538 - RNA, 16 nt, Human
cagcccaaucccugau

SEQ ID NO: 3201539 - RNA, 20 nt, Human
cagccccaaaacucuccucu

SEQ ID NO: 3201540 - RNA, 21 nt, Human
cagccccaaaacucuccucug

SEQ ID NO: 3201541 - RNA, 22 nt, Human
cagccccaaaacucuccucugc

SEQ ID NO: 3201542 - RNA, 22 nt, Human
cagcccauuugggcagagaggc

SEQ ID NO: 3201543 - RNA, 17 nt, Human
cagcccauuugggcaga

SEQ ID NO: 3201544 - RNA, 22 nt, Human
cagccccaaauugucaccugcu

SEQ ID NO: 3201545 - RNA, 18 nt, Human
cagcccacuucugccaua

SEQ ID NO: 3201546 - RNA, 17 nt, Human
cagcccagaagugcaga

SEQ ID NO: 3201547 - RNA, 22 nt, Human
cagcccagaggccgagagcuau

SEQ ID NO: 3201548 - RNA, 20 nt, Human
cagcccagaagugcagaacu

SEQ ID NO: 3201549 - RNA, 14 nt, Human
cagccacauuccug

SEQ ID NO: 3201550 - RNA, 15 nt, Human
cagccaauauuuaaa

SEQ ID NO: 3201551 - RNA, 15 nt, Human
cagccacauuccuga

SEQ ID NO: 3201552 - RNA, 17 nt, Human
cagccacauuccugaug

SEQ ID NO: 3201553 - RNA, 19 nt, Human
cagccacauuccugaugcu

SEQ ID NO: 3201554 - RNA, 22 nt, Human
cagccacggccaggccagaggg

SEQ ID NO: 3201555 - RNA, 21 nt, Human
cagccacggccaggccagagg

SEQ ID NO: 3201556 - RNA, 19 nt, Human
cagccacggccaggccaga

SEQ ID NO: 3201557 - RNA, 18 nt, Human
cagccacggccaggccag

SEQ ID NO: 3201558 - RNA, 17 nt, Human
cagccacggccaggcca

SEQ ID NO: 3201559 - RNA, 16 nt, Human
cagccacggccaggcc

SEQ ID NO: 3201560 - RNA, 15 nt, Human
cagccacggccaggc

SEQ ID NO: 3201561 - RNA, 14 nt, Human
cagccacggccagg

SEQ ID NO: 3201562 - RNA, 21 nt, Human
cagccauaggcccuuucagug

SEQ ID NO: 3201563 - RNA, 20 nt, Human
cagccauaggcccuuucagu

SEQ ID NO: 3201564 - RNA, 18 nt, Human
cagccauaggcccuuuca

SEQ ID NO: 3201565 - RNA, 23 nt, Human
cagccacggccaggccagaggga

SEQ ID NO: 3201566 - RNA, 20 nt, Human
cagccacuccccagccagcc

SEQ ID NO: 3201567 - RNA, 17 nt, Human
cagccacuccccagcca

SEQ ID NO: 3201568 - RNA, 16 nt, Human
cagccacuccccagcc

SEQ ID NO: 3201569 - RNA, 14 nt, Human
cagccacuccccag

SEQ ID NO: 3201570 - RNA, 14 nt, Human
cagccacucagaaa

SEQ ID NO: 3201571 - RNA, 12 nt, Human
cagccagaacuc

SEQ ID NO: 3201572 - RNA, 18 nt, Human
cagccagaacucuguguc

SEQ ID NO: 3201573 - RNA, 16 nt, Human
cagccagaacucugug

SEQ ID NO: 3201574 - RNA, 16 nt, Human
cagccacuuaggacaa

SEQ ID NO: 3201575 - RNA, 22 nt, Human
cagcauuuguguguuacaaugu

SEQ ID NO: 3201576 - RNA, 16 nt, Human
cagcauuuguguguua

SEQ ID NO: 3201577 - RNA, 12 nt, Human
cagcauuucaag

SEQ ID NO: 3201578 - RNA, 15 nt, Human
cagccaaagccuccu

SEQ ID NO: 3201579 - RNA, 16 nt, Human
cagccaaagccuccuc

SEQ ID NO: 3201580 - RNA, 16 nt, Human
cagccaaacacacaga

SEQ ID NO: 3201581 - RNA, 19 nt, Human
cagccaaacacacagaagg

SEQ ID NO: 3201582 - RNA, 18 nt, Human
cagccaaacacacagaag

SEQ ID NO: 3201583 - RNA, 18 nt, Human
cagccaaagccuccucca

SEQ ID NO: 3201584 - RNA, 21 nt, Human
cagccaaagccuccuccagcc

SEQ ID NO: 3201585 - RNA, 23 nt, Human
cagccaaacacacagaaggggac

SEQ ID NO: 3201586 - RNA, 20 nt, Human
cagcauccuggcacccggcc

SEQ ID NO: 3201587 - RNA, 19 nt, Human
cagcauccuggcacccggc

SEQ ID NO: 3201588 - RNA, 21 nt, Human
cagcauccuggcacccggccc

SEQ ID NO: 3201589 - RNA, 12 nt, Human
cagcaugaaaau

SEQ ID NO: 3201590 - RNA, 16 nt, Human
cagcaugaaaaugugu

SEQ ID NO: 3201591 - RNA, 24 nt, Human
cagcaucuggaagagcuaggcagg

SEQ ID NO: 3201592 - RNA, 14 nt, Human
cagcaucuggaaga

SEQ ID NO: 3201593 - RNA, 21 nt, Human
cagcaucgcacucuggcagca

SEQ ID NO: 3201594 - RNA, 19 nt, Human
cagcaucgcacucuggcag

SEQ ID NO: 3201595 - RNA, 18 nt, Human
cagcaucgcacucuggca

SEQ ID NO: 3201596 - RNA, 20 nt, Human
cagcauguguuaaucuuaau

SEQ ID NO: 3201597 - RNA, 23 nt, Human
cagcauguguuaaucuuaaugua

SEQ ID NO: 3201598 - RNA, 18 nt, Human
cagcauuaccucuuugga

SEQ ID NO: 3201599 - RNA, 16 nt, Human
cagcauuagugggaaa

SEQ ID NO: 3201600 - RNA, 19 nt, Human
cagcauuaccucuuuggaa

SEQ ID NO: 3201601 - RNA, 15 nt, Human
cagcauucucacucc

SEQ ID NO: 3201602 - RNA, 14 nt, Human
cagcauucucacuc

SEQ ID NO: 3201603 - RNA, 23 nt, Human
cagcaggagggacagucucacca

SEQ ID NO: 3201604 - RNA, 22 nt, Human
cagcaggagggacagucucacc

SEQ ID NO: 3201605 - RNA, 19 nt, Human
cagcaggagggacagucuc

SEQ ID NO: 3201606 - RNA, 15 nt, Human
cagcaggagggacag

SEQ ID NO: 3201607 - RNA, 12 nt, Human
cagcaggaggga

SEQ ID NO: 3201608 - RNA, 11 nt, Human
cagcaggaggg

SEQ ID NO: 3201609 - RNA, 14 nt, Human
cagcaggcucucag

SEQ ID NO: 3201610 - RNA, 15 nt, Human
cagcaggcucucagg

SEQ ID NO: 3201611 - RNA, 12 nt, Human
cagcaggcucuc

SEQ ID NO: 3201612 - RNA, 19 nt, Human
cagcaggcagccuuggcgg

SEQ ID NO: 3201613 - RNA, 11 nt, Human
cagcaggccca

SEQ ID NO: 3201614 - RNA, 15 nt, Human
cagcaggcagccuug

SEQ ID NO: 3201615 - RNA, 13 nt, Human
cagcaggcagccu

SEQ ID NO: 3201616 - RNA, 12 nt, Human
cagcaggcagcc

SEQ ID NO: 3201617 - RNA, 11 nt, Human
cagcaggcagc

SEQ ID NO: 3201618 - RNA, 19 nt, Human
cagcagccuggacccugug

SEQ ID NO: 3201619 - RNA, 22 nt, Human
cagcagccuggacccuguggau

SEQ ID NO: 3201620 - RNA, 12 nt, Human
cagcagccugga

SEQ ID NO: 3201621 - RNA, 14 nt, Human
cagcagccuggacc

SEQ ID NO: 3201622 - RNA, 15 nt, Human
cagcagccuggaccc

SEQ ID NO: 3201623 - RNA, 18 nt, Human
cagcagccuggacccugu

SEQ ID NO: 3201624 - RNA, 18 nt, Human
cagcagggagggcuucug

SEQ ID NO: 3201625 - RNA, 14 nt, Human
cagcaggcccaugg

SEQ ID NO: 3201626 - RNA, 20 nt, Human
cagcaggcucucaggccagc

SEQ ID NO: 3201627 - RNA, 22 nt, Human
cagcaggcucucaggccagcug

SEQ ID NO: 3201628 - RNA, 16 nt, Human
cagcaggcucucaggc

SEQ ID NO: 3201629 - RNA, 17 nt, Human
cagcaggcucucaggcc

SEQ ID NO: 3201630 - RNA, 18 nt, Human
cagcaggcucucaggcca

SEQ ID NO: 3201631 - RNA, 19 nt, Human
cagcaggcucucaggccag

SEQ ID NO: 3201632 - RNA, 20 nt, Human
cagcagggagggcuucugcc

SEQ ID NO: 3201633 - RNA, 15 nt, Human
cagcagggcaguagc

SEQ ID NO: 3201634 - RNA, 11 nt, Human
cagcagggcag

SEQ ID NO: 3201635 - RNA, 17 nt, Human
cagcauccuggcacccg

SEQ ID NO: 3201636 - RNA, 16 nt, Human
cagcauccuggcaccc

SEQ ID NO: 3201637 - RNA, 15 nt, Human
cagcauccuggcacc

SEQ ID NO: 3201638 - RNA, 14 nt, Human
cagcauccuggcac

SEQ ID NO: 3201639 - RNA, 18 nt, Human
cagaugggugcuuggagg

SEQ ID NO: 3201640 - RNA, 12 nt, Human
cagaugccuggg

SEQ ID NO: 3201641 - RNA, 15 nt, Human
cagaugcugugcaaa

SEQ ID NO: 3201642 - RNA, 22 nt, Human
cagaugcuugcggcaaaaggaa

SEQ ID NO: 3201643 - RNA, 23 nt, Human
cagaugcuugcggcaaaaggaaa

SEQ ID NO: 3201644 - RNA, 12 nt, Human
cagaugcucuga

SEQ ID NO: 3201645 - RNA, 14 nt, Human
cagaugcucugaga

SEQ ID NO: 3201646 - RNA, 13 nt, Human
cagaugcucugag

SEQ ID NO: 3201647 - RNA, 15 nt, Human
cagauucaggcauuu

SEQ ID NO: 3201648 - RNA, 14 nt, Human
cagauucaggcauu

SEQ ID NO: 3201649 - RNA, 13 nt, Human
cagauucaggcau

SEQ ID NO: 3201650 - RNA, 20 nt, Human
cagauucuaggaccuguguc

SEQ ID NO: 3201651 - RNA, 21 nt, Human
cagauucguggucuuuuccuc

SEQ ID NO: 3201652 - RNA, 19 nt, Human
cagauucguggucuuuucc

SEQ ID NO: 3201653 - RNA, 21 nt, Human
cagauuacugcuuuaaucaga

SEQ ID NO: 3201654 - RNA, 17 nt, Human
cagauguuuaaaacacc

SEQ ID NO: 3201655 - RNA, 23 nt, Human
cagaugggugcuuggaggaagga

SEQ ID NO: 3201656 - RNA, 19 nt, Human
cagauguccuaauggugau

SEQ ID NO: 3201657 - RNA, 22 nt, Human
cagauguccuaauggugaugca

SEQ ID NO: 3201658 - RNA, 14 nt, Human
cagauguuuaaaac

SEQ ID NO: 3201659 - RNA, 23 nt, Human
cagaugugggccaccauugcaac

SEQ ID NO: 3201660 - RNA, 22 nt, Human
cagaugugggccaccauugcaa

SEQ ID NO: 3201661 - RNA, 15 nt, Human
cagauguuuaaaaca

SEQ ID NO: 3201662 - RNA, 16 nt, Human
cagauguuuaaaacac

SEQ ID NO: 3201663 - RNA, 18 nt, Human
cagaugugcuauaaucug

SEQ ID NO: 3201664 - RNA, 20 nt, Human
cagaugugcuauaaucuguu

SEQ ID NO: 3201665 - RNA, 22 nt, Human
cagaugugcuauaaucuguuuu

SEQ ID NO: 3201666 - RNA, 15 nt, Human
cagauguuaaaauaa

SEQ ID NO: 3201667 - RNA, 16 nt, Human
cagauguuaaaauaaa

SEQ ID NO: 3201668 - RNA, 17 nt, Human
cagauguuaaaauaaau

SEQ ID NO: 3201669 - RNA, 18 nt, Human
cagauguuaaaauaaaug

SEQ ID NO: 3201670 - RNA, 20 nt, Human
cagauguuaaaauaaauggu

SEQ ID NO: 3201671 - RNA, 21 nt, Human
cagauguuaaaauaaaugguu

SEQ ID NO: 3201672 - RNA, 23 nt, Human
cagcaacgcaggcccccaggugc

SEQ ID NO: 3201673 - RNA, 16 nt, Human
cagcaacgaucacaaa

SEQ ID NO: 3201674 - RNA, 18 nt, Human
cagcaacgaucacaaaug

SEQ ID NO: 3201675 - RNA, 19 nt, Human
cagcaacgaucacaaauga

SEQ ID NO: 3201676 - RNA, 20 nt, Human
cagcaacgaucacaaaugac

SEQ ID NO: 3201677 - RNA, 21 nt, Human
cagcaacgaucacaaaugacu

SEQ ID NO: 3201678 - RNA, 22 nt, Human
cagcaacgaucacaaaugacuu

SEQ ID NO: 3201679 - RNA, 23 nt, Human
cagcaacgaucacaaaugacuuu

SEQ ID NO: 3201680 - RNA, 18 nt, Human
cagcaaaagaugcuucuc

SEQ ID NO: 3201681 - RNA, 15 nt, Human
cagcaaagaaaaaaa

SEQ ID NO: 3201682 - RNA, 21 nt, Human
cagcaaaccuaauugcacaac

SEQ ID NO: 3201683 - RNA, 17 nt, Human
cagauuuuggccaugaa

SEQ ID NO: 3201684 - RNA, 19 nt, Human
cagauuuuuuacagcugcc

SEQ ID NO: 3201685 - RNA, 22 nt, Human
cagauuuuuuacagcugccugc

SEQ ID NO: 3201686 - RNA, 14 nt, Human
cagauucuuuccug

SEQ ID NO: 3201687 - RNA, 12 nt, Human
cagauuuuaguu

SEQ ID NO: 3201688 - RNA, 22 nt, Human
cagauuuuaguuuuauuuucua

SEQ ID NO: 3201689 - RNA, 17 nt, Human
cagauuuuaguuuuauu

SEQ ID NO: 3201690 - RNA, 15 nt, Human
cagauuuuaguuuua

SEQ ID NO: 3201691 - RNA, 13 nt, Human
cagauuuuaguuu

SEQ ID NO: 3201692 - RNA, 19 nt, Human
cagcaagggugaugggaaa

SEQ ID NO: 3201693 - RNA, 18 nt, Human
cagcaaggcgcuaacuug

SEQ ID NO: 3201694 - RNA, 20 nt, Human
cagcaaggcgcuaacuugcu

SEQ ID NO: 3201695 - RNA, 19 nt, Human
cagcaaggcgcuaacuugc

SEQ ID NO: 3201696 - RNA, 13 nt, Human
cagcaaggccacc

SEQ ID NO: 3201697 - RNA, 15 nt, Human
cagcaaggccaccuc

SEQ ID NO: 3201698 - RNA, 14 nt, Human
cagcaaggccaccu

SEQ ID NO: 3201699 - RNA, 20 nt, Human
cagcaaggccaccucuuccu

SEQ ID NO: 3201700 - RNA, 19 nt, Human
cagcaaggccaccucuucc

SEQ ID NO: 3201701 - RNA, 17 nt, Human
cagcaaggccaccucuu

SEQ ID NO: 3201702 - RNA, 16 nt, Human
cagcaaggccaccucu

SEQ ID NO: 3201703 - RNA, 23 nt, Human
cagcaaggccaccucuuccuggc

SEQ ID NO: 3201704 - RNA, 21 nt, Human
cagcaaggccaccucuuccug

SEQ ID NO: 3201705 - RNA, 20 nt, Human
cagcaagccgaauagcugau

SEQ ID NO: 3201706 - RNA, 23 nt, Human
cagcaagggugaugggaaagcau

SEQ ID NO: 3201707 - RNA, 22 nt, Human
cagcaagggugaugggaaagca

SEQ ID NO: 3201708 - RNA, 12 nt, Human
cagcaagugaga

SEQ ID NO: 3201709 - RNA, 18 nt, Human
cagcaaggucuugcucuc

SEQ ID NO: 3201710 - RNA, 16 nt, Human
cagcaaggucuugcuc

SEQ ID NO: 3201711 - RNA, 15 nt, Human
cagcaaggucuugcu

SEQ ID NO: 3201712 - RNA, 17 nt, Human
cagcaagugagagcugg

SEQ ID NO: 3201713 - RNA, 16 nt, Human
cagcaagugagagcug

SEQ ID NO: 3201714 - RNA, 15 nt, Human
cagcaagugagagcu

SEQ ID NO: 3201715 - RNA, 14 nt, Human
cagcaagugagagc

SEQ ID NO: 3201716 - RNA, 21 nt, Human
cagcaagugagagcugggugu

SEQ ID NO: 3201717 - RNA, 19 nt, Human
cagcaagugagagcugggu

SEQ ID NO: 3201718 - RNA, 20 nt, Human
cagcaaguuagagaaucugg

SEQ ID NO: 3201719 - RNA, 17 nt, Human
cagcaaguucacaugga

SEQ ID NO: 3201720 - RNA, 15 nt, Human
cagcaagugugaaua

SEQ ID NO: 3201721 - RNA, 21 nt, Human
cagcacaaccuucaagcugcu

SEQ ID NO: 3201722 - RNA, 18 nt, Human
cagcacaaccuucaagcu

SEQ ID NO: 3201723 - RNA, 15 nt, Human
cagcaauucuccugc

SEQ ID NO: 3201724 - RNA, 16 nt, Human
cagcaauucuccugcc

SEQ ID NO: 3201725 - RNA, 17 nt, Human
cagcaauucuccugccu

SEQ ID NO: 3201726 - RNA, 18 nt, Human
cagcaauucuccugccuc

SEQ ID NO: 3201727 - RNA, 19 nt, Human
cagcaauucuccugccuca

SEQ ID NO: 3201728 - RNA, 20 nt, Human
cagcaauucuccugccucag

SEQ ID NO: 3201729 - RNA, 23 nt, Human
cagcagccccugcacaaagcccu

SEQ ID NO: 3201730 - RNA, 16 nt, Human
cagcagccccugcaca

SEQ ID NO: 3201731 - RNA, 13 nt, Human
cagcagccccugc

SEQ ID NO: 3201732 - RNA, 14 nt, Human
cagcagccagccaa

SEQ ID NO: 3201733 - RNA, 13 nt, Human
cagcagccagcca

SEQ ID NO: 3201734 - RNA, 12 nt, Human
cagcagccagcc

SEQ ID NO: 3201735 - RNA, 23 nt, Human
cagcagccagccaaacacacaga

SEQ ID NO: 3201736 - RNA, 16 nt, Human
cagcagccagccaaac

SEQ ID NO: 3201737 - RNA, 11 nt, Human
cagcagagcac

SEQ ID NO: 3201738 - RNA, 13 nt, Human
cagcagagcaccu

SEQ ID NO: 3201739 - RNA, 23 nt, Human
cagcagaauugaccgacagcuuu

SEQ ID NO: 3201740 - RNA, 19 nt, Human
cagcacuuucuucuuccca

SEQ ID NO: 3201741 - RNA, 23 nt, Human
caggaaccauaguugacaguucc

SEQ ID NO: 3201742 - RNA, 14 nt, Human
caggaagcagcuuu

SEQ ID NO: 3201743 - RNA, 14 nt, Human
caggaagccagcag

SEQ ID NO: 3201744 - RNA, 16 nt, Human
caggaagccagcaggc

SEQ ID NO: 3201745 - RNA, 17 nt, Human
caggaagccagcaggcu

SEQ ID NO: 3201746 - RNA, 18 nt, Human
caggaagccagcaggcuc

SEQ ID NO: 3201747 - RNA, 19 nt, Human
caggaagccagcaggcucu

SEQ ID NO: 3201748 - RNA, 21 nt, Human
caggaagccagcaggcucuca

SEQ ID NO: 3201749 - RNA, 22 nt, Human
caggaagccagcaggcucucag

SEQ ID NO: 3201750 - RNA, 20 nt, Human
caggaagcucagggccuggc

SEQ ID NO: 3201751 - RNA, 21 nt, Human
caggaagcucagggccuggcu

SEQ ID NO: 3201752 - RNA, 22 nt, Human
caggaagcucagggccuggcuc

SEQ ID NO: 3201753 - RNA, 23 nt, Human
caggaagcucagggccuggcuca

SEQ ID NO: 3201754 - RNA, 16 nt, Human
caggaagcucagggcc

SEQ ID NO: 3201755 - RNA, 17 nt, Human
caggaagcucagggccu

SEQ ID NO: 3201756 - RNA, 18 nt, Human
caggaagcucagggccug

SEQ ID NO: 3201757 - RNA, 19 nt, Human
caggaagcucagggccugg

SEQ ID NO: 3201758 - RNA, 14 nt, Human
caggaagcucaggg

SEQ ID NO: 3201759 - RNA, 15 nt, Human
caggaagcucagggc

SEQ ID NO: 3201760 - RNA, 13 nt, Human
caggaagcucagg

SEQ ID NO: 3201761 - RNA, 16 nt, Human
caggaaguagaggagg

SEQ ID NO: 3201762 - RNA, 18 nt, Human
caggaaguagcacaggcu

SEQ ID NO: 3201763 - RNA, 17 nt, Human
caggaaguagcacaggc

SEQ ID NO: 3201764 - RNA, 16 nt, Human
caggaaguagcacagg

SEQ ID NO: 3201765 - RNA, 15 nt, Human
caggaaguagcacag

SEQ ID NO: 3201766 - RNA, 21 nt, Human
caggaaguccuuaucuagcug

SEQ ID NO: 3201767 - RNA, 22 nt, Human
caggaaguagcacaggcugagu

SEQ ID NO: 3201768 - RNA, 21 nt, Human
caggaaguagcacaggcugag

SEQ ID NO: 3201769 - RNA, 20 nt, Human
caggaaguagcacaggcuga

SEQ ID NO: 3201770 - RNA, 15 nt, Human
caggaaguagaggag

SEQ ID NO: 3201771 - RNA, 20 nt, Human
caggaaguacuggagaaaau

SEQ ID NO: 3201772 - RNA, 17 nt, Human
caggaaguacuggagaa

SEQ ID NO: 3201773 - RNA, 18 nt, Human
caggaaguacuggagaaa

SEQ ID NO: 3201774 - RNA, 15 nt, Human
caggaaggcuaaagg

SEQ ID NO: 3201775 - RNA, 19 nt, Human
caggaaggcugagaggaga

SEQ ID NO: 3201776 - RNA, 14 nt, Human
caggaaguacugga

SEQ ID NO: 3201777 - RNA, 16 nt, Human
caggaaguacuggaga

SEQ ID NO: 3201778 - RNA, 12 nt, Human
caggaaguacug

SEQ ID NO: 3201779 - RNA, 23 nt, Human
caggacgacuguuuucccaacac

SEQ ID NO: 3201780 - RNA, 19 nt, Human
caggaaaacacccagggaa

SEQ ID NO: 3201781 - RNA, 16 nt, Human
caggaaaacacccagg

SEQ ID NO: 3201782 - RNA, 23 nt, Human
cagcuuuucauugcugugacagu

SEQ ID NO: 3201783 - RNA, 20 nt, Human
cagcuuuucauugcugugac

SEQ ID NO: 3201784 - RNA, 15 nt, Human
cagcuuuucauugcu

SEQ ID NO: 3201785 - RNA, 17 nt, Human
cagcuuuuccugggaca

SEQ ID NO: 3201786 - RNA, 12 nt, Human
cagcuuuguuug

SEQ ID NO: 3201787 - RNA, 21 nt, Human
cagcuuuguuuguugucagcu

SEQ ID NO: 3201788 - RNA, 22 nt, Human
cagcuuuguuuguugucagcug

SEQ ID NO: 3201789 - RNA, 23 nt, Human
cagcuuuguuuguugucagcuga

SEQ ID NO: 3201790 - RNA, 14 nt, Human
cagcuuugauauuu

SEQ ID NO: 3201791 - RNA, 13 nt, Human
cagcuuugacccg

SEQ ID NO: 3201792 - RNA, 13 nt, Human
cagcuuuccagua

SEQ ID NO: 3201793 - RNA, 23 nt, Human
cagcuuuccucaaaacuucagac

SEQ ID NO: 3201794 - RNA, 23 nt, Human
cagcuuuccccaugucucgacuc

SEQ ID NO: 3201795 - RNA, 22 nt, Human
cagcuuuaaaaaauuaaucugg

SEQ ID NO: 3201796 - RNA, 16 nt, Human
cagcuuguuuuggacu

SEQ ID NO: 3201797 - RNA, 21 nt, Human
cagcuuguuuuggacuuuguu

SEQ ID NO: 3201798 - RNA, 22 nt, Human
cagcuuguuuuggacuuuguua

SEQ ID NO: 3201799 - RNA, 23 nt, Human
cagcuuguuuuggacuuuguuac

SEQ ID NO: 3201800 - RNA, 22 nt, Human
cagcuuguaaauagcucaggug

SEQ ID NO: 3201801 - RNA, 21 nt, Human
cagcuuguaaauagcucaggu

SEQ ID NO: 3201802 - RNA, 20 nt, Human
cagcuuguaaauagcucagg

SEQ ID NO: 3201803 - RNA, 19 nt, Human
cagcuuguaaauagcucag

SEQ ID NO: 3201804 - RNA, 18 nt, Human
cagcuuguaaauagcuca

SEQ ID NO: 3201805 - RNA, 18 nt, Human
cagcuugaaacugagaug

SEQ ID NO: 3201806 - RNA, 21 nt, Human
cagcuucauuuccugugucuu

SEQ ID NO: 3201807 - RNA, 20 nt, Human
cagcuucauuuccugugucu

SEQ ID NO: 3201808 - RNA, 19 nt, Human
cagcuucauuuccuguguc

SEQ ID NO: 3201809 - RNA, 11 nt, Human
cagcuuccagc

SEQ ID NO: 3201810 - RNA, 13 nt, Human
cagcuuccagcag

SEQ ID NO: 3201811 - RNA, 12 nt, Human
cagcuuccagca

SEQ ID NO: 3201812 - RNA, 18 nt, Human
cagcuuccccaguagcug

SEQ ID NO: 3201813 - RNA, 17 nt, Human
cagcuuccccaguagcu

SEQ ID NO: 3201814 - RNA, 17 nt, Human
cagcuuccagcaggagg

SEQ ID NO: 3201815 - RNA, 16 nt, Human
cagcuuccagcaggag

SEQ ID NO: 3201816 - RNA, 15 nt, Human
cagcuuccagcagga

SEQ ID NO: 3201817 - RNA, 14 nt, Human
cagcuuccagcagg

SEQ ID NO: 3201818 - RNA, 18 nt, Human
cagcuuccugucaagcaa

SEQ ID NO: 3201819 - RNA, 21 nt, Human
cagcuugaggguugggcuggu

SEQ ID NO: 3201820 - RNA, 20 nt, Human
cagcuugaggguugggcugg

SEQ ID NO: 3201821 - RNA, 19 nt, Human
cagcuugaggguugggcug

SEQ ID NO: 3201822 - RNA, 18 nt, Human
cagcuugaggguugggcu

SEQ ID NO: 3201823 - RNA, 13 nt, Human
cagcuugggcaga

SEQ ID NO: 3201824 - RNA, 20 nt, Human
cagcuugggcagaucuccca

SEQ ID NO: 3201825 - RNA, 17 nt, Human
cagcuugggcagaucuc

SEQ ID NO: 3201826 - RNA, 13 nt, Human
cagcuuggcucag

SEQ ID NO: 3201827 - RNA, 18 nt, Human
cagcuugcacauuuggua

SEQ ID NO: 3201828 - RNA, 16 nt, Human
cagcuugcacauuugg

SEQ ID NO: 3201829 - RNA, 18 nt, Human
cagcuugaccgugaggcc

SEQ ID NO: 3201830 - RNA, 19 nt, Human
cagcuugaccgugaggcca

SEQ ID NO: 3201831 - RNA, 20 nt, Human
cagcuugaccgugaggccag

SEQ ID NO: 3201832 - RNA, 21 nt, Human
cagcuugaccgugaggccaga

SEQ ID NO: 3201833 - RNA, 15 nt, Human
cagcuugaggguugg

SEQ ID NO: 3201834 - RNA, 14 nt, Human
cagcuugaggguug

SEQ ID NO: 3201835 - RNA, 23 nt, Human
cagcugggaucacauguggacuu

SEQ ID NO: 3201836 - RNA, 22 nt, Human
cagcugcuuuugucuaugggac

SEQ ID NO: 3201837 - RNA, 23 nt, Human
cagcugcuuuugucuaugggacu

SEQ ID NO: 3201838 - RNA, 15 nt, Human
cagcugcuuucuucu

SEQ ID NO: 3201839 - RNA, 14 nt, Human
cagcugcuuuguua

SEQ ID NO: 3201840 - RNA, 15 nt, Human
cagcugcuuuguuac

SEQ ID NO: 3201841 - RNA, 16 nt, Human
cagcugcuuuguuacc

SEQ ID NO: 3201842 - RNA, 22 nt, Human
cagcugcuuuguuaccuuaaaa

SEQ ID NO: 3201843 - RNA, 19 nt, Human
cagcuggccgggagccuga

SEQ ID NO: 3201844 - RNA, 21 nt, Human
cagcugggguggggaccucag

SEQ ID NO: 3201845 - RNA, 22 nt, Human
cagcugggguggggaccucagg

SEQ ID NO: 3201846 - RNA, 23 nt, Human
cagcugggguggggaccucaggc

SEQ ID NO: 3201847 - RNA, 18 nt, Human
cagcugguugagguuuca

SEQ ID NO: 3201848 - RNA, 17 nt, Human
cagcuggguuggaaaac

SEQ ID NO: 3201849 - RNA, 16 nt, Human
cagcuggguuggaaaa

SEQ ID NO: 3201850 - RNA, 18 nt, Human
cagcugccugggaucccu

SEQ ID NO: 3201851 - RNA, 23 nt, Human
cagcugccugggaucccucaucc

SEQ ID NO: 3201852 - RNA, 20 nt, Human
cagcugaaauugaaaaguua

SEQ ID NO: 3201853 - RNA, 17 nt, Human
cagcugaaauugaaaag

SEQ ID NO: 3201854 - RNA, 16 nt, Human
cagcugaaauugaaaa

SEQ ID NO: 3201855 - RNA, 13 nt, Human
cagcugaaauuga

SEQ ID NO: 3201856 - RNA, 24 nt, Human
cagcugcgguccacccaggagccc

SEQ ID NO: 3201857 - RNA, 23 nt, Human
cagcugcgguccacccaggagcc

SEQ ID NO: 3201858 - RNA, 22 nt, Human
cagcugcgguccacccaggagc

SEQ ID NO: 3201859 - RNA, 21 nt, Human
cagcugcgguccacccaggag

SEQ ID NO: 3201860 - RNA, 20 nt, Human
cagcugcgguccacccagga

SEQ ID NO: 3201861 - RNA, 19 nt, Human
cagcugcgguccacccagg

SEQ ID NO: 3201862 - RNA, 15 nt, Human
cagcugccugggauc

SEQ ID NO: 3201863 - RNA, 18 nt, Human
cagcugcgguccacccag

SEQ ID NO: 3201864 - RNA, 21 nt, Human
cagcugcugaaacaacaaaua

SEQ ID NO: 3201865 - RNA, 20 nt, Human
cagcugcugaaacaacaaau

SEQ ID NO: 3201866 - RNA, 13 nt, Human
cagcugcugagcc

SEQ ID NO: 3201867 - RNA, 20 nt, Human
cagcugcugagccgcagaga

SEQ ID NO: 3201868 - RNA, 19 nt, Human
cagcugcugagccgcagag

SEQ ID NO: 3201869 - RNA, 18 nt, Human
cagcugcugagccgcaga

SEQ ID NO: 3201870 - RNA, 17 nt, Human
cagcugcugagccgcag

SEQ ID NO: 3201871 - RNA, 16 nt, Human
cagcugcugagccgca

SEQ ID NO: 3201872 - RNA, 14 nt, Human
cagcugcugagccg

SEQ ID NO: 3201873 - RNA, 17 nt, Human
cagcugcuacuacuccu

SEQ ID NO: 3201874 - RNA, 21 nt, Human
cagcugcucaauaaaguacaa

SEQ ID NO: 3201875 - RNA, 16 nt, Human
cagcugacuuucaaag

SEQ ID NO: 3201876 - RNA, 15 nt, Human
cagcugcucagaucc

SEQ ID NO: 3201877 - RNA, 13 nt, Human
cagcugcuugggc

SEQ ID NO: 3201878 - RNA, 14 nt, Human
cagcugcuugggcu

SEQ ID NO: 3201879 - RNA, 15 nt, Human
cagcugcuugggcuu

SEQ ID NO: 3201880 - RNA, 16 nt, Human
cagcugcuugggcuuc

SEQ ID NO: 3201881 - RNA, 18 nt, Human
cagcugcuugggcuucau

SEQ ID NO: 3201882 - RNA, 19 nt, Human
cagcugcuugggcuucauc

SEQ ID NO: 3201883 - RNA, 21 nt, Human
cagcugcuugggcuucauccu

SEQ ID NO: 3201884 - RNA, 22 nt, Human
cagcugcuugggcuucauccuc

SEQ ID NO: 3201885 - RNA, 15 nt, Human
cagcucucaugcugc

SEQ ID NO: 3201886 - RNA, 23 nt, Human
cagcucucaugcugccccugccu

SEQ ID NO: 3201887 - RNA, 19 nt, Human
cagcucucaugcugccccu

SEQ ID NO: 3201888 - RNA, 22 nt, Human
cagcucgcuggauggcggaagc

SEQ ID NO: 3201889 - RNA, 21 nt, Human
cagcuccuuuuccagagcauu

SEQ ID NO: 3201890 - RNA, 20 nt, Human
cagcuccuuuuccagagcau

SEQ ID NO: 3201891 - RNA, 16 nt, Human
cagcuccuuuuccaga

SEQ ID NO: 3201892 - RNA, 13 nt, Human
cagcuccuuuucc

SEQ ID NO: 3201893 - RNA, 20 nt, Human
cagcucugcauacucauuag

SEQ ID NO: 3201894 - RNA, 21 nt, Human
cagcucugcaagaauugaagc

SEQ ID NO: 3201895 - RNA, 15 nt, Human
cagcucugcaagaau

SEQ ID NO: 3201896 - RNA, 16 nt, Human
cagcucugcaagaauu

SEQ ID NO: 3201897 - RNA, 13 nt, Human
cagcucagagagg

SEQ ID NO: 3201898 - RNA, 17 nt, Human
cagcucagagagggugg

SEQ ID NO: 3201899 - RNA, 19 nt, Human
cagcucagagaggguggga

SEQ ID NO: 3201900 - RNA, 20 nt, Human
cagcucagagagggugggag

SEQ ID NO: 3201901 - RNA, 12 nt, Human
cagcucagugag

SEQ ID NO: 3201902 - RNA, 20 nt, Human
cagcuccuuccuagccuugc

SEQ ID NO: 3201903 - RNA, 15 nt, Human
cagcuccuuccuagc

SEQ ID NO: 3201904 - RNA, 23 nt, Human
cagcuccuucuguccuacucugu

SEQ ID NO: 3201905 - RNA, 21 nt, Human
cagcuccuucuguccuacucu

SEQ ID NO: 3201906 - RNA, 17 nt, Human
cagcuccuucuguccua

SEQ ID NO: 3201907 - RNA, 16 nt, Human
cagcuccuucuguccu

SEQ ID NO: 3201908 - RNA, 23 nt, Human
cagcucuucuccaggcuguaucc

SEQ ID NO: 3201909 - RNA, 23 nt, Human
cagcucuuccuggacaggccagg

SEQ ID NO: 3201910 - RNA, 13 nt, Human
cagcucuuccugg

SEQ ID NO: 3201911 - RNA, 12 nt, Human
cagcucuuccug

SEQ ID NO: 3201912 - RNA, 22 nt, Human
cagcucuuccuagcuggagagg

SEQ ID NO: 3201913 - RNA, 20 nt, Human
cagcucuuccuagcuggaga

SEQ ID NO: 3201914 - RNA, 19 nt, Human
cagcucuuccuagcuggag

SEQ ID NO: 3201915 - RNA, 13 nt, Human
cagcucuuccuag

SEQ ID NO: 3201916 - RNA, 19 nt, Human
cagcucuucuccaggcugu

SEQ ID NO: 3201917 - RNA, 18 nt, Human
cagcucuucuccaggcug

SEQ ID NO: 3201918 - RNA, 17 nt, Human
cagcucuucuccaggcu

SEQ ID NO: 3201919 - RNA, 16 nt, Human
cagcucuucuccaggc

SEQ ID NO: 3201920 - RNA, 15 nt, Human
cagcucuucuccagg

SEQ ID NO: 3201921 - RNA, 14 nt, Human
cagcucuucuccag

SEQ ID NO: 3201922 - RNA, 13 nt, Human
cagcucuucucca

SEQ ID NO: 3201923 - RNA, 10 nt, Human
cagcucuuau

SEQ ID NO: 3201924 - RNA, 21 nt, Human
cagcucuuauauugccauuuc

SEQ ID NO: 3201925 - RNA, 23 nt, Human
cagcucuguccugggagugagcu

SEQ ID NO: 3201926 - RNA, 18 nt, Human
cagcucuguccugggagu

SEQ ID NO: 3201927 - RNA, 17 nt, Human
cagcucuguccugggag

SEQ ID NO: 3201928 - RNA, 16 nt, Human
cagcucuguccuggga

SEQ ID NO: 3201929 - RNA, 14 nt, Human
cagcucuguccugg

SEQ ID NO: 3201930 - RNA, 22 nt, Human
cagcucugguccauagagagca

SEQ ID NO: 3201931 - RNA, 23 nt, Human
cagcucugguccauagagagcaa

SEQ ID NO: 3201932 - RNA, 13 nt, Human
cagcucuguccug

SEQ ID NO: 3201933 - RNA, 12 nt, Human
cagcucuguccu

SEQ ID NO: 3201934 - RNA, 16 nt, Human
cagcucugguccauag

SEQ ID NO: 3201935 - RNA, 17 nt, Human
cagcucugguccauaga

SEQ ID NO: 3201936 - RNA, 18 nt, Human
cagcucugguccauagag

SEQ ID NO: 3201937 - RNA, 21 nt, Human
cagcucugguccauagagagc

SEQ ID NO: 3201938 - RNA, 10 nt, Human
cagcucuggu

SEQ ID NO: 3201939 - RNA, 13 nt, Human
cagcucuggucca

SEQ ID NO: 3201940 - RNA, 18 nt, Human
cagcucuggcauggcuag

SEQ ID NO: 3201941 - RNA, 14 nt, Human
cagcucuggcaugg

SEQ ID NO: 3201942 - RNA, 20 nt, Human
cagccuggaaaccugucuga

SEQ ID NO: 3201943 - RNA, 19 nt, Human
cagccuggaaaccugucug

SEQ ID NO: 3201944 - RNA, 15 nt, Human
cagccuggacccugu

SEQ ID NO: 3201945 - RNA, 19 nt, Human
cagccuggacccuguggau

SEQ ID NO: 3201946 - RNA, 21 nt, Human
cagccuggcacagggcagugg

SEQ ID NO: 3201947 - RNA, 20 nt, Human
cagccuggcacagggcagug

SEQ ID NO: 3201948 - RNA, 13 nt, Human
cagccuggcacag

SEQ ID NO: 3201949 - RNA, 10 nt, Human
cagccuggca

SEQ ID NO: 3201950 - RNA, 14 nt, Human
cagccuggcuggga

SEQ ID NO: 3201951 - RNA, 13 nt, Human
cagccuggcuccc

SEQ ID NO: 3201952 - RNA, 15 nt, Human
cagccuggcuccccu

SEQ ID NO: 3201953 - RNA, 17 nt, Human
cagccuggcuccccugg

SEQ ID NO: 3201954 - RNA, 18 nt, Human
cagccuggcuccccuggg

SEQ ID NO: 3201955 - RNA, 19 nt, Human
cagccuggcuccccugggg

SEQ ID NO: 3201956 - RNA, 23 nt, Human
cagccucccgaguagcugggacu

SEQ ID NO: 3201957 - RNA, 22 nt, Human
cagccucccgaguagcugggac

SEQ ID NO: 3201958 - RNA, 16 nt, Human
cagccucccacagugc

SEQ ID NO: 3201959 - RNA, 21 nt, Human
cagccucccgaguagcuggga

SEQ ID NO: 3201960 - RNA, 20 nt, Human
cagccucccgaguagcuggg

SEQ ID NO: 3201961 - RNA, 19 nt, Human
cagccucccgaguagcugg

SEQ ID NO: 3201962 - RNA, 23 nt, Human
cagccucccgaauagcugggacu

SEQ ID NO: 3201963 - RNA, 20 nt, Human
cagccugcuccagcuguuca

SEQ ID NO: 3201964 - RNA, 19 nt, Human
cagccucgcaggccucccu

SEQ ID NO: 3201965 - RNA, 22 nt, Human
cagccucgcaggccucccugcc

SEQ ID NO: 3201966 - RNA, 21 nt, Human
cagccucgcaggccucccugc

SEQ ID NO: 3201967 - RNA, 15 nt, Human
cagccuccugaguag

SEQ ID NO: 3201968 - RNA, 21 nt, Human
cagccuccgcuucccugguuc

SEQ ID NO: 3201969 - RNA, 20 nt, Human
cagccuccgcuucccugguu

SEQ ID NO: 3201970 - RNA, 18 nt, Human
cagccuccgcuucccugg

SEQ ID NO: 3201971 - RNA, 16 nt, Human
cagccuccgcuucccu

SEQ ID NO: 3201972 - RNA, 14 nt, Human
cagccuuaauauuu

SEQ ID NO: 3201973 - RNA, 20 nt, Human
cagccuugaccauucuccac

SEQ ID NO: 3201974 - RNA, 21 nt, Human
cagccuugaccauucuccacc

SEQ ID NO: 3201975 - RNA, 17 nt, Human
cagccuugaccauucuc

SEQ ID NO: 3201976 - RNA, 22 nt, Human
cagccuugaccauucuccaccu

SEQ ID NO: 3201977 - RNA, 23 nt, Human
cagccuugaccauucuccaccug

SEQ ID NO: 3201978 - RNA, 24 nt, Human
cagccuugaccauucuccaccugc

SEQ ID NO: 3201979 - RNA, 14 nt, Human
cagccuggucgccu

SEQ ID NO: 3201980 - RNA, 23 nt, Human
cagccuggucgccuuccaccucu

SEQ ID NO: 3201981 - RNA, 19 nt, Human
cagccuggucgccuuccac

SEQ ID NO: 3201982 - RNA, 16 nt, Human
cagccugggcaaugug

SEQ ID NO: 3201983 - RNA, 19 nt, Human
cagccugggcaaugugaua

SEQ ID NO: 3201984 - RNA, 21 nt, Human
cagccugggauaggggcagag

SEQ ID NO: 3201985 - RNA, 20 nt, Human
cagccugggauaggggcaga

SEQ ID NO: 3201986 - RNA, 20 nt, Human
cagccuggcugggacuggga

SEQ ID NO: 3201987 - RNA, 19 nt, Human
cagcuacuugggaggcuga

SEQ ID NO: 3201988 - RNA, 16 nt, Human
cagcuaaugggacacu

SEQ ID NO: 3201989 - RNA, 15 nt, Human
cagcuaaugggacac

SEQ ID NO: 3201990 - RNA, 19 nt, Human
cagcuaaucagcauucuca

SEQ ID NO: 3201991 - RNA, 20 nt, Human
cagcuaacauggaaguacua

SEQ ID NO: 3201992 - RNA, 20 nt, Human
cagcgagcccugguggcagu

SEQ ID NO: 3201993 - RNA, 19 nt, Human
cagcgagcccugguggcag

SEQ ID NO: 3201994 - RNA, 17 nt, Human
cagcgagcccugguggc

SEQ ID NO: 3201995 - RNA, 16 nt, Human
cagcgagcccuggugg

SEQ ID NO: 3201996 - RNA, 13 nt, Human
cagcgagcccugg

SEQ ID NO: 3201997 - RNA, 19 nt, Human
cagcuaacauggaaguacu

SEQ ID NO: 3201998 - RNA, 18 nt, Human
cagcuaacauggaaguac

SEQ ID NO: 3201999 - RNA, 15 nt, Human
cagcgcacagcugcu

SEQ ID NO: 3202000 - RNA, 14 nt, Human
cagcgcacagcugc

SEQ ID NO: 3202001 - RNA, 13 nt, Human
cagcgcacagcug

SEQ ID NO: 3202002 - RNA, 21 nt, Human
cagcgagcccugguggcagug

SEQ ID NO: 3202003 - RNA, 12 nt, Human
cagcgagggccc

SEQ ID NO: 3202004 - RNA, 19 nt, Human
cagcucaccagccccagug

SEQ ID NO: 3202005 - RNA, 17 nt, Human
cagcucaccagccccag

SEQ ID NO: 3202006 - RNA, 16 nt, Human
cagcucaccagcccca

SEQ ID NO: 3202007 - RNA, 15 nt, Human
cagcucaccagcccc

SEQ ID NO: 3202008 - RNA, 13 nt, Human
cagcucaccagcc

SEQ ID NO: 3202009 - RNA, 17 nt, Human
cagcuaggaacaaaucu

SEQ ID NO: 3202010 - RNA, 21 nt, Human
cagcuaggaacaaaucuuccu

SEQ ID NO: 3202011 - RNA, 20 nt, Human
cagcuaggaacaaaucuucc

SEQ ID NO: 3202012 - RNA, 19 nt, Human
cagcuaggaacaaaucuuc

SEQ ID NO: 3202013 - RNA, 18 nt, Human
cagcuaggaacaaaucuu

SEQ ID NO: 3202014 - RNA, 13 nt, Human
cagcuaugcaaaa

SEQ ID NO: 3202015 - RNA, 14 nt, Human
cagcuaugagagga

SEQ ID NO: 3202016 - RNA, 13 nt, Human
cagcucaccucuc

SEQ ID NO: 3202017 - RNA, 15 nt, Human
cagcucaccucuccc

SEQ ID NO: 3202018 - RNA, 16 nt, Human
cagcucaccucucccu

SEQ ID NO: 3202019 - RNA, 17 nt, Human
cagcucaccucucccuu

SEQ ID NO: 3202020 - RNA, 21 nt, Human
cagcucaccagccccagugcc

SEQ ID NO: 3202021 - RNA, 20 nt, Human
cagcucaccagccccagugc

SEQ ID NO: 3202022 - RNA, 14 nt, Human
cagcucaccagccc

SEQ ID NO: 3202023 - RNA, 22 nt, Human
cagcucaccagccccagugccc

SEQ ID NO: 3202024 - RNA, 19 nt, Human
cagcucaccucucccuugg

SEQ ID NO: 3202025 - RNA, 20 nt, Human
cagcucaccucucccuugga

SEQ ID NO: 3202026 - RNA, 12 nt, Human
cagcucacugca

SEQ ID NO: 3202027 - RNA, 14 nt, Human
cagcucacugcaac

SEQ ID NO: 3202028 - RNA, 12 nt, Human
cagcucagagag

SEQ ID NO: 3202029 - RNA, 15 nt, Human
cagcucacugcaacc

SEQ ID NO: 3202030 - RNA, 21 nt, Human
cagcucacugcaaccuucgcc

SEQ ID NO: 3202031 - RNA, 13 nt, Human
cagcucagaacca

SEQ ID NO: 3202032 - RNA, 15 nt, Human
cagcucagaaccaca

SEQ ID NO: 3202033 - RNA, 17 nt, Human
cagcucagaaccacagc

SEQ ID NO: 3202034 - RNA, 14 nt, Human
cagccuccaugcug

SEQ ID NO: 3202035 - RNA, 18 nt, Human
cagccuccaugcugccuc

SEQ ID NO: 3202036 - RNA, 20 nt, Human
cagccuccaugcugccucca

SEQ ID NO: 3202037 - RNA, 17 nt, Human
cagccuccaugcugccu

SEQ ID NO: 3202038 - RNA, 15 nt, Human
cagccuccaugcugc

SEQ ID NO: 3202039 - RNA, 23 nt, Human
cagccucccaaagugcugggauu

SEQ ID NO: 3202040 - RNA, 21 nt, Human
cagccucccaaagugcuggga

SEQ ID NO: 3202041 - RNA, 20 nt, Human
cagccucccaaagugcuggg

SEQ ID NO: 3202042 - RNA, 19 nt, Human
cagccucccaaagugcugg

SEQ ID NO: 3202043 - RNA, 22 nt, Human
cagccucccgaauagcugggac

SEQ ID NO: 3202044 - RNA, 21 nt, Human
cagccucccgaauagcuggga

SEQ ID NO: 3202045 - RNA, 20 nt, Human
cagccucccgaauagcuggg

SEQ ID NO: 3202046 - RNA, 15 nt, Human
cagccucccacagug

SEQ ID NO: 3202047 - RNA, 13 nt, Human
cagccucccacag

SEQ ID NO: 3202048 - RNA, 17 nt, Human
cagccucaaauccagga

SEQ ID NO: 3202049 - RNA, 18 nt, Human
cagccucaaccuccuggg

SEQ ID NO: 3202050 - RNA, 17 nt, Human
cagccucaaccuccugg

SEQ ID NO: 3202051 - RNA, 21 nt, Human
cagccucaaccuccugggcua

SEQ ID NO: 3202052 - RNA, 21 nt, Human
cagccucaaauccaggacccu

SEQ ID NO: 3202053 - RNA, 20 nt, Human
cagccucaaauccaggaccc

SEQ ID NO: 3202054 - RNA, 19 nt, Human
cagccucaaauccaggacc

SEQ ID NO: 3202055 - RNA, 18 nt, Human
cagccucaaauccaggac

SEQ ID NO: 3202056 - RNA, 20 nt, Human
cagccucaaccuccugggcu

SEQ ID NO: 3202057 - RNA, 19 nt, Human
cagccucaaccuccugggc

SEQ ID NO: 3202058 - RNA, 14 nt, Human
cagccucacagucc

SEQ ID NO: 3202059 - RNA, 15 nt, Human
cagccucacaguccu

SEQ ID NO: 3202060 - RNA, 20 nt, Human
cagccucacaguccuuacca

SEQ ID NO: 3202061 - RNA, 20 nt, Human
cagccuccaagcuccaucuc

SEQ ID NO: 3202062 - RNA, 14 nt, Human
cagccuccaagcuc

SEQ ID NO: 3202063 - RNA, 21 nt, Human
cagcccugaguuccuagccac

SEQ ID NO: 3202064 - RNA, 19 nt, Human
cagcccugaguuccuagcc

SEQ ID NO: 3202065 - RNA, 18 nt, Human
cagcccugaguuccuagc

SEQ ID NO: 3202066 - RNA, 18 nt, Human
cagcccucggcgcuccgg

SEQ ID NO: 3202067 - RNA, 21 nt, Human
cagcccucggcgcuccgggac

SEQ ID NO: 3202068 - RNA, 22 nt, Human
cagcccucccugccccucccuu

SEQ ID NO: 3202069 - RNA, 18 nt, Human
cagcccucccugccccuc

SEQ ID NO: 3202070 - RNA, 17 nt, Human
cagcccucccugccccu

SEQ ID NO: 3202071 - RNA, 16 nt, Human
cagcccucccugcccc

SEQ ID NO: 3202072 - RNA, 18 nt, Human
cagcccugcagagggcac

SEQ ID NO: 3202073 - RNA, 20 nt, Human
cagcccugcagagggcacag

SEQ ID NO: 3202074 - RNA, 13 nt, Human
cagcccugcagag

SEQ ID NO: 3202075 - RNA, 14 nt, Human
cagcccugcagagg

SEQ ID NO: 3202076 - RNA, 15 nt, Human
cagcccugcagaggg

SEQ ID NO: 3202077 - RNA, 16 nt, Human
cagcccugcagagggc

SEQ ID NO: 3202078 - RNA, 21 nt, Human
cagccguguaaccauggaccc

SEQ ID NO: 3202079 - RNA, 14 nt, Human
cagccuaagagacu

SEQ ID NO: 3202080 - RNA, 20 nt, Human
cagccgugccuucagcucua

SEQ ID NO: 3202081 - RNA, 18 nt, Human
cagccgugccuucagcuc

SEQ ID NO: 3202082 - RNA, 16 nt, Human
cagccgugccuucagc

SEQ ID NO: 3202083 - RNA, 14 nt, Human
cagccgugccuuca

SEQ ID NO: 3202084 - RNA, 9 nt, Human
cagccgugc

SEQ ID NO: 3202085 - RNA, 12 nt, Human
cagcccuggccc

SEQ ID NO: 3202086 - RNA, 18 nt, Human
cagcccuggcccaucaug

SEQ ID NO: 3202087 - RNA, 20 nt, Human
cagcccugcuuugggcugcc

SEQ ID NO: 3202088 - RNA, 19 nt, Human
cagcccugcuuugggcugc

SEQ ID NO: 3202089 - RNA, 13 nt, Human
cagcccugcuuug

SEQ ID NO: 3202090 - RNA, 11 nt, Human
cagcccugcuu

SEQ ID NO: 3202091 - RNA, 22 nt, Human
cagcccugcuuugggcugcccu

SEQ ID NO: 3202092 - RNA, 21 nt, Human
cagcccugcuuugggcugccc

SEQ ID NO: 3202093 - RNA, 23 nt, Human
cagcccugcuuugggcugcccug

SEQ ID NO: 3202094 - RNA, 18 nt, Human
cagcccucauuggcucuu

SEQ ID NO: 3202095 - RNA, 22 nt, Human
cagcccuccaucuaaacugccc

SEQ ID NO: 3202096 - RNA, 15 nt, Human
cagcccucccugccc

SEQ ID NO: 3202097 - RNA, 13 nt, Human
cagcccucccugc

SEQ ID NO: 3202098 - RNA, 23 nt, Human
cagcccuccaucuaaacugcccc

SEQ ID NO: 3202099 - RNA, 17 nt, Human
cagcccgggcucugccu

SEQ ID NO: 3202100 - RNA, 18 nt, Human
cagcccgggcucugccuc

SEQ ID NO: 3202101 - RNA, 19 nt, Human
cagcccgggcucugccucc

SEQ ID NO: 3202102 - RNA, 20 nt, Human
cagcccgggcucugccuccc

SEQ ID NO: 3202103 - RNA, 21 nt, Human
cagcccgggcucugccuccca

SEQ ID NO: 3202104 - RNA, 22 nt, Human
cagcccgggcucugccucccau

SEQ ID NO: 3202105 - RNA, 22 nt, Human
cagcccgcaucagcugcucaga

SEQ ID NO: 3202106 - RNA, 21 nt, Human
cagcccgcaucagcugcucag

SEQ ID NO: 3202107 - RNA, 14 nt, Human
cagcccgcaucagc

SEQ ID NO: 3202108 - RNA, 24 nt, Human
cagcccgauccuccccuggacucc

SEQ ID NO: 3202109 - RNA, 23 nt, Human
cagcccgauccuccccuggacuc

SEQ ID NO: 3202110 - RNA, 22 nt, Human
cagcccgauccuccccuggacu

SEQ ID NO: 3202111 - RNA, 20 nt, Human
cagcccgauccuccccugga

SEQ ID NO: 3202112 - RNA, 19 nt, Human
cagcccgauccuccccugg

SEQ ID NO: 3202113 - RNA, 17 nt, Human
cagcccgauccuccccu

SEQ ID NO: 3202114 - RNA, 13 nt, Human
cagcccgggcucu

SEQ ID NO: 3202115 - RNA, 14 nt, Human
cagcccgggcucug

SEQ ID NO: 3202116 - RNA, 15 nt, Human
cagcccgggcucugc

SEQ ID NO: 3202117 - RNA, 16 nt, Human
cagcccgggcucugcc

SEQ ID NO: 3202118 - RNA, 16 nt, Human
cagccccuucugaccc

SEQ ID NO: 3202119 - RNA, 17 nt, Human
cagccccuucugaccca

SEQ ID NO: 3202120 - RNA, 19 nt, Human
cagccccuucugacccaug

SEQ ID NO: 3202121 - RNA, 21 nt, Human
cagccccuucugacccaugcu

SEQ ID NO: 3202122 - RNA, 22 nt, Human
cagccccuucugacccaugcug

SEQ ID NO: 3202123 - RNA, 23 nt, Human
cagccccuucugacccaugcugc

SEQ ID NO: 3202124 - RNA, 24 nt, Human
cagccccuucugacccaugcugcc

SEQ ID NO: 3202125 - RNA, 22 nt, Human
cagccccaucccaaacccuuca

SEQ ID NO: 3202126 - RNA, 12 nt, Human
cagccccauccu

SEQ ID NO: 3202127 - RNA, 13 nt, Human
cagccccauccuc

SEQ ID NO: 3202128 - RNA, 14 nt, Human
cagccccauccucu

SEQ ID NO: 3202129 - RNA, 16 nt, Human
cagccccauccucugu

SEQ ID NO: 3202130 - RNA, 22 nt, Human
cagccccauccucuguacagag

SEQ ID NO: 3202131 - RNA, 14 nt, Human
cagccccauucugc

SEQ ID NO: 3202132 - RNA, 13 nt, Human
cagccccauucug

SEQ ID NO: 3202133 - RNA, 23 nt, Human
cagccccuggaugcagccucaca

SEQ ID NO: 3202134 - RNA, 18 nt, Human
cagccccauucugccugc

SEQ ID NO: 3202135 - RNA, 17 nt, Human
cagccccauucugccug

SEQ ID NO: 3202136 - RNA, 16 nt, Human
cagccccauucugccu

SEQ ID NO: 3202137 - RNA, 20 nt, Human
cagccccuguucuggcagag

SEQ ID NO: 3202138 - RNA, 22 nt, Human
cagccccuggaugcagccucac

SEQ ID NO: 3202139 - RNA, 21 nt, Human
cagccccuguucuggcagagu

SEQ ID NO: 3202140 - RNA, 11 nt, Human
cagccccaucc

SEQ ID NO: 3202141 - RNA, 21 nt, Human
cagccccaucccaaacccuuc

SEQ ID NO: 3202142 - RNA, 18 nt, Human
cagccccagugcccacag

SEQ ID NO: 3202143 - RNA, 17 nt, Human
cagccccagugcccaca

SEQ ID NO: 3202144 - RNA, 16 nt, Human
cagccccagugcccac

SEQ ID NO: 3202145 - RNA, 15 nt, Human
cagccccagugccca

SEQ ID NO: 3202146 - RNA, 14 nt, Human
cagccccagugccc

SEQ ID NO: 3202147 - RNA, 13 nt, Human
cagccccagugcc

SEQ ID NO: 3202148 - RNA, 17 nt, Human
cagccccacccuguuuu

SEQ ID NO: 3202149 - RNA, 14 nt, Human
cagccccacccugu

SEQ ID NO: 3202150 - RNA, 17 nt, Human
caggcaugguggcccac

SEQ ID NO: 3202151 - RNA, 22 nt, Human
caggcaugucccaugugagcug

SEQ ID NO: 3202152 - RNA, 16 nt, Human
caggcaugggccacca

SEQ ID NO: 3202153 - RNA, 15 nt, Human
caggcaugggccacc

SEQ ID NO: 3202154 - RNA, 12 nt, Human
caggcaggucuu

SEQ ID NO: 3202155 - RNA, 19 nt, Human
caggcagguccaggguuug

SEQ ID NO: 3202156 - RNA, 15 nt, Human
caggcagguccaggg

SEQ ID NO: 3202157 - RNA, 14 nt, Human
caggcagguccagg

SEQ ID NO: 3202158 - RNA, 22 nt, Human
caggcaggucuugaacuccugg

SEQ ID NO: 3202159 - RNA, 13 nt, Human
caggcaggucuug

SEQ ID NO: 3202160 - RNA, 15 nt, Human
caggcaggugggaug

SEQ ID NO: 3202161 - RNA, 23 nt, Human
caggcaggucuugaacuccuggc

SEQ ID NO: 3202162 - RNA, 13 nt, Human
caggcauucccca

SEQ ID NO: 3202163 - RNA, 15 nt, Human
caggcauuccccagg

SEQ ID NO: 3202164 - RNA, 16 nt, Human
caggcauuccccagga

SEQ ID NO: 3202165 - RNA, 17 nt, Human
caggcauuccccaggag

SEQ ID NO: 3202166 - RNA, 20 nt, Human
caggcauguucucugaggac

SEQ ID NO: 3202167 - RNA, 19 nt, Human
caggcauguucucugagga

SEQ ID NO: 3202168 - RNA, 18 nt, Human
caggcauguucucugagg

SEQ ID NO: 3202169 - RNA, 15 nt, Human
caggcauguucucug

SEQ ID NO: 3202170 - RNA, 18 nt, Human
caggcauuccccaggagg

SEQ ID NO: 3202171 - RNA, 19 nt, Human
caggcauuccccaggaggc

SEQ ID NO: 3202172 - RNA, 20 nt, Human
caggcauuccccaggaggcc

SEQ ID NO: 3202173 - RNA, 21 nt, Human
caggcauuccccaggaggcca

SEQ ID NO: 3202174 - RNA, 22 nt, Human
caggcauuccccaggaggccag

SEQ ID NO: 3202175 - RNA, 23 nt, Human
caggcauuccccaggaggccagc

SEQ ID NO: 3202176 - RNA, 24 nt, Human
caggcauuccccaggaggccagcc

SEQ ID NO: 3202177 - RNA, 21 nt, Human
caggcauugccucggcuggcu

SEQ ID NO: 3202178 - RNA, 22 nt, Human
caggcauugccucggcuggcuc

SEQ ID NO: 3202179 - RNA, 21 nt, Human
caggcaaggggaaucuggagg

SEQ ID NO: 3202180 - RNA, 14 nt, Human
caggcagccaggcc

SEQ ID NO: 3202181 - RNA, 15 nt, Human
caggcagccaggcca

SEQ ID NO: 3202182 - RNA, 21 nt, Human
caggcaagcaccuccugccuc

SEQ ID NO: 3202183 - RNA, 16 nt, Human
caggcaagcaccuccu

SEQ ID NO: 3202184 - RNA, 15 nt, Human
caggcaagcaccucc

SEQ ID NO: 3202185 - RNA, 14 nt, Human
caggcaagcaccuc

SEQ ID NO: 3202186 - RNA, 16 nt, Human
caggcaaauaaaauuc

SEQ ID NO: 3202187 - RNA, 16 nt, Human
caggauuuuaaucuuu

SEQ ID NO: 3202188 - RNA, 23 nt, Human
caggcaaacauuuucucuuagaa

SEQ ID NO: 3202189 - RNA, 21 nt, Human
caggcaaacauuuucucuuag

SEQ ID NO: 3202190 - RNA, 20 nt, Human
caggauucuuccucccuccc

SEQ ID NO: 3202191 - RNA, 13 nt, Human
caggcagguccag

SEQ ID NO: 3202192 - RNA, 17 nt, Human
caggcaggggcccugca

SEQ ID NO: 3202193 - RNA, 16 nt, Human
caggcaggggcccugc

SEQ ID NO: 3202194 - RNA, 22 nt, Human
caggcaggggcccugcagcucu

SEQ ID NO: 3202195 - RNA, 21 nt, Human
caggcaggggcccugcagcuc

SEQ ID NO: 3202196 - RNA, 20 nt, Human
caggcaggggcccugcagcu

SEQ ID NO: 3202197 - RNA, 18 nt, Human
caggcaggggcccugcag

SEQ ID NO: 3202198 - RNA, 23 nt, Human
caggcaggggcccugcagcucuc

SEQ ID NO: 3202199 - RNA, 14 nt, Human
caggcagggcagga

SEQ ID NO: 3202200 - RNA, 12 nt, Human
caggcagggcag

SEQ ID NO: 3202201 - RNA, 22 nt, Human
caggcagggcaggaccagccca

SEQ ID NO: 3202202 - RNA, 18 nt, Human
caggcagggcaggaccag

SEQ ID NO: 3202203 - RNA, 17 nt, Human
caggcagggcaggacca

SEQ ID NO: 3202204 - RNA, 16 nt, Human
caggcagggcaggacc

SEQ ID NO: 3202205 - RNA, 16 nt, Human
caggcagccaggccac

SEQ ID NO: 3202206 - RNA, 17 nt, Human
caggcagccaggccaca

SEQ ID NO: 3202207 - RNA, 20 nt, Human
caggcaggaaggcugagagg

SEQ ID NO: 3202208 - RNA, 22 nt, Human
caggcagcugucacugcugcuu

SEQ ID NO: 3202209 - RNA, 23 nt, Human
caggauggccgggcgcgguggcu

SEQ ID NO: 3202210 - RNA, 18 nt, Human
caggauucuuccucccuc

SEQ ID NO: 3202211 - RNA, 17 nt, Human
caggauucuuccucccu

SEQ ID NO: 3202212 - RNA, 22 nt, Human
caggauucucaccagcuguguc

SEQ ID NO: 3202213 - RNA, 19 nt, Human
caggauucucaccagcugu

SEQ ID NO: 3202214 - RNA, 19 nt, Human
caggauguacaaggacagc

SEQ ID NO: 3202215 - RNA, 21 nt, Human
caggauguggcuuaugagaua

SEQ ID NO: 3202216 - RNA, 13 nt, Human
caggaucagucug

SEQ ID NO: 3202217 - RNA, 17 nt, Human
caggauauauuuuauuu

SEQ ID NO: 3202218 - RNA, 16 nt, Human
caggauauauuuuauu

SEQ ID NO: 3202219 - RNA, 14 nt, Human
caggaucagucuga

SEQ ID NO: 3202220 - RNA, 21 nt, Human
caggccagggggccagucccu

SEQ ID NO: 3202221 - RNA, 20 nt, Human
caggccaggcccucugccca

SEQ ID NO: 3202222 - RNA, 18 nt, Human
caggccauuccccgucuc

SEQ ID NO: 3202223 - RNA, 21 nt, Human
caggccaggcccucugcccac

SEQ ID NO: 3202224 - RNA, 22 nt, Human
caggccaggcccucugcccacu

SEQ ID NO: 3202225 - RNA, 20 nt, Human
caggccacaagacccuugug

SEQ ID NO: 3202226 - RNA, 17 nt, Human
caggccacaagacccuu

SEQ ID NO: 3202227 - RNA, 18 nt, Human
caggccacaagacccuug

SEQ ID NO: 3202228 - RNA, 13 nt, Human
caggccacaagac

SEQ ID NO: 3202229 - RNA, 18 nt, Human
caggccaaacucaccugc

SEQ ID NO: 3202230 - RNA, 16 nt, Human
caggcauuuucccccu

SEQ ID NO: 3202231 - RNA, 23 nt, Human
caggccaaacucaccugccccuc

SEQ ID NO: 3202232 - RNA, 21 nt, Human
caggcccccagaaccccuggc

SEQ ID NO: 3202233 - RNA, 19 nt, Human
caggcccccaggugccagu

SEQ ID NO: 3202234 - RNA, 14 nt, Human
caggcccccaggug

SEQ ID NO: 3202235 - RNA, 20 nt, Human
caggcccccaggugccaguu

SEQ ID NO: 3202236 - RNA, 14 nt, Human
caggccccccuguc

SEQ ID NO: 3202237 - RNA, 13 nt, Human
caggccccugcca

SEQ ID NO: 3202238 - RNA, 24 nt, Human
caggcccacccugcuuggcccagg

SEQ ID NO: 3202239 - RNA, 23 nt, Human
caggcccacccugcuuggcccag

SEQ ID NO: 3202240 - RNA, 15 nt, Human
caggcccacccugcu

SEQ ID NO: 3202241 - RNA, 14 nt, Human
caggcccacccugc

SEQ ID NO: 3202242 - RNA, 21 nt, Human
caggccauuccccgucucugg

SEQ ID NO: 3202243 - RNA, 15 nt, Human
caggccauuuuuggu

SEQ ID NO: 3202244 - RNA, 13 nt, Human
caggcccacccug

SEQ ID NO: 3202245 - RNA, 22 nt, Human
caggcccaugggaggcuggagu

SEQ ID NO: 3202246 - RNA, 21 nt, Human
caggcccaugggaggcuggag

SEQ ID NO: 3202247 - RNA, 20 nt, Human
caggccccugccacccuggg

SEQ ID NO: 3202248 - RNA, 19 nt, Human
caggccccugccacccugg

SEQ ID NO: 3202249 - RNA, 17 nt, Human
caggccccugccacccu

SEQ ID NO: 3202250 - RNA, 15 nt, Human
caggccccugccacc

SEQ ID NO: 3202251 - RNA, 15 nt, Human
caggcccggcuccag

SEQ ID NO: 3202252 - RNA, 14 nt, Human
caggcccggcucca

SEQ ID NO: 3202253 - RNA, 13 nt, Human
caggcccggcucc

SEQ ID NO: 3202254 - RNA, 17 nt, Human
caggccccucccucucc

SEQ ID NO: 3202255 - RNA, 14 nt, Human
caggccccucccuc

SEQ ID NO: 3202256 - RNA, 23 nt, Human
caggagccccgaggccuucucug

SEQ ID NO: 3202257 - RNA, 22 nt, Human
caggagccccgaggccuucucu

SEQ ID NO: 3202258 - RNA, 20 nt, Human
caggagccccgaggccuucu

SEQ ID NO: 3202259 - RNA, 12 nt, Human
caggagcagcca

SEQ ID NO: 3202260 - RNA, 13 nt, Human
caggagcagccac

SEQ ID NO: 3202261 - RNA, 14 nt, Human
caggagcagccaca

SEQ ID NO: 3202262 - RNA, 19 nt, Human
caggagcagccacauuccu

SEQ ID NO: 3202263 - RNA, 18 nt, Human
caggagccccgaggccuu

SEQ ID NO: 3202264 - RNA, 16 nt, Human
caggagccccgaggcc

SEQ ID NO: 3202265 - RNA, 15 nt, Human
caggagccccgaggc

SEQ ID NO: 3202266 - RNA, 20 nt, Human
caggagcaguaucaugaagc

SEQ ID NO: 3202267 - RNA, 16 nt, Human
caggagcaguaucaug

SEQ ID NO: 3202268 - RNA, 11 nt, Human
caggagcccau

SEQ ID NO: 3202269 - RNA, 23 nt, Human
caggagcccauuuggagggccug

SEQ ID NO: 3202270 - RNA, 12 nt, Human
caggagcccauu

SEQ ID NO: 3202271 - RNA, 14 nt, Human
caggagccuccugc

SEQ ID NO: 3202272 - RNA, 17 nt, Human
caggagccuccugcccu

SEQ ID NO: 3202273 - RNA, 20 nt, Human
caggagccuccugcccuuac

SEQ ID NO: 3202274 - RNA, 16 nt, Human
caggagccugcccagc

SEQ ID NO: 3202275 - RNA, 22 nt, Human
caggagcgcucccuugaccugc

SEQ ID NO: 3202276 - RNA, 16 nt, Human
caggagcgcucccuug

SEQ ID NO: 3202277 - RNA, 15 nt, Human
caggagucccugcca

SEQ ID NO: 3202278 - RNA, 21 nt, Human
caggagucccugccaucaugu

SEQ ID NO: 3202279 - RNA, 14 nt, Human
caggagucccugcc

SEQ ID NO: 3202280 - RNA, 12 nt, Human
caggagugagca

SEQ ID NO: 3202281 - RNA, 23 nt, Human
caggaguagugaagacuccagaa

SEQ ID NO: 3202282 - RNA, 22 nt, Human
caggaguagugaagacuccaga

SEQ ID NO: 3202283 - RNA, 15 nt, Human
caggaguagugaaga

SEQ ID NO: 3202284 - RNA, 20 nt, Human
caggaguaaaagagucaagu

SEQ ID NO: 3202285 - RNA, 19 nt, Human
caggagcuccauacacacg

SEQ ID NO: 3202286 - RNA, 21 nt, Human
caggagacuguggagacugcu

SEQ ID NO: 3202287 - RNA, 20 nt, Human
caggagagauuauuuacaag

SEQ ID NO: 3202288 - RNA, 12 nt, Human
caggagaagaaa

SEQ ID NO: 3202289 - RNA, 19 nt, Human
caggagaagaaagaacuau

SEQ ID NO: 3202290 - RNA, 16 nt, Human
caggagaagaaagaac

SEQ ID NO: 3202291 - RNA, 18 nt, Human
caggagaggauggcccag

SEQ ID NO: 3202292 - RNA, 15 nt, Human
caggagagcuuaggg

SEQ ID NO: 3202293 - RNA, 16 nt, Human
caggagagcuuagggu

SEQ ID NO: 3202294 - RNA, 18 nt, Human
caggagagcuuagggucu

SEQ ID NO: 3202295 - RNA, 22 nt, Human
caggagagcuuagggucucagg

SEQ ID NO: 3202296 - RNA, 17 nt, Human
caggagaugcugugccc

SEQ ID NO: 3202297 - RNA, 16 nt, Human
caggagaugcugugcc

SEQ ID NO: 3202298 - RNA, 23 nt, Human
caggagaugcugugccccuggcc

SEQ ID NO: 3202299 - RNA, 19 nt, Human
caggagaugcugugccccu

SEQ ID NO: 3202300 - RNA, 16 nt, Human
caggacucugccuccu

SEQ ID NO: 3202301 - RNA, 15 nt, Human
caggacucugccucc

SEQ ID NO: 3202302 - RNA, 13 nt, Human
caggacucugccu

SEQ ID NO: 3202303 - RNA, 12 nt, Human
caggacucugcc

SEQ ID NO: 3202304 - RNA, 21 nt, Human
caggaguuugagaccaaccug

SEQ ID NO: 3202305 - RNA, 16 nt, Human
caggaguuggaagugu

SEQ ID NO: 3202306 - RNA, 13 nt, Human
caggauagacuuu

SEQ ID NO: 3202307 - RNA, 22 nt, Human
caggaguuugagaccaaccugg

SEQ ID NO: 3202308 - RNA, 23 nt, Human
caggaguuugagaccaaccuggg

SEQ ID NO: 3202309 - RNA, 15 nt, Human
cagggaaggggacaa

SEQ ID NO: 3202310 - RNA, 17 nt, Human
cagggaaggggacaagg

SEQ ID NO: 3202311 - RNA, 14 nt, Human
cagggacagagggg

SEQ ID NO: 3202312 - RNA, 20 nt, Human
cagggacagaggggguggcc

SEQ ID NO: 3202313 - RNA, 13 nt, Human
cagggacagaggg

SEQ ID NO: 3202314 - RNA, 19 nt, Human
cagggaagauaaguuggaa

SEQ ID NO: 3202315 - RNA, 16 nt, Human
cagggaagccuugugg

SEQ ID NO: 3202316 - RNA, 13 nt, Human
cagggaaagacug

SEQ ID NO: 3202317 - RNA, 19 nt, Human
cagggaacuaggaaggcac

SEQ ID NO: 3202318 - RNA, 22 nt, Human
cagggaaacagcuaaugggaca

SEQ ID NO: 3202319 - RNA, 16 nt, Human
cagggaaacagcuaau

SEQ ID NO: 3202320 - RNA, 22 nt, Human
cagggggccagucccugaggca

SEQ ID NO: 3202321 - RNA, 13 nt, Human
cagggggcuuccu

SEQ ID NO: 3202322 - RNA, 12 nt, Human
cagggggcuucc

SEQ ID NO: 3202323 - RNA, 22 nt, Human
cagggggcuuccugaggggaga

SEQ ID NO: 3202324 - RNA, 15 nt, Human
cagggggcuuccuga

SEQ ID NO: 3202325 - RNA, 14 nt, Human
caggggcaggagga

SEQ ID NO: 3202326 - RNA, 19 nt, Human
caggggaggguagagcgga

SEQ ID NO: 3202327 - RNA, 21 nt, Human
caggggaggccaucuggagag

SEQ ID NO: 3202328 - RNA, 17 nt, Human
caggggaggccaucugg

SEQ ID NO: 3202329 - RNA, 16 nt, Human
caggggaggccaucug

SEQ ID NO: 3202330 - RNA, 17 nt, Human
caggggagggggcaaag

SEQ ID NO: 3202331 - RNA, 15 nt, Human
caggggcccugcagc

SEQ ID NO: 3202332 - RNA, 19 nt, Human
caggggcccugcagcucuc

SEQ ID NO: 3202333 - RNA, 18 nt, Human
caggggcccugcagcucu

SEQ ID NO: 3202334 - RNA, 17 nt, Human
caggggcccugcagcuc

SEQ ID NO: 3202335 - RNA, 16 nt, Human
caggggcccugcagcu

SEQ ID NO: 3202336 - RNA, 17 nt, Human
caggggcuccaugccag

SEQ ID NO: 3202337 - RNA, 18 nt, Human
caggggcuccaugccagc

SEQ ID NO: 3202338 - RNA, 22 nt, Human
caggggccuuugggugcuguuu

SEQ ID NO: 3202339 - RNA, 18 nt, Human
caggggacacccagaaac

SEQ ID NO: 3202340 - RNA, 16 nt, Human
caggggaccuccuggg

SEQ ID NO: 3202341 - RNA, 16 nt, Human
caggggagauccuugu

SEQ ID NO: 3202342 - RNA, 14 nt, Human
caggggaggccauc

SEQ ID NO: 3202343 - RNA, 14 nt, Human
cagggccuggcuca

SEQ ID NO: 3202344 - RNA, 15 nt, Human
cagggccuggcucag

SEQ ID NO: 3202345 - RNA, 13 nt, Human
cagggccuggcuc

SEQ ID NO: 3202346 - RNA, 14 nt, Human
cagggccuggccca

SEQ ID NO: 3202347 - RNA, 13 nt, Human
cagggccuggccc

SEQ ID NO: 3202348 - RNA, 12 nt, Human
cagggccuggcc

SEQ ID NO: 3202349 - RNA, 11 nt, Human
cagggccuggc

SEQ ID NO: 3202350 - RNA, 16 nt, Human
cagggccuggcucagg

SEQ ID NO: 3202351 - RNA, 19 nt, Human
cagggccuggcucaggugg

SEQ ID NO: 3202352 - RNA, 18 nt, Human
cagggccuggcccaugua

SEQ ID NO: 3202353 - RNA, 17 nt, Human
cagggccuggcccaugu

SEQ ID NO: 3202354 - RNA, 16 nt, Human
cagggccuggcccaug

SEQ ID NO: 3202355 - RNA, 15 nt, Human
cagggccuggcccau

SEQ ID NO: 3202356 - RNA, 21 nt, Human
cagggcccccagcgagagucc

SEQ ID NO: 3202357 - RNA, 19 nt, Human
cagggcccgggaagcaaau

SEQ ID NO: 3202358 - RNA, 20 nt, Human
cagggcccgggaagcaaaug

SEQ ID NO: 3202359 - RNA, 19 nt, Human
cagggccgauggggcaguc

SEQ ID NO: 3202360 - RNA, 21 nt, Human
cagggccggucgggggggacc

SEQ ID NO: 3202361 - RNA, 17 nt, Human
cagggcauggcugggaa

SEQ ID NO: 3202362 - RNA, 20 nt, Human
cagggcauggccagguggcc

SEQ ID NO: 3202363 - RNA, 14 nt, Human
cagggcaugaaaug

SEQ ID NO: 3202364 - RNA, 24 nt, Human
cagggcaugaaaugaacacaaauu

SEQ ID NO: 3202365 - RNA, 23 nt, Human
cagggcaugaaaugaacacaaau

SEQ ID NO: 3202366 - RNA, 15 nt, Human
cagggcaugaaauga

SEQ ID NO: 3202367 - RNA, 22 nt, Human
cagggcaggaccagcccacgcu

SEQ ID NO: 3202368 - RNA, 16 nt, Human
cagggcaggaccagcc

SEQ ID NO: 3202369 - RNA, 13 nt, Human
cagggcaggacca

SEQ ID NO: 3202370 - RNA, 20 nt, Human
cagggcaggaccagcccacg

SEQ ID NO: 3202371 - RNA, 19 nt, Human
cagggcaggaccagcccac

SEQ ID NO: 3202372 - RNA, 18 nt, Human
cagggcaggaccagccca

SEQ ID NO: 3202373 - RNA, 17 nt, Human
cagggcaggaccagccc

SEQ ID NO: 3202374 - RNA, 19 nt, Human
cagggccagaaguagcuuu

SEQ ID NO: 3202375 - RNA, 19 nt, Human
cagggccaaaagcuucccu

SEQ ID NO: 3202376 - RNA, 15 nt, Human
cagggaccccagaau

SEQ ID NO: 3202377 - RNA, 14 nt, Human
cagggaccccagaa

SEQ ID NO: 3202378 - RNA, 18 nt, Human
cagggacaggauaagagg

SEQ ID NO: 3202379 - RNA, 23 nt, Human
cagggacagaggggguggccucc

SEQ ID NO: 3202380 - RNA, 14 nt, Human
cagggcacaccggg

SEQ ID NO: 3202381 - RNA, 22 nt, Human
cagggcaauaaaaugaccaugg

SEQ ID NO: 3202382 - RNA, 22 nt, Human
cagggauugauuuuaaaaugua

SEQ ID NO: 3202383 - RNA, 21 nt, Human
cagggauugauuuuaaaaugu

SEQ ID NO: 3202384 - RNA, 20 nt, Human
cagggauugauuuuaaaaug

SEQ ID NO: 3202385 - RNA, 18 nt, Human
cagggauugauuuuaaaa

SEQ ID NO: 3202386 - RNA, 16 nt, Human
cagggauugauuuuaa

SEQ ID NO: 3202387 - RNA, 21 nt, Human
cagggcacaccgggcacucag

SEQ ID NO: 3202388 - RNA, 19 nt, Human
cagggcacaccgggcacuc

SEQ ID NO: 3202389 - RNA, 17 nt, Human
cagggcacaccgggcac

SEQ ID NO: 3202390 - RNA, 15 nt, Human
cagggcacaccgggc

SEQ ID NO: 3202391 - RNA, 23 nt, Human
cagggcacaccgggcacucagaa

SEQ ID NO: 3202392 - RNA, 22 nt, Human
cagggcacaccgggcacucaga

SEQ ID NO: 3202393 - RNA, 16 nt, Human
cagggcacagggccug

SEQ ID NO: 3202394 - RNA, 15 nt, Human
cagggcacagggccu

SEQ ID NO: 3202395 - RNA, 14 nt, Human
cagggcacagggcc

SEQ ID NO: 3202396 - RNA, 12 nt, Human
cagggcacaggg

SEQ ID NO: 3202397 - RNA, 22 nt, Human
cagggcagauuuuaguuuuauu

SEQ ID NO: 3202398 - RNA, 22 nt, Human
cagggcacagggccuggcccau

SEQ ID NO: 3202399 - RNA, 21 nt, Human
cagggcacagggccuggccca

SEQ ID NO: 3202400 - RNA, 20 nt, Human
cagggcacagggccuggccc

SEQ ID NO: 3202401 - RNA, 19 nt, Human
cagggcacagggccuggcc

SEQ ID NO: 3202402 - RNA, 18 nt, Human
cagggcacagggccuggc

SEQ ID NO: 3202403 - RNA, 17 nt, Human
cagggcacagggccugg

SEQ ID NO: 3202404 - RNA, 12 nt, Human
cagggcacgugg

SEQ ID NO: 3202405 - RNA, 18 nt, Human
caggcuuucuagaaagaa

SEQ ID NO: 3202406 - RNA, 13 nt, Human
caggcuuucuaga

SEQ ID NO: 3202407 - RNA, 22 nt, Human
caggcuuagucacugagacagc

SEQ ID NO: 3202408 - RNA, 23 nt, Human
caggcuuagucacugagacagcc

SEQ ID NO: 3202409 - RNA, 16 nt, Human
caggcuuagucacuga

SEQ ID NO: 3202410 - RNA, 17 nt, Human
caggcuuagucacugag

SEQ ID NO: 3202411 - RNA, 20 nt, Human
caggcuuagucacugagaca

SEQ ID NO: 3202412 - RNA, 21 nt, Human
caggcuuagucacugagacag

SEQ ID NO: 3202413 - RNA, 23 nt, Human
caggcuguaucccaugagccuca

SEQ ID NO: 3202414 - RNA, 22 nt, Human
caggcuguaucccaugagccuc

SEQ ID NO: 3202415 - RNA, 14 nt, Human
caggcugugaguuu

SEQ ID NO: 3202416 - RNA, 21 nt, Human
caggcuguaucccaugagccu

SEQ ID NO: 3202417 - RNA, 20 nt, Human
caggcuguaucccaugagcc

SEQ ID NO: 3202418 - RNA, 14 nt, Human
caggcuguauccca

SEQ ID NO: 3202419 - RNA, 23 nt, Human
caggcuggucucgaacuccugac

SEQ ID NO: 3202420 - RNA, 19 nt, Human
caggcuggucucaaacucu

SEQ ID NO: 3202421 - RNA, 20 nt, Human
caggcuggucucgaacuccu

SEQ ID NO: 3202422 - RNA, 22 nt, Human
caggcuggucucgaacuccuga

SEQ ID NO: 3202423 - RNA, 12 nt, Human
caggcuggucuc

SEQ ID NO: 3202424 - RNA, 23 nt, Human
caggcugggcuucaguggcagcu

SEQ ID NO: 3202425 - RNA, 12 nt, Human
caggcuggcccu

SEQ ID NO: 3202426 - RNA, 14 nt, Human
caggcuggcccugc

SEQ ID NO: 3202427 - RNA, 15 nt, Human
caggcuggcccugcc

SEQ ID NO: 3202428 - RNA, 16 nt, Human
caggcuggcccugccc

SEQ ID NO: 3202429 - RNA, 12 nt, Human
caggcugcucuu

SEQ ID NO: 3202430 - RNA, 20 nt, Human
caggcugcucuugaacuccu

SEQ ID NO: 3202431 - RNA, 22 nt, Human
caggcugcucucaaaccccuga

SEQ ID NO: 3202432 - RNA, 15 nt, Human
caggcugcucucaaa

SEQ ID NO: 3202433 - RNA, 23 nt, Human
caggcugcucuugaacuccugac

SEQ ID NO: 3202434 - RNA, 12 nt, Human
caggcugagccu

SEQ ID NO: 3202435 - RNA, 22 nt, Human
caggcucuucuccuuucacaac

SEQ ID NO: 3202436 - RNA, 18 nt, Human
caggcucuucuccuuuca

SEQ ID NO: 3202437 - RNA, 12 nt, Human
caggcucuucuc

SEQ ID NO: 3202438 - RNA, 15 nt, Human
caggcucuucuccuu

SEQ ID NO: 3202439 - RNA, 14 nt, Human
caggcucuucuccu

SEQ ID NO: 3202440 - RNA, 23 nt, Human
caggcugagugcaggcccacccu

SEQ ID NO: 3202441 - RNA, 22 nt, Human
caggcugagugcaggcccaccc

SEQ ID NO: 3202442 - RNA, 21 nt, Human
caggcugagugcaggcccacc

SEQ ID NO: 3202443 - RNA, 20 nt, Human
caggcugagugcaggcccac

SEQ ID NO: 3202444 - RNA, 19 nt, Human
caggcugagugcaggccca

SEQ ID NO: 3202445 - RNA, 18 nt, Human
caggcugagugcaggccc

SEQ ID NO: 3202446 - RNA, 13 nt, Human
caggcugagccuc

SEQ ID NO: 3202447 - RNA, 14 nt, Human
caggcugagccuca

SEQ ID NO: 3202448 - RNA, 15 nt, Human
caggcugagccucag

SEQ ID NO: 3202449 - RNA, 16 nt, Human
caggcugagccucagu

SEQ ID NO: 3202450 - RNA, 17 nt, Human
caggcugagccucaguc

SEQ ID NO: 3202451 - RNA, 21 nt, Human
caggcugagccucagucuccc

SEQ ID NO: 3202452 - RNA, 15 nt, Human
caggcugagugcagg

SEQ ID NO: 3202453 - RNA, 17 nt, Human
caggcugagugcaggcc

SEQ ID NO: 3202454 - RNA, 16 nt, Human
caggcugagugcaggc

SEQ ID NO: 3202455 - RNA, 13 nt, Human
caggcugagcuga

SEQ ID NO: 3202456 - RNA, 14 nt, Human
caggcugagugcag

SEQ ID NO: 3202457 - RNA, 14 nt, Human
caggcuacugucag

SEQ ID NO: 3202458 - RNA, 20 nt, Human
caggcuccuuuagcgcccag

SEQ ID NO: 3202459 - RNA, 19 nt, Human
caggcuccuuuagcgccca

SEQ ID NO: 3202460 - RNA, 14 nt, Human
caggcuccuuuagc

SEQ ID NO: 3202461 - RNA, 18 nt, Human
caggcuccugccaccacg

SEQ ID NO: 3202462 - RNA, 13 nt, Human
caggcuccugcca

SEQ ID NO: 3202463 - RNA, 14 nt, Human
caggcuccugccac

SEQ ID NO: 3202464 - RNA, 15 nt, Human
caggcuccugccacc

SEQ ID NO: 3202465 - RNA, 16 nt, Human
caggcuccugccacca

SEQ ID NO: 3202466 - RNA, 23 nt, Human
caggcucccaggagccugcccag

SEQ ID NO: 3202467 - RNA, 24 nt, Human
caggcucccaggagccugcccagc

SEQ ID NO: 3202468 - RNA, 15 nt, Human
caggcucccaggagc

SEQ ID NO: 3202469 - RNA, 22 nt, Human
caggcucccaggagccugccca

SEQ ID NO: 3202470 - RNA, 13 nt, Human
caggcucucaggc

SEQ ID NO: 3202471 - RNA, 14 nt, Human
caggcucucaggcc

SEQ ID NO: 3202472 - RNA, 15 nt, Human
caggcucucaggcca

SEQ ID NO: 3202473 - RNA, 16 nt, Human
caggcucucaggccag

SEQ ID NO: 3202474 - RNA, 20 nt, Human
caggcucgggcuccccagcc

SEQ ID NO: 3202475 - RNA, 12 nt, Human
caggcucucagg

SEQ ID NO: 3202476 - RNA, 21 nt, Human
caggcuccuuuagcgcccagu

SEQ ID NO: 3202477 - RNA, 17 nt, Human
caggcucucaggccagc

SEQ ID NO: 3202478 - RNA, 18 nt, Human
caggcucucaggccagcu

SEQ ID NO: 3202479 - RNA, 19 nt, Human
caggcucucaggccagcug

SEQ ID NO: 3202480 - RNA, 20 nt, Human
caggcucucaggccagcugc

SEQ ID NO: 3202481 - RNA, 21 nt, Human
caggcucucaggccagcugcu

SEQ ID NO: 3202482 - RNA, 23 nt, Human
caggcucucaggccagcugcuug

SEQ ID NO: 3202483 - RNA, 15 nt, Human
caggcucucugggcu

SEQ ID NO: 3202484 - RNA, 16 nt, Human
caggcucucugggcug

SEQ ID NO: 3202485 - RNA, 19 nt, Human
caggcccggcuccaggcuc

SEQ ID NO: 3202486 - RNA, 18 nt, Human
caggcccggcuccaggcu

SEQ ID NO: 3202487 - RNA, 16 nt, Human
caggcccggcuccagg

SEQ ID NO: 3202488 - RNA, 17 nt, Human
caggcccggcuccaggc

SEQ ID NO: 3202489 - RNA, 13 nt, Human
caggcccucugcc

SEQ ID NO: 3202490 - RNA, 11 nt, Human
caggcccuccu

SEQ ID NO: 3202491 - RNA, 14 nt, Human
caggcccucugccc

SEQ ID NO: 3202492 - RNA, 15 nt, Human
caggcccucugccca

SEQ ID NO: 3202493 - RNA, 21 nt, Human
caggcccggcuccaggcuccu

SEQ ID NO: 3202494 - RNA, 20 nt, Human
caggcccggcuccaggcucc

SEQ ID NO: 3202495 - RNA, 22 nt, Human
caggcccggcuccaggcuccuu

SEQ ID NO: 3202496 - RNA, 18 nt, Human
caggcccgaaagaggcac

SEQ ID NO: 3202497 - RNA, 23 nt, Human
caggccccucccucuccagcagg

SEQ ID NO: 3202498 - RNA, 16 nt, Human
caggcccucugcccac

SEQ ID NO: 3202499 - RNA, 17 nt, Human
caggcccucugcccacu

SEQ ID NO: 3202500 - RNA, 19 nt, Human
caggcccucugcccacucc

SEQ ID NO: 3202501 - RNA, 20 nt, Human
caggcccucugcccacuccc

SEQ ID NO: 3202502 - RNA, 21 nt, Human
caggcccucugcccacucccu

SEQ ID NO: 3202503 - RNA, 22 nt, Human
caggcccucugcccacucccug

SEQ ID NO: 3202504 - RNA, 23 nt, Human
caggcccuccucccucccagcuc

SEQ ID NO: 3202505 - RNA, 20 nt, Human
caggcccuccucccucccag

SEQ ID NO: 3202506 - RNA, 18 nt, Human
caggcccuccucccuccc

SEQ ID NO: 3202507 - RNA, 23 nt, Human
caggcccuuccucuccacugccu

SEQ ID NO: 3202508 - RNA, 21 nt, Human
caggcccuuccucuccacugc

SEQ ID NO: 3202509 - RNA, 20 nt, Human
caggcccuuccucuccacug

SEQ ID NO: 3202510 - RNA, 19 nt, Human
caggcccuuccucuccacu

SEQ ID NO: 3202511 - RNA, 17 nt, Human
caggcccuuccucucca

SEQ ID NO: 3202512 - RNA, 16 nt, Human
caggcccuuccucucc

SEQ ID NO: 3202513 - RNA, 15 nt, Human
caggcccuuccucuc

SEQ ID NO: 3202514 - RNA, 22 nt, Human
cagucuuuaaucugagaggcca

SEQ ID NO: 3202515 - RNA, 20 nt, Human
cagucuuucaacucauugca

SEQ ID NO: 3202516 - RNA, 12 nt, Human
cagucuuuuguc

SEQ ID NO: 3202517 - RNA, 14 nt, Human
cagucuuuuguccu

SEQ ID NO: 3202518 - RNA, 19 nt, Human
cagucuggaaugcaguggu

SEQ ID NO: 3202519 - RNA, 22 nt, Human
cagucuuagaucauaguuuuau

SEQ ID NO: 3202520 - RNA, 17 nt, Human
cagucuuaugcuuccag

SEQ ID NO: 3202521 - RNA, 16 nt, Human
cagucuuaugcuucca

SEQ ID NO: 3202522 - RNA, 20 nt, Human
cagucuuaugcuuccagaaa

SEQ ID NO: 3202523 - RNA, 19 nt, Human
cagucuuaugcuuccagaa

SEQ ID NO: 3202524 - RNA, 18 nt, Human
cagucuuaugcuuccaga

SEQ ID NO: 3202525 - RNA, 15 nt, Human
caguccuuaccagca

SEQ ID NO: 3202526 - RNA, 18 nt, Human
caguccuuaccagcagag

SEQ ID NO: 3202527 - RNA, 19 nt, Human
caguccuuaccagcagagc

SEQ ID NO: 3202528 - RNA, 20 nt, Human
caguccuuaccagcagagca

SEQ ID NO: 3202529 - RNA, 21 nt, Human
caguccuuaccagcagagcac

SEQ ID NO: 3202530 - RNA, 18 nt, Human
cagucuggaaugcagugg

SEQ ID NO: 3202531 - RNA, 16 nt, Human
caguccucccaucuca

SEQ ID NO: 3202532 - RNA, 17 nt, Human
caguccucccaucucac

SEQ ID NO: 3202533 - RNA, 14 nt, Human
cagugaagaaagcc

SEQ ID NO: 3202534 - RNA, 22 nt, Human
cagugaaaauaagccaugagaa

SEQ ID NO: 3202535 - RNA, 23 nt, Human
cagugaaaauaagccaugagaau

SEQ ID NO: 3202536 - RNA, 15 nt, Human
cagugagacagcucu

SEQ ID NO: 3202537 - RNA, 15 nt, Human
cagugagagcagaug

SEQ ID NO: 3202538 - RNA, 13 nt, Human
cagugagagcaga

SEQ ID NO: 3202539 - RNA, 23 nt, Human
cagugaccuggaaggcccagcac

SEQ ID NO: 3202540 - RNA, 20 nt, Human
cagugaccuggaaggcccag

SEQ ID NO: 3202541 - RNA, 24 nt, Human
cagugagccgagauugcaccacug

SEQ ID NO: 3202542 - RNA, 12 nt, Human
cagugaggcucu

SEQ ID NO: 3202543 - RNA, 23 nt, Human
cagugagcuggagauacuugguc

SEQ ID NO: 3202544 - RNA, 14 nt, Human
cagugagcuggaga

SEQ ID NO: 3202545 - RNA, 13 nt, Human
cagugaggcucug

SEQ ID NO: 3202546 - RNA, 14 nt, Human
cagugaggcucugc

SEQ ID NO: 3202547 - RNA, 15 nt, Human
cagugaggcucugcc

SEQ ID NO: 3202548 - RNA, 16 nt, Human
cagugaggcucugccc

SEQ ID NO: 3202549 - RNA, 17 nt, Human
cagugaggcucugcccu

SEQ ID NO: 3202550 - RNA, 18 nt, Human
cagugaggcucugcccuu

SEQ ID NO: 3202551 - RNA, 19 nt, Human
cagugaggcucugcccuug

SEQ ID NO: 3202552 - RNA, 20 nt, Human
cagugaggcucugcccuugg

SEQ ID NO: 3202553 - RNA, 18 nt, Human
cagugagucgaggacagg

SEQ ID NO: 3202554 - RNA, 17 nt, Human
cagugagucgaggacag

SEQ ID NO: 3202555 - RNA, 21 nt, Human
cagugaggcucugcccuuggu

SEQ ID NO: 3202556 - RNA, 23 nt, Human
cagugaggguaaguauuuuccug

SEQ ID NO: 3202557 - RNA, 18 nt, Human
cagugauuaccagggacu

SEQ ID NO: 3202558 - RNA, 22 nt, Human
cagugaugugccuaaauaaguu

SEQ ID NO: 3202559 - RNA, 17 nt, Human
cagugauuaccagggac

SEQ ID NO: 3202560 - RNA, 22 nt, Human
cagugauauucuuuguuaauuu

SEQ ID NO: 3202561 - RNA, 15 nt, Human
cagugcccuccagga

SEQ ID NO: 3202562 - RNA, 22 nt, Human
cagugccccgucuacagcuccc

SEQ ID NO: 3202563 - RNA, 23 nt, Human
cagugagucgaggacagggaggu

SEQ ID NO: 3202564 - RNA, 22 nt, Human
cagugagucgaggacagggagg

SEQ ID NO: 3202565 - RNA, 20 nt, Human
cagugagucgaggacaggga

SEQ ID NO: 3202566 - RNA, 19 nt, Human
cagugagucgaggacaggg

SEQ ID NO: 3202567 - RNA, 18 nt, Human
cagugauauucuuuguua

SEQ ID NO: 3202568 - RNA, 15 nt, Human
cagugauauucuuug

SEQ ID NO: 3202569 - RNA, 14 nt, Human
cagugauauucuuu

SEQ ID NO: 3202570 - RNA, 12 nt, Human
cagugauauucu

SEQ ID NO: 3202571 - RNA, 15 nt, Human
cagugccuuauggaa

SEQ ID NO: 3202572 - RNA, 16 nt, Human
cagugccuuauggaac

SEQ ID NO: 3202573 - RNA, 17 nt, Human
cagugccuuauggaaca

SEQ ID NO: 3202574 - RNA, 18 nt, Human
cagugccuuauggaacac

SEQ ID NO: 3202575 - RNA, 19 nt, Human
cagugccuuauggaacacu

SEQ ID NO: 3202576 - RNA, 20 nt, Human
cagugccuuauggaacacuc

SEQ ID NO: 3202577 - RNA, 21 nt, Human
cagugccuuauggaacacucu

SEQ ID NO: 3202578 - RNA, 22 nt, Human
cagugccuuauggaacacucug

SEQ ID NO: 3202579 - RNA, 15 nt, Human
cagugccgagaagga

SEQ ID NO: 3202580 - RNA, 18 nt, Human
cagugccgagaaggaagc

SEQ ID NO: 3202581 - RNA, 19 nt, Human
cagugccuaaaauaagaau

SEQ ID NO: 3202582 - RNA, 15 nt, Human
cagugccuaaaauaa

SEQ ID NO: 3202583 - RNA, 11 nt, Human
cagugccuuau

SEQ ID NO: 3202584 - RNA, 13 nt, Human
cagugccuuaugg

SEQ ID NO: 3202585 - RNA, 23 nt, Human
cagugccuuauggaacacucuga

SEQ ID NO: 3202586 - RNA, 16 nt, Human
cagugcgggugcagac

SEQ ID NO: 3202587 - RNA, 15 nt, Human
cagugcuacugaaag

SEQ ID NO: 3202588 - RNA, 13 nt, Human
cagugcuacugaa

SEQ ID NO: 3202589 - RNA, 14 nt, Human
cagucccugaggca

SEQ ID NO: 3202590 - RNA, 22 nt, Human
caguccccuucccgugaccugg

SEQ ID NO: 3202591 - RNA, 14 nt, Human
caguccccuucccg

SEQ ID NO: 3202592 - RNA, 23 nt, Human
cagucccugaggcagguccccag

SEQ ID NO: 3202593 - RNA, 20 nt, Human
cagucccugaggcagguccc

SEQ ID NO: 3202594 - RNA, 12 nt, Human
cagucccugcca

SEQ ID NO: 3202595 - RNA, 13 nt, Human
cagucccugccaa

SEQ ID NO: 3202596 - RNA, 14 nt, Human
cagucccugccaau

SEQ ID NO: 3202597 - RNA, 15 nt, Human
cagucccugccaaug

SEQ ID NO: 3202598 - RNA, 16 nt, Human
cagucccugccaaugg

SEQ ID NO: 3202599 - RNA, 12 nt, Human
caguccucccau

SEQ ID NO: 3202600 - RNA, 13 nt, Human
caguccucccauc

SEQ ID NO: 3202601 - RNA, 14 nt, Human
caguccucccaucu

SEQ ID NO: 3202602 - RNA, 15 nt, Human
caguccucccaucuc

SEQ ID NO: 3202603 - RNA, 17 nt, Human
cagucccugccaaugga

SEQ ID NO: 3202604 - RNA, 16 nt, Human
cagucccuuuaaagaa

SEQ ID NO: 3202605 - RNA, 17 nt, Human
caguccuagaauguuuc

SEQ ID NO: 3202606 - RNA, 18 nt, Human
caguccuagaauguuuca

SEQ ID NO: 3202607 - RNA, 17 nt, Human
cagucccccugccccag

SEQ ID NO: 3202608 - RNA, 16 nt, Human
cagucccccugcccca

SEQ ID NO: 3202609 - RNA, 23 nt, Human
caguccccgugaaggagagcccu

SEQ ID NO: 3202610 - RNA, 13 nt, Human
caguccccagaac

SEQ ID NO: 3202611 - RNA, 21 nt, Human
caguccccagaacucugccug

SEQ ID NO: 3202612 - RNA, 20 nt, Human
caguccccagaacucugccu

SEQ ID NO: 3202613 - RNA, 19 nt, Human
caguccccagaacucugcc

SEQ ID NO: 3202614 - RNA, 15 nt, Human
caguccccagaacuc

SEQ ID NO: 3202615 - RNA, 12 nt, Human
caguauguggaa

SEQ ID NO: 3202616 - RNA, 16 nt, Human
caguauuacuucugcu

SEQ ID NO: 3202617 - RNA, 18 nt, Human
caguauuacuucugcuac

SEQ ID NO: 3202618 - RNA, 18 nt, Human
cagucaggcucucugggc

SEQ ID NO: 3202619 - RNA, 16 nt, Human
cagucaggcucucugg

SEQ ID NO: 3202620 - RNA, 22 nt, Human
cagucaggcucucugggcugac

SEQ ID NO: 3202621 - RNA, 19 nt, Human
cagucaggcucucugggcu

SEQ ID NO: 3202622 - RNA, 22 nt, Human
cagucaucgaguggcccaacag

SEQ ID NO: 3202623 - RNA, 15 nt, Human
cagucagguugaaga

SEQ ID NO: 3202624 - RNA, 13 nt, Human
caguccaugaaga

SEQ ID NO: 3202625 - RNA, 16 nt, Human
caguccauagcagaga

SEQ ID NO: 3202626 - RNA, 13 nt, Human
cagucccagcagc

SEQ ID NO: 3202627 - RNA, 12 nt, Human
cagucccagcag

SEQ ID NO: 3202628 - RNA, 18 nt, Human
cagucccagcagccagcc

SEQ ID NO: 3202629 - RNA, 17 nt, Human
cagucccagcagccagc

SEQ ID NO: 3202630 - RNA, 15 nt, Human
cagucccagcagcca

SEQ ID NO: 3202631 - RNA, 14 nt, Human
cagucccagcagcc

SEQ ID NO: 3202632 - RNA, 19 nt, Human
cagucccagcagccagcca

SEQ ID NO: 3202633 - RNA, 19 nt, Human
cagucauuaaauuacuaua

SEQ ID NO: 3202634 - RNA, 22 nt, Human
cagucauggagaaccaccuacc

SEQ ID NO: 3202635 - RNA, 22 nt, Human
caguccaagggguccccuccag

SEQ ID NO: 3202636 - RNA, 12 nt, Human
caguagugauag

SEQ ID NO: 3202637 - RNA, 21 nt, Human
caguauaaagaauaggacuug

SEQ ID NO: 3202638 - RNA, 18 nt, Human
caguauaaagaauaggac

SEQ ID NO: 3202639 - RNA, 17 nt, Human
caguauaaagaauagga

SEQ ID NO: 3202640 - RNA, 15 nt, Human
caguauaaagaauag

SEQ ID NO: 3202641 - RNA, 14 nt, Human
caguauaaagaaua

SEQ ID NO: 3202642 - RNA, 20 nt, Human
caguaguuugcauuucagaa

SEQ ID NO: 3202643 - RNA, 13 nt, Human
caguauaaagaau

SEQ ID NO: 3202644 - RNA, 21 nt, Human
caguaguuugcauuucagaaa

SEQ ID NO: 3202645 - RNA, 13 nt, Human
caguauaaaauua

SEQ ID NO: 3202646 - RNA, 18 nt, Human
caguauaaaauuacagug

SEQ ID NO: 3202647 - RNA, 22 nt, Human
caguauaaaauuacaguggauu

SEQ ID NO: 3202648 - RNA, 19 nt, Human
caguaguuugcauuucaga

SEQ ID NO: 3202649 - RNA, 15 nt, Human
caguaguuugcauuu

SEQ ID NO: 3202650 - RNA, 13 nt, Human
caguagaaaauau

SEQ ID NO: 3202651 - RNA, 14 nt, Human
caguagcaggcccg

SEQ ID NO: 3202652 - RNA, 20 nt, Human
caguagcugggaccacaggu

SEQ ID NO: 3202653 - RNA, 19 nt, Human
caguagcugggaccacagg

SEQ ID NO: 3202654 - RNA, 14 nt, Human
caguagcugggacc

SEQ ID NO: 3202655 - RNA, 24 nt, Human
caguaggacaaggugcaggcaggc

SEQ ID NO: 3202656 - RNA, 23 nt, Human
caguaggacaaggugcaggcagg

SEQ ID NO: 3202657 - RNA, 22 nt, Human
caguaggacaaggugcaggcag

SEQ ID NO: 3202658 - RNA, 18 nt, Human
caguagcuuaagaaaaaa

SEQ ID NO: 3202659 - RNA, 12 nt, Human
caguauggcagc

SEQ ID NO: 3202660 - RNA, 21 nt, Human
caguaucuugaagacuuuucu

SEQ ID NO: 3202661 - RNA, 15 nt, Human
caguaucucagggcc

SEQ ID NO: 3202662 - RNA, 12 nt, Human
caguaucuugaa

SEQ ID NO: 3202663 - RNA, 18 nt, Human
caguaucuugaagacuuu

SEQ ID NO: 3202664 - RNA, 13 nt, Human
caguaucucaggg

SEQ ID NO: 3202665 - RNA, 23 nt, Human
caguauauguuaauuuguguguu

SEQ ID NO: 3202666 - RNA, 14 nt, Human
caguauauuaguau

SEQ ID NO: 3202667 - RNA, 16 nt, Human
caguauauuaguauua

SEQ ID NO: 3202668 - RNA, 14 nt, Human
caguauauuuuauu

SEQ ID NO: 3202669 - RNA, 16 nt, Human
caguauauuuuauuuc

SEQ ID NO: 3202670 - RNA, 17 nt, Human
caguauauuuuauuuca

SEQ ID NO: 3202671 - RNA, 18 nt, Human
caguauauuuuauuucaa

SEQ ID NO: 3202672 - RNA, 19 nt, Human
caguauauuuuauuucaau

SEQ ID NO: 3202673 - RNA, 20 nt, Human
caguauauuuuauuucaaug

SEQ ID NO: 3202674 - RNA, 22 nt, Human
caguauauuuuauuucaaugua

SEQ ID NO: 3202675 - RNA, 15 nt, Human
caguaucaugaagcc

SEQ ID NO: 3202676 - RNA, 14 nt, Human
caguaucaugaagc

SEQ ID NO: 3202677 - RNA, 12 nt, Human
cagguguucuuc

SEQ ID NO: 3202678 - RNA, 20 nt, Human
cagguguuuauaucuccuuu

SEQ ID NO: 3202679 - RNA, 20 nt, Human
cagguuaaauguuuuguaaa

SEQ ID NO: 3202680 - RNA, 16 nt, Human
cagguuaaauguuuug

SEQ ID NO: 3202681 - RNA, 13 nt, Human
cagguuaaauguu

SEQ ID NO: 3202682 - RNA, 15 nt, Human
cagguuaaauguuuu

SEQ ID NO: 3202683 - RNA, 14 nt, Human
cagguuaaauguuu

SEQ ID NO: 3202684 - RNA, 23 nt, Human
caggugugagucaccaagcccag

SEQ ID NO: 3202685 - RNA, 22 nt, Human
caggugugagucaccaagccca

SEQ ID NO: 3202686 - RNA, 21 nt, Human
caggugugagccaccacgccc

SEQ ID NO: 3202687 - RNA, 20 nt, Human
caggugugagggcagugcaa

SEQ ID NO: 3202688 - RNA, 16 nt, Human
caggugugagggcagu

SEQ ID NO: 3202689 - RNA, 16 nt, Human
caggugugagucacca

SEQ ID NO: 3202690 - RNA, 18 nt, Human
caggugugagccaccacg

SEQ ID NO: 3202691 - RNA, 21 nt, Human
caggugugagucaccaagccc

SEQ ID NO: 3202692 - RNA, 20 nt, Human
caggugugagucaccaagcc

SEQ ID NO: 3202693 - RNA, 23 nt, Human
caggugugaaccaccacacccag

SEQ ID NO: 3202694 - RNA, 22 nt, Human
caggugugaaccaccacaccca

SEQ ID NO: 3202695 - RNA, 19 nt, Human
caggugugaaccaccacac

SEQ ID NO: 3202696 - RNA, 16 nt, Human
caggugugaaccacca

SEQ ID NO: 3202697 - RNA, 12 nt, Human
caggugugaacc

SEQ ID NO: 3202698 - RNA, 19 nt, Human
caggugucccugcacuugc

SEQ ID NO: 3202699 - RNA, 18 nt, Human
caggugucccugcacuug

SEQ ID NO: 3202700 - RNA, 16 nt, Human
caggugucccugcacu

SEQ ID NO: 3202701 - RNA, 15 nt, Human
caggugucccugcac

SEQ ID NO: 3202702 - RNA, 13 nt, Human
cagguucagcuug

SEQ ID NO: 3202703 - RNA, 15 nt, Human
cagguuccacagagg

SEQ ID NO: 3202704 - RNA, 19 nt, Human
cagguuccacagaggacac

SEQ ID NO: 3202705 - RNA, 12 nt, Human
cagguucagcuu

SEQ ID NO: 3202706 - RNA, 23 nt, Human
cagguuaggcaguauaaagaaua

SEQ ID NO: 3202707 - RNA, 22 nt, Human
cagguuaggcaguauaaagaau

SEQ ID NO: 3202708 - RNA, 21 nt, Human
cagguuauugcaauaaaguau

SEQ ID NO: 3202709 - RNA, 22 nt, Human
cagguuauugcaauaaaguaua

SEQ ID NO: 3202710 - RNA, 13 nt, Human
caguaacacaggc

SEQ ID NO: 3202711 - RNA, 15 nt, Human
caguaagaucacugu

SEQ ID NO: 3202712 - RNA, 16 nt, Human
caguaagaucacuguu

SEQ ID NO: 3202713 - RNA, 17 nt, Human
caguaagaucacuguuu

SEQ ID NO: 3202714 - RNA, 22 nt, Human
caguaacacauagacugugcgc

SEQ ID NO: 3202715 - RNA, 19 nt, Human
caguacccauggggcuagg

SEQ ID NO: 3202716 - RNA, 23 nt, Human
caguaccauuuaauggggaggac

SEQ ID NO: 3202717 - RNA, 21 nt, Human
caguacauucucaguuuuucu

SEQ ID NO: 3202718 - RNA, 19 nt, Human
caguacauucucaguuuuu

SEQ ID NO: 3202719 - RNA, 15 nt, Human
caguacauuuaaauu

SEQ ID NO: 3202720 - RNA, 16 nt, Human
caguacauuuaaauuu

SEQ ID NO: 3202721 - RNA, 17 nt, Human
caguacauuuaaauuuu

SEQ ID NO: 3202722 - RNA, 20 nt, Human
caguacauuuaaauuuuuug

SEQ ID NO: 3202723 - RNA, 22 nt, Human
caguacauuuaaauuuuuuggc

SEQ ID NO: 3202724 - RNA, 22 nt, Human
caguaccuggguccccagcccu

SEQ ID NO: 3202725 - RNA, 23 nt, Human
caguaccuggguccccagcccuu

SEQ ID NO: 3202726 - RNA, 16 nt, Human
caguacccugguugug

SEQ ID NO: 3202727 - RNA, 17 nt, Human
caguacccugguugugu

SEQ ID NO: 3202728 - RNA, 22 nt, Human
caguaagucucauagguuaaaa

SEQ ID NO: 3202729 - RNA, 19 nt, Human
caguaagaucacuguuuag

SEQ ID NO: 3202730 - RNA, 20 nt, Human
caguaagaucacuguuuaga

SEQ ID NO: 3202731 - RNA, 21 nt, Human
caguaagaucacuguuuagau

SEQ ID NO: 3202732 - RNA, 13 nt, Human
caguaauaacucu

SEQ ID NO: 3202733 - RNA, 12 nt, Human
caguaauaacuc

SEQ ID NO: 3202734 - RNA, 18 nt, Human
caguaaugucauaaagug

SEQ ID NO: 3202735 - RNA, 15 nt, Human
caguaauuuucggau

SEQ ID NO: 3202736 - RNA, 21 nt, Human
caguacaaugugacuuugaaa

SEQ ID NO: 3202737 - RNA, 20 nt, Human
caggugguuauggagagggu

SEQ ID NO: 3202738 - RNA, 14 nt, Human
caggugucccugca

SEQ ID NO: 3202739 - RNA, 11 nt, Human
caggugucccu

SEQ ID NO: 3202740 - RNA, 18 nt, Human
cagguggggucacucugg

SEQ ID NO: 3202741 - RNA, 17 nt, Human
cagguggggcagcuuga

SEQ ID NO: 3202742 - RNA, 16 nt, Human
cagguggggcagcuug

SEQ ID NO: 3202743 - RNA, 15 nt, Human
cagguggggcagcuu

SEQ ID NO: 3202744 - RNA, 14 nt, Human
cagguggggcagcu

SEQ ID NO: 3202745 - RNA, 13 nt, Human
cagguggggcagc

SEQ ID NO: 3202746 - RNA, 19 nt, Human
cagguggggucacucuggc

SEQ ID NO: 3202747 - RNA, 20 nt, Human
cagguggggucacucuggca

SEQ ID NO: 3202748 - RNA, 21 nt, Human
cagguggggucacucuggcag

SEQ ID NO: 3202749 - RNA, 22 nt, Human
cagguggggucacucuggcagc

SEQ ID NO: 3202750 - RNA, 23 nt, Human
cagguggggucacucuggcagcu

SEQ ID NO: 3202751 - RNA, 18 nt, Human
caggugguuauggagagg

SEQ ID NO: 3202752 - RNA, 16 nt, Human
caggugggugucugcg

SEQ ID NO: 3202753 - RNA, 14 nt, Human
cagguccucccugc

SEQ ID NO: 3202754 - RNA, 21 nt, Human
caggucuaccccucccggccc

SEQ ID NO: 3202755 - RNA, 12 nt, Human
cagguccugcuc

SEQ ID NO: 3202756 - RNA, 15 nt, Human
cagguccugcucagc

SEQ ID NO: 3202757 - RNA, 13 nt, Human
cagguccugcuca

SEQ ID NO: 3202758 - RNA, 17 nt, Human
cagguccugcucagcag

SEQ ID NO: 3202759 - RNA, 23 nt, Human
caggucuugaacuccuggccuca

SEQ ID NO: 3202760 - RNA, 22 nt, Human
caggucuugaacuccuggccuc

SEQ ID NO: 3202761 - RNA, 21 nt, Human
caggucuugaacuccuggccu

SEQ ID NO: 3202762 - RNA, 20 nt, Human
caggucuugaacuccuggcc

SEQ ID NO: 3202763 - RNA, 19 nt, Human
caggucuugaacuccuggc

SEQ ID NO: 3202764 - RNA, 18 nt, Human
caggucuugaacuccugg

SEQ ID NO: 3202765 - RNA, 13 nt, Human
caggugagaagca

SEQ ID NO: 3202766 - RNA, 20 nt, Human
caggugagaagcagaggaag

SEQ ID NO: 3202767 - RNA, 21 nt, Human
caggugagaagcagaggaagg

SEQ ID NO: 3202768 - RNA, 23 nt, Human
caggugaaggaggcuccaggcag

SEQ ID NO: 3202769 - RNA, 19 nt, Human
caggugaaggaggcuccag

SEQ ID NO: 3202770 - RNA, 18 nt, Human
caggugaaggaggcucca

SEQ ID NO: 3202771 - RNA, 14 nt, Human
caggugaaggaggc

SEQ ID NO: 3202772 - RNA, 21 nt, Human
cagguggccacuccagacccc

SEQ ID NO: 3202773 - RNA, 19 nt, Human
cagguggccacuccagacc

SEQ ID NO: 3202774 - RNA, 16 nt, Human
cagguggccacuccag

SEQ ID NO: 3202775 - RNA, 15 nt, Human
cagguggccacucca

SEQ ID NO: 3202776 - RNA, 20 nt, Human
cagguggagguggcaucccc

SEQ ID NO: 3202777 - RNA, 17 nt, Human
cagguggagguggcauc

SEQ ID NO: 3202778 - RNA, 12 nt, Human
cagguccccaga

SEQ ID NO: 3202779 - RNA, 15 nt, Human
cagguccagaugugc

SEQ ID NO: 3202780 - RNA, 18 nt, Human
cagguccccagcuuuggc

SEQ ID NO: 3202781 - RNA, 13 nt, Human
cagguccccagac

SEQ ID NO: 3202782 - RNA, 21 nt, Human
cagguaacaggcagauacagg

SEQ ID NO: 3202783 - RNA, 20 nt, Human
cagguaacaggcagauacag

SEQ ID NO: 3202784 - RNA, 17 nt, Human
cagguaaucgaccugcc

SEQ ID NO: 3202785 - RNA, 18 nt, Human
cagguaaucgaccugccu

SEQ ID NO: 3202786 - RNA, 19 nt, Human
cagguaaucgaccugccuc

SEQ ID NO: 3202787 - RNA, 20 nt, Human
cagguaaucgaccugccucg

SEQ ID NO: 3202788 - RNA, 23 nt, Human
cagguacuuugucuaagaaacau

SEQ ID NO: 3202789 - RNA, 13 nt, Human
cagguacuuuguc

SEQ ID NO: 3202790 - RNA, 12 nt, Human
cagguacuuugu

SEQ ID NO: 3202791 - RNA, 14 nt, Human
cagguaccaguucu

SEQ ID NO: 3202792 - RNA, 15 nt, Human
cagguaccaguucuu

SEQ ID NO: 3202793 - RNA, 13 nt, Human
cagguaggaauau

SEQ ID NO: 3202794 - RNA, 20 nt, Human
cagguaggaauauuauauuu

SEQ ID NO: 3202795 - RNA, 15 nt, Human
cagguaggaauauua

SEQ ID NO: 3202796 - RNA, 21 nt, Human
cagguagcauagcucuguaca

SEQ ID NO: 3202797 - RNA, 21 nt, Human
cagguagaacgccagggaccc

SEQ ID NO: 3202798 - RNA, 19 nt, Human
cagguagaacgccagggac

SEQ ID NO: 3202799 - RNA, 17 nt, Human
cagguagaacgccaggg

SEQ ID NO: 3202800 - RNA, 18 nt, Human
cagguagaggugcaugcc

SEQ ID NO: 3202801 - RNA, 23 nt, Human
cagguaggaauauuauauuugga

SEQ ID NO: 3202802 - RNA, 14 nt, Human
cagggucccuggug

SEQ ID NO: 3202803 - RNA, 12 nt, Human
cagggucccugg

SEQ ID NO: 3202804 - RNA, 15 nt, Human
cagggucccuggugg

SEQ ID NO: 3202805 - RNA, 18 nt, Human
cagggucccugguggcag

SEQ ID NO: 3202806 - RNA, 19 nt, Human
cagggucccugguggcagc

SEQ ID NO: 3202807 - RNA, 22 nt, Human
cagggucccugguggcagcuca

SEQ ID NO: 3202808 - RNA, 20 nt, Human
caggguauuccagagugggg

SEQ ID NO: 3202809 - RNA, 21 nt, Human
caggguauuccagagugggga

SEQ ID NO: 3202810 - RNA, 15 nt, Human
caggguacaaaaaau

SEQ ID NO: 3202811 - RNA, 12 nt, Human
cagggguuccuu

SEQ ID NO: 3202812 - RNA, 20 nt, Human
cagggguuccuucugggcau

SEQ ID NO: 3202813 - RNA, 19 nt, Human
cagggguuccuucugggca

SEQ ID NO: 3202814 - RNA, 21 nt, Human
cagggguuccuucugggcauu

SEQ ID NO: 3202815 - RNA, 16 nt, Human
cagggucucacucugu

SEQ ID NO: 3202816 - RNA, 16 nt, Human
caggguuuugccaugu

SEQ ID NO: 3202817 - RNA, 19 nt, Human
cagguaaagggcaaauaau

SEQ ID NO: 3202818 - RNA, 22 nt, Human
cagguaaagggcaaauaaugau

SEQ ID NO: 3202819 - RNA, 17 nt, Human
cagguaacaggcagaua

SEQ ID NO: 3202820 - RNA, 16 nt, Human
cagguaacaggcagau

SEQ ID NO: 3202821 - RNA, 15 nt, Human
cagguaacaggcaga

SEQ ID NO: 3202822 - RNA, 14 nt, Human
cagguaacaggcag

SEQ ID NO: 3202823 - RNA, 18 nt, Human
caggguccuguagcccua

SEQ ID NO: 3202824 - RNA, 23 nt, Human
cagggucccugguggcagcucac

SEQ ID NO: 3202825 - RNA, 15 nt, Human
cagggucucacucug

SEQ ID NO: 3202826 - RNA, 23 nt, Human
cagggucucacuauguugcccag

SEQ ID NO: 3202827 - RNA, 22 nt, Human
cagggucucacuauguugccca

SEQ ID NO: 3202828 - RNA, 21 nt, Human
cagggucucacuauguugccc

SEQ ID NO: 3202829 - RNA, 14 nt, Human
caggggugggacac

SEQ ID NO: 3202830 - RNA, 15 nt, Human
caggggugggacacc

SEQ ID NO: 3202831 - RNA, 20 nt, Human
caggggugggacacccugug

SEQ ID NO: 3202832 - RNA, 21 nt, Human
caggggugggacacccuguga

SEQ ID NO: 3202833 - RNA, 14 nt, Human
accaucucuuuacc

SEQ ID NO: 3202834 - RNA, 12 nt, Human
accauccccucc

SEQ ID NO: 3202835 - RNA, 17 nt, Human
accaucuuuuauucuuu

SEQ ID NO: 3202836 - RNA, 19 nt, Human
accaucuuuuauucuuuuu

SEQ ID NO: 3202837 - RNA, 20 nt, Human
accaucuuuuauucuuuuuu

SEQ ID NO: 3202838 - RNA, 13 nt, Human
accaucugcuguc

SEQ ID NO: 3202839 - RNA, 23 nt, Human
accaucauugaaaucuuuuugcu

SEQ ID NO: 3202840 - RNA, 15 nt, Human
accaucauugaaauc

SEQ ID NO: 3202841 - RNA, 12 nt, Human
accaucauugaa

SEQ ID NO: 3202842 - RNA, 15 nt, Human
accaucaagccacca

SEQ ID NO: 3202843 - RNA, 15 nt, Human
accaucacagcuugu

SEQ ID NO: 3202844 - RNA, 16 nt, Human
accaucacagcuuguu

SEQ ID NO: 3202845 - RNA, 14 nt, Human
accauaguugacag

SEQ ID NO: 3202846 - RNA, 14 nt, Human
accaucaagccacc

SEQ ID NO: 3202847 - RNA, 22 nt, Human
accauaguuacuguaaaaugca

SEQ ID NO: 3202848 - RNA, 18 nt, Human
accauaguuacuguaaaa

SEQ ID NO: 3202849 - RNA, 15 nt, Human
accauaguuacugua

SEQ ID NO: 3202850 - RNA, 19 nt, Human
accauaguguucauugaua

SEQ ID NO: 3202851 - RNA, 21 nt, Human
accauacuaauuauacccccu

SEQ ID NO: 3202852 - RNA, 17 nt, Human
accauaggucaccuuua

SEQ ID NO: 3202853 - RNA, 13 nt, Human
accauacuaauua

SEQ ID NO: 3202854 - RNA, 16 nt, Human
accauacuaauuauac

SEQ ID NO: 3202855 - RNA, 15 nt, Human
acccacccccaccca

SEQ ID NO: 3202856 - RNA, 12 nt, Human
acccaccacaca

SEQ ID NO: 3202857 - RNA, 17 nt, Human
acccacccccacccaag

SEQ ID NO: 3202858 - RNA, 17 nt, Human
accaugaagaacauaaa

SEQ ID NO: 3202859 - RNA, 15 nt, Human
accaucugcugucuu

SEQ ID NO: 3202860 - RNA, 14 nt, Human
accaucugcugucu

SEQ ID NO: 3202861 - RNA, 15 nt, Human
acccacccuccuuuc

SEQ ID NO: 3202862 - RNA, 21 nt, Human
acccacccuuucuacuuccaa

SEQ ID NO: 3202863 - RNA, 13 nt, Human
acccaugcugccc

SEQ ID NO: 3202864 - RNA, 20 nt, Human
acccauccaccguccccucc

SEQ ID NO: 3202865 - RNA, 13 nt, Human
acauuuagaaaag

SEQ ID NO: 3202866 - RNA, 16 nt, Human
acauuuagaaaaguga

SEQ ID NO: 3202867 - RNA, 17 nt, Human
acauuuagaaaagugaa

SEQ ID NO: 3202868 - RNA, 20 nt, Human
acauuuagaaaagugaauug

SEQ ID NO: 3202869 - RNA, 22 nt, Human
acauuuagaaaagugaauugaa

SEQ ID NO: 3202870 - RNA, 15 nt, Human
acauuuagaagaaag

SEQ ID NO: 3202871 - RNA, 16 nt, Human
acauuuagaagaaaga

SEQ ID NO: 3202872 - RNA, 18 nt, Human
acauuuagaagaaagaug

SEQ ID NO: 3202873 - RNA, 23 nt, Human
acaugucuuuucuugcaugaggc

SEQ ID NO: 3202874 - RNA, 18 nt, Human
acaugugaaaagaauaga

SEQ ID NO: 3202875 - RNA, 17 nt, Human
acaugugaaaagaauag

SEQ ID NO: 3202876 - RNA, 14 nt, Human
acaugugaaaagaa

SEQ ID NO: 3202877 - RNA, 19 nt, Human
acaugccucucucaggcca

SEQ ID NO: 3202878 - RNA, 21 nt, Human
accaaggcugagacagugaau

SEQ ID NO: 3202879 - RNA, 23 nt, Human
accaaggcugagacagugaauuu

SEQ ID NO: 3202880 - RNA, 16 nt, Human
accacccgguccccac

SEQ ID NO: 3202881 - RNA, 17 nt, Human
accacccgguccccacu

SEQ ID NO: 3202882 - RNA, 12 nt, Human
accaccugccca

SEQ ID NO: 3202883 - RNA, 14 nt, Human
accacccuccuucc

SEQ ID NO: 3202884 - RNA, 12 nt, Human
accacccuccuu

SEQ ID NO: 3202885 - RNA, 19 nt, Human
accaaggcugauuaaacca

SEQ ID NO: 3202886 - RNA, 23 nt, Human
acauuucuaagucaaacacuugu

SEQ ID NO: 3202887 - RNA, 19 nt, Human
acauuuccgccacaucccu

SEQ ID NO: 3202888 - RNA, 18 nt, Human
accaagaaaggaaccugu

SEQ ID NO: 3202889 - RNA, 12 nt, Human
accagcagagca

SEQ ID NO: 3202890 - RNA, 13 nt, Human
accagcagagcac

SEQ ID NO: 3202891 - RNA, 17 nt, Human
accagccccagugccca

SEQ ID NO: 3202892 - RNA, 16 nt, Human
accagccccagugccc

SEQ ID NO: 3202893 - RNA, 16 nt, Human
accagccccacccugu

SEQ ID NO: 3202894 - RNA, 19 nt, Human
accagccccagugcccaca

SEQ ID NO: 3202895 - RNA, 18 nt, Human
accagccccagugcccac

SEQ ID NO: 3202896 - RNA, 20 nt, Human
accagccccagugcccacag

SEQ ID NO: 3202897 - RNA, 21 nt, Human
acauaauuaacacuuaagguu

SEQ ID NO: 3202898 - RNA, 15 nt, Human
acauaagauaaaugu

SEQ ID NO: 3202899 - RNA, 12 nt, Human
acaucagcuuga

SEQ ID NO: 3202900 - RNA, 21 nt, Human
acaucagcuugaccaguauaa

SEQ ID NO: 3202901 - RNA, 20 nt, Human
acaucagguuaggcaguaua

SEQ ID NO: 3202902 - RNA, 20 nt, Human
acauaauucaggaagcagcu

SEQ ID NO: 3202903 - RNA, 13 nt, Human
acauaauucuuau

SEQ ID NO: 3202904 - RNA, 18 nt, Human
acauaauuuaguuguuuc

SEQ ID NO: 3202905 - RNA, 19 nt, Human
acauaauuuaguuguuucu

SEQ ID NO: 3202906 - RNA, 11 nt, Human
acauacaaaug

SEQ ID NO: 3202907 - RNA, 21 nt, Human
acauacaaaugcaucuuugau

SEQ ID NO: 3202908 - RNA, 16 nt, Human
acauaagauaaaugug

SEQ ID NO: 3202909 - RNA, 20 nt, Human
acaucaucuguaagcuguuu

SEQ ID NO: 3202910 - RNA, 19 nt, Human
acaucaucuguaagcuguu

SEQ ID NO: 3202911 - RNA, 13 nt, Human
acaucaucuguaa

SEQ ID NO: 3202912 - RNA, 18 nt, Human
acaucaucuguaagcugu

SEQ ID NO: 3202913 - RNA, 14 nt, Human
acaucaucuguaag

SEQ ID NO: 3202914 - RNA, 15 nt, Human
acauccuacaagaca

SEQ ID NO: 3202915 - RNA, 19 nt, Human
acauccggggccagcuccg

SEQ ID NO: 3202916 - RNA, 18 nt, Human
acauccggggccagcucc

SEQ ID NO: 3202917 - RNA, 15 nt, Human
acaugccaggggccu

SEQ ID NO: 3202918 - RNA, 15 nt, Human
acaugccucucucag

SEQ ID NO: 3202919 - RNA, 16 nt, Human
acaugccucucucagg

SEQ ID NO: 3202920 - RNA, 17 nt, Human
acaugccucucucaggc

SEQ ID NO: 3202921 - RNA, 18 nt, Human
acaugccucucucaggcc

SEQ ID NO: 3202922 - RNA, 21 nt, Human
acagugcaccugggacaggga

SEQ ID NO: 3202923 - RNA, 21 nt, Human
acagugauuaccagggacuga

SEQ ID NO: 3202924 - RNA, 20 nt, Human
acagugauuaccagggacug

SEQ ID NO: 3202925 - RNA, 23 nt, Human
acagugagucgaggacagggagg

SEQ ID NO: 3202926 - RNA, 18 nt, Human
acaguguaccauuaaaau

SEQ ID NO: 3202927 - RNA, 23 nt, Human
acaguguaccauuaaaauaugca

SEQ ID NO: 3202928 - RNA, 20 nt, Human
acaguguaccauuaaaauau

SEQ ID NO: 3202929 - RNA, 19 nt, Human
acaguguaccauuaaaaua

SEQ ID NO: 3202930 - RNA, 13 nt, Human
acagcucuguccu

SEQ ID NO: 3202931 - RNA, 23 nt, Human
acagcugagcacccagcucuguc

SEQ ID NO: 3202932 - RNA, 16 nt, Human
acagcucuguccuggg

SEQ ID NO: 3202933 - RNA, 23 nt, Human
acaggcaagcaccuccugccucg

SEQ ID NO: 3202934 - RNA, 20 nt, Human
acaggcaagcaccuccugcc

SEQ ID NO: 3202935 - RNA, 16 nt, Human
acagcugccugcagua

SEQ ID NO: 3202936 - RNA, 12 nt, Human
acagcugccugc

SEQ ID NO: 3202937 - RNA, 14 nt, Human
acagcucuguccug

SEQ ID NO: 3202938 - RNA, 18 nt, Human
acagcuccuucuguccua

SEQ ID NO: 3202939 - RNA, 16 nt, Human
acagcuccuucugucc

SEQ ID NO: 3202940 - RNA, 17 nt, Human
acagaggggguggccuc

SEQ ID NO: 3202941 - RNA, 18 nt, Human
acagaggggguggccucc

SEQ ID NO: 3202942 - RNA, 19 nt, Human
acagaggggguggccuccc

SEQ ID NO: 3202943 - RNA, 15 nt, Human
acagcuccuucuguc

SEQ ID NO: 3202944 - RNA, 19 nt, Human
acaggcaagcaccuccugc

SEQ ID NO: 3202945 - RNA, 13 nt, Human
acagggccuggcc

SEQ ID NO: 3202946 - RNA, 12 nt, Human
acagggccuggc

SEQ ID NO: 3202947 - RNA, 17 nt, Human
acagggccuggcccaug

SEQ ID NO: 3202948 - RNA, 16 nt, Human
acagggccuggcccau

SEQ ID NO: 3202949 - RNA, 15 nt, Human
acagggccuggccca

SEQ ID NO: 3202950 - RNA, 14 nt, Human
acagggccuggccc

SEQ ID NO: 3202951 - RNA, 19 nt, Human
acagggccuggcccaugua

SEQ ID NO: 3202952 - RNA, 13 nt, Human
acaggugcccgcc

SEQ ID NO: 3202953 - RNA, 18 nt, Human
acaggugauuaacuugga

SEQ ID NO: 3202954 - RNA, 23 nt, Human
acaggugugagucaccaagccca

SEQ ID NO: 3202955 - RNA, 22 nt, Human
acaggugugagucaccaagccc

SEQ ID NO: 3202956 - RNA, 19 nt, Human
acaggugugaaccaccaca

SEQ ID NO: 3202957 - RNA, 22 nt, Human
acagugagucgaggacagggag

SEQ ID NO: 3202958 - RNA, 18 nt, Human
acagguguuuauaucucc

SEQ ID NO: 3202959 - RNA, 20 nt, Human
acacguaaugaaacuuggau

SEQ ID NO: 3202960 - RNA, 15 nt, Human
acacgaauauugcug

SEQ ID NO: 3202961 - RNA, 21 nt, Human
acacgaauauugcugauggug

SEQ ID NO: 3202962 - RNA, 12 nt, Human
acacgaauauug

SEQ ID NO: 3202963 - RNA, 14 nt, Human
acacgaauauugcu

SEQ ID NO: 3202964 - RNA, 21 nt, Human
acacagcucuucuccaggcug

SEQ ID NO: 3202965 - RNA, 20 nt, Human
acacagcucuucuccaggcu

SEQ ID NO: 3202966 - RNA, 19 nt, Human
acacaaaaguuucucuuuu

SEQ ID NO: 3202967 - RNA, 19 nt, Human
acacagcucuucuccaggc

SEQ ID NO: 3202968 - RNA, 12 nt, Human
acacaaaaucaa

SEQ ID NO: 3202969 - RNA, 17 nt, Human
acacaaaacaaauccug

SEQ ID NO: 3202970 - RNA, 19 nt, Human
acaauuuuuauuucuuuua

SEQ ID NO: 3202971 - RNA, 21 nt, Human
acaauuuuuauuucuuuuacu

SEQ ID NO: 3202972 - RNA, 19 nt, Human
acaauucaaagaaucaccu

SEQ ID NO: 3202973 - RNA, 14 nt, Human
acaauucagcauua

SEQ ID NO: 3202974 - RNA, 13 nt, Human
acaauuccaugac

SEQ ID NO: 3202975 - RNA, 20 nt, Human
acaauuauuccaaaccaaau

SEQ ID NO: 3202976 - RNA, 21 nt, Human
acaauuauuccaaaccaaauu

SEQ ID NO: 3202977 - RNA, 22 nt, Human
acaauuauuccaaaccaaauuu

SEQ ID NO: 3202978 - RNA, 23 nt, Human
acaauuauaaacucauuuugcuu

SEQ ID NO: 3202979 - RNA, 12 nt, Human
acaauuauaaac

SEQ ID NO: 3202980 - RNA, 13 nt, Human
acaauuagauuuc

SEQ ID NO: 3202981 - RNA, 14 nt, Human
acaauuagauuucu

SEQ ID NO: 3202982 - RNA, 20 nt, Human
acaaggaugaucuaggaaga

SEQ ID NO: 3202983 - RNA, 16 nt, Human
acaaggauugcuacug

SEQ ID NO: 3202984 - RNA, 23 nt, Human
acagaggacaguauuugugggga

SEQ ID NO: 3202985 - RNA, 16 nt, Human
acagaggacacagaga

SEQ ID NO: 3202986 - RNA, 13 nt, Human
acagaggcagccc

SEQ ID NO: 3202987 - RNA, 21 nt, Human
acagaggaccagcacacuccc

SEQ ID NO: 3202988 - RNA, 20 nt, Human
acagaggaccagcacacucc

SEQ ID NO: 3202989 - RNA, 15 nt, Human
acagaggaccagcac

SEQ ID NO: 3202990 - RNA, 14 nt, Human
acagaggaccagca

SEQ ID NO: 3202991 - RNA, 12 nt, Human
acagaggaccag

SEQ ID NO: 3202992 - RNA, 21 nt, Human
acagaggccaugggccuccug

SEQ ID NO: 3202993 - RNA, 14 nt, Human
acagaggggguggc

SEQ ID NO: 3202994 - RNA, 17 nt, Human
acagaggccaugggccu

SEQ ID NO: 3202995 - RNA, 23 nt, Human
acagaggcagccccauucugccu

SEQ ID NO: 3202996 - RNA, 18 nt, Human
acagaaggcuccugcccc

SEQ ID NO: 3202997 - RNA, 16 nt, Human
acagaaggcuccugcc

SEQ ID NO: 3202998 - RNA, 19 nt, Human
acagaaggcuccugccccc

SEQ ID NO: 3202999 - RNA, 14 nt, Human
acagacaaagcgug

SEQ ID NO: 3203000 - RNA, 23 nt, Human
acagaaggggacugccaccuccc

SEQ ID NO: 3203001 - RNA, 22 nt, Human
acagaaggggacugccaccucc

SEQ ID NO: 3203002 - RNA, 17 nt, Human
acagaaggggacugcca

SEQ ID NO: 3203003 - RNA, 13 nt, Human
acagacaaagcgu

SEQ ID NO: 3203004 - RNA, 17 nt, Human
acacugugcugagucug

SEQ ID NO: 3203005 - RNA, 22 nt, Human
acacugugcugagucugaaggc

SEQ ID NO: 3203006 - RNA, 18 nt, Human
acacugugguagguguuu

SEQ ID NO: 3203007 - RNA, 20 nt, Human
acacugugguagguguuuga

SEQ ID NO: 3203008 - RNA, 20 nt, Human
acagaacucgguguccccac

SEQ ID NO: 3203009 - RNA, 19 nt, Human
acagaacucggugucccca

SEQ ID NO: 3203010 - RNA, 22 nt, Human
acagaacucgguguccccacca

SEQ ID NO: 3203011 - RNA, 23 nt, Human
aauuggguggggggcuucauaca

SEQ ID NO: 3203012 - RNA, 20 nt, Human
aauugguuaucaugggaaag

SEQ ID NO: 3203013 - RNA, 15 nt, Human
aauugguaccuugca

SEQ ID NO: 3203014 - RNA, 19 nt, Human
aauugguguaauggggcag

SEQ ID NO: 3203015 - RNA, 22 nt, Human
aauuggguggggggcuucauac

SEQ ID NO: 3203016 - RNA, 21 nt, Human
aauuggguggggggcuucaua

SEQ ID NO: 3203017 - RNA, 19 nt, Human
aaugucacaggcaggucca

SEQ ID NO: 3203018 - RNA, 16 nt, Human
aaugucacaggcaggu

SEQ ID NO: 3203019 - RNA, 12 nt, Human
aauuguaaggaa

SEQ ID NO: 3203020 - RNA, 11 nt, Human
aauuguaaaag

SEQ ID NO: 3203021 - RNA, 11 nt, Human
aauuguauuuu

SEQ ID NO: 3203022 - RNA, 12 nt, Human
aauuguauuuuu

SEQ ID NO: 3203023 - RNA, 14 nt, Human
aauuguauuuuugu

SEQ ID NO: 3203024 - RNA, 19 nt, Human
aauuguauuuuuguuguug

SEQ ID NO: 3203025 - RNA, 14 nt, Human
aauugugauguguc

SEQ ID NO: 3203026 - RNA, 15 nt, Human
aauugugaugugucc

SEQ ID NO: 3203027 - RNA, 11 nt, Human
aauugugaugu

SEQ ID NO: 3203028 - RNA, 15 nt, Human
aauugucuuuaaaaa

SEQ ID NO: 3203029 - RNA, 19 nt, Human
aauugucuuaauggaugaa

SEQ ID NO: 3203030 - RNA, 23 nt, Human
aauuuauugaggaaaaauaugug

SEQ ID NO: 3203031 - RNA, 22 nt, Human
aauuuauugaggaaaaauaugu

SEQ ID NO: 3203032 - RNA, 21 nt, Human
aauuuauugaggaaaaauaug

SEQ ID NO: 3203033 - RNA, 19 nt, Human
aauuuauugaggaaaaaua

SEQ ID NO: 3203034 - RNA, 20 nt, Human
aauuuauuuaugggauccug

SEQ ID NO: 3203035 - RNA, 12 nt, Human
aauuuauuucca

SEQ ID NO: 3203036 - RNA, 23 nt, Human
aauuuauuuccaauguuucaagc

SEQ ID NO: 3203037 - RNA, 20 nt, Human
aauuucagagagaaucaaga

SEQ ID NO: 3203038 - RNA, 21 nt, Human
aauuucacgucauaggaaguu

SEQ ID NO: 3203039 - RNA, 22 nt, Human
aauuucacgucauaggaaguua

SEQ ID NO: 3203040 - RNA, 18 nt, Human
aauuucacgauucauuuu

SEQ ID NO: 3203041 - RNA, 13 nt, Human
aauuucaagcuua

SEQ ID NO: 3203042 - RNA, 23 nt, Human
aauuucaacgccugccuuuggca

SEQ ID NO: 3203043 - RNA, 22 nt, Human
aauuucaagcuuauuuuggaga

SEQ ID NO: 3203044 - RNA, 20 nt, Human
aauuucaagcuuauuuugga

SEQ ID NO: 3203045 - RNA, 17 nt, Human
aauuucaagcuuauuuu

SEQ ID NO: 3203046 - RNA, 15 nt, Human
aauuucaagcuuauu

SEQ ID NO: 3203047 - RNA, 20 nt, Human
aauuuauuuuuaagaaagaa

SEQ ID NO: 3203048 - RNA, 19 nt, Human
aauuuauuuuuaagaaaga

SEQ ID NO: 3203049 - RNA, 19 nt, Human
aauuucgcuucuuagaaca

SEQ ID NO: 3203050 - RNA, 13 nt, Human
aauuucaguguaa

SEQ ID NO: 3203051 - RNA, 19 nt, Human
aauuucaguguaaagugug

SEQ ID NO: 3203052 - RNA, 16 nt, Human
aauuucaguaagauca

SEQ ID NO: 3203053 - RNA, 20 nt, Human
aauuuucagauuugcacaaa

SEQ ID NO: 3203054 - RNA, 18 nt, Human
aauuuucagauuugcaca

SEQ ID NO: 3203055 - RNA, 17 nt, Human
aauuuucagauuugcac

SEQ ID NO: 3203056 - RNA, 14 nt, Human
aauuuucagauuug

SEQ ID NO: 3203057 - RNA, 13 nt, Human
aauuuucagauuu

SEQ ID NO: 3203058 - RNA, 19 nt, Human
aauuuuauuuuaaaauuuc

SEQ ID NO: 3203059 - RNA, 22 nt, Human
aauuuuauuuuaaaauuucaua

SEQ ID NO: 3203060 - RNA, 10 nt, Human
aauuuucauu

SEQ ID NO: 3203061 - RNA, 13 nt, Human
aauuuucauuuua

SEQ ID NO: 3203062 - RNA, 12 nt, Human
aauuuucauuuu

SEQ ID NO: 3203063 - RNA, 19 nt, Human
aauuuucauuuuacaguua

SEQ ID NO: 3203064 - RNA, 16 nt, Human
aauuuucauuuuacag

SEQ ID NO: 3203065 - RNA, 15 nt, Human
aauuuucauuuuaca

SEQ ID NO: 3203066 - RNA, 13 nt, Human
acaaaaugaaacg

SEQ ID NO: 3203067 - RNA, 22 nt, Human
acaaaaugaaacgcaaccacca

SEQ ID NO: 3203068 - RNA, 23 nt, Human
acaaccuucauuuaaaaagguuu

SEQ ID NO: 3203069 - RNA, 15 nt, Human
acaagaaaugaaagc

SEQ ID NO: 3203070 - RNA, 16 nt, Human
acaagaaaugaaagca

SEQ ID NO: 3203071 - RNA, 13 nt, Human
acaagaaaugaaa

SEQ ID NO: 3203072 - RNA, 16 nt, Human
acaacccccagcuccc

SEQ ID NO: 3203073 - RNA, 20 nt, Human
acaaagaaccuaacauuuau

SEQ ID NO: 3203074 - RNA, 14 nt, Human
acaacccccagcuc

SEQ ID NO: 3203075 - RNA, 19 nt, Human
accgggccacagagaaagu

SEQ ID NO: 3203076 - RNA, 15 nt, Human
accgggccacagaga

SEQ ID NO: 3203077 - RNA, 14 nt, Human
accgugaggccaga

SEQ ID NO: 3203078 - RNA, 14 nt, Human
accgugaagauacu

SEQ ID NO: 3203079 - RNA, 15 nt, Human
accgucuacauuuca

SEQ ID NO: 3203080 - RNA, 16 nt, Human
accgucuacauuucac

SEQ ID NO: 3203081 - RNA, 15 nt, Human
accguccccucccag

SEQ ID NO: 3203082 - RNA, 18 nt, Human
accguccccucccaggga

SEQ ID NO: 3203083 - RNA, 16 nt, Human
accguccccucccagg

SEQ ID NO: 3203084 - RNA, 16 nt, Human
accguaaagguuuauu

SEQ ID NO: 3203085 - RNA, 22 nt, Human
accguaaagguuuauuuuucug

SEQ ID NO: 3203086 - RNA, 23 nt, Human
accguaaagguuuauuuuucugu

SEQ ID NO: 3203087 - RNA, 14 nt, Human
accggcuggccugg

SEQ ID NO: 3203088 - RNA, 15 nt, Human
accggcuggccuggc

SEQ ID NO: 3203089 - RNA, 17 nt, Human
accggcuggccuggccc

SEQ ID NO: 3203090 - RNA, 18 nt, Human
accggcuggccuggcccc

SEQ ID NO: 3203091 - RNA, 20 nt, Human
accgggcacucagaagacac

SEQ ID NO: 3203092 - RNA, 17 nt, Human
acccuguuaccauuuug

SEQ ID NO: 3203093 - RNA, 17 nt, Human
acccuguuuugagcccu

SEQ ID NO: 3203094 - RNA, 18 nt, Human
acccuguuuugagcccug

SEQ ID NO: 3203095 - RNA, 22 nt, Human
acccugugauggggcccugccu

SEQ ID NO: 3203096 - RNA, 23 nt, Human
accccaagcgcccuggcccccac

SEQ ID NO: 3203097 - RNA, 20 nt, Human
acccugugcagaagggagcu

SEQ ID NO: 3203098 - RNA, 16 nt, Human
accccacacacgccag

SEQ ID NO: 3203099 - RNA, 21 nt, Human
accccaagcgcccuggccccc

SEQ ID NO: 3203100 - RNA, 19 nt, Human
accccaagcgcccuggccc

SEQ ID NO: 3203101 - RNA, 16 nt, Human
accccaagcgcccugg

SEQ ID NO: 3203102 - RNA, 15 nt, Human
accccaagcgcccug

SEQ ID NO: 3203103 - RNA, 14 nt, Human
acccaugcugcccu

SEQ ID NO: 3203104 - RNA, 15 nt, Human
acccaugcugcccug

SEQ ID NO: 3203105 - RNA, 16 nt, Human
accgugaggccagaga

SEQ ID NO: 3203106 - RNA, 17 nt, Human
accgugaggccagagac

SEQ ID NO: 3203107 - RNA, 12 nt, Human
accucaggccug

SEQ ID NO: 3203108 - RNA, 13 nt, Human
accucaggccugg

SEQ ID NO: 3203109 - RNA, 14 nt, Human
accucaggccuggg

SEQ ID NO: 3203110 - RNA, 22 nt, Human
accucaggccugggggcugggc

SEQ ID NO: 3203111 - RNA, 22 nt, Human
accucagguaaucgaccugccu

SEQ ID NO: 3203112 - RNA, 18 nt, Human
accgugaagauacuuugu

SEQ ID NO: 3203113 - RNA, 19 nt, Human
accgugaagauacuuugua

SEQ ID NO: 3203114 - RNA, 20 nt, Human
accgugaagauacuuuguau

SEQ ID NO: 3203115 - RNA, 21 nt, Human
accgugaagauacuuuguauu

SEQ ID NO: 3203116 - RNA, 18 nt, Human
accucaggugagaagcag

SEQ ID NO: 3203117 - RNA, 23 nt, Human
accucagguaaucgaccugccuc

SEQ ID NO: 3203118 - RNA, 17 nt, Human
accugucuuuugggagu

SEQ ID NO: 3203119 - RNA, 15 nt, Human
accugucuuuuggga

SEQ ID NO: 3203120 - RNA, 22 nt, Human
accugccccuccucucugcccu

SEQ ID NO: 3203121 - RNA, 23 nt, Human
accugccccuccucucugcccua

SEQ ID NO: 3203122 - RNA, 11 nt, Human
accugccaggg

SEQ ID NO: 3203123 - RNA, 12 nt, Human
accugccaggga

SEQ ID NO: 3203124 - RNA, 13 nt, Human
accugccagggac

SEQ ID NO: 3203125 - RNA, 15 nt, Human
accugccagggacag

SEQ ID NO: 3203126 - RNA, 16 nt, Human
accugccagggacaga

SEQ ID NO: 3203127 - RNA, 18 nt, Human
accugccagggacagagg

SEQ ID NO: 3203128 - RNA, 22 nt, Human
acuaggugcccagaaugaggcu

SEQ ID NO: 3203129 - RNA, 14 nt, Human
acuauugagucuuc

SEQ ID NO: 3203130 - RNA, 16 nt, Human
acuauuguuagucucu

SEQ ID NO: 3203131 - RNA, 17 nt, Human
acuagggaagauaauau

SEQ ID NO: 3203132 - RNA, 16 nt, Human
acuaacuucuaaaacu

SEQ ID NO: 3203133 - RNA, 13 nt, Human
acuaacuucuaaa

SEQ ID NO: 3203134 - RNA, 23 nt, Human
acgucugacaggcaaugcuggcu

SEQ ID NO: 3203135 - RNA, 15 nt, Human
acgucugacaggcaa

SEQ ID NO: 3203136 - RNA, 16 nt, Human
acguggcaccuccucg

SEQ ID NO: 3203137 - RNA, 15 nt, Human
acguggcaccuccuc

SEQ ID NO: 3203138 - RNA, 14 nt, Human
acguggcaccuccu

SEQ ID NO: 3203139 - RNA, 13 nt, Human
acguggcaccucc

SEQ ID NO: 3203140 - RNA, 19 nt, Human
acggacgaaccuugaaaac

SEQ ID NO: 3203141 - RNA, 19 nt, Human
acggacacucaaaagcugg

SEQ ID NO: 3203142 - RNA, 15 nt, Human
acggaagagccuugc

SEQ ID NO: 3203143 - RNA, 16 nt, Human
acggaagagccuugcg

SEQ ID NO: 3203144 - RNA, 18 nt, Human
acgcuggagugcagugag

SEQ ID NO: 3203145 - RNA, 19 nt, Human
acgcuggagugcagugagc

SEQ ID NO: 3203146 - RNA, 11 nt, Human
accugugucuc

SEQ ID NO: 3203147 - RNA, 22 nt, Human
acugauuaguaagucuugccua

SEQ ID NO: 3203148 - RNA, 23 nt, Human
acugauuuuuuuuuccuucagug

SEQ ID NO: 3203149 - RNA, 14 nt, Human
acugauuucaguaa

SEQ ID NO: 3203150 - RNA, 21 nt, Human
acugauuuuuuuuuccuucag

SEQ ID NO: 3203151 - RNA, 22 nt, Human
acugauuuuuuuuuccuucagu

SEQ ID NO: 3203152 - RNA, 23 nt, Human
acugacauuguuggccaaagcca

SEQ ID NO: 3203153 - RNA, 22 nt, Human
acugacauuguuggccaaagcc

SEQ ID NO: 3203154 - RNA, 15 nt, Human
acugaaucuguacag

SEQ ID NO: 3203155 - RNA, 14 nt, Human
acugaaucuguaca

SEQ ID NO: 3203156 - RNA, 13 nt, Human
acugaaucuguac

SEQ ID NO: 3203157 - RNA, 20 nt, Human
acugaccagccuccaugcug

SEQ ID NO: 3203158 - RNA, 15 nt, Human
acugaccagccucca

SEQ ID NO: 3203159 - RNA, 13 nt, Human
acugaccagccuc

SEQ ID NO: 3203160 - RNA, 14 nt, Human
acugaccagacaag

SEQ ID NO: 3203161 - RNA, 13 nt, Human
acugaucucucgu

SEQ ID NO: 3203162 - RNA, 23 nt, Human
acugaccagccuccaugcugccu

SEQ ID NO: 3203163 - RNA, 22 nt, Human
acugauggcuaauguacugcau

SEQ ID NO: 3203164 - RNA, 12 nt, Human
acugauggaauu

SEQ ID NO: 3203165 - RNA, 21 nt, Human
acugauggaauuuuuuuguac

SEQ ID NO: 3203166 - RNA, 22 nt, Human
acugauggaauuuuuuuguacg

SEQ ID NO: 3203167 - RNA, 23 nt, Human
acugauggaauuuuuuuguacga

SEQ ID NO: 3203168 - RNA, 22 nt, Human
acugaugggcaacccccagccu

SEQ ID NO: 3203169 - RNA, 12 nt, Human
acugaugggcaa

SEQ ID NO: 3203170 - RNA, 21 nt, Human
acugaaguucugccucugaug

SEQ ID NO: 3203171 - RNA, 12 nt, Human
acugaaguuuga

SEQ ID NO: 3203172 - RNA, 18 nt, Human
acugaaguuugauaaaua

SEQ ID NO: 3203173 - RNA, 15 nt, Human
acugaaguuugauaa

SEQ ID NO: 3203174 - RNA, 23 nt, Human
acugaaguuugauaaauaguguu

SEQ ID NO: 3203175 - RNA, 22 nt, Human
acugaaguuugauaaauagugu

SEQ ID NO: 3203176 - RNA, 21 nt, Human
acugaaguuugauaaauagug

SEQ ID NO: 3203177 - RNA, 19 nt, Human
acugaaguuugauaaauag

SEQ ID NO: 3203178 - RNA, 15 nt, Human
acucugucucagucc

SEQ ID NO: 3203179 - RNA, 19 nt, Human
acucugugucagguggggc

SEQ ID NO: 3203180 - RNA, 21 nt, Human
acucugugucagguggggcag

SEQ ID NO: 3203181 - RNA, 19 nt, Human
acucugucucaaaaaaaca

SEQ ID NO: 3203182 - RNA, 21 nt, Human
acucuacuuagcaugucccua

SEQ ID NO: 3203183 - RNA, 20 nt, Human
acucuacuuagcaugucccu

SEQ ID NO: 3203184 - RNA, 23 nt, Human
acucuaaguuuuaggguacaugu

SEQ ID NO: 3203185 - RNA, 23 nt, Human
acucuaaguguuugcugcaauuu

SEQ ID NO: 3203186 - RNA, 14 nt, Human
acucuaagauguua

SEQ ID NO: 3203187 - RNA, 13 nt, Human
acucuaagauguu

SEQ ID NO: 3203188 - RNA, 16 nt, Human
acucuaaguguuugcu

SEQ ID NO: 3203189 - RNA, 19 nt, Human
acucuaagauguuauauuu

SEQ ID NO: 3203190 - RNA, 14 nt, Human
acucuaacuguaua

SEQ ID NO: 3203191 - RNA, 15 nt, Human
acucuaacuguauau

SEQ ID NO: 3203192 - RNA, 18 nt, Human
acucuaacuguauauuug

SEQ ID NO: 3203193 - RNA, 21 nt, Human
acucuaacuguauauuuguau

SEQ ID NO: 3203194 - RNA, 14 nt, Human
acucuaaagucugu

SEQ ID NO: 3203195 - RNA, 21 nt, Human
acuauuuuuauuuuuaaauua

SEQ ID NO: 3203196 - RNA, 16 nt, Human
acuauuuuuauuuuua

SEQ ID NO: 3203197 - RNA, 15 nt, Human
acugcccggcagggu

SEQ ID NO: 3203198 - RNA, 18 nt, Human
acugccagucccccugcc

SEQ ID NO: 3203199 - RNA, 19 nt, Human
acugccagucccccugccc

SEQ ID NO: 3203200 - RNA, 16 nt, Human
acugcuuuuggucugu

SEQ ID NO: 3203201 - RNA, 15 nt, Human
acugcuuuuggucug

SEQ ID NO: 3203202 - RNA, 14 nt, Human
acugcuuuuggucu

SEQ ID NO: 3203203 - RNA, 22 nt, Human
acugcccggcaggguccuagaa

SEQ ID NO: 3203204 - RNA, 12 nt, Human
acuuuaugcuaa

SEQ ID NO: 3203205 - RNA, 17 nt, Human
acuuuaugcuaagugaa

SEQ ID NO: 3203206 - RNA, 22 nt, Human
acuuucaggccacauggcuaaa

SEQ ID NO: 3203207 - RNA, 16 nt, Human
acuuucacuauaaugu

SEQ ID NO: 3203208 - RNA, 20 nt, Human
acuuucacuauaaugugaaa

SEQ ID NO: 3203209 - RNA, 21 nt, Human
acuuucacuauaaugugaaau

SEQ ID NO: 3203210 - RNA, 23 nt, Human
acuuucacuauaaugugaaaugu

SEQ ID NO: 3203211 - RNA, 21 nt, Human
acuuucaaaguggaugcaauu

SEQ ID NO: 3203212 - RNA, 16 nt, Human
acuuucaagaacuugu

SEQ ID NO: 3203213 - RNA, 19 nt, Human
acuuucaagaacuuguuua

SEQ ID NO: 3203214 - RNA, 22 nt, Human
acuugggaggcugagaugggag

SEQ ID NO: 3203215 - RNA, 20 nt, Human
acuucugccauauucuguug

SEQ ID NO: 3203216 - RNA, 19 nt, Human
acuucugccauauucuguu

SEQ ID NO: 3203217 - RNA, 17 nt, Human
acuucuuauacauuuga

SEQ ID NO: 3203218 - RNA, 14 nt, Human
acuuggcucugagg

SEQ ID NO: 3203219 - RNA, 15 nt, Human
acuucuguuuagucu

SEQ ID NO: 3203220 - RNA, 12 nt, Human
acuucuguuuca

SEQ ID NO: 3203221 - RNA, 15 nt, Human
acuucuguuuucaau

SEQ ID NO: 3203222 - RNA, 14 nt, Human
acuucuguuuucaa

SEQ ID NO: 3203223 - RNA, 23 nt, Human
acuucuguuuucaaucucguaua

SEQ ID NO: 3203224 - RNA, 22 nt, Human
acuucuguuuucaaucucguau

SEQ ID NO: 3203225 - RNA, 17 nt, Human
acuucuguuuucaaucu

SEQ ID NO: 3203226 - RNA, 16 nt, Human
acuucuguuuucaauc

SEQ ID NO: 3203227 - RNA, 23 nt, Human
acuucugccugaggggcagccug

SEQ ID NO: 3203228 - RNA, 13 nt, Human
acuuaaaaauggu

SEQ ID NO: 3203229 - RNA, 14 nt, Human
acuuaaaaaugguu

SEQ ID NO: 3203230 - RNA, 20 nt, Human
acuuaaaauauuccugcauu

SEQ ID NO: 3203231 - RNA, 19 nt, Human
acuuaaagggcccaaugaa

SEQ ID NO: 3203232 - RNA, 21 nt, Human
acuuaaagggcccaaugaauu

SEQ ID NO: 3203233 - RNA, 22 nt, Human
acuuaaaauauuccugcauuug

SEQ ID NO: 3203234 - RNA, 18 nt, Human
aagagaagggcagggcug

SEQ ID NO: 3203235 - RNA, 16 nt, Human
aagacuuuggaaagac

SEQ ID NO: 3203236 - RNA, 20 nt, Human
aagagagaaagcauauugac

SEQ ID NO: 3203237 - RNA, 18 nt, Human
aagagacagagacaagua

SEQ ID NO: 3203238 - RNA, 22 nt, Human
aagagacagagacaaguaauuu

SEQ ID NO: 3203239 - RNA, 14 nt, Human
aagagacaggcagg

SEQ ID NO: 3203240 - RNA, 17 nt, Human
aagagacaauuucugca

SEQ ID NO: 3203241 - RNA, 16 nt, Human
aagacuuuggaaagag

SEQ ID NO: 3203242 - RNA, 19 nt, Human
aagacaggagagauuauuu

SEQ ID NO: 3203243 - RNA, 22 nt, Human
aagacaggagagauuauuuaca

SEQ ID NO: 3203244 - RNA, 19 nt, Human
aacuguuguauaaauuuau

SEQ ID NO: 3203245 - RNA, 22 nt, Human
aacuuacaggugauuaacuugg

SEQ ID NO: 3203246 - RNA, 20 nt, Human
aacuuacauauuuauuuuua

SEQ ID NO: 3203247 - RNA, 13 nt, Human
aacuguuguauaa

SEQ ID NO: 3203248 - RNA, 15 nt, Human
aacuguuguauaaau

SEQ ID NO: 3203249 - RNA, 14 nt, Human
aacuguuguauaaa

SEQ ID NO: 3203250 - RNA, 23 nt, Human
aacuuacccuguauaucagggua

SEQ ID NO: 3203251 - RNA, 21 nt, Human
aagacagcccgauccuccccu

SEQ ID NO: 3203252 - RNA, 16 nt, Human
aagacagcauuugugu

SEQ ID NO: 3203253 - RNA, 20 nt, Human
aacuuagacucuaguauuua

SEQ ID NO: 3203254 - RNA, 15 nt, Human
aacuuagagcuuuuu

SEQ ID NO: 3203255 - RNA, 19 nt, Human
aagauuuugaaauuuuuau

SEQ ID NO: 3203256 - RNA, 23 nt, Human
aagauuuugaucucacauuuuua

SEQ ID NO: 3203257 - RNA, 21 nt, Human
aagauuuugaucucacauuuu

SEQ ID NO: 3203258 - RNA, 20 nt, Human
aagauuuugaucucacauuu

SEQ ID NO: 3203259 - RNA, 13 nt, Human
aagauuuugaucu

SEQ ID NO: 3203260 - RNA, 15 nt, Human
aagcagggacuugaa

SEQ ID NO: 3203261 - RNA, 21 nt, Human
aagcagaggaaggagaggaga

SEQ ID NO: 3203262 - RNA, 15 nt, Human
aagcagaauuggaaa

SEQ ID NO: 3203263 - RNA, 14 nt, Human
aagcagaauuggaa

SEQ ID NO: 3203264 - RNA, 19 nt, Human
aagccaccaacauacuccc

SEQ ID NO: 3203265 - RNA, 18 nt, Human
aagcagguuaaauguuuu

SEQ ID NO: 3203266 - RNA, 17 nt, Human
aagcagguuaaauguuu

SEQ ID NO: 3203267 - RNA, 16 nt, Human
aagcagguuaaauguu

SEQ ID NO: 3203268 - RNA, 15 nt, Human
aagcagguuaaaugu

SEQ ID NO: 3203269 - RNA, 14 nt, Human
aagcagguuaaaug

SEQ ID NO: 3203270 - RNA, 20 nt, Human
aagauucauauuuacuucuu

SEQ ID NO: 3203271 - RNA, 17 nt, Human
aagauucuugguauuug

SEQ ID NO: 3203272 - RNA, 14 nt, Human
aagauucuuuuaaa

SEQ ID NO: 3203273 - RNA, 16 nt, Human
aagauucuuuuaaauu

SEQ ID NO: 3203274 - RNA, 17 nt, Human
aagauucuuuuaaauua

SEQ ID NO: 3203275 - RNA, 20 nt, Human
aagauucuuuuaaauuagaa

SEQ ID NO: 3203276 - RNA, 17 nt, Human
aagauugauguuuccuu

SEQ ID NO: 3203277 - RNA, 12 nt, Human
aagauacuuugu

SEQ ID NO: 3203278 - RNA, 13 nt, Human
aagauacuuugua

SEQ ID NO: 3203279 - RNA, 12 nt, Human
aagauacuguuu

SEQ ID NO: 3203280 - RNA, 17 nt, Human
aagauucaaucccagga

SEQ ID NO: 3203281 - RNA, 20 nt, Human
aagauuauaauuguugcaua

SEQ ID NO: 3203282 - RNA, 19 nt, Human
aagauuauaauuguugcau

SEQ ID NO: 3203283 - RNA, 14 nt, Human
aagauuauaauugu

SEQ ID NO: 3203284 - RNA, 14 nt, Human
aagauacuuuguau

SEQ ID NO: 3203285 - RNA, 16 nt, Human
aagauacuuuguauug

SEQ ID NO: 3203286 - RNA, 19 nt, Human
aagauagaguaaaaagaaa

SEQ ID NO: 3203287 - RNA, 17 nt, Human
aagauagaguaaaaaga

SEQ ID NO: 3203288 - RNA, 18 nt, Human
aagggacgcuacccggga

SEQ ID NO: 3203289 - RNA, 17 nt, Human
aagggacugauguuugu

SEQ ID NO: 3203290 - RNA, 20 nt, Human
aagggacuuggaagcuccgc

SEQ ID NO: 3203291 - RNA, 15 nt, Human
aagggaguuuaaaaa

SEQ ID NO: 3203292 - RNA, 18 nt, Human
aagggaguuuaaaaaugg

SEQ ID NO: 3203293 - RNA, 15 nt, Human
aagggaguuuuugau

SEQ ID NO: 3203294 - RNA, 17 nt, Human
aagggaugaauuguaaa

SEQ ID NO: 3203295 - RNA, 16 nt, Human
aagggauguauuugua

SEQ ID NO: 3203296 - RNA, 17 nt, Human
aagggauggcaagaugu

SEQ ID NO: 3203297 - RNA, 14 nt, Human
aagggauggcaaga

SEQ ID NO: 3203298 - RNA, 15 nt, Human
aagggcaaauaauga

SEQ ID NO: 3203299 - RNA, 16 nt, Human
aagggcacauagaaag

SEQ ID NO: 3203300 - RNA, 13 nt, Human
aagggcagaguua

SEQ ID NO: 3203301 - RNA, 18 nt, Human
aagggcagaaguagggga

SEQ ID NO: 3203302 - RNA, 19 nt, Human
aagggcagaguuacuugau

SEQ ID NO: 3203303 - RNA, 14 nt, Human
aagggcagggacag

SEQ ID NO: 3203304 - RNA, 12 nt, Human
aaguagaggagg

SEQ ID NO: 3203305 - RNA, 19 nt, Human
aaguagacuacuguucagc

SEQ ID NO: 3203306 - RNA, 14 nt, Human
aaguagcacaggcu

SEQ ID NO: 3203307 - RNA, 21 nt, Human
aaguagcaaaugagacagcag

SEQ ID NO: 3203308 - RNA, 13 nt, Human
aaguagauuucau

SEQ ID NO: 3203309 - RNA, 14 nt, Human
aaguagauuucaug

SEQ ID NO: 3203310 - RNA, 22 nt, Human
aaguagccaccugaguuccuga

SEQ ID NO: 3203311 - RNA, 16 nt, Human
aaguagcacaggcuga

SEQ ID NO: 3203312 - RNA, 15 nt, Human
aaguagcacaggcug

SEQ ID NO: 3203313 - RNA, 12 nt, Human
aagguguuugaa

SEQ ID NO: 3203314 - RNA, 17 nt, Human
aaggucuguuugcuguu

SEQ ID NO: 3203315 - RNA, 14 nt, Human
aaggucuguuuuga

SEQ ID NO: 3203316 - RNA, 18 nt, Human
aaggucuguuugcuguug

SEQ ID NO: 3203317 - RNA, 22 nt, Human
aaggucuugcauuuaaaagaca

SEQ ID NO: 3203318 - RNA, 16 nt, Human
aaggucuguuuugagu

SEQ ID NO: 3203319 - RNA, 19 nt, Human
aaggaauuuugcuaaguaa

SEQ ID NO: 3203320 - RNA, 22 nt, Human
aaggacccggaggggccuggca

SEQ ID NO: 3203321 - RNA, 13 nt, Human
aaggacuaggguc

SEQ ID NO: 3203322 - RNA, 24 nt, Human
aaggaccuucacucuaagauguua

SEQ ID NO: 3203323 - RNA, 15 nt, Human
aaggaccuaaaaauu

SEQ ID NO: 3203324 - RNA, 21 nt, Human
aaggacccggaggggccuggc

SEQ ID NO: 3203325 - RNA, 23 nt, Human
aaggaccuucacucuaagauguu

SEQ ID NO: 3203326 - RNA, 22 nt, Human
aaggaccuucacucuaagaugu

SEQ ID NO: 3203327 - RNA, 21 nt, Human
aaggaccuucacucuaagaug

SEQ ID NO: 3203328 - RNA, 20 nt, Human
aaggaccuucacucuaagau

SEQ ID NO: 3203329 - RNA, 22 nt, Human
aaggcaaaccuuucuauaauuu

SEQ ID NO: 3203330 - RNA, 15 nt, Human
aaggcaaacauuuga

SEQ ID NO: 3203331 - RNA, 13 nt, Human
aaggcagagaaau

SEQ ID NO: 3203332 - RNA, 15 nt, Human
aaggcagagaaaucu

SEQ ID NO: 3203333 - RNA, 22 nt, Human
aaggcagagaaaucuaagcugu

SEQ ID NO: 3203334 - RNA, 19 nt, Human
aaggcagaaagcaaaauua

SEQ ID NO: 3203335 - RNA, 17 nt, Human
aaggcagaaagcaaaau

SEQ ID NO: 3203336 - RNA, 16 nt, Human
aaggcagaaagcaaaa

SEQ ID NO: 3203337 - RNA, 15 nt, Human
aaggcagaaagcaaa

SEQ ID NO: 3203338 - RNA, 23 nt, Human
aaggaaucuagccagugaacaua

SEQ ID NO: 3203339 - RNA, 18 nt, Human
aaggaaucuagccaguga

SEQ ID NO: 3203340 - RNA, 23 nt, Human
aaggaaugauuaauuaaaacaca

SEQ ID NO: 3203341 - RNA, 21 nt, Human
aaggaauaugggagaaauagu

SEQ ID NO: 3203342 - RNA, 16 nt, Human
aagcugcugacagugu

SEQ ID NO: 3203343 - RNA, 13 nt, Human
aagcugcugugau

SEQ ID NO: 3203344 - RNA, 11 nt, Human
aagcugccagc

SEQ ID NO: 3203345 - RNA, 12 nt, Human
aagcugccagcc

SEQ ID NO: 3203346 - RNA, 22 nt, Human
aagcugccagccgagauagcca

SEQ ID NO: 3203347 - RNA, 14 nt, Human
aagcugcugacagu

SEQ ID NO: 3203348 - RNA, 20 nt, Human
aagcgugagccacugcaccg

SEQ ID NO: 3203349 - RNA, 17 nt, Human
aagcgugagccacugca

SEQ ID NO: 3203350 - RNA, 16 nt, Human
aagccacccaaagcag

SEQ ID NO: 3203351 - RNA, 21 nt, Human
aagccaccaacauacucccau

SEQ ID NO: 3203352 - RNA, 14 nt, Human
aagccaccagaugu

SEQ ID NO: 3203353 - RNA, 14 nt, Human
aagccaccaacagc

SEQ ID NO: 3203354 - RNA, 21 nt, Human
aagcagguuaaauguuuugua

SEQ ID NO: 3203355 - RNA, 20 nt, Human
aagcagguuaaauguuuugu

SEQ ID NO: 3203356 - RNA, 15 nt, Human
aagccagcaggcucu

SEQ ID NO: 3203357 - RNA, 18 nt, Human
aagccagcaggcucucag

SEQ ID NO: 3203358 - RNA, 16 nt, Human
aagcgauucuucugcu

SEQ ID NO: 3203359 - RNA, 16 nt, Human
aagcgugagccacugc

SEQ ID NO: 3203360 - RNA, 14 nt, Human
aagcgauucuucug

SEQ ID NO: 3203361 - RNA, 15 nt, Human
aagcgauucuucugc

SEQ ID NO: 3203362 - RNA, 18 nt, Human
aauccaaccauuuucauu

SEQ ID NO: 3203363 - RNA, 16 nt, Human
aauccaaauauuguua

SEQ ID NO: 3203364 - RNA, 14 nt, Human
aauccaaauauugu

SEQ ID NO: 3203365 - RNA, 16 nt, Human
aauccaaaagaaaaac

SEQ ID NO: 3203366 - RNA, 15 nt, Human
aauccaaaagaaaaa

SEQ ID NO: 3203367 - RNA, 18 nt, Human
aauccacauguuucagag

SEQ ID NO: 3203368 - RNA, 21 nt, Human
aauccaaauauuguuaaggga

SEQ ID NO: 3203369 - RNA, 20 nt, Human
aauccagaaacuuguucuuc

SEQ ID NO: 3203370 - RNA, 19 nt, Human
aauccagaaacuuguucuu

SEQ ID NO: 3203371 - RNA, 19 nt, Human
aauccaucagugccaaacu

SEQ ID NO: 3203372 - RNA, 23 nt, Human
aaucucgcucugucgcccaggcu

SEQ ID NO: 3203373 - RNA, 18 nt, Human
aaucucggcucacugcau

SEQ ID NO: 3203374 - RNA, 20 nt, Human
aaucucguauagaagucuuc

SEQ ID NO: 3203375 - RNA, 19 nt, Human
aaucucguauagaagucuu

SEQ ID NO: 3203376 - RNA, 16 nt, Human
aaucuggacuccucug

SEQ ID NO: 3203377 - RNA, 15 nt, Human
aaucuggacuccucu

SEQ ID NO: 3203378 - RNA, 24 nt, Human
aaucuggaccccaucugugaauaa

SEQ ID NO: 3203379 - RNA, 23 nt, Human
aaucuggaccccaucugugaaua

SEQ ID NO: 3203380 - RNA, 18 nt, Human
aaucuggacuccucuguc

SEQ ID NO: 3203381 - RNA, 17 nt, Human
aaucuggacuccucugu

SEQ ID NO: 3203382 - RNA, 20 nt, Human
aaucuggacuccucugucca

SEQ ID NO: 3203383 - RNA, 14 nt, Human
aaugaaauguaugc

SEQ ID NO: 3203384 - RNA, 20 nt, Human
aaugaacacaaauuaugcua

SEQ ID NO: 3203385 - RNA, 17 nt, Human
aaugaacacaaauuaug

SEQ ID NO: 3203386 - RNA, 14 nt, Human
aaugaacacaaauu

SEQ ID NO: 3203387 - RNA, 21 nt, Human
aaugaacaagcauucucucca

SEQ ID NO: 3203388 - RNA, 15 nt, Human
aaugaacaagcauuc

SEQ ID NO: 3203389 - RNA, 14 nt, Human
aaugaacaaaauua

SEQ ID NO: 3203390 - RNA, 16 nt, Human
aaugaacaaaauuauu

SEQ ID NO: 3203391 - RNA, 17 nt, Human
aaugaacaaaauuauuu

SEQ ID NO: 3203392 - RNA, 16 nt, Human
aaugaacaaagaccaa

SEQ ID NO: 3203393 - RNA, 12 nt, Human
aaugauuaauua

SEQ ID NO: 3203394 - RNA, 13 nt, Human
aaugauuaauuaa

SEQ ID NO: 3203395 - RNA, 19 nt, Human
aaugaugugccugcuucag

SEQ ID NO: 3203396 - RNA, 15 nt, Human
aaugauagcuacugu

SEQ ID NO: 3203397 - RNA, 23 nt, Human
aaugauauacugaucuucauuac

SEQ ID NO: 3203398 - RNA, 17 nt, Human
aaugauaugcuuguaac

SEQ ID NO: 3203399 - RNA, 15 nt, Human
aaugauaugcuugua

SEQ ID NO: 3203400 - RNA, 20 nt, Human
aaugauguauguugaagccu

SEQ ID NO: 3203401 - RNA, 18 nt, Human
aaugauaugcuuguaacu

SEQ ID NO: 3203402 - RNA, 19 nt, Human
aaugauaugcuuguaacua

SEQ ID NO: 3203403 - RNA, 14 nt, Human
aaugauauugcuga

SEQ ID NO: 3203404 - RNA, 16 nt, Human
aaugauauugcugaag

SEQ ID NO: 3203405 - RNA, 22 nt, Human
aaugauauugcugaagaaucua

SEQ ID NO: 3203406 - RNA, 23 nt, Human
aaugauguauguugaagccuuug

SEQ ID NO: 3203407 - RNA, 22 nt, Human
aaucauuucugcaucagcugcu

SEQ ID NO: 3203408 - RNA, 11 nt, Human
aaucauuuguu

SEQ ID NO: 3203409 - RNA, 19 nt, Human
aaucauuuuuuauauauau

SEQ ID NO: 3203410 - RNA, 18 nt, Human
aaucauuuuuuauauaua

SEQ ID NO: 3203411 - RNA, 24 nt, Human
aaucauuuuuuauauauaugcaua

SEQ ID NO: 3203412 - RNA, 23 nt, Human
aaucauuuuuuauauauaugcau

SEQ ID NO: 3203413 - RNA, 22 nt, Human
aaucauuuuuuauauauaugca

SEQ ID NO: 3203414 - RNA, 21 nt, Human
aaucauuuuuuauauauaugc

SEQ ID NO: 3203415 - RNA, 18 nt, Human
aaucauuuguucaaagcu

SEQ ID NO: 3203416 - RNA, 22 nt, Human
aaucaaauaugcaaagcacuga

SEQ ID NO: 3203417 - RNA, 13 nt, Human
aaucaaauaauac

SEQ ID NO: 3203418 - RNA, 21 nt, Human
aaucaaauaauaccuuagaag

SEQ ID NO: 3203419 - RNA, 16 nt, Human
aaucaaauaauaccuu

SEQ ID NO: 3203420 - RNA, 13 nt, Human
aaucaaauguaaa

SEQ ID NO: 3203421 - RNA, 16 nt, Human
aaucaaauaugcaaag

SEQ ID NO: 3203422 - RNA, 15 nt, Human
aaucaaauaugcaaa

SEQ ID NO: 3203423 - RNA, 15 nt, Human
aaucaaauguaaagu

SEQ ID NO: 3203424 - RNA, 14 nt, Human
aaucaaauguaaag

SEQ ID NO: 3203425 - RNA, 15 nt, Human
aaugucacaggcagg

SEQ ID NO: 3203426 - RNA, 16 nt, Human
aaugguaucaaaauua

SEQ ID NO: 3203427 - RNA, 18 nt, Human
aaugguaucaaaauuaca

SEQ ID NO: 3203428 - RNA, 23 nt, Human
aaugcucuuuacuucauggacuu

SEQ ID NO: 3203429 - RNA, 14 nt, Human
aaugggagcucaug

SEQ ID NO: 3203430 - RNA, 13 nt, Human
aaugggacacuaa

SEQ ID NO: 3203431 - RNA, 21 nt, Human
aaugggaggggaaaugggaau

SEQ ID NO: 3203432 - RNA, 15 nt, Human
aaugcuagaaaaauu

SEQ ID NO: 3203433 - RNA, 17 nt, Human
aaugcgcaggcuggccc

SEQ ID NO: 3203434 - RNA, 18 nt, Human
aaugcgcaggcuggcccu

SEQ ID NO: 3203435 - RNA, 19 nt, Human
aaugcgcaggcuggcccug

SEQ ID NO: 3203436 - RNA, 20 nt, Human
aaugcgcaggcuggcccugc

SEQ ID NO: 3203437 - RNA, 15 nt, Human
aaugcgcaggcuggc

SEQ ID NO: 3203438 - RNA, 14 nt, Human
aaugcgcaggcugg

SEQ ID NO: 3203439 - RNA, 23 nt, Human
aaugccucuggcucuacacauau

SEQ ID NO: 3203440 - RNA, 13 nt, Human
aaugccugcuuuu

SEQ ID NO: 3203441 - RNA, 17 nt, Human
aaugccugcuuuuugga

SEQ ID NO: 3203442 - RNA, 19 nt, Human
aaugccugcuuuuuggaaa

SEQ ID NO: 3203443 - RNA, 16 nt, Human
aaugccucuugucuuc

SEQ ID NO: 3203444 - RNA, 15 nt, Human
aaugccuauuguaau

SEQ ID NO: 3203445 - RNA, 17 nt, Human
aaugccuauuguaauau

SEQ ID NO: 3203446 - RNA, 20 nt, Human
aaugccucuccuuaaaugcu

SEQ ID NO: 3203447 - RNA, 22 nt, Human
aaugccucuccuuaaaugcuuc

SEQ ID NO: 3203448 - RNA, 21 nt, Human
aaugccgcccucccagcucug

SEQ ID NO: 3203449 - RNA, 21 nt, Human
aauaaagccuugugaucacuu

SEQ ID NO: 3203450 - RNA, 10 nt, Human
aauaaaccau

SEQ ID NO: 3203451 - RNA, 18 nt, Human
aaguugauggugaugaaa

SEQ ID NO: 3203452 - RNA, 15 nt, Human
aaguugaucucccca

SEQ ID NO: 3203453 - RNA, 17 nt, Human
aaguugaucuccccagc

SEQ ID NO: 3203454 - RNA, 15 nt, Human
aaguucuuugauucu

SEQ ID NO: 3203455 - RNA, 14 nt, Human
aaguucuuugauuc

SEQ ID NO: 3203456 - RNA, 22 nt, Human
aaguucugccucugauguauuu

SEQ ID NO: 3203457 - RNA, 17 nt, Human
aaguucugccucugaug

SEQ ID NO: 3203458 - RNA, 16 nt, Human
aaguucugccucugau

SEQ ID NO: 3203459 - RNA, 15 nt, Human
aaguucugccucuga

SEQ ID NO: 3203460 - RNA, 17 nt, Human
aaguucugcagauaaac

SEQ ID NO: 3203461 - RNA, 15 nt, Human
aaguggggacagagc

SEQ ID NO: 3203462 - RNA, 13 nt, Human
aagugcuauuacg

SEQ ID NO: 3203463 - RNA, 18 nt, Human
aagugcuauuacgaaguu

SEQ ID NO: 3203464 - RNA, 15 nt, Human
aaguauaaacuuuua

SEQ ID NO: 3203465 - RNA, 15 nt, Human
aaguauaaauuugug

SEQ ID NO: 3203466 - RNA, 16 nt, Human
aaguauaaauuugugu

SEQ ID NO: 3203467 - RNA, 18 nt, Human
aaguauaaauuuguguaa

SEQ ID NO: 3203468 - RNA, 20 nt, Human
aaguauaaauuuguguaaua

SEQ ID NO: 3203469 - RNA, 21 nt, Human
aaguauaaauuuguguaauau

SEQ ID NO: 3203470 - RNA, 13 nt, Human
aaguauaauguuu

SEQ ID NO: 3203471 - RNA, 20 nt, Human
aaguauaauguuuauuaaau

SEQ ID NO: 3203472 - RNA, 22 nt, Human
aaguauaauguuuauuaaaugc

SEQ ID NO: 3203473 - RNA, 23 nt, Human
aaguagugucuggaucaguaaaa

SEQ ID NO: 3203474 - RNA, 14 nt, Human
aaguaguucuguau

SEQ ID NO: 3203475 - RNA, 23 nt, Human
aaguaguucuguauuugaaagug

SEQ ID NO: 3203476 - RNA, 21 nt, Human
aaguaguucuguauuugaaag

SEQ ID NO: 3203477 - RNA, 22 nt, Human
aaguaguucuguauuugaaagu

SEQ ID NO: 3203478 - RNA, 16 nt, Human
aaguaguucuguauuu

SEQ ID NO: 3203479 - RNA, 19 nt, Human
aaguaguucuguauuugaa

SEQ ID NO: 3203480 - RNA, 20 nt, Human
aaguaguucuguauuugaaa

SEQ ID NO: 3203481 - RNA, 19 nt, Human
aauaauguuaacauggaca

SEQ ID NO: 3203482 - RNA, 20 nt, Human
aauaauauguuuccuucccu

SEQ ID NO: 3203483 - RNA, 17 nt, Human
aauaaagcgaaaaacuc

SEQ ID NO: 3203484 - RNA, 15 nt, Human
aauaauaccuuagaa

SEQ ID NO: 3203485 - RNA, 18 nt, Human
aauaauagauugugaaua

SEQ ID NO: 3203486 - RNA, 16 nt, Human
aauaauaccuuagaag

SEQ ID NO: 3203487 - RNA, 17 nt, Human
aauaugcuuauaaccua

SEQ ID NO: 3203488 - RNA, 12 nt, Human
aauauaaaugug

SEQ ID NO: 3203489 - RNA, 13 nt, Human
aauauaaaugugu

SEQ ID NO: 3203490 - RNA, 16 nt, Human
aauauaaaugugugua

SEQ ID NO: 3203491 - RNA, 20 nt, Human
aauauaaauguguguaugug

SEQ ID NO: 3203492 - RNA, 19 nt, Human
aauauagauuaaaucauac

SEQ ID NO: 3203493 - RNA, 17 nt, Human
aauauagauuaaaucau

SEQ ID NO: 3203494 - RNA, 15 nt, Human
aauauagauuaaauc

SEQ ID NO: 3203495 - RNA, 13 nt, Human
aauauagaaaaaa

SEQ ID NO: 3203496 - RNA, 21 nt, Human
aauauagaaaaaaacauucua

SEQ ID NO: 3203497 - RNA, 22 nt, Human
aauauagaaaaaaacauucuau

SEQ ID NO: 3203498 - RNA, 21 nt, Human
aauaccugucccccugacaac

SEQ ID NO: 3203499 - RNA, 13 nt, Human
aauaccuuagaag

SEQ ID NO: 3203500 - RNA, 16 nt, Human
aauacuguuauucuuu

SEQ ID NO: 3203501 - RNA, 20 nt, Human
aauacuuaaauguuauguau

SEQ ID NO: 3203502 - RNA, 18 nt, Human
aauacuuaaauguuaugu

SEQ ID NO: 3203503 - RNA, 15 nt, Human
aauacuuaaauguua

SEQ ID NO: 3203504 - RNA, 14 nt, Human
aauacuuaaauguu

SEQ ID NO: 3203505 - RNA, 22 nt, Human
aauacuguuauucuuugcacuu

SEQ ID NO: 3203506 - RNA, 21 nt, Human
aauacuguuauucuuugcacu

SEQ ID NO: 3203507 - RNA, 19 nt, Human
aauacuguuauucuuugca

SEQ ID NO: 3203508 - RNA, 18 nt, Human
aauacuguuauucuuugc

SEQ ID NO: 3203509 - RNA, 17 nt, Human
aauacuguuauucuuug

SEQ ID NO: 3203510 - RNA, 14 nt, Human
aauacuugaaccau

SEQ ID NO: 3203511 - RNA, 17 nt, Human
aauacuugaaccauaaa

SEQ ID NO: 3203512 - RNA, 19 nt, Human
aauacuugaaccauaaaau

SEQ ID NO: 3203513 - RNA, 22 nt, Human
aauacuugaaccauaaaauguc

SEQ ID NO: 3203514 - RNA, 14 nt, Human
aauacuucuuuuua

SEQ ID NO: 3203515 - RNA, 19 nt, Human
aauagaacaacauauacaa

SEQ ID NO: 3203516 - RNA, 20 nt, Human
aauaguuuauuuuaaaacaa

SEQ ID NO: 3203517 - RNA, 22 nt, Human
aauaguuuauuuuaaaacaaua

SEQ ID NO: 3203518 - RNA, 22 nt, Human
aauagaagcuaagguuuagaua

SEQ ID NO: 3203519 - RNA, 19 nt, Human
aauaguuuauuuuaaaaca

SEQ ID NO: 3203520 - RNA, 12 nt, Human
aauauaaaaaau

SEQ ID NO: 3203521 - RNA, 16 nt, Human
aauauaaaaaaucaug

SEQ ID NO: 3203522 - RNA, 20 nt, Human
aauauaaaaaaucaugccag

SEQ ID NO: 3203523 - RNA, 15 nt, Human
aacauccuacaagac

SEQ ID NO: 3203524 - RNA, 22 nt, Human
aacauccuacaagacacaguga

SEQ ID NO: 3203525 - RNA, 16 nt, Human
aacagcuaugagagga

SEQ ID NO: 3203526 - RNA, 20 nt, Human
aacagcggcuggacuuggag

SEQ ID NO: 3203527 - RNA, 16 nt, Human
aacagcuaaugggaca

SEQ ID NO: 3203528 - RNA, 15 nt, Human
aacagauuuggaaag

SEQ ID NO: 3203529 - RNA, 14 nt, Human
aacagauuuggaaa

SEQ ID NO: 3203530 - RNA, 13 nt, Human
aacagauuuggaa

SEQ ID NO: 3203531 - RNA, 24 nt, Human
aacagauuggauuuuauguugaca

SEQ ID NO: 3203532 - RNA, 13 nt, Human
aacccuucagugc

SEQ ID NO: 3203533 - RNA, 18 nt, Human
aaccauaaaauguccagu

SEQ ID NO: 3203534 - RNA, 12 nt, Human
aaccauaguuac

SEQ ID NO: 3203535 - RNA, 15 nt, Human
aacauggaaguacua

SEQ ID NO: 3203536 - RNA, 17 nt, Human
aaccaggcuuucuagaa

SEQ ID NO: 3203537 - RNA, 14 nt, Human
aaccaggcuuucua

SEQ ID NO: 3203538 - RNA, 21 nt, Human
aaccaggcuuucuagaaagaa

SEQ ID NO: 3203539 - RNA, 18 nt, Human
aaccagguccagaugugc

SEQ ID NO: 3203540 - RNA, 18 nt, Human
aacaucucaucaugucua

SEQ ID NO: 3203541 - RNA, 14 nt, Human
aacaugcuguguaa

SEQ ID NO: 3203542 - RNA, 17 nt, Human
aacaugcuguguaagcu

SEQ ID NO: 3203543 - RNA, 19 nt, Human
aacaugcuguguaagcugu

SEQ ID NO: 3203544 - RNA, 21 nt, Human
aacaugcuguguaagcugugu

SEQ ID NO: 3203545 - RNA, 21 nt, Human
aacguagucggcacagccugg

SEQ ID NO: 3203546 - RNA, 15 nt, Human
aacucaccccagccc

SEQ ID NO: 3203547 - RNA, 18 nt, Human
aacucaccccagccccaa

SEQ ID NO: 3203548 - RNA, 16 nt, Human
aacucaccccagcccc

SEQ ID NO: 3203549 - RNA, 17 nt, Human
aacucaccccagcccca

SEQ ID NO: 3203550 - RNA, 17 nt, Human
aacucaaacucuuaaaa

SEQ ID NO: 3203551 - RNA, 22 nt, Human
aacucaaggauaccuucuuauu

SEQ ID NO: 3203552 - RNA, 23 nt, Human
aacucaaccaaaugguacaaaac

SEQ ID NO: 3203553 - RNA, 19 nt, Human
aacucaaccaaaugguaca

SEQ ID NO: 3203554 - RNA, 17 nt, Human
aacucaaccaaauggua

SEQ ID NO: 3203555 - RNA, 21 nt, Human
aacugagcuuggaagcuucug

SEQ ID NO: 3203556 - RNA, 17 nt, Human
aacugagcuuggaagcu

SEQ ID NO: 3203557 - RNA, 13 nt, Human
aacugagcuugga

SEQ ID NO: 3203558 - RNA, 23 nt, Human
aacugagaugugaacacaucagc

SEQ ID NO: 3203559 - RNA, 14 nt, Human
aacuguuagaaugu

SEQ ID NO: 3203560 - RNA, 23 nt, Human
aacuguuaccauuggaaauuuca

SEQ ID NO: 3203561 - RNA, 19 nt, Human
aacuguuaccauuggaaau

SEQ ID NO: 3203562 - RNA, 16 nt, Human
aacuguuagaauguaa

SEQ ID NO: 3203563 - RNA, 14 nt, Human
aacuguuacaguaa

SEQ ID NO: 3203564 - RNA, 15 nt, Human
aacuguuacaguaau

SEQ ID NO: 3203565 - RNA, 14 nt, Human
aacuguuaccauug

SEQ ID NO: 3203566 - RNA, 18 nt, Human
aacuguuaccauuggaaa

SEQ ID NO: 3203567 - RNA, 17 nt, Human
aacuguuaccauuggaa

SEQ ID NO: 3203568 - RNA, 15 nt, Human
aacuguuaacuuauu

SEQ ID NO: 3203569 - RNA, 20 nt, Human
aacugaauagcaaguggcau

SEQ ID NO: 3203570 - RNA, 13 nt, Human
aacugaauuugga

SEQ ID NO: 3203571 - RNA, 14 nt, Human
aacugaauuuggag

SEQ ID NO: 3203572 - RNA, 13 nt, Human
aacugaaguucug

SEQ ID NO: 3203573 - RNA, 14 nt, Human
aacgaaaaucauug

SEQ ID NO: 3203574 - RNA, 17 nt, Human
aacgaucacaaaugacu

SEQ ID NO: 3203575 - RNA, 21 nt, Human
aacgagccuuuucacccuucu

SEQ ID NO: 3203576 - RNA, 17 nt, Human
aacgacaaaucugucug

SEQ ID NO: 3203577 - RNA, 18 nt, Human
aacgacaaaucugucugc

SEQ ID NO: 3203578 - RNA, 17 nt, Human
aacacauaauuaacacu

SEQ ID NO: 3203579 - RNA, 18 nt, Human
aacacauaauuaacacuu

SEQ ID NO: 3203580 - RNA, 21 nt, Human
aacacauacaggaagguagaa

SEQ ID NO: 3203581 - RNA, 16 nt, Human
aacacaggccacccug

SEQ ID NO: 3203582 - RNA, 14 nt, Human
aacaaaucuuccug

SEQ ID NO: 3203583 - RNA, 13 nt, Human
aacaaaucuuccu

SEQ ID NO: 3203584 - RNA, 22 nt, Human
aacaaaccuguuucugcagcca

SEQ ID NO: 3203585 - RNA, 14 nt, Human
aacaaacugcacau

SEQ ID NO: 3203586 - RNA, 22 nt, Human
aacaaaggccuaauucuaugcc

SEQ ID NO: 3203587 - RNA, 18 nt, Human
aacaaauccugcauuuag

SEQ ID NO: 3203588 - RNA, 15 nt, Human
aaauugggguuuauu

SEQ ID NO: 3203589 - RNA, 20 nt, Human
aaauugguaccuugcacaca

SEQ ID NO: 3203590 - RNA, 18 nt, Human
aaauugguaccuugcaca

SEQ ID NO: 3203591 - RNA, 16 nt, Human
aaauugguaccuugca

SEQ ID NO: 3203592 - RNA, 17 nt, Human
aacaaacagaugcucug

SEQ ID NO: 3203593 - RNA, 14 nt, Human
aacaaacagaugcu

SEQ ID NO: 3203594 - RNA, 12 nt, Human
aaauuaaaaaaa

SEQ ID NO: 3203595 - RNA, 15 nt, Human
aaauuaaaaaaaaau

SEQ ID NO: 3203596 - RNA, 17 nt, Human
aaauuaaaaaaaaauug

SEQ ID NO: 3203597 - RNA, 22 nt, Human
aaauuaaaaaaaaauuguaucu

SEQ ID NO: 3203598 - RNA, 21 nt, Human
aaauuaaaaguuugaaaagca

SEQ ID NO: 3203599 - RNA, 22 nt, Human
aaauugacacuuaaaaaugguu

SEQ ID NO: 3203600 - RNA, 13 nt, Human
aaauugacuguac

SEQ ID NO: 3203601 - RNA, 14 nt, Human
aaauugacuguacu

SEQ ID NO: 3203602 - RNA, 23 nt, Human
aaauugagcugcuuuuuuugaaa

SEQ ID NO: 3203603 - RNA, 16 nt, Human
aaauugagcugcuuuu

SEQ ID NO: 3203604 - RNA, 13 nt, Human
aaauguucuucca

SEQ ID NO: 3203605 - RNA, 15 nt, Human
aaauguucuuccagu

SEQ ID NO: 3203606 - RNA, 17 nt, Human
aaauguucaucaaugaa

SEQ ID NO: 3203607 - RNA, 20 nt, Human
aaauguucaucaaugaauga

SEQ ID NO: 3203608 - RNA, 15 nt, Human
aaaucugaagauugu

SEQ ID NO: 3203609 - RNA, 17 nt, Human
aaaucugaagauuguuu

SEQ ID NO: 3203610 - RNA, 16 nt, Human
aaaucugaagauuguu

SEQ ID NO: 3203611 - RNA, 21 nt, Human
aaaucugaagauuguuuaucu

SEQ ID NO: 3203612 - RNA, 20 nt, Human
aaaucugaagauuguuuauc

SEQ ID NO: 3203613 - RNA, 19 nt, Human
aaaucugaagauuguuuau

SEQ ID NO: 3203614 - RNA, 18 nt, Human
aaaucugaagauuguuua

SEQ ID NO: 3203615 - RNA, 22 nt, Human
aaaucucuacaaauuuuucugu

SEQ ID NO: 3203616 - RNA, 12 nt, Human
aaaucucuucug

SEQ ID NO: 3203617 - RNA, 13 nt, Human
aaaucucuucugu

SEQ ID NO: 3203618 - RNA, 13 nt, Human
aaaucugaacauu

SEQ ID NO: 3203619 - RNA, 16 nt, Human
aaaucugaacauucuc

SEQ ID NO: 3203620 - RNA, 14 nt, Human
aaaucuuaagaaau

SEQ ID NO: 3203621 - RNA, 13 nt, Human
aaaucuuaagaaa

SEQ ID NO: 3203622 - RNA, 15 nt, Human
aaaugcuagaaaaau

SEQ ID NO: 3203623 - RNA, 19 nt, Human
aaaugcuaugucauuucau

SEQ ID NO: 3203624 - RNA, 17 nt, Human
aaaugcuaugucauuuc

SEQ ID NO: 3203625 - RNA, 16 nt, Human
aaaugcuaugucauuu

SEQ ID NO: 3203626 - RNA, 14 nt, Human
aaaucuuaacuuga

SEQ ID NO: 3203627 - RNA, 12 nt, Human
aaaucuuaagaa

SEQ ID NO: 3203628 - RNA, 15 nt, Human
aaaucugcuguuaac

SEQ ID NO: 3203629 - RNA, 23 nt, Human
aaaucugcaaagcauguuuugca

SEQ ID NO: 3203630 - RNA, 17 nt, Human
aaaucugcaaagcaugu

SEQ ID NO: 3203631 - RNA, 15 nt, Human
aaaucugcaaagcau

SEQ ID NO: 3203632 - RNA, 23 nt, Human
aaaucugaagauuguuuaucuag

SEQ ID NO: 3203633 - RNA, 15 nt, Human
aaauggacguguuau

SEQ ID NO: 3203634 - RNA, 17 nt, Human
aaauggacguguuauga

SEQ ID NO: 3203635 - RNA, 14 nt, Human
aaauggacguguua

SEQ ID NO: 3203636 - RNA, 21 nt, Human
aaaugcugauuuaaacuucuu

SEQ ID NO: 3203637 - RNA, 21 nt, Human
aaaugcuaugucauuucaugu

SEQ ID NO: 3203638 - RNA, 20 nt, Human
aaaugcuaugucauuucaug

SEQ ID NO: 3203639 - RNA, 22 nt, Human
aaaugcuaugucauuucauguc

SEQ ID NO: 3203640 - RNA, 16 nt, Human
aaaugcugaaaauugc

SEQ ID NO: 3203641 - RNA, 15 nt, Human
aaaugcugaacauug

SEQ ID NO: 3203642 - RNA, 12 nt, Human
aaaugcugaaca

SEQ ID NO: 3203643 - RNA, 14 nt, Human
aaaugcugauuuaa

SEQ ID NO: 3203644 - RNA, 16 nt, Human
aaaugcugacccaugg

SEQ ID NO: 3203645 - RNA, 12 nt, Human
aaaugcugaccc

SEQ ID NO: 3203646 - RNA, 17 nt, Human
aaaugcugaaaauugcc

SEQ ID NO: 3203647 - RNA, 14 nt, Human
aaaauccaaauauu

SEQ ID NO: 3203648 - RNA, 19 nt, Human
aaaauccaaauauuguuaa

SEQ ID NO: 3203649 - RNA, 16 nt, Human
aaaauccaaauauugu

SEQ ID NO: 3203650 - RNA, 15 nt, Human
aaaaucacuuucaua

SEQ ID NO: 3203651 - RNA, 17 nt, Human
aaaaucacuuucauaau

SEQ ID NO: 3203652 - RNA, 20 nt, Human
aaaaucacuuucauaaucuu

SEQ ID NO: 3203653 - RNA, 18 nt, Human
aaaaucaauaugcagaau

SEQ ID NO: 3203654 - RNA, 21 nt, Human
aaaaucauuucugcaucagcu

SEQ ID NO: 3203655 - RNA, 14 nt, Human
aaaaucacguuaaa

SEQ ID NO: 3203656 - RNA, 16 nt, Human
aaaaucaaguauuaua

SEQ ID NO: 3203657 - RNA, 15 nt, Human
aaaaucaaguauuau

SEQ ID NO: 3203658 - RNA, 14 nt, Human
aaaaucaaauaaua

SEQ ID NO: 3203659 - RNA, 17 nt, Human
aaaauauuuuuuuuucu

SEQ ID NO: 3203660 - RNA, 21 nt, Human
aaaauaaaaaaaagaaaaaag

SEQ ID NO: 3203661 - RNA, 17 nt, Human
aaaaguuugaaaagcaa

SEQ ID NO: 3203662 - RNA, 18 nt, Human
aaaaguuugaaaagcaau

SEQ ID NO: 3203663 - RNA, 23 nt, Human
aaaaguuugaaaagcaauauugu

SEQ ID NO: 3203664 - RNA, 18 nt, Human
aaaauaaaaaaaagaaaa

SEQ ID NO: 3203665 - RNA, 17 nt, Human
aaaauaaaaaaaagaaa

SEQ ID NO: 3203666 - RNA, 16 nt, Human
aaaauaaaaaaaagaa

SEQ ID NO: 3203667 - RNA, 15 nt, Human
aaaauaaaaaaaaga

SEQ ID NO: 3203668 - RNA, 23 nt, Human
aaaauuaaucugggccagaauuu

SEQ ID NO: 3203669 - RNA, 17 nt, Human
aaaauuaagguguuuga

SEQ ID NO: 3203670 - RNA, 18 nt, Human
aaaauuaagguguuugaa

SEQ ID NO: 3203671 - RNA, 22 nt, Human
aaaauccagaaacuuguucuuc

SEQ ID NO: 3203672 - RNA, 21 nt, Human
aaaauccagaaacuuguucuu

SEQ ID NO: 3203673 - RNA, 12 nt, Human
aaaauccagaaa

SEQ ID NO: 3203674 - RNA, 22 nt, Human
aaaauccaaauauuguuaaggg

SEQ ID NO: 3203675 - RNA, 15 nt, Human
aaaauuagccaagug

SEQ ID NO: 3203676 - RNA, 20 nt, Human
aaaauuaagguguuugaaaa

SEQ ID NO: 3203677 - RNA, 14 nt, Human
aaaauuacaacuaa

SEQ ID NO: 3203678 - RNA, 13 nt, Human
aaaauuauacugu

SEQ ID NO: 3203679 - RNA, 15 nt, Human
aaaauuauacugugu

SEQ ID NO: 3203680 - RNA, 18 nt, Human
aaaauuauacugugugug

SEQ ID NO: 3203681 - RNA, 19 nt, Human
aaaauuaggauuucaugau

SEQ ID NO: 3203682 - RNA, 17 nt, Human
aaaauuagccuaagaua

SEQ ID NO: 3203683 - RNA, 19 nt, Human
aaaauuauugauugcuuuu

SEQ ID NO: 3203684 - RNA, 23 nt, Human
aaaauuauguuugccacuuugca

SEQ ID NO: 3203685 - RNA, 13 nt, Human
aaaauuauuugua

SEQ ID NO: 3203686 - RNA, 17 nt, Human
aaaauuccaaauucaug

SEQ ID NO: 3203687 - RNA, 17 nt, Human
aaaauuccagaaugaag

SEQ ID NO: 3203688 - RNA, 15 nt, Human
aaaauucccuaaagc

SEQ ID NO: 3203689 - RNA, 16 nt, Human
aaaauucccuaaagcc

SEQ ID NO: 3203690 - RNA, 17 nt, Human
aaacagcuaaugggaca

SEQ ID NO: 3203691 - RNA, 13 nt, Human
aaagaggugugca

SEQ ID NO: 3203692 - RNA, 18 nt, Human
aaagaggucgcuugggaa

SEQ ID NO: 3203693 - RNA, 13 nt, Human
aaagauaaauauu

SEQ ID NO: 3203694 - RNA, 15 nt, Human
aaagauaaauauuau

SEQ ID NO: 3203695 - RNA, 14 nt, Human
aaagauaaauauua

SEQ ID NO: 3203696 - RNA, 16 nt, Human
aaagauaaauauuaua

SEQ ID NO: 3203697 - RNA, 19 nt, Human
aaagauaaucucagugcuu

SEQ ID NO: 3203698 - RNA, 23 nt, Human
aaagauaaucucagugcuuuccu

SEQ ID NO: 3203699 - RNA, 21 nt, Human
aaaccguguuugucucuucug

SEQ ID NO: 3203700 - RNA, 17 nt, Human
aaacucuugaccucagg

SEQ ID NO: 3203701 - RNA, 20 nt, Human
aaacucuuuaacuuguaaua

SEQ ID NO: 3203702 - RNA, 12 nt, Human
aaacucuuuaac

SEQ ID NO: 3203703 - RNA, 14 nt, Human
aaacccuucagugc

SEQ ID NO: 3203704 - RNA, 20 nt, Human
aaaccguguuugucucuucu

SEQ ID NO: 3203705 - RNA, 13 nt, Human
aaaccguguuugu

SEQ ID NO: 3203706 - RNA, 18 nt, Human
aaacccugucaaacauua

SEQ ID NO: 3203707 - RNA, 17 nt, Human
aaacccugucaaacauu

SEQ ID NO: 3203708 - RNA, 21 nt, Human
aaacccugucucuacuaaaaa

SEQ ID NO: 3203709 - RNA, 16 nt, Human
aaacccugucaaacau

SEQ ID NO: 3203710 - RNA, 17 nt, Human
aaaccccaucucuacaa

SEQ ID NO: 3203711 - RNA, 23 nt, Human
aaacccagcugcaccccuuccug

SEQ ID NO: 3203712 - RNA, 22 nt, Human
aaacccagcugcaccccuuccu

SEQ ID NO: 3203713 - RNA, 18 nt, Human
aaacccagcucuggucca

SEQ ID NO: 3203714 - RNA, 12 nt, Human
aaagaaacaugg

SEQ ID NO: 3203715 - RNA, 18 nt, Human
aaagaaccuaacauuuau

SEQ ID NO: 3203716 - RNA, 18 nt, Human
aaagaacgcugauuuaaa

SEQ ID NO: 3203717 - RNA, 15 nt, Human
aaagaacgcugauuu

SEQ ID NO: 3203718 - RNA, 16 nt, Human
aaagaacuaucuucau

SEQ ID NO: 3203719 - RNA, 20 nt, Human
aaagaacgcugauuuaaaga

SEQ ID NO: 3203720 - RNA, 19 nt, Human
aaagaagaaauaguucugu

SEQ ID NO: 3203721 - RNA, 22 nt, Human
aaagaacuaucuucaucugaga

SEQ ID NO: 3203722 - RNA, 20 nt, Human
aaagaacuaucuucaucuga

SEQ ID NO: 3203723 - RNA, 18 nt, Human
aaagaacuaucuucaucu

SEQ ID NO: 3203724 - RNA, 20 nt, Human
aaacugauuuuuuuuuccuu

SEQ ID NO: 3203725 - RNA, 12 nt, Human
aaacugauguga

SEQ ID NO: 3203726 - RNA, 14 nt, Human
aaacugaugugaaa

SEQ ID NO: 3203727 - RNA, 15 nt, Human
aaacugaugugaaac

SEQ ID NO: 3203728 - RNA, 13 nt, Human
aaacugauuuuuu

SEQ ID NO: 3203729 - RNA, 19 nt, Human
aaacugauuuuuuuuuccu

SEQ ID NO: 3203730 - RNA, 23 nt, Human
aaacucuuuaacuuguaauaaac

SEQ ID NO: 3203731 - RNA, 14 nt, Human
aaagugccuuugca

SEQ ID NO: 3203732 - RNA, 12 nt, Human
aaagugccuuug

SEQ ID NO: 3203733 - RNA, 13 nt, Human
aaauaaaaauucu

SEQ ID NO: 3203734 - RNA, 21 nt, Human
aaagucaugauguuuuuaaaa

SEQ ID NO: 3203735 - RNA, 18 nt, Human
aaagucaugauguuuuua

SEQ ID NO: 3203736 - RNA, 17 nt, Human
aaagucaugauguuuuu

SEQ ID NO: 3203737 - RNA, 16 nt, Human
aaagucaugauguuuu

SEQ ID NO: 3203738 - RNA, 15 nt, Human
aaagucaugauguuu

SEQ ID NO: 3203739 - RNA, 15 nt, Human
aaagugaugaacugg

SEQ ID NO: 3203740 - RNA, 22 nt, Human
aaagucaugauguuuuuaaaau

SEQ ID NO: 3203741 - RNA, 20 nt, Human
aaaggcuguauucagcaagg

SEQ ID NO: 3203742 - RNA, 18 nt, Human
aaaggcuguauucagcaa

SEQ ID NO: 3203743 - RNA, 14 nt, Human
aaaggcuguauuca

SEQ ID NO: 3203744 - RNA, 13 nt, Human
aaagucacaguua

SEQ ID NO: 3203745 - RNA, 17 nt, Human
aaagucaccaaauagug

SEQ ID NO: 3203746 - RNA, 14 nt, Human
aaagucagauguuu

SEQ ID NO: 3203747 - RNA, 16 nt, Human
aaagucagaacaaauu

SEQ ID NO: 3203748 - RNA, 13 nt, Human
aaagucagaaguu

SEQ ID NO: 3203749 - RNA, 15 nt, Human
aaagucagaaguuuu

SEQ ID NO: 3203750 - RNA, 14 nt, Human
aaagucagaaucag

SEQ ID NO: 3203751 - RNA, 23 nt, Human
aaagucaguugcucaaaaagaaa

SEQ ID NO: 3203752 - RNA, 11 nt, Human
aaauaaauuau

SEQ ID NO: 3203753 - RNA, 14 nt, Human
aaauaaaccuuaau

SEQ ID NO: 3203754 - RNA, 15 nt, Human
aaagccaagaggcug

SEQ ID NO: 3203755 - RNA, 22 nt, Human
aaagcccaaccucuuccuccug

SEQ ID NO: 3203756 - RNA, 20 nt, Human
aaagcccaaccucuuccucc

SEQ ID NO: 3203757 - RNA, 15 nt, Human
aaagcccaaccucuu

SEQ ID NO: 3203758 - RNA, 15 nt, Human
aaagcccaggagccc

SEQ ID NO: 3203759 - RNA, 12 nt, Human
aaagcccaggag

SEQ ID NO: 3203760 - RNA, 14 nt, Human
aaagcccaggagcc

SEQ ID NO: 3203761 - RNA, 13 nt, Human
aaagcccaggagc

SEQ ID NO: 3203762 - RNA, 22 nt, Human
aaaggcagcuguugucucuucu

SEQ ID NO: 3203763 - RNA, 15 nt, Human
aaaggcauuagaguc

SEQ ID NO: 3203764 - RNA, 19 nt, Human
aaaggcagaagcaacccaa

SEQ ID NO: 3203765 - RNA, 12 nt, Human
aaaggcagcugu

SEQ ID NO: 3203766 - RNA, 17 nt, Human
aaaggcagcuguugucu

SEQ ID NO: 3203767 - RNA, 14 nt, Human
aaaggcagcuguug

SEQ ID NO: 3203768 - RNA, 16 nt, Human
aaagccccauuaacug

SEQ ID NO: 3203769 - RNA, 22 nt, Human
aaaggcuccaggagcagccaca

SEQ ID NO: 3203770 - RNA, 13 nt, Human
aaaggcuguauuc

SEQ ID NO: 3203771 - RNA, 21 nt, Human
aaaggcuccaggagcagccac

SEQ ID NO: 3203772 - RNA, 14 nt, Human
aaaggcuccaggag

SEQ ID NO: 3203773 - RNA, 20 nt, Human
aaagcauuguaaaugugcuu

SEQ ID NO: 3203774 - RNA, 19 nt, Human
aaagcauuguaaaugugcu

SEQ ID NO: 3203775 - RNA, 15 nt, Human
aaagccaaagcuagg

SEQ ID NO: 3203776 - RNA, 21 nt, Human
aaagcauuuuguaauaauaaa

SEQ ID NO: 3203777 - RNA, 13 nt, Human
aaagcauuuugua

SEQ ID NO: 3203778 - RNA, 15 nt, Human
aaagcauuuuguaau

SEQ ID NO: 3203779 - RNA, 14 nt, Human
aaagcauuuuguaa

SEQ ID NO: 3203780 - RNA, 22 nt, Human
agaggagugcguggcccaccag

SEQ ID NO: 3203781 - RNA, 13 nt, Human
agagggccugcaa

SEQ ID NO: 3203782 - RNA, 16 nt, Human
agagggccugcaaggg

SEQ ID NO: 3203783 - RNA, 17 nt, Human
agaggggguggccuccc

SEQ ID NO: 3203784 - RNA, 19 nt, Human
agaggggguggccucccaa

SEQ ID NO: 3203785 - RNA, 22 nt, Human
agaggacuuuucuuuguggcuu

SEQ ID NO: 3203786 - RNA, 21 nt, Human
agaggacuuuucuuuguggcu

SEQ ID NO: 3203787 - RNA, 14 nt, Human
agaggacuuuucuu

SEQ ID NO: 3203788 - RNA, 14 nt, Human
agaggaggaggagg

SEQ ID NO: 3203789 - RNA, 23 nt, Human
agaggagggagcaucagugcccu

SEQ ID NO: 3203790 - RNA, 13 nt, Human
agaggaaugaagu

SEQ ID NO: 3203791 - RNA, 15 nt, Human
agagccugagaguga

SEQ ID NO: 3203792 - RNA, 19 nt, Human
agagccguaaaaacugaag

SEQ ID NO: 3203793 - RNA, 17 nt, Human
agagccguaaaaacuga

SEQ ID NO: 3203794 - RNA, 14 nt, Human
agagccguaaaaac

SEQ ID NO: 3203795 - RNA, 15 nt, Human
agagcccuucauuug

SEQ ID NO: 3203796 - RNA, 17 nt, Human
agagaggcuaaaauguu

SEQ ID NO: 3203797 - RNA, 19 nt, Human
agagaggcuaaaauguuuu

SEQ ID NO: 3203798 - RNA, 18 nt, Human
agagaggcuaaaauguuu

SEQ ID NO: 3203799 - RNA, 13 nt, Human
agagccagggucu

SEQ ID NO: 3203800 - RNA, 22 nt, Human
agagagggugaguccuccagaa

SEQ ID NO: 3203801 - RNA, 16 nt, Human
agagagaagagcccca

SEQ ID NO: 3203802 - RNA, 14 nt, Human
agagagaagagccc

SEQ ID NO: 3203803 - RNA, 16 nt, Human
agagagaccacuuuuc

SEQ ID NO: 3203804 - RNA, 16 nt, Human
agacugcuuugagaaa

SEQ ID NO: 3203805 - RNA, 18 nt, Human
agacucugucucagucca

SEQ ID NO: 3203806 - RNA, 13 nt, Human
agacucugucuca

SEQ ID NO: 3203807 - RNA, 18 nt, Human
agacucugucucaaaaaa

SEQ ID NO: 3203808 - RNA, 16 nt, Human
agacgcugugcugccc

SEQ ID NO: 3203809 - RNA, 19 nt, Human
agacgcucauucagcaucu

SEQ ID NO: 3203810 - RNA, 16 nt, Human
agacagcauguguuaa

SEQ ID NO: 3203811 - RNA, 20 nt, Human
agacagcauuuguguguuac

SEQ ID NO: 3203812 - RNA, 15 nt, Human
agacagcauuugugu

SEQ ID NO: 3203813 - RNA, 12 nt, Human
agaccagaaauu

SEQ ID NO: 3203814 - RNA, 14 nt, Human
agaccagaaauucc

SEQ ID NO: 3203815 - RNA, 21 nt, Human
agacagagucucacuguugcc

SEQ ID NO: 3203816 - RNA, 17 nt, Human
agacccaaaaggcagaa

SEQ ID NO: 3203817 - RNA, 19 nt, Human
agacccaaaaggcagaagc

SEQ ID NO: 3203818 - RNA, 15 nt, Human
agacagagcuacaca

SEQ ID NO: 3203819 - RNA, 20 nt, Human
agacagagucucacuguugc

SEQ ID NO: 3203820 - RNA, 19 nt, Human
agacagagucucacuguug

SEQ ID NO: 3203821 - RNA, 13 nt, Human
agacagagcuaca

SEQ ID NO: 3203822 - RNA, 11 nt, Human
agacagagucu

SEQ ID NO: 3203823 - RNA, 17 nt, Human
agacaaauaguaggcaa

SEQ ID NO: 3203824 - RNA, 12 nt, Human
agacaaauagua

SEQ ID NO: 3203825 - RNA, 16 nt, Human
agaaugaaagggccca

SEQ ID NO: 3203826 - RNA, 18 nt, Human
agaaugaaagggcccaga

SEQ ID NO: 3203827 - RNA, 21 nt, Human
agaagugaaaaucuacacucc

SEQ ID NO: 3203828 - RNA, 12 nt, Human
agaaugaacaaa

SEQ ID NO: 3203829 - RNA, 22 nt, Human
agaaugaacaaagaccaauuuu

SEQ ID NO: 3203830 - RNA, 13 nt, Human
agaaugaacaaag

SEQ ID NO: 3203831 - RNA, 18 nt, Human
agaaugaagguuuuugua

SEQ ID NO: 3203832 - RNA, 20 nt, Human
agaaugaagguuuuuguaaa

SEQ ID NO: 3203833 - RNA, 19 nt, Human
agaaugaagguuuuuguaa

SEQ ID NO: 3203834 - RNA, 20 nt, Human
agaaugaccuuguaauguaa

SEQ ID NO: 3203835 - RNA, 17 nt, Human
agaaugaccuuguaaug

SEQ ID NO: 3203836 - RNA, 16 nt, Human
agaaugaccuuguaau

SEQ ID NO: 3203837 - RNA, 15 nt, Human
agaaugaccuuguaa

SEQ ID NO: 3203838 - RNA, 14 nt, Human
agaaugaccuugua

SEQ ID NO: 3203839 - RNA, 13 nt, Human
agaaugaccuugu

SEQ ID NO: 3203840 - RNA, 12 nt, Human
agaaugaccuug

SEQ ID NO: 3203841 - RNA, 22 nt, Human
agaaugaagguuuuuguaaaga

SEQ ID NO: 3203842 - RNA, 23 nt, Human
agaaugaccuuguaauguaacug

SEQ ID NO: 3203843 - RNA, 22 nt, Human
agaaugaccuuguaauguaacu

SEQ ID NO: 3203844 - RNA, 21 nt, Human
agaaugaccuuguaauguaac

SEQ ID NO: 3203845 - RNA, 19 nt, Human
agaaugcacaaacagaggc

SEQ ID NO: 3203846 - RNA, 18 nt, Human
agaauggcauuugcaaua

SEQ ID NO: 3203847 - RNA, 14 nt, Human
agaauggcauuugc

SEQ ID NO: 3203848 - RNA, 18 nt, Human
agaauggaagagagaaag

SEQ ID NO: 3203849 - RNA, 21 nt, Human
agaauggcauuugcaauaaaa

SEQ ID NO: 3203850 - RNA, 21 nt, Human
agaagagcuguucacagccag

SEQ ID NO: 3203851 - RNA, 22 nt, Human
agaagagcuguucacagccaga

SEQ ID NO: 3203852 - RNA, 23 nt, Human
agaagagaaugcacaaacagagg

SEQ ID NO: 3203853 - RNA, 15 nt, Human
agaagacauuugcca

SEQ ID NO: 3203854 - RNA, 21 nt, Human
agaagacacugaugggcaacc

SEQ ID NO: 3203855 - RNA, 13 nt, Human
agaagacacugau

SEQ ID NO: 3203856 - RNA, 21 nt, Human
acuuuccucuuuggucuacac

SEQ ID NO: 3203857 - RNA, 21 nt, Human
acuuuccucuuagucgagcca

SEQ ID NO: 3203858 - RNA, 14 nt, Human
agaaguaacuuacu

SEQ ID NO: 3203859 - RNA, 22 nt, Human
agaaguaacuggugauauaucu

SEQ ID NO: 3203860 - RNA, 18 nt, Human
agaagguuucagaaagaa

SEQ ID NO: 3203861 - RNA, 21 nt, Human
agaagguuuacuuuuuggugu

SEQ ID NO: 3203862 - RNA, 20 nt, Human
agaaguauacguuuuucagu

SEQ ID NO: 3203863 - RNA, 18 nt, Human
agaaguaggggaagaaua

SEQ ID NO: 3203864 - RNA, 19 nt, Human
agaaguagggguggcccga

SEQ ID NO: 3203865 - RNA, 23 nt, Human
agaaguagugucuggaucaguaa

SEQ ID NO: 3203866 - RNA, 15 nt, Human
agaagagucuauugu

SEQ ID NO: 3203867 - RNA, 13 nt, Human
agaagaguggcag

SEQ ID NO: 3203868 - RNA, 23 nt, Human
agaagagagggugaguccuccag

SEQ ID NO: 3203869 - RNA, 23 nt, Human
agaagguauuaagauuauaauug

SEQ ID NO: 3203870 - RNA, 13 nt, Human
agaaggucuguuu

SEQ ID NO: 3203871 - RNA, 18 nt, Human
agaugaugaaaauauuua

SEQ ID NO: 3203872 - RNA, 18 nt, Human
agaugaggucaguugugu

SEQ ID NO: 3203873 - RNA, 21 nt, Human
agaugaggucaguuguguuuu

SEQ ID NO: 3203874 - RNA, 23 nt, Human
agaugaugaaaauauuuaaaggc

SEQ ID NO: 3203875 - RNA, 19 nt, Human
agauggucauauuuaaaca

SEQ ID NO: 3203876 - RNA, 15 nt, Human
agaugguuaaacauu

SEQ ID NO: 3203877 - RNA, 17 nt, Human
agaugguuaaacauuuu

SEQ ID NO: 3203878 - RNA, 18 nt, Human
agaugguuaaacauuuuc

SEQ ID NO: 3203879 - RNA, 22 nt, Human
agauggucauauuuaaacagaa

SEQ ID NO: 3203880 - RNA, 19 nt, Human
agauguagaggagaaacug

SEQ ID NO: 3203881 - RNA, 15 nt, Human
agauguagauuuauu

SEQ ID NO: 3203882 - RNA, 21 nt, Human
agauguagcaaacccugucaa

SEQ ID NO: 3203883 - RNA, 18 nt, Human
agauguagauuuauuuca

SEQ ID NO: 3203884 - RNA, 16 nt, Human
agauguagaggagaaa

SEQ ID NO: 3203885 - RNA, 23 nt, Human
agauguagcaaacccugucaaac

SEQ ID NO: 3203886 - RNA, 22 nt, Human
agauguagcaaacccugucaaa

SEQ ID NO: 3203887 - RNA, 14 nt, Human
agaguggccccacc

SEQ ID NO: 3203888 - RNA, 20 nt, Human
agagugccaacuucuuucau

SEQ ID NO: 3203889 - RNA, 19 nt, Human
agaguggccccaccuggcc

SEQ ID NO: 3203890 - RNA, 15 nt, Human
agaguggccccaccu

SEQ ID NO: 3203891 - RNA, 21 nt, Human
agaguggccccaccuggcccu

SEQ ID NO: 3203892 - RNA, 20 nt, Human
agcaaagcggguuauaauga

SEQ ID NO: 3203893 - RNA, 20 nt, Human
agcaaaggagauuggaagga

SEQ ID NO: 3203894 - RNA, 22 nt, Human
agcaaagcggguuauaaugaau

SEQ ID NO: 3203895 - RNA, 20 nt, Human
agcaaauggccucaugucaa

SEQ ID NO: 3203896 - RNA, 15 nt, Human
agcaaauggccucau

SEQ ID NO: 3203897 - RNA, 17 nt, Human
agcaaaugucuuccugg

SEQ ID NO: 3203898 - RNA, 20 nt, Human
agcaaaugucuuccuggauu

SEQ ID NO: 3203899 - RNA, 16 nt, Human
agcaaauguggcuccu

SEQ ID NO: 3203900 - RNA, 15 nt, Human
agcaaaaucaagaga

SEQ ID NO: 3203901 - RNA, 16 nt, Human
agcaaacccugucaaa

SEQ ID NO: 3203902 - RNA, 20 nt, Human
agcaaaccuaauugcacaac

SEQ ID NO: 3203903 - RNA, 19 nt, Human
agcaaaccuaauugcacaa

SEQ ID NO: 3203904 - RNA, 21 nt, Human
agcaaacccugucaaacauua

SEQ ID NO: 3203905 - RNA, 20 nt, Human
agcaaacccugucaaacauu

SEQ ID NO: 3203906 - RNA, 17 nt, Human
agcaaacccugucaaac

SEQ ID NO: 3203907 - RNA, 12 nt, Human
agcaaaaggcau

SEQ ID NO: 3203908 - RNA, 13 nt, Human
agcaaaaucaaga

SEQ ID NO: 3203909 - RNA, 18 nt, Human
agcaaaagaugcuucuca

SEQ ID NO: 3203910 - RNA, 11 nt, Human
agcaaaaggca

SEQ ID NO: 3203911 - RNA, 21 nt, Human
agauugcaacaggcugggcuu

SEQ ID NO: 3203912 - RNA, 20 nt, Human
agauugcaacaggcugggcu

SEQ ID NO: 3203913 - RNA, 23 nt, Human
agauugcaacaggcugggcuuca

SEQ ID NO: 3203914 - RNA, 19 nt, Human
agauugcaacaggcugggc

SEQ ID NO: 3203915 - RNA, 19 nt, Human
agauucuuuccugaggcug

SEQ ID NO: 3203916 - RNA, 21 nt, Human
agauucuuuccugaggcuggg

SEQ ID NO: 3203917 - RNA, 18 nt, Human
agauucuuuccugaggcu

SEQ ID NO: 3203918 - RNA, 11 nt, Human
agauucuuuua

SEQ ID NO: 3203919 - RNA, 12 nt, Human
agauucuuuuaa

SEQ ID NO: 3203920 - RNA, 20 nt, Human
agauucuuuuaaauuagaaa

SEQ ID NO: 3203921 - RNA, 21 nt, Human
agauucuuuuaaauuagaaaa

SEQ ID NO: 3203922 - RNA, 22 nt, Human
agauucuuuuaaauuagaaaau

SEQ ID NO: 3203923 - RNA, 20 nt, Human
agauugaaccugaauauugc

SEQ ID NO: 3203924 - RNA, 16 nt, Human
agcacagacccugccc

SEQ ID NO: 3203925 - RNA, 18 nt, Human
agcacuuaaauuccucaa

SEQ ID NO: 3203926 - RNA, 18 nt, Human
agcacuuccuugccaguc

SEQ ID NO: 3203927 - RNA, 16 nt, Human
agcacuuccuugccag

SEQ ID NO: 3203928 - RNA, 20 nt, Human
agcacuucuaaguugaguau

SEQ ID NO: 3203929 - RNA, 17 nt, Human
agcacuucuaaguugag

SEQ ID NO: 3203930 - RNA, 20 nt, Human
agcacuuccuugccagucuu

SEQ ID NO: 3203931 - RNA, 19 nt, Human
agcacuuccuugccagucu

SEQ ID NO: 3203932 - RNA, 19 nt, Human
agcacuucagggcagauuu

SEQ ID NO: 3203933 - RNA, 15 nt, Human
agcacuucaggaggc

SEQ ID NO: 3203934 - RNA, 14 nt, Human
agcacagacccugc

SEQ ID NO: 3203935 - RNA, 15 nt, Human
agcacagacccugcc

SEQ ID NO: 3203936 - RNA, 12 nt, Human
agcacagacccu

SEQ ID NO: 3203937 - RNA, 14 nt, Human
agcacaacccccag

SEQ ID NO: 3203938 - RNA, 22 nt, Human
agcacaaccuucaagcugcuuu

SEQ ID NO: 3203939 - RNA, 20 nt, Human
agcacaaccuucaagcugcu

SEQ ID NO: 3203940 - RNA, 18 nt, Human
agcacaaccuucaagcug

SEQ ID NO: 3203941 - RNA, 22 nt, Human
agcacaacccccagcucccgcu

SEQ ID NO: 3203942 - RNA, 19 nt, Human
agcacaacccccagcuccc

SEQ ID NO: 3203943 - RNA, 18 nt, Human
agcacaacccccagcucc

SEQ ID NO: 3203944 - RNA, 15 nt, Human
agccaagaggcugca

SEQ ID NO: 3203945 - RNA, 16 nt, Human
agccaaagcuaggccu

SEQ ID NO: 3203946 - RNA, 17 nt, Human
agcauccuggcacccgg

SEQ ID NO: 3203947 - RNA, 14 nt, Human
agcauccuggcacc

SEQ ID NO: 3203948 - RNA, 14 nt, Human
agccagcaggcucu

SEQ ID NO: 3203949 - RNA, 17 nt, Human
agccagaggagagagga

SEQ ID NO: 3203950 - RNA, 13 nt, Human
agccagaggagag

SEQ ID NO: 3203951 - RNA, 15 nt, Human
agccagaggagagag

SEQ ID NO: 3203952 - RNA, 15 nt, Human
agccaagcuuuaaau

SEQ ID NO: 3203953 - RNA, 16 nt, Human
agccaagcuuuaaauu

SEQ ID NO: 3203954 - RNA, 19 nt, Human
agccaagcuuuaaauuaug

SEQ ID NO: 3203955 - RNA, 20 nt, Human
agccaagcuuuaaauuaugu

SEQ ID NO: 3203956 - RNA, 22 nt, Human
agccaagcuuuaaauuauguga

SEQ ID NO: 3203957 - RNA, 16 nt, Human
agccagcaggcucuca

SEQ ID NO: 3203958 - RNA, 15 nt, Human
agcccaccccucaac

SEQ ID NO: 3203959 - RNA, 16 nt, Human
agcccacaguauauuu

SEQ ID NO: 3203960 - RNA, 19 nt, Human
agcccacaguauauuuuau

SEQ ID NO: 3203961 - RNA, 20 nt, Human
agcccacaguauauuuuauu

SEQ ID NO: 3203962 - RNA, 14 nt, Human
agcccaccuuggcu

SEQ ID NO: 3203963 - RNA, 16 nt, Human
agcccaccuuggcuca

SEQ ID NO: 3203964 - RNA, 14 nt, Human
agcccacgccccca

SEQ ID NO: 3203965 - RNA, 20 nt, Human
agcccacgcccccacuggug

SEQ ID NO: 3203966 - RNA, 23 nt, Human
agcccacgcccccacuggugaca

SEQ ID NO: 3203967 - RNA, 22 nt, Human
agcccacgcugacuacagggcc

SEQ ID NO: 3203968 - RNA, 21 nt, Human
agcccacgcugacuacagggc

SEQ ID NO: 3203969 - RNA, 20 nt, Human
agcccacgcugacuacaggg

SEQ ID NO: 3203970 - RNA, 23 nt, Human
agcccacgcugacuacagggccg

SEQ ID NO: 3203971 - RNA, 13 nt, Human
agcauccuggcac

SEQ ID NO: 3203972 - RNA, 17 nt, Human
agcagcuuuagcaaaga

SEQ ID NO: 3203973 - RNA, 19 nt, Human
agccccauucugccugccc

SEQ ID NO: 3203974 - RNA, 18 nt, Human
agccccauucugccugcc

SEQ ID NO: 3203975 - RNA, 17 nt, Human
agccccauucugccugc

SEQ ID NO: 3203976 - RNA, 11 nt, Human
agccccauccu

SEQ ID NO: 3203977 - RNA, 17 nt, Human
agccccauccucuguac

SEQ ID NO: 3203978 - RNA, 23 nt, Human
agccccauccucuguacagagcc

SEQ ID NO: 3203979 - RNA, 15 nt, Human
agccccauccucugu

SEQ ID NO: 3203980 - RNA, 17 nt, Human
agcccgggcucugccuc

SEQ ID NO: 3203981 - RNA, 18 nt, Human
agcccgggcucugccucc

SEQ ID NO: 3203982 - RNA, 20 nt, Human
agcccgggcucugccuccca

SEQ ID NO: 3203983 - RNA, 13 nt, Human
agcccucccugcc

SEQ ID NO: 3203984 - RNA, 12 nt, Human
agcccucccugc

SEQ ID NO: 3203985 - RNA, 21 nt, Human
agcccuccaucuaaacugccc

SEQ ID NO: 3203986 - RNA, 23 nt, Human
agcccuccaucuaaacugccccc

SEQ ID NO: 3203987 - RNA, 24 nt, Human
agccccaaaacucuccucugcugc

SEQ ID NO: 3203988 - RNA, 21 nt, Human
agccccaaauugucaccugcu

SEQ ID NO: 3203989 - RNA, 16 nt, Human
agcugaacacauuucu

SEQ ID NO: 3203990 - RNA, 14 nt, Human
agcugaacacauuu

SEQ ID NO: 3203991 - RNA, 20 nt, Human
agcuccccucggagaagagc

SEQ ID NO: 3203992 - RNA, 19 nt, Human
agcuccccucggagaagag

SEQ ID NO: 3203993 - RNA, 17 nt, Human
agcuccccucggagaag

SEQ ID NO: 3203994 - RNA, 15 nt, Human
agcugaaccugggua

SEQ ID NO: 3203995 - RNA, 15 nt, Human
agcugaagagcuggg

SEQ ID NO: 3203996 - RNA, 13 nt, Human
agcugaagagcug

SEQ ID NO: 3203997 - RNA, 22 nt, Human
agcugaacagaugaccccugcc

SEQ ID NO: 3203998 - RNA, 19 nt, Human
agcugaacacauuucuuuu

SEQ ID NO: 3203999 - RNA, 17 nt, Human
agcugaacacauuucuu

SEQ ID NO: 3204000 - RNA, 15 nt, Human
agcugagccuucuga

SEQ ID NO: 3204001 - RNA, 15 nt, Human
agcugcgggcugggu

SEQ ID NO: 3204002 - RNA, 20 nt, Human
agcugcugaaacaacaaaua

SEQ ID NO: 3204003 - RNA, 12 nt, Human
agcugcugacag

SEQ ID NO: 3204004 - RNA, 20 nt, Human
agcugcgguccacccaggag

SEQ ID NO: 3204005 - RNA, 19 nt, Human
agcugcgguccacccagga

SEQ ID NO: 3204006 - RNA, 18 nt, Human
agcugcgguccacccagg

SEQ ID NO: 3204007 - RNA, 17 nt, Human
agcugcgguccacccag

SEQ ID NO: 3204008 - RNA, 16 nt, Human
agcugcgguccaccca

SEQ ID NO: 3204009 - RNA, 13 nt, Human
agcugcgguccac

SEQ ID NO: 3204010 - RNA, 17 nt, Human
agcuggucccacucagu

SEQ ID NO: 3204011 - RNA, 16 nt, Human
agcuggucccacucag

SEQ ID NO: 3204012 - RNA, 14 nt, Human
agcugcugacagug

SEQ ID NO: 3204013 - RNA, 13 nt, Human
agcugcugacagu

SEQ ID NO: 3204014 - RNA, 18 nt, Human
agcuggucccacucaguc

SEQ ID NO: 3204015 - RNA, 16 nt, Human
agcugguugagguuuc

SEQ ID NO: 3204016 - RNA, 22 nt, Human
agcugguuuuuagcggagacgg

SEQ ID NO: 3204017 - RNA, 19 nt, Human
agcuaauucuuugaccugu

SEQ ID NO: 3204018 - RNA, 16 nt, Human
agcucaccagccccag

SEQ ID NO: 3204019 - RNA, 12 nt, Human
agcucaaaugaa

SEQ ID NO: 3204020 - RNA, 16 nt, Human
agcucaaaugaaaugu

SEQ ID NO: 3204021 - RNA, 17 nt, Human
agcucaaaugaaaugua

SEQ ID NO: 3204022 - RNA, 23 nt, Human
agcucaaaugaaauguaugcauu

SEQ ID NO: 3204023 - RNA, 16 nt, Human
agcuaaucagcauucu

SEQ ID NO: 3204024 - RNA, 21 nt, Human
agcuaaucagcauucucacuc

SEQ ID NO: 3204025 - RNA, 18 nt, Human
agcuaauaacaugugaaa

SEQ ID NO: 3204026 - RNA, 22 nt, Human
agcguuuugcaagguaaaauuu

SEQ ID NO: 3204027 - RNA, 14 nt, Human
agcguuuugcaagg

SEQ ID NO: 3204028 - RNA, 13 nt, Human
agcguuuugcaag

SEQ ID NO: 3204029 - RNA, 15 nt, Human
agcucaccucucccu

SEQ ID NO: 3204030 - RNA, 18 nt, Human
agcucaccucucccuugg

SEQ ID NO: 3204031 - RNA, 19 nt, Human
agcucaccucucccuugga

SEQ ID NO: 3204032 - RNA, 12 nt, Human
agcucaccucuc

SEQ ID NO: 3204033 - RNA, 15 nt, Human
agcucaccagcccca

SEQ ID NO: 3204034 - RNA, 19 nt, Human
agcucaccagccccagugc

SEQ ID NO: 3204035 - RNA, 18 nt, Human
agcucagagaggguggga

SEQ ID NO: 3204036 - RNA, 14 nt, Human
agcucagagagggu

SEQ ID NO: 3204037 - RNA, 12 nt, Human
agcucagagagg

SEQ ID NO: 3204038 - RNA, 15 nt, Human
agcucagaaccacag

SEQ ID NO: 3204039 - RNA, 12 nt, Human
agccuggcuccc

SEQ ID NO: 3204040 - RNA, 15 nt, Human
agccuggcuccccug

SEQ ID NO: 3204041 - RNA, 16 nt, Human
agccuggcuccccugg

SEQ ID NO: 3204042 - RNA, 17 nt, Human
agccuggcuccccuggg

SEQ ID NO: 3204043 - RNA, 16 nt, Human
agccccaucuagggga

SEQ ID NO: 3204044 - RNA, 23 nt, Human
agcccucccugccccucccuuca

SEQ ID NO: 3204045 - RNA, 22 nt, Human
agcccucccugccccucccuuc

SEQ ID NO: 3204046 - RNA, 19 nt, Human
agcccucccugccccuccc

SEQ ID NO: 3204047 - RNA, 17 nt, Human
agcccucccugccccuc

SEQ ID NO: 3204048 - RNA, 16 nt, Human
agcccucccugccccu

SEQ ID NO: 3204049 - RNA, 15 nt, Human
agcccucccugcccc

SEQ ID NO: 3204050 - RNA, 12 nt, Human
agccugggaggu

SEQ ID NO: 3204051 - RNA, 17 nt, Human
agcgacagugagacucu

SEQ ID NO: 3204052 - RNA, 17 nt, Human
agcgacaucucugacuu

SEQ ID NO: 3204053 - RNA, 20 nt, Human
agcgacaucucugacuuucu

SEQ ID NO: 3204054 - RNA, 15 nt, Human
agccuuuggaaacag

SEQ ID NO: 3204055 - RNA, 17 nt, Human
agccuuuucacccuucu

SEQ ID NO: 3204056 - RNA, 23 nt, Human
agccuuuguugaacuguuagaau

SEQ ID NO: 3204057 - RNA, 21 nt, Human
agccuuuguugaacuguuaga

SEQ ID NO: 3204058 - RNA, 19 nt, Human
agccuuuguugaacuguua

SEQ ID NO: 3204059 - RNA, 15 nt, Human
agccuuuguugaacu

SEQ ID NO: 3204060 - RNA, 13 nt, Human
agcgagcccuggu

SEQ ID NO: 3204061 - RNA, 19 nt, Human
agcgagcccugguggcagu

SEQ ID NO: 3204062 - RNA, 22 nt, Human
agcgagggccccagcgugaagc

SEQ ID NO: 3204063 - RNA, 16 nt, Human
agcuuuuacucccuga

SEQ ID NO: 3204064 - RNA, 12 nt, Human
aggaacaaggca

SEQ ID NO: 3204065 - RNA, 13 nt, Human
aggaacaaaucuu

SEQ ID NO: 3204066 - RNA, 14 nt, Human
aggaaauuugcagc

SEQ ID NO: 3204067 - RNA, 13 nt, Human
aggaacaaggcaa

SEQ ID NO: 3204068 - RNA, 16 nt, Human
aggaacaaggcaaggc

SEQ ID NO: 3204069 - RNA, 17 nt, Human
aggaacaaggcaaggcu

SEQ ID NO: 3204070 - RNA, 19 nt, Human
aggaacaaggcaaggcugu

SEQ ID NO: 3204071 - RNA, 16 nt, Human
aggaaccauaaucaau

SEQ ID NO: 3204072 - RNA, 15 nt, Human
aggaaccaaagcgaa

SEQ ID NO: 3204073 - RNA, 13 nt, Human
aggaaccaaagcg

SEQ ID NO: 3204074 - RNA, 20 nt, Human
aggaacaaggcaaggcuguc

SEQ ID NO: 3204075 - RNA, 17 nt, Human
aggaacaaaucuuccug

SEQ ID NO: 3204076 - RNA, 16 nt, Human
aggaacaaaucuuccu

SEQ ID NO: 3204077 - RNA, 15 nt, Human
aggaacaaaucuucc

SEQ ID NO: 3204078 - RNA, 14 nt, Human
aggaacaaaucuuc

SEQ ID NO: 3204079 - RNA, 22 nt, Human
aggaacugcugggcuuggcagc

SEQ ID NO: 3204080 - RNA, 23 nt, Human
aggaaccauaguugacaguucca

SEQ ID NO: 3204081 - RNA, 16 nt, Human
aggaacugcugggcuu

SEQ ID NO: 3204082 - RNA, 14 nt, Human
aggaaccucugauu

SEQ ID NO: 3204083 - RNA, 17 nt, Human
aggaaccucugauuuau

SEQ ID NO: 3204084 - RNA, 18 nt, Human
aggaaccucugauuuauu

SEQ ID NO: 3204085 - RNA, 21 nt, Human
aggaaccucugauuuauuuug

SEQ ID NO: 3204086 - RNA, 22 nt, Human
aggaaccucugauuuauuuugu

SEQ ID NO: 3204087 - RNA, 13 nt, Human
aggaaguagagga

SEQ ID NO: 3204088 - RNA, 15 nt, Human
aggaaguagcacagg

SEQ ID NO: 3204089 - RNA, 23 nt, Human
aggaaguccuuaucuagcugcau

SEQ ID NO: 3204090 - RNA, 19 nt, Human
aggaaguagcacaggcuga

SEQ ID NO: 3204091 - RNA, 18 nt, Human
aggaaguagcacaggcug

SEQ ID NO: 3204092 - RNA, 16 nt, Human
aggaaguagcacaggc

SEQ ID NO: 3204093 - RNA, 15 nt, Human
aggaaggcugucuca

SEQ ID NO: 3204094 - RNA, 20 nt, Human
aggaaggcugucucagauaa

SEQ ID NO: 3204095 - RNA, 15 nt, Human
aggaaggcuuugaaa

SEQ ID NO: 3204096 - RNA, 19 nt, Human
aggaagggauguauuugua

SEQ ID NO: 3204097 - RNA, 15 nt, Human
aggaaggcugagagg

SEQ ID NO: 3204098 - RNA, 22 nt, Human
aggaaggcugagaggagagaga

SEQ ID NO: 3204099 - RNA, 23 nt, Human
aggaagugauuuuugagcccuug

SEQ ID NO: 3204100 - RNA, 20 nt, Human
aggaauaaauugcuccuuga

SEQ ID NO: 3204101 - RNA, 19 nt, Human
aggaauaaauugcuccuug

SEQ ID NO: 3204102 - RNA, 15 nt, Human
aggaauaccuguccc

SEQ ID NO: 3204103 - RNA, 18 nt, Human
aggaauaccugucccccu

SEQ ID NO: 3204104 - RNA, 22 nt, Human
aggaauaccugucccccugaca

SEQ ID NO: 3204105 - RNA, 22 nt, Human
agcuuauuuuuacaguuauaga

SEQ ID NO: 3204106 - RNA, 14 nt, Human
agcuuauuuuuaca

SEQ ID NO: 3204107 - RNA, 20 nt, Human
agcuuauuuuggagagauag

SEQ ID NO: 3204108 - RNA, 18 nt, Human
agcuucauuuccuguguc

SEQ ID NO: 3204109 - RNA, 19 nt, Human
agcuucauuuccugugucu

SEQ ID NO: 3204110 - RNA, 22 nt, Human
agcuuuguuuguugucagcuga

SEQ ID NO: 3204111 - RNA, 23 nt, Human
agcuuuguuuguugucagcugaa

SEQ ID NO: 3204112 - RNA, 16 nt, Human
agcuuuuaaacccuau

SEQ ID NO: 3204113 - RNA, 17 nt, Human
agcuguaacaguucuuu

SEQ ID NO: 3204114 - RNA, 16 nt, Human
agcuguaacaguucuu

SEQ ID NO: 3204115 - RNA, 15 nt, Human
agcuguaacaguucu

SEQ ID NO: 3204116 - RNA, 15 nt, Human
aggagaggagagggg

SEQ ID NO: 3204117 - RNA, 12 nt, Human
aggaccugcccg

SEQ ID NO: 3204118 - RNA, 13 nt, Human
aggaccugcaaac

SEQ ID NO: 3204119 - RNA, 14 nt, Human
aggagacuuguagu

SEQ ID NO: 3204120 - RNA, 21 nt, Human
aggagacuguggagacugcuc

SEQ ID NO: 3204121 - RNA, 20 nt, Human
aggagacuguggagacugcu

SEQ ID NO: 3204122 - RNA, 22 nt, Human
aggacccggaggggccuggcag

SEQ ID NO: 3204123 - RNA, 21 nt, Human
aggacccggaggggccuggca

SEQ ID NO: 3204124 - RNA, 16 nt, Human
aggacccugccaggca

SEQ ID NO: 3204125 - RNA, 15 nt, Human
aggacccugccaggc

SEQ ID NO: 3204126 - RNA, 14 nt, Human
aggacccugccagg

SEQ ID NO: 3204127 - RNA, 13 nt, Human
aggacccugccag

SEQ ID NO: 3204128 - RNA, 20 nt, Human
aggacccggaggggccuggc

SEQ ID NO: 3204129 - RNA, 18 nt, Human
aggacccggaggggccug

SEQ ID NO: 3204130 - RNA, 22 nt, Human
aggaccaggguuggcaccuucc

SEQ ID NO: 3204131 - RNA, 12 nt, Human
aggaccagggcu

SEQ ID NO: 3204132 - RNA, 22 nt, Human
aggaauauuauauuuggaugca

SEQ ID NO: 3204133 - RNA, 19 nt, Human
aggaauauagauuaaauca

SEQ ID NO: 3204134 - RNA, 18 nt, Human
aggaauaugggagaaaua

SEQ ID NO: 3204135 - RNA, 20 nt, Human
aggaauauuauauuuggaug

SEQ ID NO: 3204136 - RNA, 19 nt, Human
aggaauauuauauuuggau

SEQ ID NO: 3204137 - RNA, 17 nt, Human
aggaauauuauauuugg

SEQ ID NO: 3204138 - RNA, 14 nt, Human
aggaauauuauauu

SEQ ID NO: 3204139 - RNA, 15 nt, Human
agggacccuccacca

SEQ ID NO: 3204140 - RNA, 15 nt, Human
agggacugaggggag

SEQ ID NO: 3204141 - RNA, 23 nt, Human
agggacugccagucccccugccc

SEQ ID NO: 3204142 - RNA, 18 nt, Human
aggcuuagucacugagac

SEQ ID NO: 3204143 - RNA, 17 nt, Human
aggcuuagucacugaga

SEQ ID NO: 3204144 - RNA, 22 nt, Human
aggcuguaucccaugagccuca

SEQ ID NO: 3204145 - RNA, 21 nt, Human
aggcuguaucccaugagccuc

SEQ ID NO: 3204146 - RNA, 20 nt, Human
aggcuguaucccaugagccu

SEQ ID NO: 3204147 - RNA, 23 nt, Human
aggcuggucucgaacuccugacc

SEQ ID NO: 3204148 - RNA, 15 nt, Human
aggcugacuccuggu

SEQ ID NO: 3204149 - RNA, 16 nt, Human
aggcugacuccugguc

SEQ ID NO: 3204150 - RNA, 18 nt, Human
aggcugagacagugaauu

SEQ ID NO: 3204151 - RNA, 18 nt, Human
aggcuggguucugauccu

SEQ ID NO: 3204152 - RNA, 22 nt, Human
aggcuaauguuggcagaugcag

SEQ ID NO: 3204153 - RNA, 19 nt, Human
aggcuaauguuggcagaug

SEQ ID NO: 3204154 - RNA, 23 nt, Human
aggcuaauguuggcagaugcagc

SEQ ID NO: 3204155 - RNA, 21 nt, Human
aggcccucugcccacucccug

SEQ ID NO: 3204156 - RNA, 22 nt, Human
aggcccucugcccacucccugc

SEQ ID NO: 3204157 - RNA, 23 nt, Human
aggcccucugcccacucccugca

SEQ ID NO: 3204158 - RNA, 15 nt, Human
aggcccuucucucca

SEQ ID NO: 3204159 - RNA, 19 nt, Human
aggcccuucucuccagccc

SEQ ID NO: 3204160 - RNA, 12 nt, Human
aggcccuucucu

SEQ ID NO: 3204161 - RNA, 22 nt, Human
aggcccuuccucuccacugccu

SEQ ID NO: 3204162 - RNA, 19 nt, Human
aggcccuuccucuccacug

SEQ ID NO: 3204163 - RNA, 19 nt, Human
aggcauuccccaggaggcc

SEQ ID NO: 3204164 - RNA, 20 nt, Human
aggcauuccccaggaggcca

SEQ ID NO: 3204165 - RNA, 23 nt, Human
aggccagcugcuugggcuucauc

SEQ ID NO: 3204166 - RNA, 13 nt, Human
aggccaggcccuc

SEQ ID NO: 3204167 - RNA, 14 nt, Human
aggccaggcccucu

SEQ ID NO: 3204168 - RNA, 15 nt, Human
aggccaggcccucug

SEQ ID NO: 3204169 - RNA, 11 nt, Human
aggccaucugg

SEQ ID NO: 3204170 - RNA, 10 nt, Human
aggccaucug

SEQ ID NO: 3204171 - RNA, 20 nt, Human
aggccauggaggcaguagga

SEQ ID NO: 3204172 - RNA, 16 nt, Human
aggccauggaggcagu

SEQ ID NO: 3204173 - RNA, 21 nt, Human
aggccaucuggagagcccaga

SEQ ID NO: 3204174 - RNA, 20 nt, Human
aggccaucuggagagcccag

SEQ ID NO: 3204175 - RNA, 16 nt, Human
aggccaucuggagagc

SEQ ID NO: 3204176 - RNA, 15 nt, Human
aggccaucuggagag

SEQ ID NO: 3204177 - RNA, 14 nt, Human
aggccaucuggaga

SEQ ID NO: 3204178 - RNA, 18 nt, Human
aggcauuccccaggaggc

SEQ ID NO: 3204179 - RNA, 17 nt, Human
aggcauuccccaggagg

SEQ ID NO: 3204180 - RNA, 12 nt, Human
aggcauguucuc

SEQ ID NO: 3204181 - RNA, 19 nt, Human
aggcauguucucugaggac

SEQ ID NO: 3204182 - RNA, 18 nt, Human
aggcauguucucugagga

SEQ ID NO: 3204183 - RNA, 19 nt, Human
aggcaugugaugagaggaa

SEQ ID NO: 3204184 - RNA, 20 nt, Human
aggcaugugaugagaggaaa

SEQ ID NO: 3204185 - RNA, 21 nt, Human
aggcaugugaugagaggaaau

SEQ ID NO: 3204186 - RNA, 17 nt, Human
aggcauguucucugagg

SEQ ID NO: 3204187 - RNA, 17 nt, Human
aggcaugugaugagagg

SEQ ID NO: 3204188 - RNA, 16 nt, Human
aggcaugggcuugcug

SEQ ID NO: 3204189 - RNA, 22 nt, Human
aggcaugucccaugugagcugc

SEQ ID NO: 3204190 - RNA, 15 nt, Human
aggcaugguggccca

SEQ ID NO: 3204191 - RNA, 17 nt, Human
aggcaugggccaccacg

SEQ ID NO: 3204192 - RNA, 15 nt, Human
aggcaugggccacca

SEQ ID NO: 3204193 - RNA, 19 nt, Human
aggcauggaugaauaaaug

SEQ ID NO: 3204194 - RNA, 18 nt, Human
aggcagcacgugcacaaa

SEQ ID NO: 3204195 - RNA, 16 nt, Human
aggagaggauggccca

SEQ ID NO: 3204196 - RNA, 14 nt, Human
aggcagagcccaga

SEQ ID NO: 3204197 - RNA, 13 nt, Human
aggcagagaaauc

SEQ ID NO: 3204198 - RNA, 14 nt, Human
aggcagagaaaucu

SEQ ID NO: 3204199 - RNA, 19 nt, Human
aggucccuuucauuugcua

SEQ ID NO: 3204200 - RNA, 14 nt, Human
agguacucuccugg

SEQ ID NO: 3204201 - RNA, 13 nt, Human
agguacucuccug

SEQ ID NO: 3204202 - RNA, 14 nt, Human
agguaacaggcaga

SEQ ID NO: 3204203 - RNA, 13 nt, Human
agguaacaggcag

SEQ ID NO: 3204204 - RNA, 16 nt, Human
agguaacaggcagaua

SEQ ID NO: 3204205 - RNA, 22 nt, Human
agguacgaaaagaggggaagag

SEQ ID NO: 3204206 - RNA, 22 nt, Human
aggucuauuuggauuauucuuu

SEQ ID NO: 3204207 - RNA, 14 nt, Human
aggucuauuuggau

SEQ ID NO: 3204208 - RNA, 21 nt, Human
aggucguuuuaaaaacaaaaa

SEQ ID NO: 3204209 - RNA, 22 nt, Human
aggguuuugccauguuggccag

SEQ ID NO: 3204210 - RNA, 16 nt, Human
agggaugguguucaaa

SEQ ID NO: 3204211 - RNA, 12 nt, Human
agggauguauuu

SEQ ID NO: 3204212 - RNA, 14 nt, Human
agggauguauuugu

SEQ ID NO: 3204213 - RNA, 14 nt, Human
agggaugguguuca

SEQ ID NO: 3204214 - RNA, 15 nt, Human
agggauuagggagag

SEQ ID NO: 3204215 - RNA, 12 nt, Human
agggccuggccu

SEQ ID NO: 3204216 - RNA, 13 nt, Human
agggccuggccug

SEQ ID NO: 3204217 - RNA, 15 nt, Human
agggccugcaaggga

SEQ ID NO: 3204218 - RNA, 14 nt, Human
agggccugcaaggg

SEQ ID NO: 3204219 - RNA, 16 nt, Human
agggauacccauccca

SEQ ID NO: 3204220 - RNA, 22 nt, Human
agggauacgagcggaguccccu

SEQ ID NO: 3204221 - RNA, 18 nt, Human
aggggcaggaggaagggg

SEQ ID NO: 3204222 - RNA, 13 nt, Human
aggggcaggagga

SEQ ID NO: 3204223 - RNA, 12 nt, Human
aggggcaggagg

SEQ ID NO: 3204224 - RNA, 16 nt, Human
agggccuggcccaugu

SEQ ID NO: 3204225 - RNA, 14 nt, Human
agggccuggcccau

SEQ ID NO: 3204226 - RNA, 13 nt, Human
agggccuggccca

SEQ ID NO: 3204227 - RNA, 22 nt, Human
aggggcccaaauucuuucagug

SEQ ID NO: 3204228 - RNA, 16 nt, Human
agggucccugguggca

SEQ ID NO: 3204229 - RNA, 17 nt, Human
agggucccugguggcag

SEQ ID NO: 3204230 - RNA, 20 nt, Human
agggucccugguggcagcuc

SEQ ID NO: 3204231 - RNA, 22 nt, Human
agggucccugguggcagcucac

SEQ ID NO: 3204232 - RNA, 12 nt, Human
agggucccuggu

SEQ ID NO: 3204233 - RNA, 14 nt, Human
agggucccuggugg

SEQ ID NO: 3204234 - RNA, 19 nt, Human
agggucacuggggcccaag

SEQ ID NO: 3204235 - RNA, 13 nt, Human
aggguauuccaga

SEQ ID NO: 3204236 - RNA, 21 nt, Human
aggguaucuggugacuuuccu

SEQ ID NO: 3204237 - RNA, 15 nt, Human
aggguaucuggugac

SEQ ID NO: 3204238 - RNA, 13 nt, Human
aggggccuggcag

SEQ ID NO: 3204239 - RNA, 12 nt, Human
aggggccuggca

SEQ ID NO: 3204240 - RNA, 16 nt, Human
agucuguucugguaau

SEQ ID NO: 3204241 - RNA, 16 nt, Human
agucuguugauuaaag

SEQ ID NO: 3204242 - RNA, 19 nt, Human
agugaauuugggcugcugu

SEQ ID NO: 3204243 - RNA, 17 nt, Human
agugaccucagcuuuga

SEQ ID NO: 3204244 - RNA, 17 nt, Human
agucugaaggcuggguu

SEQ ID NO: 3204245 - RNA, 19 nt, Human
aguccuuaccagcagagca

SEQ ID NO: 3204246 - RNA, 16 nt, Human
aguccuuaucuagcug

SEQ ID NO: 3204247 - RNA, 18 nt, Human
aguccuuaucuagcugca

SEQ ID NO: 3204248 - RNA, 18 nt, Human
agucugaggccguugcug

SEQ ID NO: 3204249 - RNA, 17 nt, Human
agucugagggcuuguag

SEQ ID NO: 3204250 - RNA, 18 nt, Human
agucugagggcuuguagu

SEQ ID NO: 3204251 - RNA, 21 nt, Human
agucugagggcuuguaguucu

SEQ ID NO: 3204252 - RNA, 19 nt, Human
agugacgaaaacauugucc

SEQ ID NO: 3204253 - RNA, 14 nt, Human
agugacgguuccua

SEQ ID NO: 3204254 - RNA, 23 nt, Human
agugacgguuccuacacaggaca

SEQ ID NO: 3204255 - RNA, 20 nt, Human
agugacgguuccuacacagg

SEQ ID NO: 3204256 - RNA, 22 nt, Human
agugaccuggaaggcccagcac

SEQ ID NO: 3204257 - RNA, 18 nt, Human
agugaccucagcuuugau

SEQ ID NO: 3204258 - RNA, 12 nt, Human
agugaauugaag

SEQ ID NO: 3204259 - RNA, 19 nt, Human
aguccucuuuucugagagg

SEQ ID NO: 3204260 - RNA, 20 nt, Human
aguccuuaccagcagagcac

SEQ ID NO: 3204261 - RNA, 17 nt, Human
aguccugcaaccaaacu

SEQ ID NO: 3204262 - RNA, 22 nt, Human
aguccucuuuucugagaggacu

SEQ ID NO: 3204263 - RNA, 23 nt, Human
agucaugauguuuuuaaaaucuu

SEQ ID NO: 3204264 - RNA, 22 nt, Human
agucaugauguuuuuaaaaucu

SEQ ID NO: 3204265 - RNA, 19 nt, Human
agucaugcguuuaaucaca

SEQ ID NO: 3204266 - RNA, 15 nt, Human
agucaugaugaauca

SEQ ID NO: 3204267 - RNA, 13 nt, Human
agucaugauguuu

SEQ ID NO: 3204268 - RNA, 17 nt, Human
agucaugauguuuuuaa

SEQ ID NO: 3204269 - RNA, 14 nt, Human
agucaugauguuuu

SEQ ID NO: 3204270 - RNA, 21 nt, Human
agucaugauguuuuuaaaauc

SEQ ID NO: 3204271 - RNA, 20 nt, Human
agucaugauguuuuuaaaau

SEQ ID NO: 3204272 - RNA, 19 nt, Human
agucaugauguuuuuaaaa

SEQ ID NO: 3204273 - RNA, 18 nt, Human
agucaugauguuuuuaaa

SEQ ID NO: 3204274 - RNA, 14 nt, Human
agucaugugggcca

SEQ ID NO: 3204275 - RNA, 21 nt, Human
agucauuuuguguugaagagc

SEQ ID NO: 3204276 - RNA, 14 nt, Human
agucaugcuccccu

SEQ ID NO: 3204277 - RNA, 13 nt, Human
agucaugcucccc

SEQ ID NO: 3204278 - RNA, 23 nt, Human
agucaugcuccccugugccagcc

SEQ ID NO: 3204279 - RNA, 12 nt, Human
agucauggagaa

SEQ ID NO: 3204280 - RNA, 18 nt, Human
agucauggagaaccaccu

SEQ ID NO: 3204281 - RNA, 19 nt, Human
agucauggagaaccaccua

SEQ ID NO: 3204282 - RNA, 19 nt, Human
agucaugcuccccugugcc

SEQ ID NO: 3204283 - RNA, 18 nt, Human
agucaugcuccccugugc

SEQ ID NO: 3204284 - RNA, 21 nt, Human
agucaugcuccccugugccag

SEQ ID NO: 3204285 - RNA, 14 nt, Human
aguauuuuuaaagg

SEQ ID NO: 3204286 - RNA, 16 nt, Human
aguauuuuuguauuca

SEQ ID NO: 3204287 - RNA, 20 nt, Human
aguauccugagagcccagaa

SEQ ID NO: 3204288 - RNA, 17 nt, Human
aguacuuuauagaagaa

SEQ ID NO: 3204289 - RNA, 16 nt, Human
aguacuuuauagaaga

SEQ ID NO: 3204290 - RNA, 13 nt, Human
aguacuuuauaga

SEQ ID NO: 3204291 - RNA, 14 nt, Human
aguacuucuucugu

SEQ ID NO: 3204292 - RNA, 16 nt, Human
aguacuucuucuguaa

SEQ ID NO: 3204293 - RNA, 17 nt, Human
aguacuucuucuguaau

SEQ ID NO: 3204294 - RNA, 18 nt, Human
aguacuucuucuguaaua

SEQ ID NO: 3204295 - RNA, 19 nt, Human
aguacuucuucuguaauau

SEQ ID NO: 3204296 - RNA, 23 nt, Human
aguacuucuucuguaauauuuac

SEQ ID NO: 3204297 - RNA, 19 nt, Human
aguacuuuauagaagaaug

SEQ ID NO: 3204298 - RNA, 18 nt, Human
aguacuuuauagaagaau

SEQ ID NO: 3204299 - RNA, 13 nt, Human
agucaaaacuuua

SEQ ID NO: 3204300 - RNA, 15 nt, Human
agucaauuacauguu

SEQ ID NO: 3204301 - RNA, 22 nt, Human
agucacacaguauuacuucugc

SEQ ID NO: 3204302 - RNA, 19 nt, Human
aguaaauguaguucauacu

SEQ ID NO: 3204303 - RNA, 18 nt, Human
aguaaaucucuucugugu

SEQ ID NO: 3204304 - RNA, 16 nt, Human
aguaaaucucuucugu

SEQ ID NO: 3204305 - RNA, 15 nt, Human
aguaaaucucuucug

SEQ ID NO: 3204306 - RNA, 14 nt, Human
aguaaaucucuucu

SEQ ID NO: 3204307 - RNA, 14 nt, Human
aguaagaucacugu

SEQ ID NO: 3204308 - RNA, 15 nt, Human
aguaagaucacuguu

SEQ ID NO: 3204309 - RNA, 20 nt, Human
aguaagaucacuguuuagau

SEQ ID NO: 3204310 - RNA, 21 nt, Human
aguaagaucacuguuuagauu

SEQ ID NO: 3204311 - RNA, 18 nt, Human
aguaagaucucuuucuaa

SEQ ID NO: 3204312 - RNA, 14 nt, Human
aguaacacaggcca

SEQ ID NO: 3204313 - RNA, 19 nt, Human
aguacugguaagauuguua

SEQ ID NO: 3204314 - RNA, 20 nt, Human
aguacugguaagauuguuau

SEQ ID NO: 3204315 - RNA, 21 nt, Human
aguacugguaagauuguuauu

SEQ ID NO: 3204316 - RNA, 23 nt, Human
aguacugguaagauuguuauuaa

SEQ ID NO: 3204317 - RNA, 14 nt, Human
aguacuauguauca

SEQ ID NO: 3204318 - RNA, 12 nt, Human
aguacuauguau

SEQ ID NO: 3204319 - RNA, 22 nt, Human
aguacuucuccacccugcucuc

SEQ ID NO: 3204320 - RNA, 12 nt, Human
aguacuucuuuu

SEQ ID NO: 3204321 - RNA, 17 nt, Human
aguacuucuccacccug

SEQ ID NO: 3204322 - RNA, 17 nt, Human
aguacugugaauccagu

SEQ ID NO: 3204323 - RNA, 13 nt, Human
aguacugugaauc

SEQ ID NO: 3204324 - RNA, 19 nt, Human
aguacuacaguccucccau

SEQ ID NO: 3204325 - RNA, 22 nt, Human
aguacuacaguccucccaucuc

SEQ ID NO: 3204326 - RNA, 14 nt, Human
aguacuauaauuua

SEQ ID NO: 3204327 - RNA, 19 nt, Human
aguacuagagauauuuugu

SEQ ID NO: 3204328 - RNA, 21 nt, Human
aguacuagagauauuuuguaa

SEQ ID NO: 3204329 - RNA, 15 nt, Human
aguaagcauuucaaa

SEQ ID NO: 3204330 - RNA, 14 nt, Human
aguucagcuugggg

SEQ ID NO: 3204331 - RNA, 22 nt, Human
aguucagggaagauaaguugga

SEQ ID NO: 3204332 - RNA, 19 nt, Human
aguucagggaagauaaguu

SEQ ID NO: 3204333 - RNA, 13 nt, Human
aguucagcuuggg

SEQ ID NO: 3204334 - RNA, 15 nt, Human
aguucagcaaaacug

SEQ ID NO: 3204335 - RNA, 15 nt, Human
aguucaucuugaauu

SEQ ID NO: 3204336 - RNA, 19 nt, Human
aguucaucuugaauuguaa

SEQ ID NO: 3204337 - RNA, 13 nt, Human
aguucaucuugaa

SEQ ID NO: 3204338 - RNA, 18 nt, Human
aguugaaaagacuccaaa

SEQ ID NO: 3204339 - RNA, 14 nt, Human
aguugaaaagacuc

SEQ ID NO: 3204340 - RNA, 20 nt, Human
aguugaaaagacuccaaaga

SEQ ID NO: 3204341 - RNA, 19 nt, Human
aguugaaaagacuccaaag

SEQ ID NO: 3204342 - RNA, 17 nt, Human
aguugacucugcucuug

SEQ ID NO: 3204343 - RNA, 18 nt, Human
aguugacuagaaucgaca

SEQ ID NO: 3204344 - RNA, 22 nt, Human
aguucaucccuucucuuccagg

SEQ ID NO: 3204345 - RNA, 20 nt, Human
aguucaucccuucucuucca

SEQ ID NO: 3204346 - RNA, 23 nt, Human
aguugaguauauuauaauagauu

SEQ ID NO: 3204347 - RNA, 18 nt, Human
aguugagcuaugacuuaa

SEQ ID NO: 3204348 - RNA, 19 nt, Human
aguugaguauauuauaaua

SEQ ID NO: 3204349 - RNA, 15 nt, Human
aguugagcuaugacu

SEQ ID NO: 3204350 - RNA, 17 nt, Human
aguugagcuaugacuua

SEQ ID NO: 3204351 - RNA, 13 nt, Human
aguugagcuauga

SEQ ID NO: 3204352 - RNA, 16 nt, Human
agugccuuauggaaca

SEQ ID NO: 3204353 - RNA, 10 nt, Human
agugccuuau

SEQ ID NO: 3204354 - RNA, 13 nt, Human
agugccuuaugga

SEQ ID NO: 3204355 - RNA, 14 nt, Human
agugccuuauggaa

SEQ ID NO: 3204356 - RNA, 15 nt, Human
agugccuuauggaac

SEQ ID NO: 3204357 - RNA, 21 nt, Human
aguggccuccgucacuaccug

SEQ ID NO: 3204358 - RNA, 21 nt, Human
aguggccucgaacuccuggca

SEQ ID NO: 3204359 - RNA, 22 nt, Human
aguggccuccgucacuaccugg

SEQ ID NO: 3204360 - RNA, 24 nt, Human
agugauccucccaccucagccucc

SEQ ID NO: 3204361 - RNA, 23 nt, Human
agugauccucccaccucagccuc

SEQ ID NO: 3204362 - RNA, 18 nt, Human
agugauccucccaccuca

SEQ ID NO: 3204363 - RNA, 15 nt, Human
agugauccucccacc

SEQ ID NO: 3204364 - RNA, 14 nt, Human
agugauccucccac

SEQ ID NO: 3204365 - RNA, 17 nt, Human
agugccuuacacaaugg

SEQ ID NO: 3204366 - RNA, 15 nt, Human
agugauucuccugcc

SEQ ID NO: 3204367 - RNA, 18 nt, Human
agugccuuacacaauggu

SEQ ID NO: 3204368 - RNA, 14 nt, Human
agugauucuccugc

SEQ ID NO: 3204369 - RNA, 21 nt, Human
agugauucucaugccucagcc

SEQ ID NO: 3204370 - RNA, 13 nt, Human
agugauccuccca

SEQ ID NO: 3204371 - RNA, 14 nt, Human
agugucuggcugca

SEQ ID NO: 3204372 - RNA, 13 nt, Human
agugucuggcugc

SEQ ID NO: 3204373 - RNA, 12 nt, Human
agugucuggcug

SEQ ID NO: 3204374 - RNA, 18 nt, Human
agugucuggaucaguaaa

SEQ ID NO: 3204375 - RNA, 20 nt, Human
agugucuggaucaguaaaau

SEQ ID NO: 3204376 - RNA, 21 nt, Human
agugucuggaucaguaaaauu

SEQ ID NO: 3204377 - RNA, 23 nt, Human
agugucuggaucaguaaaauuau

SEQ ID NO: 3204378 - RNA, 19 nt, Human
agugucaaugcagccccca

SEQ ID NO: 3204379 - RNA, 14 nt, Human
agugggcagucaca

SEQ ID NO: 3204380 - RNA, 16 nt, Human
agugggagcugccugu

SEQ ID NO: 3204381 - RNA, 21 nt, Human
agugggacagggcauggccag

SEQ ID NO: 3204382 - RNA, 19 nt, Human
agugggacagggcauggcc

SEQ ID NO: 3204383 - RNA, 18 nt, Human
auaucaucacguauguua

SEQ ID NO: 3204384 - RNA, 20 nt, Human
auaucaucacguauguuaua

SEQ ID NO: 3204385 - RNA, 17 nt, Human
auaugcagauuuugccc

SEQ ID NO: 3204386 - RNA, 18 nt, Human
auaugcagaaauagacaa

SEQ ID NO: 3204387 - RNA, 19 nt, Human
auaugcacuaagucucuuu

SEQ ID NO: 3204388 - RNA, 17 nt, Human
auaugcucugcauguua

SEQ ID NO: 3204389 - RNA, 16 nt, Human
auaugcucugcauguu

SEQ ID NO: 3204390 - RNA, 20 nt, Human
auaugcucugcauguuacau

SEQ ID NO: 3204391 - RNA, 23 nt, Human
auaugcacuaagucucuuuuuua

SEQ ID NO: 3204392 - RNA, 19 nt, Human
auauucaggaagcucaggg

SEQ ID NO: 3204393 - RNA, 17 nt, Human
auauucaggaagcucag

SEQ ID NO: 3204394 - RNA, 16 nt, Human
auauucacacuugaac

SEQ ID NO: 3204395 - RNA, 13 nt, Human
auauucacaucuu

SEQ ID NO: 3204396 - RNA, 15 nt, Human
auauucacacuugaa

SEQ ID NO: 3204397 - RNA, 19 nt, Human
auauuucccugaaggaacc

SEQ ID NO: 3204398 - RNA, 14 nt, Human
auauuuaugaagaa

SEQ ID NO: 3204399 - RNA, 13 nt, Human
auauuuaugaaga

SEQ ID NO: 3204400 - RNA, 21 nt, Human
auauuuaugaagaaaauacuu

SEQ ID NO: 3204401 - RNA, 19 nt, Human
auauuuaugaagaaaauac

SEQ ID NO: 3204402 - RNA, 17 nt, Human
auauuuaugaagaaaau

SEQ ID NO: 3204403 - RNA, 15 nt, Human
auauuuaugaagaaa

SEQ ID NO: 3204404 - RNA, 19 nt, Human
auauucauaguagaacuuu

SEQ ID NO: 3204405 - RNA, 15 nt, Human
auagcagcuuauuca

SEQ ID NO: 3204406 - RNA, 15 nt, Human
auagcagccuggcuc

SEQ ID NO: 3204407 - RNA, 21 nt, Human
auagcagccuggcuccccugg

SEQ ID NO: 3204408 - RNA, 15 nt, Human
auagcauugucuauu

SEQ ID NO: 3204409 - RNA, 15 nt, Human
auagcauuguaaaag

SEQ ID NO: 3204410 - RNA, 16 nt, Human
auagcauuuaugguaa

SEQ ID NO: 3204411 - RNA, 17 nt, Human
auagcauugucuauuuu

SEQ ID NO: 3204412 - RNA, 17 nt, Human
auagcauuuaugguaau

SEQ ID NO: 3204413 - RNA, 19 nt, Human
auagccccucuccccgcag

SEQ ID NO: 3204414 - RNA, 17 nt, Human
auagcacagacccugcc

SEQ ID NO: 3204415 - RNA, 18 nt, Human
auagcacagacccugccc

SEQ ID NO: 3204416 - RNA, 19 nt, Human
auagcagaucuguuuugug

SEQ ID NO: 3204417 - RNA, 15 nt, Human
auagcacagacccug

SEQ ID NO: 3204418 - RNA, 23 nt, Human
auagaaacugucuagcacuuccu

SEQ ID NO: 3204419 - RNA, 15 nt, Human
auagaaagcuuuguu

SEQ ID NO: 3204420 - RNA, 15 nt, Human
auagaaaguguucug

SEQ ID NO: 3204421 - RNA, 18 nt, Human
auagaaaguguucuguua

SEQ ID NO: 3204422 - RNA, 17 nt, Human
auagaaaguguucuguu

SEQ ID NO: 3204423 - RNA, 23 nt, Human
auagaaaguguucuguuacaaaa

SEQ ID NO: 3204424 - RNA, 22 nt, Human
auagaaaguguucuguuacaaa

SEQ ID NO: 3204425 - RNA, 20 nt, Human
auagaaaguguucuguuaca

SEQ ID NO: 3204426 - RNA, 19 nt, Human
auagaaaguguucuguuac

SEQ ID NO: 3204427 - RNA, 18 nt, Human
auacuuuaguagacauuu

SEQ ID NO: 3204428 - RNA, 20 nt, Human
auacuuuaguagacauuuau

SEQ ID NO: 3204429 - RNA, 15 nt, Human
auacuuuaucaaugu

SEQ ID NO: 3204430 - RNA, 21 nt, Human
auacuuuaucaaugugucuuu

SEQ ID NO: 3204431 - RNA, 20 nt, Human
auacuuguuuuuguaaagaa

SEQ ID NO: 3204432 - RNA, 15 nt, Human
auacuuguuuuugua

SEQ ID NO: 3204433 - RNA, 19 nt, Human
auacuuguuuuuguaaaga

SEQ ID NO: 3204434 - RNA, 16 nt, Human
auacuuguuuuuguaa

SEQ ID NO: 3204435 - RNA, 16 nt, Human
auacuuugaguuuuga

SEQ ID NO: 3204436 - RNA, 18 nt, Human
auacuuuguauuguccua

SEQ ID NO: 3204437 - RNA, 10 nt, Human
auacuuugua

SEQ ID NO: 3204438 - RNA, 13 nt, Human
auacuuuguauug

SEQ ID NO: 3204439 - RNA, 14 nt, Human
auacuuuguauugu

SEQ ID NO: 3204440 - RNA, 22 nt, Human
auacuuugcagcacagcugaga

SEQ ID NO: 3204441 - RNA, 16 nt, Human
auacuuugcauugucu

SEQ ID NO: 3204442 - RNA, 18 nt, Human
auacuuugcauugucugu

SEQ ID NO: 3204443 - RNA, 17 nt, Human
auagccuaggugacaga

SEQ ID NO: 3204444 - RNA, 15 nt, Human
auagccuaggugaca

SEQ ID NO: 3204445 - RNA, 14 nt, Human
auaguaaaaauaaa

SEQ ID NO: 3204446 - RNA, 13 nt, Human
auaguaaaaauaa

SEQ ID NO: 3204447 - RNA, 14 nt, Human
auaguaaauguagu

SEQ ID NO: 3204448 - RNA, 16 nt, Human
auaguaaauguaguuc

SEQ ID NO: 3204449 - RNA, 23 nt, Human
auaguaauauaauacacaaaauc

SEQ ID NO: 3204450 - RNA, 13 nt, Human
auaguaauauaau

SEQ ID NO: 3204451 - RNA, 21 nt, Human
auauacaacaccaaaaaauau

SEQ ID NO: 3204452 - RNA, 15 nt, Human
auauacaaaacuuua

SEQ ID NO: 3204453 - RNA, 16 nt, Human
auauacaaaacuuuau

SEQ ID NO: 3204454 - RNA, 18 nt, Human
auauaauauugucucuuu

SEQ ID NO: 3204455 - RNA, 11 nt, Human
auauaaugaac

SEQ ID NO: 3204456 - RNA, 21 nt, Human
auauaauacacaaaaucaaau

SEQ ID NO: 3204457 - RNA, 19 nt, Human
auauaauacacaaaaucaa

SEQ ID NO: 3204458 - RNA, 18 nt, Human
auauaauacacaaaauca

SEQ ID NO: 3204459 - RNA, 17 nt, Human
auauaauacacaaaauc

SEQ ID NO: 3204460 - RNA, 16 nt, Human
auauaauacacaaaau

SEQ ID NO: 3204461 - RNA, 22 nt, Human
auaguacuagagauauuuugua

SEQ ID NO: 3204462 - RNA, 23 nt, Human
auaguacuagagauauuuuguaa

SEQ ID NO: 3204463 - RNA, 16 nt, Human
aguuuggcaaacucuc

SEQ ID NO: 3204464 - RNA, 18 nt, Human
aguuuggcaaacucucca

SEQ ID NO: 3204465 - RNA, 10 nt, Human
aguuugcacu

SEQ ID NO: 3204466 - RNA, 23 nt, Human
aguuugcacucaaaucuuaagaa

SEQ ID NO: 3204467 - RNA, 22 nt, Human
aguuugcacucaaaucuuaaga

SEQ ID NO: 3204468 - RNA, 20 nt, Human
aguuugcacucaaaucuuaa

SEQ ID NO: 3204469 - RNA, 18 nt, Human
aguuugcacucaaaucuu

SEQ ID NO: 3204470 - RNA, 13 nt, Human
auaaaacugaugu

SEQ ID NO: 3204471 - RNA, 15 nt, Human
auaaaacugauguga

SEQ ID NO: 3204472 - RNA, 16 nt, Human
auaaaacugaugugaa

SEQ ID NO: 3204473 - RNA, 17 nt, Human
auaaaacugaugugaaa

SEQ ID NO: 3204474 - RNA, 18 nt, Human
auaaaacugaugugaaac

SEQ ID NO: 3204475 - RNA, 19 nt, Human
auaaaacugaugugaaacu

SEQ ID NO: 3204476 - RNA, 20 nt, Human
aguuugagaucagccugggc

SEQ ID NO: 3204477 - RNA, 18 nt, Human
aguuugagaucagccugg

SEQ ID NO: 3204478 - RNA, 19 nt, Human
aguuugagaucagccuggg

SEQ ID NO: 3204479 - RNA, 24 nt, Human
aguuguuaccccaagcgcccuggc

SEQ ID NO: 3204480 - RNA, 22 nt, Human
aguuguuaccccaagcgcccug

SEQ ID NO: 3204481 - RNA, 17 nt, Human
aguuugaaaagcaauau

SEQ ID NO: 3204482 - RNA, 21 nt, Human
aguuugaaaagcaauauugua

SEQ ID NO: 3204483 - RNA, 14 nt, Human
aguuucuuuacauu

SEQ ID NO: 3204484 - RNA, 14 nt, Human
auaaagcaauaaga

SEQ ID NO: 3204485 - RNA, 19 nt, Human
auaaagcaauaagaacaaa

SEQ ID NO: 3204486 - RNA, 14 nt, Human
auaaauuuauuuac

SEQ ID NO: 3204487 - RNA, 19 nt, Human
auaaauuuauuuacugcua

SEQ ID NO: 3204488 - RNA, 17 nt, Human
auaaauuucgcuucuua

SEQ ID NO: 3204489 - RNA, 15 nt, Human
auaaauuuauuuacu

SEQ ID NO: 3204490 - RNA, 15 nt, Human
auaaauugucuuaau

SEQ ID NO: 3204491 - RNA, 18 nt, Human
auaaauugucuuaaugga

SEQ ID NO: 3204492 - RNA, 13 nt, Human
auaaauugucuuu

SEQ ID NO: 3204493 - RNA, 17 nt, Human
auaaauugucuuuaaaa

SEQ ID NO: 3204494 - RNA, 21 nt, Human
auaaauugucuuuaaaaacug

SEQ ID NO: 3204495 - RNA, 22 nt, Human
auaaauugucuuuaaaaacugu

SEQ ID NO: 3204496 - RNA, 14 nt, Human
auaaauuguuuagu

SEQ ID NO: 3204497 - RNA, 22 nt, Human
auaaauuguuuaguggaaaaua

SEQ ID NO: 3204498 - RNA, 13 nt, Human
auaaauuuugaaa

SEQ ID NO: 3204499 - RNA, 14 nt, Human
auaaauuuugaaaa

SEQ ID NO: 3204500 - RNA, 15 nt, Human
auaaauuuugaaaag

SEQ ID NO: 3204501 - RNA, 16 nt, Human
auaaauuuugaaaagu

SEQ ID NO: 3204502 - RNA, 21 nt, Human
auaaauuuugaaaaguaauau

SEQ ID NO: 3204503 - RNA, 15 nt, Human
auaaauuuguguaau

SEQ ID NO: 3204504 - RNA, 20 nt, Human
auaaauuuguguaauauuac

SEQ ID NO: 3204505 - RNA, 18 nt, Human
auaacauguaauuaagua

SEQ ID NO: 3204506 - RNA, 13 nt, Human
auaacauguaauu

SEQ ID NO: 3204507 - RNA, 12 nt, Human
auaacauguaau

SEQ ID NO: 3204508 - RNA, 17 nt, Human
auacccacccccaccca

SEQ ID NO: 3204509 - RNA, 17 nt, Human
auacccccugcaaagcc

SEQ ID NO: 3204510 - RNA, 19 nt, Human
auacccccugcaaagccca

SEQ ID NO: 3204511 - RNA, 14 nt, Human
auacccacccccac

SEQ ID NO: 3204512 - RNA, 16 nt, Human
auacccacccccaccc

SEQ ID NO: 3204513 - RNA, 13 nt, Human
auacccaccccca

SEQ ID NO: 3204514 - RNA, 18 nt, Human
auacaaucauagcauugu

SEQ ID NO: 3204515 - RNA, 15 nt, Human
auacaauacauagga

SEQ ID NO: 3204516 - RNA, 12 nt, Human
auacaaucagcu

SEQ ID NO: 3204517 - RNA, 13 nt, Human
auacaaucagcug

SEQ ID NO: 3204518 - RNA, 14 nt, Human
auacaaucagcugc

SEQ ID NO: 3204519 - RNA, 15 nt, Human
auacaaucagcugcu

SEQ ID NO: 3204520 - RNA, 16 nt, Human
auacaaucagcugcuu

SEQ ID NO: 3204521 - RNA, 21 nt, Human
auacaaucagcugcuuuguua

SEQ ID NO: 3204522 - RNA, 16 nt, Human
auaauguuuauuaaau

SEQ ID NO: 3204523 - RNA, 17 nt, Human
auaauguuuauuaaaug

SEQ ID NO: 3204524 - RNA, 19 nt, Human
auaauguuuauuaaaugcu

SEQ ID NO: 3204525 - RNA, 22 nt, Human
auacacuuacacuuuaugcaca

SEQ ID NO: 3204526 - RNA, 13 nt, Human
auacacuuacacu

SEQ ID NO: 3204527 - RNA, 13 nt, Human
auaccuguccccc

SEQ ID NO: 3204528 - RNA, 14 nt, Human
auaccugucccccu

SEQ ID NO: 3204529 - RNA, 15 nt, Human
auaccugucccccug

SEQ ID NO: 3204530 - RNA, 16 nt, Human
auaccugucccccuga

SEQ ID NO: 3204531 - RNA, 20 nt, Human
auacccccugcaaagcccag

SEQ ID NO: 3204532 - RNA, 18 nt, Human
auaaggguaucuggugac

SEQ ID NO: 3204533 - RNA, 15 nt, Human
auaauguaaauaaag

SEQ ID NO: 3204534 - RNA, 21 nt, Human
auaagccagacaucaacagau

SEQ ID NO: 3204535 - RNA, 22 nt, Human
auaagccagacaucaacagaua

SEQ ID NO: 3204536 - RNA, 18 nt, Human
auaagccaugagaauguu

SEQ ID NO: 3204537 - RNA, 16 nt, Human
auaagccaugagaaug

SEQ ID NO: 3204538 - RNA, 16 nt, Human
auaagggaaaaaucaa

SEQ ID NO: 3204539 - RNA, 13 nt, Human
auaagggaaaaga

SEQ ID NO: 3204540 - RNA, 15 nt, Human
auaagggaaaagaua

SEQ ID NO: 3204541 - RNA, 16 nt, Human
auaagggaaaagauaa

SEQ ID NO: 3204542 - RNA, 15 nt, Human
auaagggaaaaauca

SEQ ID NO: 3204543 - RNA, 13 nt, Human
auaagggaaaaau

SEQ ID NO: 3204544 - RNA, 23 nt, Human
auaagggacugauguuugugcag

SEQ ID NO: 3204545 - RNA, 14 nt, Human
auaagccagacauc

SEQ ID NO: 3204546 - RNA, 19 nt, Human
aucccaugagccucagcau

SEQ ID NO: 3204547 - RNA, 16 nt, Human
auccccaagccuggca

SEQ ID NO: 3204548 - RNA, 18 nt, Human
auccccaagccuggcaag

SEQ ID NO: 3204549 - RNA, 14 nt, Human
aucccgugcuuuua

SEQ ID NO: 3204550 - RNA, 15 nt, Human
aucccggcugcccuu

SEQ ID NO: 3204551 - RNA, 19 nt, Human
auccagacccggcugcgug

SEQ ID NO: 3204552 - RNA, 15 nt, Human
auccagacccggcug

SEQ ID NO: 3204553 - RNA, 13 nt, Human
auccacucgccuu

SEQ ID NO: 3204554 - RNA, 19 nt, Human
auccaccguccccucccag

SEQ ID NO: 3204555 - RNA, 16 nt, Human
auccaccguccccucc

SEQ ID NO: 3204556 - RNA, 18 nt, Human
aucgcccuggcaggcagg

SEQ ID NO: 3204557 - RNA, 14 nt, Human
aucgccagcaaaac

SEQ ID NO: 3204558 - RNA, 19 nt, Human
auccuuguguuuaucagaa

SEQ ID NO: 3204559 - RNA, 18 nt, Human
auccuuucacuucuuucc

SEQ ID NO: 3204560 - RNA, 19 nt, Human
auccuuucacuucuuuccc

SEQ ID NO: 3204561 - RNA, 22 nt, Human
auccuuucacuucuuucccuuc

SEQ ID NO: 3204562 - RNA, 20 nt, Human
auccuuucacuucuuucccu

SEQ ID NO: 3204563 - RNA, 23 nt, Human
auccuucaaagucucaaugaaau

SEQ ID NO: 3204564 - RNA, 15 nt, Human
auccuugacuuuuua

SEQ ID NO: 3204565 - RNA, 14 nt, Human
auccuugacuuuuu

SEQ ID NO: 3204566 - RNA, 15 nt, Human
auccuugucaguugu

SEQ ID NO: 3204567 - RNA, 12 nt, Human
auccuucccacu

SEQ ID NO: 3204568 - RNA, 14 nt, Human
auccuugauaauau

SEQ ID NO: 3204569 - RNA, 14 nt, Human
auccuuacaaauga

SEQ ID NO: 3204570 - RNA, 21 nt, Human
auccuuacaaaugauugcuuu

SEQ ID NO: 3204571 - RNA, 18 nt, Human
auccuuacaaaugauugc

SEQ ID NO: 3204572 - RNA, 17 nt, Human
auccuuacaaaugauug

SEQ ID NO: 3204573 - RNA, 16 nt, Human
auccuuacaaaugauu

SEQ ID NO: 3204574 - RNA, 21 nt, Human
auccuuaucuaguguuugauu

SEQ ID NO: 3204575 - RNA, 14 nt, Human
aucaugucuggcua

SEQ ID NO: 3204576 - RNA, 14 nt, Human
aucaugucuauugu

SEQ ID NO: 3204577 - RNA, 16 nt, Human
aucaugucuauugucc

SEQ ID NO: 3204578 - RNA, 17 nt, Human
aucaugucuauugucca

SEQ ID NO: 3204579 - RNA, 21 nt, Human
aucaugucuauuguccaaagu

SEQ ID NO: 3204580 - RNA, 22 nt, Human
aucagcuugcccuguuaaaaga

SEQ ID NO: 3204581 - RNA, 20 nt, Human
aucaccuaauuaauuucagu

SEQ ID NO: 3204582 - RNA, 16 nt, Human
aucaugaaugcuuuua

SEQ ID NO: 3204583 - RNA, 18 nt, Human
aucaugaaugcuuuuagu

SEQ ID NO: 3204584 - RNA, 23 nt, Human
aucaugaauaacugauuaguaag

SEQ ID NO: 3204585 - RNA, 15 nt, Human
aucaugaauaacuga

SEQ ID NO: 3204586 - RNA, 20 nt, Human
aucaaagagguuuuaaaaaa

SEQ ID NO: 3204587 - RNA, 23 nt, Human
aucaaagagguuuuaaaaaaauc

SEQ ID NO: 3204588 - RNA, 12 nt, Human
aucaaaauuaca

SEQ ID NO: 3204589 - RNA, 14 nt, Human
aucaaaauuacaua

SEQ ID NO: 3204590 - RNA, 21 nt, Human
auauuucccugaaggaaccaa

SEQ ID NO: 3204591 - RNA, 18 nt, Human
auauuuccuauaccauuu

SEQ ID NO: 3204592 - RNA, 22 nt, Human
auauuuccuauaccauuuccgu

SEQ ID NO: 3204593 - RNA, 21 nt, Human
auauuuccuauaccauuuccg

SEQ ID NO: 3204594 - RNA, 23 nt, Human
auauuuccuauaccauuuccgua

SEQ ID NO: 3204595 - RNA, 24 nt, Human
aucaaaagguuaauaaaguaauua

SEQ ID NO: 3204596 - RNA, 14 nt, Human
aucaaauaugcaaa

SEQ ID NO: 3204597 - RNA, 21 nt, Human
aucacacccagcccauguggc

SEQ ID NO: 3204598 - RNA, 16 nt, Human
aucacacauguucaga

SEQ ID NO: 3204599 - RNA, 13 nt, Human
aucaccagacagg

SEQ ID NO: 3204600 - RNA, 20 nt, Human
aucaccaacgucugugccau

SEQ ID NO: 3204601 - RNA, 17 nt, Human
aucaccuaauuaauuuc

SEQ ID NO: 3204602 - RNA, 19 nt, Human
aucaccgaugcaaacauug

SEQ ID NO: 3204603 - RNA, 13 nt, Human
aucaccagggcca

SEQ ID NO: 3204604 - RNA, 21 nt, Human
aucaccgaaaacguggcugcu

SEQ ID NO: 3204605 - RNA, 22 nt, Human
aucucugcaggaaauggcugug

SEQ ID NO: 3204606 - RNA, 16 nt, Human
aucucugcuuuggaaa

SEQ ID NO: 3204607 - RNA, 22 nt, Human
aucuggacuccucuguccaggc

SEQ ID NO: 3204608 - RNA, 23 nt, Human
aucucugacuuucuuuagucuuu

SEQ ID NO: 3204609 - RNA, 20 nt, Human
aucucugaguucuguguauu

SEQ ID NO: 3204610 - RNA, 20 nt, Human
aucuggaugccucauuaugu

SEQ ID NO: 3204611 - RNA, 15 nt, Human
aucuggauucaaauu

SEQ ID NO: 3204612 - RNA, 18 nt, Human
aucuggaguucucaaaga

SEQ ID NO: 3204613 - RNA, 18 nt, Human
aucuggagucuuugauaa

SEQ ID NO: 3204614 - RNA, 19 nt, Human
aucuggagagcccagaguc

SEQ ID NO: 3204615 - RNA, 14 nt, Human
aucuuauuaaaguu

SEQ ID NO: 3204616 - RNA, 18 nt, Human
aucuggguagcuguaagg

SEQ ID NO: 3204617 - RNA, 17 nt, Human
aucuggguagcuguaag

SEQ ID NO: 3204618 - RNA, 15 nt, Human
aucuggguagcugua

SEQ ID NO: 3204619 - RNA, 14 nt, Human
aucuggguagcugu

SEQ ID NO: 3204620 - RNA, 15 nt, Human
aucuuauuaaaguuu

SEQ ID NO: 3204621 - RNA, 18 nt, Human
aucuuauuaaaguuucaa

SEQ ID NO: 3204622 - RNA, 16 nt, Human
aucuuauuaaaguuuc

SEQ ID NO: 3204623 - RNA, 23 nt, Human
aucuuauuaaaguuucaaaaauc

SEQ ID NO: 3204624 - RNA, 22 nt, Human
aucuuauuaaaguuucaaaaau

SEQ ID NO: 3204625 - RNA, 20 nt, Human
aucuuauuaaaguuucaaaa

SEQ ID NO: 3204626 - RNA, 19 nt, Human
aucuuauuaaaguuucaaa

SEQ ID NO: 3204627 - RNA, 15 nt, Human
aucuucguuaguaau

SEQ ID NO: 3204628 - RNA, 19 nt, Human
aucuucguuaguaaucugu

SEQ ID NO: 3204629 - RNA, 21 nt, Human
aucuucguuaguaaucuguau

SEQ ID NO: 3204630 - RNA, 22 nt, Human
aucuucguuaguaaucuguaua

SEQ ID NO: 3204631 - RNA, 23 nt, Human
aucuuccuggucgaaaguuagua

SEQ ID NO: 3204632 - RNA, 22 nt, Human
aucuuccuggucgaaaguuagu

SEQ ID NO: 3204633 - RNA, 20 nt, Human
aucuuccuggucgaaaguua

SEQ ID NO: 3204634 - RNA, 19 nt, Human
aucuuccuggucgaaaguu

SEQ ID NO: 3204635 - RNA, 18 nt, Human
aucuuccuggucgaaagu

SEQ ID NO: 3204636 - RNA, 20 nt, Human
aucuuccucugcuaaauuga

SEQ ID NO: 3204637 - RNA, 19 nt, Human
aucuuccucugcuaaauug

SEQ ID NO: 3204638 - RNA, 18 nt, Human
aucuuccucugcuaaauu

SEQ ID NO: 3204639 - RNA, 16 nt, Human
aucuuccucugcuaaa

SEQ ID NO: 3204640 - RNA, 15 nt, Human
aucuuccucugcuaa

SEQ ID NO: 3204641 - RNA, 14 nt, Human
aucuuccucugcua

SEQ ID NO: 3204642 - RNA, 22 nt, Human
aucuaguaauauauuuaaaggg

SEQ ID NO: 3204643 - RNA, 19 nt, Human
aucuaguaauauauuuaaa

SEQ ID NO: 3204644 - RNA, 18 nt, Human
aucuaguaauauauuuaa

SEQ ID NO: 3204645 - RNA, 16 nt, Human
aucuaguaauauauuu

SEQ ID NO: 3204646 - RNA, 14 nt, Human
aucuaguaauauau

SEQ ID NO: 3204647 - RNA, 19 nt, Human
aucuaggggagccuugauu

SEQ ID NO: 3204648 - RNA, 20 nt, Human
aucuaggggagccuugauuc

SEQ ID NO: 3204649 - RNA, 17 nt, Human
aucuaggggagccuuga

SEQ ID NO: 3204650 - RNA, 12 nt, Human
aucuaguguuug

SEQ ID NO: 3204651 - RNA, 19 nt, Human
aucuauaacuacauauuga

SEQ ID NO: 3204652 - RNA, 17 nt, Human
aucuauaacuacauauu

SEQ ID NO: 3204653 - RNA, 11 nt, Human
aucuauaauau

SEQ ID NO: 3204654 - RNA, 15 nt, Human
aucuauaaacacugu

SEQ ID NO: 3204655 - RNA, 14 nt, Human
aucuauaaacacug

SEQ ID NO: 3204656 - RNA, 13 nt, Human
aucuauaaacacu

SEQ ID NO: 3204657 - RNA, 21 nt, Human
aucucccuuuuccaugacugu

SEQ ID NO: 3204658 - RNA, 11 nt, Human
aucuauauaaa

SEQ ID NO: 3204659 - RNA, 12 nt, Human
aucuauauaaaa

SEQ ID NO: 3204660 - RNA, 13 nt, Human
aucuauauaaaau

SEQ ID NO: 3204661 - RNA, 14 nt, Human
aucuauauaaaaua

SEQ ID NO: 3204662 - RNA, 16 nt, Human
aucuauauaaaauaac

SEQ ID NO: 3204663 - RNA, 17 nt, Human
aucuauauaaaauaacu

SEQ ID NO: 3204664 - RNA, 21 nt, Human
aucuauaggaagauugaaccu

SEQ ID NO: 3204665 - RNA, 14 nt, Human
aucuauagaaagug

SEQ ID NO: 3204666 - RNA, 13 nt, Human
aucuauagaaagu

SEQ ID NO: 3204667 - RNA, 22 nt, Human
aucuauagaaaguguucuguua

SEQ ID NO: 3204668 - RNA, 17 nt, Human
aucuauagaaaguguuc

SEQ ID NO: 3204669 - RNA, 16 nt, Human
aucuauagaaaguguu

SEQ ID NO: 3204670 - RNA, 15 nt, Human
aucuauagaaagugu

SEQ ID NO: 3204671 - RNA, 12 nt, Human
aucuauauuaga

SEQ ID NO: 3204672 - RNA, 23 nt, Human
aucuauagaaaguguucuguuac

SEQ ID NO: 3204673 - RNA, 16 nt, Human
augaaaauauuuaaag

SEQ ID NO: 3204674 - RNA, 14 nt, Human
augaaaauauuuaa

SEQ ID NO: 3204675 - RNA, 13 nt, Human
augaaaauauuua

SEQ ID NO: 3204676 - RNA, 12 nt, Human
augaaaauauuu

SEQ ID NO: 3204677 - RNA, 13 nt, Human
augagggucuugg

SEQ ID NO: 3204678 - RNA, 14 nt, Human
augagggggcucag

SEQ ID NO: 3204679 - RNA, 15 nt, Human
augagggggcucagu

SEQ ID NO: 3204680 - RNA, 15 nt, Human
augacucuuuauugu

SEQ ID NO: 3204681 - RNA, 18 nt, Human
augacucuuuauugucug

SEQ ID NO: 3204682 - RNA, 16 nt, Human
augacugaaagcacug

SEQ ID NO: 3204683 - RNA, 13 nt, Human
augaaguacucau

SEQ ID NO: 3204684 - RNA, 21 nt, Human
augaaguacucauacauguua

SEQ ID NO: 3204685 - RNA, 17 nt, Human
augaaaacauggaacag

SEQ ID NO: 3204686 - RNA, 20 nt, Human
augaaaacauggaacagugu

SEQ ID NO: 3204687 - RNA, 18 nt, Human
augaccacacuccagcug

SEQ ID NO: 3204688 - RNA, 15 nt, Human
augaccacacuccag

SEQ ID NO: 3204689 - RNA, 20 nt, Human
augaccauaaaauuagacau

SEQ ID NO: 3204690 - RNA, 20 nt, Human
augacguacaaguaguucug

SEQ ID NO: 3204691 - RNA, 23 nt, Human
augacguacaaguaguucuguau

SEQ ID NO: 3204692 - RNA, 19 nt, Human
augacguacaaguaguucu

SEQ ID NO: 3204693 - RNA, 24 nt, Human
augacguacaaguaguucuguauu

SEQ ID NO: 3204694 - RNA, 17 nt, Human
auggcugugccucugcc

SEQ ID NO: 3204695 - RNA, 16 nt, Human
auggcugugccucugc

SEQ ID NO: 3204696 - RNA, 15 nt, Human
auggcugugccucug

SEQ ID NO: 3204697 - RNA, 18 nt, Human
augcuuuaggauguacag

SEQ ID NO: 3204698 - RNA, 15 nt, Human
augcuuguguuucuu

SEQ ID NO: 3204699 - RNA, 15 nt, Human
augcuuuagcuuauu

SEQ ID NO: 3204700 - RNA, 14 nt, Human
augcuuuagcuuau

SEQ ID NO: 3204701 - RNA, 19 nt, Human
augcugacccaugggcagg

SEQ ID NO: 3204702 - RNA, 17 nt, Human
augcugacccaugggca

SEQ ID NO: 3204703 - RNA, 21 nt, Human
augcugacuguacuccuccca

SEQ ID NO: 3204704 - RNA, 20 nt, Human
augcugacuguacuccuccc

SEQ ID NO: 3204705 - RNA, 19 nt, Human
augcugacuguacuccucc

SEQ ID NO: 3204706 - RNA, 16 nt, Human
augcugacccaugggc

SEQ ID NO: 3204707 - RNA, 13 nt, Human
augcugacccaug

SEQ ID NO: 3204708 - RNA, 13 nt, Human
augcugcccugug

SEQ ID NO: 3204709 - RNA, 12 nt, Human
augcugcccugu

SEQ ID NO: 3204710 - RNA, 14 nt, Human
augcugcccuguga

SEQ ID NO: 3204711 - RNA, 15 nt, Human
augcugcccugugag

SEQ ID NO: 3204712 - RNA, 16 nt, Human
augcugcccugugagu

SEQ ID NO: 3204713 - RNA, 15 nt, Human
augcugccuccagaa

SEQ ID NO: 3204714 - RNA, 12 nt, Human
augcugccucca

SEQ ID NO: 3204715 - RNA, 14 nt, Human
augcacaauuccau

SEQ ID NO: 3204716 - RNA, 16 nt, Human
augaugggucaguugu

SEQ ID NO: 3204717 - RNA, 18 nt, Human
augcacaaacagaggccg

SEQ ID NO: 3204718 - RNA, 20 nt, Human
augaugguuuccaauuucau

SEQ ID NO: 3204719 - RNA, 19 nt, Human
augaugaaaauauuuaaag

SEQ ID NO: 3204720 - RNA, 18 nt, Human
augaugaaaugaggucag

SEQ ID NO: 3204721 - RNA, 23 nt, Human
augaugaaaugaggucagagccu

SEQ ID NO: 3204722 - RNA, 21 nt, Human
augaugaucuuuaaaauacac

SEQ ID NO: 3204723 - RNA, 14 nt, Human
augaugauuucaga

SEQ ID NO: 3204724 - RNA, 18 nt, Human
augaugaucuuuaaaaua

SEQ ID NO: 3204725 - RNA, 15 nt, Human
augaugauccuaggc

SEQ ID NO: 3204726 - RNA, 15 nt, Human
augaugaaaauauuu

SEQ ID NO: 3204727 - RNA, 13 nt, Human
augaugaaaauau

SEQ ID NO: 3204728 - RNA, 21 nt, Human
augaucuuugcagacaggcaa

SEQ ID NO: 3204729 - RNA, 19 nt, Human
augaucuuugcagacaggc

SEQ ID NO: 3204730 - RNA, 18 nt, Human
augaucuuugcagacagg

SEQ ID NO: 3204731 - RNA, 16 nt, Human
augaucuuuaaaauac

SEQ ID NO: 3204732 - RNA, 17 nt, Human
augaucuuugcagacag

SEQ ID NO: 3204733 - RNA, 18 nt, Human
augaucuucuuuauaauu

SEQ ID NO: 3204734 - RNA, 19 nt, Human
augccuggauggggcugca

SEQ ID NO: 3204735 - RNA, 12 nt, Human
augccugcucuu

SEQ ID NO: 3204736 - RNA, 20 nt, Human
augccuggauggggcugcac

SEQ ID NO: 3204737 - RNA, 19 nt, Human
augccugcucuuuggccug

SEQ ID NO: 3204738 - RNA, 18 nt, Human
augccugcuuuuuggaaa

SEQ ID NO: 3204739 - RNA, 19 nt, Human
augccugcuuuuuggaaag

SEQ ID NO: 3204740 - RNA, 23 nt, Human
augccugcuuuuuggaaagucag

SEQ ID NO: 3204741 - RNA, 13 nt, Human
augcauuauuaaa

SEQ ID NO: 3204742 - RNA, 16 nt, Human
augcauuauuaaauug

SEQ ID NO: 3204743 - RNA, 19 nt, Human
augcauucacauuuagaaa

SEQ ID NO: 3204744 - RNA, 22 nt, Human
augcauucacauuuagaaaagu

SEQ ID NO: 3204745 - RNA, 23 nt, Human
augcauucacauuuagaaaagug

SEQ ID NO: 3204746 - RNA, 20 nt, Human
augcauuaaaagaaaauaaa

SEQ ID NO: 3204747 - RNA, 17 nt, Human
augcauuaaaagaaaau

SEQ ID NO: 3204748 - RNA, 16 nt, Human
augcauuaaaagaaaa

SEQ ID NO: 3204749 - RNA, 15 nt, Human
augcauuaaaagaaa

SEQ ID NO: 3204750 - RNA, 19 nt, Human
augccugucuuaauuuucu

SEQ ID NO: 3204751 - RNA, 21 nt, Human
augccuuguauaauauugaaa

SEQ ID NO: 3204752 - RNA, 13 nt, Human
augugaaaaaucu

SEQ ID NO: 3204753 - RNA, 14 nt, Human
augugaaaaaucug

SEQ ID NO: 3204754 - RNA, 19 nt, Human
augugaaaaaucugcuguu

SEQ ID NO: 3204755 - RNA, 19 nt, Human
augucacaggcagguccag

SEQ ID NO: 3204756 - RNA, 17 nt, Human
augucacaggcaggucc

SEQ ID NO: 3204757 - RNA, 18 nt, Human
augucaaugaacaagcau

SEQ ID NO: 3204758 - RNA, 16 nt, Human
augugaacagcggcug

SEQ ID NO: 3204759 - RNA, 17 nt, Human
augugaaauguaacugu

SEQ ID NO: 3204760 - RNA, 15 nt, Human
augugaacacaucag

SEQ ID NO: 3204761 - RNA, 15 nt, Human
auguauuugcugaca

SEQ ID NO: 3204762 - RNA, 13 nt, Human
auguauuuguagu

SEQ ID NO: 3204763 - RNA, 15 nt, Human
auguauuuguagugu

SEQ ID NO: 3204764 - RNA, 19 nt, Human
auguauuuguaguguuauu

SEQ ID NO: 3204765 - RNA, 21 nt, Human
auguauuuguaguguuauugc

SEQ ID NO: 3204766 - RNA, 13 nt, Human
augucacaggcag

SEQ ID NO: 3204767 - RNA, 23 nt, Human
auguaauuuuguguaagaaauac

SEQ ID NO: 3204768 - RNA, 22 nt, Human
auguaauuuuguguaagaaaua

SEQ ID NO: 3204769 - RNA, 17 nt, Human
auguaauuuuguguaag

SEQ ID NO: 3204770 - RNA, 16 nt, Human
auguaauuuuguguaa

SEQ ID NO: 3204771 - RNA, 15 nt, Human
auguaauuuugugua

SEQ ID NO: 3204772 - RNA, 14 nt, Human
auguaacugcucuu

SEQ ID NO: 3204773 - RNA, 23 nt, Human
auguaauuaaguacuauguauca

SEQ ID NO: 3204774 - RNA, 23 nt, Human
auguaacuguuaccauuggaaau

SEQ ID NO: 3204775 - RNA, 22 nt, Human
auguaacuguuaccauuggaaa

SEQ ID NO: 3204776 - RNA, 21 nt, Human
auguaacuguuaccauuggaa

SEQ ID NO: 3204777 - RNA, 18 nt, Human
auguaacuguuaccauug

SEQ ID NO: 3204778 - RNA, 22 nt, Human
auguaacuguccguaguaucag

SEQ ID NO: 3204779 - RNA, 13 nt, Human
auguaacuguuac

SEQ ID NO: 3204780 - RNA, 17 nt, Human
auguaacuguuaccauu

SEQ ID NO: 3204781 - RNA, 14 nt, Human
auguaacuguuacc

SEQ ID NO: 3204782 - RNA, 20 nt, Human
auguaacugcucuugggcaa

SEQ ID NO: 3204783 - RNA, 15 nt, Human
auguaacugcucuug

SEQ ID NO: 3204784 - RNA, 13 nt, Human
auguaauuugugu

SEQ ID NO: 3204785 - RNA, 20 nt, Human
auguaauuuuauuuuaaaau

SEQ ID NO: 3204786 - RNA, 23 nt, Human
auguaauuuuauuuuaaaauuuc

SEQ ID NO: 3204787 - RNA, 12 nt, Human
auguaauuuugu

SEQ ID NO: 3204788 - RNA, 20 nt, Human
auguaacuuugguuaaaauc

SEQ ID NO: 3204789 - RNA, 20 nt, Human
augggugcuuggaggaagga

SEQ ID NO: 3204790 - RNA, 21 nt, Human
augggugcuuggaggaaggaa

SEQ ID NO: 3204791 - RNA, 23 nt, Human
augggugcuuggaggaaggaaac

SEQ ID NO: 3204792 - RNA, 15 nt, Human
augguaaucauauua

SEQ ID NO: 3204793 - RNA, 13 nt, Human
augguaagagaaa

SEQ ID NO: 3204794 - RNA, 15 nt, Human
augguaagagaaaag

SEQ ID NO: 3204795 - RNA, 16 nt, Human
augguaagagaaaaga

SEQ ID NO: 3204796 - RNA, 15 nt, Human
augguaaaauuuugu

SEQ ID NO: 3204797 - RNA, 22 nt, Human
augguaguuucugugguuggcu

SEQ ID NO: 3204798 - RNA, 23 nt, Human
augguaguuucugugguuggcug

SEQ ID NO: 3204799 - RNA, 15 nt, Human
augguccauagcacu

SEQ ID NO: 3204800 - RNA, 12 nt, Human
augguaguuucu

SEQ ID NO: 3204801 - RNA, 13 nt, Human
augguaguuucug

SEQ ID NO: 3204802 - RNA, 15 nt, Human
augguaguuucugug

SEQ ID NO: 3204803 - RNA, 18 nt, Human
augguaguuucugugguu

SEQ ID NO: 3204804 - RNA, 19 nt, Human
augguaguuucugugguug

SEQ ID NO: 3204805 - RNA, 13 nt, Human
augguagaaaaau

SEQ ID NO: 3204806 - RNA, 18 nt, Human
augguagaaaaauuucac

SEQ ID NO: 3204807 - RNA, 16 nt, Human
auguuccuagugaaag

SEQ ID NO: 3204808 - RNA, 15 nt, Human
auguuccuagugaaa

SEQ ID NO: 3204809 - RNA, 13 nt, Human
auguguauaaauu

SEQ ID NO: 3204810 - RNA, 14 nt, Human
auguguauaaauug

SEQ ID NO: 3204811 - RNA, 19 nt, Human
auguguauaaauugucuuu

SEQ ID NO: 3204812 - RNA, 13 nt, Human
auguucccuccgg

SEQ ID NO: 3204813 - RNA, 15 nt, Human
auguucccacuucaa

SEQ ID NO: 3204814 - RNA, 13 nt, Human
auguguaaguauu

SEQ ID NO: 3204815 - RNA, 16 nt, Human
auguguaucaguguuu

SEQ ID NO: 3204816 - RNA, 21 nt, Human
auguguaucaguguuuaugug

SEQ ID NO: 3204817 - RNA, 21 nt, Human
auguguagcugcaaaaauaau

SEQ ID NO: 3204818 - RNA, 17 nt, Human
auguuccuagugaaaga

SEQ ID NO: 3204819 - RNA, 16 nt, Human
auguucucucuucucc

SEQ ID NO: 3204820 - RNA, 17 nt, Human
auguucucucuucucca

SEQ ID NO: 3204821 - RNA, 13 nt, Human
auguucucugagg

SEQ ID NO: 3204822 - RNA, 14 nt, Human
auguucugggacac

SEQ ID NO: 3204823 - RNA, 13 nt, Human
auguucugggaca

SEQ ID NO: 3204824 - RNA, 15 nt, Human
auguucugggacaca

SEQ ID NO: 3204825 - RNA, 17 nt, Human
auguuugccucugccuc

SEQ ID NO: 3204826 - RNA, 15 nt, Human
auguuugccucugcc

SEQ ID NO: 3204827 - RNA, 14 nt, Human
auguuugccucugc

SEQ ID NO: 3204828 - RNA, 15 nt, Human
auguuuccuucccuc

SEQ ID NO: 3204829 - RNA, 14 nt, Human
auguuuccuucccu

SEQ ID NO: 3204830 - RNA, 13 nt, Human
auguuucuaaggu

SEQ ID NO: 3204831 - RNA, 15 nt, Human
auguuuccauaguuu

SEQ ID NO: 3204832 - RNA, 23 nt, Human
cuuucaauaggaaaaacugauuu

SEQ ID NO: 3204833 - RNA, 14 nt, Human
cuuucacaaccuuc

SEQ ID NO: 3204834 - RNA, 23 nt, Human
cuuucagccaagaauucuuaaau

SEQ ID NO: 3204835 - RNA, 20 nt, Human
cuuucagccaagaauucuua

SEQ ID NO: 3204836 - RNA, 19 nt, Human
cuuucaggagcuccauaca

SEQ ID NO: 3204837 - RNA, 22 nt, Human
cuuuccugaggcugggcucccu

SEQ ID NO: 3204838 - RNA, 21 nt, Human
cuuuccugaggcugggcuccc

SEQ ID NO: 3204839 - RNA, 17 nt, Human
cuuuccuguuucucagu

SEQ ID NO: 3204840 - RNA, 15 nt, Human
cuuuccugugccagg

SEQ ID NO: 3204841 - RNA, 14 nt, Human
cuuuccugugccag

SEQ ID NO: 3204842 - RNA, 13 nt, Human
cuuuccugugcca

SEQ ID NO: 3204843 - RNA, 13 nt, Human
cuuuuaucucaga

SEQ ID NO: 3204844 - RNA, 19 nt, Human
cuuuguauaguuauguaaa

SEQ ID NO: 3204845 - RNA, 21 nt, Human
cuuuguauaguuauguaaaua

SEQ ID NO: 3204846 - RNA, 16 nt, Human
cuuuguauacaaguac

SEQ ID NO: 3204847 - RNA, 17 nt, Human
cuuuguauacaaguacu

SEQ ID NO: 3204848 - RNA, 12 nt, Human
cuuuguauaguu

SEQ ID NO: 3204849 - RNA, 15 nt, Human
cuuuguauaguuaug

SEQ ID NO: 3204850 - RNA, 18 nt, Human
cuuuguauaguuauguaa

SEQ ID NO: 3204851 - RNA, 20 nt, Human
cuuuguagcauuuggugcuu

SEQ ID NO: 3204852 - RNA, 16 nt, Human
cuuuguagcauuuggu

SEQ ID NO: 3204853 - RNA, 20 nt, Human
cuuuuaguuuuucugucccu

SEQ ID NO: 3204854 - RNA, 18 nt, Human
cuuuuaguuuuucugucc

SEQ ID NO: 3204855 - RNA, 14 nt, Human
cuuuuaguuuuucu

SEQ ID NO: 3204856 - RNA, 16 nt, Human
cuuucuagccagagga

SEQ ID NO: 3204857 - RNA, 22 nt, Human
cuuugauauauaggacauugau

SEQ ID NO: 3204858 - RNA, 22 nt, Human
cuuugauauuuucaacgcagcc

SEQ ID NO: 3204859 - RNA, 11 nt, Human
cuuugauguca

SEQ ID NO: 3204860 - RNA, 20 nt, Human
cuuugaucaugaauaacuga

SEQ ID NO: 3204861 - RNA, 14 nt, Human
cuuugaucaugaau

SEQ ID NO: 3204862 - RNA, 15 nt, Human
cuuucuagccagagg

SEQ ID NO: 3204863 - RNA, 16 nt, Human
cuuucuacucauuuua

SEQ ID NO: 3204864 - RNA, 18 nt, Human
cuuucuagaaagaauaaa

SEQ ID NO: 3204865 - RNA, 14 nt, Human
cuuucuagaaagaa

SEQ ID NO: 3204866 - RNA, 16 nt, Human
cuuucuacuuccaaga

SEQ ID NO: 3204867 - RNA, 15 nt, Human
cuuucuacuuccaag

SEQ ID NO: 3204868 - RNA, 17 nt, Human
cuuucuacccagcgagc

SEQ ID NO: 3204869 - RNA, 17 nt, Human
cuuugggccuggcuccc

SEQ ID NO: 3204870 - RNA, 14 nt, Human
cuuugggcugcccu

SEQ ID NO: 3204871 - RNA, 22 nt, Human
cuuugaugucagcaguugcugg

SEQ ID NO: 3204872 - RNA, 12 nt, Human
cuuugauguguu

SEQ ID NO: 3204873 - RNA, 13 nt, Human
cuuugauguguug

SEQ ID NO: 3204874 - RNA, 15 nt, Human
cuuugauguguuguu

SEQ ID NO: 3204875 - RNA, 16 nt, Human
cuuugauguguuguuc

SEQ ID NO: 3204876 - RNA, 18 nt, Human
cuuugauguguuguucuu

SEQ ID NO: 3204877 - RNA, 21 nt, Human
cuuugggcugcccuggugcug

SEQ ID NO: 3204878 - RNA, 20 nt, Human
cuuugggcugcccuggugcu

SEQ ID NO: 3204879 - RNA, 19 nt, Human
cuuugggcugcccuggugc

SEQ ID NO: 3204880 - RNA, 15 nt, Human
cuuugggcugcccug

SEQ ID NO: 3204881 - RNA, 13 nt, Human
cuuuguaccaaaa

SEQ ID NO: 3204882 - RNA, 15 nt, Human
cuuuguaccaaaauu

SEQ ID NO: 3204883 - RNA, 15 nt, Human
cuuuguaaauuguca

SEQ ID NO: 3204884 - RNA, 18 nt, Human
cuuuguaaccacaacuuu

SEQ ID NO: 3204885 - RNA, 17 nt, Human
cuuuguaaauucugauu

SEQ ID NO: 3204886 - RNA, 15 nt, Human
cuuuguaaauucuga

SEQ ID NO: 3204887 - RNA, 16 nt, Human
cuuuguaaauucugau

SEQ ID NO: 3204888 - RNA, 20 nt, Human
cuuugauguguuguucuugg

SEQ ID NO: 3204889 - RNA, 12 nt, Human
cuuuguaaauuc

SEQ ID NO: 3204890 - RNA, 15 nt, Human
gaaagacuauucaaa

SEQ ID NO: 3204891 - RNA, 14 nt, Human
gaaagacuauucaa

SEQ ID NO: 3204892 - RNA, 20 nt, Human
gaaagacuaucuaaauguug

SEQ ID NO: 3204893 - RNA, 21 nt, Human
gaaaggcuccaggagcagcca

SEQ ID NO: 3204894 - RNA, 20 nt, Human
gaaaggcuccaggagcagcc

SEQ ID NO: 3204895 - RNA, 22 nt, Human
gaaaggcuccaggagcagccac

SEQ ID NO: 3204896 - RNA, 19 nt, Human
gaaacuuugagaucuaaaa

SEQ ID NO: 3204897 - RNA, 22 nt, Human
gaaacuuugagaucuaaaaaua

SEQ ID NO: 3204898 - RNA, 17 nt, Human
gaaaucaaauaugcaaa

SEQ ID NO: 3204899 - RNA, 18 nt, Human
gaaaucaaauaugcaaag

SEQ ID NO: 3204900 - RNA, 20 nt, Human
gaaaucaaauaugcaaagca

SEQ ID NO: 3204901 - RNA, 19 nt, Human
gaaaucaaauaugcaaagc

SEQ ID NO: 3204902 - RNA, 19 nt, Human
gaaaucaccgaaaacgugg

SEQ ID NO: 3204903 - RNA, 19 nt, Human
gaaaucaguaaacacugug

SEQ ID NO: 3204904 - RNA, 16 nt, Human
gaaaucauauuuggaa

SEQ ID NO: 3204905 - RNA, 16 nt, Human
gaaaucaguaaacacu

SEQ ID NO: 3204906 - RNA, 20 nt, Human
gaaaggucaccucacucagc

SEQ ID NO: 3204907 - RNA, 18 nt, Human
gaaaggucaccucacuca

SEQ ID NO: 3204908 - RNA, 16 nt, Human
gaaaggucaccucacu

SEQ ID NO: 3204909 - RNA, 14 nt, Human
gaaaggucaccuca

SEQ ID NO: 3204910 - RNA, 17 nt, Human
gaaaggguucuguaaaa

SEQ ID NO: 3204911 - RNA, 12 nt, Human
gaaagggucucc

SEQ ID NO: 3204912 - RNA, 22 nt, Human
gaaagggacuuggaagcuccgc

SEQ ID NO: 3204913 - RNA, 20 nt, Human
gaaagggacgcuacccggga

SEQ ID NO: 3204914 - RNA, 19 nt, Human
gaaagggacuuggaagcuc

SEQ ID NO: 3204915 - RNA, 15 nt, Human
cuuuugggaaaugcu

SEQ ID NO: 3204916 - RNA, 19 nt, Human
cuuuugguucauuuucaga

SEQ ID NO: 3204917 - RNA, 21 nt, Human
cuuuugguuaugaauacuuug

SEQ ID NO: 3204918 - RNA, 18 nt, Human
cuuuugucuaugggacuc

SEQ ID NO: 3204919 - RNA, 13 nt, Human
cuuuugccauuga

SEQ ID NO: 3204920 - RNA, 23 nt, Human
cuuuugcccacacuugggagcaa

SEQ ID NO: 3204921 - RNA, 13 nt, Human
cuuuuggagucag

SEQ ID NO: 3204922 - RNA, 17 nt, Human
cuuuuuuucucuagagu

SEQ ID NO: 3204923 - RNA, 18 nt, Human
cuuuuuuucuauauuauu

SEQ ID NO: 3204924 - RNA, 19 nt, Human
cuuuuuuucuauauuauug

SEQ ID NO: 3204925 - RNA, 20 nt, Human
cuuuuuuuuuuuugagacag

SEQ ID NO: 3204926 - RNA, 22 nt, Human
cuuuuuuuuuuaagugaaauuu

SEQ ID NO: 3204927 - RNA, 21 nt, Human
cuuuuuuuuuuaagugaaauu

SEQ ID NO: 3204928 - RNA, 15 nt, Human
cuuuuuuuuuuaagu

SEQ ID NO: 3204929 - RNA, 23 nt, Human
cuuuuuuggcugcugaaggcucg

SEQ ID NO: 3204930 - RNA, 20 nt, Human
gaaaaacucaaccaaauggu

SEQ ID NO: 3204931 - RNA, 21 nt, Human
cuuuuuuuuuuuugagacaga

SEQ ID NO: 3204932 - RNA, 11 nt, Human
gaaaaaaaaga

SEQ ID NO: 3204933 - RNA, 16 nt, Human
gaaaaaaaagaaaaaa

SEQ ID NO: 3204934 - RNA, 21 nt, Human
gaaaauugccuuucuguguuu

SEQ ID NO: 3204935 - RNA, 20 nt, Human
gaaaauugccuuucuguguu

SEQ ID NO: 3204936 - RNA, 19 nt, Human
gaaaauugccuuucugugu

SEQ ID NO: 3204937 - RNA, 21 nt, Human
gaaaacuuuaugcuaagugaa

SEQ ID NO: 3204938 - RNA, 11 nt, Human
gaaaacuuugu

SEQ ID NO: 3204939 - RNA, 14 nt, Human
gaaaaacugauuuu

SEQ ID NO: 3204940 - RNA, 18 nt, Human
gaaaacuuuguuaggcca

SEQ ID NO: 3204941 - RNA, 16 nt, Human
gaaaacuuuguuaggc

SEQ ID NO: 3204942 - RNA, 13 nt, Human
gaaaacuuuguua

SEQ ID NO: 3204943 - RNA, 9 nt, Human
gaaaagaaa

SEQ ID NO: 3204944 - RNA, 11 nt, Human
gaaaagaaaaa

SEQ ID NO: 3204945 - RNA, 10 nt, Human
gaaaagaaaa

SEQ ID NO: 3204946 - RNA, 12 nt, Human
gaaaagaaaaaa

SEQ ID NO: 3204947 - RNA, 17 nt, Human
gaaaagaaaaaaaaaga

SEQ ID NO: 3204948 - RNA, 21 nt, Human
gaaaauggaagacagcucuua

SEQ ID NO: 3204949 - RNA, 23 nt, Human
gaaaaugcuguauuagucacaga

SEQ ID NO: 3204950 - RNA, 18 nt, Human
gaaaagaaaaaugagccu

SEQ ID NO: 3204951 - RNA, 20 nt, Human
gaaaagaaaaaaaaagaaaa

SEQ ID NO: 3204952 - RNA, 19 nt, Human
gaaaagaaaaaaaaagaaa

SEQ ID NO: 3204953 - RNA, 18 nt, Human
gaaaauugccuuucugug

SEQ ID NO: 3204954 - RNA, 17 nt, Human
gaaaauugccuuucugu

SEQ ID NO: 3204955 - RNA, 19 nt, Human
gaaaauugcauugaagccc

SEQ ID NO: 3204956 - RNA, 15 nt, Human
gaaaauguaugugua

SEQ ID NO: 3204957 - RNA, 19 nt, Human
gaaaauggacguguuauga

SEQ ID NO: 3204958 - RNA, 23 nt, Human
gaaaauggacguguuaugacucc

SEQ ID NO: 3204959 - RNA, 14 nt, Human
cuuggcgcugcccc

SEQ ID NO: 3204960 - RNA, 17 nt, Human
cuuggcgcugccccugg

SEQ ID NO: 3204961 - RNA, 12 nt, Human
cuuggcgcugcc

SEQ ID NO: 3204962 - RNA, 23 nt, Human
cuuggcagguaggaauauuauau

SEQ ID NO: 3204963 - RNA, 22 nt, Human
cuugaugaaauaacacagcagu

SEQ ID NO: 3204964 - RNA, 21 nt, Human
cuugaugaaauaacacagcag

SEQ ID NO: 3204965 - RNA, 14 nt, Human
cuugccuuugaaga

SEQ ID NO: 3204966 - RNA, 17 nt, Human
cuugcggcaaaaggaaa

SEQ ID NO: 3204967 - RNA, 22 nt, Human
cuuggcaauaaauuuugaaaag

SEQ ID NO: 3204968 - RNA, 23 nt, Human
cuuggcaauaaauuuugaaaagu

SEQ ID NO: 3204969 - RNA, 19 nt, Human
cuugacaaagucaagccac

SEQ ID NO: 3204970 - RNA, 16 nt, Human
cuugacaaagucaagc

SEQ ID NO: 3204971 - RNA, 13 nt, Human
cuugacagggcac

SEQ ID NO: 3204972 - RNA, 15 nt, Human
cuugacagggcacac

SEQ ID NO: 3204973 - RNA, 14 nt, Human
cuugacagggcaca

SEQ ID NO: 3204974 - RNA, 19 nt, Human
cuugaauuguaaggaauga

SEQ ID NO: 3204975 - RNA, 18 nt, Human
cuugaaggaaaaauucaa

SEQ ID NO: 3204976 - RNA, 18 nt, Human
cuugaauuguaaggaaug

SEQ ID NO: 3204977 - RNA, 13 nt, Human
cuugaaggaaaaa

SEQ ID NO: 3204978 - RNA, 15 nt, Human
cuugaaggaaaaauu

SEQ ID NO: 3204979 - RNA, 14 nt, Human
cuugaaggaaaaau

SEQ ID NO: 3204980 - RNA, 15 nt, Human
cuugaagccugcucc

SEQ ID NO: 3204981 - RNA, 20 nt, Human
cuugaagccugcuccuuccc

SEQ ID NO: 3204982 - RNA, 16 nt, Human
cuugaagccugcuccu

SEQ ID NO: 3204983 - RNA, 23 nt, Human
cuugauagccucauuaaagcauu

SEQ ID NO: 3204984 - RNA, 22 nt, Human
cuugauaauuuuccuuuaauau

SEQ ID NO: 3204985 - RNA, 16 nt, Human
cuugauaauuuuccuu

SEQ ID NO: 3204986 - RNA, 16 nt, Human
cuugaagacuuuucuu

SEQ ID NO: 3204987 - RNA, 18 nt, Human
cuuccucccucccucuuu

SEQ ID NO: 3204988 - RNA, 23 nt, Human
cuucuaaguaaaaccacagcagu

SEQ ID NO: 3204989 - RNA, 22 nt, Human
cuucuaaguaaaaccacagcag

SEQ ID NO: 3204990 - RNA, 23 nt, Human
cuuccugauugguuucucuucuc

SEQ ID NO: 3204991 - RNA, 22 nt, Human
cuuccugauugguuucucuucu

SEQ ID NO: 3204992 - RNA, 17 nt, Human
cuuccugcaacaccuug

SEQ ID NO: 3204993 - RNA, 23 nt, Human
cuuccugaggggagacagagcaa

SEQ ID NO: 3204994 - RNA, 20 nt, Human
cuuccugauugguuucucuu

SEQ ID NO: 3204995 - RNA, 19 nt, Human
cuuccugauugguuucucu

SEQ ID NO: 3204996 - RNA, 15 nt, Human
cuuccuccugacacc

SEQ ID NO: 3204997 - RNA, 14 nt, Human
cuuccuccugacac

SEQ ID NO: 3204998 - RNA, 19 nt, Human
cuuccuccugacaccccac

SEQ ID NO: 3204999 - RNA, 18 nt, Human
cuuccuccugacacccca

SEQ ID NO: 3205000 - RNA, 17 nt, Human
cuucuagaaccaggcaa

SEQ ID NO: 3205001 - RNA, 21 nt, Human
cuucuaaguugaguauauuau

SEQ ID NO: 3205002 - RNA, 13 nt, Human
cuucuagaaccag

SEQ ID NO: 3205003 - RNA, 21 nt, Human
cuucuucccacaaagaauaua

SEQ ID NO: 3205004 - RNA, 23 nt, Human
cuucuucagagacuccugcaggc

SEQ ID NO: 3205005 - RNA, 21 nt, Human
cuucuguugcugccucaugcu

SEQ ID NO: 3205006 - RNA, 15 nt, Human
cuucuguugcugccu

SEQ ID NO: 3205007 - RNA, 13 nt, Human
cuucuucauguuc

SEQ ID NO: 3205008 - RNA, 16 nt, Human
cuucuguuuagucucc

SEQ ID NO: 3205009 - RNA, 17 nt, Human
cuucuguugcugccuca

SEQ ID NO: 3205010 - RNA, 18 nt, Human
cuucuguugcugccucau

SEQ ID NO: 3205011 - RNA, 19 nt, Human
cuucuguugcugccucaug

SEQ ID NO: 3205012 - RNA, 20 nt, Human
cuucuguugcugccucaugc

SEQ ID NO: 3205013 - RNA, 21 nt, Human
cuucugacccaugcugcccug

SEQ ID NO: 3205014 - RNA, 22 nt, Human
cuucugacccaugcugcccugu

SEQ ID NO: 3205015 - RNA, 20 nt, Human
cuucugacccaugcugcccu

SEQ ID NO: 3205016 - RNA, 22 nt, Human
cuucugcacauaaacucuuuua

SEQ ID NO: 3205017 - RNA, 20 nt, Human
cuucugaucacugaaauaaa

SEQ ID NO: 3205018 - RNA, 20 nt, Human
cuucugaugaaauguuaaca

SEQ ID NO: 3205019 - RNA, 17 nt, Human
cuucugagcuggccucu

SEQ ID NO: 3205020 - RNA, 11 nt, Human
cuucccaccuc

SEQ ID NO: 3205021 - RNA, 21 nt, Human
cuuccauaaucuggacuccuc

SEQ ID NO: 3205022 - RNA, 11 nt, Human
cuuccauaauc

SEQ ID NO: 3205023 - RNA, 21 nt, Human
cuucccaccucucucacuccu

SEQ ID NO: 3205024 - RNA, 23 nt, Human
cuucccaccucucucacuccuug

SEQ ID NO: 3205025 - RNA, 21 nt, Human
cuuccagugaggcucugcccu

SEQ ID NO: 3205026 - RNA, 12 nt, Human
cuucaugaaaug

SEQ ID NO: 3205027 - RNA, 23 nt, Human
cuucaugaaaugcuaugucauuu

SEQ ID NO: 3205028 - RNA, 17 nt, Human
cuucaugaaaugcuaug

SEQ ID NO: 3205029 - RNA, 14 nt, Human
cuucaugaaaugcu

SEQ ID NO: 3205030 - RNA, 13 nt, Human
cuucaugaaaugc

SEQ ID NO: 3205031 - RNA, 22 nt, Human
cuuccagugaggcucugcccuu

SEQ ID NO: 3205032 - RNA, 23 nt, Human
cuuccagugaggcucugcccuug

SEQ ID NO: 3205033 - RNA, 19 nt, Human
cuuccaguuacuuuccaau

SEQ ID NO: 3205034 - RNA, 16 nt, Human
cuuccaguuacuuucc

SEQ ID NO: 3205035 - RNA, 23 nt, Human
cuuccaguuuauuccagagcugc

SEQ ID NO: 3205036 - RNA, 21 nt, Human
cuuccaguuuauuccagagcu

SEQ ID NO: 3205037 - RNA, 20 nt, Human
cuuccaguuuauuccagagc

SEQ ID NO: 3205038 - RNA, 19 nt, Human
cuuccaguuuauuccagag

SEQ ID NO: 3205039 - RNA, 22 nt, Human
cuucauacagggaugguguuca

SEQ ID NO: 3205040 - RNA, 13 nt, Human
cuucauacaggga

SEQ ID NO: 3205041 - RNA, 12 nt, Human
cuucauacaggg

SEQ ID NO: 3205042 - RNA, 14 nt, Human
cuucauauucagcu

SEQ ID NO: 3205043 - RNA, 14 nt, Human
cuucaucuggaagu

SEQ ID NO: 3205044 - RNA, 10 nt, Human
cuucauacac

SEQ ID NO: 3205045 - RNA, 9 nt, Human
cuucauaca

SEQ ID NO: 3205046 - RNA, 16 nt, Human
cuucaguuuuuguguu

SEQ ID NO: 3205047 - RNA, 18 nt, Human
cuucagagacuccugcag

SEQ ID NO: 3205048 - RNA, 19 nt, Human
cuucagagacuccugcagg

SEQ ID NO: 3205049 - RNA, 20 nt, Human
cuucagagacuccugcaggc

SEQ ID NO: 3205050 - RNA, 17 nt, Human
cuucagagacuccugca

SEQ ID NO: 3205051 - RNA, 17 nt, Human
cuucacucaaauuuugg

SEQ ID NO: 3205052 - RNA, 23 nt, Human
cuucacuaagaacaaaagaagca

SEQ ID NO: 3205053 - RNA, 17 nt, Human
cuucacucuaagauguu

SEQ ID NO: 3205054 - RNA, 18 nt, Human
cuuauuggcagcucuacu

SEQ ID NO: 3205055 - RNA, 21 nt, Human
cuucaccuuuguccccaccgc

SEQ ID NO: 3205056 - RNA, 20 nt, Human
cuucaccuuuguccccaccg

SEQ ID NO: 3205057 - RNA, 15 nt, Human
cuucacggaagagcc

SEQ ID NO: 3205058 - RNA, 19 nt, Human
cuucacggaagagccuugc

SEQ ID NO: 3205059 - RNA, 22 nt, Human
cuucaccuuuguccccaccgca

SEQ ID NO: 3205060 - RNA, 17 nt, Human
cuuauggaacacucuga

SEQ ID NO: 3205061 - RNA, 19 nt, Human
cuuauggaacacucugaga

SEQ ID NO: 3205062 - RNA, 20 nt, Human
cuuauggaacacucugagac

SEQ ID NO: 3205063 - RNA, 16 nt, Human
cuuaugcuuccagaaa

SEQ ID NO: 3205064 - RNA, 15 nt, Human
cuuaugcuuccagaa

SEQ ID NO: 3205065 - RNA, 14 nt, Human
cuuaugcuuccaga

SEQ ID NO: 3205066 - RNA, 13 nt, Human
cuuaugcuuccag

SEQ ID NO: 3205067 - RNA, 19 nt, Human
cuuauugauauucuaagaa

SEQ ID NO: 3205068 - RNA, 23 nt, Human
cuuauugauauucuaagaaauau

SEQ ID NO: 3205069 - RNA, 22 nt, Human
cuuauuccauauuagaaaacuu

SEQ ID NO: 3205070 - RNA, 16 nt, Human
cuuauuccauauuaga

SEQ ID NO: 3205071 - RNA, 16 nt, Human
cuuauucaaagagaaa

SEQ ID NO: 3205072 - RNA, 17 nt, Human
cuuauucaaagagaaaa

SEQ ID NO: 3205073 - RNA, 12 nt, Human
cuuaugcuucca

SEQ ID NO: 3205074 - RNA, 14 nt, Human
cuuaugcuuaaauu

SEQ ID NO: 3205075 - RNA, 13 nt, Human
cuuauggaacacu

SEQ ID NO: 3205076 - RNA, 16 nt, Human
cuuauggaacacucug

SEQ ID NO: 3205077 - RNA, 14 nt, Human
cugugcugagucug

SEQ ID NO: 3205078 - RNA, 12 nt, Human
cugugcugaguc

SEQ ID NO: 3205079 - RNA, 17 nt, Human
cugagacucgcgacaau

SEQ ID NO: 3205080 - RNA, 19 nt, Human
cugagacucgcgacaaugc

SEQ ID NO: 3205081 - RNA, 13 nt, Human
cugcauguuacau

SEQ ID NO: 3205082 - RNA, 16 nt, Human
cugcauucuucugauc

SEQ ID NO: 3205083 - RNA, 22 nt, Human
cugcauucuucugaucacugaa

SEQ ID NO: 3205084 - RNA, 20 nt, Human
cugcauucaggaucaaaccc

SEQ ID NO: 3205085 - RNA, 13 nt, Human
cugcauuugugaa

SEQ ID NO: 3205086 - RNA, 13 nt, Human
cugcauuuaggga

SEQ ID NO: 3205087 - RNA, 22 nt, Human
cugcauuuagggaguauucuaa

SEQ ID NO: 3205088 - RNA, 23 nt, Human
cugcauuuagggaguauucuaau

SEQ ID NO: 3205089 - RNA, 15 nt, Human
cugccaaugggagcu

SEQ ID NO: 3205090 - RNA, 22 nt, Human
cugcauuugugaaaugauggug

SEQ ID NO: 3205091 - RNA, 17 nt, Human
cugcauuugugaaauga

SEQ ID NO: 3205092 - RNA, 15 nt, Human
cugcauuugugaaau

SEQ ID NO: 3205093 - RNA, 14 nt, Human
cugcauuugugaaa

SEQ ID NO: 3205094 - RNA, 17 nt, Human
cugcauuugucuggccu

SEQ ID NO: 3205095 - RNA, 19 nt, Human
cugccaacugaucuguuau

SEQ ID NO: 3205096 - RNA, 23 nt, Human
cugccaaccucgcuccaacucca

SEQ ID NO: 3205097 - RNA, 21 nt, Human
cugccaaccucgcuccaacuc

SEQ ID NO: 3205098 - RNA, 17 nt, Human
cugccaaccucgcucca

SEQ ID NO: 3205099 - RNA, 14 nt, Human
cugccaaccucgcu

SEQ ID NO: 3205100 - RNA, 23 nt, Human
cugccaucauguuuacagaggac

SEQ ID NO: 3205101 - RNA, 19 nt, Human
cugccccagcuugggcaga

SEQ ID NO: 3205102 - RNA, 17 nt, Human
cugccaucauguuuaca

SEQ ID NO: 3205103 - RNA, 22 nt, Human
cugccaucauguuuacagagga

SEQ ID NO: 3205104 - RNA, 19 nt, Human
cugccccagggcucccggc

SEQ ID NO: 3205105 - RNA, 14 nt, Human
cugcccccucugcc

SEQ ID NO: 3205106 - RNA, 15 nt, Human
cugcccccucugccc

SEQ ID NO: 3205107 - RNA, 13 nt, Human
cugcccccuccug

SEQ ID NO: 3205108 - RNA, 23 nt, Human
cugccauauucuguuggccagug

SEQ ID NO: 3205109 - RNA, 22 nt, Human
cugccauauucuguuggccagu

SEQ ID NO: 3205110 - RNA, 21 nt, Human
cugccauauucuguuggccag

SEQ ID NO: 3205111 - RNA, 20 nt, Human
cugccauauucuguuggcca

SEQ ID NO: 3205112 - RNA, 12 nt, Human
cugccagggaca

SEQ ID NO: 3205113 - RNA, 15 nt, Human
cugccagggacagag

SEQ ID NO: 3205114 - RNA, 11 nt, Human
cugccagggac

SEQ ID NO: 3205115 - RNA, 14 nt, Human
cugccccucaacuc

SEQ ID NO: 3205116 - RNA, 22 nt, Human
cugccccucaacucuccuccag

SEQ ID NO: 3205117 - RNA, 16 nt, Human
cugcccccucugcccu

SEQ ID NO: 3205118 - RNA, 17 nt, Human
cugcccccucugcccug

SEQ ID NO: 3205119 - RNA, 18 nt, Human
cugcccccucugcccugc

SEQ ID NO: 3205120 - RNA, 15 nt, Human
cugcccccuccugag

SEQ ID NO: 3205121 - RNA, 14 nt, Human
cugcccccuccuga

SEQ ID NO: 3205122 - RNA, 19 nt, Human
cugcccuggugcugccaca

SEQ ID NO: 3205123 - RNA, 18 nt, Human
cugcccuggugcugccac

SEQ ID NO: 3205124 - RNA, 16 nt, Human
cugcccuggugcugcc

SEQ ID NO: 3205125 - RNA, 17 nt, Human
cugcccuggugcugcca

SEQ ID NO: 3205126 - RNA, 15 nt, Human
cugcccugugggccc

SEQ ID NO: 3205127 - RNA, 16 nt, Human
cugcccugugggcccc

SEQ ID NO: 3205128 - RNA, 18 nt, Human
cugcccugugggccccca

SEQ ID NO: 3205129 - RNA, 12 nt, Human
cugcccugugag

SEQ ID NO: 3205130 - RNA, 20 nt, Human
cugcccugucaggaggcaga

SEQ ID NO: 3205131 - RNA, 17 nt, Human
cugcccugucaggaggc

SEQ ID NO: 3205132 - RNA, 21 nt, Human
cugcccugguuuccugcccug

SEQ ID NO: 3205133 - RNA, 22 nt, Human
cugcccugguuuccugcccugg

SEQ ID NO: 3205134 - RNA, 23 nt, Human
cugcccugguuuccugcccuggg

SEQ ID NO: 3205135 - RNA, 21 nt, Human
cugcccuggugcugccacacu

SEQ ID NO: 3205136 - RNA, 20 nt, Human
cugcccuggugcugccacac

SEQ ID NO: 3205137 - RNA, 14 nt, Human
cugcccugugggcc

SEQ ID NO: 3205138 - RNA, 23 nt, Human
cugccugggaucccucauccuca

SEQ ID NO: 3205139 - RNA, 14 nt, Human
cugccuguucagcu

SEQ ID NO: 3205140 - RNA, 22 nt, Human
cugccugggaucccucauccuc

SEQ ID NO: 3205141 - RNA, 18 nt, Human
cugccucgaacuggcugc

SEQ ID NO: 3205142 - RNA, 17 nt, Human
cugccucgaacuggcug

SEQ ID NO: 3205143 - RNA, 15 nt, Human
cugccucgaacuggc

SEQ ID NO: 3205144 - RNA, 12 nt, Human
cugcucacugca

SEQ ID NO: 3205145 - RNA, 15 nt, Human
cugcuacagagcaga

SEQ ID NO: 3205146 - RNA, 12 nt, Human
cugcucagaucc

SEQ ID NO: 3205147 - RNA, 23 nt, Human
cugcucagaucccacuuuugcca

SEQ ID NO: 3205148 - RNA, 23 nt, Human
cugcucagcagugagagcagaug

SEQ ID NO: 3205149 - RNA, 21 nt, Human
cugcucagcagugagagcaga

SEQ ID NO: 3205150 - RNA, 16 nt, Human
cugccuguugggccag

SEQ ID NO: 3205151 - RNA, 14 nt, Human
cugccuguugggcc

SEQ ID NO: 3205152 - RNA, 18 nt, Human
cugccuguugggccagga

SEQ ID NO: 3205153 - RNA, 19 nt, Human
cugccuguugggccaggag

SEQ ID NO: 3205154 - RNA, 16 nt, Human
cugcuaauuccccaga

SEQ ID NO: 3205155 - RNA, 23 nt, Human
cugcuaauucuuugcaaaaaucc

SEQ ID NO: 3205156 - RNA, 22 nt, Human
cugcuaauucuuugcaaaaauc

SEQ ID NO: 3205157 - RNA, 15 nt, Human
cugcuaauucuuugc

SEQ ID NO: 3205158 - RNA, 23 nt, Human
cugcugacagacacaggcccggc

SEQ ID NO: 3205159 - RNA, 21 nt, Human
cugcugacagacacaggcccg

SEQ ID NO: 3205160 - RNA, 20 nt, Human
cugcugacagacacaggccc

SEQ ID NO: 3205161 - RNA, 19 nt, Human
cugcugacagacacaggcc

SEQ ID NO: 3205162 - RNA, 18 nt, Human
cugcugacagacacaggc

SEQ ID NO: 3205163 - RNA, 15 nt, Human
cugcugacagacaca

SEQ ID NO: 3205164 - RNA, 17 nt, Human
cuggaacucuugacagc

SEQ ID NO: 3205165 - RNA, 19 nt, Human
cugcuuuuuaaagaaugcu

SEQ ID NO: 3205166 - RNA, 14 nt, Human
cugcuuuuuggaaa

SEQ ID NO: 3205167 - RNA, 16 nt, Human
cugcuuuuuggaaagu

SEQ ID NO: 3205168 - RNA, 18 nt, Human
cugcuuuuuggaaaguca

SEQ ID NO: 3205169 - RNA, 20 nt, Human
cugcuuuuuggaaagucaga

SEQ ID NO: 3205170 - RNA, 16 nt, Human
cuggaaauauuaagaa

SEQ ID NO: 3205171 - RNA, 17 nt, Human
cuggaacacuaaugagg

SEQ ID NO: 3205172 - RNA, 23 nt, Human
cuggaaauacuagauuugggaga

SEQ ID NO: 3205173 - RNA, 16 nt, Human
cugcuucagccuccca

SEQ ID NO: 3205174 - RNA, 22 nt, Human
cugcuuuuuaaagaaugcucuu

SEQ ID NO: 3205175 - RNA, 16 nt, Human
cugcuucagccucccg

SEQ ID NO: 3205176 - RNA, 14 nt, Human
cugcuucagccucc

SEQ ID NO: 3205177 - RNA, 22 nt, Human
cugcuuaaaagaaaauguucac

SEQ ID NO: 3205178 - RNA, 22 nt, Human
cugcuuaaaguugguauuaaua

SEQ ID NO: 3205179 - RNA, 13 nt, Human
cugcuucagccuc

SEQ ID NO: 3205180 - RNA, 21 nt, Human
cuggugaugcgcaguugcugu

SEQ ID NO: 3205181 - RNA, 20 nt, Human
cuggugaugcgcaguugcug

SEQ ID NO: 3205182 - RNA, 13 nt, Human
cuggugagcauua

SEQ ID NO: 3205183 - RNA, 15 nt, Human
cuggugauauaucuc

SEQ ID NO: 3205184 - RNA, 19 nt, Human
cuggugaugcgcaguugcu

SEQ ID NO: 3205185 - RNA, 23 nt, Human
cuggugacuuuccucuuuggucu

SEQ ID NO: 3205186 - RNA, 23 nt, Human
cuggguggcaccagcagccugga

SEQ ID NO: 3205187 - RNA, 22 nt, Human
cuggguggcaccagcagccugg

SEQ ID NO: 3205188 - RNA, 17 nt, Human
cuggguguggcgcagca

SEQ ID NO: 3205189 - RNA, 18 nt, Human
cuggguuagacugccagc

SEQ ID NO: 3205190 - RNA, 16 nt, Human
cuggguuagacugcca

SEQ ID NO: 3205191 - RNA, 23 nt, Human
cuggguuagacugccagcucuuc

SEQ ID NO: 3205192 - RNA, 21 nt, Human
cuggguuagacugccagcucu

SEQ ID NO: 3205193 - RNA, 20 nt, Human
cuggguuagacugccagcuc

SEQ ID NO: 3205194 - RNA, 19 nt, Human
cuggguuagacugccagcu

SEQ ID NO: 3205195 - RNA, 16 nt, Human
cuggguguggcgcagc

SEQ ID NO: 3205196 - RNA, 23 nt, Human
cuggguuccuuccucugagccuu

SEQ ID NO: 3205197 - RNA, 15 nt, Human
cuggugacuuuccuc

SEQ ID NO: 3205198 - RNA, 20 nt, Human
cuggugacuuuccucuuugg

SEQ ID NO: 3205199 - RNA, 21 nt, Human
cuggugacuuuccucuuuggu

SEQ ID NO: 3205200 - RNA, 14 nt, Human
cuggguucacugca

SEQ ID NO: 3205201 - RNA, 22 nt, Human
cuggguuccagcaauucuccug

SEQ ID NO: 3205202 - RNA, 18 nt, Human
cuggguuccuuccucuga

SEQ ID NO: 3205203 - RNA, 22 nt, Human
cuggguuccuuccucugagccu

SEQ ID NO: 3205204 - RNA, 17 nt, Human
cugggcagaaggaagac

SEQ ID NO: 3205205 - RNA, 18 nt, Human
cuggggccuaauaaaacu

SEQ ID NO: 3205206 - RNA, 16 nt, Human
cuggggauugggcccc

SEQ ID NO: 3205207 - RNA, 22 nt, Human
cuggggauugggccccugccag

SEQ ID NO: 3205208 - RNA, 18 nt, Human
cuggggauugggccccug

SEQ ID NO: 3205209 - RNA, 17 nt, Human
cuggggaugucucucau

SEQ ID NO: 3205210 - RNA, 22 nt, Human
cuggggaugucucucaugacca

SEQ ID NO: 3205211 - RNA, 18 nt, Human
cuggggaacguucucuuu

SEQ ID NO: 3205212 - RNA, 16 nt, Human
cuggggaaccugaccc

SEQ ID NO: 3205213 - RNA, 17 nt, Human
cuggggaaccugacccc

SEQ ID NO: 3205214 - RNA, 15 nt, Human
cuggggaaccugacc

SEQ ID NO: 3205215 - RNA, 16 nt, Human
cugggcagaaggaaga

SEQ ID NO: 3205216 - RNA, 18 nt, Human
cugggcagaaggaagacu

SEQ ID NO: 3205217 - RNA, 22 nt, Human
cugggacaccauuaccaaaaua

SEQ ID NO: 3205218 - RNA, 17 nt, Human
cugggacgcucugcugu

SEQ ID NO: 3205219 - RNA, 16 nt, Human
cugggacgcucugcug

SEQ ID NO: 3205220 - RNA, 15 nt, Human
cugggacgcucugcu

SEQ ID NO: 3205221 - RNA, 14 nt, Human
cugggacgcucugc

SEQ ID NO: 3205222 - RNA, 17 nt, Human
cuggagacuaaccccac

SEQ ID NO: 3205223 - RNA, 12 nt, Human
cuggcagcucag

SEQ ID NO: 3205224 - RNA, 13 nt, Human
cuggcagcucaga

SEQ ID NO: 3205225 - RNA, 14 nt, Human
cuggcagcucagag

SEQ ID NO: 3205226 - RNA, 13 nt, Human
cuggccccucagg

SEQ ID NO: 3205227 - RNA, 21 nt, Human
cuggcaggcaggggcccugca

SEQ ID NO: 3205228 - RNA, 23 nt, Human
cuggcaggcaggggcccugcagc

SEQ ID NO: 3205229 - RNA, 12 nt, Human
cuggcaggcagg

SEQ ID NO: 3205230 - RNA, 11 nt, Human
cuggcaggcag

SEQ ID NO: 3205231 - RNA, 13 nt, Human
cuggcaggcaggg

SEQ ID NO: 3205232 - RNA, 16 nt, Human
cuggcuccaggccagg

SEQ ID NO: 3205233 - RNA, 16 nt, Human
cuggcuccagccugga

SEQ ID NO: 3205234 - RNA, 15 nt, Human
cuggcuccagccugg

SEQ ID NO: 3205235 - RNA, 14 nt, Human
cuggcuccagccug

SEQ ID NO: 3205236 - RNA, 15 nt, Human
cuggcucccacaggc

SEQ ID NO: 3205237 - RNA, 13 nt, Human
cuggcuccagcug

SEQ ID NO: 3205238 - RNA, 14 nt, Human
cuggcuccagcugg

SEQ ID NO: 3205239 - RNA, 18 nt, Human
cuggcuccagcuggccgg

SEQ ID NO: 3205240 - RNA, 20 nt, Human
cuggcuccagcuggccggga

SEQ ID NO: 3205241 - RNA, 11 nt, Human
cugggacacag

SEQ ID NO: 3205242 - RNA, 13 nt, Human
cugggacacaguu

SEQ ID NO: 3205243 - RNA, 12 nt, Human
cugggacacagu

SEQ ID NO: 3205244 - RNA, 17 nt, Human
cuggccccucagggucc

SEQ ID NO: 3205245 - RNA, 18 nt, Human
cuggccccucaggguccc

SEQ ID NO: 3205246 - RNA, 20 nt, Human
cuggccccucagggucccug

SEQ ID NO: 3205247 - RNA, 21 nt, Human
cuggccccucagggucccugg

SEQ ID NO: 3205248 - RNA, 13 nt, Human
cuggcuccagccu

SEQ ID NO: 3205249 - RNA, 11 nt, Human
cuggcuccagc

SEQ ID NO: 3205250 - RNA, 16 nt, Human
cugugagaugcuagaa

SEQ ID NO: 3205251 - RNA, 19 nt, Human
cugugcucuggacaggcau

SEQ ID NO: 3205252 - RNA, 14 nt, Human
cugugcucuggaca

SEQ ID NO: 3205253 - RNA, 15 nt, Human
cugugaagagaacca

SEQ ID NO: 3205254 - RNA, 13 nt, Human
cugugaaguguua

SEQ ID NO: 3205255 - RNA, 13 nt, Human
cugucgcccaguc

SEQ ID NO: 3205256 - RNA, 16 nt, Human
cugucgcccaggcugg

SEQ ID NO: 3205257 - RNA, 23 nt, Human
cugucgagccugggggcuggagc

SEQ ID NO: 3205258 - RNA, 14 nt, Human
cugucgagccuggg

SEQ ID NO: 3205259 - RNA, 18 nt, Human
cugguuuccugcccuggg

SEQ ID NO: 3205260 - RNA, 21 nt, Human
cugguuuccugcccugggagg

SEQ ID NO: 3205261 - RNA, 16 nt, Human
cugguuuccugcccug

SEQ ID NO: 3205262 - RNA, 22 nt, Human
cugguuuccugcccugggaggc

SEQ ID NO: 3205263 - RNA, 12 nt, Human
cuguacuuugau

SEQ ID NO: 3205264 - RNA, 24 nt, Human
cuguacuuugauucacauguuuuc

SEQ ID NO: 3205265 - RNA, 21 nt, Human
cuguacuuugauucacauguu

SEQ ID NO: 3205266 - RNA, 19 nt, Human
cuguacuuugauucacaug

SEQ ID NO: 3205267 - RNA, 15 nt, Human
cuguacuuugauuca

SEQ ID NO: 3205268 - RNA, 13 nt, Human
cuguaaaacuaag

SEQ ID NO: 3205269 - RNA, 14 nt, Human
cuguaaaagaaaaa

SEQ ID NO: 3205270 - RNA, 20 nt, Human
cuguaaaagcaaguccugca

SEQ ID NO: 3205271 - RNA, 19 nt, Human
cuguaaaagcaaguccugc

SEQ ID NO: 3205272 - RNA, 14 nt, Human
cuguaaaaugcaaa

SEQ ID NO: 3205273 - RNA, 20 nt, Human
cuguaaaaugcaaaaaaucu

SEQ ID NO: 3205274 - RNA, 18 nt, Human
cuguaaaaugcaaaaaau

SEQ ID NO: 3205275 - RNA, 15 nt, Human
cuguaaacacucagc

SEQ ID NO: 3205276 - RNA, 17 nt, Human
cuguaaacacucagcug

SEQ ID NO: 3205277 - RNA, 18 nt, Human
cuguaaacacucagcugu

SEQ ID NO: 3205278 - RNA, 19 nt, Human
cuguaaacacucagcuguu

SEQ ID NO: 3205279 - RNA, 21 nt, Human
cuguaggaagguuaauguuca

SEQ ID NO: 3205280 - RNA, 18 nt, Human
cuguaggaagguuaaugu

SEQ ID NO: 3205281 - RNA, 12 nt, Human
cuguaggccuca

SEQ ID NO: 3205282 - RNA, 18 nt, Human
cuguaggaguucuauuuu

SEQ ID NO: 3205283 - RNA, 22 nt, Human
cuguaggccucaggugaaacuc

SEQ ID NO: 3205284 - RNA, 13 nt, Human
cuguaggccucag

SEQ ID NO: 3205285 - RNA, 19 nt, Human
cugucacaguaaaaauaaa

SEQ ID NO: 3205286 - RNA, 21 nt, Human
cugucacaguaaaaauaaaau

SEQ ID NO: 3205287 - RNA, 22 nt, Human
cugucacaguaaaaauaaaaua

SEQ ID NO: 3205288 - RNA, 19 nt, Human
cugucacccgaucgccagc

SEQ ID NO: 3205289 - RNA, 21 nt, Human
cugucagcuccccucggagaa

SEQ ID NO: 3205290 - RNA, 18 nt, Human
cugucagccauuccuguu

SEQ ID NO: 3205291 - RNA, 11 nt, Human
cugucacuguu

SEQ ID NO: 3205292 - RNA, 21 nt, Human
cugucacuguuggacgucagc

SEQ ID NO: 3205293 - RNA, 15 nt, Human
cugucacugcugcuu

SEQ ID NO: 3205294 - RNA, 23 nt, Human
cugucagcuccccucggagaaga

SEQ ID NO: 3205295 - RNA, 16 nt, Human
cugucauuugagcagg

SEQ ID NO: 3205296 - RNA, 18 nt, Human
cugucauuugagcagggc

SEQ ID NO: 3205297 - RNA, 17 nt, Human
cugucauuugagcaggg

SEQ ID NO: 3205298 - RNA, 12 nt, Human
cuguccugccua

SEQ ID NO: 3205299 - RNA, 16 nt, Human
gaugagaggaaaucac

SEQ ID NO: 3205300 - RNA, 14 nt, Human
gaugaucuuugcag

SEQ ID NO: 3205301 - RNA, 21 nt, Human
gaugaucuuugcagacaggca

SEQ ID NO: 3205302 - RNA, 20 nt, Human
gaugaucuuugcagacaggc

SEQ ID NO: 3205303 - RNA, 23 nt, Human
gaucucagugguuaagauuccua

SEQ ID NO: 3205304 - RNA, 16 nt, Human
gauccauuuuuuauau

SEQ ID NO: 3205305 - RNA, 21 nt, Human
gaucucauuguucaauuccca

SEQ ID NO: 3205306 - RNA, 18 nt, Human
gauccauuuuuuauauuu

SEQ ID NO: 3205307 - RNA, 17 nt, Human
gaucucccuuuccuaua

SEQ ID NO: 3205308 - RNA, 19 nt, Human
gauccauuaauuuaaauga

SEQ ID NO: 3205309 - RNA, 13 nt, Human
gauauuuuuaaua

SEQ ID NO: 3205310 - RNA, 21 nt, Human
gauauucuuuguuaauuugga

SEQ ID NO: 3205311 - RNA, 17 nt, Human
gauauuuuguaaaaugu

SEQ ID NO: 3205312 - RNA, 18 nt, Human
gauauuuuguaaaaugua

SEQ ID NO: 3205313 - RNA, 20 nt, Human
gauauuuuguaaaauguauu

SEQ ID NO: 3205314 - RNA, 21 nt, Human
gauccaggccccucccucucc

SEQ ID NO: 3205315 - RNA, 12 nt, Human
gaucucuugagc

SEQ ID NO: 3205316 - RNA, 16 nt, Human
gaucucuugagccugg

SEQ ID NO: 3205317 - RNA, 17 nt, Human
gaucucuugagccuggg

SEQ ID NO: 3205318 - RNA, 14 nt, Human
gauuaccagggacu

SEQ ID NO: 3205319 - RNA, 15 nt, Human
gauuacauucaguug

SEQ ID NO: 3205320 - RNA, 16 nt, Human
gaugugaacacaucag

SEQ ID NO: 3205321 - RNA, 14 nt, Human
gaugugaacacauc

SEQ ID NO: 3205322 - RNA, 20 nt, Human
gauuacaggugugaaccacc

SEQ ID NO: 3205323 - RNA, 20 nt, Human
gauuacaggugugagccacc

SEQ ID NO: 3205324 - RNA, 17 nt, Human
gaugugacauuugucau

SEQ ID NO: 3205325 - RNA, 14 nt, Human
gaugugacauuugu

SEQ ID NO: 3205326 - RNA, 13 nt, Human
gauuaguuuagaa

SEQ ID NO: 3205327 - RNA, 14 nt, Human
gauuaguaagucuu

SEQ ID NO: 3205328 - RNA, 15 nt, Human
gauuaguaagaucuc

SEQ ID NO: 3205329 - RNA, 14 nt, Human
gauuaguuuagaac

SEQ ID NO: 3205330 - RNA, 15 nt, Human
gauuaguuuagaaca

SEQ ID NO: 3205331 - RNA, 14 nt, Human
gauuauaaucagaa

SEQ ID NO: 3205332 - RNA, 13 nt, Human
gauuauaauuguu

SEQ ID NO: 3205333 - RNA, 17 nt, Human
gauuagggagagaagau

SEQ ID NO: 3205334 - RNA, 13 nt, Human
gauuauuuacaag

SEQ ID NO: 3205335 - RNA, 18 nt, Human
gauuauuuacaagaagaa

SEQ ID NO: 3205336 - RNA, 21 nt, Human
gauuauuuacaagaagaacuc

SEQ ID NO: 3205337 - RNA, 23 nt, Human
gauucucuugccucagcuucccc

SEQ ID NO: 3205338 - RNA, 22 nt, Human
gauucucuccauuuuggugucu

SEQ ID NO: 3205339 - RNA, 11 nt, Human
gauucucucca

SEQ ID NO: 3205340 - RNA, 21 nt, Human
gauaccuuaaaauuugaaaca

SEQ ID NO: 3205341 - RNA, 18 nt, Human
gauaccuucuuauuuaau

SEQ ID NO: 3205342 - RNA, 20 nt, Human
gauaccuucuuauuuaaucu

SEQ ID NO: 3205343 - RNA, 17 nt, Human
gauaccuuaaaauuuga

SEQ ID NO: 3205344 - RNA, 14 nt, Human
gauaccuuaaaauu

SEQ ID NO: 3205345 - RNA, 13 nt, Human
gauacccauccca

SEQ ID NO: 3205346 - RNA, 14 nt, Human
gauacccaucccau

SEQ ID NO: 3205347 - RNA, 19 nt, Human
gauaccuuaaaauuugaaa

SEQ ID NO: 3205348 - RNA, 15 nt, Human
gauacgugucaaugu

SEQ ID NO: 3205349 - RNA, 16 nt, Human
gauacuacugaccaga

SEQ ID NO: 3205350 - RNA, 13 nt, Human
gauacucugggaa

SEQ ID NO: 3205351 - RNA, 11 nt, Human
gauacucuggg

SEQ ID NO: 3205352 - RNA, 14 nt, Human
gauacucugggaac

SEQ ID NO: 3205353 - RNA, 16 nt, Human
gauaugccugcucuuu

SEQ ID NO: 3205354 - RNA, 18 nt, Human
gauaugccugcucuuugg

SEQ ID NO: 3205355 - RNA, 22 nt, Human
gauaugcuuguaacuaaaauaa

SEQ ID NO: 3205356 - RNA, 12 nt, Human
gauaugcuugua

SEQ ID NO: 3205357 - RNA, 20 nt, Human
gauauguaccuaacgaagua

SEQ ID NO: 3205358 - RNA, 13 nt, Human
gauauuaauguau

SEQ ID NO: 3205359 - RNA, 22 nt, Human
gauauuaauuuaucagauugcu

SEQ ID NO: 3205360 - RNA, 21 nt, Human
gauauucuaagaaauaucugu

SEQ ID NO: 3205361 - RNA, 23 nt, Human
gauauucuaagaaauaucuguga

SEQ ID NO: 3205362 - RNA, 17 nt, Human
gauauugcugaagaauc

SEQ ID NO: 3205363 - RNA, 24 nt, Human
gauauugcugaagaaucuacuuaa

SEQ ID NO: 3205364 - RNA, 18 nt, Human
gauauucuuuguuaauuu

SEQ ID NO: 3205365 - RNA, 15 nt, Human
gauauucuuuguuaa

SEQ ID NO: 3205366 - RNA, 18 nt, Human
gagugaggaugucugggc

SEQ ID NO: 3205367 - RNA, 19 nt, Human
gagugaggaauggcaguga

SEQ ID NO: 3205368 - RNA, 18 nt, Human
gagugcaggcccacccug

SEQ ID NO: 3205369 - RNA, 16 nt, Human
gagugcaggcccaccc

SEQ ID NO: 3205370 - RNA, 12 nt, Human
gagugcagugag

SEQ ID NO: 3205371 - RNA, 11 nt, Human
gagugcaguga

SEQ ID NO: 3205372 - RNA, 12 nt, Human
gagugagcuggu

SEQ ID NO: 3205373 - RNA, 13 nt, Human
gagucccaccuug

SEQ ID NO: 3205374 - RNA, 24 nt, Human
gagugagcacuaaggugugcucug

SEQ ID NO: 3205375 - RNA, 20 nt, Human
gagucccaccuuggcugcag

SEQ ID NO: 3205376 - RNA, 16 nt, Human
gagucccaccuuggcu

SEQ ID NO: 3205377 - RNA, 14 nt, Human
gagucaccaagccc

SEQ ID NO: 3205378 - RNA, 13 nt, Human
gagucaccaagcc

SEQ ID NO: 3205379 - RNA, 12 nt, Human
gaggugggaucc

SEQ ID NO: 3205380 - RNA, 11 nt, Human
gaggugggagg

SEQ ID NO: 3205381 - RNA, 16 nt, Human
gaggugcaugccuaau

SEQ ID NO: 3205382 - RNA, 18 nt, Human
gaguuucacagugugauu

SEQ ID NO: 3205383 - RNA, 23 nt, Human
gaguuugccccguucuguuugua

SEQ ID NO: 3205384 - RNA, 13 nt, Human
gaguuggcuggga

SEQ ID NO: 3205385 - RNA, 18 nt, Human
gagugccuuacacaaugg

SEQ ID NO: 3205386 - RNA, 20 nt, Human
gaguuugggguaugggagag

SEQ ID NO: 3205387 - RNA, 12 nt, Human
gcagccaggcca

SEQ ID NO: 3205388 - RNA, 14 nt, Human
gcagccacuauugu

SEQ ID NO: 3205389 - RNA, 18 nt, Human
gcagccacuuaggacaaa

SEQ ID NO: 3205390 - RNA, 15 nt, Human
gcagccacauuccug

SEQ ID NO: 3205391 - RNA, 16 nt, Human
gcagccacauuccuga

SEQ ID NO: 3205392 - RNA, 11 nt, Human
gcagagcccug

SEQ ID NO: 3205393 - RNA, 15 nt, Human
gcagagcccugcucc

SEQ ID NO: 3205394 - RNA, 13 nt, Human
gcagagcccugcu

SEQ ID NO: 3205395 - RNA, 16 nt, Human
gcagagcccugcuccc

SEQ ID NO: 3205396 - RNA, 13 nt, Human
gcagccaggccac

SEQ ID NO: 3205397 - RNA, 14 nt, Human
gcagccaggccaca

SEQ ID NO: 3205398 - RNA, 18 nt, Human
gcagcccaccccucaaca

SEQ ID NO: 3205399 - RNA, 12 nt, Human
gcagccaggaga

SEQ ID NO: 3205400 - RNA, 21 nt, Human
gcagccaggagagcuuagggu

SEQ ID NO: 3205401 - RNA, 22 nt, Human
gcagccccaaauugucaccugc

SEQ ID NO: 3205402 - RNA, 17 nt, Human
gcauaauaauccugcaa

SEQ ID NO: 3205403 - RNA, 23 nt, Human
gcauaauucugaaguuauauuuc

SEQ ID NO: 3205404 - RNA, 19 nt, Human
gcaguuugaggauuaguuu

SEQ ID NO: 3205405 - RNA, 20 nt, Human
gcaguuucaauaaaguuuga

SEQ ID NO: 3205406 - RNA, 17 nt, Human
gcaguuucaauaaaguu

SEQ ID NO: 3205407 - RNA, 12 nt, Human
gcaguuucaaua

SEQ ID NO: 3205408 - RNA, 21 nt, Human
gcagucauggagaaccaccua

SEQ ID NO: 3205409 - RNA, 12 nt, Human
gcagucauuuug

SEQ ID NO: 3205410 - RNA, 20 nt, Human
gcaggcucucaggccagcug

SEQ ID NO: 3205411 - RNA, 22 nt, Human
gcaggcucucaggccagcugcu

SEQ ID NO: 3205412 - RNA, 17 nt, Human
gcagcugcgguccaccc

SEQ ID NO: 3205413 - RNA, 23 nt, Human
gcaggcucucaggccagcugcuu

SEQ ID NO: 3205414 - RNA, 18 nt, Human
gcaggcucucaggccagc

SEQ ID NO: 3205415 - RNA, 14 nt, Human
gcaggcuggcccug

SEQ ID NO: 3205416 - RNA, 15 nt, Human
gcaggcuggcccugc

SEQ ID NO: 3205417 - RNA, 16 nt, Human
gcaggcuggcccugcc

SEQ ID NO: 3205418 - RNA, 17 nt, Human
gcaggcuggcccugccc

SEQ ID NO: 3205419 - RNA, 18 nt, Human
gcaggcuggcccugcccu

SEQ ID NO: 3205420 - RNA, 21 nt, Human
gcaggcuggcccugcccuggu

SEQ ID NO: 3205421 - RNA, 19 nt, Human
gcaggcuggcccugcccug

SEQ ID NO: 3205422 - RNA, 20 nt, Human
gcaggcuggcccugcccugg

SEQ ID NO: 3205423 - RNA, 19 nt, Human
gcagggacuugaacccaua

SEQ ID NO: 3205424 - RNA, 10 nt, Human
gcagggaggg

SEQ ID NO: 3205425 - RNA, 13 nt, Human
gcagggagggccu

SEQ ID NO: 3205426 - RNA, 16 nt, Human
gcaguaacuugggagu

SEQ ID NO: 3205427 - RNA, 13 nt, Human
gcaguaacuuggg

SEQ ID NO: 3205428 - RNA, 20 nt, Human
gcaguauaaagaauaggacu

SEQ ID NO: 3205429 - RNA, 15 nt, Human
gcaguaucaugaagc

SEQ ID NO: 3205430 - RNA, 12 nt, Human
gcaguaucauga

SEQ ID NO: 3205431 - RNA, 14 nt, Human
gcacugaaguuuga

SEQ ID NO: 3205432 - RNA, 12 nt, Human
gcacugacauug

SEQ ID NO: 3205433 - RNA, 13 nt, Human
gcacugacucugg

SEQ ID NO: 3205434 - RNA, 18 nt, Human
gcacugacucuggaaaag

SEQ ID NO: 3205435 - RNA, 17 nt, Human
gcacugacucuggaaaa

SEQ ID NO: 3205436 - RNA, 16 nt, Human
gcacugacucuggaaa

SEQ ID NO: 3205437 - RNA, 14 nt, Human
gcacugacucugga

SEQ ID NO: 3205438 - RNA, 16 nt, Human
gcagaaauagacaaaa

SEQ ID NO: 3205439 - RNA, 21 nt, Human
gcagagcagugggccuggcca

SEQ ID NO: 3205440 - RNA, 19 nt, Human
gcagagcagagaccauccc

SEQ ID NO: 3205441 - RNA, 20 nt, Human
gcagagcagagaccaucccu

SEQ ID NO: 3205442 - RNA, 24 nt, Human
gcagagcaccuuagacagucccug

SEQ ID NO: 3205443 - RNA, 12 nt, Human
gcagagcagaga

SEQ ID NO: 3205444 - RNA, 14 nt, Human
gcagagcagagacc

SEQ ID NO: 3205445 - RNA, 15 nt, Human
gcagagcagagacca

SEQ ID NO: 3205446 - RNA, 15 nt, Human
gcagaaauucuguuu

SEQ ID NO: 3205447 - RNA, 14 nt, Human
gcagaaauucuguu

SEQ ID NO: 3205448 - RNA, 12 nt, Human
gcagaaauucug

SEQ ID NO: 3205449 - RNA, 16 nt, Human
gcagaaaucugaggaa

SEQ ID NO: 3205450 - RNA, 17 nt, Human
gcagaaauucuguuuuu

SEQ ID NO: 3205451 - RNA, 16 nt, Human
gcagaaauucuguuuu

SEQ ID NO: 3205452 - RNA, 21 nt, Human
gcagaaauucuguuuuuaaaa

SEQ ID NO: 3205453 - RNA, 13 nt, Human
gcagagaggcugu

SEQ ID NO: 3205454 - RNA, 22 nt, Human
gcagagcaccuuagacaguccc

SEQ ID NO: 3205455 - RNA, 23 nt, Human
gcagagcaccuuagacagucccu

SEQ ID NO: 3205456 - RNA, 19 nt, Human
gcagagcaccuuagacagu

SEQ ID NO: 3205457 - RNA, 14 nt, Human
gcagagaggcugug

SEQ ID NO: 3205458 - RNA, 18 nt, Human
gcaccggcuggccuggcc

SEQ ID NO: 3205459 - RNA, 21 nt, Human
gcaccggcuggccuggccccu

SEQ ID NO: 3205460 - RNA, 23 nt, Human
gcaccggcuggccuggccccuca

SEQ ID NO: 3205461 - RNA, 19 nt, Human
gcaccgacuagacacacaa

SEQ ID NO: 3205462 - RNA, 20 nt, Human
gcaccgacuagacacacaaa

SEQ ID NO: 3205463 - RNA, 17 nt, Human
gcaccgccucuucccgc

SEQ ID NO: 3205464 - RNA, 14 nt, Human
gcaccgccucuucc

SEQ ID NO: 3205465 - RNA, 19 nt, Human
gcaccggcuggccuggccc

SEQ ID NO: 3205466 - RNA, 15 nt, Human
gcaccgaauauugag

SEQ ID NO: 3205467 - RNA, 20 nt, Human
gcacccuuccaucugauucc

SEQ ID NO: 3205468 - RNA, 14 nt, Human
gcacaugccucucu

SEQ ID NO: 3205469 - RNA, 17 nt, Human
gcacaugccucucucag

SEQ ID NO: 3205470 - RNA, 18 nt, Human
gcacaugccucucucagg

SEQ ID NO: 3205471 - RNA, 19 nt, Human
gcacaugccucucucaggc

SEQ ID NO: 3205472 - RNA, 20 nt, Human
gcacaugccucucucaggcc

SEQ ID NO: 3205473 - RNA, 21 nt, Human
gcacaugccucucucaggcca

SEQ ID NO: 3205474 - RNA, 22 nt, Human
gcacaugauuucacaaauauua

SEQ ID NO: 3205475 - RNA, 20 nt, Human
gcacaugauuucacaaauau

SEQ ID NO: 3205476 - RNA, 11 nt, Human
gcacccugagg

SEQ ID NO: 3205477 - RNA, 12 nt, Human
gcacccugaggg

SEQ ID NO: 3205478 - RNA, 13 nt, Human
gcacccugagggc

SEQ ID NO: 3205479 - RNA, 15 nt, Human
gcacccugagggcgg

SEQ ID NO: 3205480 - RNA, 13 nt, Human
gcacaugccucuc

SEQ ID NO: 3205481 - RNA, 13 nt, Human
gcacaugauuuca

SEQ ID NO: 3205482 - RNA, 12 nt, Human
gcacaugauuuc

SEQ ID NO: 3205483 - RNA, 19 nt, Human
gcacaugauuucacaaaua

SEQ ID NO: 3205484 - RNA, 17 nt, Human
gcacaugauuucacaaa

SEQ ID NO: 3205485 - RNA, 15 nt, Human
gcacaugauuucaca

SEQ ID NO: 3205486 - RNA, 14 nt, Human
gcacaugauuucac

SEQ ID NO: 3205487 - RNA, 18 nt, Human
gcacaguuuucugagaaa

SEQ ID NO: 3205488 - RNA, 17 nt, Human
gcacaguuuucugagaa

SEQ ID NO: 3205489 - RNA, 14 nt, Human
gcacaguuuucuga

SEQ ID NO: 3205490 - RNA, 18 nt, Human
gcacacaauuagauuucu

SEQ ID NO: 3205491 - RNA, 14 nt, Human
gcacacaaauauua

SEQ ID NO: 3205492 - RNA, 21 nt, Human
gcacaaucucggcucacugca

SEQ ID NO: 3205493 - RNA, 14 nt, Human
gcaauaagaacaaa

SEQ ID NO: 3205494 - RNA, 22 nt, Human
gcaauaacaguaguguuacaug

SEQ ID NO: 3205495 - RNA, 22 nt, Human
gcacaaucucggcucacugcau

SEQ ID NO: 3205496 - RNA, 12 nt, Human
gcacaauuauaa

SEQ ID NO: 3205497 - RNA, 15 nt, Human
gcaauaaauuuugaa

SEQ ID NO: 3205498 - RNA, 16 nt, Human
gcaauaaauuuugaaa

SEQ ID NO: 3205499 - RNA, 13 nt, Human
gcaauaaaguaua

SEQ ID NO: 3205500 - RNA, 18 nt, Human
gcaauaaauuuugaaaag

SEQ ID NO: 3205501 - RNA, 13 nt, Human
gcaauaaauuuug

SEQ ID NO: 3205502 - RNA, 14 nt, Human
gcaauaaauuuuga

SEQ ID NO: 3205503 - RNA, 14 nt, Human
gcacaagcugcacc

SEQ ID NO: 3205504 - RNA, 23 nt, Human
gcacaagcuccaagcucccaggc

SEQ ID NO: 3205505 - RNA, 21 nt, Human
gcacaagcuccaagcucccag

SEQ ID NO: 3205506 - RNA, 22 nt, Human
gcacaagcuccaagcucccagg

SEQ ID NO: 3205507 - RNA, 13 nt, Human
gcaagugagagcu

SEQ ID NO: 3205508 - RNA, 16 nt, Human
gcaaguccugcaacca

SEQ ID NO: 3205509 - RNA, 13 nt, Human
gauucugagagcu

SEQ ID NO: 3205510 - RNA, 21 nt, Human
gauucugaccuuaaaugcaac

SEQ ID NO: 3205511 - RNA, 20 nt, Human
gauucugaccuuaaaugcaa

SEQ ID NO: 3205512 - RNA, 23 nt, Human
gauucugaccuuaaaugcaacca

SEQ ID NO: 3205513 - RNA, 14 nt, Human
gagcagggcucagc

SEQ ID NO: 3205514 - RNA, 13 nt, Human
gagccccacucuc

SEQ ID NO: 3205515 - RNA, 12 nt, Human
gagccccacucu

SEQ ID NO: 3205516 - RNA, 18 nt, Human
gagccccacucucagagg

SEQ ID NO: 3205517 - RNA, 17 nt, Human
gagccccacucucagag

SEQ ID NO: 3205518 - RNA, 16 nt, Human
gagccccacucucaga

SEQ ID NO: 3205519 - RNA, 14 nt, Human
gagccccacucuca

SEQ ID NO: 3205520 - RNA, 23 nt, Human
gagccccacucucagaggcccca

SEQ ID NO: 3205521 - RNA, 22 nt, Human
gagccccacucucagaggcccc

SEQ ID NO: 3205522 - RNA, 21 nt, Human
gagccccacucucagaggccc

SEQ ID NO: 3205523 - RNA, 20 nt, Human
gagccccacucucagaggcc

SEQ ID NO: 3205524 - RNA, 19 nt, Human
gagccccacucucagaggc

SEQ ID NO: 3205525 - RNA, 22 nt, Human
gagcccccagcuuccagcagga

SEQ ID NO: 3205526 - RNA, 21 nt, Human
gagcccccagcuuccagcagg

SEQ ID NO: 3205527 - RNA, 20 nt, Human
gagcccccagcuuccagcag

SEQ ID NO: 3205528 - RNA, 17 nt, Human
gagcccccagcuuccag

SEQ ID NO: 3205529 - RNA, 22 nt, Human
gagcaugccuggauggggcugc

SEQ ID NO: 3205530 - RNA, 21 nt, Human
gagcaugccuggauggggcug

SEQ ID NO: 3205531 - RNA, 12 nt, Human
gagcaucaggcc

SEQ ID NO: 3205532 - RNA, 19 nt, Human
gagcuggggaugucucuca

SEQ ID NO: 3205533 - RNA, 20 nt, Human
gagcuggggagaauggggcu

SEQ ID NO: 3205534 - RNA, 18 nt, Human
gagcugggugucaagagg

SEQ ID NO: 3205535 - RNA, 21 nt, Human
gagcuggggaccagcagucug

SEQ ID NO: 3205536 - RNA, 14 nt, Human
gagccuuccagggg

SEQ ID NO: 3205537 - RNA, 15 nt, Human
gagccuuccaggggu

SEQ ID NO: 3205538 - RNA, 16 nt, Human
gagccuuccaggggug

SEQ ID NO: 3205539 - RNA, 17 nt, Human
gagccuuccaggggugg

SEQ ID NO: 3205540 - RNA, 15 nt, Human
gagcgacagagcagu

SEQ ID NO: 3205541 - RNA, 14 nt, Human
gagcgacagagcag

SEQ ID NO: 3205542 - RNA, 22 nt, Human
gagcugccuguucagcuccagc

SEQ ID NO: 3205543 - RNA, 21 nt, Human
gagcugccuguucagcuccag

SEQ ID NO: 3205544 - RNA, 20 nt, Human
gagcugccuguucagcucca

SEQ ID NO: 3205545 - RNA, 18 nt, Human
gagcggagaaaggaaggg

SEQ ID NO: 3205546 - RNA, 21 nt, Human
gagcggagaaaggaagggcug

SEQ ID NO: 3205547 - RNA, 17 nt, Human
gagcggagaaaggaagg

SEQ ID NO: 3205548 - RNA, 20 nt, Human
gagcggagacgggaggccug

SEQ ID NO: 3205549 - RNA, 18 nt, Human
gagcggauugcaaagcaa

SEQ ID NO: 3205550 - RNA, 16 nt, Human
gagcggauugcaaagc

SEQ ID NO: 3205551 - RNA, 19 nt, Human
gagaugaugaaaauauuua

SEQ ID NO: 3205552 - RNA, 20 nt, Human
gagaugaugaaaauauuuaa

SEQ ID NO: 3205553 - RNA, 22 nt, Human
gagaggcauccaguaucuugaa

SEQ ID NO: 3205554 - RNA, 21 nt, Human
gagaugaugccaugggcccuc

SEQ ID NO: 3205555 - RNA, 12 nt, Human
gagaugauuucc

SEQ ID NO: 3205556 - RNA, 14 nt, Human
gagaugcugugccc

SEQ ID NO: 3205557 - RNA, 17 nt, Human
gagaugcugugccccug

SEQ ID NO: 3205558 - RNA, 15 nt, Human
gagaugcugugcccc

SEQ ID NO: 3205559 - RNA, 14 nt, Human
gagacuccugcagg

SEQ ID NO: 3205560 - RNA, 15 nt, Human
gagacuccugcaggc

SEQ ID NO: 3205561 - RNA, 16 nt, Human
gagacuccugcaggca

SEQ ID NO: 3205562 - RNA, 17 nt, Human
gagacuccugcaggcag

SEQ ID NO: 3205563 - RNA, 14 nt, Human
gagaggcauccagu

SEQ ID NO: 3205564 - RNA, 21 nt, Human
gagaugguaugcacaauucca

SEQ ID NO: 3205565 - RNA, 18 nt, Human
gagauugcaccacugcac

SEQ ID NO: 3205566 - RNA, 12 nt, Human
gagaugucucuu

SEQ ID NO: 3205567 - RNA, 20 nt, Human
gagauuuggggcuaaagacu

SEQ ID NO: 3205568 - RNA, 22 nt, Human
gacuauucaaacagucucagga

SEQ ID NO: 3205569 - RNA, 22 nt, Human
gacuaucuaaauguugaaagau

SEQ ID NO: 3205570 - RNA, 15 nt, Human
gacuaggguccuggg

SEQ ID NO: 3205571 - RNA, 16 nt, Human
gacuaggguccugggg

SEQ ID NO: 3205572 - RNA, 21 nt, Human
gacucuuuauugucuguaaau

SEQ ID NO: 3205573 - RNA, 22 nt, Human
gacucuuuauugucuguaaauc

SEQ ID NO: 3205574 - RNA, 23 nt, Human
gacucuuuauugucuguaaaucu

SEQ ID NO: 3205575 - RNA, 22 nt, Human
gacucuuuuccaaacacaggca

SEQ ID NO: 3205576 - RNA, 12 nt, Human
gacucugucuca

SEQ ID NO: 3205577 - RNA, 16 nt, Human
gacucugccuccucuu

SEQ ID NO: 3205578 - RNA, 16 nt, Human
gacucugcucuugcau

SEQ ID NO: 3205579 - RNA, 18 nt, Human
gacuuuugaaaagaggug

SEQ ID NO: 3205580 - RNA, 23 nt, Human
gacuuuucuguccgagcuuugaa

SEQ ID NO: 3205581 - RNA, 17 nt, Human
gacuuuugcuuuaauuc

SEQ ID NO: 3205582 - RNA, 15 nt, Human
gacuuuugcuuuaau

SEQ ID NO: 3205583 - RNA, 14 nt, Human
gacuuuugcuuuaa

SEQ ID NO: 3205584 - RNA, 13 nt, Human
gacuuuugcuuua

SEQ ID NO: 3205585 - RNA, 23 nt, Human
gacuuuucuuucagccaagaauu

SEQ ID NO: 3205586 - RNA, 21 nt, Human
gacuuuucuuuguggcuuccu

SEQ ID NO: 3205587 - RNA, 11 nt, Human
gacuuuccucu

SEQ ID NO: 3205588 - RNA, 23 nt, Human
gagacuaaccccaccacacccuc

SEQ ID NO: 3205589 - RNA, 11 nt, Human
gagaccugccc

SEQ ID NO: 3205590 - RNA, 12 nt, Human
gagaccugcccc

SEQ ID NO: 3205591 - RNA, 14 nt, Human
gagaaucacuugaa

SEQ ID NO: 3205592 - RNA, 18 nt, Human
gagaagugacgguuccua

SEQ ID NO: 3205593 - RNA, 15 nt, Human
gagaaucacuugaac

SEQ ID NO: 3205594 - RNA, 16 nt, Human
gagaaucacaggcugg

SEQ ID NO: 3205595 - RNA, 15 nt, Human
gagaaucauguuucu

SEQ ID NO: 3205596 - RNA, 20 nt, Human
gagaaucauguuucuuugau

SEQ ID NO: 3205597 - RNA, 19 nt, Human
gagaaucauguuucuuuga

SEQ ID NO: 3205598 - RNA, 17 nt, Human
gagaaucauguuucuuu

SEQ ID NO: 3205599 - RNA, 16 nt, Human
gagaaucauguuucuu

SEQ ID NO: 3205600 - RNA, 12 nt, Human
gagaaggaagcc

SEQ ID NO: 3205601 - RNA, 20 nt, Human
gagaaggacccggaggggcc

SEQ ID NO: 3205602 - RNA, 22 nt, Human
gagaaggacccggaggggccug

SEQ ID NO: 3205603 - RNA, 13 nt, Human
gagaagcggcugg

SEQ ID NO: 3205604 - RNA, 15 nt, Human
gagaagcggcuggca

SEQ ID NO: 3205605 - RNA, 19 nt, Human
gaagugugggucugugugu

SEQ ID NO: 3205606 - RNA, 17 nt, Human
gaagugugggucugugu

SEQ ID NO: 3205607 - RNA, 18 nt, Human
gaagugugggucugugug

SEQ ID NO: 3205608 - RNA, 11 nt, Human
gaaugaauguc

SEQ ID NO: 3205609 - RNA, 14 nt, Human
gaaugaaugucagu

SEQ ID NO: 3205610 - RNA, 18 nt, Human
gaaugaaugucaguguga

SEQ ID NO: 3205611 - RNA, 22 nt, Human
gaaugaaugucagugugacuga

SEQ ID NO: 3205612 - RNA, 16 nt, Human
gaaugagacuggcuug

SEQ ID NO: 3205613 - RNA, 21 nt, Human
gaaugaccuuguaauguaacu

SEQ ID NO: 3205614 - RNA, 19 nt, Human
gaaugaccuuguaauguaa

SEQ ID NO: 3205615 - RNA, 18 nt, Human
gaaugaccuuguaaugua

SEQ ID NO: 3205616 - RNA, 22 nt, Human
gaaugacuaagaggaaaguaca

SEQ ID NO: 3205617 - RNA, 20 nt, Human
gaaugacuuccccaauaucu

SEQ ID NO: 3205618 - RNA, 13 nt, Human
gaaugacucguuu

SEQ ID NO: 3205619 - RNA, 20 nt, Human
gaaugaauggcuaagcaaaa

SEQ ID NO: 3205620 - RNA, 16 nt, Human
gaaugaccuuguaaug

SEQ ID NO: 3205621 - RNA, 15 nt, Human
gaaugaccuuguaau

SEQ ID NO: 3205622 - RNA, 12 nt, Human
gaaugaauuuca

SEQ ID NO: 3205623 - RNA, 15 nt, Human
gaaggcuauggggau

SEQ ID NO: 3205624 - RNA, 16 nt, Human
gaaggcucgagcaugc

SEQ ID NO: 3205625 - RNA, 17 nt, Human
gaaggcucgagcaugcc

SEQ ID NO: 3205626 - RNA, 19 nt, Human
gaagggcagggcugaggcc

SEQ ID NO: 3205627 - RNA, 18 nt, Human
gaagucuuuguacagaca

SEQ ID NO: 3205628 - RNA, 19 nt, Human
gaagucuuuguacagacaa

SEQ ID NO: 3205629 - RNA, 20 nt, Human
gaagucuuuguacagacaac

SEQ ID NO: 3205630 - RNA, 15 nt, Human
gaaguggggacagag

SEQ ID NO: 3205631 - RNA, 16 nt, Human
gaagugagaaaaugaa

SEQ ID NO: 3205632 - RNA, 22 nt, Human
gaagugacgguuccuacacagg

SEQ ID NO: 3205633 - RNA, 16 nt, Human
gaagugacgguuccua

SEQ ID NO: 3205634 - RNA, 17 nt, Human
gaagugcagaacugcag

SEQ ID NO: 3205635 - RNA, 20 nt, Human
gaagugcagaacugcaguca

SEQ ID NO: 3205636 - RNA, 18 nt, Human
gaagugcagaacugcagu

SEQ ID NO: 3205637 - RNA, 19 nt, Human
gaaaucccugcucacugca

SEQ ID NO: 3205638 - RNA, 18 nt, Human
gaaaucccugcucacugc

SEQ ID NO: 3205639 - RNA, 15 nt, Human
gaaaucccugcucac

SEQ ID NO: 3205640 - RNA, 22 nt, Human
gaaaucauauuuggaauaaaaa

SEQ ID NO: 3205641 - RNA, 13 nt, Human
gaaauccagggug

SEQ ID NO: 3205642 - RNA, 18 nt, Human
gaaauccagggugguggu

SEQ ID NO: 3205643 - RNA, 14 nt, Human
gaagcucagggccu

SEQ ID NO: 3205644 - RNA, 15 nt, Human
gaagcucagggccug

SEQ ID NO: 3205645 - RNA, 16 nt, Human
gaagcucagggccugg

SEQ ID NO: 3205646 - RNA, 17 nt, Human
gaagcucagggccuggc

SEQ ID NO: 3205647 - RNA, 18 nt, Human
gaagcucagggccuggcu

SEQ ID NO: 3205648 - RNA, 19 nt, Human
gaagcucagggccuggcuc

SEQ ID NO: 3205649 - RNA, 20 nt, Human
gaagcucagggccuggcuca

SEQ ID NO: 3205650 - RNA, 21 nt, Human
gaagcucagggccuggcucag

SEQ ID NO: 3205651 - RNA, 23 nt, Human
gaagcucagggccuggcucaggu

SEQ ID NO: 3205652 - RNA, 23 nt, Human
gaauuuuaaaagaugcaauguag

SEQ ID NO: 3205653 - RNA, 21 nt, Human
gaauuuuaaaagaugcaaugu

SEQ ID NO: 3205654 - RNA, 15 nt, Human
gaauuuuaaaagaug

SEQ ID NO: 3205655 - RNA, 12 nt, Human
gaauuuuaaaag

SEQ ID NO: 3205656 - RNA, 12 nt, Human
gaauuuuaaagu

SEQ ID NO: 3205657 - RNA, 13 nt, Human
gaauuuuaaagua

SEQ ID NO: 3205658 - RNA, 15 nt, Human
gaauuuuaaaguaug

SEQ ID NO: 3205659 - RNA, 20 nt, Human
gaauuuuaagccuuuguuga

SEQ ID NO: 3205660 - RNA, 13 nt, Human
gaauuuuaagccu

SEQ ID NO: 3205661 - RNA, 19 nt, Human
gaauuuuggcugugucucc

SEQ ID NO: 3205662 - RNA, 15 nt, Human
gaauuuucuaaaagc

SEQ ID NO: 3205663 - RNA, 16 nt, Human
gaauuuucuaaaagcu

SEQ ID NO: 3205664 - RNA, 22 nt, Human
gaauuuucauuuuacaguuacu

SEQ ID NO: 3205665 - RNA, 21 nt, Human
gaauuuuauuuuuugggaaaa

SEQ ID NO: 3205666 - RNA, 18 nt, Human
gaauuuuauugacacagu

SEQ ID NO: 3205667 - RNA, 12 nt, Human
gaauuuucauuu

SEQ ID NO: 3205668 - RNA, 11 nt, Human
gaauuuucauu

SEQ ID NO: 3205669 - RNA, 20 nt, Human
gaauuuucauuuuacaguua

SEQ ID NO: 3205670 - RNA, 16 nt, Human
gaauuuucauuuuaca

SEQ ID NO: 3205671 - RNA, 14 nt, Human
gaauuuucauuuua

SEQ ID NO: 3205672 - RNA, 13 nt, Human
gaauuuucauuuu

SEQ ID NO: 3205673 - RNA, 15 nt, Human
gaauuaucagcaaag

SEQ ID NO: 3205674 - RNA, 16 nt, Human
gaauuaucagcaaaga

SEQ ID NO: 3205675 - RNA, 17 nt, Human
gaauuaucagcaaagaa

SEQ ID NO: 3205676 - RNA, 18 nt, Human
gaauuaucagcaaagaaa

SEQ ID NO: 3205677 - RNA, 20 nt, Human
gaauuaucagcaaagaaaaa

SEQ ID NO: 3205678 - RNA, 12 nt, Human
gaaugagggggc

SEQ ID NO: 3205679 - RNA, 15 nt, Human
gaaugagggggcuca

SEQ ID NO: 3205680 - RNA, 16 nt, Human
gaaugagggggcucag

SEQ ID NO: 3205681 - RNA, 17 nt, Human
gaaugagggggcucagu

SEQ ID NO: 3205682 - RNA, 15 nt, Human
gaaugaggguuugag

SEQ ID NO: 3205683 - RNA, 19 nt, Human
gaaugaggguuugagagag

SEQ ID NO: 3205684 - RNA, 16 nt, Human
gacaaaaaguauauua

SEQ ID NO: 3205685 - RNA, 18 nt, Human
gacaaaaaguauauuaaa

SEQ ID NO: 3205686 - RNA, 22 nt, Human
gacaaaaaguauauuaaacaaa

SEQ ID NO: 3205687 - RNA, 18 nt, Human
gaauuuuuaugugugauu

SEQ ID NO: 3205688 - RNA, 15 nt, Human
gaauuuuuaugugug

SEQ ID NO: 3205689 - RNA, 21 nt, Human
gaauuuugugcccccauguaa

SEQ ID NO: 3205690 - RNA, 20 nt, Human
gaauuuugugcccccaugua

SEQ ID NO: 3205691 - RNA, 23 nt, Human
gaauuuuggcugugucucccuuc

SEQ ID NO: 3205692 - RNA, 19 nt, Human
gacacacagcucuguccug

SEQ ID NO: 3205693 - RNA, 18 nt, Human
gacacacagcucuguccu

SEQ ID NO: 3205694 - RNA, 17 nt, Human
gacacacagcucugucc

SEQ ID NO: 3205695 - RNA, 15 nt, Human
gacacacagcucugu

SEQ ID NO: 3205696 - RNA, 13 nt, Human
gacacacagcucu

SEQ ID NO: 3205697 - RNA, 14 nt, Human
gacacacagcucug

SEQ ID NO: 3205698 - RNA, 21 nt, Human
gacacacagcucuguccuggg

SEQ ID NO: 3205699 - RNA, 22 nt, Human
gacaggguuuugccauguuggc

SEQ ID NO: 3205700 - RNA, 20 nt, Human
gacaggguuuugccauguug

SEQ ID NO: 3205701 - RNA, 18 nt, Human
gacagcgcacagcugcuc

SEQ ID NO: 3205702 - RNA, 15 nt, Human
gacagcgcacagcug

SEQ ID NO: 3205703 - RNA, 19 nt, Human
gacagccuggcacagggca

SEQ ID NO: 3205704 - RNA, 13 nt, Human
gacagccuggcac

SEQ ID NO: 3205705 - RNA, 15 nt, Human
gacaguauuuguggg

SEQ ID NO: 3205706 - RNA, 20 nt, Human
gacaguauggcagcuuuccu

SEQ ID NO: 3205707 - RNA, 23 nt, Human
gacagucucaccauuuccccagg

SEQ ID NO: 3205708 - RNA, 14 nt, Human
gacagucucaccau

SEQ ID NO: 3205709 - RNA, 13 nt, Human
gacagucucacca

SEQ ID NO: 3205710 - RNA, 20 nt, Human
gacagaaggcuccugccccc

SEQ ID NO: 3205711 - RNA, 19 nt, Human
gacagaaggcuccugcccc

SEQ ID NO: 3205712 - RNA, 14 nt, Human
gacagaaggcuccu

SEQ ID NO: 3205713 - RNA, 23 nt, Human
gacacuuauccacgagagcgcag

SEQ ID NO: 3205714 - RNA, 17 nt, Human
gacacuuaauucuguuc

SEQ ID NO: 3205715 - RNA, 19 nt, Human
gacacuuaauucuguucug

SEQ ID NO: 3205716 - RNA, 20 nt, Human
gacagcccgggcucugccuc

SEQ ID NO: 3205717 - RNA, 21 nt, Human
gacagcccgggcucugccucc

SEQ ID NO: 3205718 - RNA, 22 nt, Human
gacagcccgggcucugccuccc

SEQ ID NO: 3205719 - RNA, 23 nt, Human
gacagcccgggcucugccuccca

SEQ ID NO: 3205720 - RNA, 16 nt, Human
gacacuuaaaaauggu

SEQ ID NO: 3205721 - RNA, 15 nt, Human
gacacugaugggcaa

SEQ ID NO: 3205722 - RNA, 13 nt, Human
gacacugaugggc

SEQ ID NO: 3205723 - RNA, 13 nt, Human
gacacugaaauaa

SEQ ID NO: 3205724 - RNA, 17 nt, Human
ggcccugugccuuggug

SEQ ID NO: 3205725 - RNA, 16 nt, Human
ggcccuucucuccagc

SEQ ID NO: 3205726 - RNA, 17 nt, Human
ggcccuucucuccagcc

SEQ ID NO: 3205727 - RNA, 14 nt, Human
ggcccuuccuuuuc

SEQ ID NO: 3205728 - RNA, 15 nt, Human
ggcccuuccucucca

SEQ ID NO: 3205729 - RNA, 13 nt, Human
ggcccuuccucuc

SEQ ID NO: 3205730 - RNA, 17 nt, Human
ggcccuuccucuccacu

SEQ ID NO: 3205731 - RNA, 18 nt, Human
ggcccuucucuccagccc

SEQ ID NO: 3205732 - RNA, 16 nt, Human
ggccgauggggcaguc

SEQ ID NO: 3205733 - RNA, 22 nt, Human
ggcccagggggcuuccugaggg

SEQ ID NO: 3205734 - RNA, 19 nt, Human
ggcccagggggcuuccuga

SEQ ID NO: 3205735 - RNA, 22 nt, Human
ggccccaccuggcccucucuga

SEQ ID NO: 3205736 - RNA, 15 nt, Human
ggccccaccuggccc

SEQ ID NO: 3205737 - RNA, 13 nt, Human
ggccccaccuggc

SEQ ID NO: 3205738 - RNA, 19 nt, Human
ggccccaccugcagcuccc

SEQ ID NO: 3205739 - RNA, 16 nt, Human
ggccccaccugcagcu

SEQ ID NO: 3205740 - RNA, 13 nt, Human
ggccccaccugca

SEQ ID NO: 3205741 - RNA, 17 nt, Human
ggcagugggagcugccu

SEQ ID NO: 3205742 - RNA, 24 nt, Human
ggcacugcuuccagugaggcucug

SEQ ID NO: 3205743 - RNA, 15 nt, Human
ggcaccagcagccug

SEQ ID NO: 3205744 - RNA, 16 nt, Human
ggcaccagcagccugg

SEQ ID NO: 3205745 - RNA, 22 nt, Human
ggcacugcuuccagugaggcuc

SEQ ID NO: 3205746 - RNA, 22 nt, Human
ggcauuuucccccuuggcucuc

SEQ ID NO: 3205747 - RNA, 22 nt, Human
ggcauccauggggucucucaca

SEQ ID NO: 3205748 - RNA, 13 nt, Human
ggcauccaugggg

SEQ ID NO: 3205749 - RNA, 23 nt, Human
ggcauauauguacuaguggcaug

SEQ ID NO: 3205750 - RNA, 18 nt, Human
ggcauccaguaucuugaa

SEQ ID NO: 3205751 - RNA, 19 nt, Human
ggcagugggagcugccugu

SEQ ID NO: 3205752 - RNA, 18 nt, Human
ggcagugggagcugccug

SEQ ID NO: 3205753 - RNA, 19 nt, Human
ggccaguggcuggaucugu

SEQ ID NO: 3205754 - RNA, 16 nt, Human
ggccagugugacaagg

SEQ ID NO: 3205755 - RNA, 14 nt, Human
ggccaguggcggaa

SEQ ID NO: 3205756 - RNA, 20 nt, Human
ggccaucuggagagcccaga

SEQ ID NO: 3205757 - RNA, 16 nt, Human
ggccaucuggagagcc

SEQ ID NO: 3205758 - RNA, 14 nt, Human
ggccaucuggagag

SEQ ID NO: 3205759 - RNA, 14 nt, Human
ggccaggcuggucu

SEQ ID NO: 3205760 - RNA, 12 nt, Human
ggccaggcuggu

SEQ ID NO: 3205761 - RNA, 18 nt, Human
ggccaggcuggucucaaa

SEQ ID NO: 3205762 - RNA, 16 nt, Human
ggccaggcuggucuca

SEQ ID NO: 3205763 - RNA, 17 nt, Human
ggccaaacucaccugcc

SEQ ID NO: 3205764 - RNA, 23 nt, Human
ggccaaacaacagucuucauuuu

SEQ ID NO: 3205765 - RNA, 15 nt, Human
ggccaaaagcuuccc

SEQ ID NO: 3205766 - RNA, 15 nt, Human
ggccaaacaggcccu

SEQ ID NO: 3205767 - RNA, 23 nt, Human
ggccaaaagcuucccucccugcu

SEQ ID NO: 3205768 - RNA, 23 nt, Human
ggcucagcggggacagcuccuuc

SEQ ID NO: 3205769 - RNA, 22 nt, Human
ggcucagcggggacagcuccuu

SEQ ID NO: 3205770 - RNA, 21 nt, Human
ggcucagcggggacagcuccu

SEQ ID NO: 3205771 - RNA, 20 nt, Human
ggcucagcggggacagcucc

SEQ ID NO: 3205772 - RNA, 22 nt, Human
ggcucagcaaggccaccucuuc

SEQ ID NO: 3205773 - RNA, 21 nt, Human
ggcucagcaaggccaccucuu

SEQ ID NO: 3205774 - RNA, 20 nt, Human
ggcucagcaaggccaccucu

SEQ ID NO: 3205775 - RNA, 19 nt, Human
ggcucagcaaggccaccuc

SEQ ID NO: 3205776 - RNA, 18 nt, Human
ggcucagcaaggccaccu

SEQ ID NO: 3205777 - RNA, 17 nt, Human
ggcucagcaaggccacc

SEQ ID NO: 3205778 - RNA, 15 nt, Human
ggcucagcaaggcca

SEQ ID NO: 3205779 - RNA, 14 nt, Human
ggcucagcaaggcc

SEQ ID NO: 3205780 - RNA, 23 nt, Human
ggcucagcaaaagaugcuucuca

SEQ ID NO: 3205781 - RNA, 19 nt, Human
ggcucagcaaaagaugcuu

SEQ ID NO: 3205782 - RNA, 13 nt, Human
ggcucagcaaggc

SEQ ID NO: 3205783 - RNA, 17 nt, Human
ggcucacugcagccuca

SEQ ID NO: 3205784 - RNA, 16 nt, Human
ggcucacugcauccuc

SEQ ID NO: 3205785 - RNA, 19 nt, Human
ggcucacugcauccuccgc

SEQ ID NO: 3205786 - RNA, 16 nt, Human
ggcucacugcagccuc

SEQ ID NO: 3205787 - RNA, 14 nt, Human
ggcgugcaguggug

SEQ ID NO: 3205788 - RNA, 19 nt, Human
ggcgugcaguggugcgauc

SEQ ID NO: 3205789 - RNA, 15 nt, Human
ggccugagcugggau

SEQ ID NO: 3205790 - RNA, 12 nt, Human
ggccugagcugg

SEQ ID NO: 3205791 - RNA, 16 nt, Human
ggccuugaguccccca

SEQ ID NO: 3205792 - RNA, 16 nt, Human
ggccuucucugaagga

SEQ ID NO: 3205793 - RNA, 15 nt, Human
ggccuucucugaagg

SEQ ID NO: 3205794 - RNA, 13 nt, Human
ggccuuuggcuuc

SEQ ID NO: 3205795 - RNA, 13 nt, Human
ggccuuucccacu

SEQ ID NO: 3205796 - RNA, 14 nt, Human
ggccuuguggucca

SEQ ID NO: 3205797 - RNA, 15 nt, Human
ggccuugugguccaa

SEQ ID NO: 3205798 - RNA, 18 nt, Human
ggccuugugguccaaaua

SEQ ID NO: 3205799 - RNA, 15 nt, Human
ggcgaaucauuuguu

SEQ ID NO: 3205800 - RNA, 13 nt, Human
ggcgaaucucaaa

SEQ ID NO: 3205801 - RNA, 17 nt, Human
ggcgaaucucaaaauua

SEQ ID NO: 3205802 - RNA, 22 nt, Human
ggcgaaaucccugcucacugca

SEQ ID NO: 3205803 - RNA, 18 nt, Human
ggcgaaaucccugcucac

SEQ ID NO: 3205804 - RNA, 14 nt, Human
ggccuuuggcuuca

SEQ ID NO: 3205805 - RNA, 22 nt, Human
ggcgagaccugauuucuccugc

SEQ ID NO: 3205806 - RNA, 21 nt, Human
ggccugugucuaguuguuuga

SEQ ID NO: 3205807 - RNA, 22 nt, Human
ggccuucggccuccauccugag

SEQ ID NO: 3205808 - RNA, 23 nt, Human
ggccuucggccuccauccugagg

SEQ ID NO: 3205809 - RNA, 12 nt, Human
ggccuucucuga

SEQ ID NO: 3205810 - RNA, 21 nt, Human
ggccuggccagaugcaccagc

SEQ ID NO: 3205811 - RNA, 16 nt, Human
ggccuggccagaugca

SEQ ID NO: 3205812 - RNA, 22 nt, Human
ggccugagugagaggggaggcc

SEQ ID NO: 3205813 - RNA, 20 nt, Human
ggccugagugagaggggagg

SEQ ID NO: 3205814 - RNA, 16 nt, Human
ggagcaucagugcccu

SEQ ID NO: 3205815 - RNA, 22 nt, Human
ggagcauuggggauguuuuucu

SEQ ID NO: 3205816 - RNA, 21 nt, Human
ggagguagcuuugagguggaa

SEQ ID NO: 3205817 - RNA, 16 nt, Human
ggaggggggagguggg

SEQ ID NO: 3205818 - RNA, 20 nt, Human
ggaggccuugggcucugcug

SEQ ID NO: 3205819 - RNA, 20 nt, Human
ggaggucaaggcugcaguga

SEQ ID NO: 3205820 - RNA, 14 nt, Human
ggaggugaccccag

SEQ ID NO: 3205821 - RNA, 13 nt, Human
ggagccaggaggg

SEQ ID NO: 3205822 - RNA, 18 nt, Human
ggagcccaggagucccac

SEQ ID NO: 3205823 - RNA, 13 nt, Human
ggagcccaggagu

SEQ ID NO: 3205824 - RNA, 12 nt, Human
ggagcccaggag

SEQ ID NO: 3205825 - RNA, 16 nt, Human
ggagccaauggagacu

SEQ ID NO: 3205826 - RNA, 22 nt, Human
ggagccccgaggccuucucuga

SEQ ID NO: 3205827 - RNA, 16 nt, Human
ggagccccgaggccuu

SEQ ID NO: 3205828 - RNA, 12 nt, Human
ggagcugccugu

SEQ ID NO: 3205829 - RNA, 16 nt, Human
ggagcugaguggggga

SEQ ID NO: 3205830 - RNA, 21 nt, Human
ggagcugccuguucagcucca

SEQ ID NO: 3205831 - RNA, 19 nt, Human
ggaggaaggaaacccagcu

SEQ ID NO: 3205832 - RNA, 18 nt, Human
ggagcuggcuccagccug

SEQ ID NO: 3205833 - RNA, 20 nt, Human
ggagcuggcuccagccugga

SEQ ID NO: 3205834 - RNA, 20 nt, Human
ggaggaaggaaacccagcuc

SEQ ID NO: 3205835 - RNA, 23 nt, Human
ggaggaaggaaacccagcucugg

SEQ ID NO: 3205836 - RNA, 11 nt, Human
ggaggccagcc

SEQ ID NO: 3205837 - RNA, 14 nt, Human
ggaggccaccuccu

SEQ ID NO: 3205838 - RNA, 13 nt, Human
ggaggccaccucc

SEQ ID NO: 3205839 - RNA, 18 nt, Human
ggaggccaccuccuaaaa

SEQ ID NO: 3205840 - RNA, 20 nt, Human
ggaggccaaggugggaggau

SEQ ID NO: 3205841 - RNA, 22 nt, Human
ggaggaccagggcuggggcagc

SEQ ID NO: 3205842 - RNA, 12 nt, Human
ggaggaccaggg

SEQ ID NO: 3205843 - RNA, 13 nt, Human
ggaggaccagggc

SEQ ID NO: 3205844 - RNA, 15 nt, Human
ggagugcagugagcc

SEQ ID NO: 3205845 - RNA, 12 nt, Human
ggagugcagugg

SEQ ID NO: 3205846 - RNA, 22 nt, Human
ggagugcaguggcgaaaucccu

SEQ ID NO: 3205847 - RNA, 14 nt, Human
ggaguggccacaga

SEQ ID NO: 3205848 - RNA, 15 nt, Human
ggaguucugguuccu

SEQ ID NO: 3205849 - RNA, 12 nt, Human
ggaguucuucuu

SEQ ID NO: 3205850 - RNA, 18 nt, Human
ggaguuggaguagaaugu

SEQ ID NO: 3205851 - RNA, 21 nt, Human
ggaguuggaagugugugaucu

SEQ ID NO: 3205852 - RNA, 12 nt, Human
ggauaacaccac

SEQ ID NO: 3205853 - RNA, 18 nt, Human
ggauaaaucauaaaguca

SEQ ID NO: 3205854 - RNA, 12 nt, Human
ggauggcaagau

SEQ ID NO: 3205855 - RNA, 18 nt, Human
ggauggauuuccagccaa

SEQ ID NO: 3205856 - RNA, 18 nt, Human
ggauggaggaagaacuga

SEQ ID NO: 3205857 - RNA, 16 nt, Human
ggauggggcugcaccg

SEQ ID NO: 3205858 - RNA, 21 nt, Human
ggauguacaaggacagccccu

SEQ ID NO: 3205859 - RNA, 22 nt, Human
ggaugggcagucauuuugcaga

SEQ ID NO: 3205860 - RNA, 15 nt, Human
ggauggcccagggug

SEQ ID NO: 3205861 - RNA, 18 nt, Human
ggaucucuugagccuggg

SEQ ID NO: 3205862 - RNA, 15 nt, Human
ggauccuccaggugc

SEQ ID NO: 3205863 - RNA, 14 nt, Human
ggauccuccaggug

SEQ ID NO: 3205864 - RNA, 13 nt, Human
ggauccugagcca

SEQ ID NO: 3205865 - RNA, 14 nt, Human
ggauccugagccag

SEQ ID NO: 3205866 - RNA, 12 nt, Human
ggcacagccugg

SEQ ID NO: 3205867 - RNA, 13 nt, Human
ggcacagccugca

SEQ ID NO: 3205868 - RNA, 12 nt, Human
ggcacagccugc

SEQ ID NO: 3205869 - RNA, 15 nt, Human
ggcacagccugcacu

SEQ ID NO: 3205870 - RNA, 14 nt, Human
ggcacagccugcac

SEQ ID NO: 3205871 - RNA, 16 nt, Human
ggcacagggcaguggg

SEQ ID NO: 3205872 - RNA, 13 nt, Human
ggcacagggccug

SEQ ID NO: 3205873 - RNA, 12 nt, Human
ggcacagggccu

SEQ ID NO: 3205874 - RNA, 19 nt, Human
ggcacagggcaugaaauga

SEQ ID NO: 3205875 - RNA, 16 nt, Human
ggcacagggcaugaaa

SEQ ID NO: 3205876 - RNA, 18 nt, Human
ggcacagggccuggccca

SEQ ID NO: 3205877 - RNA, 17 nt, Human
ggcacagggccuggccc

SEQ ID NO: 3205878 - RNA, 15 nt, Human
ggcacagggccuggc

SEQ ID NO: 3205879 - RNA, 14 nt, Human
ggcacagggccugg

SEQ ID NO: 3205880 - RNA, 21 nt, Human
ggcacaggcagggcaggacca

SEQ ID NO: 3205881 - RNA, 13 nt, Human
ggcacagggagag

SEQ ID NO: 3205882 - RNA, 16 nt, Human
ggcacaggcagggcag

SEQ ID NO: 3205883 - RNA, 15 nt, Human
ggcacaggcagggca

SEQ ID NO: 3205884 - RNA, 14 nt, Human
ggcacaggcagggc

SEQ ID NO: 3205885 - RNA, 13 nt, Human
ggcacaggcaggg

SEQ ID NO: 3205886 - RNA, 12 nt, Human
ggcacaggcagg

SEQ ID NO: 3205887 - RNA, 16 nt, Human
ggcaauguuuugcuuu

SEQ ID NO: 3205888 - RNA, 22 nt, Human
ggcacaaucucggcucacugca

SEQ ID NO: 3205889 - RNA, 24 nt, Human
ggcacagaaaauggaagacagcuc

SEQ ID NO: 3205890 - RNA, 23 nt, Human
ggcacagaaaauggaagacagcu

SEQ ID NO: 3205891 - RNA, 15 nt, Human
ggauguucugggaca

SEQ ID NO: 3205892 - RNA, 16 nt, Human
ggauguucugggacac

SEQ ID NO: 3205893 - RNA, 13 nt, Human
ggauguucuggga

SEQ ID NO: 3205894 - RNA, 14 nt, Human
gggagggcuccaga

SEQ ID NO: 3205895 - RNA, 15 nt, Human
gggagggcuccagac

SEQ ID NO: 3205896 - RNA, 17 nt, Human
gggagggcuccagacac

SEQ ID NO: 3205897 - RNA, 17 nt, Human
gggaggucgaggcagga

SEQ ID NO: 3205898 - RNA, 18 nt, Human
gggaggucgaggcaggag

SEQ ID NO: 3205899 - RNA, 19 nt, Human
gggaggucgaggcaggagg

SEQ ID NO: 3205900 - RNA, 16 nt, Human
gggaugguguucaaaa

SEQ ID NO: 3205901 - RNA, 19 nt, Human
gggaugguaagagaaaaga

SEQ ID NO: 3205902 - RNA, 14 nt, Human
gggaugucucucau

SEQ ID NO: 3205903 - RNA, 22 nt, Human
gggaugugugugugcagagcug

SEQ ID NO: 3205904 - RNA, 13 nt, Human
gggauguuuuucu

SEQ ID NO: 3205905 - RNA, 15 nt, Human
gggaggucgaggcag

SEQ ID NO: 3205906 - RNA, 16 nt, Human
gggaugggagccgggc

SEQ ID NO: 3205907 - RNA, 15 nt, Human
gggaugggagccggg

SEQ ID NO: 3205908 - RNA, 14 nt, Human
gggauggggcuggg

SEQ ID NO: 3205909 - RNA, 14 nt, Human
gggaugggccugag

SEQ ID NO: 3205910 - RNA, 15 nt, Human
aaaagaugcaaugua

SEQ ID NO: 3205911 - RNA, 13 nt, Human
aaaagauguagau

SEQ ID NO: 3205912 - RNA, 15 nt, Human
aaaagcaauauugua

SEQ ID NO: 3205913 - RNA, 14 nt, Human
aaaagauguagauu

SEQ ID NO: 3205914 - RNA, 17 nt, Human
aaaagcaacaucagcuu

SEQ ID NO: 3205915 - RNA, 22 nt, Human
gggagaaugucaguauguggaa

SEQ ID NO: 3205916 - RNA, 19 nt, Human
gggagaaugucaguaugug

SEQ ID NO: 3205917 - RNA, 14 nt, Human
aaaagcagcauaaa

SEQ ID NO: 3205918 - RNA, 19 nt, Human
gggaggccaaggugggagg

SEQ ID NO: 3205919 - RNA, 12 nt, Human
gggagcagcccc

SEQ ID NO: 3205920 - RNA, 19 nt, Human
gggaggccaucuggagagc

SEQ ID NO: 3205921 - RNA, 15 nt, Human
gggagcacccugagg

SEQ ID NO: 3205922 - RNA, 13 nt, Human
gggagacagagca

SEQ ID NO: 3205923 - RNA, 19 nt, Human
aaaagggaguuuaaaaaug

SEQ ID NO: 3205924 - RNA, 14 nt, Human
aaaagggaguuuuu

SEQ ID NO: 3205925 - RNA, 16 nt, Human
gggcagaucucccaca

SEQ ID NO: 3205926 - RNA, 21 nt, Human
gggcagaggagaacuugcugc

SEQ ID NO: 3205927 - RNA, 15 nt, Human
gggcagaggagaacu

SEQ ID NO: 3205928 - RNA, 23 nt, Human
gggcagaggagaacuugcugccu

SEQ ID NO: 3205929 - RNA, 14 nt, Human
gggcagccugccuu

SEQ ID NO: 3205930 - RNA, 15 nt, Human
gggauugggccccug

SEQ ID NO: 3205931 - RNA, 18 nt, Human
gggauugauuuuaaaaug

SEQ ID NO: 3205932 - RNA, 16 nt, Human
gggauuguaaaauggu

SEQ ID NO: 3205933 - RNA, 17 nt, Human
gggauuguaaaauggug

SEQ ID NO: 3205934 - RNA, 13 nt, Human
gggcaaauaauga

SEQ ID NO: 3205935 - RNA, 15 nt, Human
gggauuacaggugug

SEQ ID NO: 3205936 - RNA, 12 nt, Human
gggauuacaggu

SEQ ID NO: 3205937 - RNA, 14 nt, Human
gggauuacaggcgu

SEQ ID NO: 3205938 - RNA, 13 nt, Human
gggauuacaggcu

SEQ ID NO: 3205939 - RNA, 16 nt, Human
gggauuacaggcuccu

SEQ ID NO: 3205940 - RNA, 21 nt, Human
gggauuacaggcuccugccac

SEQ ID NO: 3205941 - RNA, 14 nt, Human
gggcagaggaaagc

SEQ ID NO: 3205942 - RNA, 17 nt, Human
gggcagagcagagacca

SEQ ID NO: 3205943 - RNA, 22 nt, Human
gggcagagcagagaccaucccu

SEQ ID NO: 3205944 - RNA, 16 nt, Human
gggcagagcagagacc

SEQ ID NO: 3205945 - RNA, 12 nt, Human
gggcagagcaga

SEQ ID NO: 3205946 - RNA, 18 nt, Human
gggcaacccccagccugc

SEQ ID NO: 3205947 - RNA, 16 nt, Human
gggcaacccccagccu

SEQ ID NO: 3205948 - RNA, 14 nt, Human
aaaaauaucaaauu

SEQ ID NO: 3205949 - RNA, 15 nt, Human
aaaaauaucaaauua

SEQ ID NO: 3205950 - RNA, 16 nt, Human
aaaaauaucaaauuaa

SEQ ID NO: 3205951 - RNA, 15 nt, Human
aaaaauaucuguaag

SEQ ID NO: 3205952 - RNA, 21 nt, Human
aaaaauaugaccacacuccag

SEQ ID NO: 3205953 - RNA, 23 nt, Human
aaaaauaugaccacacuccagcu

SEQ ID NO: 3205954 - RNA, 18 nt, Human
aaaaauauacauguuuau

SEQ ID NO: 3205955 - RNA, 17 nt, Human
aaaaauauacauguuua

SEQ ID NO: 3205956 - RNA, 16 nt, Human
aaaaauauacauguuu

SEQ ID NO: 3205957 - RNA, 14 nt, Human
aaaaauauacaugu

SEQ ID NO: 3205958 - RNA, 12 nt, Human
aaaaauauacau

SEQ ID NO: 3205959 - RNA, 13 nt, Human
aaaaauauuuaau

SEQ ID NO: 3205960 - RNA, 16 nt, Human
aaaaauauuuaauguu

SEQ ID NO: 3205961 - RNA, 15 nt, Human
aaaaauauuuaaugu

SEQ ID NO: 3205962 - RNA, 13 nt, Human
aaaaauaugugaa

SEQ ID NO: 3205963 - RNA, 23 nt, Human
aaaaauaugugaaggaccuucac

SEQ ID NO: 3205964 - RNA, 10 nt, Human
aaaaauauua

SEQ ID NO: 3205965 - RNA, 16 nt, Human
aaaaauaugugaagga

SEQ ID NO: 3205966 - RNA, 14 nt, Human
aaaaauccagaaac

SEQ ID NO: 3205967 - RNA, 21 nt, Human
aaaaauccaaauauuguuaag

SEQ ID NO: 3205968 - RNA, 18 nt, Human
aaaaauccaaauauuguu

SEQ ID NO: 3205969 - RNA, 20 nt, Human
aaaaaucaugccaguauuuu

SEQ ID NO: 3205970 - RNA, 21 nt, Human
aaaaaucaugccaguauuuuu

SEQ ID NO: 3205971 - RNA, 18 nt, Human
aaaaauauuuuuuuuucu

SEQ ID NO: 3205972 - RNA, 12 nt, Human
aaaaaucaagua

SEQ ID NO: 3205973 - RNA, 23 nt, Human
gggacagggaggugugaggcagg

SEQ ID NO: 3205974 - RNA, 21 nt, Human
gggacagcuccuucuguccua

SEQ ID NO: 3205975 - RNA, 13 nt, Human
gggacagaggggg

SEQ ID NO: 3205976 - RNA, 22 nt, Human
gggacagaggggguggccuccc

SEQ ID NO: 3205977 - RNA, 23 nt, Human
gggacagaggggguggccuccca

SEQ ID NO: 3205978 - RNA, 16 nt, Human
gggacagcuccuucug

SEQ ID NO: 3205979 - RNA, 16 nt, Human
gggaagagcuuagaaa

SEQ ID NO: 3205980 - RNA, 13 nt, Human
gggaagagacuug

SEQ ID NO: 3205981 - RNA, 22 nt, Human
aaaacauuguccccaaugaaua

SEQ ID NO: 3205982 - RNA, 22 nt, Human
aaaacccagcugcaccccuucc

SEQ ID NO: 3205983 - RNA, 19 nt, Human
aaaacccagcugcaccccu

SEQ ID NO: 3205984 - RNA, 14 nt, Human
aaaacccagcugca

SEQ ID NO: 3205985 - RNA, 12 nt, Human
aaaacccagcug

SEQ ID NO: 3205986 - RNA, 13 nt, Human
aaaaccacagcag

SEQ ID NO: 3205987 - RNA, 18 nt, Human
aaaacuaggcauuuguaa

SEQ ID NO: 3205988 - RNA, 21 nt, Human
aaaacuaggcauuuguaaaua

SEQ ID NO: 3205989 - RNA, 19 nt, Human
aaaacucaaccaaauggua

SEQ ID NO: 3205990 - RNA, 23 nt, Human
aaaacucaaccaaaugguacaaa

SEQ ID NO: 3205991 - RNA, 23 nt, Human
aaaaccguguuugucucuucugg

SEQ ID NO: 3205992 - RNA, 21 nt, Human
aaaaccguguuugucucuucu

SEQ ID NO: 3205993 - RNA, 19 nt, Human
aaaaccguguuugucucuu

SEQ ID NO: 3205994 - RNA, 13 nt, Human
aaaacucauuuuu

SEQ ID NO: 3205995 - RNA, 20 nt, Human
aaaacugcugacuguuuucu

SEQ ID NO: 3205996 - RNA, 22 nt, Human
aaaacugcugacuguuuucucu

SEQ ID NO: 3205997 - RNA, 17 nt, Human
aaaagaugaaaauauuu

SEQ ID NO: 3205998 - RNA, 13 nt, Human
aaaagaugcuucu

SEQ ID NO: 3205999 - RNA, 23 nt, Human
aaaacugcugacuguuuucucuu

SEQ ID NO: 3206000 - RNA, 21 nt, Human
aaaacuguacuuugauucaca

SEQ ID NO: 3206001 - RNA, 20 nt, Human
aaaacuguacuuugauucac

SEQ ID NO: 3206002 - RNA, 19 nt, Human
aaaacuguacuuugauuca

SEQ ID NO: 3206003 - RNA, 15 nt, Human
aaaacuguacuuuga

SEQ ID NO: 3206004 - RNA, 22 nt, Human
aaaaauggaacauaaaauacaa

SEQ ID NO: 3206005 - RNA, 19 nt, Human
aaaaaugcugaacauugca

SEQ ID NO: 3206006 - RNA, 16 nt, Human
aaaaaugcugaacauu

SEQ ID NO: 3206007 - RNA, 15 nt, Human
aaaaaugcugaacau

SEQ ID NO: 3206008 - RNA, 18 nt, Human
aaaacaguaguguauuaa

SEQ ID NO: 3206009 - RNA, 14 nt, Human
aaaaaugcugaaca

SEQ ID NO: 3206010 - RNA, 12 nt, Human
aaaaccacagca

SEQ ID NO: 3206011 - RNA, 21 nt, Human
aaaaccaauguucucucuucu

SEQ ID NO: 3206012 - RNA, 12 nt, Human
aaaacauucuau

SEQ ID NO: 3206013 - RNA, 16 nt, Human
aaaacauucuaucuac

SEQ ID NO: 3206014 - RNA, 19 nt, Human
aaaacauucuaucuacuga

SEQ ID NO: 3206015 - RNA, 19 nt, Human
aaaacaucauuccuuuuua

SEQ ID NO: 3206016 - RNA, 14 nt, Human
aaaacaucauuccu

SEQ ID NO: 3206017 - RNA, 20 nt, Human
aaaacaguuggcaugcaucc

SEQ ID NO: 3206018 - RNA, 21 nt, Human
aaaacaguuggcaugcauccc

SEQ ID NO: 3206019 - RNA, 18 nt, Human
gggcucagagugggguag

SEQ ID NO: 3206020 - RNA, 18 nt, Human
gggcugcaugcgggcuuc

SEQ ID NO: 3206021 - RNA, 21 nt, Human
gggcugcaugcgggcuuccuc

SEQ ID NO: 3206022 - RNA, 22 nt, Human
gggcugcaccggcuggccuggc

SEQ ID NO: 3206023 - RNA, 10 nt, Human
gggcucagca

SEQ ID NO: 3206024 - RNA, 20 nt, Human
gggcuggguucuacccaggu

SEQ ID NO: 3206025 - RNA, 20 nt, Human
gggcugggcacugcucucac

SEQ ID NO: 3206026 - RNA, 17 nt, Human
gggcugggcacugcucu

SEQ ID NO: 3206027 - RNA, 16 nt, Human
gggcugggcacugcuc

SEQ ID NO: 3206028 - RNA, 18 nt, Human
gggcugggagcucugcag

SEQ ID NO: 3206029 - RNA, 16 nt, Human
gggcugggagcucugc

SEQ ID NO: 3206030 - RNA, 15 nt, Human
gggcugcccuggugc

SEQ ID NO: 3206031 - RNA, 14 nt, Human
gggcugcccuggug

SEQ ID NO: 3206032 - RNA, 13 nt, Human
gggcugcccuggu

SEQ ID NO: 3206033 - RNA, 15 nt, Human
aaaaugugauaugua

SEQ ID NO: 3206034 - RNA, 20 nt, Human
aaaaugugagugguugaaua

SEQ ID NO: 3206035 - RNA, 18 nt, Human
aaaaugugagugguugaa

SEQ ID NO: 3206036 - RNA, 22 nt, Human
gggcuggguucuacccaggugc

SEQ ID NO: 3206037 - RNA, 22 nt, Human
gggcugggcacugcucucaccu

SEQ ID NO: 3206038 - RNA, 21 nt, Human
aaaaugucuuuccaaauuauu

SEQ ID NO: 3206039 - RNA, 13 nt, Human
aaaauuuguuuaa

SEQ ID NO: 3206040 - RNA, 20 nt, Human
aaaauuugaaacauugcuuu

SEQ ID NO: 3206041 - RNA, 19 nt, Human
aaaauuugaaacauugcuu

SEQ ID NO: 3206042 - RNA, 21 nt, Human
aaaauuugaaacauugcuuuu

SEQ ID NO: 3206043 - RNA, 22 nt, Human
aaaauuugucugaaacauuuca

SEQ ID NO: 3206044 - RNA, 14 nt, Human
aaaauguuaggaca

SEQ ID NO: 3206045 - RNA, 13 nt, Human
aaaauuugaaaca

SEQ ID NO: 3206046 - RNA, 12 nt, Human
aaaauuugaaac

SEQ ID NO: 3206047 - RNA, 17 nt, Human
aaaauuugaaacauugc

SEQ ID NO: 3206048 - RNA, 16 nt, Human
aaaauuugaaacauug

SEQ ID NO: 3206049 - RNA, 15 nt, Human
aaaauuugaaacauu

SEQ ID NO: 3206050 - RNA, 14 nt, Human
aaaauuugaaacau

SEQ ID NO: 3206051 - RNA, 12 nt, Human
aaaaugugugug

SEQ ID NO: 3206052 - RNA, 14 nt, Human
aaaauguguguuuu

SEQ ID NO: 3206053 - RNA, 14 nt, Human
aaaauguuaagcau

SEQ ID NO: 3206054 - RNA, 16 nt, Human
aaacaaaaagaugucu

SEQ ID NO: 3206055 - RNA, 17 nt, Human
aaacaccggguuccagc

SEQ ID NO: 3206056 - RNA, 20 nt, Human
aaacagucucaggaaaucaa

SEQ ID NO: 3206057 - RNA, 23 nt, Human
aaacaccugacagccccucccuc

SEQ ID NO: 3206058 - RNA, 18 nt, Human
aaacaccugacagccccu

SEQ ID NO: 3206059 - RNA, 14 nt, Human
aaacagugcuguuu

SEQ ID NO: 3206060 - RNA, 15 nt, Human
ggggccucagugcca

SEQ ID NO: 3206061 - RNA, 16 nt, Human
ggggccugaggcuccu

SEQ ID NO: 3206062 - RNA, 23 nt, Human
aaacaugagguucucucuacugg

SEQ ID NO: 3206063 - RNA, 20 nt, Human
ggggacagcuccuucugucc

SEQ ID NO: 3206064 - RNA, 14 nt, Human
ggggacagcuccuu

SEQ ID NO: 3206065 - RNA, 12 nt, Human
ggggacagcucc

SEQ ID NO: 3206066 - RNA, 19 nt, Human
aaacaugacucuuuauugu

SEQ ID NO: 3206067 - RNA, 20 nt, Human
aaacaugacucuuuauuguc

SEQ ID NO: 3206068 - RNA, 16 nt, Human
aaacaucauuccuuuu

SEQ ID NO: 3206069 - RNA, 19 nt, Human
aaacaucauuccuuuuuau

SEQ ID NO: 3206070 - RNA, 20 nt, Human
aaacaucauuccuuuuuauu

SEQ ID NO: 3206071 - RNA, 18 nt, Human
aaacaucauuccuuuuua

SEQ ID NO: 3206072 - RNA, 18 nt, Human
aaacauccuacaagacac

SEQ ID NO: 3206073 - RNA, 21 nt, Human
aaacaucauuccuuuuuauuu

SEQ ID NO: 3206074 - RNA, 22 nt, Human
aaacaucauuccuuuuuauuua

SEQ ID NO: 3206075 - RNA, 22 nt, Human
aaacauccuacaagacacagug

SEQ ID NO: 3206076 - RNA, 13 nt, Human
aaacaucuccuua

SEQ ID NO: 3206077 - RNA, 13 nt, Human
aaacaucucagag

SEQ ID NO: 3206078 - RNA, 15 nt, Human
aaacaucucaucaug

SEQ ID NO: 3206079 - RNA, 18 nt, Human
aaacaucucaucaugucu

SEQ ID NO: 3206080 - RNA, 23 nt, Human
aaacaucucaucaugucuauugu

SEQ ID NO: 3206081 - RNA, 15 nt, Human
gggccgagccugccu

SEQ ID NO: 3206082 - RNA, 16 nt, Human
gggccuaauaaaacug

SEQ ID NO: 3206083 - RNA, 14 nt, Human
gggccaguuggucc

SEQ ID NO: 3206084 - RNA, 18 nt, Human
gggccaguuggucccccu

SEQ ID NO: 3206085 - RNA, 22 nt, Human
gggccaguuggucccccuucca

SEQ ID NO: 3206086 - RNA, 23 nt, Human
gggccaguuggucccccuuccau

SEQ ID NO: 3206087 - RNA, 15 nt, Human
gggccucagugccac

SEQ ID NO: 3206088 - RNA, 13 nt, Human
gggccuccugugu

SEQ ID NO: 3206089 - RNA, 15 nt, Human
gggccuccugugugu

SEQ ID NO: 3206090 - RNA, 20 nt, Human
gggccucuuaugggcugggu

SEQ ID NO: 3206091 - RNA, 19 nt, Human
gggccucuuaugggcuggg

SEQ ID NO: 3206092 - RNA, 18 nt, Human
gggccugaggcuccuuag

SEQ ID NO: 3206093 - RNA, 17 nt, Human
gggccugaggcuccuua

SEQ ID NO: 3206094 - RNA, 15 nt, Human
gggcgugguggugag

SEQ ID NO: 3206095 - RNA, 23 nt, Human
gggcuacaccuuagccugcccuc

SEQ ID NO: 3206096 - RNA, 18 nt, Human
gggcuaguugggcuuccu

SEQ ID NO: 3206097 - RNA, 20 nt, Human
gggcuacccgugagcccuuc

SEQ ID NO: 3206098 - RNA, 15 nt, Human
gggcgggaggauguu

SEQ ID NO: 3206099 - RNA, 18 nt, Human
gggccagucccugaggca

SEQ ID NO: 3206100 - RNA, 21 nt, Human
gggccagucccugaggcaggu

SEQ ID NO: 3206101 - RNA, 11 nt, Human
gggccaggagc

SEQ ID NO: 3206102 - RNA, 11 nt, Human
gggccagcucc

SEQ ID NO: 3206103 - RNA, 15 nt, Human
aaaaugcugaacauu

SEQ ID NO: 3206104 - RNA, 18 nt, Human
aaaaugcugaacauugca

SEQ ID NO: 3206105 - RNA, 16 nt, Human
aaaaugcugaacauug

SEQ ID NO: 3206106 - RNA, 20 nt, Human
aaaaugcugaacauugcaua

SEQ ID NO: 3206107 - RNA, 17 nt, Human
aaaaguagaacuuugua

SEQ ID NO: 3206108 - RNA, 18 nt, Human
aaaaguagaacuuuguau

SEQ ID NO: 3206109 - RNA, 20 nt, Human
aaaaguagaacuuuguauag

SEQ ID NO: 3206110 - RNA, 17 nt, Human
aaaaguauauuaaacaa

SEQ ID NO: 3206111 - RNA, 22 nt, Human
aaaaguauauuaaacaaaguuu

SEQ ID NO: 3206112 - RNA, 14 nt, Human
aaaaguauugccaa

SEQ ID NO: 3206113 - RNA, 23 nt, Human
aaaaucuuauuaaaguuucaaaa

SEQ ID NO: 3206114 - RNA, 22 nt, Human
aaaaucuuauuaaaguuucaaa

SEQ ID NO: 3206115 - RNA, 21 nt, Human
aaaaucuuauuaaaguuucaa

SEQ ID NO: 3206116 - RNA, 18 nt, Human
aaaaucuuauuaaaguuu

SEQ ID NO: 3206117 - RNA, 16 nt, Human
aaaaucuuauuaaagu

SEQ ID NO: 3206118 - RNA, 12 nt, Human
aaaaucuuauua

SEQ ID NO: 3206119 - RNA, 16 nt, Human
aaaaucuuaauacugu

SEQ ID NO: 3206120 - RNA, 16 nt, Human
aaaaguauugccaaac

SEQ ID NO: 3206121 - RNA, 22 nt, Human
aaaaucuuaauacuguuauucu

SEQ ID NO: 3206122 - RNA, 20 nt, Human
aaaaucuuaauacuguuauu

SEQ ID NO: 3206123 - RNA, 18 nt, Human
aaaaucuuaauacuguua

SEQ ID NO: 3206124 - RNA, 17 nt, Human
aaaaucuuaauacuguu

SEQ ID NO: 3206125 - RNA, 14 nt, Human
aaaaugagccuggc

SEQ ID NO: 3206126 - RNA, 21 nt, Human
aaaaugagccuggcaagaaug

SEQ ID NO: 3206127 - RNA, 16 nt, Human
aaaaugagcuugauua

SEQ ID NO: 3206128 - RNA, 15 nt, Human
aaaaugaagaauuua

SEQ ID NO: 3206129 - RNA, 16 nt, Human
aaaaugaagaauuuaa

SEQ ID NO: 3206130 - RNA, 11 nt, Human
aaaaugaagaa

SEQ ID NO: 3206131 - RNA, 14 nt, Human
aaaaugaagaauuu

SEQ ID NO: 3206132 - RNA, 18 nt, Human
gggugucugucuuccuuu

SEQ ID NO: 3206133 - RNA, 17 nt, Human
ggguguggcgcagcaua

SEQ ID NO: 3206134 - RNA, 20 nt, Human
ggguggggaccucaggccug

SEQ ID NO: 3206135 - RNA, 19 nt, Human
gggugggacacccugugau

SEQ ID NO: 3206136 - RNA, 13 nt, Human
ggguggaugccug

SEQ ID NO: 3206137 - RNA, 12 nt, Human
ggggccuggcag

SEQ ID NO: 3206138 - RNA, 11 nt, Human
ggggccuggca

SEQ ID NO: 3206139 - RNA, 15 nt, Human
ggguggcaccagcag

SEQ ID NO: 3206140 - RNA, 17 nt, Human
ggguggaugccuggugg

SEQ ID NO: 3206141 - RNA, 14 nt, Human
gguaauaagggaaa

SEQ ID NO: 3206142 - RNA, 13 nt, Human
gguaacaggcaga

SEQ ID NO: 3206143 - RNA, 20 nt, Human
gguaacaggcagauacagga

SEQ ID NO: 3206144 - RNA, 14 nt, Human
gguaacaggcagau

SEQ ID NO: 3206145 - RNA, 17 nt, Human
ggguuucuaaagcugcc

SEQ ID NO: 3206146 - RNA, 21 nt, Human
ggguuugagagagcagccagg

SEQ ID NO: 3206147 - RNA, 19 nt, Human
gguagcccccucuucccug

SEQ ID NO: 3206148 - RNA, 20 nt, Human
gguaccacugaaucuguaca

SEQ ID NO: 3206149 - RNA, 13 nt, Human
gguaccacugaau

SEQ ID NO: 3206150 - RNA, 23 nt, Human
gguacaaccuguucugcuuuccu

SEQ ID NO: 3206151 - RNA, 24 nt, Human
gguacaaccuguucugcuuuccuc

SEQ ID NO: 3206152 - RNA, 16 nt, Human
gguacaauuucuuuug

SEQ ID NO: 3206153 - RNA, 14 nt, Human
gguaaucgaccugc

SEQ ID NO: 3206154 - RNA, 17 nt, Human
gguaaucgaccugccuc

SEQ ID NO: 3206155 - RNA, 18 nt, Human
gguaaucgaccugccucg

SEQ ID NO: 3206156 - RNA, 15 nt, Human
gguaaucauauuaga

SEQ ID NO: 3206157 - RNA, 17 nt, Human
gguagcuuugaggugga

SEQ ID NO: 3206158 - RNA, 21 nt, Human
gguagcuguaaggcaugaagg

SEQ ID NO: 3206159 - RNA, 18 nt, Human
gguagcugggaaagcaua

SEQ ID NO: 3206160 - RNA, 12 nt, Human
gguagcuguaag

SEQ ID NO: 3206161 - RNA, 14 nt, Human
gguagcuuuucccu

SEQ ID NO: 3206162 - RNA, 14 nt, Human
gguaugcaaucaaa

SEQ ID NO: 3206163 - RNA, 22 nt, Human
gguaugaucacggcucacugca

SEQ ID NO: 3206164 - RNA, 16 nt, Human
gguccacaacacacag

SEQ ID NO: 3206165 - RNA, 16 nt, Human
gguccacccaggagcc

SEQ ID NO: 3206166 - RNA, 15 nt, Human
gguccacccaggagc

SEQ ID NO: 3206167 - RNA, 13 nt, Human
gguccacccagga

SEQ ID NO: 3206168 - RNA, 12 nt, Human
gguccacccagg

SEQ ID NO: 3206169 - RNA, 17 nt, Human
gguccacccaggagccc

SEQ ID NO: 3206170 - RNA, 14 nt, Human
aaagacuauucaaa

SEQ ID NO: 3206171 - RNA, 17 nt, Human
aaagacuaucuaaaugu

SEQ ID NO: 3206172 - RNA, 19 nt, Human
aaagacaccuacugagugg

SEQ ID NO: 3206173 - RNA, 13 nt, Human
aaagacaccuacu

SEQ ID NO: 3206174 - RNA, 18 nt, Human
aaagacaaauaguaggca

SEQ ID NO: 3206175 - RNA, 22 nt, Human
aaagaaucaccuaauuaauuuc

SEQ ID NO: 3206176 - RNA, 19 nt, Human
aaagaauaggacuuguuuu

SEQ ID NO: 3206177 - RNA, 14 nt, Human
aaagaauaggacuu

SEQ ID NO: 3206178 - RNA, 16 nt, Human
aaagaauagaagcuaa

SEQ ID NO: 3206179 - RNA, 15 nt, Human
gguccauagagagca

SEQ ID NO: 3206180 - RNA, 15 nt, Human
gguccauagcugugg

SEQ ID NO: 3206181 - RNA, 18 nt, Human
aaagaaguggggacagag

SEQ ID NO: 3206182 - RNA, 11 nt, Human
ggucugugugu

SEQ ID NO: 3206183 - RNA, 17 nt, Human
ggucuguguguguguau

SEQ ID NO: 3206184 - RNA, 24 nt, Human
ggucugugagaugcuagaacuccc

SEQ ID NO: 3206185 - RNA, 21 nt, Human
ggucuagaggccugaaauccu

SEQ ID NO: 3206186 - RNA, 17 nt, Human
ggucuacacugugcuga

SEQ ID NO: 3206187 - RNA, 13 nt, Human
ggucuaauguuua

SEQ ID NO: 3206188 - RNA, 18 nt, Human
ggucgcuugggaauuuua

SEQ ID NO: 3206189 - RNA, 21 nt, Human
ggucguuuuaaaaacaaaaau

SEQ ID NO: 3206190 - RNA, 14 nt, Human
ggucgggggggacc

SEQ ID NO: 3206191 - RNA, 14 nt, Human
gguccugcugcagu

SEQ ID NO: 3206192 - RNA, 18 nt, Human
gguccuggaggcucaaau

SEQ ID NO: 3206193 - RNA, 13 nt, Human
aaagcaaaaggca

SEQ ID NO: 3206194 - RNA, 14 nt, Human
aaagauuucuguuc

SEQ ID NO: 3206195 - RNA, 13 nt, Human
aaagauuucuguu

SEQ ID NO: 3206196 - RNA, 13 nt, Human
aaagcaaaggaga

SEQ ID NO: 3206197 - RNA, 14 nt, Human
aaagcaaaagugcu

SEQ ID NO: 3206198 - RNA, 15 nt, Human
aaagacuauucaaac

SEQ ID NO: 3206199 - RNA, 13 nt, Human
aaagacuaagauc

SEQ ID NO: 3206200 - RNA, 18 nt, Human
aaagauugacaccagguu

SEQ ID NO: 3206201 - RNA, 22 nt, Human
aaagauucugaccuuaaaugca

SEQ ID NO: 3206202 - RNA, 16 nt, Human
aaagauuguguggugu

SEQ ID NO: 3206203 - RNA, 21 nt, Human
gguccugcugcaguugccagu

SEQ ID NO: 3206204 - RNA, 23 nt, Human
gguccugcugcaguugccaguca

SEQ ID NO: 3206205 - RNA, 23 nt, Human
gguccuagaaauuccccacccug

SEQ ID NO: 3206206 - RNA, 13 nt, Human
aaagcaaaugucu

SEQ ID NO: 3206207 - RNA, 13 nt, Human
aaagcaacaucag

SEQ ID NO: 3206208 - RNA, 18 nt, Human
aaagcaacaucagcuuga

SEQ ID NO: 3206209 - RNA, 14 nt, Human
gguccuaggcugga

SEQ ID NO: 3206210 - RNA, 16 nt, Human
gguccuaggcuggaag

SEQ ID NO: 3206211 - RNA, 17 nt, Human
gguccuaggcuggaagg

SEQ ID NO: 3206212 - RNA, 20 nt, Human
gguccuaggcuggaaggagg

SEQ ID NO: 3206213 - RNA, 16 nt, Human
ggugcaaugaccuuuc

SEQ ID NO: 3206214 - RNA, 21 nt, Human
ggucuuccuacucuucucucu

SEQ ID NO: 3206215 - RNA, 20 nt, Human
ggucuguguguguguaugug

SEQ ID NO: 3206216 - RNA, 21 nt, Human
ggucuguguguguguaugugg

SEQ ID NO: 3206217 - RNA, 13 nt, Human
ggucuuauauuua

SEQ ID NO: 3206218 - RNA, 19 nt, Human
ggugcaaugaccuuucaau

SEQ ID NO: 3206219 - RNA, 20 nt, Human
ggugcaaugaccuuucaaua

SEQ ID NO: 3206220 - RNA, 18 nt, Human
ggugcaaugaccuuucaa

SEQ ID NO: 3206221 - RNA, 19 nt, Human
ggucuuccuacucuucucu

SEQ ID NO: 3206222 - RNA, 18 nt, Human
ggucuuccuacucuucuc

SEQ ID NO: 3206223 - RNA, 17 nt, Human
ggucuuccuacucuucu

SEQ ID NO: 3206224 - RNA, 10 nt, Human
ggucuuccua

SEQ ID NO: 3206225 - RNA, 18 nt, Human
ggugcuguuuugccagcc

SEQ ID NO: 3206226 - RNA, 14 nt, Human
gguggaugccuggu

SEQ ID NO: 3206227 - RNA, 21 nt, Human
gguggaugccugguggcagcu

SEQ ID NO: 3206228 - RNA, 17 nt, Human
aaagcagggacuugaac

SEQ ID NO: 3206229 - RNA, 13 nt, Human
aaagcauaaagcu

SEQ ID NO: 3206230 - RNA, 21 nt, Human
aaagcauaaagcucaaaugaa

SEQ ID NO: 3206231 - RNA, 22 nt, Human
aaagcauaaagcucaaaugaaa

SEQ ID NO: 3206232 - RNA, 22 nt, Human
aaagcaggcuugcccaguacau

SEQ ID NO: 3206233 - RNA, 24 nt, Human
aaagcaggcuugcccaguacauuu

SEQ ID NO: 3206234 - RNA, 17 nt, Human
aaagcauauugacuuuu

SEQ ID NO: 3206235 - RNA, 16 nt, Human
aaagccuguuguuuaa

SEQ ID NO: 3206236 - RNA, 21 nt, Human
aaagccuguuguuuaagugac

SEQ ID NO: 3206237 - RNA, 17 nt, Human
aaagcaugccaauuucu

SEQ ID NO: 3206238 - RNA, 15 nt, Human
aaagcauggacauuu

SEQ ID NO: 3206239 - RNA, 18 nt, Human
aaagcauggacauuuaga

SEQ ID NO: 3206240 - RNA, 14 nt, Human
ggugggauccucca

SEQ ID NO: 3206241 - RNA, 15 nt, Human
ggugggauccuccag

SEQ ID NO: 3206242 - RNA, 20 nt, Human
ggugggaggauugcuugagc

SEQ ID NO: 3206243 - RNA, 20 nt, Human
ggugggaggaucucuugagc

SEQ ID NO: 3206244 - RNA, 18 nt, Human
aaagccuuucauuuugcu

SEQ ID NO: 3206245 - RNA, 13 nt, Human
aaagccuuucauu

SEQ ID NO: 3206246 - RNA, 13 nt, Human
gguggggcagcuu

SEQ ID NO: 3206247 - RNA, 17 nt, Human
gguggggcagcuugagg

SEQ ID NO: 3206248 - RNA, 19 nt, Human
ggugggauccuccaggugc

SEQ ID NO: 3206249 - RNA, 22 nt, Human
aaagccuuucauuuugcuuuaa

SEQ ID NO: 3206250 - RNA, 15 nt, Human
gguggggucacucug

SEQ ID NO: 3206251 - RNA, 23 nt, Human
gguggggucacucuggcagcuca

SEQ ID NO: 3206252 - RNA, 13 nt, Human
ggugucgggcaug

SEQ ID NO: 3206253 - RNA, 16 nt, Human
ggugucgggcaugaca

SEQ ID NO: 3206254 - RNA, 16 nt, Human
ggugugaccacugcag

SEQ ID NO: 3206255 - RNA, 23 nt, Human
ggugucuguguuccaaccacuga

SEQ ID NO: 3206256 - RNA, 14 nt, Human
ggugucuuucucuu

SEQ ID NO: 3206257 - RNA, 13 nt, Human
ggugugagcagca

SEQ ID NO: 3206258 - RNA, 15 nt, Human
ggugucuuucucuuu

SEQ ID NO: 3206259 - RNA, 18 nt, Human
ggugugagucaccaagcc

SEQ ID NO: 3206260 - RNA, 16 nt, Human
ggugugaggcaggaga

SEQ ID NO: 3206261 - RNA, 19 nt, Human
ggugugaggacauaaaucu

SEQ ID NO: 3206262 - RNA, 22 nt, Human
ggugugagggcagugcaaggag

SEQ ID NO: 3206263 - RNA, 16 nt, Human
gguuuagaaagcuugc

SEQ ID NO: 3206264 - RNA, 17 nt, Human
gguuuauuuuucuguua

SEQ ID NO: 3206265 - RNA, 19 nt, Human
gguuccuuccucugagccu

SEQ ID NO: 3206266 - RNA, 22 nt, Human
gguuccuggggcauccaugggg

SEQ ID NO: 3206267 - RNA, 13 nt, Human
gguuucucuucuc

SEQ ID NO: 3206268 - RNA, 22 nt, Human
gguuucucuucuccccuuccau

SEQ ID NO: 3206269 - RNA, 15 nt, Human
gguuucucuucuccc

SEQ ID NO: 3206270 - RNA, 14 nt, Human
gguuucugauucuu

SEQ ID NO: 3206271 - RNA, 23 nt, Human
gguuuaucgcccuggcaggcagg

SEQ ID NO: 3206272 - RNA, 19 nt, Human
gguuucaccauguuggcca

SEQ ID NO: 3206273 - RNA, 21 nt, Human
ggugugcggccuuuggcuuca

SEQ ID NO: 3206274 - RNA, 13 nt, Human
ggugugcucugau

SEQ ID NO: 3206275 - RNA, 12 nt, Human
gguguggaagag

SEQ ID NO: 3206276 - RNA, 12 nt, Human
gguucagcuugu

SEQ ID NO: 3206277 - RNA, 21 nt, Human
gguucaggguuggccccugcc

SEQ ID NO: 3206278 - RNA, 18 nt, Human
gguucaggguuggccccu

SEQ ID NO: 3206279 - RNA, 22 nt, Human
gguucaggguuggccccugccc

SEQ ID NO: 3206280 - RNA, 15 nt, Human
gguucaguguuucug

SEQ ID NO: 3206281 - RNA, 14 nt, Human
ggugugcuauagcu

SEQ ID NO: 3206282 - RNA, 21 nt, Human
gguucccuuugacgccauccc

SEQ ID NO: 3206283 - RNA, 15 nt, Human
gguuccuacacagga

SEQ ID NO: 3206284 - RNA, 16 nt, Human
gguuccuccccuccuc

SEQ ID NO: 3206285 - RNA, 17 nt, Human
gguuccuacacaggaca

SEQ ID NO: 3206286 - RNA, 18 nt, Human
gguuccuacacaggacag

SEQ ID NO: 3206287 - RNA, 17 nt, Human
gguuccuaggggaauga

SEQ ID NO: 3206288 - RNA, 19 nt, Human
gguuccuaggggaaugagg

SEQ ID NO: 3206289 - RNA, 22 nt, Human
gguuccuaggggaaugaggggg

SEQ ID NO: 3206290 - RNA, 23 nt, Human
gguuccagcaauucuccugccuc

SEQ ID NO: 3206291 - RNA, 23 nt, Human
gguucauuuucagauucaggcau

SEQ ID NO: 3206292 - RNA, 21 nt, Human
gguucauuuucagauucaggc

SEQ ID NO: 3206293 - RNA, 24 nt, Human
gguuccagcaauucuccugccuca

SEQ ID NO: 3206294 - RNA, 15 nt, Human
gguuccccuguucac

SEQ ID NO: 3206295 - RNA, 15 nt, Human
guaaaaugucuuucc

SEQ ID NO: 3206296 - RNA, 17 nt, Human
guaaaaugucuuuccaa

SEQ ID NO: 3206297 - RNA, 14 nt, Human
guaaaauguauuau

SEQ ID NO: 3206298 - RNA, 19 nt, Human
guaaaauguauuauguccu

SEQ ID NO: 3206299 - RNA, 17 nt, Human
guaaaaugaagaauuua

SEQ ID NO: 3206300 - RNA, 13 nt, Human
guaaaauggaaaa

SEQ ID NO: 3206301 - RNA, 20 nt, Human
guaaaauggaaaacuuaguu

SEQ ID NO: 3206302 - RNA, 14 nt, Human
guaaaaugaagaau

SEQ ID NO: 3206303 - RNA, 16 nt, Human
guaaaaugaagaauuu

SEQ ID NO: 3206304 - RNA, 20 nt, Human
guaaagcaaccaaaaagaaa

SEQ ID NO: 3206305 - RNA, 19 nt, Human
guaaagcaaccaaaaagaa

SEQ ID NO: 3206306 - RNA, 16 nt, Human
guaaagauuucuguuc

SEQ ID NO: 3206307 - RNA, 14 nt, Human
guaaagauuucugu

SEQ ID NO: 3206308 - RNA, 16 nt, Human
guaaauuuaugugaug

SEQ ID NO: 3206309 - RNA, 17 nt, Human
guaaauuuaugugaugg

SEQ ID NO: 3206310 - RNA, 12 nt, Human
guaaauucugau

SEQ ID NO: 3206311 - RNA, 13 nt, Human
guaaauucugauu

SEQ ID NO: 3206312 - RNA, 14 nt, Human
guaaauucugauuu

SEQ ID NO: 3206313 - RNA, 15 nt, Human
guaaauucugauuuc

SEQ ID NO: 3206314 - RNA, 18 nt, Human
guaaauucugauuucuuu

SEQ ID NO: 3206315 - RNA, 13 nt, Human
aaauaaugcuguu

SEQ ID NO: 3206316 - RNA, 18 nt, Human
aaauaaaaaaagaaaaaa

SEQ ID NO: 3206317 - RNA, 13 nt, Human
aaauaaaaaaaag

SEQ ID NO: 3206318 - RNA, 13 nt, Human
aaaguuuugccua

SEQ ID NO: 3206319 - RNA, 22 nt, Human
aaauaaaaaaaagaaaaaagag

SEQ ID NO: 3206320 - RNA, 20 nt, Human
aaauaaaaaaaagaaaaaag

SEQ ID NO: 3206321 - RNA, 17 nt, Human
aaauaaaaaaaagaaaa

SEQ ID NO: 3206322 - RNA, 15 nt, Human
aaauaaaaaaaagaa

SEQ ID NO: 3206323 - RNA, 13 nt, Human
aaaguuugaucuu

SEQ ID NO: 3206324 - RNA, 22 nt, Human
aaaguuugaucuuccucugcua

SEQ ID NO: 3206325 - RNA, 14 nt, Human
aaaguuugaucuuc

SEQ ID NO: 3206326 - RNA, 24 nt, Human
aaaguuugaucuuccucugcuaaa

SEQ ID NO: 3206327 - RNA, 14 nt, Human
aaaguuuguuugcu

SEQ ID NO: 3206328 - RNA, 23 nt, Human
aaaguuucucuuuucaaaacauu

SEQ ID NO: 3206329 - RNA, 21 nt, Human
aaaguuucucuuuucaaaaca

SEQ ID NO: 3206330 - RNA, 18 nt, Human
aaaguuucaaaaaucuga

SEQ ID NO: 3206331 - RNA, 12 nt, Human
aaaguuucaaaa

SEQ ID NO: 3206332 - RNA, 11 nt, Human
aaaguuucaug

SEQ ID NO: 3206333 - RNA, 21 nt, Human
aaaguuucaaaaaucugaaga

SEQ ID NO: 3206334 - RNA, 20 nt, Human
aaaguuucaaaaaucugaag

SEQ ID NO: 3206335 - RNA, 19 nt, Human
aaaguuucaaaaaucugaa

SEQ ID NO: 3206336 - RNA, 23 nt, Human
aaaguucccuacuuccugugacu

SEQ ID NO: 3206337 - RNA, 16 nt, Human
aaaguguucuguuaca

SEQ ID NO: 3206338 - RNA, 18 nt, Human
aaaguguucuguuacaaa

SEQ ID NO: 3206339 - RNA, 17 nt, Human
aaaguguucuguuacaa

SEQ ID NO: 3206340 - RNA, 21 nt, Human
aaaguucccuacuuccuguga

SEQ ID NO: 3206341 - RNA, 20 nt, Human
aaaguuauuucccuuuagcu

SEQ ID NO: 3206342 - RNA, 19 nt, Human
aaaguguucuguuacaaaa

SEQ ID NO: 3206343 - RNA, 12 nt, Human
aaaguggugaga

SEQ ID NO: 3206344 - RNA, 17 nt, Human
gguuuggcuccugccca

SEQ ID NO: 3206345 - RNA, 14 nt, Human
gguuuggcuccugc

SEQ ID NO: 3206346 - RNA, 16 nt, Human
gguuuggaauauuaaa

SEQ ID NO: 3206347 - RNA, 22 nt, Human
gguuucuuuuugaaucuuuaau

SEQ ID NO: 3206348 - RNA, 20 nt, Human
gguuugagagagcagccagg

SEQ ID NO: 3206349 - RNA, 15 nt, Human
gcugaggugggagga

SEQ ID NO: 3206350 - RNA, 18 nt, Human
gcugaguagcucugccuu

SEQ ID NO: 3206351 - RNA, 15 nt, Human
gcugaguagcucugc

SEQ ID NO: 3206352 - RNA, 20 nt, Human
gcugcagagcagugggccug

SEQ ID NO: 3206353 - RNA, 21 nt, Human
gcugcagagcagugggccugg

SEQ ID NO: 3206354 - RNA, 13 nt, Human
gcugcagagcagu

SEQ ID NO: 3206355 - RNA, 21 nt, Human
gcugcaccccuuccugggcac

SEQ ID NO: 3206356 - RNA, 20 nt, Human
gcugcaccccuuccugggca

SEQ ID NO: 3206357 - RNA, 19 nt, Human
gcugcaccccuuccugggc

SEQ ID NO: 3206358 - RNA, 13 nt, Human
gcugcacccucag

SEQ ID NO: 3206359 - RNA, 15 nt, Human
gcugcacccucaggc

SEQ ID NO: 3206360 - RNA, 16 nt, Human
gcugcaccccuuccug

SEQ ID NO: 3206361 - RNA, 15 nt, Human
gcugcaccccuuccu

SEQ ID NO: 3206362 - RNA, 14 nt, Human
gcugcaccccuucc

SEQ ID NO: 3206363 - RNA, 15 nt, Human
gcugcaccagguaga

SEQ ID NO: 3206364 - RNA, 13 nt, Human
gcugccauccagg

SEQ ID NO: 3206365 - RNA, 12 nt, Human
gcugccauccag

SEQ ID NO: 3206366 - RNA, 22 nt, Human
gcugccaguggggccugaggcu

SEQ ID NO: 3206367 - RNA, 17 nt, Human
gcugccaguaccagccc

SEQ ID NO: 3206368 - RNA, 15 nt, Human
gcugccaguaccagc

SEQ ID NO: 3206369 - RNA, 19 nt, Human
gcugcagggcuuuaaaauu

SEQ ID NO: 3206370 - RNA, 17 nt, Human
gcugcagggcuuuaaaa

SEQ ID NO: 3206371 - RNA, 12 nt, Human
gcugcugugaag

SEQ ID NO: 3206372 - RNA, 13 nt, Human
gcugccccugccu

SEQ ID NO: 3206373 - RNA, 14 nt, Human
gcugccccugccuu

SEQ ID NO: 3206374 - RNA, 15 nt, Human
gcugccccuggcagc

SEQ ID NO: 3206375 - RNA, 16 nt, Human
gcugccccuggcagcc

SEQ ID NO: 3206376 - RNA, 13 nt, Human
gcugccccuggca

SEQ ID NO: 3206377 - RNA, 17 nt, Human
gcugccauccagguuca

SEQ ID NO: 3206378 - RNA, 12 nt, Human
gcugcugacagu

SEQ ID NO: 3206379 - RNA, 18 nt, Human
gcugcugaaggcucgagc

SEQ ID NO: 3206380 - RNA, 14 nt, Human
gcugcugagccgca

SEQ ID NO: 3206381 - RNA, 12 nt, Human
gcugcugagccg

SEQ ID NO: 3206382 - RNA, 16 nt, Human
gcugcugagccgcaga

SEQ ID NO: 3206383 - RNA, 15 nt, Human
gcugcugagccgcag

SEQ ID NO: 3206384 - RNA, 18 nt, Human
gcugcugagccgcagaga

SEQ ID NO: 3206385 - RNA, 22 nt, Human
gcuggagauacuuggucacagc

SEQ ID NO: 3206386 - RNA, 22 nt, Human
gcuggagaggagcccugccucu

SEQ ID NO: 3206387 - RNA, 21 nt, Human
gcuggagaggagcccugccuc

SEQ ID NO: 3206388 - RNA, 18 nt, Human
gcuggagaggagcccugc

SEQ ID NO: 3206389 - RNA, 20 nt, Human
gcucugaucauccacugugc

SEQ ID NO: 3206390 - RNA, 14 nt, Human
gcucugacaaagcu

SEQ ID NO: 3206391 - RNA, 17 nt, Human
gcucucuuuuauucugu

SEQ ID NO: 3206392 - RNA, 21 nt, Human
gcucugcccauccugccccug

SEQ ID NO: 3206393 - RNA, 15 nt, Human
gcucugcccauccug

SEQ ID NO: 3206394 - RNA, 19 nt, Human
gcucugacaaagcuucccg

SEQ ID NO: 3206395 - RNA, 22 nt, Human
gcucugaucauccacugugcca

SEQ ID NO: 3206396 - RNA, 21 nt, Human
gcucugaucauccacugugcc

SEQ ID NO: 3206397 - RNA, 14 nt, Human
gcugaggccucuca

SEQ ID NO: 3206398 - RNA, 16 nt, Human
gcugagccuucugagc

SEQ ID NO: 3206399 - RNA, 16 nt, Human
gcugagccucagucuc

SEQ ID NO: 3206400 - RNA, 12 nt, Human
gcugagccucag

SEQ ID NO: 3206401 - RNA, 23 nt, Human
gcugaaggcucgagcaugccugg

SEQ ID NO: 3206402 - RNA, 20 nt, Human
gcugaacuuguuuucuggga

SEQ ID NO: 3206403 - RNA, 17 nt, Human
gcugaauacagaggcaa

SEQ ID NO: 3206404 - RNA, 22 nt, Human
gcugaauugagccuaaaaauaa

SEQ ID NO: 3206405 - RNA, 19 nt, Human
gcugacaaccauuaaaguc

SEQ ID NO: 3206406 - RNA, 20 nt, Human
gcugacaaccauuaaaguca

SEQ ID NO: 3206407 - RNA, 22 nt, Human
gcugacaaccauuaaagucaga

SEQ ID NO: 3206408 - RNA, 17 nt, Human
gcucugugcccacccuc

SEQ ID NO: 3206409 - RNA, 19 nt, Human
gcucugucuugguagguuu

SEQ ID NO: 3206410 - RNA, 23 nt, Human
gcucugucgcccaggcuggagug

SEQ ID NO: 3206411 - RNA, 23 nt, Human
gcucugguccauagagagcaaga

SEQ ID NO: 3206412 - RNA, 17 nt, Human
gcugaacauugcauaua

SEQ ID NO: 3206413 - RNA, 15 nt, Human
gcugaacauugcaua

SEQ ID NO: 3206414 - RNA, 23 nt, Human
gcugaacagaugaccccugccca

SEQ ID NO: 3206415 - RNA, 16 nt, Human
gcugaaacaacaaaua

SEQ ID NO: 3206416 - RNA, 22 nt, Human
gcugaaaauugccuuucugugu

SEQ ID NO: 3206417 - RNA, 15 nt, Human
gcucuuuucacagcu

SEQ ID NO: 3206418 - RNA, 12 nt, Human
gcucuuuuccua

SEQ ID NO: 3206419 - RNA, 15 nt, Human
gcuccucuccccagc

SEQ ID NO: 3206420 - RNA, 16 nt, Human
gcuccucccggugccc

SEQ ID NO: 3206421 - RNA, 19 nt, Human
gcuccucccggugcccaag

SEQ ID NO: 3206422 - RNA, 23 nt, Human
gcucccaggcauuccccaggagg

SEQ ID NO: 3206423 - RNA, 14 nt, Human
gcuccagcucacca

SEQ ID NO: 3206424 - RNA, 13 nt, Human
gcuccagcucacc

SEQ ID NO: 3206425 - RNA, 11 nt, Human
gcuccagccug

SEQ ID NO: 3206426 - RNA, 20 nt, Human
gcuccacuuggucugugaga

SEQ ID NO: 3206427 - RNA, 9 nt, Human
gcuccagac

SEQ ID NO: 3206428 - RNA, 19 nt, Human
gcuccacuuggucugugag

SEQ ID NO: 3206429 - RNA, 23 nt, Human
gcuccagacacauguccaagaag

SEQ ID NO: 3206430 - RNA, 18 nt, Human
gcuccagacacaugucca

SEQ ID NO: 3206431 - RNA, 21 nt, Human
gcuccagacacauguccaaga

SEQ ID NO: 3206432 - RNA, 21 nt, Human
gcucucaccuugguuccuggg

SEQ ID NO: 3206433 - RNA, 16 nt, Human
gcucucaggccagcug

SEQ ID NO: 3206434 - RNA, 18 nt, Human
gcucucaaguuaucaggg

SEQ ID NO: 3206435 - RNA, 19 nt, Human
gcucucaccuugguuccug

SEQ ID NO: 3206436 - RNA, 19 nt, Human
gcuccucuccccagcaagu

SEQ ID NO: 3206437 - RNA, 16 nt, Human
gcuccucuccccagca

SEQ ID NO: 3206438 - RNA, 19 nt, Human
gcucuacugaggugcuaug

SEQ ID NO: 3206439 - RNA, 17 nt, Human
gcucucaggccagcugc

SEQ ID NO: 3206440 - RNA, 18 nt, Human
gcucucaggccagcugcu

SEQ ID NO: 3206441 - RNA, 19 nt, Human
gcucucaggccagcugcuu

SEQ ID NO: 3206442 - RNA, 13 nt, Human
gcuggaucuguga

SEQ ID NO: 3206443 - RNA, 20 nt, Human
gcuggaguuggggcagagga

SEQ ID NO: 3206444 - RNA, 17 nt, Human
gcuggaguuggggcaga

SEQ ID NO: 3206445 - RNA, 19 nt, Human
gcuggagugcaguggcgaa

SEQ ID NO: 3206446 - RNA, 15 nt, Human
gcuggagugcagugg

SEQ ID NO: 3206447 - RNA, 20 nt, Human
gcuguagacauuugcuauga

SEQ ID NO: 3206448 - RNA, 18 nt, Human
gcuguagacaucuguccu

SEQ ID NO: 3206449 - RNA, 17 nt, Human
gcuguacuucuugaaua

SEQ ID NO: 3206450 - RNA, 18 nt, Human
gcuguacuucuugaauau

SEQ ID NO: 3206451 - RNA, 20 nt, Human
gcuguacuucuugaauauaa

SEQ ID NO: 3206452 - RNA, 19 nt, Human
gcuguauuagucacagaga

SEQ ID NO: 3206453 - RNA, 23 nt, Human
gcugguucaggguuggccccugc

SEQ ID NO: 3206454 - RNA, 14 nt, Human
gcuucaaggauccu

SEQ ID NO: 3206455 - RNA, 14 nt, Human
gcuucaguggcagc

SEQ ID NO: 3206456 - RNA, 14 nt, Human
gcuuaauucaaaua

SEQ ID NO: 3206457 - RNA, 13 nt, Human
gcuuaauuccaau

SEQ ID NO: 3206458 - RNA, 15 nt, Human
gcuuaauucaaauaa

SEQ ID NO: 3206459 - RNA, 17 nt, Human
gcuuaaaaaaaacucuu

SEQ ID NO: 3206460 - RNA, 13 nt, Human
gcuguuggcuggg

SEQ ID NO: 3206461 - RNA, 21 nt, Human
gcuguugcugauuuuauucuu

SEQ ID NO: 3206462 - RNA, 16 nt, Human
gcuguuugguuuuaaa

SEQ ID NO: 3206463 - RNA, 23 nt, Human
gcuguuggccucugcaaaggaaa

SEQ ID NO: 3206464 - RNA, 19 nt, Human
gcuguuugguuuuaaaaua

SEQ ID NO: 3206465 - RNA, 12 nt, Human
gcugugccucug

SEQ ID NO: 3206466 - RNA, 22 nt, Human
gcuuugagguggaagagggcug

SEQ ID NO: 3206467 - RNA, 12 nt, Human
gcuuugauauau

SEQ ID NO: 3206468 - RNA, 19 nt, Human
gcuuugagguggaagaggg

SEQ ID NO: 3206469 - RNA, 19 nt, Human
gcuuuccucaucaggccau

SEQ ID NO: 3206470 - RNA, 17 nt, Human
gcuuuccuacuugcacu

SEQ ID NO: 3206471 - RNA, 15 nt, Human
gcuuucucuucauau

SEQ ID NO: 3206472 - RNA, 14 nt, Human
gcuuucucuucaua

SEQ ID NO: 3206473 - RNA, 13 nt, Human
gcuuucucuucau

SEQ ID NO: 3206474 - RNA, 23 nt, Human
gcuuucuacccagcgagcccugg

SEQ ID NO: 3206475 - RNA, 15 nt, Human
gcuuuccuaaaacag

SEQ ID NO: 3206476 - RNA, 23 nt, Human
gcuugaccgugaggccagagaca

SEQ ID NO: 3206477 - RNA, 18 nt, Human
gcuugaccuuuaagagaa

SEQ ID NO: 3206478 - RNA, 17 nt, Human
gcuuguaaauagcucag

SEQ ID NO: 3206479 - RNA, 19 nt, Human
gcuuguaaauagcucaggu

SEQ ID NO: 3206480 - RNA, 18 nt, Human
gcuuguaaauagcucagg

SEQ ID NO: 3206481 - RNA, 21 nt, Human
gcuuuccccaugucucgacuc

SEQ ID NO: 3206482 - RNA, 22 nt, Human
gcuuuccccaugucucgacuca

SEQ ID NO: 3206483 - RNA, 15 nt, Human
gcuucuucagagacu

SEQ ID NO: 3206484 - RNA, 12 nt, Human
gcuucuucagag

SEQ ID NO: 3206485 - RNA, 20 nt, Human
gcuugaccgugaggccagag

SEQ ID NO: 3206486 - RNA, 19 nt, Human
gcuugaccaguauaaaauu

SEQ ID NO: 3206487 - RNA, 18 nt, Human
gcuugaagcaaacaguug

SEQ ID NO: 3206488 - RNA, 23 nt, Human
gcuuccagugaggcucugcccuu

SEQ ID NO: 3206489 - RNA, 23 nt, Human
gcuuccugaggggagacagagca

SEQ ID NO: 3206490 - RNA, 15 nt, Human
gcuuccugaggggag

SEQ ID NO: 3206491 - RNA, 22 nt, Human
gcuuccagugaggcucugcccu

SEQ ID NO: 3206492 - RNA, 12 nt, Human
gcuuuuuggaaa

SEQ ID NO: 3206493 - RNA, 12 nt, Human
gcuuuuuggaau

SEQ ID NO: 3206494 - RNA, 13 nt, Human
gcuuuuuggaauc

SEQ ID NO: 3206495 - RNA, 14 nt, Human
gcuuuuugaaaacc

SEQ ID NO: 3206496 - RNA, 13 nt, Human
gcuuuuuaauuaa

SEQ ID NO: 3206497 - RNA, 12 nt, Human
gcuuuuuauaaa

SEQ ID NO: 3206498 - RNA, 13 nt, Human
gcuuuuuauaaaa

SEQ ID NO: 3206499 - RNA, 17 nt, Human
gcuuuuuuccaaaacaa

SEQ ID NO: 3206500 - RNA, 20 nt, Human
gcuuuuuuccaaaacaaaaa

SEQ ID NO: 3206501 - RNA, 15 nt, Human
ggaaacaacauuuau

SEQ ID NO: 3206502 - RNA, 18 nt, Human
ggaaaauuuuaaaaauac

SEQ ID NO: 3206503 - RNA, 16 nt, Human
ggaaacccagcucugg

SEQ ID NO: 3206504 - RNA, 23 nt, Human
ggaaacacuaaauguuaaagaug

SEQ ID NO: 3206505 - RNA, 21 nt, Human
ggaaacacuaaauguuaaaga

SEQ ID NO: 3206506 - RNA, 19 nt, Human
ggaaacacuaaauguuaaa

SEQ ID NO: 3206507 - RNA, 17 nt, Human
ggaaacacuaaauguua

SEQ ID NO: 3206508 - RNA, 16 nt, Human
ggaaacacuaaauguu

SEQ ID NO: 3206509 - RNA, 16 nt, Human
ggaaacagaggaccag

SEQ ID NO: 3206510 - RNA, 15 nt, Human
ggaaacagaggacca

SEQ ID NO: 3206511 - RNA, 18 nt, Human
gcuuuugucuaugggacu

SEQ ID NO: 3206512 - RNA, 15 nt, Human
gcuuuuggucugugu

SEQ ID NO: 3206513 - RNA, 14 nt, Human
gcuuugaucccuuc

SEQ ID NO: 3206514 - RNA, 17 nt, Human
gcuuugaucccuucuua

SEQ ID NO: 3206515 - RNA, 14 nt, Human
ggaacugcugggcu

SEQ ID NO: 3206516 - RNA, 15 nt, Human
ggaacugcugggcuu

SEQ ID NO: 3206517 - RNA, 15 nt, Human
ggaagaaaacacugu

SEQ ID NO: 3206518 - RNA, 14 nt, Human
ggaagacaauguga

SEQ ID NO: 3206519 - RNA, 16 nt, Human
ggaagacaaugugaaa

SEQ ID NO: 3206520 - RNA, 17 nt, Human
ggaacaccauaggucac

SEQ ID NO: 3206521 - RNA, 23 nt, Human
ggaacaaggcaaggcugucaauu

SEQ ID NO: 3206522 - RNA, 13 nt, Human
ggaacaaguugag

SEQ ID NO: 3206523 - RNA, 23 nt, Human
ggaacaaguugagcuaugacuua

SEQ ID NO: 3206524 - RNA, 15 nt, Human
ggaacacuccuucac

SEQ ID NO: 3206525 - RNA, 14 nt, Human
ggaaaccugucuga

SEQ ID NO: 3206526 - RNA, 16 nt, Human
ggaaacuaagauucuu

SEQ ID NO: 3206527 - RNA, 17 nt, Human
ggaaacuaagauucuuu

SEQ ID NO: 3206528 - RNA, 19 nt, Human
ggaaacuaagauucuuuua

SEQ ID NO: 3206529 - RNA, 13 nt, Human
ggaaacuaauaaa

SEQ ID NO: 3206530 - RNA, 17 nt, Human
ggaaacuaauaaaauau

SEQ ID NO: 3206531 - RNA, 18 nt, Human
ggaaacuaauaaaauauu

SEQ ID NO: 3206532 - RNA, 21 nt, Human
ggaaacuaauaaaauauuuuc

SEQ ID NO: 3206533 - RNA, 22 nt, Human
ggaaacuaauaaaauauuuucu

SEQ ID NO: 3206534 - RNA, 14 nt, Human
ggaaaugggcagag

SEQ ID NO: 3206535 - RNA, 15 nt, Human
ggaaaugaagcaggg

SEQ ID NO: 3206536 - RNA, 14 nt, Human
ggaaaugcugauuu

SEQ ID NO: 3206537 - RNA, 16 nt, Human
ggaaaugggcagagca

SEQ ID NO: 3206538 - RNA, 17 nt, Human
ggaaaugggcagagcag

SEQ ID NO: 3206539 - RNA, 18 nt, Human
ggaaaugggcagagcaga

SEQ ID NO: 3206540 - RNA, 22 nt, Human
ggaaaugggcagagcagagacc

SEQ ID NO: 3206541 - RNA, 17 nt, Human
ggaacaaggcaaggcug

SEQ ID NO: 3206542 - RNA, 21 nt, Human
ggaacaaggcaaggcugucaa

SEQ ID NO: 3206543 - RNA, 15 nt, Human
ggaacaaggcaaggc

SEQ ID NO: 3206544 - RNA, 15 nt, Human
ggaacaaaucuuccu

SEQ ID NO: 3206545 - RNA, 13 nt, Human
ggaacaaaucuuc

SEQ ID NO: 3206546 - RNA, 12 nt, Human
ggaaauuucacg

SEQ ID NO: 3206547 - RNA, 17 nt, Human
ggaaaugucaacaagua

SEQ ID NO: 3206548 - RNA, 18 nt, Human
ggaaaugguauccagaau

SEQ ID NO: 3206549 - RNA, 14 nt, Human
ggaaauuaagaaga

SEQ ID NO: 3206550 - RNA, 19 nt, Human
ggaaauuaagaagaaacua

SEQ ID NO: 3206551 - RNA, 17 nt, Human
ggaagacuucaucccuc

SEQ ID NO: 3206552 - RNA, 20 nt, Human
ggaagacuucaucccucugg

SEQ ID NO: 3206553 - RNA, 19 nt, Human
ggaagaauuuacuuuggaa

SEQ ID NO: 3206554 - RNA, 23 nt, Human
ggaagaauagggcccaugggagg

SEQ ID NO: 3206555 - RNA, 17 nt, Human
gcccaggccccugccac

SEQ ID NO: 3206556 - RNA, 13 nt, Human
gcccaggagggag

SEQ ID NO: 3206557 - RNA, 12 nt, Human
gcccaggcaggu

SEQ ID NO: 3206558 - RNA, 13 nt, Human
gcccaggcagguc

SEQ ID NO: 3206559 - RNA, 13 nt, Human
gcccaggccccug

SEQ ID NO: 3206560 - RNA, 15 nt, Human
gcccaggccccugcc

SEQ ID NO: 3206561 - RNA, 14 nt, Human
gcccaggcaggucu

SEQ ID NO: 3206562 - RNA, 14 nt, Human
gccaugugccaggu

SEQ ID NO: 3206563 - RNA, 21 nt, Human
gccaucaacuaaaguuguacu

SEQ ID NO: 3206564 - RNA, 15 nt, Human
gccaucaacuaaagu

SEQ ID NO: 3206565 - RNA, 11 nt, Human
gcccaggagcc

SEQ ID NO: 3206566 - RNA, 14 nt, Human
gcccaggagcccau

SEQ ID NO: 3206567 - RNA, 13 nt, Human
gcccaggagccca

SEQ ID NO: 3206568 - RNA, 15 nt, Human
gcccaggagcccauu

SEQ ID NO: 3206569 - RNA, 16 nt, Human
gccaugugcuucugcc

SEQ ID NO: 3206570 - RNA, 11 nt, Human
gcccuaucugu

SEQ ID NO: 3206571 - RNA, 16 nt, Human
gcccucacccuggggc

SEQ ID NO: 3206572 - RNA, 17 nt, Human
gcccuauuucuugauaa

SEQ ID NO: 3206573 - RNA, 17 nt, Human
gcccucacccuggggcu

SEQ ID NO: 3206574 - RNA, 15 nt, Human
gcccucacccugggg

SEQ ID NO: 3206575 - RNA, 22 nt, Human
gccccugcugguucaggguugg

SEQ ID NO: 3206576 - RNA, 21 nt, Human
gccccugcugguucaggguug

SEQ ID NO: 3206577 - RNA, 15 nt, Human
gccccugcccggcug

SEQ ID NO: 3206578 - RNA, 21 nt, Human
gccccaaguuuugugaaauuu

SEQ ID NO: 3206579 - RNA, 15 nt, Human
gccccacaccagccc

SEQ ID NO: 3206580 - RNA, 19 nt, Human
gccccaagguuuacauagu

SEQ ID NO: 3206581 - RNA, 14 nt, Human
gccaguggcuggau

SEQ ID NO: 3206582 - RNA, 23 nt, Human
gccaguggcuggaucugugaggg

SEQ ID NO: 3206583 - RNA, 13 nt, Human
gccagugugacaa

SEQ ID NO: 3206584 - RNA, 22 nt, Human
gccaguuauggcuauaggugcu

SEQ ID NO: 3206585 - RNA, 13 nt, Human
gccaguugguccc

SEQ ID NO: 3206586 - RNA, 18 nt, Human
gccagugcgggugcagac

SEQ ID NO: 3206587 - RNA, 16 nt, Human
gccaguuggucccccu

SEQ ID NO: 3206588 - RNA, 18 nt, Human
gccaguuggucccccuuc

SEQ ID NO: 3206589 - RNA, 20 nt, Human
gccaguuggucccccuucca

SEQ ID NO: 3206590 - RNA, 21 nt, Human
gccaguuggucccccuuccau

SEQ ID NO: 3206591 - RNA, 22 nt, Human
gccaguuggucccccuuccaug

SEQ ID NO: 3206592 - RNA, 23 nt, Human
gccaguuggucccccuuccaugg

SEQ ID NO: 3206593 - RNA, 20 nt, Human
gccaguuuuguuuccuuuca

SEQ ID NO: 3206594 - RNA, 20 nt, Human
gccauaagcaacaauuuuca

SEQ ID NO: 3206595 - RNA, 23 nt, Human
gccauaagcaacaauuuucagau

SEQ ID NO: 3206596 - RNA, 21 nt, Human
gccauaagcaacaauuuucag

SEQ ID NO: 3206597 - RNA, 22 nt, Human
gccauagaguacacugccugcc

SEQ ID NO: 3206598 - RNA, 16 nt, Human
gccauaggcccuuuca

SEQ ID NO: 3206599 - RNA, 15 nt, Human
gccauaggcccuuuc

SEQ ID NO: 3206600 - RNA, 17 nt, Human
gccauagaguacacugc

SEQ ID NO: 3206601 - RNA, 18 nt, Human
gccauagaguacacugcc

SEQ ID NO: 3206602 - RNA, 19 nt, Human
gccauagaguacacugccu

SEQ ID NO: 3206603 - RNA, 14 nt, Human
gccaggauggaaug

SEQ ID NO: 3206604 - RNA, 20 nt, Human
gccaggcacaggcagggcag

SEQ ID NO: 3206605 - RNA, 19 nt, Human
gccaggcacaggcagggca

SEQ ID NO: 3206606 - RNA, 17 nt, Human
gccaggcacaggcaggg

SEQ ID NO: 3206607 - RNA, 16 nt, Human
gccaggcacaggcagg

SEQ ID NO: 3206608 - RNA, 15 nt, Human
gccaggcacaggcag

SEQ ID NO: 3206609 - RNA, 12 nt, Human
gccaggcacagg

SEQ ID NO: 3206610 - RNA, 14 nt, Human
gccaggcacaggca

SEQ ID NO: 3206611 - RNA, 13 nt, Human
gccaggcacaggc

SEQ ID NO: 3206612 - RNA, 22 nt, Human
gccagcccauuugggcagagag

SEQ ID NO: 3206613 - RNA, 19 nt, Human
gccagcccauuugggcaga

SEQ ID NO: 3206614 - RNA, 18 nt, Human
gccagcccauuugggcag

SEQ ID NO: 3206615 - RNA, 16 nt, Human
gccagcccagaggccg

SEQ ID NO: 3206616 - RNA, 17 nt, Human
gccagcccauuugggca

SEQ ID NO: 3206617 - RNA, 23 nt, Human
gccagcaggcucucaggccagcu

SEQ ID NO: 3206618 - RNA, 13 nt, Human
gccaggcccucug

SEQ ID NO: 3206619 - RNA, 14 nt, Human
gccaggcccucugc

SEQ ID NO: 3206620 - RNA, 21 nt, Human
gccaggccacaagacccuugu

SEQ ID NO: 3206621 - RNA, 15 nt, Human
gccaggccagaggga

SEQ ID NO: 3206622 - RNA, 22 nt, Human
gccaggccagagggagugacag

SEQ ID NO: 3206623 - RNA, 13 nt, Human
gccaggccacaag

SEQ ID NO: 3206624 - RNA, 18 nt, Human
gccaggccacaagacccu

SEQ ID NO: 3206625 - RNA, 17 nt, Human
gccuccaagcuccaucu

SEQ ID NO: 3206626 - RNA, 21 nt, Human
gccuccaaccccucgcccagu

SEQ ID NO: 3206627 - RNA, 20 nt, Human
gccuccaaccccucgcccag

SEQ ID NO: 3206628 - RNA, 17 nt, Human
gccuccaaccccucgcc

SEQ ID NO: 3206629 - RNA, 22 nt, Human
gccuccaaccccucgcccaguc

SEQ ID NO: 3206630 - RNA, 22 nt, Human
gccuccaauuuuuuaagugaaa

SEQ ID NO: 3206631 - RNA, 15 nt, Human
gccuccauccugagg

SEQ ID NO: 3206632 - RNA, 16 nt, Human
gccuccauccugaggc

SEQ ID NO: 3206633 - RNA, 20 nt, Human
gccuccauccugaggcucca

SEQ ID NO: 3206634 - RNA, 20 nt, Human
gccuccuuugugaggaagcc

SEQ ID NO: 3206635 - RNA, 21 nt, Human
gccuccuuugugaggaagccg

SEQ ID NO: 3206636 - RNA, 19 nt, Human
gccuccuuugugaggaagc

SEQ ID NO: 3206637 - RNA, 13 nt, Human
gccugcuccagcu

SEQ ID NO: 3206638 - RNA, 23 nt, Human
gccugcuaauuccccagauugca

SEQ ID NO: 3206639 - RNA, 17 nt, Human
gccugcuaauuccccag

SEQ ID NO: 3206640 - RNA, 22 nt, Human
gccugcccuuuguccuccugcu

SEQ ID NO: 3206641 - RNA, 20 nt, Human
gccugcccuuuguccuccug

SEQ ID NO: 3206642 - RNA, 19 nt, Human
gccugcccuuuguccuccu

SEQ ID NO: 3206643 - RNA, 16 nt, Human
gccugcccuuuguccu

SEQ ID NO: 3206644 - RNA, 19 nt, Human
gccugcccugucaggaggc

SEQ ID NO: 3206645 - RNA, 13 nt, Human
gccugcccuguca

SEQ ID NO: 3206646 - RNA, 13 nt, Human
gccucggacuuag

SEQ ID NO: 3206647 - RNA, 17 nt, Human
gccucgacacagagugg

SEQ ID NO: 3206648 - RNA, 20 nt, Human
gccuccuugauauuuguauu

SEQ ID NO: 3206649 - RNA, 21 nt, Human
gccucgcaggccucccugcca

SEQ ID NO: 3206650 - RNA, 19 nt, Human
gccucgcaggccucccugc

SEQ ID NO: 3206651 - RNA, 18 nt, Human
gccucgcaggccucccug

SEQ ID NO: 3206652 - RNA, 13 nt, Human
gcgauucuucugc

SEQ ID NO: 3206653 - RNA, 15 nt, Human
gcgagagucccugca

SEQ ID NO: 3206654 - RNA, 14 nt, Human
gcgauucuucugcu

SEQ ID NO: 3206655 - RNA, 21 nt, Human
gcgauucucuugccucagcuu

SEQ ID NO: 3206656 - RNA, 13 nt, Human
gcggccucagagu

SEQ ID NO: 3206657 - RNA, 15 nt, Human
gcggccucuucucuc

SEQ ID NO: 3206658 - RNA, 18 nt, Human
gcggccucuucucucaga

SEQ ID NO: 3206659 - RNA, 19 nt, Human
gcggccucuucucucagac

SEQ ID NO: 3206660 - RNA, 20 nt, Human
gcgugguggacaugcacagc

SEQ ID NO: 3206661 - RNA, 18 nt, Human
gcguggggcucccgccuc

SEQ ID NO: 3206662 - RNA, 13 nt, Human
gcguggggcuccc

SEQ ID NO: 3206663 - RNA, 17 nt, Human
gcguggcccaccaggcc

SEQ ID NO: 3206664 - RNA, 22 nt, Human
gcguggcccaccaggccccccu

SEQ ID NO: 3206665 - RNA, 18 nt, Human
gcgugcacacaccagagc

SEQ ID NO: 3206666 - RNA, 14 nt, Human
gcgugcacacacca

SEQ ID NO: 3206667 - RNA, 16 nt, Human
gcuaauuuuucauuuu

SEQ ID NO: 3206668 - RNA, 12 nt, Human
gcuaauuguacc

SEQ ID NO: 3206669 - RNA, 17 nt, Human
gcuaauucuuugcaaaa

SEQ ID NO: 3206670 - RNA, 13 nt, Human
gcuaauucuuugc

SEQ ID NO: 3206671 - RNA, 15 nt, Human
gcuaauucuuugcaa

SEQ ID NO: 3206672 - RNA, 14 nt, Human
gcuaauucuuugca

SEQ ID NO: 3206673 - RNA, 17 nt, Human
gcuacaaaaacacagca

SEQ ID NO: 3206674 - RNA, 19 nt, Human
gcuacaaaaacacagcaag

SEQ ID NO: 3206675 - RNA, 18 nt, Human
gcuacaaaaacacagcaa

SEQ ID NO: 3206676 - RNA, 15 nt, Human
gcuacuggauucuua

SEQ ID NO: 3206677 - RNA, 15 nt, Human
gcuacugucagcucc

SEQ ID NO: 3206678 - RNA, 20 nt, Human
gcuacuguccuacccacccu

SEQ ID NO: 3206679 - RNA, 19 nt, Human
gcuacuguccuacccaccc

SEQ ID NO: 3206680 - RNA, 17 nt, Human
gcuacuugggaggcuga

SEQ ID NO: 3206681 - RNA, 16 nt, Human
gcuacuugguggguuu

SEQ ID NO: 3206682 - RNA, 19 nt, Human
gcuagaaaaauuguuaagg

SEQ ID NO: 3206683 - RNA, 20 nt, Human
cucccuccgggucuuccuac

SEQ ID NO: 3206684 - RNA, 22 nt, Human
cucccugacugggggcagacau

SEQ ID NO: 3206685 - RNA, 24 nt, Human
cucccugacugggggcagacaugg

SEQ ID NO: 3206686 - RNA, 12 nt, Human
cucccaccucag

SEQ ID NO: 3206687 - RNA, 23 nt, Human
cuccaguccccagaacucugccu

SEQ ID NO: 3206688 - RNA, 17 nt, Human
cuccaguccccagaacu

SEQ ID NO: 3206689 - RNA, 19 nt, Human
cucccuccgggucuuccua

SEQ ID NO: 3206690 - RNA, 18 nt, Human
cucccuccgggucuuccu

SEQ ID NO: 3206691 - RNA, 23 nt, Human
cuccccgccguacaguucuccag

SEQ ID NO: 3206692 - RNA, 15 nt, Human
cucccccuuuucccu

SEQ ID NO: 3206693 - RNA, 14 nt, Human
cucccccuuuuccc

SEQ ID NO: 3206694 - RNA, 20 nt, Human
cuccccgcaguguuugugug

SEQ ID NO: 3206695 - RNA, 19 nt, Human
cuccgcuuucuacccagcg

SEQ ID NO: 3206696 - RNA, 16 nt, Human
cuccgcggcgggcccu

SEQ ID NO: 3206697 - RNA, 23 nt, Human
cuccgcggcgggcccugcccaca

SEQ ID NO: 3206698 - RNA, 15 nt, Human
cuccgccucccgggu

SEQ ID NO: 3206699 - RNA, 16 nt, Human
cuccagacacaugucc

SEQ ID NO: 3206700 - RNA, 17 nt, Human
cuccagacacaugucca

SEQ ID NO: 3206701 - RNA, 19 nt, Human
cuccagacacauguccaag

SEQ ID NO: 3206702 - RNA, 15 nt, Human
cuccagaauuuccca

SEQ ID NO: 3206703 - RNA, 18 nt, Human
cuccagaauuucccaaag

SEQ ID NO: 3206704 - RNA, 17 nt, Human
cuccaagaccuucuccu

SEQ ID NO: 3206705 - RNA, 18 nt, Human
cuccaagaccuucuccuu

SEQ ID NO: 3206706 - RNA, 16 nt, Human
cuccaagaccuucucc

SEQ ID NO: 3206707 - RNA, 15 nt, Human
cuccaagaccuucuc

SEQ ID NO: 3206708 - RNA, 19 nt, Human
cuccaaccgggaugggagc

SEQ ID NO: 3206709 - RNA, 23 nt, Human
cuccaaccccucgcccaguccca

SEQ ID NO: 3206710 - RNA, 22 nt, Human
cuccacuuucuagccagaggag

SEQ ID NO: 3206711 - RNA, 20 nt, Human
cuccacuuucuagccagagg

SEQ ID NO: 3206712 - RNA, 20 nt, Human
cuccagaaaugucccuuucu

SEQ ID NO: 3206713 - RNA, 19 nt, Human
cuccagaaaugucccuuuc

SEQ ID NO: 3206714 - RNA, 22 nt, Human
cuccaaccgggaugggagccgg

SEQ ID NO: 3206715 - RNA, 16 nt, Human
cuccagaacucuuccu

SEQ ID NO: 3206716 - RNA, 19 nt, Human
cuccagaacucuuccucca

SEQ ID NO: 3206717 - RNA, 17 nt, Human
cuccagaacucuuccuc

SEQ ID NO: 3206718 - RNA, 11 nt, Human
cuccaggugca

SEQ ID NO: 3206719 - RNA, 14 nt, Human
cuccaguccccaga

SEQ ID NO: 3206720 - RNA, 16 nt, Human
cuccaguccccagaac

SEQ ID NO: 3206721 - RNA, 15 nt, Human
cuccaguccccagaa

SEQ ID NO: 3206722 - RNA, 17 nt, Human
cuccagggguuuacagu

SEQ ID NO: 3206723 - RNA, 22 nt, Human
cucaucuugacagagccugccc

SEQ ID NO: 3206724 - RNA, 21 nt, Human
cucaucuugacagagccugcc

SEQ ID NO: 3206725 - RNA, 13 nt, Human
cucagugccacua

SEQ ID NO: 3206726 - RNA, 15 nt, Human
cucagugcuuuccuc

SEQ ID NO: 3206727 - RNA, 18 nt, Human
cucagucuggcccuuccu

SEQ ID NO: 3206728 - RNA, 17 nt, Human
cucagucuggcccuucc

SEQ ID NO: 3206729 - RNA, 22 nt, Human
cuccaaaguauuguacaaauaa

SEQ ID NO: 3206730 - RNA, 14 nt, Human
cuccaacauccacu

SEQ ID NO: 3206731 - RNA, 20 nt, Human
cuccaaccccucgcccaguc

SEQ ID NO: 3206732 - RNA, 19 nt, Human
cuccaaccccucgcccagu

SEQ ID NO: 3206733 - RNA, 18 nt, Human
cuccaaccccucgcccag

SEQ ID NO: 3206734 - RNA, 15 nt, Human
cuccaaccccucgcc

SEQ ID NO: 3206735 - RNA, 12 nt, Human
cucaugcugccc

SEQ ID NO: 3206736 - RNA, 20 nt, Human
cucaugcugccccugccuug

SEQ ID NO: 3206737 - RNA, 19 nt, Human
cucaugcugccccugccuu

SEQ ID NO: 3206738 - RNA, 18 nt, Human
cucaugcugccccugccu

SEQ ID NO: 3206739 - RNA, 14 nt, Human
cucaugcugccccu

SEQ ID NO: 3206740 - RNA, 16 nt, Human
cucaugccucagccuc

SEQ ID NO: 3206741 - RNA, 18 nt, Human
cucaugccucagccuccu

SEQ ID NO: 3206742 - RNA, 20 nt, Human
cucaugccucagccuccuga

SEQ ID NO: 3206743 - RNA, 16 nt, Human
cucaggcccaaagccu

SEQ ID NO: 3206744 - RNA, 13 nt, Human
cucaggccugggg

SEQ ID NO: 3206745 - RNA, 14 nt, Human
cucaggccuggggg

SEQ ID NO: 3206746 - RNA, 20 nt, Human
cucaggccugggggcugggc

SEQ ID NO: 3206747 - RNA, 21 nt, Human
cucaggccugggggcugggca

SEQ ID NO: 3206748 - RNA, 12 nt, Human
cucagccuccug

SEQ ID NO: 3206749 - RNA, 13 nt, Human
cucagccuccuga

SEQ ID NO: 3206750 - RNA, 14 nt, Human
cucaggccagcugc

SEQ ID NO: 3206751 - RNA, 20 nt, Human
cucaggccagcugcuugggc

SEQ ID NO: 3206752 - RNA, 21 nt, Human
cucaggccagcugcuugggcu

SEQ ID NO: 3206753 - RNA, 22 nt, Human
cucaggccagcugcuugggcuu

SEQ ID NO: 3206754 - RNA, 13 nt, Human
cucaggccagcug

SEQ ID NO: 3206755 - RNA, 14 nt, Human
cucagcgaaugaau

SEQ ID NO: 3206756 - RNA, 13 nt, Human
cucagccucccaa

SEQ ID NO: 3206757 - RNA, 15 nt, Human
cuaucccggcugccc

SEQ ID NO: 3206758 - RNA, 16 nt, Human
cuaucccggcugcccu

SEQ ID NO: 3206759 - RNA, 16 nt, Human
cucagccucccaaagu

SEQ ID NO: 3206760 - RNA, 14 nt, Human
cucagccucccaaa

SEQ ID NO: 3206761 - RNA, 21 nt, Human
cucagccucccaaagugcugg

SEQ ID NO: 3206762 - RNA, 17 nt, Human
cuaucccggcugcccuu

SEQ ID NO: 3206763 - RNA, 13 nt, Human
cucagccucccga

SEQ ID NO: 3206764 - RNA, 22 nt, Human
cucagccucccaaagugcuggg

SEQ ID NO: 3206765 - RNA, 23 nt, Human
cucagccucccgaauagcuggga

SEQ ID NO: 3206766 - RNA, 14 nt, Human
cucuuggagccugc

SEQ ID NO: 3206767 - RNA, 22 nt, Human
cucuugccucagcuuccccagu

SEQ ID NO: 3206768 - RNA, 12 nt, Human
cugaaaagaagg

SEQ ID NO: 3206769 - RNA, 16 nt, Human
cugaaaagaaggaaag

SEQ ID NO: 3206770 - RNA, 18 nt, Human
cugaaaagaaggaaagau

SEQ ID NO: 3206771 - RNA, 16 nt, Human
cucuugccacugccuc

SEQ ID NO: 3206772 - RNA, 20 nt, Human
cucuugccacugccucuucc

SEQ ID NO: 3206773 - RNA, 19 nt, Human
cucuugccacugccucuuc

SEQ ID NO: 3206774 - RNA, 18 nt, Human
cucuugccacugccucuu

SEQ ID NO: 3206775 - RNA, 17 nt, Human
cucuugccacugccucu

SEQ ID NO: 3206776 - RNA, 13 nt, Human
cugaaggccccgc

SEQ ID NO: 3206777 - RNA, 14 nt, Human
cugaaggccccgcc

SEQ ID NO: 3206778 - RNA, 17 nt, Human
cugaaggcuggguucug

SEQ ID NO: 3206779 - RNA, 17 nt, Human
cugaaggccccgcccag

SEQ ID NO: 3206780 - RNA, 20 nt, Human
cugaaggacauugcggacag

SEQ ID NO: 3206781 - RNA, 19 nt, Human
cugaaggacauugcggaca

SEQ ID NO: 3206782 - RNA, 15 nt, Human
cugaaggaggccacc

SEQ ID NO: 3206783 - RNA, 19 nt, Human
cugaaggaggccaccuccu

SEQ ID NO: 3206784 - RNA, 18 nt, Human
cugaaggaggccaccucc

SEQ ID NO: 3206785 - RNA, 17 nt, Human
cugaaggaggccaccuc

SEQ ID NO: 3206786 - RNA, 16 nt, Human
cugaaggaggccaccu

SEQ ID NO: 3206787 - RNA, 16 nt, Human
cugaaaauguaugugu

SEQ ID NO: 3206788 - RNA, 14 nt, Human
cugaaaauguaugu

SEQ ID NO: 3206789 - RNA, 22 nt, Human
cugaaggaauaaauugcuccuu

SEQ ID NO: 3206790 - RNA, 14 nt, Human
cugacagacacagg

SEQ ID NO: 3206791 - RNA, 12 nt, Human
cugacagacaca

SEQ ID NO: 3206792 - RNA, 18 nt, Human
cugacagaaucucugaau

SEQ ID NO: 3206793 - RNA, 20 nt, Human
cugaagggguuuucuugaua

SEQ ID NO: 3206794 - RNA, 19 nt, Human
cugaagggguuuucuugau

SEQ ID NO: 3206795 - RNA, 14 nt, Human
cugacagaaggacu

SEQ ID NO: 3206796 - RNA, 18 nt, Human
cugaagggguuuucuuga

SEQ ID NO: 3206797 - RNA, 16 nt, Human
cugaagggguuuucuu

SEQ ID NO: 3206798 - RNA, 18 nt, Human
cugacccaugcugcccug

SEQ ID NO: 3206799 - RNA, 17 nt, Human
cugacccaugcugcccu

SEQ ID NO: 3206800 - RNA, 19 nt, Human
cugacccaugcugcccugu

SEQ ID NO: 3206801 - RNA, 23 nt, Human
cugacccugcuucaaauauuucc

SEQ ID NO: 3206802 - RNA, 19 nt, Human
cugaccuuaaaugcaacca

SEQ ID NO: 3206803 - RNA, 15 nt, Human
cugaccuuaaaugca

SEQ ID NO: 3206804 - RNA, 12 nt, Human
cugaccucaaau

SEQ ID NO: 3206805 - RNA, 22 nt, Human
cucugcuccaaccgggauggga

SEQ ID NO: 3206806 - RNA, 20 nt, Human
cucugcuaaauugauguuga

SEQ ID NO: 3206807 - RNA, 17 nt, Human
cucugcuaccuugcccc

SEQ ID NO: 3206808 - RNA, 17 nt, Human
cucugcuaaauugaugu

SEQ ID NO: 3206809 - RNA, 13 nt, Human
cucugcuaaauug

SEQ ID NO: 3206810 - RNA, 18 nt, Human
cucuuagaagaauauugu

SEQ ID NO: 3206811 - RNA, 22 nt, Human
cucuuagaagaauauuguauug

SEQ ID NO: 3206812 - RNA, 22 nt, Human
cucuuagaaaaggugauaaaau

SEQ ID NO: 3206813 - RNA, 18 nt, Human
cucuguacauauuagcga

SEQ ID NO: 3206814 - RNA, 16 nt, Human
cucuguacauauuagc

SEQ ID NO: 3206815 - RNA, 17 nt, Human
cucuguacagagcccac

SEQ ID NO: 3206816 - RNA, 21 nt, Human
cucuguacagagcccacgccc

SEQ ID NO: 3206817 - RNA, 15 nt, Human
cucugguccauagag

SEQ ID NO: 3206818 - RNA, 19 nt, Human
cucugcugacagacacagg

SEQ ID NO: 3206819 - RNA, 18 nt, Human
cucugcugacagacacag

SEQ ID NO: 3206820 - RNA, 17 nt, Human
cucugcugacagacaca

SEQ ID NO: 3206821 - RNA, 16 nt, Human
cucugguccauagaga

SEQ ID NO: 3206822 - RNA, 18 nt, Human
cucugguccauagagagc

SEQ ID NO: 3206823 - RNA, 19 nt, Human
cucugguccauagagagca

SEQ ID NO: 3206824 - RNA, 15 nt, Human
cucugguuaucuaau

SEQ ID NO: 3206825 - RNA, 14 nt, Human
cucugguuccuccc

SEQ ID NO: 3206826 - RNA, 11 nt, Human
cucucuggccu

SEQ ID NO: 3206827 - RNA, 12 nt, Human
cucucuggccuu

SEQ ID NO: 3206828 - RNA, 15 nt, Human
cucugaaggacauug

SEQ ID NO: 3206829 - RNA, 15 nt, Human
cucucagaggcccca

SEQ ID NO: 3206830 - RNA, 24 nt, Human
cucuccccagcaagugagagcugg

SEQ ID NO: 3206831 - RNA, 21 nt, Human
cucuccgaccagacaccuuga

SEQ ID NO: 3206832 - RNA, 17 nt, Human
cucuccgccccugagcc

SEQ ID NO: 3206833 - RNA, 20 nt, Human
cucuccgccccugagcccac

SEQ ID NO: 3206834 - RNA, 18 nt, Human
cucuccgccccugagccc

SEQ ID NO: 3206835 - RNA, 12 nt, Human
cucucacuccuu

SEQ ID NO: 3206836 - RNA, 14 nt, Human
cucucacuccuuga

SEQ ID NO: 3206837 - RNA, 19 nt, Human
cucucagauuguaccauug

SEQ ID NO: 3206838 - RNA, 18 nt, Human
cucucagaccgucuuccu

SEQ ID NO: 3206839 - RNA, 19 nt, Human
cucucagaccgucuuccuc

SEQ ID NO: 3206840 - RNA, 21 nt, Human
cucucagaccgucuuccucca

SEQ ID NO: 3206841 - RNA, 15 nt, Human
cucucacuccuugaa

SEQ ID NO: 3206842 - RNA, 14 nt, Human
cucucacugccucc

SEQ ID NO: 3206843 - RNA, 17 nt, Human
cucuauuugaauuauuu

SEQ ID NO: 3206844 - RNA, 23 nt, Human
cucuauuucccccuuucuuccuc

SEQ ID NO: 3206845 - RNA, 22 nt, Human
cucuauuucccccuuucuuccu

SEQ ID NO: 3206846 - RNA, 23 nt, Human
cucuauuuagaugcauauuacug

SEQ ID NO: 3206847 - RNA, 14 nt, Human
cucuauuucccccu

SEQ ID NO: 3206848 - RNA, 18 nt, Human
cucuauuucccccuuucu

SEQ ID NO: 3206849 - RNA, 17 nt, Human
cucuauuucccccuuuc

SEQ ID NO: 3206850 - RNA, 20 nt, Human
cucuauuccccacccucccc

SEQ ID NO: 3206851 - RNA, 19 nt, Human
cucuauguucuaagaagug

SEQ ID NO: 3206852 - RNA, 14 nt, Human
cuccgcuucccugg

SEQ ID NO: 3206853 - RNA, 20 nt, Human
cucgggauuaguacacacuu

SEQ ID NO: 3206854 - RNA, 14 nt, Human
cguggucuuuuccu

SEQ ID NO: 3206855 - RNA, 22 nt, Human
cuaaacugcccccucugcccug

SEQ ID NO: 3206856 - RNA, 20 nt, Human
cuaaacuuggugcuuauuga

SEQ ID NO: 3206857 - RNA, 23 nt, Human
cuaaacugcccccucugcccugc

SEQ ID NO: 3206858 - RNA, 14 nt, Human
cgugagaccugccc

SEQ ID NO: 3206859 - RNA, 16 nt, Human
cgugagaccugccccu

SEQ ID NO: 3206860 - RNA, 23 nt, Human
cgugagccaccgugccuggccac

SEQ ID NO: 3206861 - RNA, 13 nt, Human
cgugagaccugcc

SEQ ID NO: 3206862 - RNA, 16 nt, Human
cgugaccuggucaggg

SEQ ID NO: 3206863 - RNA, 12 nt, Human
cgugaccugguc

SEQ ID NO: 3206864 - RNA, 18 nt, Human
cuaaagauagaguaaaaa

SEQ ID NO: 3206865 - RNA, 14 nt, Human
cuaacuggacuggu

SEQ ID NO: 3206866 - RNA, 12 nt, Human
cuaacuguauau

SEQ ID NO: 3206867 - RNA, 15 nt, Human
cuaacuguauauuug

SEQ ID NO: 3206868 - RNA, 16 nt, Human
cuaacuguauauuugu

SEQ ID NO: 3206869 - RNA, 19 nt, Human
cuaacuguauauuuguaug

SEQ ID NO: 3206870 - RNA, 16 nt, Human
cuaacuuuccuucauu

SEQ ID NO: 3206871 - RNA, 16 nt, Human
cuaacuugcuuaaaug

SEQ ID NO: 3206872 - RNA, 14 nt, Human
cuaacuugcuuaaa

SEQ ID NO: 3206873 - RNA, 18 nt, Human
cuaacuucuaaaacugua

SEQ ID NO: 3206874 - RNA, 17 nt, Human
cuaacuucuaaaacugu

SEQ ID NO: 3206875 - RNA, 19 nt, Human
cuaacuugcuuaaauguga

SEQ ID NO: 3206876 - RNA, 18 nt, Human
cuaacuugcuuaaaugug

SEQ ID NO: 3206877 - RNA, 17 nt, Human
cuaacuugcuuaaaugu

SEQ ID NO: 3206878 - RNA, 16 nt, Human
cuaacuucuaaaacug

SEQ ID NO: 3206879 - RNA, 13 nt, Human
cuaacuucuaaaa

SEQ ID NO: 3206880 - RNA, 16 nt, Human
cuaagaaacuuaaauu

SEQ ID NO: 3206881 - RNA, 22 nt, Human
cuaagaaacauuggaagcaggu

SEQ ID NO: 3206882 - RNA, 12 nt, Human
cuaagaaaauag

SEQ ID NO: 3206883 - RNA, 13 nt, Human
cuaagaaaauaga

SEQ ID NO: 3206884 - RNA, 12 nt, Human
cuaagaaacauu

SEQ ID NO: 3206885 - RNA, 19 nt, Human
cuaagaaacauuggaagca

SEQ ID NO: 3206886 - RNA, 18 nt, Human
cuaagaaacauuggaagc

SEQ ID NO: 3206887 - RNA, 14 nt, Human
cuaagaaacauugg

SEQ ID NO: 3206888 - RNA, 13 nt, Human
cuaagaaacauug

SEQ ID NO: 3206889 - RNA, 21 nt, Human
cuacauaaaauaaaucuacug

SEQ ID NO: 3206890 - RNA, 15 nt, Human
cuacaugagguacug

SEQ ID NO: 3206891 - RNA, 16 nt, Human
cuaccuccucuccuga

SEQ ID NO: 3206892 - RNA, 15 nt, Human
cuaccuccucuccug

SEQ ID NO: 3206893 - RNA, 15 nt, Human
cuacaguccucccau

SEQ ID NO: 3206894 - RNA, 16 nt, Human
cuacaguccucccauc

SEQ ID NO: 3206895 - RNA, 17 nt, Human
cuacaguccucccaucu

SEQ ID NO: 3206896 - RNA, 13 nt, Human
cuacaguugaaaa

SEQ ID NO: 3206897 - RNA, 22 nt, Human
cuaagugauccucccaccucag

SEQ ID NO: 3206898 - RNA, 20 nt, Human
cuaagugauccucccaccuc

SEQ ID NO: 3206899 - RNA, 18 nt, Human
cuaagugaggaugaaaaa

SEQ ID NO: 3206900 - RNA, 20 nt, Human
cuaagucucuuuuuuacaaa

SEQ ID NO: 3206901 - RNA, 14 nt, Human
cuacaaaucaguaa

SEQ ID NO: 3206902 - RNA, 15 nt, Human
cuacaaaucaguaau

SEQ ID NO: 3206903 - RNA, 20 nt, Human
cuaagugaaauaagccagac

SEQ ID NO: 3206904 - RNA, 23 nt, Human
cuaagugaaauaagccagacauc

SEQ ID NO: 3206905 - RNA, 18 nt, Human
cuagccaccgccuccuac

SEQ ID NO: 3206906 - RNA, 19 nt, Human
cuagcauuucccaacacaa

SEQ ID NO: 3206907 - RNA, 17 nt, Human
cuagcauggcugccaau

SEQ ID NO: 3206908 - RNA, 23 nt, Human
cuagcagcagggagggcuucugc

SEQ ID NO: 3206909 - RNA, 16 nt, Human
cuagaacucccuuuca

SEQ ID NO: 3206910 - RNA, 17 nt, Human
cuagaacucccuuucaa

SEQ ID NO: 3206911 - RNA, 18 nt, Human
cuagaacucccuuucaac

SEQ ID NO: 3206912 - RNA, 19 nt, Human
cuagaacucccuuucaaca

SEQ ID NO: 3206913 - RNA, 13 nt, Human
cuagaacucccuu

SEQ ID NO: 3206914 - RNA, 22 nt, Human
cuagcagcagggagggcuucug

SEQ ID NO: 3206915 - RNA, 12 nt, Human
cuagcagcaggg

SEQ ID NO: 3206916 - RNA, 16 nt, Human
cuagaagagucuauug

SEQ ID NO: 3206917 - RNA, 17 nt, Human
cuagaagagucuauugu

SEQ ID NO: 3206918 - RNA, 19 nt, Human
cuagaagagucuauugucu

SEQ ID NO: 3206919 - RNA, 20 nt, Human
cuagaagagucuauugucuc

SEQ ID NO: 3206920 - RNA, 19 nt, Human
cuagaaauuccccacccug

SEQ ID NO: 3206921 - RNA, 11 nt, Human
cuaccugaggg

SEQ ID NO: 3206922 - RNA, 14 nt, Human
cuaccugaggggcc

SEQ ID NO: 3206923 - RNA, 13 nt, Human
cuaguugaauacu

SEQ ID NO: 3206924 - RNA, 15 nt, Human
cuaguugaauacuug

SEQ ID NO: 3206925 - RNA, 17 nt, Human
cuaguugaauacuugaa

SEQ ID NO: 3206926 - RNA, 18 nt, Human
cuaguugaauacuugaac

SEQ ID NO: 3206927 - RNA, 12 nt, Human
cuaguugaauac

SEQ ID NO: 3206928 - RNA, 22 nt, Human
cuaguuccaccaucaagccacc

SEQ ID NO: 3206929 - RNA, 19 nt, Human
cuauaacacugugaagagc

SEQ ID NO: 3206930 - RNA, 17 nt, Human
cuauaacacugugaaga

SEQ ID NO: 3206931 - RNA, 13 nt, Human
cuauaacacugug

SEQ ID NO: 3206932 - RNA, 20 nt, Human
cuaguugaauacuugaacca

SEQ ID NO: 3206933 - RNA, 21 nt, Human
cuaguugaauacuugaaccau

SEQ ID NO: 3206934 - RNA, 23 nt, Human
cuaguugaauacuugaaccauaa

SEQ ID NO: 3206935 - RNA, 14 nt, Human
cuauaaauguugcu

SEQ ID NO: 3206936 - RNA, 13 nt, Human
cuauaaauuauau

SEQ ID NO: 3206937 - RNA, 20 nt, Human
cuauaacuacauauugaaua

SEQ ID NO: 3206938 - RNA, 19 nt, Human
cuauaacauagaauugcaa

SEQ ID NO: 3206939 - RNA, 19 nt, Human
cuagggaaaaaccagcgug

SEQ ID NO: 3206940 - RNA, 23 nt, Human
cuagccucacgcuccuuucugau

SEQ ID NO: 3206941 - RNA, 22 nt, Human
cuagccucacgcuccuuucuga

SEQ ID NO: 3206942 - RNA, 13 nt, Human
cuagccucacgcu

SEQ ID NO: 3206943 - RNA, 13 nt, Human
cuagcccugcccg

SEQ ID NO: 3206944 - RNA, 21 nt, Human
cuagggaaaaaccagcgugug

SEQ ID NO: 3206945 - RNA, 18 nt, Human
cuaguuccaccaucaagc

SEQ ID NO: 3206946 - RNA, 20 nt, Human
cuaguuccaccaucaagcca

SEQ ID NO: 3206947 - RNA, 14 nt, Human
cuaguuccaccauc

SEQ ID NO: 3206948 - RNA, 13 nt, Human
cuaggggaaugag

SEQ ID NO: 3206949 - RNA, 14 nt, Human
cuaggggaaugagg

SEQ ID NO: 3206950 - RNA, 18 nt, Human
cuaggggaaugagggggc

SEQ ID NO: 3206951 - RNA, 19 nt, Human
cuaggggaaugagggggcu

SEQ ID NO: 3206952 - RNA, 22 nt, Human
cuaggggaaugagggggcucag

SEQ ID NO: 3206953 - RNA, 18 nt, Human
cggcucacugcagccuca

SEQ ID NO: 3206954 - RNA, 15 nt, Human
cggcggccucagagu

SEQ ID NO: 3206955 - RNA, 19 nt, Human
cggcucacugcagccucaa

SEQ ID NO: 3206956 - RNA, 17 nt, Human
cggcucacugcagccuc

SEQ ID NO: 3206957 - RNA, 17 nt, Human
cggcucacugcauccuc

SEQ ID NO: 3206958 - RNA, 20 nt, Human
cggagcggauugcaaagcaa

SEQ ID NO: 3206959 - RNA, 18 nt, Human
cggaggggccuggcagcc

SEQ ID NO: 3206960 - RNA, 16 nt, Human
cggaggggccuggcag

SEQ ID NO: 3206961 - RNA, 23 nt, Human
cggagucauuuuguguugaagag

SEQ ID NO: 3206962 - RNA, 15 nt, Human
cggccuuuggcuuca

SEQ ID NO: 3206963 - RNA, 17 nt, Human
cgccucggaucagcuga

SEQ ID NO: 3206964 - RNA, 12 nt, Human
cgaccagccagg

SEQ ID NO: 3206965 - RNA, 17 nt, Human
cgaccuggccugucugu

SEQ ID NO: 3206966 - RNA, 16 nt, Human
cgaccugccucggccu

SEQ ID NO: 3206967 - RNA, 23 nt, Human
cgaccugaggacauggcuucuga

SEQ ID NO: 3206968 - RNA, 17 nt, Human
cgaguguguuucauccu

SEQ ID NO: 3206969 - RNA, 17 nt, Human
cgaguuacagacaaagc

SEQ ID NO: 3206970 - RNA, 18 nt, Human
cgaguuacagacaaagcg

SEQ ID NO: 3206971 - RNA, 15 nt, Human
cgaguagcugggacu

SEQ ID NO: 3206972 - RNA, 14 nt, Human
cgaguagcugggac

SEQ ID NO: 3206973 - RNA, 13 nt, Human
cgaguagcuggga

SEQ ID NO: 3206974 - RNA, 15 nt, Human
cgccgcccagcccac

SEQ ID NO: 3206975 - RNA, 20 nt, Human
cgccggcaauaaaagcccag

SEQ ID NO: 3206976 - RNA, 22 nt, Human
cgccggcaauaaaagcccagga

SEQ ID NO: 3206977 - RNA, 21 nt, Human
cgccggcaauaaaagcccagg

SEQ ID NO: 3206978 - RNA, 13 nt, Human
cgccaaggcuggg

SEQ ID NO: 3206979 - RNA, 16 nt, Human
cgccaaggcuggggga

SEQ ID NO: 3206980 - RNA, 21 nt, Human
cgaguguguuucauccuuccc

SEQ ID NO: 3206981 - RNA, 12 nt, Human
cgccaaggcugg

SEQ ID NO: 3206982 - RNA, 19 nt, Human
cgcaggcuggcccugcccu

SEQ ID NO: 3206983 - RNA, 20 nt, Human
cgcaggcuggcccugcccug

SEQ ID NO: 3206984 - RNA, 14 nt, Human
cgcaggcuggcccu

SEQ ID NO: 3206985 - RNA, 15 nt, Human
cgcaggcuggcccug

SEQ ID NO: 3206986 - RNA, 17 nt, Human
cgcaggcuggcccugcc

SEQ ID NO: 3206987 - RNA, 18 nt, Human
cgcaggcuggcccugccc

SEQ ID NO: 3206988 - RNA, 23 nt, Human
ccuugcccacuccugcucugcuc

SEQ ID NO: 3206989 - RNA, 22 nt, Human
ccuugcccacuccugcucugcu

SEQ ID NO: 3206990 - RNA, 21 nt, Human
ccuugcccacuccugcucugc

SEQ ID NO: 3206991 - RNA, 20 nt, Human
ccuugcccacuccugcucug

SEQ ID NO: 3206992 - RNA, 17 nt, Human
ccuugccgucuaccuga

SEQ ID NO: 3206993 - RNA, 20 nt, Human
ccuugccgucuaccugaggg

SEQ ID NO: 3206994 - RNA, 17 nt, Human
ccuugcccacuccugcu

SEQ ID NO: 3206995 - RNA, 19 nt, Human
ccuugcccacuccugcucu

SEQ ID NO: 3206996 - RNA, 18 nt, Human
ccuugcccacuccugcuc

SEQ ID NO: 3206997 - RNA, 12 nt, Human
ccuugccagucu

SEQ ID NO: 3206998 - RNA, 15 nt, Human
cgacagugagacucu

SEQ ID NO: 3206999 - RNA, 16 nt, Human
cgacagugagacucug

SEQ ID NO: 3207000 - RNA, 23 nt, Human
cgaccagacaccuugacagggca

SEQ ID NO: 3207001 - RNA, 14 nt, Human
cgaccaccugccca

SEQ ID NO: 3207002 - RNA, 12 nt, Human
cgaccaccugcc

SEQ ID NO: 3207003 - RNA, 19 nt, Human
ccuuuuguucauuucaucc

SEQ ID NO: 3207004 - RNA, 11 nt, Human
ccuuuuguguu

SEQ ID NO: 3207005 - RNA, 15 nt, Human
ccuuuugcaggcucc

SEQ ID NO: 3207006 - RNA, 20 nt, Human
ccuuuucgcaggauucuucc

SEQ ID NO: 3207007 - RNA, 11 nt, Human
ccuuucccacu

SEQ ID NO: 3207008 - RNA, 16 nt, Human
ccuuuucuuguaucug

SEQ ID NO: 3207009 - RNA, 14 nt, Human
ccuuuucuguguuu

SEQ ID NO: 3207010 - RNA, 13 nt, Human
ccuuuucuguguu

SEQ ID NO: 3207011 - RNA, 20 nt, Human
ccuuuagcgcccaguugggu

SEQ ID NO: 3207012 - RNA, 14 nt, Human
ccuuuagcgcccag

SEQ ID NO: 3207013 - RNA, 13 nt, Human
ccuuuccaccuuc

SEQ ID NO: 3207014 - RNA, 16 nt, Human
ccuuuccaccuucuca

SEQ ID NO: 3207015 - RNA, 17 nt, Human
ccuuuccaccuucucac

SEQ ID NO: 3207016 - RNA, 18 nt, Human
ccuuuccaccuucucaca

SEQ ID NO: 3207017 - RNA, 14 nt, Human
ccuuuagcuguguu

SEQ ID NO: 3207018 - RNA, 18 nt, Human
ccuuuagauagcagccug

SEQ ID NO: 3207019 - RNA, 19 nt, Human
ccuuuagauagcagccugg

SEQ ID NO: 3207020 - RNA, 21 nt, Human
ccuuuagauagcagccuggcu

SEQ ID NO: 3207021 - RNA, 22 nt, Human
ccuuuagauagcagccuggcuc

SEQ ID NO: 3207022 - RNA, 22 nt, Human
ccuuggaaaucaaauguaaagu

SEQ ID NO: 3207023 - RNA, 20 nt, Human
ccuuggaaaucaaauguaaa

SEQ ID NO: 3207024 - RNA, 21 nt, Human
ccuucugacccaugcugcccu

SEQ ID NO: 3207025 - RNA, 22 nt, Human
ccuucugacccaugcugcccug

SEQ ID NO: 3207026 - RNA, 23 nt, Human
ccuucugacccaugcugcccugu

SEQ ID NO: 3207027 - RNA, 19 nt, Human
ccuucucuuccaggcagcc

SEQ ID NO: 3207028 - RNA, 18 nt, Human
ccuucucuuccaggcagc

SEQ ID NO: 3207029 - RNA, 22 nt, Human
ccuucuggaauaaggagaauga

SEQ ID NO: 3207030 - RNA, 23 nt, Human
ccuucugcacauaaacucuuuua

SEQ ID NO: 3207031 - RNA, 15 nt, Human
ccuucugaugaaaug

SEQ ID NO: 3207032 - RNA, 21 nt, Human
ccuucugaugaaauguuaaca

SEQ ID NO: 3207033 - RNA, 20 nt, Human
ccuucugagcuggccucuca

SEQ ID NO: 3207034 - RNA, 19 nt, Human
ccuucugagcuggccucuc

SEQ ID NO: 3207035 - RNA, 12 nt, Human
ccuucugaccca

SEQ ID NO: 3207036 - RNA, 16 nt, Human
ccuucugacccaugcu

SEQ ID NO: 3207037 - RNA, 17 nt, Human
ccuucugacccaugcug

SEQ ID NO: 3207038 - RNA, 20 nt, Human
ccuucugacccaugcugccc

SEQ ID NO: 3207039 - RNA, 14 nt, Human
ccuggccugagcug

SEQ ID NO: 3207040 - RNA, 15 nt, Human
ccuggccugagcugg

SEQ ID NO: 3207041 - RNA, 17 nt, Human
ccuucucuuccaggcag

SEQ ID NO: 3207042 - RNA, 14 nt, Human
ccuucucuuccagg

SEQ ID NO: 3207043 - RNA, 13 nt, Human
ccuucucuuccag

SEQ ID NO: 3207044 - RNA, 12 nt, Human
ccuucugggcau

SEQ ID NO: 3207045 - RNA, 20 nt, Human
ccccagacuccaccaagccu

SEQ ID NO: 3207046 - RNA, 21 nt, Human
ccccagacuccaccaagccug

SEQ ID NO: 3207047 - RNA, 21 nt, Human
ccccaaaacucuccucugcug

SEQ ID NO: 3207048 - RNA, 23 nt, Human
ccccaaaacucuccucugcugcu

SEQ ID NO: 3207049 - RNA, 22 nt, Human
cccauuguggucacaggaagua

SEQ ID NO: 3207050 - RNA, 23 nt, Human
cccauuguggucacaggaaguag

SEQ ID NO: 3207051 - RNA, 22 nt, Human
ccccaaaacucuccucugcugc

SEQ ID NO: 3207052 - RNA, 22 nt, Human
ccccagcaagugagagcugggu

SEQ ID NO: 3207053 - RNA, 21 nt, Human
ccccagcaagugagagcuggg

SEQ ID NO: 3207054 - RNA, 22 nt, Human
cccccaaauggaaaugggcaga

SEQ ID NO: 3207055 - RNA, 23 nt, Human
ccccgacccuugccgucuaccug

SEQ ID NO: 3207056 - RNA, 13 nt, Human
cccgggacucugc

SEQ ID NO: 3207057 - RNA, 22 nt, Human
cccgggaagggggcugggacau

SEQ ID NO: 3207058 - RNA, 23 nt, Human
cccgggaggcagagguugcagug

SEQ ID NO: 3207059 - RNA, 18 nt, Human
cccuauuagagaagagau

SEQ ID NO: 3207060 - RNA, 17 nt, Human
cccuauugguaaagaau

SEQ ID NO: 3207061 - RNA, 16 nt, Human
cccggcuccaggcucc

SEQ ID NO: 3207062 - RNA, 15 nt, Human
cccggcuccaggcuc

SEQ ID NO: 3207063 - RNA, 14 nt, Human
cccggcuccaggcu

SEQ ID NO: 3207064 - RNA, 13 nt, Human
cccggcuccaggc

SEQ ID NO: 3207065 - RNA, 13 nt, Human
cccggccaccugc

SEQ ID NO: 3207066 - RNA, 14 nt, Human
cccggccaccugcg

SEQ ID NO: 3207067 - RNA, 12 nt, Human
cccggcuccagg

SEQ ID NO: 3207068 - RNA, 11 nt, Human
cccggcuccag

SEQ ID NO: 3207069 - RNA, 15 nt, Human
ccccuuucuuccuca

SEQ ID NO: 3207070 - RNA, 14 nt, Human
cccgaauagcuggg

SEQ ID NO: 3207071 - RNA, 22 nt, Human
cccgaaagaggcacccuuccau

SEQ ID NO: 3207072 - RNA, 21 nt, Human
cccgaaagaggcacccuucca

SEQ ID NO: 3207073 - RNA, 20 nt, Human
cccgaaaggucaccucacuc

SEQ ID NO: 3207074 - RNA, 19 nt, Human
cccgaaaggucaccucacu

SEQ ID NO: 3207075 - RNA, 17 nt, Human
cccgaaaggucaccuca

SEQ ID NO: 3207076 - RNA, 24 nt, Human
cccgaaagaggcacccuuccaucu

SEQ ID NO: 3207077 - RNA, 21 nt, Human
cccgaaaggucaccucacuca

SEQ ID NO: 3207078 - RNA, 19 nt, Human
ccccuugccagcugcugag

SEQ ID NO: 3207079 - RNA, 16 nt, Human
ccccuugccagcugcu

SEQ ID NO: 3207080 - RNA, 21 nt, Human
ccccuugccagcugcugagcc

SEQ ID NO: 3207081 - RNA, 12 nt, Human
ccccucuucccu

SEQ ID NO: 3207082 - RNA, 14 nt, Human
ccccucuucccugg

SEQ ID NO: 3207083 - RNA, 14 nt, Human
ccccuuucuuccuc

SEQ ID NO: 3207084 - RNA, 13 nt, Human
ccccuuucuuccu

SEQ ID NO: 3207085 - RNA, 19 nt, Human
ccccucuggcuccagcugg

SEQ ID NO: 3207086 - RNA, 18 nt, Human
ccccucuggcuccagcug

SEQ ID NO: 3207087 - RNA, 16 nt, Human
cccagccacuccccag

SEQ ID NO: 3207088 - RNA, 15 nt, Human
cccagccacucccca

SEQ ID NO: 3207089 - RNA, 14 nt, Human
cccagccacucccc

SEQ ID NO: 3207090 - RNA, 23 nt, Human
cccagcucugguccauagagagc

SEQ ID NO: 3207091 - RNA, 22 nt, Human
cccagcuuaaaggggcuagagu

SEQ ID NO: 3207092 - RNA, 13 nt, Human
cccagcugcaccc

SEQ ID NO: 3207093 - RNA, 20 nt, Human
cccagcugcaccccuuccug

SEQ ID NO: 3207094 - RNA, 18 nt, Human
cccagcugcaccccuucc

SEQ ID NO: 3207095 - RNA, 12 nt, Human
cccagcugcacc

SEQ ID NO: 3207096 - RNA, 13 nt, Human
cccauccucugua

SEQ ID NO: 3207097 - RNA, 13 nt, Human
cccauccuccagg

SEQ ID NO: 3207098 - RNA, 17 nt, Human
cccaggcuggcgugcag

SEQ ID NO: 3207099 - RNA, 13 nt, Human
cccaggcuggcgu

SEQ ID NO: 3207100 - RNA, 19 nt, Human
cccaggcuggagugcagug

SEQ ID NO: 3207101 - RNA, 18 nt, Human
cccaggcuggagugcagu

SEQ ID NO: 3207102 - RNA, 15 nt, Human
cccagcuugaaaccu

SEQ ID NO: 3207103 - RNA, 14 nt, Human
cccagcuugggcag

SEQ ID NO: 3207104 - RNA, 16 nt, Human
cccagcuucucagcuc

SEQ ID NO: 3207105 - RNA, 19 nt, Human
cccagcuuccagcaggagg

SEQ ID NO: 3207106 - RNA, 18 nt, Human
cccagcuuccagcaggag

SEQ ID NO: 3207107 - RNA, 22 nt, Human
cccagcuucacuucugacucuu

SEQ ID NO: 3207108 - RNA, 17 nt, Human
cccagcuucacuucuga

SEQ ID NO: 3207109 - RNA, 17 nt, Human
cccagcuuccagcagga

SEQ ID NO: 3207110 - RNA, 16 nt, Human
cccagcuuccagcagg

SEQ ID NO: 3207111 - RNA, 15 nt, Human
cccagcuuccagcag

SEQ ID NO: 3207112 - RNA, 13 nt, Human
cccagcuuccagc

SEQ ID NO: 3207113 - RNA, 22 nt, Human
cccagcuugggcagaucuccca

SEQ ID NO: 3207114 - RNA, 11 nt, Human
cccauaucaug

SEQ ID NO: 3207115 - RNA, 13 nt, Human
cccacugcucugg

SEQ ID NO: 3207116 - RNA, 12 nt, Human
cccacugcucug

SEQ ID NO: 3207117 - RNA, 19 nt, Human
cccacugcuuuuggucugu

SEQ ID NO: 3207118 - RNA, 20 nt, Human
cccacugugcguggggcucc

SEQ ID NO: 3207119 - RNA, 18 nt, Human
cccacuagacccacugga

SEQ ID NO: 3207120 - RNA, 20 nt, Human
cccacccugcuuggcccagg

SEQ ID NO: 3207121 - RNA, 21 nt, Human
cccacccugcuuggcccaggg

SEQ ID NO: 3207122 - RNA, 18 nt, Human
cccacuccaagccagcaa

SEQ ID NO: 3207123 - RNA, 20 nt, Human
cccacccaagggccuggccu

SEQ ID NO: 3207124 - RNA, 21 nt, Human
cccacccaagggccuggccug

SEQ ID NO: 3207125 - RNA, 22 nt, Human
cccacccaagggccuggccuga

SEQ ID NO: 3207126 - RNA, 18 nt, Human
cccacccugaaagcccug

SEQ ID NO: 3207127 - RNA, 11 nt, Human
cccacccugcu

SEQ ID NO: 3207128 - RNA, 18 nt, Human
cccacccaagggccuggc

SEQ ID NO: 3207129 - RNA, 12 nt, Human
cccacccccacc

SEQ ID NO: 3207130 - RNA, 15 nt, Human
cccacccccacccaa

SEQ ID NO: 3207131 - RNA, 17 nt, Human
cccacccccacccaagg

SEQ ID NO: 3207132 - RNA, 13 nt, Human
cccacugcugacu

SEQ ID NO: 3207133 - RNA, 22 nt, Human
ccagaguccccccacucccagc

SEQ ID NO: 3207134 - RNA, 21 nt, Human
ccagaguccccccacucccag

SEQ ID NO: 3207135 - RNA, 18 nt, Human
ccagagggccugcaaggg

SEQ ID NO: 3207136 - RNA, 19 nt, Human
ccagagggccugcaaggga

SEQ ID NO: 3207137 - RNA, 17 nt, Human
ccagagggccugcaagg

SEQ ID NO: 3207138 - RNA, 16 nt, Human
ccaccuuggcucaagu

SEQ ID NO: 3207139 - RNA, 16 nt, Human
ccagaucagccagaag

SEQ ID NO: 3207140 - RNA, 23 nt, Human
ccagagucuagcguagugcagca

SEQ ID NO: 3207141 - RNA, 23 nt, Human
ccagaguccccccacucccagca

SEQ ID NO: 3207142 - RNA, 22 nt, Human
ccagagucuagcguagugcagc

SEQ ID NO: 3207143 - RNA, 15 nt, Human
ccagaugcaccagcc

SEQ ID NO: 3207144 - RNA, 17 nt, Human
ccagaugcaccagcccu

SEQ ID NO: 3207145 - RNA, 18 nt, Human
ccagaugcaccagcccuu

SEQ ID NO: 3207146 - RNA, 15 nt, Human
ccagcagccagccaa

SEQ ID NO: 3207147 - RNA, 14 nt, Human
ccagcagccagcca

SEQ ID NO: 3207148 - RNA, 13 nt, Human
ccagcagccagcc

SEQ ID NO: 3207149 - RNA, 12 nt, Human
ccagcagccagc

SEQ ID NO: 3207150 - RNA, 13 nt, Human
ccagcaggcucuc

SEQ ID NO: 3207151 - RNA, 15 nt, Human
ccagcaggcucucag

SEQ ID NO: 3207152 - RNA, 20 nt, Human
ccagcagccuggacccugug

SEQ ID NO: 3207153 - RNA, 16 nt, Human
ccagcagccagccaaa

SEQ ID NO: 3207154 - RNA, 20 nt, Human
ccagcaggagggacagucuc

SEQ ID NO: 3207155 - RNA, 16 nt, Human
ccagcaggagggacag

SEQ ID NO: 3207156 - RNA, 13 nt, Human
ccagcaggaggga

SEQ ID NO: 3207157 - RNA, 12 nt, Human
ccagcaggaggg

SEQ ID NO: 3207158 - RNA, 11 nt, Human
ccagccccugg

SEQ ID NO: 3207159 - RNA, 17 nt, Human
ccagcaggcccauggga

SEQ ID NO: 3207160 - RNA, 12 nt, Human
ccagcaggccca

SEQ ID NO: 3207161 - RNA, 16 nt, Human
ccagcucaccagcccc

SEQ ID NO: 3207162 - RNA, 15 nt, Human
ccagcucaccagccc

SEQ ID NO: 3207163 - RNA, 16 nt, Human
ccagcuguucagcugg

SEQ ID NO: 3207164 - RNA, 22 nt, Human
ccagcucaccagccccagugcc

SEQ ID NO: 3207165 - RNA, 17 nt, Human
ccagcuguucagcuggu

SEQ ID NO: 3207166 - RNA, 19 nt, Human
ccagcuuaaaggggcuaga

SEQ ID NO: 3207167 - RNA, 13 nt, Human
ccaggaagccagc

SEQ ID NO: 3207168 - RNA, 12 nt, Human
ccaggaagccag

SEQ ID NO: 3207169 - RNA, 14 nt, Human
ccaggaaaggcucc

SEQ ID NO: 3207170 - RNA, 15 nt, Human
ccaggaaaggcucca

SEQ ID NO: 3207171 - RNA, 16 nt, Human
ccaggaaaggcuccag

SEQ ID NO: 3207172 - RNA, 15 nt, Human
ccaguucagcuuggg

SEQ ID NO: 3207173 - RNA, 21 nt, Human
ccaguuauggcuauaggugcu

SEQ ID NO: 3207174 - RNA, 20 nt, Human
ccaguuggguggaugccugg

SEQ ID NO: 3207175 - RNA, 19 nt, Human
ccaguuggguggaugccug

SEQ ID NO: 3207176 - RNA, 17 nt, Human
ccaguuggguggaugcc

SEQ ID NO: 3207177 - RNA, 15 nt, Human
ccaguuccucuuuug

SEQ ID NO: 3207178 - RNA, 16 nt, Human
ccaguuccucuuuugu

SEQ ID NO: 3207179 - RNA, 15 nt, Human
ccauguaugcauaau

SEQ ID NO: 3207180 - RNA, 11 nt, Human
ccauguaugca

SEQ ID NO: 3207181 - RNA, 21 nt, Human
ccauguauggccaggaaguag

SEQ ID NO: 3207182 - RNA, 18 nt, Human
ccauguauggccaggaag

SEQ ID NO: 3207183 - RNA, 15 nt, Human
ccauguauggccagg

SEQ ID NO: 3207184 - RNA, 14 nt, Human
ccauguauggccag

SEQ ID NO: 3207185 - RNA, 23 nt, Human
ccaugagccucagcauccuggca

SEQ ID NO: 3207186 - RNA, 21 nt, Human
ccaugagccucagcauccugg

SEQ ID NO: 3207187 - RNA, 14 nt, Human
ccaucccagcccca

SEQ ID NO: 3207188 - RNA, 13 nt, Human
ccaucccagcccc

SEQ ID NO: 3207189 - RNA, 15 nt, Human
ccaucccagccccaa

SEQ ID NO: 3207190 - RNA, 23 nt, Human
ccaguuggucccccuuccaugga

SEQ ID NO: 3207191 - RNA, 21 nt, Human
ccaguuguuagauuaagaaau

SEQ ID NO: 3207192 - RNA, 18 nt, Human
ccaguuuauuccagagcu

SEQ ID NO: 3207193 - RNA, 14 nt, Human
ccaucccugaaggc

SEQ ID NO: 3207194 - RNA, 15 nt, Human
ccaucccugaaggcc

SEQ ID NO: 3207195 - RNA, 17 nt, Human
ccaucccugaaggcccc

SEQ ID NO: 3207196 - RNA, 15 nt, Human
ccaugaauguuccug

SEQ ID NO: 3207197 - RNA, 18 nt, Human
ccagggcuggggcagccu

SEQ ID NO: 3207198 - RNA, 18 nt, Human
ccaggcuggcgugcagug

SEQ ID NO: 3207199 - RNA, 17 nt, Human
ccaggcuggcgugcagu

SEQ ID NO: 3207200 - RNA, 21 nt, Human
ccaggcuccuuuagcgcccag

SEQ ID NO: 3207201 - RNA, 20 nt, Human
ccaggcuccuuuagcgccca

SEQ ID NO: 3207202 - RNA, 16 nt, Human
ccaggcuggcgugcag

SEQ ID NO: 3207203 - RNA, 23 nt, Human
ccaggggugggacacccugugau

SEQ ID NO: 3207204 - RNA, 14 nt, Human
ccaggggugggaca

SEQ ID NO: 3207205 - RNA, 17 nt, Human
ccaggggugggacaccc

SEQ ID NO: 3207206 - RNA, 20 nt, Human
ccaggggaaaaucagccugc

SEQ ID NO: 3207207 - RNA, 13 nt, Human
ccaggggugggac

SEQ ID NO: 3207208 - RNA, 19 nt, Human
ccaggggaaaaucagccug

SEQ ID NO: 3207209 - RNA, 22 nt, Human
ccagggcuggggcagccucugg

SEQ ID NO: 3207210 - RNA, 21 nt, Human
ccagggcuggggcagccucug

SEQ ID NO: 3207211 - RNA, 13 nt, Human
ccaggcacaggca

SEQ ID NO: 3207212 - RNA, 12 nt, Human
ccaggcacaggc

SEQ ID NO: 3207213 - RNA, 17 nt, Human
ccaggcacaggcagggc

SEQ ID NO: 3207214 - RNA, 16 nt, Human
ccaggcacaggcaggg

SEQ ID NO: 3207215 - RNA, 15 nt, Human
ccaggcacaggcagg

SEQ ID NO: 3207216 - RNA, 14 nt, Human
ccaggcacaggcag

SEQ ID NO: 3207217 - RNA, 19 nt, Human
ccaggcacaggcagggcag

SEQ ID NO: 3207218 - RNA, 18 nt, Human
ccaggcacaggcagggca

SEQ ID NO: 3207219 - RNA, 20 nt, Human
ccaggcacaggcagggcagg

SEQ ID NO: 3207220 - RNA, 13 nt, Human
ccaggcaccuccc

SEQ ID NO: 3207221 - RNA, 18 nt, Human
ccaggcacugcugcccag

SEQ ID NO: 3207222 - RNA, 16 nt, Human
ccaggcacugcugccc

SEQ ID NO: 3207223 - RNA, 22 nt, Human
ccugaguaaaaaagcugugugc

SEQ ID NO: 3207224 - RNA, 22 nt, Human
ccugcacuugcagacucuacag

SEQ ID NO: 3207225 - RNA, 22 nt, Human
ccugcacuugggggcucagcaa

SEQ ID NO: 3207226 - RNA, 21 nt, Human
ccugcacuugggggcucagca

SEQ ID NO: 3207227 - RNA, 20 nt, Human
ccugcacuugggggcucagc

SEQ ID NO: 3207228 - RNA, 18 nt, Human
ccugcacuugggggcuca

SEQ ID NO: 3207229 - RNA, 16 nt, Human
ccugcacuugggggcu

SEQ ID NO: 3207230 - RNA, 15 nt, Human
ccugcacuugggggc

SEQ ID NO: 3207231 - RNA, 19 nt, Human
ccugcacuugcagacucua

SEQ ID NO: 3207232 - RNA, 15 nt, Human
ccugcagcucucaug

SEQ ID NO: 3207233 - RNA, 12 nt, Human
ccugcagcucuc

SEQ ID NO: 3207234 - RNA, 12 nt, Human
ccugcagcuccc

SEQ ID NO: 3207235 - RNA, 10 nt, Human
ccugcagcuc

SEQ ID NO: 3207236 - RNA, 22 nt, Human
ccucuugucuuccuauuucaga

SEQ ID NO: 3207237 - RNA, 22 nt, Human
ccugaccucaaaugaugugccu

SEQ ID NO: 3207238 - RNA, 19 nt, Human
ccucuugucuuccuauuuc

SEQ ID NO: 3207239 - RNA, 14 nt, Human
ccucuugcauuuca

SEQ ID NO: 3207240 - RNA, 13 nt, Human
ccucuuggguuca

SEQ ID NO: 3207241 - RNA, 14 nt, Human
ccugacucucagca

SEQ ID NO: 3207242 - RNA, 15 nt, Human
ccugacuucuguuua

SEQ ID NO: 3207243 - RNA, 16 nt, Human
ccugacugggggcaga

SEQ ID NO: 3207244 - RNA, 19 nt, Human
ccugacugggggcagacau

SEQ ID NO: 3207245 - RNA, 17 nt, Human
ccugacugggggcagac

SEQ ID NO: 3207246 - RNA, 23 nt, Human
ccucucugaaggaggccaccucc

SEQ ID NO: 3207247 - RNA, 22 nt, Human
ccucucugaaggaggccaccuc

SEQ ID NO: 3207248 - RNA, 20 nt, Human
ccucucugaaggaggccacc

SEQ ID NO: 3207249 - RNA, 18 nt, Human
ccucucugaaggaggcca

SEQ ID NO: 3207250 - RNA, 14 nt, Human
ccucucucaggcca

SEQ ID NO: 3207251 - RNA, 12 nt, Human
ccucucucacuc

SEQ ID NO: 3207252 - RNA, 13 nt, Human
ccucucucacucc

SEQ ID NO: 3207253 - RNA, 14 nt, Human
ccucucucacuccu

SEQ ID NO: 3207254 - RNA, 15 nt, Human
ccucucucacuccuu

SEQ ID NO: 3207255 - RNA, 17 nt, Human
ccucucucacuccuuga

SEQ ID NO: 3207256 - RNA, 12 nt, Human
ccucucucaggc

SEQ ID NO: 3207257 - RNA, 21 nt, Human
ccucugccugaagucacacag

SEQ ID NO: 3207258 - RNA, 12 nt, Human
ccucucugcccu

SEQ ID NO: 3207259 - RNA, 22 nt, Human
ccucugccugaagucacacagu

SEQ ID NO: 3207260 - RNA, 19 nt, Human
ccucugcucccccuuuucc

SEQ ID NO: 3207261 - RNA, 12 nt, Human
ccucugccuguc

SEQ ID NO: 3207262 - RNA, 15 nt, Human
ccucugcugcuggcu

SEQ ID NO: 3207263 - RNA, 16 nt, Human
ccucugcugcuggcug

SEQ ID NO: 3207264 - RNA, 17 nt, Human
ccucugcugcuggcugg

SEQ ID NO: 3207265 - RNA, 18 nt, Human
ccucugcugcuggcuggu

SEQ ID NO: 3207266 - RNA, 13 nt, Human
ccucugcugcugg

SEQ ID NO: 3207267 - RNA, 14 nt, Human
ccucugcugcuggc

SEQ ID NO: 3207268 - RNA, 15 nt, Human
ccucugcugauccuc

SEQ ID NO: 3207269 - RNA, 18 nt, Human
ccucugcugauccuccca

SEQ ID NO: 3207270 - RNA, 19 nt, Human
ccuggaggcucaaauuuug

SEQ ID NO: 3207271 - RNA, 20 nt, Human
ccuggaggcucaaauuuuga

SEQ ID NO: 3207272 - RNA, 16 nt, Human
ccuggaguucugguuc

SEQ ID NO: 3207273 - RNA, 17 nt, Human
ccuggaguucugguucc

SEQ ID NO: 3207274 - RNA, 15 nt, Human
ccuggaguucugguu

SEQ ID NO: 3207275 - RNA, 13 nt, Human
ccuggaugcagcc

SEQ ID NO: 3207276 - RNA, 21 nt, Human
ccuggauccaucaggccacuu

SEQ ID NO: 3207277 - RNA, 14 nt, Human
ccuggaugcagccu

SEQ ID NO: 3207278 - RNA, 17 nt, Human
ccuggaugcagccucac

SEQ ID NO: 3207279 - RNA, 19 nt, Human
ccuggaugcagccucacag

SEQ ID NO: 3207280 - RNA, 18 nt, Human
ccuggcacagggcagugg

SEQ ID NO: 3207281 - RNA, 17 nt, Human
ccuggcacagggcagug

SEQ ID NO: 3207282 - RNA, 16 nt, Human
ccuggcacagggcagu

SEQ ID NO: 3207283 - RNA, 14 nt, Human
ccugcugggugugg

SEQ ID NO: 3207284 - RNA, 20 nt, Human
ccugcuggguguggcgcagc

SEQ ID NO: 3207285 - RNA, 12 nt, Human
ccugcugggugu

SEQ ID NO: 3207286 - RNA, 21 nt, Human
ccugcuggccggacacccgac

SEQ ID NO: 3207287 - RNA, 16 nt, Human
ccugcccaggccccug

SEQ ID NO: 3207288 - RNA, 22 nt, Human
ccugcccaggccccugccaccc

SEQ ID NO: 3207289 - RNA, 15 nt, Human
ccugcccaggccccu

SEQ ID NO: 3207290 - RNA, 14 nt, Human
ccugcccaggcccc

SEQ ID NO: 3207291 - RNA, 14 nt, Human
ccuggccucugcac

SEQ ID NO: 3207292 - RNA, 15 nt, Human
ccuggccucugcacu

SEQ ID NO: 3207293 - RNA, 13 nt, Human
ccuggccugagcu

SEQ ID NO: 3207294 - RNA, 12 nt, Human
ccuggccucugc

SEQ ID NO: 3207295 - RNA, 16 nt, Human
cccuggcuccaggcca

SEQ ID NO: 3207296 - RNA, 13 nt, Human
cccuggcuccagg

SEQ ID NO: 3207297 - RNA, 17 nt, Human
cccuggcucccacaggc

SEQ ID NO: 3207298 - RNA, 13 nt, Human
cccuggcuuuuca

SEQ ID NO: 3207299 - RNA, 14 nt, Human
cccuggcuuccuua

SEQ ID NO: 3207300 - RNA, 17 nt, Human
cccuggcccccacaugg

SEQ ID NO: 3207301 - RNA, 12 nt, Human
cccuggccccca

SEQ ID NO: 3207302 - RNA, 14 nt, Human
cccuggcagccccu

SEQ ID NO: 3207303 - RNA, 16 nt, Human
cccuggcagccccugu

SEQ ID NO: 3207304 - RNA, 15 nt, Human
cccuggcaggcaggg

SEQ ID NO: 3207305 - RNA, 14 nt, Human
cccuggcaggcagg

SEQ ID NO: 3207306 - RNA, 15 nt, Human
cccuggcagcccgca

SEQ ID NO: 3207307 - RNA, 12 nt, Human
cccuggcagccc

SEQ ID NO: 3207308 - RNA, 13 nt, Human
cccuggcagcccc

SEQ ID NO: 3207309 - RNA, 16 nt, Human
cccugcccugugggcc

SEQ ID NO: 3207310 - RNA, 20 nt, Human
cccugcccugugggccccca

SEQ ID NO: 3207311 - RNA, 15 nt, Human
cccugcccugugggc

SEQ ID NO: 3207312 - RNA, 14 nt, Human
cccugcccuguggg

SEQ ID NO: 3207313 - RNA, 11 nt, Human
cccugcccugu

SEQ ID NO: 3207314 - RNA, 12 nt, Human
cccugcccugug

SEQ ID NO: 3207315 - RNA, 13 nt, Human
cccugcccugugg

SEQ ID NO: 3207316 - RNA, 23 nt, Human
cccuauuuaacagggucucuagu

SEQ ID NO: 3207317 - RNA, 21 nt, Human
cccuauuuaacagggucucua

SEQ ID NO: 3207318 - RNA, 24 nt, Human
cccugugccuuggugugcuguauc

SEQ ID NO: 3207319 - RNA, 13 nt, Human
cccugugccagcc

SEQ ID NO: 3207320 - RNA, 13 nt, Human
cccuucucuucca

SEQ ID NO: 3207321 - RNA, 12 nt, Human
cccuucucuucc

SEQ ID NO: 3207322 - RNA, 21 nt, Human
cccuucugacccaugcugccc

SEQ ID NO: 3207323 - RNA, 22 nt, Human
cccuucugacccaugcugcccu

SEQ ID NO: 3207324 - RNA, 23 nt, Human
cccuucugacccaugcugcccug

SEQ ID NO: 3207325 - RNA, 16 nt, Human
cccuucuaccuuccug

SEQ ID NO: 3207326 - RNA, 18 nt, Human
cccuucgcuccugugucu

SEQ ID NO: 3207327 - RNA, 16 nt, Human
cccuucgcuccugugu

SEQ ID NO: 3207328 - RNA, 16 nt, Human
ccgacccuugccgucu

SEQ ID NO: 3207329 - RNA, 17 nt, Human
ccgccaaggcuggggga

SEQ ID NO: 3207330 - RNA, 22 nt, Human
ccgaauauugagcaauauguca

SEQ ID NO: 3207331 - RNA, 14 nt, Human
ccgccacaucccuc

SEQ ID NO: 3207332 - RNA, 12 nt, Human
cccuucuucaug

SEQ ID NO: 3207333 - RNA, 18 nt, Human
ccgaccagacaccuugac

SEQ ID NO: 3207334 - RNA, 13 nt, Human
ccgacaagcacag

SEQ ID NO: 3207335 - RNA, 17 nt, Human
ccgaauagcugggacua

SEQ ID NO: 3207336 - RNA, 20 nt, Human
ccgaauagcugggacuacag

SEQ ID NO: 3207337 - RNA, 19 nt, Human
cccuucucuuccaggcagc

SEQ ID NO: 3207338 - RNA, 17 nt, Human
cccuucucuuccaggca

SEQ ID NO: 3207339 - RNA, 15 nt, Human
cccuucucuuccagg

SEQ ID NO: 3207340 - RNA, 14 nt, Human
cccuucucuuccag

SEQ ID NO: 3207341 - RNA, 20 nt, Human
ccgcccaggcuuagucacug

SEQ ID NO: 3207342 - RNA, 12 nt, Human
ccgcccaggcuu

SEQ ID NO: 3207343 - RNA, 16 nt, Human
ccgccaugcuccuggc

SEQ ID NO: 3207344 - RNA, 19 nt, Human
ccggcuaauuuuuguauuu

SEQ ID NO: 3207345 - RNA, 17 nt, Human
ccggcuaugggggcacu

SEQ ID NO: 3207346 - RNA, 23 nt, Human
ccggcuaugggggcacugaggac

SEQ ID NO: 3207347 - RNA, 22 nt, Human
ccggcuaugggggcacugagga

SEQ ID NO: 3207348 - RNA, 16 nt, Human
ccggcuaagcaggcgc

SEQ ID NO: 3207349 - RNA, 21 nt, Human
ccggcuaagcaggcgcaaggg

SEQ ID NO: 3207350 - RNA, 22 nt, Human
ccguaguaucagagauguccau

SEQ ID NO: 3207351 - RNA, 13 nt, Human
ccgucacauccca

SEQ ID NO: 3207352 - RNA, 11 nt, Human
ccgucucaggu

SEQ ID NO: 3207353 - RNA, 17 nt, Human
ccgucacuaccuggcug

SEQ ID NO: 3207354 - RNA, 18 nt, Human
ccuaaucacucagagcag

SEQ ID NO: 3207355 - RNA, 18 nt, Human
ccgucucugguuccuccc

SEQ ID NO: 3207356 - RNA, 19 nt, Human
ccuaagauguguucuuauu

SEQ ID NO: 3207357 - RNA, 21 nt, Human
ccuaagauauacuuguuuuug

SEQ ID NO: 3207358 - RNA, 19 nt, Human
ccuaggauucacaccccac

SEQ ID NO: 3207359 - RNA, 18 nt, Human
ccuaggauucacacccca

SEQ ID NO: 3207360 - RNA, 23 nt, Human
ccuaggauucacaccccaccugc

SEQ ID NO: 3207361 - RNA, 22 nt, Human
ccuaggauucacaccccaccug

SEQ ID NO: 3207362 - RNA, 20 nt, Human
ccuaggauucacaccccacc

SEQ ID NO: 3207363 - RNA, 12 nt, Human
ccuauuucagaa

SEQ ID NO: 3207364 - RNA, 11 nt, Human
ccuauuucaga

SEQ ID NO: 3207365 - RNA, 16 nt, Human
ccucaaccuccugggc

SEQ ID NO: 3207366 - RNA, 15 nt, Human
ccuauuucuugauaa

SEQ ID NO: 3207367 - RNA, 20 nt, Human
ccuauuuuugacauggaaau

SEQ ID NO: 3207368 - RNA, 15 nt, Human
ccucaacucuccucc

SEQ ID NO: 3207369 - RNA, 15 nt, Human
ccucaagagaaggca

SEQ ID NO: 3207370 - RNA, 22 nt, Human
ccucagccucccaaagugcugg

SEQ ID NO: 3207371 - RNA, 11 nt, Human
ccucagccucc

SEQ ID NO: 3207372 - RNA, 15 nt, Human
ccucccacagugcug

SEQ ID NO: 3207373 - RNA, 14 nt, Human
ccuccaaggccagg

SEQ ID NO: 3207374 - RNA, 20 nt, Human
ccucccaggcgccccuuccc

SEQ ID NO: 3207375 - RNA, 14 nt, Human
ccucccaggcgccc

SEQ ID NO: 3207376 - RNA, 12 nt, Human
ccucccagcucc

SEQ ID NO: 3207377 - RNA, 20 nt, Human
ccucauguccacugguucuu

SEQ ID NO: 3207378 - RNA, 15 nt, Human
ccucauguccacugg

SEQ ID NO: 3207379 - RNA, 13 nt, Human
ccucagccuccug

SEQ ID NO: 3207380 - RNA, 22 nt, Human
ccucagccucccgaauagcugg

SEQ ID NO: 3207381 - RNA, 23 nt, Human
ccucagccucccaaagugcuggg

SEQ ID NO: 3207382 - RNA, 22 nt, Human
ccucccaaggggcccaaauucu

SEQ ID NO: 3207383 - RNA, 23 nt, Human
ccucccaacucaccccagcccca

SEQ ID NO: 3207384 - RNA, 13 nt, Human
ccuccaaggccag

SEQ ID NO: 3207385 - RNA, 20 nt, Human
ccuccaagaccuucuccuuc

SEQ ID NO: 3207386 - RNA, 22 nt, Human
ccuccaagcuccaucuccacuc

SEQ ID NO: 3207387 - RNA, 21 nt, Human
ccuccaagcuccaucuccacu

SEQ ID NO: 3207388 - RNA, 18 nt, Human
cacugcauccuccgccuc

SEQ ID NO: 3207389 - RNA, 14 nt, Human
cacugcauccuccg

SEQ ID NO: 3207390 - RNA, 16 nt, Human
cacugcauccuccgcc

SEQ ID NO: 3207391 - RNA, 13 nt, Human
cacugcagccuca

SEQ ID NO: 3207392 - RNA, 21 nt, Human
cacugcagaacagcuucaugu

SEQ ID NO: 3207393 - RNA, 21 nt, Human
cacugcagaagacaguauggc

SEQ ID NO: 3207394 - RNA, 12 nt, Human
cacugcagccuc

SEQ ID NO: 3207395 - RNA, 20 nt, Human
cacugcacuccagccugggu

SEQ ID NO: 3207396 - RNA, 19 nt, Human
cacugcacuccagccuggg

SEQ ID NO: 3207397 - RNA, 18 nt, Human
cacugcacuccagccugg

SEQ ID NO: 3207398 - RNA, 15 nt, Human
cacugcacuccagcc

SEQ ID NO: 3207399 - RNA, 16 nt, Human
cacugcacuccagccu

SEQ ID NO: 3207400 - RNA, 19 nt, Human
cacugcacuauagccuagg

SEQ ID NO: 3207401 - RNA, 16 nt, Human
cacuuguagauuugau

SEQ ID NO: 3207402 - RNA, 17 nt, Human
cacuuguagauuugauu

SEQ ID NO: 3207403 - RNA, 21 nt, Human
cacuuagcuggagaugucucu

SEQ ID NO: 3207404 - RNA, 20 nt, Human
cacuuagccuuucuuuucuu

SEQ ID NO: 3207405 - RNA, 23 nt, Human
cacuuaggaacguaaucgugucc

SEQ ID NO: 3207406 - RNA, 24 nt, Human
cacuuagaaauugcauuuccugac

SEQ ID NO: 3207407 - RNA, 14 nt, Human
cacuuguagauuug

SEQ ID NO: 3207408 - RNA, 15 nt, Human
cacuuguagauuuga

SEQ ID NO: 3207409 - RNA, 23 nt, Human
cacugguggcccgacagccuggc

SEQ ID NO: 3207410 - RNA, 22 nt, Human
cacugguucuucuuggucucag

SEQ ID NO: 3207411 - RNA, 18 nt, Human
cacuuacacuuuaugcac

SEQ ID NO: 3207412 - RNA, 16 nt, Human
cacuuacacuuuaugc

SEQ ID NO: 3207413 - RNA, 21 nt, Human
cacuuaccugaguugaagagg

SEQ ID NO: 3207414 - RNA, 23 nt, Human
cacucuuggagccugcagagcug

SEQ ID NO: 3207415 - RNA, 14 nt, Human
cacucuuguuucuc

SEQ ID NO: 3207416 - RNA, 21 nt, Human
cacucuuguuucucccgugcu

SEQ ID NO: 3207417 - RNA, 15 nt, Human
cacucuuuaccuuua

SEQ ID NO: 3207418 - RNA, 19 nt, Human
cacucuuuaccuuuauuga

SEQ ID NO: 3207419 - RNA, 22 nt, Human
cacucuuggagccugcagagcu

SEQ ID NO: 3207420 - RNA, 21 nt, Human
cacucuuggagccugcagagc

SEQ ID NO: 3207421 - RNA, 14 nt, Human
cacuccccugcugg

SEQ ID NO: 3207422 - RNA, 12 nt, Human
cacuccccugcu

SEQ ID NO: 3207423 - RNA, 13 nt, Human
cacuccccugcug

SEQ ID NO: 3207424 - RNA, 22 nt, Human
cacugaauuuuuaugugugauu

SEQ ID NO: 3207425 - RNA, 20 nt, Human
cacugaaucuguacagagcc

SEQ ID NO: 3207426 - RNA, 17 nt, Human
cacugaaucuguacaga

SEQ ID NO: 3207427 - RNA, 16 nt, Human
cacugaaucuguacag

SEQ ID NO: 3207428 - RNA, 15 nt, Human
cacugaaucuguaca

SEQ ID NO: 3207429 - RNA, 14 nt, Human
cacugaaucuguac

SEQ ID NO: 3207430 - RNA, 13 nt, Human
cacugaaucugua

SEQ ID NO: 3207431 - RNA, 21 nt, Human
cacugaaguuugauaaauagu

SEQ ID NO: 3207432 - RNA, 15 nt, Human
cacugaaguuugaua

SEQ ID NO: 3207433 - RNA, 22 nt, Human
cacugaaguuugauaaauagug

SEQ ID NO: 3207434 - RNA, 15 nt, Human
cacugaaucccugua

SEQ ID NO: 3207435 - RNA, 21 nt, Human
cacuagggcagggacaggaua

SEQ ID NO: 3207436 - RNA, 20 nt, Human
cacuagggcagggacaggau

SEQ ID NO: 3207437 - RNA, 14 nt, Human
cacuaggcuucugg

SEQ ID NO: 3207438 - RNA, 16 nt, Human
cacuccagccugggug

SEQ ID NO: 3207439 - RNA, 11 nt, Human
cacuccagcug

SEQ ID NO: 3207440 - RNA, 12 nt, Human
cacuccagcugg

SEQ ID NO: 3207441 - RNA, 15 nt, Human
cacuccagcugggau

SEQ ID NO: 3207442 - RNA, 15 nt, Human
cacuccaagccagca

SEQ ID NO: 3207443 - RNA, 11 nt, Human
caccccagccc

SEQ ID NO: 3207444 - RNA, 16 nt, Human
caccccaccugcgcuu

SEQ ID NO: 3207445 - RNA, 13 nt, Human
caccccaccugcg

SEQ ID NO: 3207446 - RNA, 12 nt, Human
caccccaccugc

SEQ ID NO: 3207447 - RNA, 14 nt, Human
cacccucaggcagg

SEQ ID NO: 3207448 - RNA, 20 nt, Human
cacccuccccuucccagggc

SEQ ID NO: 3207449 - RNA, 16 nt, Human
cacccuccccuuccca

SEQ ID NO: 3207450 - RNA, 16 nt, Human
cacccuggggagaaag

SEQ ID NO: 3207451 - RNA, 15 nt, Human
cacccuggggagaaa

SEQ ID NO: 3207452 - RNA, 17 nt, Human
cacccugaaagcccuga

SEQ ID NO: 3207453 - RNA, 21 nt, Human
cacccugaacaacgagccuuu

SEQ ID NO: 3207454 - RNA, 15 nt, Human
caccugccccucaac

SEQ ID NO: 3207455 - RNA, 14 nt, Human
caccugccccucaa

SEQ ID NO: 3207456 - RNA, 13 nt, Human
caccucagccucc

SEQ ID NO: 3207457 - RNA, 12 nt, Human
caccucagccuc

SEQ ID NO: 3207458 - RNA, 14 nt, Human
caccucagccuccc

SEQ ID NO: 3207459 - RNA, 15 nt, Human
caccuaauuaauuuc

SEQ ID NO: 3207460 - RNA, 13 nt, Human
caccuuggcugca

SEQ ID NO: 3207461 - RNA, 15 nt, Human
caccuuggcucaagu

SEQ ID NO: 3207462 - RNA, 14 nt, Human
caccuuggcucaag

SEQ ID NO: 3207463 - RNA, 19 nt, Human
caccugccuguugggccag

SEQ ID NO: 3207464 - RNA, 17 nt, Human
caccugccuguugggcc

SEQ ID NO: 3207465 - RNA, 12 nt, Human
caauggcagccu

SEQ ID NO: 3207466 - RNA, 11 nt, Human
caauggcagcc

SEQ ID NO: 3207467 - RNA, 23 nt, Human
caauuuaaguguuggaaaaaauu

SEQ ID NO: 3207468 - RNA, 20 nt, Human
caauggagacugucucaaga

SEQ ID NO: 3207469 - RNA, 14 nt, Human
cacaagagcccagg

SEQ ID NO: 3207470 - RNA, 16 nt, Human
cacaagagcccaggcc

SEQ ID NO: 3207471 - RNA, 13 nt, Human
cacaagcuccaag

SEQ ID NO: 3207472 - RNA, 14 nt, Human
cacaagcuccaagc

SEQ ID NO: 3207473 - RNA, 15 nt, Human
cacaagcuccaagcu

SEQ ID NO: 3207474 - RNA, 17 nt, Human
cacaagcugcacccuca

SEQ ID NO: 3207475 - RNA, 23 nt, Human
cacaagcugcacccucaggcagg

SEQ ID NO: 3207476 - RNA, 17 nt, Human
cacaagcuccaagcucc

SEQ ID NO: 3207477 - RNA, 23 nt, Human
cacaagcuccaagcucccaggca

SEQ ID NO: 3207478 - RNA, 21 nt, Human
cacaagcuccaagcucccagg

SEQ ID NO: 3207479 - RNA, 20 nt, Human
cacacagcucuguccuggga

SEQ ID NO: 3207480 - RNA, 17 nt, Human
cacacagcucuguccug

SEQ ID NO: 3207481 - RNA, 14 nt, Human
cacagccugcacuu

SEQ ID NO: 3207482 - RNA, 13 nt, Human
cacagccugcacu

SEQ ID NO: 3207483 - RNA, 23 nt, Human
cacagccugcacuugggggcuca

SEQ ID NO: 3207484 - RNA, 22 nt, Human
cacagccugcacuugggggcuc

SEQ ID NO: 3207485 - RNA, 22 nt, Human
cacaggcccuuccucuccacug

SEQ ID NO: 3207486 - RNA, 23 nt, Human
cacaggcccuuccucuccacugc

SEQ ID NO: 3207487 - RNA, 17 nt, Human
cacaggggaaaagagga

SEQ ID NO: 3207488 - RNA, 18 nt, Human
cacaggggaaaagaggag

SEQ ID NO: 3207489 - RNA, 19 nt, Human
cacaggggaaaagaggagu

SEQ ID NO: 3207490 - RNA, 17 nt, Human
cacaggggacacccaga

SEQ ID NO: 3207491 - RNA, 15 nt, Human
cacaggugcccgcca

SEQ ID NO: 3207492 - RNA, 19 nt, Human
cacaguauuacuucugcua

SEQ ID NO: 3207493 - RNA, 17 nt, Human
cacagucagguugaaga

SEQ ID NO: 3207494 - RNA, 14 nt, Human
cacagucagguuga

SEQ ID NO: 3207495 - RNA, 21 nt, Human
cacaguauuacuucugcuaca

SEQ ID NO: 3207496 - RNA, 20 nt, Human
cacaguauuacuucugcuac

SEQ ID NO: 3207497 - RNA, 14 nt, Human
cacaguaaaaauaa

SEQ ID NO: 3207498 - RNA, 15 nt, Human
cacaguaaaaauaaa

SEQ ID NO: 3207499 - RNA, 16 nt, Human
cacaguaaaaauaaaa

SEQ ID NO: 3207500 - RNA, 17 nt, Human
cacaguaaaaauaaaau

SEQ ID NO: 3207501 - RNA, 18 nt, Human
cacaggugcccgccacca

SEQ ID NO: 3207502 - RNA, 22 nt, Human
cacacaucaucuguaagcuguu

SEQ ID NO: 3207503 - RNA, 21 nt, Human
cacacaucaucuguaagcugu

SEQ ID NO: 3207504 - RNA, 15 nt, Human
cacacaucaucugua

SEQ ID NO: 3207505 - RNA, 14 nt, Human
cacacaucaucugu

SEQ ID NO: 3207506 - RNA, 20 nt, Human
cacacaugagcaucaggcca

SEQ ID NO: 3207507 - RNA, 23 nt, Human
cacacagugagucgaggacaggg

SEQ ID NO: 3207508 - RNA, 21 nt, Human
cacacagugagucgaggacag

SEQ ID NO: 3207509 - RNA, 15 nt, Human
cacacauacacacac

SEQ ID NO: 3207510 - RNA, 16 nt, Human
cacacagcucuguccu

SEQ ID NO: 3207511 - RNA, 23 nt, Human
cacacaguauuacuucugcuaca

SEQ ID NO: 3207512 - RNA, 20 nt, Human
cacacaguauuacuucugcu

SEQ ID NO: 3207513 - RNA, 18 nt, Human
cacacagugagucgagga

SEQ ID NO: 3207514 - RNA, 23 nt, Human
cacagaaaauggaagacagcucu

SEQ ID NO: 3207515 - RNA, 19 nt, Human
cacagaaaauucuucucca

SEQ ID NO: 3207516 - RNA, 13 nt, Human
cacagacccugcc

SEQ ID NO: 3207517 - RNA, 11 nt, Human
cacagccucug

SEQ ID NO: 3207518 - RNA, 21 nt, Human
cacacaugagcaucaggccag

SEQ ID NO: 3207519 - RNA, 22 nt, Human
cacacaugagcaucaggccagg

SEQ ID NO: 3207520 - RNA, 15 nt, Human
cacacaugcaaggga

SEQ ID NO: 3207521 - RNA, 18 nt, Human
cacagaaaauggaagaca

SEQ ID NO: 3207522 - RNA, 19 nt, Human
cacagaaaauggaagacag

SEQ ID NO: 3207523 - RNA, 20 nt, Human
cacagaaaauggaagacagc

SEQ ID NO: 3207524 - RNA, 22 nt, Human
cacagaaaauggaagacagcuc

SEQ ID NO: 3207525 - RNA, 14 nt, Human
caaguccaagcaua

SEQ ID NO: 3207526 - RNA, 13 nt, Human
caagucaagugaa

SEQ ID NO: 3207527 - RNA, 17 nt, Human
caagucaagugaaaaag

SEQ ID NO: 3207528 - RNA, 21 nt, Human
caaguaugaauaaagacaccu

SEQ ID NO: 3207529 - RNA, 19 nt, Human
caaguaugaauaaagacac

SEQ ID NO: 3207530 - RNA, 15 nt, Human
caaggccaaaggaag

SEQ ID NO: 3207531 - RNA, 16 nt, Human
caaggccaaaggaagc

SEQ ID NO: 3207532 - RNA, 17 nt, Human
caaggccaaaggaagca

SEQ ID NO: 3207533 - RNA, 18 nt, Human
caaggccaaaggaagcac

SEQ ID NO: 3207534 - RNA, 16 nt, Human
caaguaugaauaaaga

SEQ ID NO: 3207535 - RNA, 17 nt, Human
caaguaguucuguauuu

SEQ ID NO: 3207536 - RNA, 13 nt, Human
caaguaguucugu

SEQ ID NO: 3207537 - RNA, 18 nt, Human
caaguaguucuguauuug

SEQ ID NO: 3207538 - RNA, 19 nt, Human
caaguaguucuguauuuga

SEQ ID NO: 3207539 - RNA, 20 nt, Human
caaguaguucuguauuugaa

SEQ ID NO: 3207540 - RNA, 21 nt, Human
caaguaguucuguauuugaaa

SEQ ID NO: 3207541 - RNA, 23 nt, Human
caaguaguucuguauuugaaagu

SEQ ID NO: 3207542 - RNA, 14 nt, Human
caaguauaaacuuu

SEQ ID NO: 3207543 - RNA, 14 nt, Human
caagcugcacccuc

SEQ ID NO: 3207544 - RNA, 18 nt, Human
caagcugcacccucaggc

SEQ ID NO: 3207545 - RNA, 13 nt, Human
caagcugcacccu

SEQ ID NO: 3207546 - RNA, 14 nt, Human
caagcucugcuccu

SEQ ID NO: 3207547 - RNA, 12 nt, Human
caagcuccaagc

SEQ ID NO: 3207548 - RNA, 13 nt, Human
caagcucugcucc

SEQ ID NO: 3207549 - RNA, 19 nt, Human
caagcucuaucaccaagga

SEQ ID NO: 3207550 - RNA, 18 nt, Human
caagcucacuugcuuuag

SEQ ID NO: 3207551 - RNA, 14 nt, Human
caagcucacuugcu

SEQ ID NO: 3207552 - RNA, 17 nt, Human
caauaaagcaauaagaa

SEQ ID NO: 3207553 - RNA, 11 nt, Human
caauaaagcaa

SEQ ID NO: 3207554 - RNA, 20 nt, Human
caaguccccgucugccuggc

SEQ ID NO: 3207555 - RNA, 16 nt, Human
caauaaaguauaaugu

SEQ ID NO: 3207556 - RNA, 18 nt, Human
caauaaaguauaauguuu

SEQ ID NO: 3207557 - RNA, 20 nt, Human
caauaaaguauaauguuuau

SEQ ID NO: 3207558 - RNA, 18 nt, Human
caagcgugagccacugca

SEQ ID NO: 3207559 - RNA, 17 nt, Human
auugauaaccauagcau

SEQ ID NO: 3207560 - RNA, 21 nt, Human
auugauaagaaccuuuugagu

SEQ ID NO: 3207561 - RNA, 22 nt, Human
auugagucauuuuauauaugaa

SEQ ID NO: 3207562 - RNA, 17 nt, Human
auugaguuccaguugaa

SEQ ID NO: 3207563 - RNA, 17 nt, Human
auugaguucuuccugua

SEQ ID NO: 3207564 - RNA, 19 nt, Human
auugaguucuuccuguaau

SEQ ID NO: 3207565 - RNA, 20 nt, Human
auugaguucuuccuguaauc

SEQ ID NO: 3207566 - RNA, 22 nt, Human
auugaguucuuccuguaaucuu

SEQ ID NO: 3207567 - RNA, 22 nt, Human
auugcuacuguccuacccaccc

SEQ ID NO: 3207568 - RNA, 20 nt, Human
auugcuacuguccuacccac

SEQ ID NO: 3207569 - RNA, 17 nt, Human
auugauaugcuuauaca

SEQ ID NO: 3207570 - RNA, 20 nt, Human
auugauaucuccaugaugau

SEQ ID NO: 3207571 - RNA, 15 nt, Human
auugcuacuguccua

SEQ ID NO: 3207572 - RNA, 14 nt, Human
auugcuacuguccu

SEQ ID NO: 3207573 - RNA, 13 nt, Human
auugauagaauaa

SEQ ID NO: 3207574 - RNA, 15 nt, Human
auucuucugaucacu

SEQ ID NO: 3207575 - RNA, 12 nt, Human
auucuucugauc

SEQ ID NO: 3207576 - RNA, 11 nt, Human
auucuuuccug

SEQ ID NO: 3207577 - RNA, 22 nt, Human
auucuugaugaaaagcuuuguu

SEQ ID NO: 3207578 - RNA, 21 nt, Human
auucuugaugaaaagcuuugu

SEQ ID NO: 3207579 - RNA, 17 nt, Human
auucuugaucaguaguu

SEQ ID NO: 3207580 - RNA, 21 nt, Human
auucuugaucaguaguuugca

SEQ ID NO: 3207581 - RNA, 19 nt, Human
auucuugaucaguaguuug

SEQ ID NO: 3207582 - RNA, 18 nt, Human
auucuugaugaaaagcuu

SEQ ID NO: 3207583 - RNA, 14 nt, Human
auucuugaugaaaa

SEQ ID NO: 3207584 - RNA, 10 nt, Human
auucuugaug

SEQ ID NO: 3207585 - RNA, 22 nt, Human
auucuugaucaguaguuugcau

SEQ ID NO: 3207586 - RNA, 12 nt, Human
auucuucugcuu

SEQ ID NO: 3207587 - RNA, 11 nt, Human
auucuucugcu

SEQ ID NO: 3207588 - RNA, 23 nt, Human
auucugaauuaauuaauuuggag

SEQ ID NO: 3207589 - RNA, 12 nt, Human
auucucuuuuca

SEQ ID NO: 3207590 - RNA, 14 nt, Human
auucugaaguuaua

SEQ ID NO: 3207591 - RNA, 12 nt, Human
auucugaaguua

SEQ ID NO: 3207592 - RNA, 22 nt, Human
auucugaaguuauauuuccuau

SEQ ID NO: 3207593 - RNA, 20 nt, Human
auucugaaguuauauuuccu

SEQ ID NO: 3207594 - RNA, 18 nt, Human
auucugaaguuauauuuc

SEQ ID NO: 3207595 - RNA, 15 nt, Human
auucugaaguuauau

SEQ ID NO: 3207596 - RNA, 13 nt, Human
auucauacuuaaa

SEQ ID NO: 3207597 - RNA, 14 nt, Human
auucauacuuaaaa

SEQ ID NO: 3207598 - RNA, 20 nt, Human
auucauacuuaaaaauuuau

SEQ ID NO: 3207599 - RNA, 21 nt, Human
auucauacuuaaaaauuuauu

SEQ ID NO: 3207600 - RNA, 20 nt, Human
auuguaauguugugaauaau

SEQ ID NO: 3207601 - RNA, 17 nt, Human
auuguaauguugugaau

SEQ ID NO: 3207602 - RNA, 14 nt, Human
auuguaauguugug

SEQ ID NO: 3207603 - RNA, 12 nt, Human
auuguaauguug

SEQ ID NO: 3207604 - RNA, 15 nt, Human
auuguaauauagaaa

SEQ ID NO: 3207605 - RNA, 22 nt, Human
auuguaauauagaaaaaaacau

SEQ ID NO: 3207606 - RNA, 13 nt, Human
auuguaaaauggu

SEQ ID NO: 3207607 - RNA, 14 nt, Human
auuguaaaauggug

SEQ ID NO: 3207608 - RNA, 18 nt, Human
auuguaauuaauaauaga

SEQ ID NO: 3207609 - RNA, 23 nt, Human
auuguaauguugugaauaauuac

SEQ ID NO: 3207610 - RNA, 22 nt, Human
auuguaauguugugaauaauua

SEQ ID NO: 3207611 - RNA, 14 nt, Human
auugugugaacuug

SEQ ID NO: 3207612 - RNA, 20 nt, Human
auugugugauauuucagaaa

SEQ ID NO: 3207613 - RNA, 18 nt, Human
auugugugauauuucaga

SEQ ID NO: 3207614 - RNA, 21 nt, Human
auugugucucuugguccugcu

SEQ ID NO: 3207615 - RNA, 23 nt, Human
auugugucucuugguccugcugc

SEQ ID NO: 3207616 - RNA, 16 nt, Human
auuguuagucucuuga

SEQ ID NO: 3207617 - RNA, 15 nt, Human
auuguucaauuccca

SEQ ID NO: 3207618 - RNA, 15 nt, Human
auuguuagauguuug

SEQ ID NO: 3207619 - RNA, 16 nt, Human
auuguuagauguuugu

SEQ ID NO: 3207620 - RNA, 15 nt, Human
auuguuacuccauau

SEQ ID NO: 3207621 - RNA, 13 nt, Human
auuguuauuaaau

SEQ ID NO: 3207622 - RNA, 14 nt, Human
auuguuauuaaaug

SEQ ID NO: 3207623 - RNA, 15 nt, Human
auugcugauggugca

SEQ ID NO: 3207624 - RNA, 16 nt, Human
auugcugauggugcaa

SEQ ID NO: 3207625 - RNA, 18 nt, Human
auugcugauggugcaaug

SEQ ID NO: 3207626 - RNA, 19 nt, Human
auugcugauggugcaauga

SEQ ID NO: 3207627 - RNA, 20 nt, Human
auugcuccugcucagaucuu

SEQ ID NO: 3207628 - RNA, 22 nt, Human
auugcucaucucaguccucaaa

SEQ ID NO: 3207629 - RNA, 13 nt, Human
auugcucacaguu

SEQ ID NO: 3207630 - RNA, 21 nt, Human
auugcucacaguuauuacaua

SEQ ID NO: 3207631 - RNA, 17 nt, Human
auugcucacaguuauua

SEQ ID NO: 3207632 - RNA, 12 nt, Human
auugcuccuuga

SEQ ID NO: 3207633 - RNA, 21 nt, Human
auugcugaauggaguuaaacu

SEQ ID NO: 3207634 - RNA, 14 nt, Human
auugcuugagcuca

SEQ ID NO: 3207635 - RNA, 14 nt, Human
auugcuucuucuga

SEQ ID NO: 3207636 - RNA, 13 nt, Human
auugcuucuucug

SEQ ID NO: 3207637 - RNA, 10 nt, Human
auugcuucuu

SEQ ID NO: 3207638 - RNA, 23 nt, Human
auugcugauggugcaaugaccuu

SEQ ID NO: 3207639 - RNA, 12 nt, Human
auugcugcuuga

SEQ ID NO: 3207640 - RNA, 22 nt, Human
auuguuguccgguuuacuuuaa

SEQ ID NO: 3207641 - RNA, 20 nt, Human
auuguugcauagguuagaua

SEQ ID NO: 3207642 - RNA, 19 nt, Human
auucauaaugacuuaagca

SEQ ID NO: 3207643 - RNA, 19 nt, Human
auucauagcagcuuauuca

SEQ ID NO: 3207644 - RNA, 22 nt, Human
auucauagcagcuuauucacaa

SEQ ID NO: 3207645 - RNA, 14 nt, Human
auucauaaugacuu

SEQ ID NO: 3207646 - RNA, 15 nt, Human
auucauaaugacuua

SEQ ID NO: 3207647 - RNA, 16 nt, Human
auuagggagagaagau

SEQ ID NO: 3207648 - RNA, 17 nt, Human
auuagggcucuaauuuc

SEQ ID NO: 3207649 - RNA, 15 nt, Human
auuagguauaucucc

SEQ ID NO: 3207650 - RNA, 19 nt, Human
auucacaagacccaaaagg

SEQ ID NO: 3207651 - RNA, 19 nt, Human
auucacaaguuaagauucu

SEQ ID NO: 3207652 - RNA, 21 nt, Human
auucacaaguuaagauucuug

SEQ ID NO: 3207653 - RNA, 23 nt, Human
auucacaaguuaagauucuuggu

SEQ ID NO: 3207654 - RNA, 16 nt, Human
auucacacuugaacca

SEQ ID NO: 3207655 - RNA, 18 nt, Human
auucacaccccaccugcg

SEQ ID NO: 3207656 - RNA, 17 nt, Human
auucacaccccaccugc

SEQ ID NO: 3207657 - RNA, 16 nt, Human
auucacaccccaccug

SEQ ID NO: 3207658 - RNA, 15 nt, Human
auucacaccccaccu

SEQ ID NO: 3207659 - RNA, 14 nt, Human
auucacaccccacc

SEQ ID NO: 3207660 - RNA, 14 nt, Human
auucacaauuauuc

SEQ ID NO: 3207661 - RNA, 17 nt, Human
auucaauuaaagaaaua

SEQ ID NO: 3207662 - RNA, 12 nt, Human
auucaauuaaag

SEQ ID NO: 3207663 - RNA, 22 nt, Human
auucaauuaaagaaauaauuuu

SEQ ID NO: 3207664 - RNA, 21 nt, Human
auucaauuaaagaaauaauuu

SEQ ID NO: 3207665 - RNA, 19 nt, Human
auucaauuaaagaaauaau

SEQ ID NO: 3207666 - RNA, 18 nt, Human
auucaauuaaagaaauaa

SEQ ID NO: 3207667 - RNA, 18 nt, Human
auuacaacugaccaaguu

SEQ ID NO: 3207668 - RNA, 20 nt, Human
auuacaagccuggaaaaaaa

SEQ ID NO: 3207669 - RNA, 16 nt, Human
auuaauuaucgugucu

SEQ ID NO: 3207670 - RNA, 17 nt, Human
auuaauguugauuucua

SEQ ID NO: 3207671 - RNA, 16 nt, Human
auuaauguugauuucu

SEQ ID NO: 3207672 - RNA, 15 nt, Human
auuaauuaauuugga

SEQ ID NO: 3207673 - RNA, 16 nt, Human
auuaauuaauuuggag

SEQ ID NO: 3207674 - RNA, 14 nt, Human
auuaauucucuuuc

SEQ ID NO: 3207675 - RNA, 12 nt, Human
auuaauguugau

SEQ ID NO: 3207676 - RNA, 15 nt, Human
auuaauguugauuuc

SEQ ID NO: 3207677 - RNA, 14 nt, Human
auuaauguugauuu

SEQ ID NO: 3207678 - RNA, 15 nt, Human
auuacagugccuaaa

SEQ ID NO: 3207679 - RNA, 23 nt, Human
auuacagucucacucagaacugu

SEQ ID NO: 3207680 - RNA, 19 nt, Human
auuacagugccuaaaauaa

SEQ ID NO: 3207681 - RNA, 18 nt, Human
auuacagugccuaaaaua

SEQ ID NO: 3207682 - RNA, 16 nt, Human
auuacaggugugaacc

SEQ ID NO: 3207683 - RNA, 17 nt, Human
auuacaggaaguacugg

SEQ ID NO: 3207684 - RNA, 17 nt, Human
auuagcaguuugcuuug

SEQ ID NO: 3207685 - RNA, 20 nt, Human
auuagauuuuaaaacuucau

SEQ ID NO: 3207686 - RNA, 23 nt, Human
auuagauuucucauuugccaaua

SEQ ID NO: 3207687 - RNA, 22 nt, Human
auuagcaaaaaaaguuguauga

SEQ ID NO: 3207688 - RNA, 21 nt, Human
auuagcaaaaaaaguuguaug

SEQ ID NO: 3207689 - RNA, 20 nt, Human
auuagcaaaaaaaguuguau

SEQ ID NO: 3207690 - RNA, 19 nt, Human
auuagcaaaaaaaguugua

SEQ ID NO: 3207691 - RNA, 18 nt, Human
auuagcaaaaaaaguugu

SEQ ID NO: 3207692 - RNA, 17 nt, Human
auuagcaaaaaaaguug

SEQ ID NO: 3207693 - RNA, 16 nt, Human
auuagcaaaaaaaguu

SEQ ID NO: 3207694 - RNA, 14 nt, Human
auuagcaaaaaaag

SEQ ID NO: 3207695 - RNA, 20 nt, Human
auuagcgacaacagauugga

SEQ ID NO: 3207696 - RNA, 15 nt, Human
auuagcccugcauuu

SEQ ID NO: 3207697 - RNA, 17 nt, Human
auuagcccugcauuuuc

SEQ ID NO: 3207698 - RNA, 22 nt, Human
auguuugugcaguaacuuggga

SEQ ID NO: 3207699 - RNA, 23 nt, Human
auguuugggagacugcugaguca

SEQ ID NO: 3207700 - RNA, 19 nt, Human
auguuugugcaguaacuug

SEQ ID NO: 3207701 - RNA, 17 nt, Human
auguuugugcaguaacu

SEQ ID NO: 3207702 - RNA, 18 nt, Human
auguuuguacaagauugu

SEQ ID NO: 3207703 - RNA, 14 nt, Human
auguuuguacaaga

SEQ ID NO: 3207704 - RNA, 17 nt, Human
auguuugguaccaagaa

SEQ ID NO: 3207705 - RNA, 16 nt, Human
auuugcuaugagcugg

SEQ ID NO: 3207706 - RNA, 20 nt, Human
auuugcuaugagcuggggau

SEQ ID NO: 3207707 - RNA, 21 nt, Human
auuugccauagaguacacugc

SEQ ID NO: 3207708 - RNA, 16 nt, Human
auuugccaauaauaau

SEQ ID NO: 3207709 - RNA, 13 nt, Human
auuugccauagag

SEQ ID NO: 3207710 - RNA, 15 nt, Human
auuugccauagagua

SEQ ID NO: 3207711 - RNA, 15 nt, Human
auuugccaauaauaa

SEQ ID NO: 3207712 - RNA, 19 nt, Human
auuugauuuuuauuauuaa

SEQ ID NO: 3207713 - RNA, 16 nt, Human
auuugauuuguacaga

SEQ ID NO: 3207714 - RNA, 22 nt, Human
auuugauuuauuaacuuaauaa

SEQ ID NO: 3207715 - RNA, 17 nt, Human
auuugauuuauuaacuu

SEQ ID NO: 3207716 - RNA, 18 nt, Human
auuugauuuauuaacuua

SEQ ID NO: 3207717 - RNA, 14 nt, Human
auuugauuuauuaa

SEQ ID NO: 3207718 - RNA, 15 nt, Human
auuugauuuauuaac

SEQ ID NO: 3207719 - RNA, 16 nt, Human
auuugcagcuuccaau

SEQ ID NO: 3207720 - RNA, 9 nt, Human
auuugcagu

SEQ ID NO: 3207721 - RNA, 10 nt, Human
auuugcaguc

SEQ ID NO: 3207722 - RNA, 22 nt, Human
auuuguggggagggauuugggg

SEQ ID NO: 3207723 - RNA, 15 nt, Human
auuuguggugauuug

SEQ ID NO: 3207724 - RNA, 15 nt, Human
auuugugugcuaaac

SEQ ID NO: 3207725 - RNA, 14 nt, Human
auuugugugcuaaa

SEQ ID NO: 3207726 - RNA, 16 nt, Human
auuuguugauucucuc

SEQ ID NO: 3207727 - RNA, 20 nt, Human
auuuguuggggcuuuacaua

SEQ ID NO: 3207728 - RNA, 18 nt, Human
auuuguugauucucucca

SEQ ID NO: 3207729 - RNA, 14 nt, Human
auuuguuuaaagua

SEQ ID NO: 3207730 - RNA, 18 nt, Human
auuuuauaguguguugug

SEQ ID NO: 3207731 - RNA, 16 nt, Human
auuuguuuccagcaug

SEQ ID NO: 3207732 - RNA, 23 nt, Human
auuuguuugguuauagugcaaua

SEQ ID NO: 3207733 - RNA, 21 nt, Human
auuuguuugguuauagugcaa

SEQ ID NO: 3207734 - RNA, 13 nt, Human
auuugcuccuuuc

SEQ ID NO: 3207735 - RNA, 15 nt, Human
auuugcuaucucuau

SEQ ID NO: 3207736 - RNA, 21 nt, Human
auuugcugacaaccauuaaag

SEQ ID NO: 3207737 - RNA, 22 nt, Human
auuugcugacaaccauuaaagu

SEQ ID NO: 3207738 - RNA, 23 nt, Human
auuugcugacaaccauuaaaguc

SEQ ID NO: 3207739 - RNA, 11 nt, Human
auuugcugcug

SEQ ID NO: 3207740 - RNA, 12 nt, Human
auuugcugcuga

SEQ ID NO: 3207741 - RNA, 22 nt, Human
auuugcuuaaauauccauauua

SEQ ID NO: 3207742 - RNA, 12 nt, Human
auuuggaaaaua

SEQ ID NO: 3207743 - RNA, 13 nt, Human
auuuggaaaauaa

SEQ ID NO: 3207744 - RNA, 15 nt, Human
auuuggaaacuaaua

SEQ ID NO: 3207745 - RNA, 16 nt, Human
auuuggaaacuaauaa

SEQ ID NO: 3207746 - RNA, 17 nt, Human
auuuggaaacuaauaaa

SEQ ID NO: 3207747 - RNA, 18 nt, Human
auuuggaaacuaauaaaa

SEQ ID NO: 3207748 - RNA, 19 nt, Human
auuuggaaacuaauaaaau

SEQ ID NO: 3207749 - RNA, 20 nt, Human
auuuggaaacuaauaaaaua

SEQ ID NO: 3207750 - RNA, 21 nt, Human
auuuggaaacuaauaaaauau

SEQ ID NO: 3207751 - RNA, 22 nt, Human
auuuggaaacuaauaaaauauu

SEQ ID NO: 3207752 - RNA, 23 nt, Human
auuuggaaacuaauaaaauauuu

SEQ ID NO: 3207753 - RNA, 13 nt, Human
auuugcuuuggaa

SEQ ID NO: 3207754 - RNA, 15 nt, Human
auuugcucauaugaa

SEQ ID NO: 3207755 - RNA, 15 nt, Human
auuugcuuuggaagu

SEQ ID NO: 3207756 - RNA, 14 nt, Human
auuugcuuuggaag

SEQ ID NO: 3207757 - RNA, 17 nt, Human
auuugugauguacugua

SEQ ID NO: 3207758 - RNA, 14 nt, Human
auuugugccagaau

SEQ ID NO: 3207759 - RNA, 15 nt, Human
caaacagaggccgcc

SEQ ID NO: 3207760 - RNA, 18 nt, Human
caaacagauucuuuuaug

SEQ ID NO: 3207761 - RNA, 16 nt, Human
caaacagaugcucuga

SEQ ID NO: 3207762 - RNA, 19 nt, Human
caaaaggcuugcagaacuu

SEQ ID NO: 3207763 - RNA, 15 nt, Human
caaaaggcuugcaga

SEQ ID NO: 3207764 - RNA, 17 nt, Human
caaacccacccuuucua

SEQ ID NO: 3207765 - RNA, 21 nt, Human
caaaccaucauugaaaucuuu

SEQ ID NO: 3207766 - RNA, 19 nt, Human
caaaccaucauugaaaucu

SEQ ID NO: 3207767 - RNA, 15 nt, Human
caaaaggcagaagca

SEQ ID NO: 3207768 - RNA, 21 nt, Human
caaaaggcauuucccacccug

SEQ ID NO: 3207769 - RNA, 17 nt, Human
caaaaggcauuucccac

SEQ ID NO: 3207770 - RNA, 18 nt, Human
caaaagaugcuucucacu

SEQ ID NO: 3207771 - RNA, 20 nt, Human
caaaaaaaaaaaaaaauuag

SEQ ID NO: 3207772 - RNA, 18 nt, Human
auuuuuuuuuuuaaucua

SEQ ID NO: 3207773 - RNA, 21 nt, Human
auuuuuuuuuuuaaucuacug

SEQ ID NO: 3207774 - RNA, 16 nt, Human
caaaagaugcuucuca

SEQ ID NO: 3207775 - RNA, 20 nt, Human
caaaagaguguaaaauauuu

SEQ ID NO: 3207776 - RNA, 19 nt, Human
caaaagaguguaaaauauu

SEQ ID NO: 3207777 - RNA, 18 nt, Human
caaaagaguguaaaauau

SEQ ID NO: 3207778 - RNA, 16 nt, Human
caaaagaguguaaaau

SEQ ID NO: 3207779 - RNA, 15 nt, Human
caaaagaguguaaaa

SEQ ID NO: 3207780 - RNA, 23 nt, Human
auuuuuuuuuccuucagugccuu

SEQ ID NO: 3207781 - RNA, 16 nt, Human
auuuuuuuuucuuuca

SEQ ID NO: 3207782 - RNA, 17 nt, Human
caacaaucccaaggccc

SEQ ID NO: 3207783 - RNA, 14 nt, Human
caacaauucagcau

SEQ ID NO: 3207784 - RNA, 23 nt, Human
caacacgagcaggcuacugucag

SEQ ID NO: 3207785 - RNA, 15 nt, Human
caacacgagcaggcu

SEQ ID NO: 3207786 - RNA, 18 nt, Human
caacaccaucacagcuug

SEQ ID NO: 3207787 - RNA, 22 nt, Human
caacaccaucacagcuuguuuu

SEQ ID NO: 3207788 - RNA, 21 nt, Human
caaauggaaaugggcagagca

SEQ ID NO: 3207789 - RNA, 19 nt, Human
caacaagaauaaaggcagc

SEQ ID NO: 3207790 - RNA, 16 nt, Human
caacaaggcaaaaaca

SEQ ID NO: 3207791 - RNA, 19 nt, Human
caacaaggcuugcugcaga

SEQ ID NO: 3207792 - RNA, 20 nt, Human
caaauggaaaugggcagagc

SEQ ID NO: 3207793 - RNA, 21 nt, Human
caaauggaaacagaggaccag

SEQ ID NO: 3207794 - RNA, 20 nt, Human
caaauggaaacagaggacca

SEQ ID NO: 3207795 - RNA, 14 nt, Human
caaauggaaacaga

SEQ ID NO: 3207796 - RNA, 18 nt, Human
caaauccugcauuuagau

SEQ ID NO: 3207797 - RNA, 15 nt, Human
caaagcagugcaugc

SEQ ID NO: 3207798 - RNA, 17 nt, Human
caaagcagugcaugcug

SEQ ID NO: 3207799 - RNA, 15 nt, Human
caaaguacagaauuu

SEQ ID NO: 3207800 - RNA, 16 nt, Human
caaaguacagaauuug

SEQ ID NO: 3207801 - RNA, 21 nt, Human
caaaguacagguacuuugucu

SEQ ID NO: 3207802 - RNA, 20 nt, Human
caaaguacagguacuuuguc

SEQ ID NO: 3207803 - RNA, 19 nt, Human
caaaguacagguacuuugu

SEQ ID NO: 3207804 - RNA, 17 nt, Human
caaaguacagguacuuu

SEQ ID NO: 3207805 - RNA, 19 nt, Human
caaagucucaaugaaauag

SEQ ID NO: 3207806 - RNA, 21 nt, Human
caaaguagaagucuuagaugu

SEQ ID NO: 3207807 - RNA, 14 nt, Human
caaaguagaagucu

SEQ ID NO: 3207808 - RNA, 22 nt, Human
caaauccaggacccugccaggc

SEQ ID NO: 3207809 - RNA, 21 nt, Human
caaauccaggacccugccagg

SEQ ID NO: 3207810 - RNA, 15 nt, Human
caaauccgaaaucag

SEQ ID NO: 3207811 - RNA, 22 nt, Human
caaagugcuauuacgaaguuca

SEQ ID NO: 3207812 - RNA, 22 nt, Human
caaagcacugacuucuaaguaa

SEQ ID NO: 3207813 - RNA, 20 nt, Human
caaagcacugacuucuaagu

SEQ ID NO: 3207814 - RNA, 18 nt, Human
caaagcaccaaaauaaga

SEQ ID NO: 3207815 - RNA, 17 nt, Human
caaagcaccaaaauaag

SEQ ID NO: 3207816 - RNA, 24 nt, Human
caaagcaccaaaauaagaaaagau

SEQ ID NO: 3207817 - RNA, 22 nt, Human
caaagcaccaaaauaagaaaag

SEQ ID NO: 3207818 - RNA, 21 nt, Human
caaagcaccaaaauaagaaaa

SEQ ID NO: 3207819 - RNA, 19 nt, Human
caaagcaccaaaauaagaa

SEQ ID NO: 3207820 - RNA, 21 nt, Human
caaagcacccauuucaaugug

SEQ ID NO: 3207821 - RNA, 18 nt, Human
caaagcagcaacacacau

SEQ ID NO: 3207822 - RNA, 15 nt, Human
caaagcagagagcau

SEQ ID NO: 3207823 - RNA, 14 nt, Human
caaagaugcagccg

SEQ ID NO: 3207824 - RNA, 17 nt, Human
caaagcaaaccaacaag

SEQ ID NO: 3207825 - RNA, 19 nt, Human
cagccccgugggguuccuc

SEQ ID NO: 3207826 - RNA, 13 nt, Human
cagcccccugguc

SEQ ID NO: 3207827 - RNA, 13 nt, Human
cagccccugcaca

SEQ ID NO: 3207828 - RNA, 21 nt, Human
cagccccucccuccucugaga

SEQ ID NO: 3207829 - RNA, 18 nt, Human
cagccccucccuccucug

SEQ ID NO: 3207830 - RNA, 22 nt, Human
cagccccauucugccugcccag

SEQ ID NO: 3207831 - RNA, 20 nt, Human
cagccccauucugccugccc

SEQ ID NO: 3207832 - RNA, 19 nt, Human
cagccccauucugccugcc

SEQ ID NO: 3207833 - RNA, 24 nt, Human
cagccccauucugccugcccaggc

SEQ ID NO: 3207834 - RNA, 23 nt, Human
cagccccauucugccugcccagg

SEQ ID NO: 3207835 - RNA, 18 nt, Human
cagcggcuggacuuggag

SEQ ID NO: 3207836 - RNA, 16 nt, Human
cagcggcuggacuugg

SEQ ID NO: 3207837 - RNA, 17 nt, Human
cagcggcuggaauuggg

SEQ ID NO: 3207838 - RNA, 17 nt, Human
cagccugccacucaggc

SEQ ID NO: 3207839 - RNA, 16 nt, Human
cagccugccacucagg

SEQ ID NO: 3207840 - RNA, 12 nt, Human
cagccugccacu

SEQ ID NO: 3207841 - RNA, 11 nt, Human
cagccugccac

SEQ ID NO: 3207842 - RNA, 23 nt, Human
cagccugcacuugggggcucagc

SEQ ID NO: 3207843 - RNA, 18 nt, Human
cagccugccuugcccacu

SEQ ID NO: 3207844 - RNA, 21 nt, Human
cagccugccuugcccacuccu

SEQ ID NO: 3207845 - RNA, 20 nt, Human
cagccgccuucacagcaguc

SEQ ID NO: 3207846 - RNA, 18 nt, Human
cagccgccuucacagcag

SEQ ID NO: 3207847 - RNA, 18 nt, Human
cagccgcuccagagucag

SEQ ID NO: 3207848 - RNA, 14 nt, Human
cagccgcuccagag

SEQ ID NO: 3207849 - RNA, 13 nt, Human
cagccgcuccaga

SEQ ID NO: 3207850 - RNA, 13 nt, Human
cagccgccuucac

SEQ ID NO: 3207851 - RNA, 13 nt, Human
cagcccuuagcag

SEQ ID NO: 3207852 - RNA, 23 nt, Human
cagccgccaugcuccuggcccac

SEQ ID NO: 3207853 - RNA, 22 nt, Human
cagccugagcgacagugagacu

SEQ ID NO: 3207854 - RNA, 23 nt, Human
cagccugagcgacagugagacuc

SEQ ID NO: 3207855 - RNA, 24 nt, Human
cagcacauaggguucccacgaagc

SEQ ID NO: 3207856 - RNA, 20 nt, Human
cagccagacuggcacaguuu

SEQ ID NO: 3207857 - RNA, 18 nt, Human
cagcauauucaggaagcu

SEQ ID NO: 3207858 - RNA, 16 nt, Human
cagcauauucaggaag

SEQ ID NO: 3207859 - RNA, 17 nt, Human
cagcauauucaggaagc

SEQ ID NO: 3207860 - RNA, 17 nt, Human
cagcauagaaguaacuu

SEQ ID NO: 3207861 - RNA, 15 nt, Human
cagauuucacucucc

SEQ ID NO: 3207862 - RNA, 16 nt, Human
cagauuucacucuccu

SEQ ID NO: 3207863 - RNA, 19 nt, Human
cagauuugaacucuucaau

SEQ ID NO: 3207864 - RNA, 18 nt, Human
cagauuucacucuccuug

SEQ ID NO: 3207865 - RNA, 13 nt, Human
cagauuucacucu

SEQ ID NO: 3207866 - RNA, 13 nt, Human
cagauuugagcuc

SEQ ID NO: 3207867 - RNA, 14 nt, Human
cagauuugagcuca

SEQ ID NO: 3207868 - RNA, 16 nt, Human
cagauuugagcucagc

SEQ ID NO: 3207869 - RNA, 20 nt, Human
cagauuugcacaaaaagaua

SEQ ID NO: 3207870 - RNA, 17 nt, Human
cagauuugcacaaaaag

SEQ ID NO: 3207871 - RNA, 14 nt, Human
cagauuugcacaaa

SEQ ID NO: 3207872 - RNA, 13 nt, Human
cagauuugcacaa

SEQ ID NO: 3207873 - RNA, 13 nt, Human
cagauuuggaaag

SEQ ID NO: 3207874 - RNA, 21 nt, Human
cagauugcaacaggcugggcu

SEQ ID NO: 3207875 - RNA, 19 nt, Human
cagauugcugaauggaguu

SEQ ID NO: 3207876 - RNA, 12 nt, Human
cagauugcuuuu

SEQ ID NO: 3207877 - RNA, 17 nt, Human
cagauugcuuuugugca

SEQ ID NO: 3207878 - RNA, 15 nt, Human
cagauuggauuuuau

SEQ ID NO: 3207879 - RNA, 12 nt, Human
cagauuggauuu

SEQ ID NO: 3207880 - RNA, 23 nt, Human
cagauuggauuuuauguugacau

SEQ ID NO: 3207881 - RNA, 21 nt, Human
cagauuggauuuuauguugac

SEQ ID NO: 3207882 - RNA, 22 nt, Human
cagauacuacugaccagacaag

SEQ ID NO: 3207883 - RNA, 15 nt, Human
cagauaccaagcaug

SEQ ID NO: 3207884 - RNA, 18 nt, Human
cagauacuacugaccaga

SEQ ID NO: 3207885 - RNA, 23 nt, Human
cagaucauuaucagccugugcca

SEQ ID NO: 3207886 - RNA, 23 nt, Human
cagauacaggaaaagcugcugac

SEQ ID NO: 3207887 - RNA, 17 nt, Human
cagaggucuagauuaau

SEQ ID NO: 3207888 - RNA, 21 nt, Human
cagagcuggcaucuaucuggu

SEQ ID NO: 3207889 - RNA, 16 nt, Human
cagagcugcgggcugg

SEQ ID NO: 3207890 - RNA, 22 nt, Human
cagagcugcggugucucccugc

SEQ ID NO: 3207891 - RNA, 16 nt, Human
cagagcugcuuccccg

SEQ ID NO: 3207892 - RNA, 17 nt, Human
cagagcuacacagggga

SEQ ID NO: 3207893 - RNA, 22 nt, Human
cagagcuacacaggggaaaaga

SEQ ID NO: 3207894 - RNA, 16 nt, Human
cagagcgacagagcag

SEQ ID NO: 3207895 - RNA, 16 nt, Human
cagagagggugggagu

SEQ ID NO: 3207896 - RNA, 13 nt, Human
cagagaggguggg

SEQ ID NO: 3207897 - RNA, 20 nt, Human
cagagagggugggagugggc

SEQ ID NO: 3207898 - RNA, 22 nt, Human
cagagagggugggagugggccc

SEQ ID NO: 3207899 - RNA, 14 nt, Human
cagagccugcaguu

SEQ ID NO: 3207900 - RNA, 17 nt, Human
cagagccugccccagcg

SEQ ID NO: 3207901 - RNA, 15 nt, Human
cagagccugccccag

SEQ ID NO: 3207902 - RNA, 19 nt, Human
cagagccugccccagcgcu

SEQ ID NO: 3207903 - RNA, 14 nt, Human
cagagccugcccca

SEQ ID NO: 3207904 - RNA, 13 nt, Human
cagagccugcccc

SEQ ID NO: 3207905 - RNA, 19 nt, Human
cagagacuccugcaggcag

SEQ ID NO: 3207906 - RNA, 19 nt, Human
cagagagagauacucuggg

SEQ ID NO: 3207907 - RNA, 21 nt, Human
cagagacuccugcaggcagcc

SEQ ID NO: 3207908 - RNA, 22 nt, Human
cagagacuccugcaggcagcca

SEQ ID NO: 3207909 - RNA, 12 nt, Human
cagagagcauua

SEQ ID NO: 3207910 - RNA, 20 nt, Human
cagagacuccugcaggcagc

SEQ ID NO: 3207911 - RNA, 15 nt, Human
caguauuugugggga

SEQ ID NO: 3207912 - RNA, 16 nt, Human
cagucaccccggccac

SEQ ID NO: 3207913 - RNA, 17 nt, Human
cagucaccccggccacc

SEQ ID NO: 3207914 - RNA, 14 nt, Human
cagucaccccggcc

SEQ ID NO: 3207915 - RNA, 23 nt, Human
caguauuuuaguggacccugaaa

SEQ ID NO: 3207916 - RNA, 15 nt, Human
caguauuuuagugga

SEQ ID NO: 3207917 - RNA, 13 nt, Human
caguauuuuagug

SEQ ID NO: 3207918 - RNA, 19 nt, Human
caguauuacuucugcuaca

SEQ ID NO: 3207919 - RNA, 17 nt, Human
caguaaaauuauacugu

SEQ ID NO: 3207920 - RNA, 11 nt, Human
cagguugacag

SEQ ID NO: 3207921 - RNA, 16 nt, Human
cagguugacaggaggu

SEQ ID NO: 3207922 - RNA, 23 nt, Human
cagguuuuuggucugacccacug

SEQ ID NO: 3207923 - RNA, 23 nt, Human
cagguugaagaccuaaccagggc

SEQ ID NO: 3207924 - RNA, 22 nt, Human
cagguugaagaccuaaccaggg

SEQ ID NO: 3207925 - RNA, 15 nt, Human
cagguugaagaccua

SEQ ID NO: 3207926 - RNA, 14 nt, Human
cagguucugaaaga

SEQ ID NO: 3207927 - RNA, 23 nt, Human
cagguucugaaagagucuuucuu

SEQ ID NO: 3207928 - RNA, 18 nt, Human
cagguucugaaagagucu

SEQ ID NO: 3207929 - RNA, 21 nt, Human
caggguuggccccugcccggc

SEQ ID NO: 3207930 - RNA, 17 nt, Human
caggguuggccccugcc

SEQ ID NO: 3207931 - RNA, 14 nt, Human
caggguuggccccu

SEQ ID NO: 3207932 - RNA, 14 nt, Human
caggugcugccauc

SEQ ID NO: 3207933 - RNA, 13 nt, Human
caggugcugccau

SEQ ID NO: 3207934 - RNA, 17 nt, Human
caggugcucaaaaugca

SEQ ID NO: 3207935 - RNA, 20 nt, Human
caggguuucaccauguuggc

SEQ ID NO: 3207936 - RNA, 23 nt, Human
cagggucucacucugucgcccag

SEQ ID NO: 3207937 - RNA, 22 nt, Human
cagggucucacucugucgccca

SEQ ID NO: 3207938 - RNA, 21 nt, Human
cagggucucuaccauccccug

SEQ ID NO: 3207939 - RNA, 21 nt, Human
cagggucucuagugcugugaa

SEQ ID NO: 3207940 - RNA, 20 nt, Human
cagggucucuagugcuguga

SEQ ID NO: 3207941 - RNA, 19 nt, Human
cagggucucuagugcugug

SEQ ID NO: 3207942 - RNA, 22 nt, Human
cagggucucuagugcugugaaa

SEQ ID NO: 3207943 - RNA, 16 nt, Human
caggguuggccccugc

SEQ ID NO: 3207944 - RNA, 15 nt, Human
caggguuggccccug

SEQ ID NO: 3207945 - RNA, 18 nt, Human
cagggugagcccaugugg

SEQ ID NO: 3207946 - RNA, 15 nt, Human
cagggcucagcgggg

SEQ ID NO: 3207947 - RNA, 12 nt, Human
cagggcucagcg

SEQ ID NO: 3207948 - RNA, 16 nt, Human
cagggagggcuucugc

SEQ ID NO: 3207949 - RNA, 17 nt, Human
cagggagggccugggcc

SEQ ID NO: 3207950 - RNA, 18 nt, Human
cagggagggccugggccc

SEQ ID NO: 3207951 - RNA, 22 nt, Human
cagggaggacgcucucuggccu

SEQ ID NO: 3207952 - RNA, 19 nt, Human
cagggaggacgcucucugg

SEQ ID NO: 3207953 - RNA, 21 nt, Human
caggcugggcugggcacugcu

SEQ ID NO: 3207954 - RNA, 14 nt, Human
caggcugggcuuca

SEQ ID NO: 3207955 - RNA, 13 nt, Human
caggcugggcugg

SEQ ID NO: 3207956 - RNA, 12 nt, Human
caggcugggcug

SEQ ID NO: 3207957 - RNA, 19 nt, Human
caggcugggcugggcacug

SEQ ID NO: 3207958 - RNA, 17 nt, Human
caggcugggcugggcac

SEQ ID NO: 3207959 - RNA, 16 nt, Human
caggcugggcugggca

SEQ ID NO: 3207960 - RNA, 14 nt, Human
caggcugggcuggg

SEQ ID NO: 3207961 - RNA, 15 nt, Human
caggcugggagagcc

SEQ ID NO: 3207962 - RNA, 20 nt, Human
caggccugggggcugggcag

SEQ ID NO: 3207963 - RNA, 22 nt, Human
caggccugggggcugggcagag

SEQ ID NO: 3207964 - RNA, 19 nt, Human
caggcuggcgugcaguggu

SEQ ID NO: 3207965 - RNA, 18 nt, Human
caggcuggcgugcagugg

SEQ ID NO: 3207966 - RNA, 23 nt, Human
caggccugggggcugggcagagg

SEQ ID NO: 3207967 - RNA, 17 nt, Human
caggcuggcgugcagug

SEQ ID NO: 3207968 - RNA, 16 nt, Human
caggcugggagagccu

SEQ ID NO: 3207969 - RNA, 18 nt, Human
caggcugggagagccuuc

SEQ ID NO: 3207970 - RNA, 19 nt, Human
caggcugggagagccuucc

SEQ ID NO: 3207971 - RNA, 15 nt, Human
caggcuggcgugcag

SEQ ID NO: 3207972 - RNA, 20 nt, Human
cagggcuggggcagccucug

SEQ ID NO: 3207973 - RNA, 19 nt, Human
cagggcuggggcagccucu

SEQ ID NO: 3207974 - RNA, 15 nt, Human
cagggcuggggcagc

SEQ ID NO: 3207975 - RNA, 21 nt, Human
caggacagggguuccuucugg

SEQ ID NO: 3207976 - RNA, 17 nt, Human
caggacagggguuccuu

SEQ ID NO: 3207977 - RNA, 16 nt, Human
caggacagggguuccu

SEQ ID NO: 3207978 - RNA, 15 nt, Human
caggacagggguucc

SEQ ID NO: 3207979 - RNA, 17 nt, Human
caggacaggagaugcug

SEQ ID NO: 3207980 - RNA, 21 nt, Human
caggacaggagaugcugugcc

SEQ ID NO: 3207981 - RNA, 13 nt, Human
caggaccagggau

SEQ ID NO: 3207982 - RNA, 15 nt, Human
caggacccugccagg

SEQ ID NO: 3207983 - RNA, 14 nt, Human
caggacccugccag

SEQ ID NO: 3207984 - RNA, 13 nt, Human
caggacccugcca

SEQ ID NO: 3207985 - RNA, 12 nt, Human
caggacccugcc

SEQ ID NO: 3207986 - RNA, 19 nt, Human
caggacccugccaggcaca

SEQ ID NO: 3207987 - RNA, 18 nt, Human
caggacccugccaggcac

SEQ ID NO: 3207988 - RNA, 17 nt, Human
caggacccugccaggca

SEQ ID NO: 3207989 - RNA, 16 nt, Human
caggacccugccaggc

SEQ ID NO: 3207990 - RNA, 21 nt, Human
caggacccugccaggcacagg

SEQ ID NO: 3207991 - RNA, 20 nt, Human
caggacccugccaggcacag

SEQ ID NO: 3207992 - RNA, 22 nt, Human
caggacccugccaggcacaggc

SEQ ID NO: 3207993 - RNA, 23 nt, Human
caggccagagggagugacagagg

SEQ ID NO: 3207994 - RNA, 13 nt, Human
caggccagcugcu

SEQ ID NO: 3207995 - RNA, 15 nt, Human
caggccagcugcuug

SEQ ID NO: 3207996 - RNA, 23 nt, Human
caggcacugcugcccagccucca

SEQ ID NO: 3207997 - RNA, 16 nt, Human
caggccacccugugca

SEQ ID NO: 3207998 - RNA, 15 nt, Human
caggccacccugugc

SEQ ID NO: 3207999 - RNA, 17 nt, Human
caggccacccugugcag

SEQ ID NO: 3208000 - RNA, 12 nt, Human
caggaggccagc

SEQ ID NO: 3208001 - RNA, 13 nt, Human
caggaggccagcc

SEQ ID NO: 3208002 - RNA, 20 nt, Human
caggcaaugcuggcuguugg

SEQ ID NO: 3208003 - RNA, 19 nt, Human
caggcaaugcuggcuguug

SEQ ID NO: 3208004 - RNA, 21 nt, Human
caggcaaugcuggcuguuggc

SEQ ID NO: 3208005 - RNA, 17 nt, Human
caggcaaugcuggcugu

SEQ ID NO: 3208006 - RNA, 14 nt, Human
caggaggcagaagg

SEQ ID NO: 3208007 - RNA, 17 nt, Human
caggaggccaagguggg

SEQ ID NO: 3208008 - RNA, 17 nt, Human
caggcacugcugcccag

SEQ ID NO: 3208009 - RNA, 16 nt, Human
caggcacugcugccca

SEQ ID NO: 3208010 - RNA, 13 nt, Human
caggccaggcccu

SEQ ID NO: 3208011 - RNA, 14 nt, Human
caggccaggcccuc

SEQ ID NO: 3208012 - RNA, 15 nt, Human
caggccaggcccucu

SEQ ID NO: 3208013 - RNA, 16 nt, Human
caggccaggcccucug

SEQ ID NO: 3208014 - RNA, 19 nt, Human
caggaaaucaaauaugcaa

SEQ ID NO: 3208015 - RNA, 22 nt, Human
caggaaaguggcaccugucugc

SEQ ID NO: 3208016 - RNA, 21 nt, Human
caggaaaguggcaccugucug

SEQ ID NO: 3208017 - RNA, 21 nt, Human
caggaaaucaaauaugcaaag

SEQ ID NO: 3208018 - RNA, 15 nt, Human
cagcuguucagcugg

SEQ ID NO: 3208019 - RNA, 16 nt, Human
cagcuguucagcuggu

SEQ ID NO: 3208020 - RNA, 19 nt, Human
cagcuguucagauuggaca

SEQ ID NO: 3208021 - RNA, 20 nt, Human
cagcuguucagauuggacau

SEQ ID NO: 3208022 - RNA, 16 nt, Human
cagcuuauucacaaga

SEQ ID NO: 3208023 - RNA, 23 nt, Human
cagcuguguccggcccaguuuug

SEQ ID NO: 3208024 - RNA, 20 nt, Human
caggaaaggcuccaggagca

SEQ ID NO: 3208025 - RNA, 20 nt, Human
caggaaaagcugcugacagu

SEQ ID NO: 3208026 - RNA, 19 nt, Human
caggaaaagcugcugacag

SEQ ID NO: 3208027 - RNA, 21 nt, Human
caggaaaggcuccaggagcag

SEQ ID NO: 3208028 - RNA, 22 nt, Human
caggaaaggcuccaggagcagc

SEQ ID NO: 3208029 - RNA, 23 nt, Human
caggaaaggcuccaggagcagcc

SEQ ID NO: 3208030 - RNA, 21 nt, Human
caugaauuaccuggauguucu

SEQ ID NO: 3208031 - RNA, 22 nt, Human
caugaauuaccuggauguucuu

SEQ ID NO: 3208032 - RNA, 14 nt, Human
caugacacgaauau

SEQ ID NO: 3208033 - RNA, 17 nt, Human
caugacacgaauauugc

SEQ ID NO: 3208034 - RNA, 18 nt, Human
caugacacgaauauugcu

SEQ ID NO: 3208035 - RNA, 24 nt, Human
caugauuaaccacuucagcugacu

SEQ ID NO: 3208036 - RNA, 16 nt, Human
caugcugcccugugag

SEQ ID NO: 3208037 - RNA, 18 nt, Human
caugcugcccugugagua

SEQ ID NO: 3208038 - RNA, 15 nt, Human
caugcugcccuguga

SEQ ID NO: 3208039 - RNA, 12 nt, Human
caugcugccucc

SEQ ID NO: 3208040 - RNA, 14 nt, Human
caugcugccuccag

SEQ ID NO: 3208041 - RNA, 16 nt, Human
caugcaaguauucuca

SEQ ID NO: 3208042 - RNA, 22 nt, Human
caugauugcagaauuguuuaga

SEQ ID NO: 3208043 - RNA, 20 nt, Human
caugauugcagaauuguuua

SEQ ID NO: 3208044 - RNA, 13 nt, Human
caucagcugcuga

SEQ ID NO: 3208045 - RNA, 15 nt, Human
caucagcugcugaaa

SEQ ID NO: 3208046 - RNA, 18 nt, Human
caucagcugcugaaacaa

SEQ ID NO: 3208047 - RNA, 17 nt, Human
caucagcugcugaaaca

SEQ ID NO: 3208048 - RNA, 20 nt, Human
caucagcuugcccuguuaaa

SEQ ID NO: 3208049 - RNA, 13 nt, Human
caucaggccaggc

SEQ ID NO: 3208050 - RNA, 20 nt, Human
caucaggccaggcccucugc

SEQ ID NO: 3208051 - RNA, 21 nt, Human
caucaggccaggcccucugcc

SEQ ID NO: 3208052 - RNA, 22 nt, Human
caucaggccaggcccucugccc

SEQ ID NO: 3208053 - RNA, 23 nt, Human
caucaggccaggcccucugccca

SEQ ID NO: 3208054 - RNA, 12 nt, Human
caucccagcccc

SEQ ID NO: 3208055 - RNA, 16 nt, Human
caucccagccccaaug

SEQ ID NO: 3208056 - RNA, 14 nt, Human
caucccagccccaa

SEQ ID NO: 3208057 - RNA, 13 nt, Human
caucccagcccca

SEQ ID NO: 3208058 - RNA, 23 nt, Human
cauccuggcacccggccccugcu

SEQ ID NO: 3208059 - RNA, 19 nt, Human
cauccugucaucugagaau

SEQ ID NO: 3208060 - RNA, 16 nt, Human
cauccugucaucugag

SEQ ID NO: 3208061 - RNA, 22 nt, Human
cauccccacguggacaagaaag

SEQ ID NO: 3208062 - RNA, 18 nt, Human
caucugugaaaggaaaga

SEQ ID NO: 3208063 - RNA, 19 nt, Human
caucugugaaaggaaagag

SEQ ID NO: 3208064 - RNA, 17 nt, Human
cauccuuucacuucuuu

SEQ ID NO: 3208065 - RNA, 21 nt, Human
cauccuuucacuucuuucccu

SEQ ID NO: 3208066 - RNA, 20 nt, Human
cauccuuucacuucuuuccc

SEQ ID NO: 3208067 - RNA, 19 nt, Human
cauccuuucacuucuuucc

SEQ ID NO: 3208068 - RNA, 21 nt, Human
caucuuagguuggcaaaaagg

SEQ ID NO: 3208069 - RNA, 13 nt, Human
caucuuaaaagcu

SEQ ID NO: 3208070 - RNA, 20 nt, Human
caucuuaaaagcuaucuuca

SEQ ID NO: 3208071 - RNA, 11 nt, Human
caucugugaau

SEQ ID NO: 3208072 - RNA, 22 nt, Human
caucuuagguuggcaaaaaggc

SEQ ID NO: 3208073 - RNA, 17 nt, Human
caguuuggcaaacucuc

SEQ ID NO: 3208074 - RNA, 21 nt, Human
caguuugcuuuguaugcacuu

SEQ ID NO: 3208075 - RNA, 14 nt, Human
caguuugcuuugua

SEQ ID NO: 3208076 - RNA, 12 nt, Human
caguuugcuuug

SEQ ID NO: 3208077 - RNA, 23 nt, Human
caguuugaggauuaguuuagaac

SEQ ID NO: 3208078 - RNA, 14 nt, Human
caguuuauauggaa

SEQ ID NO: 3208079 - RNA, 15 nt, Human
caguuuacugguuua

SEQ ID NO: 3208080 - RNA, 23 nt, Human
cauaaucuggacuccucugucca

SEQ ID NO: 3208081 - RNA, 20 nt, Human
cauaaucuggacuccucugu

SEQ ID NO: 3208082 - RNA, 22 nt, Human
cauaaucuggacuccucugucc

SEQ ID NO: 3208083 - RNA, 21 nt, Human
cauaaucuggacuccucuguc

SEQ ID NO: 3208084 - RNA, 19 nt, Human
cauaaucuggacuccucug

SEQ ID NO: 3208085 - RNA, 13 nt, Human
caguuguuugaug

SEQ ID NO: 3208086 - RNA, 20 nt, Human
cauagcagcuuauucacaag

SEQ ID NO: 3208087 - RNA, 14 nt, Human
cauagcaguauaug

SEQ ID NO: 3208088 - RNA, 14 nt, Human
cauagcauaggaca

SEQ ID NO: 3208089 - RNA, 14 nt, Human
cauagccaaaaugu

SEQ ID NO: 3208090 - RNA, 16 nt, Human
cauagccaaaauguga

SEQ ID NO: 3208091 - RNA, 15 nt, Human
cauagcccucacccu

SEQ ID NO: 3208092 - RNA, 19 nt, Human
cauagcccucacccugggg

SEQ ID NO: 3208093 - RNA, 12 nt, Human
cauagcccucac

SEQ ID NO: 3208094 - RNA, 18 nt, Human
cauagauucccugagcag

SEQ ID NO: 3208095 - RNA, 17 nt, Human
cauagauucccugagca

SEQ ID NO: 3208096 - RNA, 22 nt, Human
cauacacaagcgugucaggcug

SEQ ID NO: 3208097 - RNA, 15 nt, Human
cauacaauuccaaac

SEQ ID NO: 3208098 - RNA, 22 nt, Human
cauacaaaugcaucuuugaugu

SEQ ID NO: 3208099 - RNA, 21 nt, Human
cauacaaacaagcauauaaaa

SEQ ID NO: 3208100 - RNA, 19 nt, Human
cauacaaaugcaucuuuga

SEQ ID NO: 3208101 - RNA, 20 nt, Human
cauacaaaugcaucuuugau

SEQ ID NO: 3208102 - RNA, 18 nt, Human
cauaauuuguuuccagca

SEQ ID NO: 3208103 - RNA, 17 nt, Human
cauacaaacaagcauau

SEQ ID NO: 3208104 - RNA, 19 nt, Human
cauaggaaguuaaaagcac

SEQ ID NO: 3208105 - RNA, 20 nt, Human
cauaggaaguuagccuuuau

SEQ ID NO: 3208106 - RNA, 17 nt, Human
cauaggaaguuagccuu

SEQ ID NO: 3208107 - RNA, 16 nt, Human
cauaggccugcuuugu

SEQ ID NO: 3208108 - RNA, 18 nt, Human
cagucaccccggccaccu

SEQ ID NO: 3208109 - RNA, 18 nt, Human
ccaccagaagcccagaau

SEQ ID NO: 3208110 - RNA, 16 nt, Human
ccaccagaagcccaga

SEQ ID NO: 3208111 - RNA, 15 nt, Human
ccaccagaagcccag

SEQ ID NO: 3208112 - RNA, 14 nt, Human
ccaccagaagccca

SEQ ID NO: 3208113 - RNA, 16 nt, Human
ccaccaucaagccacc

SEQ ID NO: 3208114 - RNA, 17 nt, Human
ccaccaucaagccacca

SEQ ID NO: 3208115 - RNA, 13 nt, Human
ccaccagaagccc

SEQ ID NO: 3208116 - RNA, 12 nt, Human
ccaccagaagcc

SEQ ID NO: 3208117 - RNA, 11 nt, Human
ccaccagaagc

SEQ ID NO: 3208118 - RNA, 22 nt, Human
ccacacuucaggcucuucuccu

SEQ ID NO: 3208119 - RNA, 14 nt, Human
ccaccgcagacagg

SEQ ID NO: 3208120 - RNA, 17 nt, Human
ccaccgcagacaggacc

SEQ ID NO: 3208121 - RNA, 20 nt, Human
ccacccugcuuggcccaggg

SEQ ID NO: 3208122 - RNA, 20 nt, Human
ccaccaucaagccaccaaca

SEQ ID NO: 3208123 - RNA, 15 nt, Human
ccaccaucaagccac

SEQ ID NO: 3208124 - RNA, 13 nt, Human
ccacccugcucuc

SEQ ID NO: 3208125 - RNA, 17 nt, Human
ccacccugcuuggccca

SEQ ID NO: 3208126 - RNA, 19 nt, Human
ccacccugcuuggcccagg

SEQ ID NO: 3208127 - RNA, 18 nt, Human
ccacccugcuuggcccag

SEQ ID NO: 3208128 - RNA, 18 nt, Human
ccaccgcagacaggacca

SEQ ID NO: 3208129 - RNA, 13 nt, Human
ccaccgcagacag

SEQ ID NO: 3208130 - RNA, 22 nt, Human
ccaccgggcugggagcucugca

SEQ ID NO: 3208131 - RNA, 23 nt, Human
ccaccgggcugggagcucugcag

SEQ ID NO: 3208132 - RNA, 13 nt, Human
ccaccguccccuc

SEQ ID NO: 3208133 - RNA, 14 nt, Human
ccaccguccccucc

SEQ ID NO: 3208134 - RNA, 15 nt, Human
ccaccuuggcucaag

SEQ ID NO: 3208135 - RNA, 14 nt, Human
ccaccuuggcucaa

SEQ ID NO: 3208136 - RNA, 13 nt, Human
ccaccuuggcuca

SEQ ID NO: 3208137 - RNA, 19 nt, Human
ccaaugugaacagcggcug

SEQ ID NO: 3208138 - RNA, 20 nt, Human
ccaauguucucucuucucca

SEQ ID NO: 3208139 - RNA, 20 nt, Human
ccaagcuggucccacucagu

SEQ ID NO: 3208140 - RNA, 22 nt, Human
ccaacuuucaagaacuuguuua

SEQ ID NO: 3208141 - RNA, 22 nt, Human
ccaagcuuaggguauuuuuccu

SEQ ID NO: 3208142 - RNA, 20 nt, Human
ccaaugcacuuuguucuggc

SEQ ID NO: 3208143 - RNA, 22 nt, Human
ccaaugcacuuuguucuggcuc

SEQ ID NO: 3208144 - RNA, 23 nt, Human
ccaaugcacuuuguucuggcucu

SEQ ID NO: 3208145 - RNA, 15 nt, Human
ccaagcuuuaaauua

SEQ ID NO: 3208146 - RNA, 18 nt, Human
ccaagcuuuaaauuaugu

SEQ ID NO: 3208147 - RNA, 14 nt, Human
ccaaugcagaacuc

SEQ ID NO: 3208148 - RNA, 22 nt, Human
ccaaaugagggucuugguucca

SEQ ID NO: 3208149 - RNA, 18 nt, Human
ccaaauguucaucaauga

SEQ ID NO: 3208150 - RNA, 19 nt, Human
ccaaauuauuucuuaauua

SEQ ID NO: 3208151 - RNA, 12 nt, Human
ccaaauuaaaaa

SEQ ID NO: 3208152 - RNA, 16 nt, Human
ccaaaucauaguggcu

SEQ ID NO: 3208153 - RNA, 22 nt, Human
ccaaagugcugggauuacaggu

SEQ ID NO: 3208154 - RNA, 11 nt, Human
ccaacuuguaa

SEQ ID NO: 3208155 - RNA, 13 nt, Human
ccaacuugccuuu

SEQ ID NO: 3208156 - RNA, 19 nt, Human
ccaacuuucaagaacuugu

SEQ ID NO: 3208157 - RNA, 16 nt, Human
ccaacuuucaagaacu

SEQ ID NO: 3208158 - RNA, 16 nt, Human
ccaacgucugugccau

SEQ ID NO: 3208159 - RNA, 14 nt, Human
ccaaagugcuggga

SEQ ID NO: 3208160 - RNA, 19 nt, Human
ccaaagugcugggauuaca

SEQ ID NO: 3208161 - RNA, 22 nt, Human
ccaaagugcugggauuacaggc

SEQ ID NO: 3208162 - RNA, 20 nt, Human
cauuggauucugagagcugu

SEQ ID NO: 3208163 - RNA, 17 nt, Human
cauugcuuaccuugguu

SEQ ID NO: 3208164 - RNA, 14 nt, Human
cauugcuuaccuug

SEQ ID NO: 3208165 - RNA, 22 nt, Human
cauuggcucuugaacugagcuu

SEQ ID NO: 3208166 - RNA, 15 nt, Human
cauuuauucugcuca

SEQ ID NO: 3208167 - RNA, 16 nt, Human
cauuuauucugcucac

SEQ ID NO: 3208168 - RNA, 14 nt, Human
cauuucaaugugua

SEQ ID NO: 3208169 - RNA, 18 nt, Human
cauuucaauguguauaaa

SEQ ID NO: 3208170 - RNA, 20 nt, Human
cauuucaauguguauaaauu

SEQ ID NO: 3208171 - RNA, 16 nt, Human
cauuucacauuauucu

SEQ ID NO: 3208172 - RNA, 17 nt, Human
cauugggccauguuuaa

SEQ ID NO: 3208173 - RNA, 15 nt, Human
cauuucacugucugu

SEQ ID NO: 3208174 - RNA, 18 nt, Human
cauuucauuugugccaga

SEQ ID NO: 3208175 - RNA, 17 nt, Human
cauuucagaaagccuuu

SEQ ID NO: 3208176 - RNA, 11 nt, Human
cauuucagaaa

SEQ ID NO: 3208177 - RNA, 17 nt, Human
ccaaaaaaugcuugcuu

SEQ ID NO: 3208178 - RNA, 17 nt, Human
ccaaaacucuccucugc

SEQ ID NO: 3208179 - RNA, 19 nt, Human
cauuuuugaaacugcauuu

SEQ ID NO: 3208180 - RNA, 14 nt, Human
cauuuguaaauauu

SEQ ID NO: 3208181 - RNA, 15 nt, Human
cauuuguaaauauua

SEQ ID NO: 3208182 - RNA, 16 nt, Human
cauuuguaaauauuaa

SEQ ID NO: 3208183 - RNA, 20 nt, Human
cauuuuugaauacaggcaua

SEQ ID NO: 3208184 - RNA, 18 nt, Human
cauuuuugaauacaggca

SEQ ID NO: 3208185 - RNA, 21 nt, Human
cauugcggacagccacggcca

SEQ ID NO: 3208186 - RNA, 17 nt, Human
cauugcggacagccacg

SEQ ID NO: 3208187 - RNA, 15 nt, Human
cauugcggacagcca

SEQ ID NO: 3208188 - RNA, 14 nt, Human
cauugcggacagcc

SEQ ID NO: 3208189 - RNA, 18 nt, Human
cauugcugggcuugucug

SEQ ID NO: 3208190 - RNA, 23 nt, Human
cauugccugauuuguuccuucug

SEQ ID NO: 3208191 - RNA, 21 nt, Human
cauugccugauuuguuccuuc

SEQ ID NO: 3208192 - RNA, 18 nt, Human
cauugccucggcuggcuc

SEQ ID NO: 3208193 - RNA, 20 nt, Human
cauugccucggcuggcuccc

SEQ ID NO: 3208194 - RNA, 15 nt, Human
cauuaggauggcuag

SEQ ID NO: 3208195 - RNA, 15 nt, Human
cauguucucugagga

SEQ ID NO: 3208196 - RNA, 18 nt, Human
cauuagcaguuugcuuug

SEQ ID NO: 3208197 - RNA, 17 nt, Human
cauggcugccaauggga

SEQ ID NO: 3208198 - RNA, 22 nt, Human
cauggcugccaaugggagcuca

SEQ ID NO: 3208199 - RNA, 19 nt, Human
cauggcgaaaacaucuccu

SEQ ID NO: 3208200 - RNA, 13 nt, Human
cauguucaauuau

SEQ ID NO: 3208201 - RNA, 20 nt, Human
cauguucaauuauuuccccc

SEQ ID NO: 3208202 - RNA, 21 nt, Human
cauguucccacuucaaaacaa

SEQ ID NO: 3208203 - RNA, 21 nt, Human
cauggcgaaaacaucuccuua

SEQ ID NO: 3208204 - RNA, 21 nt, Human
cauucuccaccugccagggac

SEQ ID NO: 3208205 - RNA, 20 nt, Human
cauucuccuuagcuucuggc

SEQ ID NO: 3208206 - RNA, 22 nt, Human
cauucuccagggguuuacagug

SEQ ID NO: 3208207 - RNA, 13 nt, Human
cauuaugaugugu

SEQ ID NO: 3208208 - RNA, 16 nt, Human
cauucucacuccuacc

SEQ ID NO: 3208209 - RNA, 14 nt, Human
cauucucacuccua

SEQ ID NO: 3208210 - RNA, 17 nt, Human
cauucucacuccuaccu

SEQ ID NO: 3208211 - RNA, 13 nt, Human
cauucucaguuuu

SEQ ID NO: 3208212 - RNA, 20 nt, Human
cauucucaguuuuucuuaau

SEQ ID NO: 3208213 - RNA, 19 nt, Human
cauucucaguuuuucuuaa

SEQ ID NO: 3208214 - RNA, 18 nt, Human
cauucucaguuuuucuua

SEQ ID NO: 3208215 - RNA, 15 nt, Human
cauucucaguuuuuc

SEQ ID NO: 3208216 - RNA, 23 nt, Human
auugcaggagucccugccaucau

SEQ ID NO: 3208217 - RNA, 20 nt, Human
auugcagaauuguuuagauu

SEQ ID NO: 3208218 - RNA, 19 nt, Human
auugcagaauuguuuagau

SEQ ID NO: 3208219 - RNA, 16 nt, Human
auugcagaauuguuua

SEQ ID NO: 3208220 - RNA, 13 nt, Human
auugcagaauugu

SEQ ID NO: 3208221 - RNA, 21 nt, Human
auugcaacaggcugggcuuca

SEQ ID NO: 3208222 - RNA, 17 nt, Human
auugcaacaaaauacau

SEQ ID NO: 3208223 - RNA, 16 nt, Human
auugcaacaaaauaca

SEQ ID NO: 3208224 - RNA, 14 nt, Human
auugcaacaaaaua

SEQ ID NO: 3208225 - RNA, 13 nt, Human
auugcaacaaaau

SEQ ID NO: 3208226 - RNA, 19 nt, Human
auugcaaucuauaauauuu

SEQ ID NO: 3208227 - RNA, 13 nt, Human
auugcaauuaaac

SEQ ID NO: 3208228 - RNA, 22 nt, Human
auugcaacaaaauacauucuuu

SEQ ID NO: 3208229 - RNA, 21 nt, Human
auugcaacaaaauacauucuu

SEQ ID NO: 3208230 - RNA, 23 nt, Human
auugcaagaagcuuuauuucuag

SEQ ID NO: 3208231 - RNA, 14 nt, Human
auugcaauaaagua

SEQ ID NO: 3208232 - RNA, 15 nt, Human
auugcaauaaaguau

SEQ ID NO: 3208233 - RNA, 16 nt, Human
auugcaauaaaguaua

SEQ ID NO: 3208234 - RNA, 17 nt, Human
auugcaauaaaguauaa

SEQ ID NO: 3208235 - RNA, 21 nt, Human
auugacccacaagaaaugaaa

SEQ ID NO: 3208236 - RNA, 21 nt, Human
auugaccgacagcuuuccagu

SEQ ID NO: 3208237 - RNA, 15 nt, Human
auugcaacaggcugg

SEQ ID NO: 3208238 - RNA, 13 nt, Human
auugaccugaggc

SEQ ID NO: 3208239 - RNA, 13 nt, Human
auugcaaagcaaa

SEQ ID NO: 3208240 - RNA, 19 nt, Human
auugcggacagccacggcc

SEQ ID NO: 3208241 - RNA, 18 nt, Human
auugcggacagccacggc

SEQ ID NO: 3208242 - RNA, 16 nt, Human
auugcggacagccacg

SEQ ID NO: 3208243 - RNA, 19 nt, Human
auugccucggcuggcuccc

SEQ ID NO: 3208244 - RNA, 23 nt, Human
auugccucggcuggcuccccugc

SEQ ID NO: 3208245 - RNA, 21 nt, Human
auugcccacgcuggagugcag

SEQ ID NO: 3208246 - RNA, 17 nt, Human
auugcccacgcuggagu

SEQ ID NO: 3208247 - RNA, 16 nt, Human
auugcccaugauauaa

SEQ ID NO: 3208248 - RNA, 19 nt, Human
auugcccaugauauaacuu

SEQ ID NO: 3208249 - RNA, 23 nt, Human
auugccauuucuuccacaagagc

SEQ ID NO: 3208250 - RNA, 22 nt, Human
auugccaaacauuaauguugau

SEQ ID NO: 3208251 - RNA, 21 nt, Human
auugccaaacauuaauguuga

SEQ ID NO: 3208252 - RNA, 16 nt, Human
auugccaaaacccagc

SEQ ID NO: 3208253 - RNA, 16 nt, Human
auugcauuugcuuuug

SEQ ID NO: 3208254 - RNA, 19 nt, Human
auugccaaacauuaauguu

SEQ ID NO: 3208255 - RNA, 14 nt, Human
auugccaaacauua

SEQ ID NO: 3208256 - RNA, 13 nt, Human
auugccaaacauu

SEQ ID NO: 3208257 - RNA, 22 nt, Human
auugccaaaacccagcugcacc

SEQ ID NO: 3208258 - RNA, 20 nt, Human
auugccaaaacccagcugca

SEQ ID NO: 3208259 - RNA, 19 nt, Human
auugccaaaacccagcugc

SEQ ID NO: 3208260 - RNA, 18 nt, Human
auugccaaaacccagcug

SEQ ID NO: 3208261 - RNA, 17 nt, Human
auugccaaaacccagcu

SEQ ID NO: 3208262 - RNA, 17 nt, Human
auugcauuuccugacag

SEQ ID NO: 3208263 - RNA, 16 nt, Human
auugcauuuccugaca

SEQ ID NO: 3208264 - RNA, 20 nt, Human
auugacacuuaaaaaugguu

SEQ ID NO: 3208265 - RNA, 16 nt, Human
auucuccaccugccag

SEQ ID NO: 3208266 - RNA, 17 nt, Human
auucuccaccugccagg

SEQ ID NO: 3208267 - RNA, 20 nt, Human
auucucagaaucucaaauaa

SEQ ID NO: 3208268 - RNA, 18 nt, Human
auucucagaaucucaaau

SEQ ID NO: 3208269 - RNA, 13 nt, Human
auucuccaccugc

SEQ ID NO: 3208270 - RNA, 16 nt, Human
auucuacuuugagugc

SEQ ID NO: 3208271 - RNA, 13 nt, Human
auucuacuuugag

SEQ ID NO: 3208272 - RNA, 14 nt, Human
auucucagaaucuc

SEQ ID NO: 3208273 - RNA, 18 nt, Human
auucucaccagcuguguc

SEQ ID NO: 3208274 - RNA, 15 nt, Human
auucucaccagcugu

SEQ ID NO: 3208275 - RNA, 16 nt, Human
auucuagauuaccaug

SEQ ID NO: 3208276 - RNA, 21 nt, Human
auuuaaaggcccuaucuguuu

SEQ ID NO: 3208277 - RNA, 17 nt, Human
auuuaaagggaaauuga

SEQ ID NO: 3208278 - RNA, 20 nt, Human
auuuaaaggcccuaucuguu

SEQ ID NO: 3208279 - RNA, 18 nt, Human
auuuaaaggcccuaucug

SEQ ID NO: 3208280 - RNA, 19 nt, Human
auuuaaaauugugaugugu

SEQ ID NO: 3208281 - RNA, 17 nt, Human
auuuaaaagacagcuuu

SEQ ID NO: 3208282 - RNA, 14 nt, Human
auuuaaaagacagc

SEQ ID NO: 3208283 - RNA, 20 nt, Human
auuuaaaauugugauguguc

SEQ ID NO: 3208284 - RNA, 19 nt, Human
auuuaaaacauuaaaauau

SEQ ID NO: 3208285 - RNA, 17 nt, Human
auuuaaaacuguaauuu

SEQ ID NO: 3208286 - RNA, 21 nt, Human
auuuaaaacauuaaaauauaa

SEQ ID NO: 3208287 - RNA, 20 nt, Human
auuuaaaacauuaaaauaua

SEQ ID NO: 3208288 - RNA, 19 nt, Human
auuuaaagcuuauuaaaac

SEQ ID NO: 3208289 - RNA, 20 nt, Human
auuuaauuuugacacugaaa

SEQ ID NO: 3208290 - RNA, 22 nt, Human
auuuaauuuugacacugaaaua

SEQ ID NO: 3208291 - RNA, 20 nt, Human
auuuacaacacuuuaauggg

SEQ ID NO: 3208292 - RNA, 23 nt, Human
auuuaauuuuuuugagacagagu

SEQ ID NO: 3208293 - RNA, 19 nt, Human
auuuaauuuuuuugagaca

SEQ ID NO: 3208294 - RNA, 22 nt, Human
auuuaacagggucucuagugcu

SEQ ID NO: 3208295 - RNA, 21 nt, Human
auuggcucuugaacugagcuu

SEQ ID NO: 3208296 - RNA, 23 nt, Human
auuggcuuuggguugcaggaccu

SEQ ID NO: 3208297 - RNA, 18 nt, Human
auuguauagauauaauga

SEQ ID NO: 3208298 - RNA, 18 nt, Human
auuguaucucauuacuua

SEQ ID NO: 3208299 - RNA, 18 nt, Human
auuguauauuuuuaucua

SEQ ID NO: 3208300 - RNA, 19 nt, Human
auuguauauuuuuaucuau

SEQ ID NO: 3208301 - RNA, 13 nt, Human
auugugccccugc

SEQ ID NO: 3208302 - RNA, 19 nt, Human
auugucuuuaaaaacuguu

SEQ ID NO: 3208303 - RNA, 20 nt, Human
auugucuuuaaaaacuguuu

SEQ ID NO: 3208304 - RNA, 23 nt, Human
auugucuuaauggaugaaaucau

SEQ ID NO: 3208305 - RNA, 21 nt, Human
auugucuuaauggaugaaauc

SEQ ID NO: 3208306 - RNA, 19 nt, Human
auugucuuaauggaugaaa

SEQ ID NO: 3208307 - RNA, 17 nt, Human
auugucuuaauggauga

SEQ ID NO: 3208308 - RNA, 14 nt, Human
auugucuuaaugga

SEQ ID NO: 3208309 - RNA, 15 nt, Human
auugucuuaauggau

SEQ ID NO: 3208310 - RNA, 12 nt, Human
auugucuguaaa

SEQ ID NO: 3208311 - RNA, 13 nt, Human
auugucuguaaau

SEQ ID NO: 3208312 - RNA, 14 nt, Human
auugucuguaaauc

SEQ ID NO: 3208313 - RNA, 22 nt, Human
auuuuauuaagcuuuuuggaau

SEQ ID NO: 3208314 - RNA, 15 nt, Human
auuuuauucuugauc

SEQ ID NO: 3208315 - RNA, 16 nt, Human
auuuuauucuugauca

SEQ ID NO: 3208316 - RNA, 18 nt, Human
auuuuauucuugaucagu

SEQ ID NO: 3208317 - RNA, 19 nt, Human
auuuuauuuuaaaauuuca

SEQ ID NO: 3208318 - RNA, 14 nt, Human
auuuuauuucaaug

SEQ ID NO: 3208319 - RNA, 16 nt, Human
auuuuauuucaaugua

SEQ ID NO: 3208320 - RNA, 17 nt, Human
auuuuauuucaauguaa

SEQ ID NO: 3208321 - RNA, 18 nt, Human
auuuuauuucaauguaau

SEQ ID NO: 3208322 - RNA, 19 nt, Human
auuuuauuucaauguaauu

SEQ ID NO: 3208323 - RNA, 21 nt, Human
auuuuauuucaauguaauuaa

SEQ ID NO: 3208324 - RNA, 16 nt, Human
auuuuacuuggaaaua

SEQ ID NO: 3208325 - RNA, 23 nt, Human
auuuuacuuggaaauauuaaaag

SEQ ID NO: 3208326 - RNA, 19 nt, Human
auuuuaauuuuuaaaugca

SEQ ID NO: 3208327 - RNA, 19 nt, Human
auuuuaauuuuugcuuuua

SEQ ID NO: 3208328 - RNA, 18 nt, Human
auuuuaauuuuuaaaugc

SEQ ID NO: 3208329 - RNA, 17 nt, Human
auuuuaauuuuuaaaug

SEQ ID NO: 3208330 - RNA, 14 nt, Human
auuuguaugauauu

SEQ ID NO: 3208331 - RNA, 15 nt, Human
auuuguaugauauuu

SEQ ID NO: 3208332 - RNA, 18 nt, Human
auuuguaugucaaagcuu

SEQ ID NO: 3208333 - RNA, 19 nt, Human
auuuuaauuucaagcuuau

SEQ ID NO: 3208334 - RNA, 18 nt, Human
auuuuaauuucaagcuua

SEQ ID NO: 3208335 - RNA, 13 nt, Human
auuuuaauuucaa

SEQ ID NO: 3208336 - RNA, 15 nt, Human
auuuguaucacaaau

SEQ ID NO: 3208337 - RNA, 24 nt, Human
auuuguacuuucuguuaaaaugca

SEQ ID NO: 3208338 - RNA, 18 nt, Human
auuugaauguaugcuuca

SEQ ID NO: 3208339 - RNA, 17 nt, Human
auuugaauguaugcuuc

SEQ ID NO: 3208340 - RNA, 21 nt, Human
auuugaauguaugcuucauac

SEQ ID NO: 3208341 - RNA, 20 nt, Human
auuugaauguaugcuucaua

SEQ ID NO: 3208342 - RNA, 22 nt, Human
auuugaauguaugcuucauaca

SEQ ID NO: 3208343 - RNA, 16 nt, Human
auuugagcagggcuca

SEQ ID NO: 3208344 - RNA, 20 nt, Human
auuucuuuucaccauucgua

SEQ ID NO: 3208345 - RNA, 17 nt, Human
auuugagcagggcucag

SEQ ID NO: 3208346 - RNA, 16 nt, Human
auuugaggaguguuaa

SEQ ID NO: 3208347 - RNA, 20 nt, Human
auuugaggaguguuaagauu

SEQ ID NO: 3208348 - RNA, 23 nt, Human
auuugaggaguguuaagauugca

SEQ ID NO: 3208349 - RNA, 14 nt, Human
auuuggaauuagaa

SEQ ID NO: 3208350 - RNA, 22 nt, Human
auuuggaauaaaaauuccagaa

SEQ ID NO: 3208351 - RNA, 21 nt, Human
auuuggaauaaaaauuccaga

SEQ ID NO: 3208352 - RNA, 22 nt, Human
auuuggggauucagauuucucu

SEQ ID NO: 3208353 - RNA, 18 nt, Human
auuuggaccauuuuccug

SEQ ID NO: 3208354 - RNA, 17 nt, Human
auuuggaccauuuuccu

SEQ ID NO: 3208355 - RNA, 14 nt, Human
auuuggaccauuuu

SEQ ID NO: 3208356 - RNA, 15 nt, Human
auuugggguauuuau

SEQ ID NO: 3208357 - RNA, 15 nt, Human
auuugguauccuuau

SEQ ID NO: 3208358 - RNA, 18 nt, Human
auuugguaauguuuuuaa

SEQ ID NO: 3208359 - RNA, 22 nt, Human
auuuguacuuucuguuaaaaug

SEQ ID NO: 3208360 - RNA, 20 nt, Human
auuuguacuuucuguuaaaa

SEQ ID NO: 3208361 - RNA, 19 nt, Human
auuuguacuuucuguuaaa

SEQ ID NO: 3208362 - RNA, 18 nt, Human
auuuguacuuucuguuaa

SEQ ID NO: 3208363 - RNA, 15 nt, Human
auuuguacuuucugu

SEQ ID NO: 3208364 - RNA, 20 nt, Human
auuuauuaaaugcccagccc

SEQ ID NO: 3208365 - RNA, 19 nt, Human
auuuauuagcccugcauuu

SEQ ID NO: 3208366 - RNA, 22 nt, Human
auuuauuagcccugcauuuuca

SEQ ID NO: 3208367 - RNA, 24 nt, Human
auuuagggaguauucuaauaagcu

SEQ ID NO: 3208368 - RNA, 16 nt, Human
auuuagggaguauucu

SEQ ID NO: 3208369 - RNA, 18 nt, Human
auuuagggaguauucuaa

SEQ ID NO: 3208370 - RNA, 19 nt, Human
auuuagggaguauucuaau

SEQ ID NO: 3208371 - RNA, 20 nt, Human
auuuagggaguauucuaaua

SEQ ID NO: 3208372 - RNA, 14 nt, Human
auuuccugugucuu

SEQ ID NO: 3208373 - RNA, 21 nt, Human
auuucuaagucaaacacuugu

SEQ ID NO: 3208374 - RNA, 19 nt, Human
auguugugaauaauuacag

SEQ ID NO: 3208375 - RNA, 17 nt, Human
auguugugaauaauuac

SEQ ID NO: 3208376 - RNA, 15 nt, Human
auguugugaauaauu

SEQ ID NO: 3208377 - RNA, 12 nt, Human
auguugugaaua

SEQ ID NO: 3208378 - RNA, 15 nt, Human
auguuguagauacaa

SEQ ID NO: 3208379 - RNA, 21 nt, Human
auguuguagauacaaucagcu

SEQ ID NO: 3208380 - RNA, 22 nt, Human
auguuguagauacaaucagcug

SEQ ID NO: 3208381 - RNA, 15 nt, Human
auguuuacagaggac

SEQ ID NO: 3208382 - RNA, 17 nt, Human
auguuuacagaggacag

SEQ ID NO: 3208383 - RNA, 19 nt, Human
auguuuacagaggacagua

SEQ ID NO: 3208384 - RNA, 14 nt, Human
auguuuuccaugag

SEQ ID NO: 3208385 - RNA, 19 nt, Human
auguuuuugaaggcagaaa

SEQ ID NO: 3208386 - RNA, 15 nt, Human
auguuuuugaaggca

SEQ ID NO: 3208387 - RNA, 21 nt, Human
auguuuuugaaggcagaaagc

SEQ ID NO: 3208388 - RNA, 18 nt, Human
auguuuuuguacucugca

SEQ ID NO: 3208389 - RNA, 18 nt, Human
auguuuuucuucucccuc

SEQ ID NO: 3208390 - RNA, 14 nt, Human
auguuuuugaaggc

SEQ ID NO: 3208391 - RNA, 12 nt, Human
auguuuuugaag

SEQ ID NO: 3208392 - RNA, 17 nt, Human
auguuuuucuucucccu

SEQ ID NO: 3208393 - RNA, 16 nt, Human
auuaaaagaauauuuu

SEQ ID NO: 3208394 - RNA, 15 nt, Human
auuaaaaguuugaaa

SEQ ID NO: 3208395 - RNA, 13 nt, Human
auuaaaauauaau

SEQ ID NO: 3208396 - RNA, 12 nt, Human
auuaaaauaugc

SEQ ID NO: 3208397 - RNA, 18 nt, Human
auuaaaauauaaucucua

SEQ ID NO: 3208398 - RNA, 20 nt, Human
auuaaaauaugcacuaaguc

SEQ ID NO: 3208399 - RNA, 18 nt, Human
auuaaaauaugcacuaag

SEQ ID NO: 3208400 - RNA, 14 nt, Human
auuaaaauaugcac

SEQ ID NO: 3208401 - RNA, 13 nt, Human
auuaaaauaugca

SEQ ID NO: 3208402 - RNA, 15 nt, Human
auuaaaagaauauuu

SEQ ID NO: 3208403 - RNA, 17 nt, Human
auuaaaaauaucaaauu

SEQ ID NO: 3208404 - RNA, 23 nt, Human
auuaaaaagucuuuuaaaaagua

SEQ ID NO: 3208405 - RNA, 18 nt, Human
auuaaaaagucuuuuaaa

SEQ ID NO: 3208406 - RNA, 15 nt, Human
auuaaaaagucuuuu

SEQ ID NO: 3208407 - RNA, 14 nt, Human
auuaaaaagucuuu

SEQ ID NO: 3208408 - RNA, 12 nt, Human
auuaaaaagucu

SEQ ID NO: 3208409 - RNA, 13 nt, Human
auuaaaaagucuu

SEQ ID NO: 3208410 - RNA, 13 nt, Human
auuaaaaaagucu

SEQ ID NO: 3208411 - RNA, 11 nt, Human
auuaaagucag

SEQ ID NO: 3208412 - RNA, 13 nt, Human
auuaaagucagaa

SEQ ID NO: 3208413 - RNA, 16 nt, Human
auuaaagucagaaguu

SEQ ID NO: 3208414 - RNA, 19 nt, Human
auuaaagucagaaguuuua

SEQ ID NO: 3208415 - RNA, 17 nt, Human
auuaaccacuucagcug

SEQ ID NO: 3208416 - RNA, 18 nt, Human
auuaaccacuucagcuga

SEQ ID NO: 3208417 - RNA, 20 nt, Human
auuaaccacuucagcugacu

SEQ ID NO: 3208418 - RNA, 18 nt, Human
auuaaccccauaauuaga

SEQ ID NO: 3208419 - RNA, 15 nt, Human
auuaaccaagguaga

SEQ ID NO: 3208420 - RNA, 17 nt, Human
auuaacugcuuccuaua

SEQ ID NO: 3208421 - RNA, 16 nt, Human
auuaacuuaauaauca

SEQ ID NO: 3208422 - RNA, 14 nt, Human
auuaacuuaauaau

SEQ ID NO: 3208423 - RNA, 19 nt, Human
auuaacuuaauaaucaaga

SEQ ID NO: 3208424 - RNA, 19 nt, Human
auuaacuuacccuguauau

SEQ ID NO: 3208425 - RNA, 20 nt, Human
auuaacuuggaugaguuuug

SEQ ID NO: 3208426 - RNA, 14 nt, Human
auuaagaaagacua

SEQ ID NO: 3208427 - RNA, 13 nt, Human
auuaagaaagacu

SEQ ID NO: 3208428 - RNA, 14 nt, Human
auuaagaagaaacu

SEQ ID NO: 3208429 - RNA, 12 nt, Human
auuaagaaauag

SEQ ID NO: 3208430 - RNA, 11 nt, Human
auuaagaaaua

SEQ ID NO: 3208431 - RNA, 13 nt, Human
uuuuauguugaca

SEQ ID NO: 3208432 - RNA, 12 nt, Human
uuuuauguugac

SEQ ID NO: 3208433 - RNA, 18 nt, Human
uuuuauguugacauuugu

SEQ ID NO: 3208434 - RNA, 15 nt, Human
uuuuauguugacauu

SEQ ID NO: 3208435 - RNA, 23 nt, Human
uuuuauggaggcuuugcauagau

SEQ ID NO: 3208436 - RNA, 15 nt, Human
uuuuauaagaaaacc

SEQ ID NO: 3208437 - RNA, 20 nt, Human
uuuuauaaggacuuccugau

SEQ ID NO: 3208438 - RNA, 19 nt, Human
uuuuauaaggacuuccuga

SEQ ID NO: 3208439 - RNA, 21 nt, Human
uuuuauaacaucuuuauugaa

SEQ ID NO: 3208440 - RNA, 14 nt, Human
uuuuauaaaaagau

SEQ ID NO: 3208441 - RNA, 19 nt, Human
uuuuauuauuaaugcuuug

SEQ ID NO: 3208442 - RNA, 23 nt, Human
uuuuauguugacauuuguuuggu

SEQ ID NO: 3208443 - RNA, 14 nt, Human
uuuucagauucagg

SEQ ID NO: 3208444 - RNA, 18 nt, Human
uuuucagauuugcacaaa

SEQ ID NO: 3208445 - RNA, 17 nt, Human
uuuucagauuugcacaa

SEQ ID NO: 3208446 - RNA, 15 nt, Human
uuuucagauuugcac

SEQ ID NO: 3208447 - RNA, 14 nt, Human
uuuucagauuugca

SEQ ID NO: 3208448 - RNA, 13 nt, Human
uuuucagauuugc

SEQ ID NO: 3208449 - RNA, 18 nt, Human
uuuucagauucaggcauu

SEQ ID NO: 3208450 - RNA, 16 nt, Human
uuuuccaucuaaaaau

SEQ ID NO: 3208451 - RNA, 18 nt, Human
uuuuccauauuuuuacaa

SEQ ID NO: 3208452 - RNA, 15 nt, Human
uuuuccaucuaaaaa

SEQ ID NO: 3208453 - RNA, 14 nt, Human
uuuuccaucuaaaa

SEQ ID NO: 3208454 - RNA, 19 nt, Human
uuuuccagguuuaagcugu

SEQ ID NO: 3208455 - RNA, 14 nt, Human
uuuuccaguauuuu

SEQ ID NO: 3208456 - RNA, 17 nt, Human
uuuuccaguauuuuagu

SEQ ID NO: 3208457 - RNA, 20 nt, Human
uuuucauuagcaaaaaaagu

SEQ ID NO: 3208458 - RNA, 23 nt, Human
uuuucauuagcaaaaaaaguugu

SEQ ID NO: 3208459 - RNA, 22 nt, Human
uuuucauuagcaaaaaaaguug

SEQ ID NO: 3208460 - RNA, 21 nt, Human
uuuucauuagcaaaaaaaguu

SEQ ID NO: 3208461 - RNA, 16 nt, Human
uuuuaguuuuucuguc

SEQ ID NO: 3208462 - RNA, 13 nt, Human
uuuuaguuuugcu

SEQ ID NO: 3208463 - RNA, 15 nt, Human
auguuggccaggcug

SEQ ID NO: 3208464 - RNA, 21 nt, Human
auguuggccaggcugcucuca

SEQ ID NO: 3208465 - RNA, 19 nt, Human
uuuuagaugugcugcuuug

SEQ ID NO: 3208466 - RNA, 20 nt, Human
uuuuagauugagaaaugugu

SEQ ID NO: 3208467 - RNA, 23 nt, Human
uuuuagcacagcguuaugugucu

SEQ ID NO: 3208468 - RNA, 23 nt, Human
uuuuagcaaagcggguuauaaug

SEQ ID NO: 3208469 - RNA, 14 nt, Human
auguuggccaggcu

SEQ ID NO: 3208470 - RNA, 13 nt, Human
auguuggccaggc

SEQ ID NO: 3208471 - RNA, 16 nt, Human
auguuggccaggcugc

SEQ ID NO: 3208472 - RNA, 21 nt, Human
auguugacaucacuggcaugg

SEQ ID NO: 3208473 - RNA, 19 nt, Human
auguugacaucacuggcau

SEQ ID NO: 3208474 - RNA, 16 nt, Human
auguugacauuuguuu

SEQ ID NO: 3208475 - RNA, 14 nt, Human
auguugacauuugu

SEQ ID NO: 3208476 - RNA, 13 nt, Human
auguugacauuug

SEQ ID NO: 3208477 - RNA, 12 nt, Human
auguugacauuu

SEQ ID NO: 3208478 - RNA, 21 nt, Human
auguugaugcaauccuuacaa

SEQ ID NO: 3208479 - RNA, 14 nt, Human
auguugaugcaauc

SEQ ID NO: 3208480 - RNA, 12 nt, Human
auguugauuucu

SEQ ID NO: 3208481 - RNA, 15 nt, Human
auguugauuucuagu

SEQ ID NO: 3208482 - RNA, 13 nt, Human
auguugauuucua

SEQ ID NO: 3208483 - RNA, 22 nt, Human
auguugaugcaauccuuacaaa

SEQ ID NO: 3208484 - RNA, 15 nt, Human
auguugcaaugugaa

SEQ ID NO: 3208485 - RNA, 19 nt, Human
auguugcaaugugaaaaau

SEQ ID NO: 3208486 - RNA, 22 nt, Human
auguugcaaugugaaaaaucug

SEQ ID NO: 3208487 - RNA, 15 nt, Human
auguuaguuuuccuu

SEQ ID NO: 3208488 - RNA, 22 nt, Human
auguuauacaaccuucauuuaa

SEQ ID NO: 3208489 - RNA, 18 nt, Human
auguuaguuaguguagau

SEQ ID NO: 3208490 - RNA, 14 nt, Human
auguuauagcugca

SEQ ID NO: 3208491 - RNA, 16 nt, Human
uuuuaagugaaauuua

SEQ ID NO: 3208492 - RNA, 15 nt, Human
uuuuaagugaaauuu

SEQ ID NO: 3208493 - RNA, 14 nt, Human
uuuuaagugaaauu

SEQ ID NO: 3208494 - RNA, 16 nt, Human
auguugaagccuuugu

SEQ ID NO: 3208495 - RNA, 15 nt, Human
auguugaagccuuug

SEQ ID NO: 3208496 - RNA, 19 nt, Human
auguucaucaaugaaugaa

SEQ ID NO: 3208497 - RNA, 21 nt, Human
auguucaucauccuaagcuau

SEQ ID NO: 3208498 - RNA, 14 nt, Human
auguuauauuuuuc

SEQ ID NO: 3208499 - RNA, 23 nt, Human
auguuauauuuuucuuaaaaagu

SEQ ID NO: 3208500 - RNA, 20 nt, Human
auguuauauuuuucuuaaaa

SEQ ID NO: 3208501 - RNA, 20 nt, Human
auguaugcuucauacaggga

SEQ ID NO: 3208502 - RNA, 22 nt, Human
auguauguaaauagguuucuaa

SEQ ID NO: 3208503 - RNA, 16 nt, Human
auguaugcuucauaca

SEQ ID NO: 3208504 - RNA, 16 nt, Human
auguaucugaaaguca

SEQ ID NO: 3208505 - RNA, 17 nt, Human
auguaugcuucauacag

SEQ ID NO: 3208506 - RNA, 15 nt, Human
auguaucugagcagg

SEQ ID NO: 3208507 - RNA, 13 nt, Human
augucaguaugug

SEQ ID NO: 3208508 - RNA, 12 nt, Human
auguauguguaa

SEQ ID NO: 3208509 - RNA, 20 nt, Human
augucagcaguugcugguaa

SEQ ID NO: 3208510 - RNA, 21 nt, Human
augucagcaguugcugguaaa

SEQ ID NO: 3208511 - RNA, 22 nt, Human
augucagcaguugcugguaaaa

SEQ ID NO: 3208512 - RNA, 18 nt, Human
auguagugccgcucuugg

SEQ ID NO: 3208513 - RNA, 14 nt, Human
auguaguucauacu

SEQ ID NO: 3208514 - RNA, 15 nt, Human
auguaguuugaggaa

SEQ ID NO: 3208515 - RNA, 14 nt, Human
auguaguuugagga

SEQ ID NO: 3208516 - RNA, 24 nt, Human
auguaguuugaggaaauuugcagc

SEQ ID NO: 3208517 - RNA, 23 nt, Human
auguaguuugaggaaauuugcag

SEQ ID NO: 3208518 - RNA, 20 nt, Human
auguaguuugaggaaauuug

SEQ ID NO: 3208519 - RNA, 19 nt, Human
auguaguuugaggaaauuu

SEQ ID NO: 3208520 - RNA, 22 nt, Human
uuugggggaaaauuuagaaaua

SEQ ID NO: 3208521 - RNA, 15 nt, Human
auguaucaaugagua

SEQ ID NO: 3208522 - RNA, 14 nt, Human
auguaucuaagaau

SEQ ID NO: 3208523 - RNA, 16 nt, Human
auguaucuaagaauaa

SEQ ID NO: 3208524 - RNA, 14 nt, Human
augucaguaugugg

SEQ ID NO: 3208525 - RNA, 21 nt, Human
augucagugugacugaucucu

SEQ ID NO: 3208526 - RNA, 15 nt, Human
augucagugugacug

SEQ ID NO: 3208527 - RNA, 16 nt, Human
augucagugugacuga

SEQ ID NO: 3208528 - RNA, 19 nt, Human
auguccaagaagcccagga

SEQ ID NO: 3208529 - RNA, 18 nt, Human
auguccaagaagcccagg

SEQ ID NO: 3208530 - RNA, 23 nt, Human
auguccaagaagcccaggaaagg

SEQ ID NO: 3208531 - RNA, 14 nt, Human
augucccagaaaug

SEQ ID NO: 3208532 - RNA, 24 nt, Human
augucccuaccgagucucuucucc

SEQ ID NO: 3208533 - RNA, 20 nt, Human
augucccaacuuguaaaaau

SEQ ID NO: 3208534 - RNA, 21 nt, Human
auguccaguaagaucacuguu

SEQ ID NO: 3208535 - RNA, 16 nt, Human
auguccauaaaagaga

SEQ ID NO: 3208536 - RNA, 18 nt, Human
auguccauaaaagagacc

SEQ ID NO: 3208537 - RNA, 23 nt, Human
augucucuuuaaugucacaggca

SEQ ID NO: 3208538 - RNA, 13 nt, Human
augucuauugucc

SEQ ID NO: 3208539 - RNA, 14 nt, Human
augucuauugucca

SEQ ID NO: 3208540 - RNA, 23 nt, Human
uuugcucagugucuggcugcaga

SEQ ID NO: 3208541 - RNA, 19 nt, Human
uuugcuaugagcuggggau

SEQ ID NO: 3208542 - RNA, 23 nt, Human
uuugcuaaguaaaucucuucugu

SEQ ID NO: 3208543 - RNA, 21 nt, Human
uuugcuaaguaaaucucuucu

SEQ ID NO: 3208544 - RNA, 23 nt, Human
uuugcccuuuacuugucuuucug

SEQ ID NO: 3208545 - RNA, 13 nt, Human
uuugcccuuuacu

SEQ ID NO: 3208546 - RNA, 23 nt, Human
uuugcccccaaacccccauucug

SEQ ID NO: 3208547 - RNA, 22 nt, Human
uuugcccccaaacccccauucu

SEQ ID NO: 3208548 - RNA, 22 nt, Human
uuugccauguuggccaggcugg

SEQ ID NO: 3208549 - RNA, 17 nt, Human
uuugcacaaaaagauac

SEQ ID NO: 3208550 - RNA, 12 nt, Human
uuugcacaaaaa

SEQ ID NO: 3208551 - RNA, 19 nt, Human
uuuggggauucagauuucu

SEQ ID NO: 3208552 - RNA, 22 nt, Human
uuugggaggccaaggugggagg

SEQ ID NO: 3208553 - RNA, 13 nt, Human
uuuggggaagaac

SEQ ID NO: 3208554 - RNA, 21 nt, Human
uuugggaaguuaaagggaaga

SEQ ID NO: 3208555 - RNA, 17 nt, Human
uuugggaaguuaaaggg

SEQ ID NO: 3208556 - RNA, 22 nt, Human
uuuggccugaugaccaauuuua

SEQ ID NO: 3208557 - RNA, 18 nt, Human
uuuguacuuucuguuaaa

SEQ ID NO: 3208558 - RNA, 17 nt, Human
uuuguacuuucuguuaa

SEQ ID NO: 3208559 - RNA, 18 nt, Human
uuuguccugcaucaucuu

SEQ ID NO: 3208560 - RNA, 13 nt, Human
uuugucuaagaaa

SEQ ID NO: 3208561 - RNA, 20 nt, Human
uuugucuaagaaacauugga

SEQ ID NO: 3208562 - RNA, 16 nt, Human
uuugucuaagaaacau

SEQ ID NO: 3208563 - RNA, 12 nt, Human
uuugucucagau

SEQ ID NO: 3208564 - RNA, 16 nt, Human
uuugugagcaggcugu

SEQ ID NO: 3208565 - RNA, 19 nt, Human
uuugucugccccaaguuuu

SEQ ID NO: 3208566 - RNA, 21 nt, Human
uuugucugccccaaguuuugu

SEQ ID NO: 3208567 - RNA, 14 nt, Human
uuugucucuucugg

SEQ ID NO: 3208568 - RNA, 12 nt, Human
uuugucuccucu

SEQ ID NO: 3208569 - RNA, 12 nt, Human
uuugucucuucu

SEQ ID NO: 3208570 - RNA, 16 nt, Human
uuugugaguuuguuuc

SEQ ID NO: 3208571 - RNA, 15 nt, Human
uuugugaguuuguuu

SEQ ID NO: 3208572 - RNA, 18 nt, Human
uuugugaggaagccgcug

SEQ ID NO: 3208573 - RNA, 19 nt, Human
uuugugaggaagccgcugg

SEQ ID NO: 3208574 - RNA, 22 nt, Human
uuuguuucuuugaauuuucauu

SEQ ID NO: 3208575 - RNA, 17 nt, Human
uuuguuucuuucucuga

SEQ ID NO: 3208576 - RNA, 17 nt, Human
uuuguaaauuuauguga

SEQ ID NO: 3208577 - RNA, 19 nt, Human
uuuguaaauucugauuucu

SEQ ID NO: 3208578 - RNA, 20 nt, Human
uuuguaaauucugauuucuu

SEQ ID NO: 3208579 - RNA, 13 nt, Human
uuuguaaauuguc

SEQ ID NO: 3208580 - RNA, 12 nt, Human
uuuguaaauucu

SEQ ID NO: 3208581 - RNA, 15 nt, Human
uuuguaaauucugau

SEQ ID NO: 3208582 - RNA, 16 nt, Human
uuuguaaauucugauu

SEQ ID NO: 3208583 - RNA, 20 nt, Human
uuuguaaccacaacuuucac

SEQ ID NO: 3208584 - RNA, 13 nt, Human
uuuguagagccag

SEQ ID NO: 3208585 - RNA, 20 nt, Human
uuuguacuuuaucaugaaug

SEQ ID NO: 3208586 - RNA, 12 nt, Human
uuuguacuuucu

SEQ ID NO: 3208587 - RNA, 16 nt, Human
uuuguacuuucuguua

SEQ ID NO: 3208588 - RNA, 15 nt, Human
uuuguacuuucuguu

SEQ ID NO: 3208589 - RNA, 20 nt, Human
uuuguacaugccauugaaaa

SEQ ID NO: 3208590 - RNA, 14 nt, Human
uuuguaccauuuca

SEQ ID NO: 3208591 - RNA, 20 nt, Human
uuuguacgacgucagauguu

SEQ ID NO: 3208592 - RNA, 23 nt, Human
uuuuaaggguuuguggaaaauga

SEQ ID NO: 3208593 - RNA, 15 nt, Human
uuuuaaggacugacu

SEQ ID NO: 3208594 - RNA, 21 nt, Human
uuuuaagcuaggaaaagaaau

SEQ ID NO: 3208595 - RNA, 20 nt, Human
uuuuaaggguuuguggaaaa

SEQ ID NO: 3208596 - RNA, 16 nt, Human
uuuuaaggacugacug

SEQ ID NO: 3208597 - RNA, 19 nt, Human
uuuuaaggacugacugagg

SEQ ID NO: 3208598 - RNA, 22 nt, Human
uuuuaaggacugacugaggcag

SEQ ID NO: 3208599 - RNA, 23 nt, Human
uuuuaaggauaaaucauaaaguc

SEQ ID NO: 3208600 - RNA, 20 nt, Human
uuuuaagccuuuguugaacu

SEQ ID NO: 3208601 - RNA, 19 nt, Human
uuuuaagccuuuguugaac

SEQ ID NO: 3208602 - RNA, 22 nt, Human
uuuuaagaaagaaauacuguau

SEQ ID NO: 3208603 - RNA, 18 nt, Human
uuuuaagaaagaaauacu

SEQ ID NO: 3208604 - RNA, 15 nt, Human
uuuuaagaggcaggg

SEQ ID NO: 3208605 - RNA, 16 nt, Human
uuuuaagaggcagggu

SEQ ID NO: 3208606 - RNA, 18 nt, Human
uuuuaacuuagagcuuuu

SEQ ID NO: 3208607 - RNA, 17 nt, Human
uuuuaacuuagagcuuu

SEQ ID NO: 3208608 - RNA, 14 nt, Human
uuuuaagaaagaaa

SEQ ID NO: 3208609 - RNA, 20 nt, Human
uuuuaacuaaauuuuaaagc

SEQ ID NO: 3208610 - RNA, 24 nt, Human
uuuuaacuaaauuuuaaagccauu

SEQ ID NO: 3208611 - RNA, 18 nt, Human
uuuuaaaacuacuuagca

SEQ ID NO: 3208612 - RNA, 15 nt, Human
uuuuaaaacuacuua

SEQ ID NO: 3208613 - RNA, 20 nt, Human
uuuuaaaacuacuuagcacu

SEQ ID NO: 3208614 - RNA, 16 nt, Human
uuuuaaaacacuucca

SEQ ID NO: 3208615 - RNA, 22 nt, Human
uuuuaaaacacuuccauaaucu

SEQ ID NO: 3208616 - RNA, 14 nt, Human
uuuuaaaacuacuu

SEQ ID NO: 3208617 - RNA, 22 nt, Human
uuuguuugguuauagugcaaua

SEQ ID NO: 3208618 - RNA, 21 nt, Human
uuuuaaaaaacugcugacugu

SEQ ID NO: 3208619 - RNA, 14 nt, Human
uuuuaaaaaacuuu

SEQ ID NO: 3208620 - RNA, 13 nt, Human
uuuguuuguucuu

SEQ ID NO: 3208621 - RNA, 21 nt, Human
uuuuaaaaaagggaguuuuug

SEQ ID NO: 3208622 - RNA, 21 nt, Human
uuuuaaaaaguauugccaaac

SEQ ID NO: 3208623 - RNA, 20 nt, Human
uuuuaaaaaguauugccaaa

SEQ ID NO: 3208624 - RNA, 18 nt, Human
uuuuaaaaaguauugcca

SEQ ID NO: 3208625 - RNA, 14 nt, Human
uuuuaaaaaguauu

SEQ ID NO: 3208626 - RNA, 11 nt, Human
uuuuaaaaagu

SEQ ID NO: 3208627 - RNA, 11 nt, Human
uuuuaaaaaca

SEQ ID NO: 3208628 - RNA, 15 nt, Human
auucaaacagucuca

SEQ ID NO: 3208629 - RNA, 14 nt, Human
auucaaacagucuc

SEQ ID NO: 3208630 - RNA, 16 nt, Human
auucaaaaugauguau

SEQ ID NO: 3208631 - RNA, 14 nt, Human
auucagcucugcaa

SEQ ID NO: 3208632 - RNA, 18 nt, Human
auucagcucugcaagaau

SEQ ID NO: 3208633 - RNA, 21 nt, Human
auucaggaagcucagggccug

SEQ ID NO: 3208634 - RNA, 22 nt, Human
auucaggaagcucagggccugg

SEQ ID NO: 3208635 - RNA, 23 nt, Human
auucaggaagcucagggccuggc

SEQ ID NO: 3208636 - RNA, 16 nt, Human
auucaguuguuagugu

SEQ ID NO: 3208637 - RNA, 21 nt, Human
auucaguuguuagugugucuu

SEQ ID NO: 3208638 - RNA, 20 nt, Human
auucaggaagcucagggccu

SEQ ID NO: 3208639 - RNA, 20 nt, Human
auuccacuuauaggaauuga

SEQ ID NO: 3208640 - RNA, 13 nt, Human
auucaguuucuaa

SEQ ID NO: 3208641 - RNA, 18 nt, Human
auucaguuucuaaaauug

SEQ ID NO: 3208642 - RNA, 20 nt, Human
auucaguuucuaaaauugag

SEQ ID NO: 3208643 - RNA, 13 nt, Human
auucaguuuuuuu

SEQ ID NO: 3208644 - RNA, 19 nt, Human
auucaguuuuuuuccaguu

SEQ ID NO: 3208645 - RNA, 13 nt, Human
auuccacagcugc

SEQ ID NO: 3208646 - RNA, 15 nt, Human
auuccaugaauguuc

SEQ ID NO: 3208647 - RNA, 18 nt, Human
auucccuucaaugcaaaa

SEQ ID NO: 3208648 - RNA, 19 nt, Human
auucccuuguuauucaaca

SEQ ID NO: 3208649 - RNA, 23 nt, Human
auucccuuuucaccuuuucagga

SEQ ID NO: 3208650 - RNA, 16 nt, Human
auucccuuguuauuca

SEQ ID NO: 3208651 - RNA, 16 nt, Human
auuccccaggaggcca

SEQ ID NO: 3208652 - RNA, 20 nt, Human
auuccauuuacugcauucuu

SEQ ID NO: 3208653 - RNA, 22 nt, Human
auuccccacccugaaagcccug

SEQ ID NO: 3208654 - RNA, 20 nt, Human
auuccccagauugcaacagg

SEQ ID NO: 3208655 - RNA, 23 nt, Human
auuauagagcagaaauucuguuu

SEQ ID NO: 3208656 - RNA, 14 nt, Human
auuauagagcagaa

SEQ ID NO: 3208657 - RNA, 21 nt, Human
auuauagagcagaaauucugu

SEQ ID NO: 3208658 - RNA, 19 nt, Human
auuauagagcagaaauucu

SEQ ID NO: 3208659 - RNA, 17 nt, Human
auuauagagcagaaauu

SEQ ID NO: 3208660 - RNA, 16 nt, Human
auuauagagcagaaau

SEQ ID NO: 3208661 - RNA, 13 nt, Human
auuauaauguauu

SEQ ID NO: 3208662 - RNA, 14 nt, Human
auuauaauguauuc

SEQ ID NO: 3208663 - RNA, 21 nt, Human
auuauaauguauucauauuug

SEQ ID NO: 3208664 - RNA, 19 nt, Human
auuauaauguauucauauu

SEQ ID NO: 3208665 - RNA, 22 nt, Human
auuauaauguauucauauuugu

SEQ ID NO: 3208666 - RNA, 18 nt, Human
auuauaauuguugcauag

SEQ ID NO: 3208667 - RNA, 16 nt, Human
auuauaauuguugcau

SEQ ID NO: 3208668 - RNA, 15 nt, Human
auuauaauuguugca

SEQ ID NO: 3208669 - RNA, 13 nt, Human
auuauaauuguug

SEQ ID NO: 3208670 - RNA, 18 nt, Human
auuacugcuuuaaucaga

SEQ ID NO: 3208671 - RNA, 20 nt, Human
auuacugcuuuaaucagaaa

SEQ ID NO: 3208672 - RNA, 21 nt, Human
auuacugcuuuaaucagaaac

SEQ ID NO: 3208673 - RNA, 17 nt, Human
auuacuggaucucuuaa

SEQ ID NO: 3208674 - RNA, 19 nt, Human
auuacuggaucucuuaaga

SEQ ID NO: 3208675 - RNA, 18 nt, Human
auuacuuguugccuauaa

SEQ ID NO: 3208676 - RNA, 15 nt, Human
auuacuuuaacaugc

SEQ ID NO: 3208677 - RNA, 16 nt, Human
auuacuuuaacaugcc

SEQ ID NO: 3208678 - RNA, 12 nt, Human
auuagaaaacuu

SEQ ID NO: 3208679 - RNA, 17 nt, Human
auuagaaaacuuuguua

SEQ ID NO: 3208680 - RNA, 16 nt, Human
auuagaaaacuuuguu

SEQ ID NO: 3208681 - RNA, 17 nt, Human
auuacuuguugccuaua

SEQ ID NO: 3208682 - RNA, 19 nt, Human
auuaccuggauguucuuuu

SEQ ID NO: 3208683 - RNA, 14 nt, Human
auuagaacccuugc

SEQ ID NO: 3208684 - RNA, 18 nt, Human
auuagaaaacuuuguuag

SEQ ID NO: 3208685 - RNA, 13 nt, Human
auuagaaaauauu

SEQ ID NO: 3208686 - RNA, 15 nt, Human
auuagaaaauauucu

SEQ ID NO: 3208687 - RNA, 17 nt, Human
auuagaaaauauucucu

SEQ ID NO: 3208688 - RNA, 21 nt, Human
auuagaaaauauucucuauuu

SEQ ID NO: 3208689 - RNA, 15 nt, Human
auuauaagucuuaca

SEQ ID NO: 3208690 - RNA, 17 nt, Human
auuauaagucuuacaua

SEQ ID NO: 3208691 - RNA, 19 nt, Human
auuauaagucuuacauaaa

SEQ ID NO: 3208692 - RNA, 18 nt, Human
auuauaaucaccagggcc

SEQ ID NO: 3208693 - RNA, 13 nt, Human
auuagagaagaga

SEQ ID NO: 3208694 - RNA, 15 nt, Human
auuagaauuaccauu

SEQ ID NO: 3208695 - RNA, 17 nt, Human
auuagaauuaccauuug

SEQ ID NO: 3208696 - RNA, 19 nt, Human
auuagaauuaccauuuguu

SEQ ID NO: 3208697 - RNA, 21 nt, Human
auuagaauuaccauuuguuaa

SEQ ID NO: 3208698 - RNA, 13 nt, Human
auuauuuuaaaag

SEQ ID NO: 3208699 - RNA, 13 nt, Human
auuauuuauuaca

SEQ ID NO: 3208700 - RNA, 23 nt, Human
auuauuuauuaaaugcccagccc

SEQ ID NO: 3208701 - RNA, 14 nt, Human
auuauuuuaaaaga

SEQ ID NO: 3208702 - RNA, 15 nt, Human
auuauuaaugcuuug

SEQ ID NO: 3208703 - RNA, 14 nt, Human
auuauuaaugcuuu

SEQ ID NO: 3208704 - RNA, 16 nt, Human
auuauuaaugcuuugg

SEQ ID NO: 3208705 - RNA, 20 nt, Human
auuauucuuucuccuuuuuu

SEQ ID NO: 3208706 - RNA, 14 nt, Human
auuauuuacaagaa

SEQ ID NO: 3208707 - RNA, 16 nt, Human
auuauucuuucuccuu

SEQ ID NO: 3208708 - RNA, 13 nt, Human
auuauucuuucuc

SEQ ID NO: 3208709 - RNA, 19 nt, Human
auuauugagagcccuagaa

SEQ ID NO: 3208710 - RNA, 20 nt, Human
auuauugaguuccaguugaa

SEQ ID NO: 3208711 - RNA, 21 nt, Human
auuauugaguuccaguugaag

SEQ ID NO: 3208712 - RNA, 21 nt, Human
auuaucaaguagacuacuguu

SEQ ID NO: 3208713 - RNA, 13 nt, Human
auuaucagcaaag

SEQ ID NO: 3208714 - RNA, 15 nt, Human
auuaucagcaaagaa

SEQ ID NO: 3208715 - RNA, 16 nt, Human
auuaucagcaaagaaa

SEQ ID NO: 3208716 - RNA, 23 nt, Human
auuaucucaaaacugcacuguca

SEQ ID NO: 3208717 - RNA, 18 nt, Human
auuaucucaaaacugcac

SEQ ID NO: 3208718 - RNA, 18 nt, Human
auuaucuuguucaggaaa

SEQ ID NO: 3208719 - RNA, 14 nt, Human
auuauguuuuacug

SEQ ID NO: 3208720 - RNA, 23 nt, Human
auuauuaaauuguaaaacuccaa

SEQ ID NO: 3208721 - RNA, 16 nt, Human
auuaagaucucagugg

SEQ ID NO: 3208722 - RNA, 22 nt, Human
uuuuuguuccacaaguuaaaua

SEQ ID NO: 3208723 - RNA, 21 nt, Human
auuaagacaauagcacuuaaa

SEQ ID NO: 3208724 - RNA, 19 nt, Human
auuaaguaagucucaaggu

SEQ ID NO: 3208725 - RNA, 15 nt, Human
auuaagguguuugaa

SEQ ID NO: 3208726 - RNA, 17 nt, Human
auuaagguguuugaaaa

SEQ ID NO: 3208727 - RNA, 18 nt, Human
auuaagguguuugaaaau

SEQ ID NO: 3208728 - RNA, 20 nt, Human
auuaagguguuugaaaauag

SEQ ID NO: 3208729 - RNA, 18 nt, Human
uuuuuguuuuguugcacu

SEQ ID NO: 3208730 - RNA, 14 nt, Human
uuuuuguuuuucug

SEQ ID NO: 3208731 - RNA, 16 nt, Human
uuuuuguuuuucugcu

SEQ ID NO: 3208732 - RNA, 12 nt, Human
auuaauauucau

SEQ ID NO: 3208733 - RNA, 12 nt, Human
auuaauauauua

SEQ ID NO: 3208734 - RNA, 13 nt, Human
auuaauauauuaa

SEQ ID NO: 3208735 - RNA, 14 nt, Human
auuaauauauuaaa

SEQ ID NO: 3208736 - RNA, 14 nt, Human
auuaauaucuuucu

SEQ ID NO: 3208737 - RNA, 17 nt, Human
auuaauaucuuucugca

SEQ ID NO: 3208738 - RNA, 19 nt, Human
auuaauaucuuucugcaca

SEQ ID NO: 3208739 - RNA, 17 nt, Human
auuaauccacauguuuc

SEQ ID NO: 3208740 - RNA, 18 nt, Human
auuaauccacauguuuca

SEQ ID NO: 3208741 - RNA, 18 nt, Human
auuacauuuguaauuuaa

SEQ ID NO: 3208742 - RNA, 15 nt, Human
auuacauuuguaauu

SEQ ID NO: 3208743 - RNA, 14 nt, Human
auuacauuuguaau

SEQ ID NO: 3208744 - RNA, 13 nt, Human
auuacauuuguaa

SEQ ID NO: 3208745 - RNA, 23 nt, Human
auuacauuuuauuaagcuuuuug

SEQ ID NO: 3208746 - RNA, 19 nt, Human
auuacauuuguaauuuaag

SEQ ID NO: 3208747 - RNA, 12 nt, Human
auuaccaaaaua

SEQ ID NO: 3208748 - RNA, 19 nt, Human
auuaccaauaggcaaauua

SEQ ID NO: 3208749 - RNA, 20 nt, Human
auuaccaauaggcaaauuaa

SEQ ID NO: 3208750 - RNA, 22 nt, Human
auuaccaauaggcaaauuaauc

SEQ ID NO: 3208751 - RNA, 22 nt, Human
auuaccugaauuuuggcugugu

SEQ ID NO: 3208752 - RNA, 22 nt, Human
auuaccaccaucccgugcuuuu

SEQ ID NO: 3208753 - RNA, 15 nt, Human
auuaccaccaucccg

SEQ ID NO: 3208754 - RNA, 20 nt, Human
auuaccucuuuggaaaagga

SEQ ID NO: 3208755 - RNA, 16 nt, Human
aucuguaccucugccu

SEQ ID NO: 3208756 - RNA, 23 nt, Human
aucugugaaaggaaagagggagg

SEQ ID NO: 3208757 - RNA, 11 nt, Human
aucugugaaau

SEQ ID NO: 3208758 - RNA, 12 nt, Human
aucugugaaaua

SEQ ID NO: 3208759 - RNA, 16 nt, Human
aucugugaaauaucau

SEQ ID NO: 3208760 - RNA, 17 nt, Human
aucugugaaauaucauc

SEQ ID NO: 3208761 - RNA, 15 nt, Human
aucugguauuaaaug

SEQ ID NO: 3208762 - RNA, 16 nt, Human
aucugguauuaaaugc

SEQ ID NO: 3208763 - RNA, 18 nt, Human
aucugguauuaaaugcca

SEQ ID NO: 3208764 - RNA, 17 nt, Human
aucuguaagcuguuugg

SEQ ID NO: 3208765 - RNA, 15 nt, Human
aucuguaagcuguuu

SEQ ID NO: 3208766 - RNA, 14 nt, Human
aucuguaagcuguu

SEQ ID NO: 3208767 - RNA, 12 nt, Human
aucuguaagcug

SEQ ID NO: 3208768 - RNA, 17 nt, Human
aucuguaagaguguuua

SEQ ID NO: 3208769 - RNA, 17 nt, Human
aucuggguucacugcaa

SEQ ID NO: 3208770 - RNA, 19 nt, Human
aucuggguucacugcaacc

SEQ ID NO: 3208771 - RNA, 19 nt, Human
aucuugcucugcugacaga

SEQ ID NO: 3208772 - RNA, 17 nt, Human
aucuugcucugcugaca

SEQ ID NO: 3208773 - RNA, 17 nt, Human
aucuugaauuguaagga

SEQ ID NO: 3208774 - RNA, 18 nt, Human
aucuugaauuguaaggaa

SEQ ID NO: 3208775 - RNA, 14 nt, Human
aucuugacagagcc

SEQ ID NO: 3208776 - RNA, 17 nt, Human
aucuguuagaugcuacu

SEQ ID NO: 3208777 - RNA, 18 nt, Human
aucuguuagaugcuacua

SEQ ID NO: 3208778 - RNA, 19 nt, Human
aucuguuagaugcuacuaa

SEQ ID NO: 3208779 - RNA, 23 nt, Human
aucuguuagaugcuacuaagaaa

SEQ ID NO: 3208780 - RNA, 23 nt, Human
aucuguuauagguccuuuagaaa

SEQ ID NO: 3208781 - RNA, 11 nt, Human
aucugugaaua

SEQ ID NO: 3208782 - RNA, 13 nt, Human
aucugugaauaag

SEQ ID NO: 3208783 - RNA, 12 nt, Human
aucugugaauaa

SEQ ID NO: 3208784 - RNA, 12 nt, Human
aucuuacuuugu

SEQ ID NO: 3208785 - RNA, 13 nt, Human
aucuuacuuugua

SEQ ID NO: 3208786 - RNA, 14 nt, Human
aucuuacuuuguaa

SEQ ID NO: 3208787 - RNA, 21 nt, Human
aucuuacuuuguaaauucuga

SEQ ID NO: 3208788 - RNA, 22 nt, Human
aucuuacuuuguaaauucugau

SEQ ID NO: 3208789 - RNA, 16 nt, Human
aucuuacuuuguaaau

SEQ ID NO: 3208790 - RNA, 17 nt, Human
aucuuacuuuguaaauu

SEQ ID NO: 3208791 - RNA, 19 nt, Human
aucuuacuuuguaaauucu

SEQ ID NO: 3208792 - RNA, 20 nt, Human
aucuuacuuuguaaauucug

SEQ ID NO: 3208793 - RNA, 20 nt, Human
aucugagaggccacagugca

SEQ ID NO: 3208794 - RNA, 18 nt, Human
uugccuauauuuuccuga

SEQ ID NO: 3208795 - RNA, 17 nt, Human
uugccuauauuuuccug

SEQ ID NO: 3208796 - RNA, 20 nt, Human
uugccuauaagccaaaauua

SEQ ID NO: 3208797 - RNA, 18 nt, Human
uugccucagcuuccccag

SEQ ID NO: 3208798 - RNA, 19 nt, Human
uugccucagcuuccccagu

SEQ ID NO: 3208799 - RNA, 18 nt, Human
aucugaugcaagcaagaa

SEQ ID NO: 3208800 - RNA, 14 nt, Human
aucugauuccagca

SEQ ID NO: 3208801 - RNA, 21 nt, Human
aucugcaaagcauguuuugca

SEQ ID NO: 3208802 - RNA, 16 nt, Human
aucugcaaagcauguu

SEQ ID NO: 3208803 - RNA, 22 nt, Human
aucugcaaagcauguuuugcau

SEQ ID NO: 3208804 - RNA, 13 nt, Human
uugcccuguuaaa

SEQ ID NO: 3208805 - RNA, 13 nt, Human
uugccgucuaccu

SEQ ID NO: 3208806 - RNA, 22 nt, Human
uugcccuuuacuugucuuucug

SEQ ID NO: 3208807 - RNA, 18 nt, Human
uugccguggcaucuuaaa

SEQ ID NO: 3208808 - RNA, 19 nt, Human
uugccgucuaccugagggg

SEQ ID NO: 3208809 - RNA, 15 nt, Human
uugccgucuaccuga

SEQ ID NO: 3208810 - RNA, 18 nt, Human
uugccgucuaccugaggg

SEQ ID NO: 3208811 - RNA, 21 nt, Human
uugcaucuggguagcuguaag

SEQ ID NO: 3208812 - RNA, 18 nt, Human
uugcaucuggguagcugu

SEQ ID NO: 3208813 - RNA, 20 nt, Human
uugcaucuggguagcuguaa

SEQ ID NO: 3208814 - RNA, 19 nt, Human
uugcaucuggguagcugua

SEQ ID NO: 3208815 - RNA, 15 nt, Human
uugauucagacagcu

SEQ ID NO: 3208816 - RNA, 16 nt, Human
uugauucagacagcug

SEQ ID NO: 3208817 - RNA, 19 nt, Human
uugcaauuaaacuuccaaa

SEQ ID NO: 3208818 - RNA, 22 nt, Human
uugcacaaaaagauaccuuaaa

SEQ ID NO: 3208819 - RNA, 15 nt, Human
uugcacaaaaagaua

SEQ ID NO: 3208820 - RNA, 15 nt, Human
uugcacaauuauaaa

SEQ ID NO: 3208821 - RNA, 17 nt, Human
uugcacacaucaucugu

SEQ ID NO: 3208822 - RNA, 15 nt, Human
uugcacacaucaucu

SEQ ID NO: 3208823 - RNA, 23 nt, Human
uugcacaaaaagauaccuuaaaa

SEQ ID NO: 3208824 - RNA, 19 nt, Human
uugcacacaucaucuguaa

SEQ ID NO: 3208825 - RNA, 18 nt, Human
uugcacacaucaucugua

SEQ ID NO: 3208826 - RNA, 20 nt, Human
uugcacacaucaucuguaag

SEQ ID NO: 3208827 - RNA, 14 nt, Human
uugcacauggauuc

SEQ ID NO: 3208828 - RNA, 19 nt, Human
uugcacauggauucaguuu

SEQ ID NO: 3208829 - RNA, 16 nt, Human
uugauucacauguuuu

SEQ ID NO: 3208830 - RNA, 14 nt, Human
uugauucacauguu

SEQ ID NO: 3208831 - RNA, 12 nt, Human
uugauguguugu

SEQ ID NO: 3208832 - RNA, 13 nt, Human
uugauguguuguu

SEQ ID NO: 3208833 - RNA, 14 nt, Human
uugauguguuguuc

SEQ ID NO: 3208834 - RNA, 14 nt, Human
uugauucagacagc

SEQ ID NO: 3208835 - RNA, 23 nt, Human
uugauucacauguuuucaaaugg

SEQ ID NO: 3208836 - RNA, 20 nt, Human
uugauucacauguuuucaaa

SEQ ID NO: 3208837 - RNA, 19 nt, Human
uugauucacauguuuucaa

SEQ ID NO: 3208838 - RNA, 18 nt, Human
uugauucacauguuuuca

SEQ ID NO: 3208839 - RNA, 23 nt, Human
uugauggugaugaaauguaaaua

SEQ ID NO: 3208840 - RNA, 12 nt, Human
uugaugucagca

SEQ ID NO: 3208841 - RNA, 18 nt, Human
uugaugucagcaguugcu

SEQ ID NO: 3208842 - RNA, 23 nt, Human
uugauguaaagauguucuggaua

SEQ ID NO: 3208843 - RNA, 14 nt, Human
uugauguaaagaug

SEQ ID NO: 3208844 - RNA, 23 nt, Human
uugaugcauuaaaagaaaauaaa

SEQ ID NO: 3208845 - RNA, 19 nt, Human
aucucuucuggguuccuuc

SEQ ID NO: 3208846 - RNA, 20 nt, Human
uugaugcauuaaaagaaaau

SEQ ID NO: 3208847 - RNA, 22 nt, Human
uugaugggaugauugaagaaac

SEQ ID NO: 3208848 - RNA, 21 nt, Human
uugaugggaugauugaagaaa

SEQ ID NO: 3208849 - RNA, 21 nt, Human
aucucccacaugccaggggcc

SEQ ID NO: 3208850 - RNA, 13 nt, Human
aucucccacaugc

SEQ ID NO: 3208851 - RNA, 12 nt, Human
aucucccccagc

SEQ ID NO: 3208852 - RNA, 13 nt, Human
aucucccccagcc

SEQ ID NO: 3208853 - RNA, 21 nt, Human
aucucuuaagacagcaugugu

SEQ ID NO: 3208854 - RNA, 22 nt, Human
aucucuuaagacagcauguguu

SEQ ID NO: 3208855 - RNA, 23 nt, Human
aucucuuaagacagcauguguua

SEQ ID NO: 3208856 - RNA, 23 nt, Human
aucucagugguuaagauuccuaa

SEQ ID NO: 3208857 - RNA, 14 nt, Human
aucucagugcuuuc

SEQ ID NO: 3208858 - RNA, 15 nt, Human
aucucagugcuuucc

SEQ ID NO: 3208859 - RNA, 13 nt, Human
aucucaucauguc

SEQ ID NO: 3208860 - RNA, 16 nt, Human
aucucaucaugucuau

SEQ ID NO: 3208861 - RNA, 19 nt, Human
aucucaucaugucuauugu

SEQ ID NO: 3208862 - RNA, 15 nt, Human
aucuccacuccagau

SEQ ID NO: 3208863 - RNA, 15 nt, Human
aucucacacaugagc

SEQ ID NO: 3208864 - RNA, 15 nt, Human
auccuaguuccacca

SEQ ID NO: 3208865 - RNA, 19 nt, Human
auccuaguuccaccaucaa

SEQ ID NO: 3208866 - RNA, 18 nt, Human
aucucagauguuaaaaua

SEQ ID NO: 3208867 - RNA, 19 nt, Human
aucucagauguuaaaauaa

SEQ ID NO: 3208868 - RNA, 20 nt, Human
aucucagauguuaaaauaaa

SEQ ID NO: 3208869 - RNA, 21 nt, Human
aucucagauguuaaaauaaau

SEQ ID NO: 3208870 - RNA, 23 nt, Human
aucucagauguuaaaauaaaugg

SEQ ID NO: 3208871 - RNA, 11 nt, Human
aucucagccca

SEQ ID NO: 3208872 - RNA, 17 nt, Human
aucucagauauuugcac

SEQ ID NO: 3208873 - RNA, 16 nt, Human
aucucagauauuugca

SEQ ID NO: 3208874 - RNA, 15 nt, Human
aucucagauauuugc

SEQ ID NO: 3208875 - RNA, 14 nt, Human
aucucagauauuug

SEQ ID NO: 3208876 - RNA, 17 nt, Human
aucucagcccugcaacu

SEQ ID NO: 3208877 - RNA, 14 nt, Human
aucucaguccucaa

SEQ ID NO: 3208878 - RNA, 19 nt, Human
augagaacagauaaagauu

SEQ ID NO: 3208879 - RNA, 18 nt, Human
augagaacagauaaagau

SEQ ID NO: 3208880 - RNA, 17 nt, Human
augagaacagauaaaga

SEQ ID NO: 3208881 - RNA, 22 nt, Human
augagaaagguugaagcaccaa

SEQ ID NO: 3208882 - RNA, 21 nt, Human
augagaaagguugaagcacca

SEQ ID NO: 3208883 - RNA, 22 nt, Human
augagaacagauaaagauugug

SEQ ID NO: 3208884 - RNA, 11 nt, Human
augagaauguu

SEQ ID NO: 3208885 - RNA, 22 nt, Human
augacuuaagcacacuugacau

SEQ ID NO: 3208886 - RNA, 23 nt, Human
augaccaaauaucaccaggacug

SEQ ID NO: 3208887 - RNA, 13 nt, Human
augaccaauuuua

SEQ ID NO: 3208888 - RNA, 20 nt, Human
augaccaauuuuaacuuaga

SEQ ID NO: 3208889 - RNA, 17 nt, Human
augaccaauuuuaacuu

SEQ ID NO: 3208890 - RNA, 18 nt, Human
augacacgaauauugcug

SEQ ID NO: 3208891 - RNA, 15 nt, Human
augacaccaucuuuu

SEQ ID NO: 3208892 - RNA, 16 nt, Human
augacaccaucuuuua

SEQ ID NO: 3208893 - RNA, 20 nt, Human
augacaccaucuuuuauucu

SEQ ID NO: 3208894 - RNA, 22 nt, Human
augacaccaucuuuuauucuuu

SEQ ID NO: 3208895 - RNA, 23 nt, Human
augacaccaucuuuuauucuuuu

SEQ ID NO: 3208896 - RNA, 19 nt, Human
augacuuccccaauaucuu

SEQ ID NO: 3208897 - RNA, 22 nt, Human
augacuuccccaauaucuugcu

SEQ ID NO: 3208898 - RNA, 18 nt, Human
augacuuuuugaaaguaa

SEQ ID NO: 3208899 - RNA, 14 nt, Human
augacuuuuugaaa

SEQ ID NO: 3208900 - RNA, 17 nt, Human
augacuuuauuauuuau

SEQ ID NO: 3208901 - RNA, 16 nt, Human
augacuuuauugcauc

SEQ ID NO: 3208902 - RNA, 13 nt, Human
augacuuuauugc

SEQ ID NO: 3208903 - RNA, 18 nt, Human
augacuuuauuauuuauu

SEQ ID NO: 3208904 - RNA, 21 nt, Human
augacuuuauugcaucugggu

SEQ ID NO: 3208905 - RNA, 13 nt, Human
uuguauacaagua

SEQ ID NO: 3208906 - RNA, 16 nt, Human
uuguauacaaguacug

SEQ ID NO: 3208907 - RNA, 17 nt, Human
uuguauacaaguacugg

SEQ ID NO: 3208908 - RNA, 19 nt, Human
uuguaguguucagaaaaaa

SEQ ID NO: 3208909 - RNA, 19 nt, Human
uuguauauugguuuuauga

SEQ ID NO: 3208910 - RNA, 22 nt, Human
uuguauauugguuuuaugauga

SEQ ID NO: 3208911 - RNA, 19 nt, Human
uuguauaguuauguaaaua

SEQ ID NO: 3208912 - RNA, 20 nt, Human
uuguauaguuauguaaauaa

SEQ ID NO: 3208913 - RNA, 14 nt, Human
uuguauauucuauu

SEQ ID NO: 3208914 - RNA, 13 nt, Human
uuguauauugguu

SEQ ID NO: 3208915 - RNA, 22 nt, Human
uuguauauucuauuuuacaacu

SEQ ID NO: 3208916 - RNA, 14 nt, Human
uuguauauugguuu

SEQ ID NO: 3208917 - RNA, 16 nt, Human
uuguauauugguuuua

SEQ ID NO: 3208918 - RNA, 14 nt, Human
uuguauaguuaugu

SEQ ID NO: 3208919 - RNA, 16 nt, Human
uuguauaguuauguaa

SEQ ID NO: 3208920 - RNA, 17 nt, Human
uuguauaguuauguaaa

SEQ ID NO: 3208921 - RNA, 18 nt, Human
uuguauaguuauguaaau

SEQ ID NO: 3208922 - RNA, 16 nt, Human
uuguaucacaaaucuu

SEQ ID NO: 3208923 - RNA, 12 nt, Human
augaauuguaaa

SEQ ID NO: 3208924 - RNA, 14 nt, Human
augaauuuuaaagu

SEQ ID NO: 3208925 - RNA, 15 nt, Human
augaauuuuaaagua

SEQ ID NO: 3208926 - RNA, 16 nt, Human
augaauuuuaaaguau

SEQ ID NO: 3208927 - RNA, 17 nt, Human
augaauuuuaaaguaug

SEQ ID NO: 3208928 - RNA, 22 nt, Human
augaauuuuaaaguaugcauua

SEQ ID NO: 3208929 - RNA, 20 nt, Human
augaauuuuuuuauuucugu

SEQ ID NO: 3208930 - RNA, 20 nt, Human
uuguaggcgaaucauuuguu

SEQ ID NO: 3208931 - RNA, 12 nt, Human
uugguuggaagg

SEQ ID NO: 3208932 - RNA, 16 nt, Human
uugguugaauaaacua

SEQ ID NO: 3208933 - RNA, 13 nt, Human
uugguugaauaaa

SEQ ID NO: 3208934 - RNA, 18 nt, Human
aucuuuaauuaaaaccug

SEQ ID NO: 3208935 - RNA, 18 nt, Human
aucuuugcagacaggcaa

SEQ ID NO: 3208936 - RNA, 16 nt, Human
aucuuuagaaaaggca

SEQ ID NO: 3208937 - RNA, 13 nt, Human
aucuuuuucuaac

SEQ ID NO: 3208938 - RNA, 15 nt, Human
aucuuuguaccaaaa

SEQ ID NO: 3208939 - RNA, 17 nt, Human
aucuuuguaccaaaauu

SEQ ID NO: 3208940 - RNA, 19 nt, Human
aucuuuguaccaaaauuuu

SEQ ID NO: 3208941 - RNA, 20 nt, Human
aucuuuguaccaaaauuuua

SEQ ID NO: 3208942 - RNA, 21 nt, Human
aucuuuguaccaaaauuuuaa

SEQ ID NO: 3208943 - RNA, 19 nt, Human
aucuuuuuaaccucuguuc

SEQ ID NO: 3208944 - RNA, 22 nt, Human
aucuuuuguuacucuugggaca

SEQ ID NO: 3208945 - RNA, 15 nt, Human
augaaagcagggacu

SEQ ID NO: 3208946 - RNA, 21 nt, Human
aucuuuuuaaccucuguucag

SEQ ID NO: 3208947 - RNA, 19 nt, Human
augaaagcauggcuaauag

SEQ ID NO: 3208948 - RNA, 22 nt, Human
uuggaguucauucauauuacaa

SEQ ID NO: 3208949 - RNA, 21 nt, Human
uuggaguucauucauauuaca

SEQ ID NO: 3208950 - RNA, 19 nt, Human
uuggaguucauucauauua

SEQ ID NO: 3208951 - RNA, 18 nt, Human
uuggaguucauucauauu

SEQ ID NO: 3208952 - RNA, 12 nt, Human
aucuugcuugaa

SEQ ID NO: 3208953 - RNA, 13 nt, Human
uuggaguuaaaau

SEQ ID NO: 3208954 - RNA, 16 nt, Human
uuggaguucauucaua

SEQ ID NO: 3208955 - RNA, 14 nt, Human
uuggaguucauuca

SEQ ID NO: 3208956 - RNA, 18 nt, Human
uuggaugaguuuugggaa

SEQ ID NO: 3208957 - RNA, 12 nt, Human
uuggaugaguuu

SEQ ID NO: 3208958 - RNA, 22 nt, Human
uuggauaacaccaccauucaca

SEQ ID NO: 3208959 - RNA, 17 nt, Human
uuggaguuggaguagaa

SEQ ID NO: 3208960 - RNA, 15 nt, Human
uuggaucaaguauua

SEQ ID NO: 3208961 - RNA, 15 nt, Human
uuggauuaaauuagu

SEQ ID NO: 3208962 - RNA, 22 nt, Human
uuggcgcugccccuggcagccc

SEQ ID NO: 3208963 - RNA, 21 nt, Human
uuggauuauucuuucuccuuu

SEQ ID NO: 3208964 - RNA, 17 nt, Human
uuggauuauucuuucuc

SEQ ID NO: 3208965 - RNA, 23 nt, Human
uuggcgcugccccuggcagcccc

SEQ ID NO: 3208966 - RNA, 19 nt, Human
uuggcguagcagaguuaaa

SEQ ID NO: 3208967 - RNA, 22 nt, Human
uuggcguagcagaguuaaaucu

SEQ ID NO: 3208968 - RNA, 12 nt, Human
uuggcucugagg

SEQ ID NO: 3208969 - RNA, 13 nt, Human
augaacuuaacau

SEQ ID NO: 3208970 - RNA, 16 nt, Human
augaacuuaacaugcu

SEQ ID NO: 3208971 - RNA, 20 nt, Human
augaacuuaacaugcugugu

SEQ ID NO: 3208972 - RNA, 12 nt, Human
augaacugaaag

SEQ ID NO: 3208973 - RNA, 18 nt, Human
augaagauguagaggaga

SEQ ID NO: 3208974 - RNA, 13 nt, Human
augaaugaauggc

SEQ ID NO: 3208975 - RNA, 15 nt, Human
augaacuuauuaaua

SEQ ID NO: 3208976 - RNA, 20 nt, Human
augaaugucagugugacuga

SEQ ID NO: 3208977 - RNA, 23 nt, Human
augaaugacuuccccaauaucuu

SEQ ID NO: 3208978 - RNA, 22 nt, Human
augaaugacuuccccaauaucu

SEQ ID NO: 3208979 - RNA, 16 nt, Human
uuggggauguuuuucu

SEQ ID NO: 3208980 - RNA, 21 nt, Human
uuggggcuuuacauacuuuau

SEQ ID NO: 3208981 - RNA, 22 nt, Human
uugggggaggggagacuuugau

SEQ ID NO: 3208982 - RNA, 23 nt, Human
uugggggaggggagacuuugaug

SEQ ID NO: 3208983 - RNA, 15 nt, Human
uugggggcucagcaa

SEQ ID NO: 3208984 - RNA, 13 nt, Human
uugguuccugggg

SEQ ID NO: 3208985 - RNA, 22 nt, Human
uuggggggcugaggugggagga

SEQ ID NO: 3208986 - RNA, 18 nt, Human
uugggccccagaggcugg

SEQ ID NO: 3208987 - RNA, 23 nt, Human
augaauguuccugccuccuugau

SEQ ID NO: 3208988 - RNA, 13 nt, Human
augaauguuccug

SEQ ID NO: 3208989 - RNA, 22 nt, Human
uuucagaaguuuaaauauuaag

SEQ ID NO: 3208990 - RNA, 13 nt, Human
uuucagaagaaau

SEQ ID NO: 3208991 - RNA, 16 nt, Human
uuucagaagaaauaaa

SEQ ID NO: 3208992 - RNA, 21 nt, Human
uuucagaagaaauaaauauac

SEQ ID NO: 3208993 - RNA, 21 nt, Human
uuucagaaguuuaaauauuaa

SEQ ID NO: 3208994 - RNA, 17 nt, Human
uuucaucauauuauaca

SEQ ID NO: 3208995 - RNA, 16 nt, Human
uuucaucauauuauac

SEQ ID NO: 3208996 - RNA, 24 nt, Human
uuucaucagaacagcuguugacuc

SEQ ID NO: 3208997 - RNA, 17 nt, Human
uuucaucagaacagcug

SEQ ID NO: 3208998 - RNA, 17 nt, Human
uuucauauuuuaaacag

SEQ ID NO: 3208999 - RNA, 22 nt, Human
uuucauauuuuaauuucaagcu

SEQ ID NO: 3209000 - RNA, 18 nt, Human
uuucauauuuuaauuuca

SEQ ID NO: 3209001 - RNA, 18 nt, Human
uuucauauuuuucaaaau

SEQ ID NO: 3209002 - RNA, 17 nt, Human
uuucauauuuuucaaaa

SEQ ID NO: 3209003 - RNA, 21 nt, Human
auggaaugaugggucaguugu

SEQ ID NO: 3209004 - RNA, 13 nt, Human
auggaaugagggu

SEQ ID NO: 3209005 - RNA, 14 nt, Human
auggaaugaggguu

SEQ ID NO: 3209006 - RNA, 16 nt, Human
auggaagacagcucuu

SEQ ID NO: 3209007 - RNA, 22 nt, Human
uuucacugcuggcugccuuaga

SEQ ID NO: 3209008 - RNA, 20 nt, Human
uuucacugcuggcugccuua

SEQ ID NO: 3209009 - RNA, 18 nt, Human
uuucacugcuggcugccu

SEQ ID NO: 3209010 - RNA, 17 nt, Human
uuucacugcuggcugcc

SEQ ID NO: 3209011 - RNA, 14 nt, Human
uuucacugcuggcu

SEQ ID NO: 3209012 - RNA, 12 nt, Human
uuucaugugcuc

SEQ ID NO: 3209013 - RNA, 22 nt, Human
uuucauguccugugucaguuua

SEQ ID NO: 3209014 - RNA, 21 nt, Human
uuucauguccugugucaguuu

SEQ ID NO: 3209015 - RNA, 17 nt, Human
uuucauguccuguguca

SEQ ID NO: 3209016 - RNA, 15 nt, Human
uuucauguccauaaa

SEQ ID NO: 3209017 - RNA, 18 nt, Human
uuucaugucccagaacuu

SEQ ID NO: 3209018 - RNA, 14 nt, Human
auggacaugaucuu

SEQ ID NO: 3209019 - RNA, 18 nt, Human
auggacagcauugccagu

SEQ ID NO: 3209020 - RNA, 14 nt, Human
uuucccauuuagaa

SEQ ID NO: 3209021 - RNA, 14 nt, Human
uuuccccagggcac

SEQ ID NO: 3209022 - RNA, 16 nt, Human
auggccugggggaugu

SEQ ID NO: 3209023 - RNA, 20 nt, Human
auggcuaguaucaaaagaaa

SEQ ID NO: 3209024 - RNA, 17 nt, Human
auggcuacuugcuuuga

SEQ ID NO: 3209025 - RNA, 18 nt, Human
auggcuaauguacugcau

SEQ ID NO: 3209026 - RNA, 21 nt, Human
auggccgggcgcgguggcuca

SEQ ID NO: 3209027 - RNA, 16 nt, Human
auggccagguggccac

SEQ ID NO: 3209028 - RNA, 21 nt, Human
auggccaggaaguagcacagg

SEQ ID NO: 3209029 - RNA, 23 nt, Human
auggccaggaaguagcacaggcu

SEQ ID NO: 3209030 - RNA, 22 nt, Human
auggccaggaaguagcacaggc

SEQ ID NO: 3209031 - RNA, 22 nt, Human
auggccagguggccacuccaga

SEQ ID NO: 3209032 - RNA, 18 nt, Human
auggauuuccagccaaag

SEQ ID NO: 3209033 - RNA, 23 nt, Human
auggacguguuaugacuccagaa

SEQ ID NO: 3209034 - RNA, 19 nt, Human
auggacguguuaugacucc

SEQ ID NO: 3209035 - RNA, 20 nt, Human
auggacguguuaugacucca

SEQ ID NO: 3209036 - RNA, 14 nt, Human
auggcaacaaacug

SEQ ID NO: 3209037 - RNA, 22 nt, Human
auggcaacaaacugcacaugau

SEQ ID NO: 3209038 - RNA, 20 nt, Human
auggcaacaaacugcacaug

SEQ ID NO: 3209039 - RNA, 19 nt, Human
auggcaacaaacugcacau

SEQ ID NO: 3209040 - RNA, 17 nt, Human
auggcaacaaacugcac

SEQ ID NO: 3209041 - RNA, 21 nt, Human
auggcacagggcaugaaauga

SEQ ID NO: 3209042 - RNA, 20 nt, Human
auggcacagggcaugaaaug

SEQ ID NO: 3209043 - RNA, 19 nt, Human
auggcacagggcaugaaau

SEQ ID NO: 3209044 - RNA, 20 nt, Human
auggcaauguuuugcuuuug

SEQ ID NO: 3209045 - RNA, 23 nt, Human
auggcaaguuuuccauauuuuua

SEQ ID NO: 3209046 - RNA, 16 nt, Human
auggcaauguuuugcu

SEQ ID NO: 3209047 - RNA, 22 nt, Human
auggcacaaucucggcucacug

SEQ ID NO: 3209048 - RNA, 15 nt, Human
auggcacagggcaug

SEQ ID NO: 3209049 - RNA, 19 nt, Human
auggcaaggacugcaggga

SEQ ID NO: 3209050 - RNA, 11 nt, Human
uuuaugugugu

SEQ ID NO: 3209051 - RNA, 13 nt, Human
uuuaugugugugu

SEQ ID NO: 3209052 - RNA, 12 nt, Human
uuuaugugaugg

SEQ ID NO: 3209053 - RNA, 16 nt, Human
uuuaugugcuauuaau

SEQ ID NO: 3209054 - RNA, 16 nt, Human
uuuaugugugauucaa

SEQ ID NO: 3209055 - RNA, 13 nt, Human
uuuauguugacau

SEQ ID NO: 3209056 - RNA, 11 nt, Human
uuuauguugac

SEQ ID NO: 3209057 - RNA, 18 nt, Human
uuuauguugacauuuguu

SEQ ID NO: 3209058 - RNA, 17 nt, Human
uuuauguugacauuugu

SEQ ID NO: 3209059 - RNA, 15 nt, Human
uuuauguugacauuu

SEQ ID NO: 3209060 - RNA, 14 nt, Human
uuuauguugacauu

SEQ ID NO: 3209061 - RNA, 20 nt, Human
uuuauguuuugguccacuuu

SEQ ID NO: 3209062 - RNA, 14 nt, Human
uuuauguuuugguc

SEQ ID NO: 3209063 - RNA, 13 nt, Human
uuuauguuuuggu

SEQ ID NO: 3209064 - RNA, 22 nt, Human
uuuauguugacauuuguuuggu

SEQ ID NO: 3209065 - RNA, 14 nt, Human
uuuauaguuaaucu

SEQ ID NO: 3209066 - RNA, 17 nt, Human
uuuauaguuaaucuaua

SEQ ID NO: 3209067 - RNA, 16 nt, Human
uuuauaguuaaucuau

SEQ ID NO: 3209068 - RNA, 17 nt, Human
uuuauaguguguugugc

SEQ ID NO: 3209069 - RNA, 14 nt, Human
uuuauagcuuuauu

SEQ ID NO: 3209070 - RNA, 17 nt, Human
uuuauauaaaguauucu

SEQ ID NO: 3209071 - RNA, 18 nt, Human
uuuauaguuaaucuauaa

SEQ ID NO: 3209072 - RNA, 18 nt, Human
uuuaugguaaucauauua

SEQ ID NO: 3209073 - RNA, 22 nt, Human
uuuauauaaugguaugcuugca

SEQ ID NO: 3209074 - RNA, 17 nt, Human
uuuagcuguguuauuau

SEQ ID NO: 3209075 - RNA, 16 nt, Human
uuuagcuguguuauua

SEQ ID NO: 3209076 - RNA, 15 nt, Human
uuuaguagagacagg

SEQ ID NO: 3209077 - RNA, 17 nt, Human
uuuaggacaugaaaaua

SEQ ID NO: 3209078 - RNA, 15 nt, Human
uuuaggacaugaaaa

SEQ ID NO: 3209079 - RNA, 23 nt, Human
uuuagcaaagcggguuauaauga

SEQ ID NO: 3209080 - RNA, 22 nt, Human
uuuagauuuuguguuuauucuu

SEQ ID NO: 3209081 - RNA, 17 nt, Human
uuuagauguaauuuugu

SEQ ID NO: 3209082 - RNA, 18 nt, Human
uuuagauugagaaaugug

SEQ ID NO: 3209083 - RNA, 19 nt, Human
uuuagaugugcugcuuuga

SEQ ID NO: 3209084 - RNA, 23 nt, Human
augcuucauacagggaugguguu

SEQ ID NO: 3209085 - RNA, 11 nt, Human
auggaacacuc

SEQ ID NO: 3209086 - RNA, 14 nt, Human
auggaacacucuga

SEQ ID NO: 3209087 - RNA, 15 nt, Human
auggaacacucugag

SEQ ID NO: 3209088 - RNA, 16 nt, Human
augcuguaaaagcaag

SEQ ID NO: 3209089 - RNA, 16 nt, Human
auggaacacucugaga

SEQ ID NO: 3209090 - RNA, 15 nt, Human
auggaagacagcucu

SEQ ID NO: 3209091 - RNA, 12 nt, Human
auggaagaaagu

SEQ ID NO: 3209092 - RNA, 13 nt, Human
auggaagaaagua

SEQ ID NO: 3209093 - RNA, 14 nt, Human
auggaagaaaguaa

SEQ ID NO: 3209094 - RNA, 10 nt, Human
augcuucaua

SEQ ID NO: 3209095 - RNA, 12 nt, Human
augcuucauaca

SEQ ID NO: 3209096 - RNA, 11 nt, Human
augcuucauac

SEQ ID NO: 3209097 - RNA, 19 nt, Human
augcuucauacagggaugg

SEQ ID NO: 3209098 - RNA, 16 nt, Human
augcuucauacaggga

SEQ ID NO: 3209099 - RNA, 15 nt, Human
augcuucauacaggg

SEQ ID NO: 3209100 - RNA, 13 nt, Human
augcuucauacag

SEQ ID NO: 3209101 - RNA, 23 nt, Human
augcugucccuuacgugaguccu

SEQ ID NO: 3209102 - RNA, 19 nt, Human
augcugucccuuacgugag

SEQ ID NO: 3209103 - RNA, 16 nt, Human
augcuagaacucccuu

SEQ ID NO: 3209104 - RNA, 19 nt, Human
augcuccuggcccacugca

SEQ ID NO: 3209105 - RNA, 15 nt, Human
augcuagaacucccu

SEQ ID NO: 3209106 - RNA, 14 nt, Human
uuuauuacauaauu

SEQ ID NO: 3209107 - RNA, 20 nt, Human
augcuggccgaagauuucau

SEQ ID NO: 3209108 - RNA, 16 nt, Human
augauuccagguggca

SEQ ID NO: 3209109 - RNA, 15 nt, Human
augauuccagguggc

SEQ ID NO: 3209110 - RNA, 22 nt, Human
augauuucacaaauauuaaaaa

SEQ ID NO: 3209111 - RNA, 18 nt, Human
augauuucacaaauauua

SEQ ID NO: 3209112 - RNA, 15 nt, Human
augauuucacaaaua

SEQ ID NO: 3209113 - RNA, 17 nt, Human
augauuucacaaauauu

SEQ ID NO: 3209114 - RNA, 16 nt, Human
augauuucacaaauau

SEQ ID NO: 3209115 - RNA, 23 nt, Human
augauuucacaaauauuaaaaag

SEQ ID NO: 3209116 - RNA, 14 nt, Human
augauuucagaaac

SEQ ID NO: 3209117 - RNA, 13 nt, Human
augauuucagaaa

SEQ ID NO: 3209118 - RNA, 17 nt, Human
augauuucagcucacug

SEQ ID NO: 3209119 - RNA, 21 nt, Human
augauucaacagguuuuccug

SEQ ID NO: 3209120 - RNA, 13 nt, Human
augauucaaaaag

SEQ ID NO: 3209121 - RNA, 20 nt, Human
augauuaaccacuucagcug

SEQ ID NO: 3209122 - RNA, 21 nt, Human
augauuaaccacuucagcuga

SEQ ID NO: 3209123 - RNA, 19 nt, Human
augauuaaccacuucagcu

SEQ ID NO: 3209124 - RNA, 16 nt, Human
uuguuggggcuuuaca

SEQ ID NO: 3209125 - RNA, 15 nt, Human
augcaaagcacugac

SEQ ID NO: 3209126 - RNA, 20 nt, Human
augauuuggggauucagauu

SEQ ID NO: 3209127 - RNA, 13 nt, Human
augcaaaguauaa

SEQ ID NO: 3209128 - RNA, 20 nt, Human
augcaaaguauaaauuugug

SEQ ID NO: 3209129 - RNA, 19 nt, Human
augauuucagcucacugca

SEQ ID NO: 3209130 - RNA, 16 nt, Human
augauuucagaaacaa

SEQ ID NO: 3209131 - RNA, 15 nt, Human
augauuucagaaaca

SEQ ID NO: 3209132 - RNA, 13 nt, Human
augcaccagcccu

SEQ ID NO: 3209133 - RNA, 12 nt, Human
augcacuuuguu

SEQ ID NO: 3209134 - RNA, 21 nt, Human
uugugaggaagccgcuggggc

SEQ ID NO: 3209135 - RNA, 17 nt, Human
uugugacuuuugcuuua

SEQ ID NO: 3209136 - RNA, 18 nt, Human
uugugacuuuugcuuuaa

SEQ ID NO: 3209137 - RNA, 14 nt, Human
uugugaguuuguuu

SEQ ID NO: 3209138 - RNA, 22 nt, Human
uugugaguuuguuucuuugaau

SEQ ID NO: 3209139 - RNA, 21 nt, Human
uugugaguuuguuucuuugaa

SEQ ID NO: 3209140 - RNA, 19 nt, Human
uugugaguuuguuucuuug

SEQ ID NO: 3209141 - RNA, 16 nt, Human
uugugaguuuguuucu

SEQ ID NO: 3209142 - RNA, 18 nt, Human
uuguggcuccacacacac

SEQ ID NO: 3209143 - RNA, 20 nt, Human
uuguucuggcucuuccaggc

SEQ ID NO: 3209144 - RNA, 22 nt, Human
uuguucuggcucuuccaggcug

SEQ ID NO: 3209145 - RNA, 22 nt, Human
uuguguguucacuaaacucuga

SEQ ID NO: 3209146 - RNA, 17 nt, Human
uuguguguuuauuguca

SEQ ID NO: 3209147 - RNA, 19 nt, Human
uuguucuggcucuuccagg

SEQ ID NO: 3209148 - RNA, 20 nt, Human
uugugugccucuagcugaau

SEQ ID NO: 3209149 - RNA, 17 nt, Human
uugugugccucuagcug

SEQ ID NO: 3209150 - RNA, 21 nt, Human
uugugugcggagucauuuugu

SEQ ID NO: 3209151 - RNA, 23 nt, Human
uugugugccucuagcugaauuga

SEQ ID NO: 3209152 - RNA, 21 nt, Human
uugugugcuaaacguguaugu

SEQ ID NO: 3209153 - RNA, 16 nt, Human
uugugugaacuuggaa

SEQ ID NO: 3209154 - RNA, 17 nt, Human
uugugugauauuucaga

SEQ ID NO: 3209155 - RNA, 21 nt, Human
uugugugauauuucagaaaua

SEQ ID NO: 3209156 - RNA, 20 nt, Human
uugugugauauuucagaaau

SEQ ID NO: 3209157 - RNA, 19 nt, Human
uugugugauauuucagaaa

SEQ ID NO: 3209158 - RNA, 18 nt, Human
uugugugauauuucagaa

SEQ ID NO: 3209159 - RNA, 13 nt, Human
uugugugaacuug

SEQ ID NO: 3209160 - RNA, 18 nt, Human
uuguguaagaaauacaga

SEQ ID NO: 3209161 - RNA, 14 nt, Human
uuguguaagaaaua

SEQ ID NO: 3209162 - RNA, 13 nt, Human
uugugguuaaucu

SEQ ID NO: 3209163 - RNA, 11 nt, Human
uugugguccaa

SEQ ID NO: 3209164 - RNA, 14 nt, Human
uugugguccaaaua

SEQ ID NO: 3209165 - RNA, 15 nt, Human
uugugguccaaauag

SEQ ID NO: 3209166 - RNA, 14 nt, Human
uugugguuuggaau

SEQ ID NO: 3209167 - RNA, 17 nt, Human
uuuaauuguauuuuugu

SEQ ID NO: 3209168 - RNA, 13 nt, Human
uuuaauuguauuu

SEQ ID NO: 3209169 - RNA, 14 nt, Human
uuuaauuguauuuu

SEQ ID NO: 3209170 - RNA, 17 nt, Human
uuuaauuccaugaaugu

SEQ ID NO: 3209171 - RNA, 17 nt, Human
uuuaauugaaagaaugu

SEQ ID NO: 3209172 - RNA, 21 nt, Human
uuuaauugaaagaauguaaag

SEQ ID NO: 3209173 - RNA, 20 nt, Human
uuuaauugaaagaauguaaa

SEQ ID NO: 3209174 - RNA, 12 nt, Human
uuuaauucaguu

SEQ ID NO: 3209175 - RNA, 19 nt, Human
uuuaaugcuaaucuuguga

SEQ ID NO: 3209176 - RNA, 21 nt, Human
uuuaagccuaaagauuuugau

SEQ ID NO: 3209177 - RNA, 16 nt, Human
uuuaagccuaaagauu

SEQ ID NO: 3209178 - RNA, 23 nt, Human
uuuaagccuuuguugaacuguua

SEQ ID NO: 3209179 - RNA, 21 nt, Human
uuuaagccuuuguugaacugu

SEQ ID NO: 3209180 - RNA, 18 nt, Human
uuuaagccuuuguugaac

SEQ ID NO: 3209181 - RNA, 12 nt, Human
uuuaagccuuug

SEQ ID NO: 3209182 - RNA, 22 nt, Human
uuuaagcuaggaaaagaaaucu

SEQ ID NO: 3209183 - RNA, 20 nt, Human
uuuaagcuaggaaaagaaau

SEQ ID NO: 3209184 - RNA, 23 nt, Human
uuuaagcuaggaaaagaaaucua

SEQ ID NO: 3209185 - RNA, 14 nt, Human
uuuaagcucaaaau

SEQ ID NO: 3209186 - RNA, 23 nt, Human
uuuaaugaaagacuguacaaagu

SEQ ID NO: 3209187 - RNA, 16 nt, Human
uuuaaugauuguuuaa

SEQ ID NO: 3209188 - RNA, 13 nt, Human
uuuaaaugucaaa

SEQ ID NO: 3209189 - RNA, 14 nt, Human
uuguuuucauuauc

SEQ ID NO: 3209190 - RNA, 15 nt, Human
uuguuuuacugucuu

SEQ ID NO: 3209191 - RNA, 16 nt, Human
uuguuuucaguguaca

SEQ ID NO: 3209192 - RNA, 13 nt, Human
uuguuuucagugu

SEQ ID NO: 3209193 - RNA, 15 nt, Human
augcacuuuguucug

SEQ ID NO: 3209194 - RNA, 14 nt, Human
uuuaagaggcaggg

SEQ ID NO: 3209195 - RNA, 16 nt, Human
uuuaaauuaauaucuu

SEQ ID NO: 3209196 - RNA, 20 nt, Human
uuuaaauuaauaucuuucug

SEQ ID NO: 3209197 - RNA, 23 nt, Human
uuuaaauugcucacaguuauuac

SEQ ID NO: 3209198 - RNA, 14 nt, Human
uuuaaauuagaaaa

SEQ ID NO: 3209199 - RNA, 15 nt, Human
uuuaaauuagaaaau

SEQ ID NO: 3209200 - RNA, 22 nt, Human
uuuaaauuagaaaauauucucu

SEQ ID NO: 3209201 - RNA, 19 nt, Human
uuuaaauuauguuuuacug

SEQ ID NO: 3209202 - RNA, 14 nt, Human
uuuaagcagaauug

SEQ ID NO: 3209203 - RNA, 19 nt, Human
uuuaagcagaauuggaaaa

SEQ ID NO: 3209204 - RNA, 18 nt, Human
uuuaagcagaauuggaaa

SEQ ID NO: 3209205 - RNA, 17 nt, Human
uuuaagcagaauuggaa

SEQ ID NO: 3209206 - RNA, 15 nt, Human
uuuaagcagaauugg

SEQ ID NO: 3209207 - RNA, 16 nt, Human
augccaagcacuucag

SEQ ID NO: 3209208 - RNA, 22 nt, Human
augccaaggaccuuuugcugcc

SEQ ID NO: 3209209 - RNA, 23 nt, Human
augccaagaaguuuaaggaauau

SEQ ID NO: 3209210 - RNA, 15 nt, Human
augccacuaaauuga

SEQ ID NO: 3209211 - RNA, 17 nt, Human
augccacuaaauugaca

SEQ ID NO: 3209212 - RNA, 14 nt, Human
augcagugcugcuu

SEQ ID NO: 3209213 - RNA, 16 nt, Human
augcagugcugcuuug

SEQ ID NO: 3209214 - RNA, 22 nt, Human
augcagguuagaaauaauguca

SEQ ID NO: 3209215 - RNA, 13 nt, Human
augcagucuuaga

SEQ ID NO: 3209216 - RNA, 21 nt, Human
augcagucuuagaucauaguu

SEQ ID NO: 3209217 - RNA, 22 nt, Human
augcagucuuagaucauaguuu

SEQ ID NO: 3209218 - RNA, 15 nt, Human
uuuaauuuugacacu

SEQ ID NO: 3209219 - RNA, 13 nt, Human
augcagccucaca

SEQ ID NO: 3209220 - RNA, 17 nt, Human
uuuaauuuuuaaaugca

SEQ ID NO: 3209221 - RNA, 22 nt, Human
uuuaauuuuugcuuuuagaaaa

SEQ ID NO: 3209222 - RNA, 14 nt, Human
uuuaauuuuuaaau

SEQ ID NO: 3209223 - RNA, 14 nt, Human
augcagccucacag

SEQ ID NO: 3209224 - RNA, 15 nt, Human
augcagccucacagu

SEQ ID NO: 3209225 - RNA, 20 nt, Human
aucagacaguggaugagaca

SEQ ID NO: 3209226 - RNA, 13 nt, Human
aucaggccaggcc

SEQ ID NO: 3209227 - RNA, 19 nt, Human
aucaggauuuccucuugaa

SEQ ID NO: 3209228 - RNA, 13 nt, Human
uucucagcuccca

SEQ ID NO: 3209229 - RNA, 21 nt, Human
uucucacugccaugccagcuu

SEQ ID NO: 3209230 - RNA, 14 nt, Human
uucuagacuauaaa

SEQ ID NO: 3209231 - RNA, 20 nt, Human
uucuaguaauaaagacucua

SEQ ID NO: 3209232 - RNA, 17 nt, Human
uucuaguuauuuauucu

SEQ ID NO: 3209233 - RNA, 18 nt, Human
uucuagugcagcugaaau

SEQ ID NO: 3209234 - RNA, 17 nt, Human
uucuaaaguacugagca

SEQ ID NO: 3209235 - RNA, 13 nt, Human
uucuaaaguacug

SEQ ID NO: 3209236 - RNA, 17 nt, Human
uucuaaguaaaaccaca

SEQ ID NO: 3209237 - RNA, 20 nt, Human
uucuaaguaaaaccacagca

SEQ ID NO: 3209238 - RNA, 19 nt, Human
uucuaaguaaaaccacagc

SEQ ID NO: 3209239 - RNA, 14 nt, Human
uucuaacuucauaa

SEQ ID NO: 3209240 - RNA, 18 nt, Human
uucuaagaaauaucugug

SEQ ID NO: 3209241 - RNA, 19 nt, Human
uucuaagaaauaucuguga

SEQ ID NO: 3209242 - RNA, 18 nt, Human
uucuaagaaaucaaguaa

SEQ ID NO: 3209243 - RNA, 18 nt, Human
aucaauaacagccgcucc

SEQ ID NO: 3209244 - RNA, 22 nt, Human
aucaauaacagccgcuccagag

SEQ ID NO: 3209245 - RNA, 14 nt, Human
uucgaccagccagg

SEQ ID NO: 3209246 - RNA, 17 nt, Human
uucgacuugcauuuuug

SEQ ID NO: 3209247 - RNA, 21 nt, Human
uucgcaggauucuuccucccu

SEQ ID NO: 3209248 - RNA, 20 nt, Human
uucgauacaccgggccugga

SEQ ID NO: 3209249 - RNA, 15 nt, Human
auauuuuaauuucaa

SEQ ID NO: 3209250 - RNA, 14 nt, Human
auauuuuaauuuca

SEQ ID NO: 3209251 - RNA, 15 nt, Human
auauuuuaauuuuua

SEQ ID NO: 3209252 - RNA, 13 nt, Human
auauuuuaauuuu

SEQ ID NO: 3209253 - RNA, 17 nt, Human
auauuuuaauuucaagc

SEQ ID NO: 3209254 - RNA, 16 nt, Human
auauuuuaauuucaag

SEQ ID NO: 3209255 - RNA, 14 nt, Human
uucccacucuucuc

SEQ ID NO: 3209256 - RNA, 20 nt, Human
uucccacucugucgagccug

SEQ ID NO: 3209257 - RNA, 23 nt, Human
uucccacugguccaucugguuuu

SEQ ID NO: 3209258 - RNA, 12 nt, Human
auauuuuacuug

SEQ ID NO: 3209259 - RNA, 19 nt, Human
uucccccuccaaucccacc

SEQ ID NO: 3209260 - RNA, 22 nt, Human
uucccccuguuucagaggcuca

SEQ ID NO: 3209261 - RNA, 14 nt, Human
uucccccuccccca

SEQ ID NO: 3209262 - RNA, 14 nt, Human
uucccccuuucuuc

SEQ ID NO: 3209263 - RNA, 16 nt, Human
uucccccuuucuuccu

SEQ ID NO: 3209264 - RNA, 15 nt, Human
uucccccuuucuucc

SEQ ID NO: 3209265 - RNA, 20 nt, Human
uuccccuaaucuuuucugaa

SEQ ID NO: 3209266 - RNA, 13 nt, Human
uucccuacuuccu

SEQ ID NO: 3209267 - RNA, 15 nt, Human
uuccccuuccuucuu

SEQ ID NO: 3209268 - RNA, 16 nt, Human
uucccuacuuccugug

SEQ ID NO: 3209269 - RNA, 14 nt, Human
uucccuacuuccug

SEQ ID NO: 3209270 - RNA, 17 nt, Human
uucccuacuuccuguga

SEQ ID NO: 3209271 - RNA, 22 nt, Human
uuccccuuccuaauuccacagc

SEQ ID NO: 3209272 - RNA, 14 nt, Human
uuccccuuccuucu

SEQ ID NO: 3209273 - RNA, 13 nt, Human
uuccccuuccuuc

SEQ ID NO: 3209274 - RNA, 14 nt, Human
uuccccuguucacu

SEQ ID NO: 3209275 - RNA, 17 nt, Human
uuccccuguucacucua

SEQ ID NO: 3209276 - RNA, 19 nt, Human
uucccuuuuuuggcugcug

SEQ ID NO: 3209277 - RNA, 18 nt, Human
uucccuuuuuuggcugcu

SEQ ID NO: 3209278 - RNA, 21 nt, Human
uuccuaccacccgguccccac

SEQ ID NO: 3209279 - RNA, 17 nt, Human
uuccuacacaggacagg

SEQ ID NO: 3209280 - RNA, 12 nt, Human
uuccuacucuuc

SEQ ID NO: 3209281 - RNA, 19 nt, Human
uuccuacucuucucucugc

SEQ ID NO: 3209282 - RNA, 18 nt, Human
uuccuacucuucucucug

SEQ ID NO: 3209283 - RNA, 17 nt, Human
uuccuacucuucucucu

SEQ ID NO: 3209284 - RNA, 15 nt, Human
uuccuacucuucucu

SEQ ID NO: 3209285 - RNA, 20 nt, Human
aucaaauaugcaaagcacug

SEQ ID NO: 3209286 - RNA, 14 nt, Human
aucaaauguaaagu

SEQ ID NO: 3209287 - RNA, 13 nt, Human
aucaaauguaaag

SEQ ID NO: 3209288 - RNA, 22 nt, Human
auauuuuguaugcaagcaguuu

SEQ ID NO: 3209289 - RNA, 22 nt, Human
aucaaccccuucgcuccugugu

SEQ ID NO: 3209290 - RNA, 23 nt, Human
aucaaccaccuauuuuugacaug

SEQ ID NO: 3209291 - RNA, 20 nt, Human
aucaaccccuucgcuccugu

SEQ ID NO: 3209292 - RNA, 19 nt, Human
aucaaccccuucgcuccug

SEQ ID NO: 3209293 - RNA, 23 nt, Human
aucaaguuggcuucuaaucaaag

SEQ ID NO: 3209294 - RNA, 22 nt, Human
aucaaguuggcuucuaaucaaa

SEQ ID NO: 3209295 - RNA, 20 nt, Human
uuccuucaaagcaaaugucu

SEQ ID NO: 3209296 - RNA, 15 nt, Human
uuccuucagauauuu

SEQ ID NO: 3209297 - RNA, 21 nt, Human
auauuuuccuaguagaucuau

SEQ ID NO: 3209298 - RNA, 24 nt, Human
auauuuuccuaguagaucuauauu

SEQ ID NO: 3209299 - RNA, 11 nt, Human
auauuuuccug

SEQ ID NO: 3209300 - RNA, 19 nt, Human
auauuuuccugauagcaua

SEQ ID NO: 3209301 - RNA, 12 nt, Human
auauuuucugug

SEQ ID NO: 3209302 - RNA, 13 nt, Human
auauuuucugugu

SEQ ID NO: 3209303 - RNA, 14 nt, Human
auauuuucugugug

SEQ ID NO: 3209304 - RNA, 15 nt, Human
auauuuucugugugu

SEQ ID NO: 3209305 - RNA, 16 nt, Human
auauuuucuguguguu

SEQ ID NO: 3209306 - RNA, 17 nt, Human
auauuuucuguguguuc

SEQ ID NO: 3209307 - RNA, 19 nt, Human
auauuuucuguguguuccu

SEQ ID NO: 3209308 - RNA, 20 nt, Human
auauuuucuguguguuccug

SEQ ID NO: 3209309 - RNA, 21 nt, Human
auauuuucuguguguuccugg

SEQ ID NO: 3209310 - RNA, 22 nt, Human
auauuuucuguguguuccuggc

SEQ ID NO: 3209311 - RNA, 17 nt, Human
auauuuuguaugcaagc

SEQ ID NO: 3209312 - RNA, 22 nt, Human
uuccuacucuucucucugcucu

SEQ ID NO: 3209313 - RNA, 21 nt, Human
uuccuacucuucucucugcuc

SEQ ID NO: 3209314 - RNA, 20 nt, Human
uuccuacucuucucucugcu

SEQ ID NO: 3209315 - RNA, 12 nt, Human
uuccucuccacu

SEQ ID NO: 3209316 - RNA, 15 nt, Human
uuccucuccacugcc

SEQ ID NO: 3209317 - RNA, 14 nt, Human
uuccucuccacugc

SEQ ID NO: 3209318 - RNA, 13 nt, Human
uuccucuccacug

SEQ ID NO: 3209319 - RNA, 17 nt, Human
uuccugucacccugagg

SEQ ID NO: 3209320 - RNA, 22 nt, Human
aucauuggauucugagagcugu

SEQ ID NO: 3209321 - RNA, 21 nt, Human
aucauuggauucugagagcug

SEQ ID NO: 3209322 - RNA, 21 nt, Human
aucauugaaaucuuuuugcuu

SEQ ID NO: 3209323 - RNA, 21 nt, Human
aucaggccaggcccucugccc

SEQ ID NO: 3209324 - RNA, 22 nt, Human
aucaggccaggcccucugccca

SEQ ID NO: 3209325 - RNA, 23 nt, Human
aucaggccaggcccucugcccac

SEQ ID NO: 3209326 - RNA, 20 nt, Human
aucauugaaaucuuuuugcu

SEQ ID NO: 3209327 - RNA, 20 nt, Human
aucaggccaggcccucugcc

SEQ ID NO: 3209328 - RNA, 22 nt, Human
aucauuucaccugcugcuugcc

SEQ ID NO: 3209329 - RNA, 14 nt, Human
aucauuuacaagac

SEQ ID NO: 3209330 - RNA, 19 nt, Human
aucauuuacaagacaacau

SEQ ID NO: 3209331 - RNA, 12 nt, Human
uucuccugccuc

SEQ ID NO: 3209332 - RNA, 13 nt, Human
uucuccugccuca

SEQ ID NO: 3209333 - RNA, 14 nt, Human
uucuccugccucag

SEQ ID NO: 3209334 - RNA, 17 nt, Human
uucucuacucuagggaa

SEQ ID NO: 3209335 - RNA, 16 nt, Human
uucucuuuucaaaaca

SEQ ID NO: 3209336 - RNA, 21 nt, Human
uucucuuuucaagaaguucuu

SEQ ID NO: 3209337 - RNA, 12 nt, Human
uucucuuugaaa

SEQ ID NO: 3209338 - RNA, 14 nt, Human
uucugacccaugcu

SEQ ID NO: 3209339 - RNA, 22 nt, Human
uucugacacgacuucuguuuca

SEQ ID NO: 3209340 - RNA, 15 nt, Human
uucugcacacagcac

SEQ ID NO: 3209341 - RNA, 13 nt, Human
uucugccgcagcc

SEQ ID NO: 3209342 - RNA, 10 nt, Human
uucuguaaaa

SEQ ID NO: 3209343 - RNA, 11 nt, Human
uucuguaaaau

SEQ ID NO: 3209344 - RNA, 16 nt, Human
uucuguaaaauggaaa

SEQ ID NO: 3209345 - RNA, 19 nt, Human
uucuguaaaauggaaaacu

SEQ ID NO: 3209346 - RNA, 19 nt, Human
uucugguuguuuuuaaaca

SEQ ID NO: 3209347 - RNA, 22 nt, Human
uucugguugaugccugugaacu

SEQ ID NO: 3209348 - RNA, 17 nt, Human
aucauuuuuuauauaua

SEQ ID NO: 3209349 - RNA, 21 nt, Human
aucauuuuuuauauauaugca

SEQ ID NO: 3209350 - RNA, 18 nt, Human
aucauuuuuuauauauau

SEQ ID NO: 3209351 - RNA, 23 nt, Human
aucauuuuuuccuguuugggaag

SEQ ID NO: 3209352 - RNA, 21 nt, Human
aucauuuuuuccuguuuggga

SEQ ID NO: 3209353 - RNA, 15 nt, Human
aucauuuuuuccugu

SEQ ID NO: 3209354 - RNA, 14 nt, Human
aucauuuuuuccug

SEQ ID NO: 3209355 - RNA, 16 nt, Human
aucauuuuuuauauau

SEQ ID NO: 3209356 - RNA, 14 nt, Human
uucugccgcagccc

SEQ ID NO: 3209357 - RNA, 15 nt, Human
uucugccgcagcccu

SEQ ID NO: 3209358 - RNA, 15 nt, Human
aucccaccaacccuc

SEQ ID NO: 3209359 - RNA, 14 nt, Human
auccaguuuuucau

SEQ ID NO: 3209360 - RNA, 21 nt, Human
auccaagcuggucccacucag

SEQ ID NO: 3209361 - RNA, 21 nt, Human
auccaaggaagggauguauuu

SEQ ID NO: 3209362 - RNA, 15 nt, Human
auccaaaagaaaaac

SEQ ID NO: 3209363 - RNA, 13 nt, Human
auccaaguggccu

SEQ ID NO: 3209364 - RNA, 12 nt, Human
auccaaguggcc

SEQ ID NO: 3209365 - RNA, 14 nt, Human
auccaaaagaaaaa

SEQ ID NO: 3209366 - RNA, 12 nt, Human
auccaaaagaaa

SEQ ID NO: 3209367 - RNA, 13 nt, Human
auccuaguuccac

SEQ ID NO: 3209368 - RNA, 21 nt, Human
auccuaggcauuugcugaaua

SEQ ID NO: 3209369 - RNA, 13 nt, Human
auccuaaugaaug

SEQ ID NO: 3209370 - RNA, 12 nt, Human
auccuaaugaau

SEQ ID NO: 3209371 - RNA, 19 nt, Human
auccuaaugaaugcauaaa

SEQ ID NO: 3209372 - RNA, 22 nt, Human
uugaacauuaauccacauguuu

SEQ ID NO: 3209373 - RNA, 16 nt, Human
uugaaccauaaaaugu

SEQ ID NO: 3209374 - RNA, 17 nt, Human
uugaaccauaaaauguc

SEQ ID NO: 3209375 - RNA, 21 nt, Human
uugaaccauaaaauguccagu

SEQ ID NO: 3209376 - RNA, 14 nt, Human
uugaaccauaguua

SEQ ID NO: 3209377 - RNA, 14 nt, Human
uugaaccauaaaau

SEQ ID NO: 3209378 - RNA, 12 nt, Human
uugaaccaauaa

SEQ ID NO: 3209379 - RNA, 21 nt, Human
auccuaagcuauucaguaaua

SEQ ID NO: 3209380 - RNA, 12 nt, Human
uugaacaaaaua

SEQ ID NO: 3209381 - RNA, 16 nt, Human
uugaacaaaauaaauu

SEQ ID NO: 3209382 - RNA, 14 nt, Human
uugaacaaaauaaa

SEQ ID NO: 3209383 - RNA, 21 nt, Human
uugaaauuuuuauuaaauuau

SEQ ID NO: 3209384 - RNA, 11 nt, Human
uugaaaucuuu

SEQ ID NO: 3209385 - RNA, 22 nt, Human
uugaaauauauggucuaauguu

SEQ ID NO: 3209386 - RNA, 20 nt, Human
uugaaauauauggucuaaug

SEQ ID NO: 3209387 - RNA, 23 nt, Human
uugaaauauauggucuaauguuu

SEQ ID NO: 3209388 - RNA, 23 nt, Human
uugaaaucaguaaacacugugua

SEQ ID NO: 3209389 - RNA, 21 nt, Human
uugaaaucaguaaacacugug

SEQ ID NO: 3209390 - RNA, 21 nt, Human
uugaaauauggucuuuugguu

SEQ ID NO: 3209391 - RNA, 16 nt, Human
uugaaaguuuacagga

SEQ ID NO: 3209392 - RNA, 17 nt, Human
uugaaagugccuuugca

SEQ ID NO: 3209393 - RNA, 17 nt, Human
uugaaauaaaaagagua

SEQ ID NO: 3209394 - RNA, 16 nt, Human
uugaaauaaaaagagu

SEQ ID NO: 3209395 - RNA, 13 nt, Human
uucuuuuaauuuu

SEQ ID NO: 3209396 - RNA, 20 nt, Human
uucuuuuuaaagcuuuugau

SEQ ID NO: 3209397 - RNA, 22 nt, Human
uucuuuuguuuuuugaaguguu

SEQ ID NO: 3209398 - RNA, 19 nt, Human
uucuuuuguuuuuugaagu

SEQ ID NO: 3209399 - RNA, 15 nt, Human
uucuuuguagcauuu

SEQ ID NO: 3209400 - RNA, 22 nt, Human
uucuuuguacacccaugaaaga

SEQ ID NO: 3209401 - RNA, 18 nt, Human
uucuuuuaaauuagaaaa

SEQ ID NO: 3209402 - RNA, 11 nt, Human
uucuuugugua

SEQ ID NO: 3209403 - RNA, 23 nt, Human
uucuuuguuaauuuggaccauuu

SEQ ID NO: 3209404 - RNA, 21 nt, Human
uucuugguauuuggauaucug

SEQ ID NO: 3209405 - RNA, 22 nt, Human
uucuugguauuuggauaucugu

SEQ ID NO: 3209406 - RNA, 15 nt, Human
uucuuucuuccucug

SEQ ID NO: 3209407 - RNA, 13 nt, Human
uucuuucuuccuc

SEQ ID NO: 3209408 - RNA, 17 nt, Human
uucuuggacacuuaauu

SEQ ID NO: 3209409 - RNA, 19 nt, Human
uucuuggacacuuaauucu

SEQ ID NO: 3209410 - RNA, 21 nt, Human
uucuuggacacuuaauucugu

SEQ ID NO: 3209411 - RNA, 22 nt, Human
uucuuggacacuuaauucuguu

SEQ ID NO: 3209412 - RNA, 23 nt, Human
uucuuggacacuuaauucuguuc

SEQ ID NO: 3209413 - RNA, 22 nt, Human
uucuuggcaauaaauuuugaaa

SEQ ID NO: 3209414 - RNA, 21 nt, Human
uucuuggcaauaaauuuugaa

SEQ ID NO: 3209415 - RNA, 18 nt, Human
uucuugauuaaagugauu

SEQ ID NO: 3209416 - RNA, 22 nt, Human
uucuugaucaguaguuugcauu

SEQ ID NO: 3209417 - RNA, 23 nt, Human
uucuugaauggcaauguuuugcu

SEQ ID NO: 3209418 - RNA, 20 nt, Human
uucuugaucaguaguuugca

SEQ ID NO: 3209419 - RNA, 20 nt, Human
uucuugauaauuuuccuuua

SEQ ID NO: 3209420 - RNA, 23 nt, Human
uucuuccucccucccucuuuccc

SEQ ID NO: 3209421 - RNA, 11 nt, Human
uucuuccuggu

SEQ ID NO: 3209422 - RNA, 13 nt, Human
uucuuccucugcu

SEQ ID NO: 3209423 - RNA, 12 nt, Human
uucuuccucugc

SEQ ID NO: 3209424 - RNA, 11 nt, Human
uucuuccucug

SEQ ID NO: 3209425 - RNA, 14 nt, Human
uucuuaauuuggaa

SEQ ID NO: 3209426 - RNA, 17 nt, Human
uucuuaauuuggaaacu

SEQ ID NO: 3209427 - RNA, 20 nt, Human
uucuuaauuuggaaacuaau

SEQ ID NO: 3209428 - RNA, 22 nt, Human
uucuuaauuuggaaacuaauaa

SEQ ID NO: 3209429 - RNA, 23 nt, Human
uucuuaauuuggaaacuaauaaa

SEQ ID NO: 3209430 - RNA, 18 nt, Human
uucuuaauuauuauaaaa

SEQ ID NO: 3209431 - RNA, 19 nt, Human
uucuuaauuauuauaaaaa

SEQ ID NO: 3209432 - RNA, 20 nt, Human
uucuuaauuauuauaaaaau

SEQ ID NO: 3209433 - RNA, 21 nt, Human
uucuuaauuauuauaaaaaua

SEQ ID NO: 3209434 - RNA, 22 nt, Human
uucuuaauuauuauaaaaauau

SEQ ID NO: 3209435 - RNA, 15 nt, Human
uucuguugcugccuc

SEQ ID NO: 3209436 - RNA, 16 nt, Human
uucuguugcugccuca

SEQ ID NO: 3209437 - RNA, 20 nt, Human
aucccaccccauccuccagg

SEQ ID NO: 3209438 - RNA, 18 nt, Human
aucccaccccauccucca

SEQ ID NO: 3209439 - RNA, 20 nt, Human
uucuguuuuucuaggccugg

SEQ ID NO: 3209440 - RNA, 14 nt, Human
uucuuaaaaaguaa

SEQ ID NO: 3209441 - RNA, 13 nt, Human
uucuuaaaaagua

SEQ ID NO: 3209442 - RNA, 22 nt, Human
uucuguuuuuaaaaauuagccu

SEQ ID NO: 3209443 - RNA, 17 nt, Human
uucuguugcugccucau

SEQ ID NO: 3209444 - RNA, 18 nt, Human
auaggcuauuaaaaaagu

SEQ ID NO: 3209445 - RNA, 21 nt, Human
auagugacuuuucaaguauuu

SEQ ID NO: 3209446 - RNA, 18 nt, Human
auagugacuuuucaagua

SEQ ID NO: 3209447 - RNA, 17 nt, Human
auagugacuuuucaagu

SEQ ID NO: 3209448 - RNA, 12 nt, Human
auagugacuuuu

SEQ ID NO: 3209449 - RNA, 22 nt, Human
auagucuuggaagcuguuugga

SEQ ID NO: 3209450 - RNA, 20 nt, Human
auagugcaauauauuuugua

SEQ ID NO: 3209451 - RNA, 18 nt, Human
auagugcaauauauuuug

SEQ ID NO: 3209452 - RNA, 15 nt, Human
auagugcaauauauu

SEQ ID NO: 3209453 - RNA, 13 nt, Human
auagugcaauaua

SEQ ID NO: 3209454 - RNA, 12 nt, Human
auagugcaauau

SEQ ID NO: 3209455 - RNA, 21 nt, Human
auagugaggcaucgcaaugua

SEQ ID NO: 3209456 - RNA, 23 nt, Human
auagugacuuuucaaguauuuaa

SEQ ID NO: 3209457 - RNA, 17 nt, Human
auaguggcuuaaaacaa

SEQ ID NO: 3209458 - RNA, 16 nt, Human
auagugggaccacaua

SEQ ID NO: 3209459 - RNA, 21 nt, Human
auagugggguuccaugaguua

SEQ ID NO: 3209460 - RNA, 14 nt, Human
auagugugaaauau

SEQ ID NO: 3209461 - RNA, 15 nt, Human
auagugugaaauaua

SEQ ID NO: 3209462 - RNA, 22 nt, Human
auagugugaaauauauuacuua

SEQ ID NO: 3209463 - RNA, 23 nt, Human
auaguguggaaauuaagaagaaa

SEQ ID NO: 3209464 - RNA, 17 nt, Human
auaguguuauugagaga

SEQ ID NO: 3209465 - RNA, 21 nt, Human
auaguguguugugcuuucaag

SEQ ID NO: 3209466 - RNA, 22 nt, Human
auaguguguugugcuuucaaga

SEQ ID NO: 3209467 - RNA, 20 nt, Human
auaguuguaccgcaauguga

SEQ ID NO: 3209468 - RNA, 18 nt, Human
auaguuguagacaaagua

SEQ ID NO: 3209469 - RNA, 19 nt, Human
auaguuguagacaaaguac

SEQ ID NO: 3209470 - RNA, 22 nt, Human
auaguuggcuaggaccccucca

SEQ ID NO: 3209471 - RNA, 18 nt, Human
auaguugcauagcaguau

SEQ ID NO: 3209472 - RNA, 20 nt, Human
auaguugcauagcaguauau

SEQ ID NO: 3209473 - RNA, 21 nt, Human
auaguugcauagcaguauaug

SEQ ID NO: 3209474 - RNA, 15 nt, Human
auauaaaaauggcuu

SEQ ID NO: 3209475 - RNA, 16 nt, Human
auauaaaaaaucaugc

SEQ ID NO: 3209476 - RNA, 16 nt, Human
auaguuuuauuuauau

SEQ ID NO: 3209477 - RNA, 18 nt, Human
auaguuuuauuuauauuu

SEQ ID NO: 3209478 - RNA, 24 nt, Human
auaguuuuauuuauauuuauugac

SEQ ID NO: 3209479 - RNA, 21 nt, Human
auaguuacuguaaaaugcaaa

SEQ ID NO: 3209480 - RNA, 22 nt, Human
auaguuaagcgugcauaaguua

SEQ ID NO: 3209481 - RNA, 18 nt, Human
auaguuacuguaaaaugc

SEQ ID NO: 3209482 - RNA, 17 nt, Human
auaguuacuguaaaaug

SEQ ID NO: 3209483 - RNA, 15 nt, Human
auaguuacuguaaaa

SEQ ID NO: 3209484 - RNA, 13 nt, Human
auaguuacuguaa

SEQ ID NO: 3209485 - RNA, 18 nt, Human
auaguucuagugcagcug

SEQ ID NO: 3209486 - RNA, 12 nt, Human
auaguugaauua

SEQ ID NO: 3209487 - RNA, 21 nt, Human
auaguugaauuagugaguaua

SEQ ID NO: 3209488 - RNA, 14 nt, Human
auaguuauguaaau

SEQ ID NO: 3209489 - RNA, 15 nt, Human
auaguuauguaaaua

SEQ ID NO: 3209490 - RNA, 16 nt, Human
auaguuauguaaauaa

SEQ ID NO: 3209491 - RNA, 17 nt, Human
auaguuauguaaauaau

SEQ ID NO: 3209492 - RNA, 18 nt, Human
auaguuauguaaauaauu

SEQ ID NO: 3209493 - RNA, 19 nt, Human
auaguuauguaaauaauuc

SEQ ID NO: 3209494 - RNA, 15 nt, Human
auauauauauauauu

SEQ ID NO: 3209495 - RNA, 16 nt, Human
auauauauaucuguau

SEQ ID NO: 3209496 - RNA, 22 nt, Human
auauauaugcauauauauaugu

SEQ ID NO: 3209497 - RNA, 16 nt, Human
auauauaugugugugu

SEQ ID NO: 3209498 - RNA, 18 nt, Human
auauauccacacauuugu

SEQ ID NO: 3209499 - RNA, 17 nt, Human
auauaucccugauaaau

SEQ ID NO: 3209500 - RNA, 16 nt, Human
auauaucccugauaaa

SEQ ID NO: 3209501 - RNA, 22 nt, Human
auauaucccugauaaauauuca

SEQ ID NO: 3209502 - RNA, 20 nt, Human
auauaucccugauaaauauu

SEQ ID NO: 3209503 - RNA, 19 nt, Human
auauaugaaaacuaaguuc

SEQ ID NO: 3209504 - RNA, 14 nt, Human
auauaucucaaauu

SEQ ID NO: 3209505 - RNA, 19 nt, Human
auauaucucaaauuguaau

SEQ ID NO: 3209506 - RNA, 16 nt, Human
auauaucucaaauugu

SEQ ID NO: 3209507 - RNA, 20 nt, Human
auauaugcacuuaauuuguu

SEQ ID NO: 3209508 - RNA, 16 nt, Human
uucacugucugucugg

SEQ ID NO: 3209509 - RNA, 15 nt, Human
uucacugucugucug

SEQ ID NO: 3209510 - RNA, 19 nt, Human
uucacuguuucaucuaagu

SEQ ID NO: 3209511 - RNA, 23 nt, Human
uucacuguuucaucuaagugccu

SEQ ID NO: 3209512 - RNA, 22 nt, Human
uucacuuaaguuaguuccacug

SEQ ID NO: 3209513 - RNA, 15 nt, Human
uucacuuacagcacc

SEQ ID NO: 3209514 - RNA, 16 nt, Human
auauaacuuauauugu

SEQ ID NO: 3209515 - RNA, 21 nt, Human
auauaacuuauauuguaagaa

SEQ ID NO: 3209516 - RNA, 20 nt, Human
auauaacuuauauuguaaga

SEQ ID NO: 3209517 - RNA, 15 nt, Human
auauaaaguauucuu

SEQ ID NO: 3209518 - RNA, 17 nt, Human
auauaaaguauucuuuu

SEQ ID NO: 3209519 - RNA, 20 nt, Human
auauaaaguauucuuuuucu

SEQ ID NO: 3209520 - RNA, 22 nt, Human
auauaacuuauauuguaagaaa

SEQ ID NO: 3209521 - RNA, 14 nt, Human
auauaacuuuagaa

SEQ ID NO: 3209522 - RNA, 15 nt, Human
auauaacuuuagaaa

SEQ ID NO: 3209523 - RNA, 16 nt, Human
uucaaaacaaacagau

SEQ ID NO: 3209524 - RNA, 23 nt, Human
uucaaaacaaacagaugcucuga

SEQ ID NO: 3209525 - RNA, 14 nt, Human
uuauuuuucuguua

SEQ ID NO: 3209526 - RNA, 15 nt, Human
uuauuuuucuguuac

SEQ ID NO: 3209527 - RNA, 12 nt, Human
uuauuuuugcuu

SEQ ID NO: 3209528 - RNA, 22 nt, Human
uuauuuuuagaauuuugugaaa

SEQ ID NO: 3209529 - RNA, 16 nt, Human
uuauuuuuaagaaaga

SEQ ID NO: 3209530 - RNA, 17 nt, Human
uuauuuuuagacagagu

SEQ ID NO: 3209531 - RNA, 18 nt, Human
uuauuuuuagacagaguc

SEQ ID NO: 3209532 - RNA, 20 nt, Human
uuauuuuuagaauuuuguga

SEQ ID NO: 3209533 - RNA, 14 nt, Human
uuauuuuuagaauu

SEQ ID NO: 3209534 - RNA, 15 nt, Human
uuaguuuuucugucc

SEQ ID NO: 3209535 - RNA, 18 nt, Human
uuaguuuugcuuuuaguu

SEQ ID NO: 3209536 - RNA, 14 nt, Human
uuaguuuugcuuuu

SEQ ID NO: 3209537 - RNA, 22 nt, Human
uuaguuuugcuuuuaguuuuuc

SEQ ID NO: 3209538 - RNA, 17 nt, Human
uuaguuuuauuuucuaa

SEQ ID NO: 3209539 - RNA, 13 nt, Human
uuaguuuugcuuu

SEQ ID NO: 3209540 - RNA, 13 nt, Human
uuaguuuugcaua

SEQ ID NO: 3209541 - RNA, 20 nt, Human
uucaaaaguuuguuugcuua

SEQ ID NO: 3209542 - RNA, 14 nt, Human
uucaagaacuuguu

SEQ ID NO: 3209543 - RNA, 19 nt, Human
uucaagaaaugaagagcug

SEQ ID NO: 3209544 - RNA, 23 nt, Human
uucaagaaguucuuugauucugu

SEQ ID NO: 3209545 - RNA, 15 nt, Human
uucaagaacuuguuu

SEQ ID NO: 3209546 - RNA, 18 nt, Human
uucaaacagucucaggaa

SEQ ID NO: 3209547 - RNA, 17 nt, Human
uucaagaaaugaagagc

SEQ ID NO: 3209548 - RNA, 21 nt, Human
uucaagcgauucuucugcuuc

SEQ ID NO: 3209549 - RNA, 23 nt, Human
uucaagcgauucucuugccucag

SEQ ID NO: 3209550 - RNA, 16 nt, Human
uucaagcgauucucuu

SEQ ID NO: 3209551 - RNA, 14 nt, Human
uucaagcugcuuuu

SEQ ID NO: 3209552 - RNA, 20 nt, Human
uucaagcuuauuuuggagag

SEQ ID NO: 3209553 - RNA, 19 nt, Human
uucaagcuuauuuuggaga

SEQ ID NO: 3209554 - RNA, 14 nt, Human
uucaagcuuauuuu

SEQ ID NO: 3209555 - RNA, 17 nt, Human
uucaagcugcuuuuugu

SEQ ID NO: 3209556 - RNA, 13 nt, Human
uucaagaucaaaa

SEQ ID NO: 3209557 - RNA, 21 nt, Human
uucaagaucuaaaucauauau

SEQ ID NO: 3209558 - RNA, 23 nt, Human
uucaagaucuaaaucauauauaa

SEQ ID NO: 3209559 - RNA, 18 nt, Human
uucaagacugaauuccaa

SEQ ID NO: 3209560 - RNA, 20 nt, Human
uucacauguuuucaaaugga

SEQ ID NO: 3209561 - RNA, 19 nt, Human
uucacauguuuucaaaugg

SEQ ID NO: 3209562 - RNA, 18 nt, Human
uucacauguuuucaaaug

SEQ ID NO: 3209563 - RNA, 17 nt, Human
uucacauguuuucaaau

SEQ ID NO: 3209564 - RNA, 16 nt, Human
uucacauguuuucaaa

SEQ ID NO: 3209565 - RNA, 14 nt, Human
uucacauuauucug

SEQ ID NO: 3209566 - RNA, 12 nt, Human
auaggaaaaacu

SEQ ID NO: 3209567 - RNA, 14 nt, Human
auaggaaaaacuga

SEQ ID NO: 3209568 - RNA, 16 nt, Human
auaggaaaaacugauu

SEQ ID NO: 3209569 - RNA, 17 nt, Human
auaggaaaaacugauuu

SEQ ID NO: 3209570 - RNA, 22 nt, Human
auaggccugcuuugucuccucu

SEQ ID NO: 3209571 - RNA, 16 nt, Human
auaggacuuguuuuug

SEQ ID NO: 3209572 - RNA, 15 nt, Human
auaggagacuuguag

SEQ ID NO: 3209573 - RNA, 15 nt, Human
auaggacuuguuuuu

SEQ ID NO: 3209574 - RNA, 13 nt, Human
auaggacuuguuu

SEQ ID NO: 3209575 - RNA, 22 nt, Human
auaggaauugacccacaagaaa

SEQ ID NO: 3209576 - RNA, 21 nt, Human
auaggaaaugguauccagaau

SEQ ID NO: 3209577 - RNA, 15 nt, Human
uucacaccccaccug

SEQ ID NO: 3209578 - RNA, 14 nt, Human
uucacaccccaccu

SEQ ID NO: 3209579 - RNA, 16 nt, Human
uucacaauuauuccaa

SEQ ID NO: 3209580 - RNA, 16 nt, Human
uucaaguauuuaagcc

SEQ ID NO: 3209581 - RNA, 15 nt, Human
uucacaaguuaagau

SEQ ID NO: 3209582 - RNA, 17 nt, Human
uucacaccccaccugcg

SEQ ID NO: 3209583 - RNA, 16 nt, Human
uucacaccccaccugc

SEQ ID NO: 3209584 - RNA, 19 nt, Human
uucacaccccaccugcgcu

SEQ ID NO: 3209585 - RNA, 14 nt, Human
uucacaccugcaga

SEQ ID NO: 3209586 - RNA, 22 nt, Human
uucacaagacccaaaaggcaga

SEQ ID NO: 3209587 - RNA, 17 nt, Human
uucaagugauucucaug

SEQ ID NO: 3209588 - RNA, 23 nt, Human
uucacaagacccaaaaggcagaa

SEQ ID NO: 3209589 - RNA, 15 nt, Human
uucaaguacacugaa

SEQ ID NO: 3209590 - RNA, 17 nt, Human
uucaaguacacugaauu

SEQ ID NO: 3209591 - RNA, 15 nt, Human
uucaaguauuuaagc

SEQ ID NO: 3209592 - RNA, 14 nt, Human
uucaaguauuuaag

SEQ ID NO: 3209593 - RNA, 20 nt, Human
uucacagaugggugcuugga

SEQ ID NO: 3209594 - RNA, 12 nt, Human
uucacacuugaa

SEQ ID NO: 3209595 - RNA, 15 nt, Human
uucacaguucucucc

SEQ ID NO: 3209596 - RNA, 20 nt, Human
uucacaguucucuccuucuu

SEQ ID NO: 3209597 - RNA, 13 nt, Human
uucacaguucucu

SEQ ID NO: 3209598 - RNA, 15 nt, Human
uucacauguuuucaa

SEQ ID NO: 3209599 - RNA, 23 nt, Human
auaucuccuuuguauucugucuu

SEQ ID NO: 3209600 - RNA, 22 nt, Human
auaucucuauuuaauuuugaca

SEQ ID NO: 3209601 - RNA, 17 nt, Human
auaucuccuuuguauuc

SEQ ID NO: 3209602 - RNA, 12 nt, Human
auaucuuucugc

SEQ ID NO: 3209603 - RNA, 22 nt, Human
auaucuuggcagguaggaauau

SEQ ID NO: 3209604 - RNA, 16 nt, Human
auaugaaaacuaaguu

SEQ ID NO: 3209605 - RNA, 16 nt, Human
auaugaaaaaugagau

SEQ ID NO: 3209606 - RNA, 15 nt, Human
auaugaaaaaugaga

SEQ ID NO: 3209607 - RNA, 20 nt, Human
auaucugaaaauguaugugu

SEQ ID NO: 3209608 - RNA, 17 nt, Human
auaucugaaaauguaug

SEQ ID NO: 3209609 - RNA, 16 nt, Human
auaucugaaaauguau

SEQ ID NO: 3209610 - RNA, 14 nt, Human
auaucuccuuugua

SEQ ID NO: 3209611 - RNA, 22 nt, Human
auaucuaguaauauauuuaaag

SEQ ID NO: 3209612 - RNA, 17 nt, Human
auaucuauaaacacugu

SEQ ID NO: 3209613 - RNA, 16 nt, Human
auauguaacaagccac

SEQ ID NO: 3209614 - RNA, 21 nt, Human
auauggugguaauaagggaaa

SEQ ID NO: 3209615 - RNA, 17 nt, Human
auauggucuaauguuua

SEQ ID NO: 3209616 - RNA, 16 nt, Human
auauggucuaauguuu

SEQ ID NO: 3209617 - RNA, 13 nt, Human
auauggucuaaug

SEQ ID NO: 3209618 - RNA, 15 nt, Human
auauggucuaauguu

SEQ ID NO: 3209619 - RNA, 14 nt, Human
auauggucuaaugu

SEQ ID NO: 3209620 - RNA, 17 nt, Human
auauguaacaagccacc

SEQ ID NO: 3209621 - RNA, 22 nt, Human
auauguaaaugguaugucauuc

SEQ ID NO: 3209622 - RNA, 13 nt, Human
auauguacauuuc

SEQ ID NO: 3209623 - RNA, 12 nt, Human
auauguacauuu

SEQ ID NO: 3209624 - RNA, 15 nt, Human
auauguacauuucua

SEQ ID NO: 3209625 - RNA, 22 nt, Human
auaugugaaggaccuucacucu

SEQ ID NO: 3209626 - RNA, 18 nt, Human
auaugugaacgcccagag

SEQ ID NO: 3209627 - RNA, 21 nt, Human
auaugauuaaaaauaucaaau

SEQ ID NO: 3209628 - RNA, 22 nt, Human
auaugauuaaaaauaucaaauu

SEQ ID NO: 3209629 - RNA, 17 nt, Human
auaugauuaaaaauauc

SEQ ID NO: 3209630 - RNA, 11 nt, Human
auaugauuaaa

SEQ ID NO: 3209631 - RNA, 21 nt, Human
auauauuuaaagggaaauuga

SEQ ID NO: 3209632 - RNA, 20 nt, Human
auauauuuaaagggaaauug

SEQ ID NO: 3209633 - RNA, 14 nt, Human
auauauuuaaaggg

SEQ ID NO: 3209634 - RNA, 15 nt, Human
auauaugugugugug

SEQ ID NO: 3209635 - RNA, 16 nt, Human
auauauuguguugacu

SEQ ID NO: 3209636 - RNA, 23 nt, Human
auauauuguguugacuuuauaaa

SEQ ID NO: 3209637 - RNA, 21 nt, Human
uucaucccucuggggcuguuc

SEQ ID NO: 3209638 - RNA, 15 nt, Human
uucauccccucagaa

SEQ ID NO: 3209639 - RNA, 20 nt, Human
auauauggucuaauguuuaa

SEQ ID NO: 3209640 - RNA, 19 nt, Human
auauauggucuaauguuua

SEQ ID NO: 3209641 - RNA, 13 nt, Human
auauaugugaaag

SEQ ID NO: 3209642 - RNA, 17 nt, Human
uucaucccucuggggcu

SEQ ID NO: 3209643 - RNA, 14 nt, Human
uucauccccucaga

SEQ ID NO: 3209644 - RNA, 19 nt, Human
uucauauuuaauauaugug

SEQ ID NO: 3209645 - RNA, 21 nt, Human
uucauacagggaugguguuca

SEQ ID NO: 3209646 - RNA, 13 nt, Human
uucauaauuuguu

SEQ ID NO: 3209647 - RNA, 18 nt, Human
uucauauucaugcaagua

SEQ ID NO: 3209648 - RNA, 14 nt, Human
uucauauucagcuu

SEQ ID NO: 3209649 - RNA, 16 nt, Human
uucauauuacaauauu

SEQ ID NO: 3209650 - RNA, 15 nt, Human
uucauauuacaauau

SEQ ID NO: 3209651 - RNA, 13 nt, Human
uucauauuacaau

SEQ ID NO: 3209652 - RNA, 19 nt, Human
uucagaaauacagauaaau

SEQ ID NO: 3209653 - RNA, 19 nt, Human
uucagaaagccuuucauuu

SEQ ID NO: 3209654 - RNA, 21 nt, Human
uucagaaagccuuucauuuug

SEQ ID NO: 3209655 - RNA, 20 nt, Human
uucagaaagccuuucauuuu

SEQ ID NO: 3209656 - RNA, 16 nt, Human
uucagugccaaaaaca

SEQ ID NO: 3209657 - RNA, 12 nt, Human
uucagugccuua

SEQ ID NO: 3209658 - RNA, 13 nt, Human
uucagugccuuau

SEQ ID NO: 3209659 - RNA, 13 nt, Human
uuccaagagccug

SEQ ID NO: 3209660 - RNA, 22 nt, Human
uuccaagagccugagagugagg

SEQ ID NO: 3209661 - RNA, 14 nt, Human
uuccaagagccuga

SEQ ID NO: 3209662 - RNA, 20 nt, Human
uuccaagacuuauuuucaca

SEQ ID NO: 3209663 - RNA, 17 nt, Human
uuccaaggguacuaagg

SEQ ID NO: 3209664 - RNA, 15 nt, Human
uuccaaggguacuaa

SEQ ID NO: 3209665 - RNA, 15 nt, Human
auauguggaguucau

SEQ ID NO: 3209666 - RNA, 12 nt, Human
auaugugauuuu

SEQ ID NO: 3209667 - RNA, 16 nt, Human
auaugugccacauuuu

SEQ ID NO: 3209668 - RNA, 16 nt, Human
auauguggaguucauc

SEQ ID NO: 3209669 - RNA, 12 nt, Human
uucauucauauu

SEQ ID NO: 3209670 - RNA, 16 nt, Human
uucauucauacuuaaa

SEQ ID NO: 3209671 - RNA, 17 nt, Human
uucauucauacuuaaaa

SEQ ID NO: 3209672 - RNA, 18 nt, Human
auaugugccacauuuucu

SEQ ID NO: 3209673 - RNA, 23 nt, Human
uucauucauauuacaauauuugu

SEQ ID NO: 3209674 - RNA, 18 nt, Human
uucauucauauuacaaua

SEQ ID NO: 3209675 - RNA, 14 nt, Human
uucauucauauuac

SEQ ID NO: 3209676 - RNA, 13 nt, Human
uucauucauauua

SEQ ID NO: 3209677 - RNA, 19 nt, Human
uuccaccaucaagccacca

SEQ ID NO: 3209678 - RNA, 19 nt, Human
uuccaaugccucuugucuu

SEQ ID NO: 3209679 - RNA, 13 nt, Human
uuccacacaugca

SEQ ID NO: 3209680 - RNA, 22 nt, Human
uuccacaagagcccaggccucc

SEQ ID NO: 3209681 - RNA, 14 nt, Human
uuccaauaugugau

SEQ ID NO: 3209682 - RNA, 13 nt, Human
uuccaauauguga

SEQ ID NO: 3209683 - RNA, 16 nt, Human
uuccaagucuuugcua

SEQ ID NO: 3209684 - RNA, 18 nt, Human
uuccaccaucaagccacc

SEQ ID NO: 3209685 - RNA, 17 nt, Human
uuccaggggugggacac

SEQ ID NO: 3209686 - RNA, 17 nt, Human
uuccaggcccgaagcau

SEQ ID NO: 3209687 - RNA, 11 nt, Human
uuccaggcagc

SEQ ID NO: 3209688 - RNA, 12 nt, Human
uucccaaauuuc

SEQ ID NO: 3209689 - RNA, 23 nt, Human
uucccaacuugccuuugaagagu

SEQ ID NO: 3209690 - RNA, 21 nt, Human
uucccaagaaaggaaaccuuu

SEQ ID NO: 3209691 - RNA, 15 nt, Human
uucccaacuugccuu

SEQ ID NO: 3209692 - RNA, 20 nt, Human
uucccaacuugccuuugaag

SEQ ID NO: 3209693 - RNA, 19 nt, Human
uucccaacuugccuuugaa

SEQ ID NO: 3209694 - RNA, 16 nt, Human
uucccaaccugcucau

SEQ ID NO: 3209695 - RNA, 15 nt, Human
uucccaacacaaaga

SEQ ID NO: 3209696 - RNA, 13 nt, Human
uucccaacacaaa

SEQ ID NO: 3209697 - RNA, 16 nt, Human
uucccaagcucugcuc

SEQ ID NO: 3209698 - RNA, 15 nt, Human
uucccaagcucugcu

SEQ ID NO: 3209699 - RNA, 14 nt, Human
uucccaagcucugc

SEQ ID NO: 3209700 - RNA, 13 nt, Human
uucccaagcucug

SEQ ID NO: 3209701 - RNA, 12 nt, Human
uucccaccucuc

SEQ ID NO: 3209702 - RNA, 16 nt, Human
uucccacccagccugg

SEQ ID NO: 3209703 - RNA, 15 nt, Human
uucccacccagccug

SEQ ID NO: 3209704 - RNA, 14 nt, Human
uucccacccagccu

SEQ ID NO: 3209705 - RNA, 22 nt, Human
uucccaccucucucacuccuug

SEQ ID NO: 3209706 - RNA, 18 nt, Human
uucccaagcucugcuccu

SEQ ID NO: 3209707 - RNA, 21 nt, Human
uuccaggggugggacacccug

SEQ ID NO: 3209708 - RNA, 17 nt, Human
uuccagugaggcucugc

SEQ ID NO: 3209709 - RNA, 19 nt, Human
uuccagugaggcucugccc

SEQ ID NO: 3209710 - RNA, 20 nt, Human
uuccagugaggcucugcccu

SEQ ID NO: 3209711 - RNA, 21 nt, Human
uuccagugaggcucugcccuu

SEQ ID NO: 3209712 - RNA, 22 nt, Human
uuccagugaggcucugcccuug

SEQ ID NO: 3209713 - RNA, 23 nt, Human
uucccaaagcagugcaugcuguc

SEQ ID NO: 3209714 - RNA, 22 nt, Human
uucccaaaugugugcccagcuu

SEQ ID NO: 3209715 - RNA, 20 nt, Human
uucccaaaugugugcccagc

SEQ ID NO: 3209716 - RNA, 17 nt, Human
uuccauaguuaaagaag

SEQ ID NO: 3209717 - RNA, 22 nt, Human
uuccauaguuuagguacucaaa

SEQ ID NO: 3209718 - RNA, 16 nt, Human
uuccauaguuaaagaa

SEQ ID NO: 3209719 - RNA, 23 nt, Human
uuccauaaucuggacuccucugu

SEQ ID NO: 3209720 - RNA, 22 nt, Human
uuccauaaucuggacuccucug

SEQ ID NO: 3209721 - RNA, 19 nt, Human
uuccauaaucuggacuccu

SEQ ID NO: 3209722 - RNA, 17 nt, Human
uuccaguuacuuuccaa

SEQ ID NO: 3209723 - RNA, 20 nt, Human
uuccaguuuauuccagagcu

SEQ ID NO: 3209724 - RNA, 16 nt, Human
ugauaagggaaaagau

SEQ ID NO: 3209725 - RNA, 18 nt, Human
ugauaagggaaaagauaa

SEQ ID NO: 3209726 - RNA, 19 nt, Human
ugauaagggaaaagauaaa

SEQ ID NO: 3209727 - RNA, 20 nt, Human
ugauaagggaaaagauaaag

SEQ ID NO: 3209728 - RNA, 19 nt, Human
ugauaagggacugauguuu

SEQ ID NO: 3209729 - RNA, 24 nt, Human
ugauaagcagucauccucagauca

SEQ ID NO: 3209730 - RNA, 20 nt, Human
ugauaagaaccuuuugagug

SEQ ID NO: 3209731 - RNA, 17 nt, Human
ugaguucauacccuguu

SEQ ID NO: 3209732 - RNA, 24 nt, Human
ugaguuacuugcugcccugugcuc

SEQ ID NO: 3209733 - RNA, 18 nt, Human
ugaguucauaaauuuaug

SEQ ID NO: 3209734 - RNA, 17 nt, Human
ugaguuaggcuuucucu

SEQ ID NO: 3209735 - RNA, 13 nt, Human
ugaguuaggaaca

SEQ ID NO: 3209736 - RNA, 12 nt, Human
ugaguuaggaac

SEQ ID NO: 3209737 - RNA, 21 nt, Human
ugaguggggggaacgcccacu

SEQ ID NO: 3209738 - RNA, 12 nt, Human
ugaguuaucaug

SEQ ID NO: 3209739 - RNA, 16 nt, Human
ugaguuaucaugaauu

SEQ ID NO: 3209740 - RNA, 20 nt, Human
ugaguuaucaugaauuuuaa

SEQ ID NO: 3209741 - RNA, 21 nt, Human
ugaguuaucaugaauuuuaaa

SEQ ID NO: 3209742 - RNA, 23 nt, Human
ugaguuaucaugaauuuuaaagu

SEQ ID NO: 3209743 - RNA, 23 nt, Human
ugagugggggaucacagccucug

SEQ ID NO: 3209744 - RNA, 21 nt, Human
ugagugggugaauaauacagu

SEQ ID NO: 3209745 - RNA, 16 nt, Human
ugagugccuuacacaa

SEQ ID NO: 3209746 - RNA, 17 nt, Human
ugagugccuuacacaau

SEQ ID NO: 3209747 - RNA, 20 nt, Human
ugagugccuuacacaauggu

SEQ ID NO: 3209748 - RNA, 17 nt, Human
ugagucaccaagcccag

SEQ ID NO: 3209749 - RNA, 16 nt, Human
ugagucaccaagccca

SEQ ID NO: 3209750 - RNA, 14 nt, Human
ugagucaccaagcc

SEQ ID NO: 3209751 - RNA, 16 nt, Human
ugaguauauuauaaua

SEQ ID NO: 3209752 - RNA, 15 nt, Human
ugaguauauuauaau

SEQ ID NO: 3209753 - RNA, 14 nt, Human
ugaguagcucugcc

SEQ ID NO: 3209754 - RNA, 14 nt, Human
ugaguauauuauaa

SEQ ID NO: 3209755 - RNA, 22 nt, Human
ugaguagcucugccuuugcucu

SEQ ID NO: 3209756 - RNA, 11 nt, Human
agcauaaagaa

SEQ ID NO: 3209757 - RNA, 12 nt, Human
ugagaauuaccc

SEQ ID NO: 3209758 - RNA, 14 nt, Human
agcauaaagaauuu

SEQ ID NO: 3209759 - RNA, 13 nt, Human
agcauaaagcuca

SEQ ID NO: 3209760 - RNA, 18 nt, Human
agcauaaagcucaaauga

SEQ ID NO: 3209761 - RNA, 23 nt, Human
agcauaaagcucaaaugaaaugu

SEQ ID NO: 3209762 - RNA, 23 nt, Human
ugagacacacaacggcagugaag

SEQ ID NO: 3209763 - RNA, 15 nt, Human
ugaguacuacagucc

SEQ ID NO: 3209764 - RNA, 14 nt, Human
agcauauucaggaa

SEQ ID NO: 3209765 - RNA, 21 nt, Human
agcauaugacaaauguuucua

SEQ ID NO: 3209766 - RNA, 20 nt, Human
agcauaugacaaauguuucu

SEQ ID NO: 3209767 - RNA, 19 nt, Human
agcauaugacaaauguuuc

SEQ ID NO: 3209768 - RNA, 16 nt, Human
agcauaugacaaaugu

SEQ ID NO: 3209769 - RNA, 18 nt, Human
agcauaugacaaauguuu

SEQ ID NO: 3209770 - RNA, 17 nt, Human
agcauaugacaaauguu

SEQ ID NO: 3209771 - RNA, 17 nt, Human
ugaguacuacaguccuc

SEQ ID NO: 3209772 - RNA, 21 nt, Human
ugaguacuacaguccucccau

SEQ ID NO: 3209773 - RNA, 22 nt, Human
ugaguacuacaguccucccauc

SEQ ID NO: 3209774 - RNA, 23 nt, Human
ugaguacuacaguccucccaucu

SEQ ID NO: 3209775 - RNA, 14 nt, Human
ugaguacuacaguc

SEQ ID NO: 3209776 - RNA, 13 nt, Human
ugaguagcuggga

SEQ ID NO: 3209777 - RNA, 21 nt, Human
ugauagaaggcuauggggaua

SEQ ID NO: 3209778 - RNA, 16 nt, Human
ugauacuuuuuugaaa

SEQ ID NO: 3209779 - RNA, 20 nt, Human
ugauacuuuuuugaaaucag

SEQ ID NO: 3209780 - RNA, 17 nt, Human
ugauacuuuuuugaaau

SEQ ID NO: 3209781 - RNA, 23 nt, Human
ugauauuuucaacgcagcccugc

SEQ ID NO: 3209782 - RNA, 22 nt, Human
ugauauuuucaacgcagcccug

SEQ ID NO: 3209783 - RNA, 21 nt, Human
ugauauuuucaacgcagcccu

SEQ ID NO: 3209784 - RNA, 19 nt, Human
ugauauuuucaacgcagcc

SEQ ID NO: 3209785 - RNA, 16 nt, Human
ugauauuucagaaaua

SEQ ID NO: 3209786 - RNA, 15 nt, Human
ugauauuucagaaau

SEQ ID NO: 3209787 - RNA, 15 nt, Human
ugauauuuguauuua

SEQ ID NO: 3209788 - RNA, 19 nt, Human
ugauauuuguauuuauucu

SEQ ID NO: 3209789 - RNA, 18 nt, Human
ugauauuuguauuuauuc

SEQ ID NO: 3209790 - RNA, 13 nt, Human
ugauauuuuaaaa

SEQ ID NO: 3209791 - RNA, 21 nt, Human
ugauauuuguauuuauucuuu

SEQ ID NO: 3209792 - RNA, 20 nt, Human
ugauauucaaauggacaaac

SEQ ID NO: 3209793 - RNA, 22 nt, Human
ugauauuaauuuaucagauugc

SEQ ID NO: 3209794 - RNA, 18 nt, Human
ugauauucuuuguuaauu

SEQ ID NO: 3209795 - RNA, 16 nt, Human
ugauauugcugaagaa

SEQ ID NO: 3209796 - RNA, 14 nt, Human
ugauauuucagaaa

SEQ ID NO: 3209797 - RNA, 13 nt, Human
ugauauuucagaa

SEQ ID NO: 3209798 - RNA, 12 nt, Human
ugauauuucaga

SEQ ID NO: 3209799 - RNA, 17 nt, Human
ugauauucuuuguuaau

SEQ ID NO: 3209800 - RNA, 15 nt, Human
ugauauucuuuguua

SEQ ID NO: 3209801 - RNA, 22 nt, Human
ugauauucuaagaaauaucugu

SEQ ID NO: 3209802 - RNA, 19 nt, Human
ugaucacggcucacugcag

SEQ ID NO: 3209803 - RNA, 18 nt, Human
ugaucacggcucacugca

SEQ ID NO: 3209804 - RNA, 13 nt, Human
agcaucaggccag

SEQ ID NO: 3209805 - RNA, 12 nt, Human
agcaucaggcca

SEQ ID NO: 3209806 - RNA, 20 nt, Human
ugaucacggcucacugcagc

SEQ ID NO: 3209807 - RNA, 22 nt, Human
agcauauucaggaagcucaggg

SEQ ID NO: 3209808 - RNA, 22 nt, Human
agcauuguaagcguauggcuuu

SEQ ID NO: 3209809 - RNA, 22 nt, Human
agcauugucuauuuuucucuuc

SEQ ID NO: 3209810 - RNA, 15 nt, Human
agcauugucuauuuu

SEQ ID NO: 3209811 - RNA, 18 nt, Human
agcauuguaaaugugcuu

SEQ ID NO: 3209812 - RNA, 17 nt, Human
agcauuguaaaugugcu

SEQ ID NO: 3209813 - RNA, 20 nt, Human
agcauuggggauguuuuucu

SEQ ID NO: 3209814 - RNA, 17 nt, Human
agcauuguaaaagcauu

SEQ ID NO: 3209815 - RNA, 16 nt, Human
agcaugucuuauuuaa

SEQ ID NO: 3209816 - RNA, 16 nt, Human
agcauguguuaaucuu

SEQ ID NO: 3209817 - RNA, 17 nt, Human
agcauguguuaaucuua

SEQ ID NO: 3209818 - RNA, 22 nt, Human
agcauguguuaaucuuaaugua

SEQ ID NO: 3209819 - RNA, 17 nt, Human
agcaugucuuauuuaaa

SEQ ID NO: 3209820 - RNA, 15 nt, Human
agcauguuguagaua

SEQ ID NO: 3209821 - RNA, 23 nt, Human
agcauguuguagauacaaucagc

SEQ ID NO: 3209822 - RNA, 14 nt, Human
agcauguuuugcau

SEQ ID NO: 3209823 - RNA, 16 nt, Human
agcauguuuugcaugu

SEQ ID NO: 3209824 - RNA, 19 nt, Human
agcaucaggccaggcccuc

SEQ ID NO: 3209825 - RNA, 20 nt, Human
agcaucaggccaggcccucu

SEQ ID NO: 3209826 - RNA, 14 nt, Human
agcaucaggccagg

SEQ ID NO: 3209827 - RNA, 16 nt, Human
agcaucaggccaggcc

SEQ ID NO: 3209828 - RNA, 17 nt, Human
agcaucaggccaggccc

SEQ ID NO: 3209829 - RNA, 18 nt, Human
agcaucaggccaggcccu

SEQ ID NO: 3209830 - RNA, 12 nt, Human
agcauggcugcc

SEQ ID NO: 3209831 - RNA, 15 nt, Human
agccaggccacuggc

SEQ ID NO: 3209832 - RNA, 21 nt, Human
agccaggccacaagacccuug

SEQ ID NO: 3209833 - RNA, 22 nt, Human
agccaggccacaagacccuugu

SEQ ID NO: 3209834 - RNA, 19 nt, Human
agccaggcgcuagcacagc

SEQ ID NO: 3209835 - RNA, 23 nt, Human
agccaggcgcuagcacagcuccc

SEQ ID NO: 3209836 - RNA, 12 nt, Human
agccagggucuc

SEQ ID NO: 3209837 - RNA, 23 nt, Human
agccagugaacauaauucuuauu

SEQ ID NO: 3209838 - RNA, 14 nt, Human
agccagugaacaua

SEQ ID NO: 3209839 - RNA, 14 nt, Human
agccauaggcccuu

SEQ ID NO: 3209840 - RNA, 12 nt, Human
agccagcugccu

SEQ ID NO: 3209841 - RNA, 14 nt, Human
agccagacuggcac

SEQ ID NO: 3209842 - RNA, 13 nt, Human
agccagacucugc

SEQ ID NO: 3209843 - RNA, 22 nt, Human
agccagaagccacccaaagcag

SEQ ID NO: 3209844 - RNA, 18 nt, Human
agccagaacucugugucc

SEQ ID NO: 3209845 - RNA, 16 nt, Human
agccagaacucugugu

SEQ ID NO: 3209846 - RNA, 12 nt, Human
agccaggccaca

SEQ ID NO: 3209847 - RNA, 14 nt, Human
agccaggccacaag

SEQ ID NO: 3209848 - RNA, 11 nt, Human
agccaggaggg

SEQ ID NO: 3209849 - RNA, 23 nt, Human
agccaggagagcuuagggucuca

SEQ ID NO: 3209850 - RNA, 16 nt, Human
agcccagaagugcaga

SEQ ID NO: 3209851 - RNA, 22 nt, Human
agcccacuucugccauauucug

SEQ ID NO: 3209852 - RNA, 19 nt, Human
agcccaggaaaggcuccag

SEQ ID NO: 3209853 - RNA, 20 nt, Human
agcccaggaaaggcuccagg

SEQ ID NO: 3209854 - RNA, 21 nt, Human
agcccaggaaaggcuccagga

SEQ ID NO: 3209855 - RNA, 21 nt, Human
ugauucccaagcucugcuccu

SEQ ID NO: 3209856 - RNA, 19 nt, Human
ugauucccaagcucugcuc

SEQ ID NO: 3209857 - RNA, 18 nt, Human
ugauucccaagcucugcu

SEQ ID NO: 3209858 - RNA, 16 nt, Human
ugauucccaagcucug

SEQ ID NO: 3209859 - RNA, 15 nt, Human
ugauucccaagcucu

SEQ ID NO: 3209860 - RNA, 22 nt, Human
agcccaggaaaggcuccaggag

SEQ ID NO: 3209861 - RNA, 23 nt, Human
agcccaggaaaggcuccaggagc

SEQ ID NO: 3209862 - RNA, 24 nt, Human
agcccaggaaaggcuccaggagca

SEQ ID NO: 3209863 - RNA, 18 nt, Human
agcccaggaaaggcucca

SEQ ID NO: 3209864 - RNA, 13 nt, Human
ugauucagcucug

SEQ ID NO: 3209865 - RNA, 14 nt, Human
ugauucagcucugc

SEQ ID NO: 3209866 - RNA, 18 nt, Human
ugauccagcccugaguuc

SEQ ID NO: 3209867 - RNA, 17 nt, Human
ugauccagcccugaguu

SEQ ID NO: 3209868 - RNA, 15 nt, Human
ugauccagcccugag

SEQ ID NO: 3209869 - RNA, 15 nt, Human
agccacggccaggcc

SEQ ID NO: 3209870 - RNA, 18 nt, Human
ugauccuuuuggagucag

SEQ ID NO: 3209871 - RNA, 15 nt, Human
ugaucgaaaaaauaa

SEQ ID NO: 3209872 - RNA, 16 nt, Human
ugaucgaaaaaauaau

SEQ ID NO: 3209873 - RNA, 17 nt, Human
ugaucgaaaaaauaauu

SEQ ID NO: 3209874 - RNA, 14 nt, Human
ugaugaagaggagu

SEQ ID NO: 3209875 - RNA, 13 nt, Human
ugaugaagaggag

SEQ ID NO: 3209876 - RNA, 22 nt, Human
ugaugaaucaguccuagaaugu

SEQ ID NO: 3209877 - RNA, 14 nt, Human
agccacauuccuga

SEQ ID NO: 3209878 - RNA, 18 nt, Human
agccacauuccugaugcu

SEQ ID NO: 3209879 - RNA, 20 nt, Human
agccaccaacauacucccau

SEQ ID NO: 3209880 - RNA, 23 nt, Human
agccaccaacauacucccaucug

SEQ ID NO: 3209881 - RNA, 19 nt, Human
agccaccaacauacuccca

SEQ ID NO: 3209882 - RNA, 14 nt, Human
agccacggccaggc

SEQ ID NO: 3209883 - RNA, 16 nt, Human
agccaccugaguuccu

SEQ ID NO: 3209884 - RNA, 14 nt, Human
agccaccugaguuc

SEQ ID NO: 3209885 - RNA, 19 nt, Human
agccaccugaguuccugag

SEQ ID NO: 3209886 - RNA, 18 nt, Human
agccaccgugccuggcca

SEQ ID NO: 3209887 - RNA, 20 nt, Human
ugauguuugugcaguaacuu

SEQ ID NO: 3209888 - RNA, 14 nt, Human
ugauguuugugcag

SEQ ID NO: 3209889 - RNA, 23 nt, Human
ugauguuuuccaugaguccccug

SEQ ID NO: 3209890 - RNA, 15 nt, Human
ugauguuuuuaaaau

SEQ ID NO: 3209891 - RNA, 17 nt, Human
ugauguuuuuaaaaucu

SEQ ID NO: 3209892 - RNA, 16 nt, Human
ugauguuuuuaaaauc

SEQ ID NO: 3209893 - RNA, 22 nt, Human
ugauuaaaaauaucaaauuaau

SEQ ID NO: 3209894 - RNA, 19 nt, Human
ugauuaaaaauaucaaauu

SEQ ID NO: 3209895 - RNA, 20 nt, Human
ugauuaaaaauaucaaauua

SEQ ID NO: 3209896 - RNA, 15 nt, Human
ugauuaaaaauauca

SEQ ID NO: 3209897 - RNA, 21 nt, Human
ugauguuuuuaaaaucuuauu

SEQ ID NO: 3209898 - RNA, 19 nt, Human
ugauguuuuuaaaaucuua

SEQ ID NO: 3209899 - RNA, 18 nt, Human
ugauguuuuuaaaaucuu

SEQ ID NO: 3209900 - RNA, 14 nt, Human
ugaugaucuuuaaa

SEQ ID NO: 3209901 - RNA, 20 nt, Human
ugaugauccuaggcauuugc

SEQ ID NO: 3209902 - RNA, 14 nt, Human
ugaugauccuaggc

SEQ ID NO: 3209903 - RNA, 17 nt, Human
ugauggugcaaugaccu

SEQ ID NO: 3209904 - RNA, 23 nt, Human
ugauggugcaaugaccuuucaau

SEQ ID NO: 3209905 - RNA, 15 nt, Human
ugauggugcaaugac

SEQ ID NO: 3209906 - RNA, 16 nt, Human
ugauggugcaaugacc

SEQ ID NO: 3209907 - RNA, 14 nt, Human
ugauuaccagggac

SEQ ID NO: 3209908 - RNA, 12 nt, Human
ugauuaaaccaa

SEQ ID NO: 3209909 - RNA, 15 nt, Human
ugauuaauuaaaaca

SEQ ID NO: 3209910 - RNA, 21 nt, Human
ugauuaauuucugccauuuca

SEQ ID NO: 3209911 - RNA, 22 nt, Human
ugauuaauuucugccauuucau

SEQ ID NO: 3209912 - RNA, 22 nt, Human
ugauuaaagaugagcuuugucu

SEQ ID NO: 3209913 - RNA, 15 nt, Human
ugauuaaagaugagc

SEQ ID NO: 3209914 - RNA, 14 nt, Human
agccacuuaggaca

SEQ ID NO: 3209915 - RNA, 22 nt, Human
agccacugcaccgggccacaga

SEQ ID NO: 3209916 - RNA, 21 nt, Human
agccacugcaccgggccacag

SEQ ID NO: 3209917 - RNA, 13 nt, Human
agccacugcaccg

SEQ ID NO: 3209918 - RNA, 20 nt, Human
agccacugcaccgggccaca

SEQ ID NO: 3209919 - RNA, 17 nt, Human
ugcaguaacuugggagu

SEQ ID NO: 3209920 - RNA, 15 nt, Human
ugcaguaacuuggga

SEQ ID NO: 3209921 - RNA, 18 nt, Human
ugcaguacuuuaccuccu

SEQ ID NO: 3209922 - RNA, 14 nt, Human
ugcauaaguuaacu

SEQ ID NO: 3209923 - RNA, 22 nt, Human
ugcagucauggagaaccaccua

SEQ ID NO: 3209924 - RNA, 16 nt, Human
ugcagccucacagucc

SEQ ID NO: 3209925 - RNA, 23 nt, Human
ugcagccuccgcuucccugguuc

SEQ ID NO: 3209926 - RNA, 20 nt, Human
ugcagccuccgcuucccugg

SEQ ID NO: 3209927 - RNA, 19 nt, Human
ugcagccuccgcuucccug

SEQ ID NO: 3209928 - RNA, 13 nt, Human
ugcagccucacag

SEQ ID NO: 3209929 - RNA, 15 nt, Human
ugcagccucacaguc

SEQ ID NO: 3209930 - RNA, 19 nt, Human
agccugacagccagaacuc

SEQ ID NO: 3209931 - RNA, 18 nt, Human
agccugacagccagaacu

SEQ ID NO: 3209932 - RNA, 15 nt, Human
agccugacagccaga

SEQ ID NO: 3209933 - RNA, 14 nt, Human
agccugacagccag

SEQ ID NO: 3209934 - RNA, 22 nt, Human
agccugaaagaggaaugaagua

SEQ ID NO: 3209935 - RNA, 23 nt, Human
ugcagccucaaccuccugggcua

SEQ ID NO: 3209936 - RNA, 16 nt, Human
agccucagcauccugg

SEQ ID NO: 3209937 - RNA, 15 nt, Human
agccuagauguuuua

SEQ ID NO: 3209938 - RNA, 21 nt, Human
agccucagcauccuggcaccc

SEQ ID NO: 3209939 - RNA, 20 nt, Human
agccucagcauccuggcacc

SEQ ID NO: 3209940 - RNA, 19 nt, Human
agccucagcauccuggcac

SEQ ID NO: 3209941 - RNA, 17 nt, Human
agccucagcauccuggc

SEQ ID NO: 3209942 - RNA, 20 nt, Human
agccuccaugcugccuccag

SEQ ID NO: 3209943 - RNA, 18 nt, Human
agccuccaugcugccucc

SEQ ID NO: 3209944 - RNA, 16 nt, Human
agccucccaaagugcu

SEQ ID NO: 3209945 - RNA, 16 nt, Human
agccuagauguuuuau

SEQ ID NO: 3209946 - RNA, 15 nt, Human
agccucauguccacu

SEQ ID NO: 3209947 - RNA, 23 nt, Human
agccucagcauccuggcacccgg

SEQ ID NO: 3209948 - RNA, 22 nt, Human
agccucagcauccuggcacccg

SEQ ID NO: 3209949 - RNA, 16 nt, Human
agccgaauagcugaug

SEQ ID NO: 3209950 - RNA, 19 nt, Human
agccgaccugaggacaugg

SEQ ID NO: 3209951 - RNA, 23 nt, Human
agccguggcuucccgcucagccc

SEQ ID NO: 3209952 - RNA, 22 nt, Human
agccguggcuucccgcucagcc

SEQ ID NO: 3209953 - RNA, 13 nt, Human
agccguggcuucc

SEQ ID NO: 3209954 - RNA, 21 nt, Human
agccguggcuucccgcucagc

SEQ ID NO: 3209955 - RNA, 14 nt, Human
agccguggcuuccc

SEQ ID NO: 3209956 - RNA, 23 nt, Human
agcccuucuaccuuccugcaaca

SEQ ID NO: 3209957 - RNA, 22 nt, Human
agcccuucggaggaccagggcu

SEQ ID NO: 3209958 - RNA, 21 nt, Human
agcccuuccucugcucccccu

SEQ ID NO: 3209959 - RNA, 22 nt, Human
ugcacucaaaucuuaagaaaua

SEQ ID NO: 3209960 - RNA, 20 nt, Human
ugcacucaaaucuuaagaaa

SEQ ID NO: 3209961 - RNA, 19 nt, Human
ugcacucaaaucuuaagaa

SEQ ID NO: 3209962 - RNA, 16 nt, Human
ugcacucaaaucuuaa

SEQ ID NO: 3209963 - RNA, 15 nt, Human
ugcacucaaaucuua

SEQ ID NO: 3209964 - RNA, 14 nt, Human
ugcacucaaaucuu

SEQ ID NO: 3209965 - RNA, 20 nt, Human
agcccuuccucugcuccccc

SEQ ID NO: 3209966 - RNA, 19 nt, Human
agcccuuccucugcucccc

SEQ ID NO: 3209967 - RNA, 18 nt, Human
agcccuuccucugcuccc

SEQ ID NO: 3209968 - RNA, 17 nt, Human
agcccuuccucugcucc

SEQ ID NO: 3209969 - RNA, 16 nt, Human
agcccuuccucugcuc

SEQ ID NO: 3209970 - RNA, 15 nt, Human
agcccuuccucugcu

SEQ ID NO: 3209971 - RNA, 15 nt, Human
ugcacucagacugua

SEQ ID NO: 3209972 - RNA, 12 nt, Human
agcccuuccucu

SEQ ID NO: 3209973 - RNA, 14 nt, Human
ugcacucagacugu

SEQ ID NO: 3209974 - RNA, 23 nt, Human
ugcacuauagccuaggugacaga

SEQ ID NO: 3209975 - RNA, 22 nt, Human
ugcacuauagccuaggugacag

SEQ ID NO: 3209976 - RNA, 14 nt, Human
ugcacuauauacau

SEQ ID NO: 3209977 - RNA, 18 nt, Human
agcccaguucagcuuggg

SEQ ID NO: 3209978 - RNA, 13 nt, Human
ugauucuccugcc

SEQ ID NO: 3209979 - RNA, 15 nt, Human
ugauucuccugccuc

SEQ ID NO: 3209980 - RNA, 19 nt, Human
ugauucuccugccucagcc

SEQ ID NO: 3209981 - RNA, 18 nt, Human
ugauucguagauuuaaua

SEQ ID NO: 3209982 - RNA, 20 nt, Human
agccccaaaacucuccucug

SEQ ID NO: 3209983 - RNA, 21 nt, Human
agccccaaaacucuccucugc

SEQ ID NO: 3209984 - RNA, 22 nt, Human
agccccaaaacucuccucugcu

SEQ ID NO: 3209985 - RNA, 18 nt, Human
agccccgugggguuccuc

SEQ ID NO: 3209986 - RNA, 16 nt, Human
agcccccagcuuccag

SEQ ID NO: 3209987 - RNA, 20 nt, Human
agcccccagcuuccagcagg

SEQ ID NO: 3209988 - RNA, 19 nt, Human
agccccuggaugcagccuc

SEQ ID NO: 3209989 - RNA, 19 nt, Human
agccccuucugacccaugc

SEQ ID NO: 3209990 - RNA, 17 nt, Human
agccccuggaugcagcc

SEQ ID NO: 3209991 - RNA, 18 nt, Human
agccccuggaugcagccu

SEQ ID NO: 3209992 - RNA, 23 nt, Human
agccccauucugccugcccaggc

SEQ ID NO: 3209993 - RNA, 16 nt, Human
agccccgaggccuucu

SEQ ID NO: 3209994 - RNA, 22 nt, Human
agccccgaggccuucucugaag

SEQ ID NO: 3209995 - RNA, 17 nt, Human
agccccgaggccuucuc

SEQ ID NO: 3209996 - RNA, 21 nt, Human
agcccugguggcagugggagc

SEQ ID NO: 3209997 - RNA, 20 nt, Human
agcccugcuuugggcugccc

SEQ ID NO: 3209998 - RNA, 23 nt, Human
agcccugcuuugggcugcccugg

SEQ ID NO: 3209999 - RNA, 22 nt, Human
agcccugcuuugggcugcccug

SEQ ID NO: 3210000 - RNA, 20 nt, Human
agccccuucugacccaugcu

SEQ ID NO: 3210001 - RNA, 24 nt, Human
agccccuucugacccaugcugccc

SEQ ID NO: 3210002 - RNA, 21 nt, Human
agcccugcuuugggcugcccu

SEQ ID NO: 3210003 - RNA, 18 nt, Human
ugcacaagcugcacccuc

SEQ ID NO: 3210004 - RNA, 21 nt, Human
ugcacaagcugcacccucagg

SEQ ID NO: 3210005 - RNA, 22 nt, Human
ugcacacaccagagcccaccuu

SEQ ID NO: 3210006 - RNA, 22 nt, Human
agcccuguaucguauucaccuu

SEQ ID NO: 3210007 - RNA, 12 nt, Human
ugcacacagcac

SEQ ID NO: 3210008 - RNA, 24 nt, Human
ugcacacagcacgggggccaagga

SEQ ID NO: 3210009 - RNA, 14 nt, Human
ugcacaagcugcac

SEQ ID NO: 3210010 - RNA, 15 nt, Human
ugcacaagcugcacc

SEQ ID NO: 3210011 - RNA, 23 nt, Human
agcccugguggcagugggagcug

SEQ ID NO: 3210012 - RNA, 22 nt, Human
agcccugguggcagugggagcu

SEQ ID NO: 3210013 - RNA, 15 nt, Human
ugcacgugugugcac

SEQ ID NO: 3210014 - RNA, 14 nt, Human
ugcacgugugugca

SEQ ID NO: 3210015 - RNA, 16 nt, Human
ugcacccucaggcagg

SEQ ID NO: 3210016 - RNA, 17 nt, Human
ugcacccucaggcaggu

SEQ ID NO: 3210017 - RNA, 20 nt, Human
ugcacccacuaaugugucau

SEQ ID NO: 3210018 - RNA, 17 nt, Human
ugcacacaucaucugua

SEQ ID NO: 3210019 - RNA, 16 nt, Human
ugcacacaucaucugu

SEQ ID NO: 3210020 - RNA, 21 nt, Human
ugcacacaucaucuguaagcu

SEQ ID NO: 3210021 - RNA, 23 nt, Human
ugcacacgagcagacacccuugg

SEQ ID NO: 3210022 - RNA, 23 nt, Human
agcuaggaacaaaucuuccuggu

SEQ ID NO: 3210023 - RNA, 21 nt, Human
agcuaggaacaaaucuuccug

SEQ ID NO: 3210024 - RNA, 16 nt, Human
agcuaggaacaaaucu

SEQ ID NO: 3210025 - RNA, 15 nt, Human
agcuaggaacaaauc

SEQ ID NO: 3210026 - RNA, 12 nt, Human
agcuaggccugg

SEQ ID NO: 3210027 - RNA, 15 nt, Human
agcuaggccuggcca

SEQ ID NO: 3210028 - RNA, 14 nt, Human
agcuaggccuggcc

SEQ ID NO: 3210029 - RNA, 13 nt, Human
agcuaggcagggu

SEQ ID NO: 3210030 - RNA, 12 nt, Human
agcuaggcaggg

SEQ ID NO: 3210031 - RNA, 17 nt, Human
agcucaggugucccugc

SEQ ID NO: 3210032 - RNA, 18 nt, Human
agcucaggugucccugca

SEQ ID NO: 3210033 - RNA, 21 nt, Human
agcucaggugucccugcacuu

SEQ ID NO: 3210034 - RNA, 20 nt, Human
agcucaggugucccugcacu

SEQ ID NO: 3210035 - RNA, 22 nt, Human
agcucaggugucccugcacuug

SEQ ID NO: 3210036 - RNA, 21 nt, Human
ugcccagccccuucugaccca

SEQ ID NO: 3210037 - RNA, 20 nt, Human
ugcccagccccuucugaccc

SEQ ID NO: 3210038 - RNA, 23 nt, Human
ugcccagccucuuucccuuccag

SEQ ID NO: 3210039 - RNA, 18 nt, Human
ugcccagccucuuucccu

SEQ ID NO: 3210040 - RNA, 17 nt, Human
ugcccagccucuuuccc

SEQ ID NO: 3210041 - RNA, 16 nt, Human
ugcccagccucuuucc

SEQ ID NO: 3210042 - RNA, 16 nt, Human
ugcccacaggaucagu

SEQ ID NO: 3210043 - RNA, 19 nt, Human
ugcccacaggaucagucug

SEQ ID NO: 3210044 - RNA, 20 nt, Human
ugcccacaggaucagucuga

SEQ ID NO: 3210045 - RNA, 15 nt, Human
agcucaguuuucaac

SEQ ID NO: 3210046 - RNA, 21 nt, Human
ugcccaagaauagaugcugac

SEQ ID NO: 3210047 - RNA, 23 nt, Human
ugcccaagaauagaugcugacug

SEQ ID NO: 3210048 - RNA, 22 nt, Human
ugcccaagaauagaugcugacu

SEQ ID NO: 3210049 - RNA, 17 nt, Human
ugccagacccccuggag

SEQ ID NO: 3210050 - RNA, 23 nt, Human
ugccacaaggaagaaauuaacuu

SEQ ID NO: 3210051 - RNA, 19 nt, Human
ugccacuuugcaaaggagc

SEQ ID NO: 3210052 - RNA, 13 nt, Human
ugccacuuuccaa

SEQ ID NO: 3210053 - RNA, 22 nt, Human
ugccacacuucaggcucuucuc

SEQ ID NO: 3210054 - RNA, 21 nt, Human
agcgguaccaaugcagaacuc

SEQ ID NO: 3210055 - RNA, 19 nt, Human
agcgguaccaaugcagaac

SEQ ID NO: 3210056 - RNA, 22 nt, Human
ugccagacgcucauucagcauc

SEQ ID NO: 3210057 - RNA, 23 nt, Human
ugccagacgcucauucagcaucu

SEQ ID NO: 3210058 - RNA, 22 nt, Human
agcgugagccacugcaccgggc

SEQ ID NO: 3210059 - RNA, 19 nt, Human
agcgugagccacugcaccg

SEQ ID NO: 3210060 - RNA, 15 nt, Human
agcguagugcagcag

SEQ ID NO: 3210061 - RNA, 17 nt, Human
agcgugagccacugcac

SEQ ID NO: 3210062 - RNA, 15 nt, Human
agcuacguuuacuca

SEQ ID NO: 3210063 - RNA, 17 nt, Human
agcuacuugggaggcug

SEQ ID NO: 3210064 - RNA, 18 nt, Human
agcuacuugggaggcuga

SEQ ID NO: 3210065 - RNA, 15 nt, Human
agcuagagaaauucu

SEQ ID NO: 3210066 - RNA, 18 nt, Human
agcuagacgagcaggcuu

SEQ ID NO: 3210067 - RNA, 20 nt, Human
agcuaggaaaagaaaucuau

SEQ ID NO: 3210068 - RNA, 17 nt, Human
agcuaggaaaagaaauc

SEQ ID NO: 3210069 - RNA, 16 nt, Human
agccuggucagcccaa

SEQ ID NO: 3210070 - RNA, 15 nt, Human
agccuggucagccca

SEQ ID NO: 3210071 - RNA, 22 nt, Human
agccugggugacagagcaagug

SEQ ID NO: 3210072 - RNA, 19 nt, Human
agccugcuccagcuguuca

SEQ ID NO: 3210073 - RNA, 22 nt, Human
agccugcuccagcuguucagcu

SEQ ID NO: 3210074 - RNA, 11 nt, Human
agccugcuccu

SEQ ID NO: 3210075 - RNA, 15 nt, Human
agccugcuccuuccc

SEQ ID NO: 3210076 - RNA, 14 nt, Human
agccugcuccuucc

SEQ ID NO: 3210077 - RNA, 16 nt, Human
agccugcuccuucccu

SEQ ID NO: 3210078 - RNA, 14 nt, Human
agccugcuccagcu

SEQ ID NO: 3210079 - RNA, 15 nt, Human
agccugcuccagcug

SEQ ID NO: 3210080 - RNA, 16 nt, Human
agccugcuccagcugu

SEQ ID NO: 3210081 - RNA, 17 nt, Human
agccugcuccagcuguu

SEQ ID NO: 3210082 - RNA, 22 nt, Human
agccuuagaagucacacaguau

SEQ ID NO: 3210083 - RNA, 11 nt, Human
agccuguguca

SEQ ID NO: 3210084 - RNA, 16 nt, Human
agccuguuguuuaagu

SEQ ID NO: 3210085 - RNA, 20 nt, Human
agccuggucagcccaaacca

SEQ ID NO: 3210086 - RNA, 21 nt, Human
agccugugccucugggacugg

SEQ ID NO: 3210087 - RNA, 19 nt, Human
agccugugccucugggacu

SEQ ID NO: 3210088 - RNA, 21 nt, Human
agccuugugggugugagcagc

SEQ ID NO: 3210089 - RNA, 23 nt, Human
agccuugugaucacuuucugaaa

SEQ ID NO: 3210090 - RNA, 11 nt, Human
agccuuccagg

SEQ ID NO: 3210091 - RNA, 14 nt, Human
agccuuccaggggu

SEQ ID NO: 3210092 - RNA, 16 nt, Human
agccuuccaggggugg

SEQ ID NO: 3210093 - RNA, 17 nt, Human
agccuuccagggguggg

SEQ ID NO: 3210094 - RNA, 16 nt, Human
agcggagaaaggaagg

SEQ ID NO: 3210095 - RNA, 20 nt, Human
agcggagaaaggaagggcug

SEQ ID NO: 3210096 - RNA, 18 nt, Human
agcggagacggaguccca

SEQ ID NO: 3210097 - RNA, 14 nt, Human
ugcauuauuaaauu

SEQ ID NO: 3210098 - RNA, 18 nt, Human
ugccaaugggagcucaug

SEQ ID NO: 3210099 - RNA, 21 nt, Human
ugccaauaauaauaccucccu

SEQ ID NO: 3210100 - RNA, 22 nt, Human
ugccaauaauaauaccucccuu

SEQ ID NO: 3210101 - RNA, 17 nt, Human
ugccacaaggaagaaau

SEQ ID NO: 3210102 - RNA, 22 nt, Human
ugccacaaggaagaaauuaacu

SEQ ID NO: 3210103 - RNA, 18 nt, Human
ugccacaaggaagaaauu

SEQ ID NO: 3210104 - RNA, 16 nt, Human
ugccacacuucaggcu

SEQ ID NO: 3210105 - RNA, 15 nt, Human
ugccacacuucaggc

SEQ ID NO: 3210106 - RNA, 14 nt, Human
ugccacacuucagg

SEQ ID NO: 3210107 - RNA, 13 nt, Human
ugccacacuucag

SEQ ID NO: 3210108 - RNA, 21 nt, Human
uggccuguucuucuauggguu

SEQ ID NO: 3210109 - RNA, 18 nt, Human
uggccuggccccucaggg

SEQ ID NO: 3210110 - RNA, 21 nt, Human
uggccuggccccucagggucc

SEQ ID NO: 3210111 - RNA, 12 nt, Human
uggccuggcccc

SEQ ID NO: 3210112 - RNA, 19 nt, Human
uggccugaaccacaggaga

SEQ ID NO: 3210113 - RNA, 17 nt, Human
uggccugacucccccag

SEQ ID NO: 3210114 - RNA, 14 nt, Human
uggccugacucccc

SEQ ID NO: 3210115 - RNA, 20 nt, Human
uggccugaaccacaggagag

SEQ ID NO: 3210116 - RNA, 14 nt, Human
uggccucuucuaga

SEQ ID NO: 3210117 - RNA, 12 nt, Human
aggccuggggac

SEQ ID NO: 3210118 - RNA, 18 nt, Human
aggccugggggcugggca

SEQ ID NO: 3210119 - RNA, 20 nt, Human
aggccugggggcugggcaga

SEQ ID NO: 3210120 - RNA, 23 nt, Human
uggccgggcgcgguggcucacgc

SEQ ID NO: 3210121 - RNA, 13 nt, Human
uggcccugcccug

SEQ ID NO: 3210122 - RNA, 14 nt, Human
uggcccuggcagcc

SEQ ID NO: 3210123 - RNA, 14 nt, Human
uggcccugcccugg

SEQ ID NO: 3210124 - RNA, 19 nt, Human
uggcccaccaggccccccu

SEQ ID NO: 3210125 - RNA, 14 nt, Human
uggcccaccaggcc

SEQ ID NO: 3210126 - RNA, 20 nt, Human
uggcccaacaggggcuccau

SEQ ID NO: 3210127 - RNA, 23 nt, Human
uggccaguggcuggaucugugag

SEQ ID NO: 3210128 - RNA, 23 nt, Human
uggccagugugacaaggauugcu

SEQ ID NO: 3210129 - RNA, 17 nt, Human
uggccagguggccacuc

SEQ ID NO: 3210130 - RNA, 16 nt, Human
uggccagguggccacu

SEQ ID NO: 3210131 - RNA, 19 nt, Human
uggccagguggccacucca

SEQ ID NO: 3210132 - RNA, 14 nt, Human
uggccaucauuucu

SEQ ID NO: 3210133 - RNA, 22 nt, Human
uggccauaagcaacaauuuuca

SEQ ID NO: 3210134 - RNA, 23 nt, Human
uggccaaagccaaagcuaggccu

SEQ ID NO: 3210135 - RNA, 21 nt, Human
uggccaaagccaaagcuaggc

SEQ ID NO: 3210136 - RNA, 15 nt, Human
uggccaaacaacagu

SEQ ID NO: 3210137 - RNA, 17 nt, Human
uggcauuugcaauaaaa

SEQ ID NO: 3210138 - RNA, 15 nt, Human
uggcauuugcaauaa

SEQ ID NO: 3210139 - RNA, 17 nt, Human
uggccaauuaaggcauc

SEQ ID NO: 3210140 - RNA, 15 nt, Human
uggccagguggccac

SEQ ID NO: 3210141 - RNA, 11 nt, Human
uggccaggugg

SEQ ID NO: 3210142 - RNA, 18 nt, Human
uggcaucuuaaaagcuau

SEQ ID NO: 3210143 - RNA, 17 nt, Human
aggccccgcccaggcuu

SEQ ID NO: 3210144 - RNA, 20 nt, Human
aggccccucccucuccagca

SEQ ID NO: 3210145 - RNA, 16 nt, Human
uggauuauaaucagaa

SEQ ID NO: 3210146 - RNA, 17 nt, Human
uggauuauaaucagaau

SEQ ID NO: 3210147 - RNA, 14 nt, Human
uggauuaaauuagu

SEQ ID NO: 3210148 - RNA, 21 nt, Human
uggauuaaauuaguuugugaa

SEQ ID NO: 3210149 - RNA, 22 nt, Human
uggauuauucuuucuccuuuuu

SEQ ID NO: 3210150 - RNA, 16 nt, Human
uggauuauucuuucuc

SEQ ID NO: 3210151 - RNA, 16 nt, Human
uggauuauucaggcuu

SEQ ID NO: 3210152 - RNA, 13 nt, Human
uggauuguccccg

SEQ ID NO: 3210153 - RNA, 13 nt, Human
uggauggaagggg

SEQ ID NO: 3210154 - RNA, 13 nt, Human
uggaguagaaugu

SEQ ID NO: 3210155 - RNA, 16 nt, Human
uggaugggcagucauu

SEQ ID NO: 3210156 - RNA, 15 nt, Human
uggauggaaggggcu

SEQ ID NO: 3210157 - RNA, 16 nt, Human
aggccaaaggaagcac

SEQ ID NO: 3210158 - RNA, 18 nt, Human
aggccaaaggaagcacau

SEQ ID NO: 3210159 - RNA, 19 nt, Human
aggccaaaggaagcacaug

SEQ ID NO: 3210160 - RNA, 15 nt, Human
aggccaaaggaagca

SEQ ID NO: 3210161 - RNA, 17 nt, Human
aggcagccccauucugc

SEQ ID NO: 3210162 - RNA, 16 nt, Human
aggcagccccauucug

SEQ ID NO: 3210163 - RNA, 18 nt, Human
aggcagccaggccacaag

SEQ ID NO: 3210164 - RNA, 16 nt, Human
aggccaaggugggagg

SEQ ID NO: 3210165 - RNA, 23 nt, Human
aggccaagaguggccccaccugg

SEQ ID NO: 3210166 - RNA, 22 nt, Human
aggccaagaguggccccaccug

SEQ ID NO: 3210167 - RNA, 21 nt, Human
aggccaagaguggccccaccu

SEQ ID NO: 3210168 - RNA, 20 nt, Human
aggccaagaguggccccacc

SEQ ID NO: 3210169 - RNA, 19 nt, Human
aggccaagaguggccccac

SEQ ID NO: 3210170 - RNA, 14 nt, Human
aggccaagagguuu

SEQ ID NO: 3210171 - RNA, 13 nt, Human
aggccaagagguu

SEQ ID NO: 3210172 - RNA, 18 nt, Human
aggccaagaguggcccca

SEQ ID NO: 3210173 - RNA, 16 nt, Human
aggccaagaguggccc

SEQ ID NO: 3210174 - RNA, 15 nt, Human
aggccaagaguggcc

SEQ ID NO: 3210175 - RNA, 21 nt, Human
aggccaagagguuuggcuccu

SEQ ID NO: 3210176 - RNA, 18 nt, Human
uggcacaguuuucugaga

SEQ ID NO: 3210177 - RNA, 16 nt, Human
uggcacagggcaugaa

SEQ ID NO: 3210178 - RNA, 20 nt, Human
uggcacagggcaugaaauga

SEQ ID NO: 3210179 - RNA, 19 nt, Human
uggcacagggcaugaaaug

SEQ ID NO: 3210180 - RNA, 19 nt, Human
uggcacaguuuucugagaa

SEQ ID NO: 3210181 - RNA, 13 nt, Human
uggcagccuuggc

SEQ ID NO: 3210182 - RNA, 16 nt, Human
uggcacagggcagugg

SEQ ID NO: 3210183 - RNA, 18 nt, Human
uggcacagggcaguggga

SEQ ID NO: 3210184 - RNA, 21 nt, Human
uggcaaugguaguuucugugg

SEQ ID NO: 3210185 - RNA, 18 nt, Human
uggcaauguuuugcuuuu

SEQ ID NO: 3210186 - RNA, 16 nt, Human
uggcaaugguaguuuc

SEQ ID NO: 3210187 - RNA, 17 nt, Human
uggcaaugguaguuucu

SEQ ID NO: 3210188 - RNA, 18 nt, Human
uggcaaugguaguuucug

SEQ ID NO: 3210189 - RNA, 19 nt, Human
uggcaaugguaguuucugu

SEQ ID NO: 3210190 - RNA, 20 nt, Human
uggcaauggaugaacugaaa

SEQ ID NO: 3210191 - RNA, 17 nt, Human
aggccacaagacccuug

SEQ ID NO: 3210192 - RNA, 18 nt, Human
aggccacaagacccuugu

SEQ ID NO: 3210193 - RNA, 19 nt, Human
aggccacaagacccuugug

SEQ ID NO: 3210194 - RNA, 14 nt, Human
aggccagagggagu

SEQ ID NO: 3210195 - RNA, 16 nt, Human
aggccacaagacccuu

SEQ ID NO: 3210196 - RNA, 19 nt, Human
uggcagcucaccucucccu

SEQ ID NO: 3210197 - RNA, 15 nt, Human
uggcagcucaccucu

SEQ ID NO: 3210198 - RNA, 17 nt, Human
uggcagccuuggcaaac

SEQ ID NO: 3210199 - RNA, 20 nt, Human
aggccagagggagugacaga

SEQ ID NO: 3210200 - RNA, 21 nt, Human
aggcccagagggccugcaagg

SEQ ID NO: 3210201 - RNA, 16 nt, Human
aggccccgcccaggcu

SEQ ID NO: 3210202 - RNA, 19 nt, Human
aggccccaauaccccaugg

SEQ ID NO: 3210203 - RNA, 16 nt, Human
aggccccaauacccca

SEQ ID NO: 3210204 - RNA, 23 nt, Human
aggcccagcgcggacauccccug

SEQ ID NO: 3210205 - RNA, 12 nt, Human
aggcccagcacc

SEQ ID NO: 3210206 - RNA, 16 nt, Human
aggcccaugggaggcu

SEQ ID NO: 3210207 - RNA, 21 nt, Human
aggcccaugggaggcuggagu

SEQ ID NO: 3210208 - RNA, 18 nt, Human
aggcccaugggaggcugg

SEQ ID NO: 3210209 - RNA, 20 nt, Human
uggaagcuucuggugaccuu

SEQ ID NO: 3210210 - RNA, 23 nt, Human
uggaagcacaccaaucuuacuuu

SEQ ID NO: 3210211 - RNA, 21 nt, Human
uggaaggcccagcaccacccu

SEQ ID NO: 3210212 - RNA, 15 nt, Human
uggaaggcccagcac

SEQ ID NO: 3210213 - RNA, 13 nt, Human
uggaaggcccagc

SEQ ID NO: 3210214 - RNA, 14 nt, Human
uggaaggcagagaa

SEQ ID NO: 3210215 - RNA, 15 nt, Human
uggaaggcagagaaa

SEQ ID NO: 3210216 - RNA, 16 nt, Human
uggaaggcagagaaau

SEQ ID NO: 3210217 - RNA, 17 nt, Human
uggaaggcagagaaauc

SEQ ID NO: 3210218 - RNA, 18 nt, Human
uggaaggcagagaaaucu

SEQ ID NO: 3210219 - RNA, 20 nt, Human
uggaaggcagagaaaucuaa

SEQ ID NO: 3210220 - RNA, 23 nt, Human
uggaaggggacacgugacagccg

SEQ ID NO: 3210221 - RNA, 18 nt, Human
uggaaaucaaauguaaag

SEQ ID NO: 3210222 - RNA, 17 nt, Human
uggaaaucaaauguaaa

SEQ ID NO: 3210223 - RNA, 17 nt, Human
uggaaaugggcagagca

SEQ ID NO: 3210224 - RNA, 19 nt, Human
uggaaaucaaauguaaagu

SEQ ID NO: 3210225 - RNA, 18 nt, Human
uggaagcuguuuggaaaa

SEQ ID NO: 3210226 - RNA, 19 nt, Human
uggaagcuguuuggaaaag

SEQ ID NO: 3210227 - RNA, 20 nt, Human
uggaagcuguuuggaaaaga

SEQ ID NO: 3210228 - RNA, 23 nt, Human
uggaagcuguuuggaaaagacag

SEQ ID NO: 3210229 - RNA, 21 nt, Human
uggaagcacaccaaucuuacu

SEQ ID NO: 3210230 - RNA, 22 nt, Human
uggaagcacaccaaucuuacuu

SEQ ID NO: 3210231 - RNA, 18 nt, Human
uggaagauuauugagagc

SEQ ID NO: 3210232 - RNA, 18 nt, Human
uggaagauauuccugagu

SEQ ID NO: 3210233 - RNA, 13 nt, Human
aggauccugagcc

SEQ ID NO: 3210234 - RNA, 14 nt, Human
aggauccugagcca

SEQ ID NO: 3210235 - RNA, 15 nt, Human
aggauacaggcugga

SEQ ID NO: 3210236 - RNA, 16 nt, Human
aggauaccuucuuauu

SEQ ID NO: 3210237 - RNA, 18 nt, Human
aggauacugccuccccca

SEQ ID NO: 3210238 - RNA, 15 nt, Human
aggauacugccuccc

SEQ ID NO: 3210239 - RNA, 23 nt, Human
aggagcucacuguggugucugug

SEQ ID NO: 3210240 - RNA, 22 nt, Human
aggagcuccauacacacgcugc

SEQ ID NO: 3210241 - RNA, 13 nt, Human
aggagcugggccc

SEQ ID NO: 3210242 - RNA, 12 nt, Human
aggacaguauuu

SEQ ID NO: 3210243 - RNA, 19 nt, Human
aggacaguauuugugggga

SEQ ID NO: 3210244 - RNA, 15 nt, Human
aggacagggguuccu

SEQ ID NO: 3210245 - RNA, 21 nt, Human
ugcuugaggcaacucaucuua

SEQ ID NO: 3210246 - RNA, 16 nt, Human
aggacagggguuccuu

SEQ ID NO: 3210247 - RNA, 15 nt, Human
ugcuuguaacuaaaa

SEQ ID NO: 3210248 - RNA, 15 nt, Human
ugcuuggaggaagga

SEQ ID NO: 3210249 - RNA, 14 nt, Human
ugcuuggaggaagg

SEQ ID NO: 3210250 - RNA, 14 nt, Human
ugcuugccaaagua

SEQ ID NO: 3210251 - RNA, 15 nt, Human
ugcuugccaaaguac

SEQ ID NO: 3210252 - RNA, 18 nt, Human
ugcuugccaaaguacaga

SEQ ID NO: 3210253 - RNA, 14 nt, Human
ugcuuugugaacaa

SEQ ID NO: 3210254 - RNA, 14 nt, Human
ugcuuuuggucugu

SEQ ID NO: 3210255 - RNA, 19 nt, Human
ugcuuguauuuuuuaaugc

SEQ ID NO: 3210256 - RNA, 14 nt, Human
ugcuuugucuccuc

SEQ ID NO: 3210257 - RNA, 17 nt, Human
ugcuuugucuccucuau

SEQ ID NO: 3210258 - RNA, 16 nt, Human
ugcuuugucuccucua

SEQ ID NO: 3210259 - RNA, 15 nt, Human
ugcuuugucuccucu

SEQ ID NO: 3210260 - RNA, 19 nt, Human
uggaauuauuuuaaaagau

SEQ ID NO: 3210261 - RNA, 20 nt, Human
uggaauuauuuuaaaagaua

SEQ ID NO: 3210262 - RNA, 18 nt, Human
aggcaaacauuuucucuu

SEQ ID NO: 3210263 - RNA, 22 nt, Human
aggcaaacauuuucucuuagaa

SEQ ID NO: 3210264 - RNA, 19 nt, Human
aggcaaacauuuucucuua

SEQ ID NO: 3210265 - RNA, 22 nt, Human
aggcaaaccuuucuauaauuuu

SEQ ID NO: 3210266 - RNA, 23 nt, Human
aggcaaacauuuucucuuagaaa

SEQ ID NO: 3210267 - RNA, 18 nt, Human
aggcaaauccgaaaucag

SEQ ID NO: 3210268 - RNA, 15 nt, Human
aggcaaauaaaauuc

SEQ ID NO: 3210269 - RNA, 17 nt, Human
aggaucucuugagccug

SEQ ID NO: 3210270 - RNA, 18 nt, Human
aggaucucuugagccugg

SEQ ID NO: 3210271 - RNA, 19 nt, Human
aggaucucuugagccuggg

SEQ ID NO: 3210272 - RNA, 12 nt, Human
aggaucucuuga

SEQ ID NO: 3210273 - RNA, 14 nt, Human
uggacacagcucuu

SEQ ID NO: 3210274 - RNA, 13 nt, Human
uggacacagcucu

SEQ ID NO: 3210275 - RNA, 22 nt, Human
uggacacagcucuucuccaggc

SEQ ID NO: 3210276 - RNA, 21 nt, Human
uggacacagcucuucuccagg

SEQ ID NO: 3210277 - RNA, 23 nt, Human
uggacacagcucuucuccaggcu

SEQ ID NO: 3210278 - RNA, 16 nt, Human
uggacccugaggccca

SEQ ID NO: 3210279 - RNA, 18 nt, Human
uggacccugaggcccaga

SEQ ID NO: 3210280 - RNA, 23 nt, Human
uggacccuguggaugauaaaaca

SEQ ID NO: 3210281 - RNA, 21 nt, Human
uggacccugaggcccagaggg

SEQ ID NO: 3210282 - RNA, 19 nt, Human
uggacccugaggcccagag

SEQ ID NO: 3210283 - RNA, 20 nt, Human
uggacccugaggcccagagg

SEQ ID NO: 3210284 - RNA, 15 nt, Human
uggacccugaggccc

SEQ ID NO: 3210285 - RNA, 22 nt, Human
aggcaaguuuucccugaaguua

SEQ ID NO: 3210286 - RNA, 17 nt, Human
aggcaaggcugucaauu

SEQ ID NO: 3210287 - RNA, 15 nt, Human
uggagcuauuuuaaa

SEQ ID NO: 3210288 - RNA, 18 nt, Human
uggagcggggcccacccg

SEQ ID NO: 3210289 - RNA, 22 nt, Human
aggcacccaccaucaugucugg

SEQ ID NO: 3210290 - RNA, 21 nt, Human
aggcacccaccaucaugucug

SEQ ID NO: 3210291 - RNA, 20 nt, Human
aggcacccaccaucaugucu

SEQ ID NO: 3210292 - RNA, 14 nt, Human
aggcaaugcuggcu

SEQ ID NO: 3210293 - RNA, 15 nt, Human
aggcacccaccauca

SEQ ID NO: 3210294 - RNA, 13 nt, Human
aggcacccuucca

SEQ ID NO: 3210295 - RNA, 20 nt, Human
aggcaccuaccaccacgccc

SEQ ID NO: 3210296 - RNA, 14 nt, Human
uggagaacuagaga

SEQ ID NO: 3210297 - RNA, 14 nt, Human
uggagaaccaccua

SEQ ID NO: 3210298 - RNA, 13 nt, Human
uggagaagcggcu

SEQ ID NO: 3210299 - RNA, 22 nt, Human
uggagaagcggcuggcagccca

SEQ ID NO: 3210300 - RNA, 15 nt, Human
ugcuguagacauuug

SEQ ID NO: 3210301 - RNA, 17 nt, Human
ugcuguagccuauuuuu

SEQ ID NO: 3210302 - RNA, 23 nt, Human
ugcuguaguguugucuuugauaa

SEQ ID NO: 3210303 - RNA, 17 nt, Human
ugcugggauuacaggug

SEQ ID NO: 3210304 - RNA, 21 nt, Human
ugcugggauuacaagcgugag

SEQ ID NO: 3210305 - RNA, 23 nt, Human
ugcuguauccauccauggggcug

SEQ ID NO: 3210306 - RNA, 21 nt, Human
ugcuggcuguuggcugggggc

SEQ ID NO: 3210307 - RNA, 19 nt, Human
ugcuggcuguuggcugggg

SEQ ID NO: 3210308 - RNA, 19 nt, Human
ugcugggauuacaagcgug

SEQ ID NO: 3210309 - RNA, 18 nt, Human
ugcuggcuguuggcuggg

SEQ ID NO: 3210310 - RNA, 13 nt, Human
ugcuggcugccuu

SEQ ID NO: 3210311 - RNA, 15 nt, Human
ugcuggccggacacc

SEQ ID NO: 3210312 - RNA, 16 nt, Human
ugcuggccggacaccc

SEQ ID NO: 3210313 - RNA, 16 nt, Human
aggaauggacauuucu

SEQ ID NO: 3210314 - RNA, 15 nt, Human
aggaauggacauuuc

SEQ ID NO: 3210315 - RNA, 19 nt, Human
aggaaugcacauggaauau

SEQ ID NO: 3210316 - RNA, 13 nt, Human
ugcugcccugccc

SEQ ID NO: 3210317 - RNA, 16 nt, Human
ugcugcccugcccacc

SEQ ID NO: 3210318 - RNA, 17 nt, Human
ugcugcccugcccaccu

SEQ ID NO: 3210319 - RNA, 18 nt, Human
ugcugcccugcccaccug

SEQ ID NO: 3210320 - RNA, 17 nt, Human
aggaauggacauuucua

SEQ ID NO: 3210321 - RNA, 12 nt, Human
ugcugcccugcc

SEQ ID NO: 3210322 - RNA, 11 nt, Human
ugcugcccugu

SEQ ID NO: 3210323 - RNA, 19 nt, Human
ugcugcccugcccaccugg

SEQ ID NO: 3210324 - RNA, 21 nt, Human
ugcugcccugcccaccuggcc

SEQ ID NO: 3210325 - RNA, 18 nt, Human
ugcuucauguuugccuuc

SEQ ID NO: 3210326 - RNA, 20 nt, Human
ugcuucauuuguaugucaaa

SEQ ID NO: 3210327 - RNA, 14 nt, Human
ugcuuccagaaaca

SEQ ID NO: 3210328 - RNA, 13 nt, Human
ugcuuccagaaac

SEQ ID NO: 3210329 - RNA, 12 nt, Human
ugcuuccagaaa

SEQ ID NO: 3210330 - RNA, 20 nt, Human
ugcuucaaggauccugagcc

SEQ ID NO: 3210331 - RNA, 21 nt, Human
ugcuucaaggauccugagcca

SEQ ID NO: 3210332 - RNA, 23 nt, Human
ugcuucaaggauccugagccaga

SEQ ID NO: 3210333 - RNA, 17 nt, Human
aggacacugcagaacag

SEQ ID NO: 3210334 - RNA, 17 nt, Human
aggacagccccuccucc

SEQ ID NO: 3210335 - RNA, 16 nt, Human
aggacagaaggcuccu

SEQ ID NO: 3210336 - RNA, 22 nt, Human
aggacagaaggcuccugccccc

SEQ ID NO: 3210337 - RNA, 21 nt, Human
aggacagaaggcuccugcccc

SEQ ID NO: 3210338 - RNA, 19 nt, Human
aggacagaaggcuccugcc

SEQ ID NO: 3210339 - RNA, 17 nt, Human
aggacagaaggcuccug

SEQ ID NO: 3210340 - RNA, 18 nt, Human
aggacacuaaccacgcug

SEQ ID NO: 3210341 - RNA, 17 nt, Human
ugcugucccuuuuccuu

SEQ ID NO: 3210342 - RNA, 13 nt, Human
ugcugugcaaaug

SEQ ID NO: 3210343 - RNA, 15 nt, Human
ugcugugccccuggc

SEQ ID NO: 3210344 - RNA, 12 nt, Human
ugcugugccccu

SEQ ID NO: 3210345 - RNA, 16 nt, Human
ugcugugccccuggcc

SEQ ID NO: 3210346 - RNA, 19 nt, Human
ugcugucccuuacgugagu

SEQ ID NO: 3210347 - RNA, 15 nt, Human
ugcugucccuuuucc

SEQ ID NO: 3210348 - RNA, 17 nt, Human
ugcugucccuuacguga

SEQ ID NO: 3210349 - RNA, 15 nt, Human
ugcuguauucccaua

SEQ ID NO: 3210350 - RNA, 20 nt, Human
ugcuuaccuugguuggaagg

SEQ ID NO: 3210351 - RNA, 13 nt, Human
ugcuuagcaaaaa

SEQ ID NO: 3210352 - RNA, 19 nt, Human
ugcuaucucccccagcccc

SEQ ID NO: 3210353 - RNA, 13 nt, Human
agcuuuauuucua

SEQ ID NO: 3210354 - RNA, 14 nt, Human
agcuuuauuucuag

SEQ ID NO: 3210355 - RNA, 21 nt, Human
agcuuuaaugauaugcuugua

SEQ ID NO: 3210356 - RNA, 12 nt, Human
agcuuuaaauua

SEQ ID NO: 3210357 - RNA, 17 nt, Human
agcuuuaaauuauguga

SEQ ID NO: 3210358 - RNA, 19 nt, Human
ugcuaugucauuucauguc

SEQ ID NO: 3210359 - RNA, 18 nt, Human
ugcuaugucauuucaugu

SEQ ID NO: 3210360 - RNA, 17 nt, Human
ugcuaugucauuucaug

SEQ ID NO: 3210361 - RNA, 12 nt, Human
ugcuauuaauau

SEQ ID NO: 3210362 - RNA, 13 nt, Human
ugcuauuaauauu

SEQ ID NO: 3210363 - RNA, 16 nt, Human
ugcuauuaauauuugu

SEQ ID NO: 3210364 - RNA, 21 nt, Human
ugcuauuaauauuuguuuagu

SEQ ID NO: 3210365 - RNA, 18 nt, Human
ugcuauuacgaaguucaa

SEQ ID NO: 3210366 - RNA, 19 nt, Human
ugcuauuacgaaguucaag

SEQ ID NO: 3210367 - RNA, 20 nt, Human
ugcuaucucccccagcccca

SEQ ID NO: 3210368 - RNA, 18 nt, Human
ugcuaucucccccagccc

SEQ ID NO: 3210369 - RNA, 15 nt, Human
ugcuaucucuauuau

SEQ ID NO: 3210370 - RNA, 15 nt, Human
ugcuaugucauuuca

SEQ ID NO: 3210371 - RNA, 16 nt, Human
ugcuaugucauuucau

SEQ ID NO: 3210372 - RNA, 22 nt, Human
ugcucauuuuuuuuuuaucaga

SEQ ID NO: 3210373 - RNA, 15 nt, Human
ugcucccccuuuucc

SEQ ID NO: 3210374 - RNA, 13 nt, Human
ugcucccccuuuu

SEQ ID NO: 3210375 - RNA, 16 nt, Human
ugcuccccuuccccuu

SEQ ID NO: 3210376 - RNA, 18 nt, Human
ugcuccccugugccagcc

SEQ ID NO: 3210377 - RNA, 14 nt, Human
ugcucuggacaggc

SEQ ID NO: 3210378 - RNA, 16 nt, Human
ugcucuggacaggcau

SEQ ID NO: 3210379 - RNA, 15 nt, Human
ugcucuggacaggca

SEQ ID NO: 3210380 - RNA, 19 nt, Human
ugcugacuguacuccuccc

SEQ ID NO: 3210381 - RNA, 16 nt, Human
ugcugacuguacuccu

SEQ ID NO: 3210382 - RNA, 14 nt, Human
ugcugacuguacuc

SEQ ID NO: 3210383 - RNA, 15 nt, Human
aggaaaggcuccagg

SEQ ID NO: 3210384 - RNA, 13 nt, Human
aggaaaggcucca

SEQ ID NO: 3210385 - RNA, 14 nt, Human
aggaaaggcuccag

SEQ ID NO: 3210386 - RNA, 22 nt, Human
ugcugacuguacuccucccagg

SEQ ID NO: 3210387 - RNA, 21 nt, Human
ugcugacuguacuccucccag

SEQ ID NO: 3210388 - RNA, 23 nt, Human
aggaaaucaaauaugcaaagcac

SEQ ID NO: 3210389 - RNA, 15 nt, Human
aggaaaucaccgaaa

SEQ ID NO: 3210390 - RNA, 19 nt, Human
aggaaaucaccgaaaacgu

SEQ ID NO: 3210391 - RNA, 16 nt, Human
aggaagcacaugccuc

SEQ ID NO: 3210392 - RNA, 17 nt, Human
aggaagcacaugccucu

SEQ ID NO: 3210393 - RNA, 11 nt, Human
aggaagcacau

SEQ ID NO: 3210394 - RNA, 14 nt, Human
aggaaauccagggu

SEQ ID NO: 3210395 - RNA, 20 nt, Human
aggaaggaaacccagcucug

SEQ ID NO: 3210396 - RNA, 22 nt, Human
aggaaggaaacccagcucuggu

SEQ ID NO: 3210397 - RNA, 23 nt, Human
aggaaggaaacccagcucugguc

SEQ ID NO: 3210398 - RNA, 18 nt, Human
aggaagccagcaggcucu

SEQ ID NO: 3210399 - RNA, 18 nt, Human
aggaagccgcuggggcca

SEQ ID NO: 3210400 - RNA, 19 nt, Human
aggaagccgcuggggccag

SEQ ID NO: 3210401 - RNA, 20 nt, Human
aggaagccgcuggggccagu

SEQ ID NO: 3210402 - RNA, 22 nt, Human
aggaagccagcaggcucucagg

SEQ ID NO: 3210403 - RNA, 23 nt, Human
aggaagccagcaggcucucaggc

SEQ ID NO: 3210404 - RNA, 21 nt, Human
aggaagccagcaggcucucag

SEQ ID NO: 3210405 - RNA, 18 nt, Human
agcugugugcucuccaag

SEQ ID NO: 3210406 - RNA, 21 nt, Human
agcugugcucuggacaggcau

SEQ ID NO: 3210407 - RNA, 20 nt, Human
agcugugcucuggacaggca

SEQ ID NO: 3210408 - RNA, 19 nt, Human
agcugugcucuggacaggc

SEQ ID NO: 3210409 - RNA, 20 nt, Human
agcuggcuuacacuggcaau

SEQ ID NO: 3210410 - RNA, 14 nt, Human
agcugggaaagcau

SEQ ID NO: 3210411 - RNA, 15 nt, Human
agcugggaaagcaua

SEQ ID NO: 3210412 - RNA, 15 nt, Human
agcugggaccaguac

SEQ ID NO: 3210413 - RNA, 18 nt, Human
agcugggaccacaggugc

SEQ ID NO: 3210414 - RNA, 16 nt, Human
agcugucaaggcucag

SEQ ID NO: 3210415 - RNA, 18 nt, Human
agcuggcuccagccugga

SEQ ID NO: 3210416 - RNA, 20 nt, Human
agcugugugcucuccaagcc

SEQ ID NO: 3210417 - RNA, 11 nt, Human
agcuguguuua

SEQ ID NO: 3210418 - RNA, 14 nt, Human
agcuguguuauuau

SEQ ID NO: 3210419 - RNA, 14 nt, Human
agcuguucacagcc

SEQ ID NO: 3210420 - RNA, 19 nt, Human
agcuguucacagccagacu

SEQ ID NO: 3210421 - RNA, 16 nt, Human
agcuguucacagccag

SEQ ID NO: 3210422 - RNA, 20 nt, Human
ugccuguucagcuccagcuc

SEQ ID NO: 3210423 - RNA, 18 nt, Human
ugccuguucagcuccagc

SEQ ID NO: 3210424 - RNA, 13 nt, Human
agcuguucagcug

SEQ ID NO: 3210425 - RNA, 17 nt, Human
ugccuguucagcuccag

SEQ ID NO: 3210426 - RNA, 15 nt, Human
ugccuuauggaacac

SEQ ID NO: 3210427 - RNA, 16 nt, Human
ugccuuauggaacacu

SEQ ID NO: 3210428 - RNA, 20 nt, Human
ugccuguugggccaggagcc

SEQ ID NO: 3210429 - RNA, 19 nt, Human
ugccuguugggccaggagc

SEQ ID NO: 3210430 - RNA, 10 nt, Human
ugccugcccu

SEQ ID NO: 3210431 - RNA, 13 nt, Human
ugccugcccuuug

SEQ ID NO: 3210432 - RNA, 23 nt, Human
ugccugcccugucaggaggcaga

SEQ ID NO: 3210433 - RNA, 20 nt, Human
ugccugcccugucaggaggc

SEQ ID NO: 3210434 - RNA, 21 nt, Human
ugccugcccuuuguccuccug

SEQ ID NO: 3210435 - RNA, 15 nt, Human
ugccugcccuuuguc

SEQ ID NO: 3210436 - RNA, 16 nt, Human
ugccugcccaggcccc

SEQ ID NO: 3210437 - RNA, 24 nt, Human
ugccugcccaggccccugccaccc

SEQ ID NO: 3210438 - RNA, 12 nt, Human
ugccucugccuc

SEQ ID NO: 3210439 - RNA, 15 nt, Human
ugccugcccaggccc

SEQ ID NO: 3210440 - RNA, 14 nt, Human
ugccugcccaggcc

SEQ ID NO: 3210441 - RNA, 15 nt, Human
ugccucugccucuga

SEQ ID NO: 3210442 - RNA, 13 nt, Human
ugccugcccaggc

SEQ ID NO: 3210443 - RNA, 14 nt, Human
ugccucugccucug

SEQ ID NO: 3210444 - RNA, 13 nt, Human
ugccucugccucu

SEQ ID NO: 3210445 - RNA, 14 nt, Human
ugcccaggcagguc

SEQ ID NO: 3210446 - RNA, 13 nt, Human
ugcccaggcaggu

SEQ ID NO: 3210447 - RNA, 12 nt, Human
ugcccaggcagg

SEQ ID NO: 3210448 - RNA, 14 nt, Human
ugccuggaggccag

SEQ ID NO: 3210449 - RNA, 15 nt, Human
ugccuggauggggcu

SEQ ID NO: 3210450 - RNA, 14 nt, Human
ugccuggauggggc

SEQ ID NO: 3210451 - RNA, 20 nt, Human
agcugccuguucagcuccag

SEQ ID NO: 3210452 - RNA, 20 nt, Human
agcugcuugggcuucauccu

SEQ ID NO: 3210453 - RNA, 21 nt, Human
agcugccuguucagcuccagc

SEQ ID NO: 3210454 - RNA, 21 nt, Human
agcugcuugggcuucauccuc

SEQ ID NO: 3210455 - RNA, 19 nt, Human
agcugccuguucagcucca

SEQ ID NO: 3210456 - RNA, 21 nt, Human
agcugcuuuugucuaugggac

SEQ ID NO: 3210457 - RNA, 14 nt, Human
agcugcuuucuucu

SEQ ID NO: 3210458 - RNA, 13 nt, Human
agcugcuuuguua

SEQ ID NO: 3210459 - RNA, 14 nt, Human
agcugcuuuguuac

SEQ ID NO: 3210460 - RNA, 16 nt, Human
agcugcuuuguuaccu

SEQ ID NO: 3210461 - RNA, 17 nt, Human
agcugcuuuguuaccuu

SEQ ID NO: 3210462 - RNA, 20 nt, Human
agcugcuuuguuaccuuaaa

SEQ ID NO: 3210463 - RNA, 21 nt, Human
agcugcuuuguuaccuuaaaa

SEQ ID NO: 3210464 - RNA, 22 nt, Human
agcugcuuuguuaccuuaaaac

SEQ ID NO: 3210465 - RNA, 22 nt, Human
agcuggaucuccauucucucag

SEQ ID NO: 3210466 - RNA, 23 nt, Human
agcuuggggacaggggcaggagg

SEQ ID NO: 3210467 - RNA, 23 nt, Human
agcuugggcagaucucccacaug

SEQ ID NO: 3210468 - RNA, 21 nt, Human
agcuugggcagaucucccaca

SEQ ID NO: 3210469 - RNA, 19 nt, Human
agcuuguuuuggacuuugu

SEQ ID NO: 3210470 - RNA, 20 nt, Human
agcuuguuuuggacuuuguu

SEQ ID NO: 3210471 - RNA, 21 nt, Human
agcuuguuuuggacuuuguua

SEQ ID NO: 3210472 - RNA, 23 nt, Human
agcuuguuuuggacuuuguuaca

SEQ ID NO: 3210473 - RNA, 14 nt, Human
agcuugaggguugg

SEQ ID NO: 3210474 - RNA, 18 nt, Human
agcuugaggguugggcug

SEQ ID NO: 3210475 - RNA, 17 nt, Human
agcuugggcagaucucc

SEQ ID NO: 3210476 - RNA, 11 nt, Human
agcuugggcag

SEQ ID NO: 3210477 - RNA, 15 nt, Human
agcuuagaaacugga

SEQ ID NO: 3210478 - RNA, 13 nt, Human
agcuuacguaguu

SEQ ID NO: 3210479 - RNA, 15 nt, Human
agcuuacguaguucu

SEQ ID NO: 3210480 - RNA, 17 nt, Human
agcuugaaacugagaug

SEQ ID NO: 3210481 - RNA, 18 nt, Human
agcuuagaauuauuugca

SEQ ID NO: 3210482 - RNA, 20 nt, Human
ugcuacaaaaacacagcaag

SEQ ID NO: 3210483 - RNA, 14 nt, Human
agcuguucagcugg

SEQ ID NO: 3210484 - RNA, 17 nt, Human
agcuguucuaauggauu

SEQ ID NO: 3210485 - RNA, 22 nt, Human
agcuguuggccucugcaaagga

SEQ ID NO: 3210486 - RNA, 23 nt, Human
agcuguugaugggaugauugaag

SEQ ID NO: 3210487 - RNA, 17 nt, Human
agcuguugaugggauga

SEQ ID NO: 3210488 - RNA, 23 nt, Human
agcuguugacucuaguacuguga

SEQ ID NO: 3210489 - RNA, 21 nt, Human
agcuguugacucuaguacugu

SEQ ID NO: 3210490 - RNA, 20 nt, Human
agcuguugacucuaguacug

SEQ ID NO: 3210491 - RNA, 13 nt, Human
agcuguugacucu

SEQ ID NO: 3210492 - RNA, 18 nt, Human
agcuguugaccaggcacc

SEQ ID NO: 3210493 - RNA, 16 nt, Human
agcuguugaccaggca

SEQ ID NO: 3210494 - RNA, 15 nt, Human
agcuguugaccaggc

SEQ ID NO: 3210495 - RNA, 14 nt, Human
agcuguugaccagg

SEQ ID NO: 3210496 - RNA, 14 nt, Human
agcuguucuuccug

SEQ ID NO: 3210497 - RNA, 13 nt, Human
agcuguucuuccu

SEQ ID NO: 3210498 - RNA, 15 nt, Human
agcuguucuuccugg

SEQ ID NO: 3210499 - RNA, 13 nt, Human
agcuguugaccag

SEQ ID NO: 3210500 - RNA, 19 nt, Human
ugcuacaaaaacacagcaa

SEQ ID NO: 3210501 - RNA, 18 nt, Human
ugcuacaaaaacacagca

SEQ ID NO: 3210502 - RNA, 17 nt, Human
ugcuacaaaaacacagc

SEQ ID NO: 3210503 - RNA, 16 nt, Human
ugcuacaaaaacacag

SEQ ID NO: 3210504 - RNA, 15 nt, Human
ugcuacaaaaacaca

SEQ ID NO: 3210505 - RNA, 21 nt, Human
ugcuaaguaaaucucuucugu

SEQ ID NO: 3210506 - RNA, 20 nt, Human
ugcuaaguaaaucucuucug

SEQ ID NO: 3210507 - RNA, 18 nt, Human
ugcuaaguaaaucucuuc

SEQ ID NO: 3210508 - RNA, 15 nt, Human
ugcggcaaaaggaaa

SEQ ID NO: 3210509 - RNA, 23 nt, Human
ugcggagucauuuuguguugaag

SEQ ID NO: 3210510 - RNA, 19 nt, Human
ugcggagucauuuuguguu

SEQ ID NO: 3210511 - RNA, 22 nt, Human
ugcggacagccacggccaggcc

SEQ ID NO: 3210512 - RNA, 21 nt, Human
ugcggacagccacggccaggc

SEQ ID NO: 3210513 - RNA, 23 nt, Human
ugcggacagccacggccaggcca

SEQ ID NO: 3210514 - RNA, 18 nt, Human
ugccuuugaagagugaaa

SEQ ID NO: 3210515 - RNA, 11 nt, Human
ugccuuucugu

SEQ ID NO: 3210516 - RNA, 16 nt, Human
ugccuuugaagaguga

SEQ ID NO: 3210517 - RNA, 13 nt, Human
ugccuuugaagag

SEQ ID NO: 3210518 - RNA, 12 nt, Human
ugccuuugaaga

SEQ ID NO: 3210519 - RNA, 16 nt, Human
ugccuuucuguguuua

SEQ ID NO: 3210520 - RNA, 17 nt, Human
ugccuuugcucuggucu

SEQ ID NO: 3210521 - RNA, 18 nt, Human
ugccuuugcagcucagaa

SEQ ID NO: 3210522 - RNA, 12 nt, Human
ugccuuuguaac

SEQ ID NO: 3210523 - RNA, 19 nt, Human
ugccuuuggcacucugacu

SEQ ID NO: 3210524 - RNA, 17 nt, Human
ugcggugcuaucucccc

SEQ ID NO: 3210525 - RNA, 18 nt, Human
ugcgguccacccaggagc

SEQ ID NO: 3210526 - RNA, 17 nt, Human
ugcgguccacccaggag

SEQ ID NO: 3210527 - RNA, 17 nt, Human
ugcgggucacaggaggg

SEQ ID NO: 3210528 - RNA, 18 nt, Human
ugcggggcgggcacaccu

SEQ ID NO: 3210529 - RNA, 14 nt, Human
ugcggggcgggcac

SEQ ID NO: 3210530 - RNA, 14 nt, Human
ugcgggucacagga

SEQ ID NO: 3210531 - RNA, 16 nt, Human
ugcgggucacaggagg

SEQ ID NO: 3210532 - RNA, 20 nt, Human
ugcgggcuuccuccuggugu

SEQ ID NO: 3210533 - RNA, 17 nt, Human
ugcggccuuuggcuuca

SEQ ID NO: 3210534 - RNA, 19 nt, Human
ugcggccuuuggcuucacg

SEQ ID NO: 3210535 - RNA, 15 nt, Human
ugcggccuuuucaug

SEQ ID NO: 3210536 - RNA, 18 nt, Human
aggggcuagcuaagccaa

SEQ ID NO: 3210537 - RNA, 16 nt, Human
aggggcuccaugccag

SEQ ID NO: 3210538 - RNA, 18 nt, Human
aggggcuccaugccagcc

SEQ ID NO: 3210539 - RNA, 15 nt, Human
agggggaaggcaggg

SEQ ID NO: 3210540 - RNA, 23 nt, Human
aggggagcaaaaucgaugcagug

SEQ ID NO: 3210541 - RNA, 15 nt, Human
aggggccuggcagcc

SEQ ID NO: 3210542 - RNA, 15 nt, Human
aggggagacuuugau

SEQ ID NO: 3210543 - RNA, 23 nt, Human
aggggccuggcagccgugccuuc

SEQ ID NO: 3210544 - RNA, 18 nt, Human
aggggccuggcagccgug

SEQ ID NO: 3210545 - RNA, 19 nt, Human
uggggucacucuggcagcu

SEQ ID NO: 3210546 - RNA, 15 nt, Human
aggggacugccaccu

SEQ ID NO: 3210547 - RNA, 13 nt, Human
aggggacugccac

SEQ ID NO: 3210548 - RNA, 13 nt, Human
aggggagacuuug

SEQ ID NO: 3210549 - RNA, 16 nt, Human
aggggagacagagcaa

SEQ ID NO: 3210550 - RNA, 15 nt, Human
aggggagacagagca

SEQ ID NO: 3210551 - RNA, 14 nt, Human
aggggagacagagc

SEQ ID NO: 3210552 - RNA, 17 nt, Human
aggggacugccaccucc

SEQ ID NO: 3210553 - RNA, 16 nt, Human
aggggacugccaccuc

SEQ ID NO: 3210554 - RNA, 18 nt, Human
aggggugggacacccugu

SEQ ID NO: 3210555 - RNA, 20 nt, Human
aggggugggacacccuguga

SEQ ID NO: 3210556 - RNA, 22 nt, Human
aggggugggacacccugugaug

SEQ ID NO: 3210557 - RNA, 17 nt, Human
aggggguggccucccaa

SEQ ID NO: 3210558 - RNA, 15 nt, Human
aggggguggccuccc

SEQ ID NO: 3210559 - RNA, 23 nt, Human
agggucucacuauguugcccagg

SEQ ID NO: 3210560 - RNA, 22 nt, Human
agggucucacuauguugcccag

SEQ ID NO: 3210561 - RNA, 21 nt, Human
agggucucacuauguugccca

SEQ ID NO: 3210562 - RNA, 20 nt, Human
agggucucacuauguugccc

SEQ ID NO: 3210563 - RNA, 24 nt, Human
agggguucccuuuuuuggcugcug

SEQ ID NO: 3210564 - RNA, 19 nt, Human
agggguuccuucugggcau

SEQ ID NO: 3210565 - RNA, 12 nt, Human
ugggucugugug

SEQ ID NO: 3210566 - RNA, 21 nt, Human
ugggucuggaggaccugcccg

SEQ ID NO: 3210567 - RNA, 13 nt, Human
ugggucuggagga

SEQ ID NO: 3210568 - RNA, 15 nt, Human
ugggugcuuggagga

SEQ ID NO: 3210569 - RNA, 19 nt, Human
ugggugcuuggaggaagga

SEQ ID NO: 3210570 - RNA, 22 nt, Human
ugggugcuuggaggaaggaaac

SEQ ID NO: 3210571 - RNA, 22 nt, Human
uggguggcaccagcagccugga

SEQ ID NO: 3210572 - RNA, 21 nt, Human
agggucucacucugucgccca

SEQ ID NO: 3210573 - RNA, 22 nt, Human
agggucucacucugucgcccag

SEQ ID NO: 3210574 - RNA, 22 nt, Human
agggucucuagugcugugaaaa

SEQ ID NO: 3210575 - RNA, 21 nt, Human
agggucucuagugcugugaaa

SEQ ID NO: 3210576 - RNA, 20 nt, Human
agggucucuagugcugugaa

SEQ ID NO: 3210577 - RNA, 18 nt, Human
agggucucuagugcugug

SEQ ID NO: 3210578 - RNA, 16 nt, Human
agggucucuagugcug

SEQ ID NO: 3210579 - RNA, 16 nt, Human
agggucucaggguguc

SEQ ID NO: 3210580 - RNA, 17 nt, Human
agggucucagggugucc

SEQ ID NO: 3210581 - RNA, 13 nt, Human
ugguaggaacugc

SEQ ID NO: 3210582 - RNA, 21 nt, Human
ugguagcuuuucccuucuuuu

SEQ ID NO: 3210583 - RNA, 20 nt, Human
ugguaggaacugcugggcuu

SEQ ID NO: 3210584 - RNA, 17 nt, Human
ugguagcuuuucccuuc

SEQ ID NO: 3210585 - RNA, 23 nt, Human
uggucacaggacucugccuccuc

SEQ ID NO: 3210586 - RNA, 22 nt, Human
uggucacaggacucugccuccu

SEQ ID NO: 3210587 - RNA, 20 nt, Human
uggucacaggacucugccuc

SEQ ID NO: 3210588 - RNA, 16 nt, Human
ugguacuaacuuuccu

SEQ ID NO: 3210589 - RNA, 20 nt, Human
ugguagcuuuucccuucuuu

SEQ ID NO: 3210590 - RNA, 16 nt, Human
uggguggggggcuuca

SEQ ID NO: 3210591 - RNA, 12 nt, Human
ugguaagauugu

SEQ ID NO: 3210592 - RNA, 14 nt, Human
ugguaagauuguua

SEQ ID NO: 3210593 - RNA, 18 nt, Human
ugguaagauuguuauuaa

SEQ ID NO: 3210594 - RNA, 19 nt, Human
ugguaagauuguuauuaaa

SEQ ID NO: 3210595 - RNA, 20 nt, Human
ugguaagauuguuauuaaau

SEQ ID NO: 3210596 - RNA, 21 nt, Human
ugggugcugcuaauucuuugc

SEQ ID NO: 3210597 - RNA, 20 nt, Human
uggguggcuuaaaaaaaacu

SEQ ID NO: 3210598 - RNA, 16 nt, Human
ugguaaucauauuaga

SEQ ID NO: 3210599 - RNA, 14 nt, Human
ugguaccuugcaca

SEQ ID NO: 3210600 - RNA, 16 nt, Human
ugguaccuugcacaca

SEQ ID NO: 3210601 - RNA, 15 nt, Human
ugguaccuugcacac

SEQ ID NO: 3210602 - RNA, 16 nt, Human
ugguaauaagggaaaa

SEQ ID NO: 3210603 - RNA, 14 nt, Human
ugguaaucauauua

SEQ ID NO: 3210604 - RNA, 21 nt, Human
ugguaauaagggaaaaaucaa

SEQ ID NO: 3210605 - RNA, 14 nt, Human
uggucuccacuggg

SEQ ID NO: 3210606 - RNA, 19 nt, Human
uggucuauaccuuaagaau

SEQ ID NO: 3210607 - RNA, 23 nt, Human
uggucucaaacucuugaccucag

SEQ ID NO: 3210608 - RNA, 17 nt, Human
uggucucaaacucuuga

SEQ ID NO: 3210609 - RNA, 16 nt, Human
uggucccaccccacac

SEQ ID NO: 3210610 - RNA, 19 nt, Human
uggucuacacugugcugag

SEQ ID NO: 3210611 - RNA, 16 nt, Human
uggucucaaacucuug

SEQ ID NO: 3210612 - RNA, 13 nt, Human
uggucccacccca

SEQ ID NO: 3210613 - RNA, 19 nt, Human
uggucuaucuuugagcgcc

SEQ ID NO: 3210614 - RNA, 10 nt, Human
uggucagccc

SEQ ID NO: 3210615 - RNA, 12 nt, Human
uggucagcccaa

SEQ ID NO: 3210616 - RNA, 11 nt, Human
uggucagccca

SEQ ID NO: 3210617 - RNA, 22 nt, Human
uggucagauuugaacucuucaa

SEQ ID NO: 3210618 - RNA, 18 nt, Human
uggucaccaaaucagcug

SEQ ID NO: 3210619 - RNA, 14 nt, Human
uggucccaccccac

SEQ ID NO: 3210620 - RNA, 15 nt, Human
uggucccaccccaca

SEQ ID NO: 3210621 - RNA, 13 nt, Human
aggguuauaauaa

SEQ ID NO: 3210622 - RNA, 22 nt, Human
aggguguccggucccuguccca

SEQ ID NO: 3210623 - RNA, 21 nt, Human
aggguggugaccucugccuga

SEQ ID NO: 3210624 - RNA, 15 nt, Human
agggugucugccccc

SEQ ID NO: 3210625 - RNA, 21 nt, Human
agggugucugcccccuccuga

SEQ ID NO: 3210626 - RNA, 17 nt, Human
uggucugacccacugcu

SEQ ID NO: 3210627 - RNA, 16 nt, Human
uggucugacccacugc

SEQ ID NO: 3210628 - RNA, 23 nt, Human
uggucucccauaugcagaaauag

SEQ ID NO: 3210629 - RNA, 11 nt, Human
uggucuuugag

SEQ ID NO: 3210630 - RNA, 10 nt, Human
uggucuuuga

SEQ ID NO: 3210631 - RNA, 12 nt, Human
aggucagagccu

SEQ ID NO: 3210632 - RNA, 21 nt, Human
aggucauuaaggccacaucca

SEQ ID NO: 3210633 - RNA, 21 nt, Human
aggucauuuccauguaugcau

SEQ ID NO: 3210634 - RNA, 18 nt, Human
aggucauuuccauguaug

SEQ ID NO: 3210635 - RNA, 13 nt, Human
agguauuaagauu

SEQ ID NO: 3210636 - RNA, 18 nt, Human
aggucaccuuuauucugg

SEQ ID NO: 3210637 - RNA, 23 nt, Human
aggucaccucacucagcaccacu

SEQ ID NO: 3210638 - RNA, 21 nt, Human
aggucaccucacucagcacca

SEQ ID NO: 3210639 - RNA, 20 nt, Human
aggucaccucacucagcacc

SEQ ID NO: 3210640 - RNA, 19 nt, Human
aggucaccucacucagcac

SEQ ID NO: 3210641 - RNA, 14 nt, Human
aggucaccucacuc

SEQ ID NO: 3210642 - RNA, 18 nt, Human
aggucaccucacucagca

SEQ ID NO: 3210643 - RNA, 17 nt, Human
aggucaccucacucagc

SEQ ID NO: 3210644 - RNA, 19 nt, Human
aggucaccuuuauucuggc

SEQ ID NO: 3210645 - RNA, 19 nt, Human
agguauaaguggugugugu

SEQ ID NO: 3210646 - RNA, 20 nt, Human
agguauaaguggugugugua

SEQ ID NO: 3210647 - RNA, 17 nt, Human
agguaugcaaucaaauc

SEQ ID NO: 3210648 - RNA, 19 nt, Human
agguauaauugugugauau

SEQ ID NO: 3210649 - RNA, 15 nt, Human
agguauaauugugug

SEQ ID NO: 3210650 - RNA, 12 nt, Human
agguauaauugu

SEQ ID NO: 3210651 - RNA, 23 nt, Human
agguaguucaagaaaugaagagc

SEQ ID NO: 3210652 - RNA, 21 nt, Human
agguaugcaaucaaaucugcu

SEQ ID NO: 3210653 - RNA, 23 nt, Human
agguagaaauaucugaaaaugua

SEQ ID NO: 3210654 - RNA, 15 nt, Human
agguagaacgccagg

SEQ ID NO: 3210655 - RNA, 23 nt, Human
agguacuuugucuaagaaacauu

SEQ ID NO: 3210656 - RNA, 18 nt, Human
agguagaaugaccuugua

SEQ ID NO: 3210657 - RNA, 17 nt, Human
agguagaaugaccuugu

SEQ ID NO: 3210658 - RNA, 18 nt, Human
agguagaacgccagggac

SEQ ID NO: 3210659 - RNA, 17 nt, Human
agguagaacgccaggga

SEQ ID NO: 3210660 - RNA, 21 nt, Human
agguagaaugaccuuguaaug

SEQ ID NO: 3210661 - RNA, 22 nt, Human
agguaguucaagaaaugaagag

SEQ ID NO: 3210662 - RNA, 19 nt, Human
agguaguucaagaaaugaa

SEQ ID NO: 3210663 - RNA, 17 nt, Human
agguaguucaagaaaug

SEQ ID NO: 3210664 - RNA, 16 nt, Human
agguacuuugucuaag

SEQ ID NO: 3210665 - RNA, 23 nt, Human
agguacuuucauauuuuaaacag

SEQ ID NO: 3210666 - RNA, 19 nt, Human
agguagaaauaucugaaaa

SEQ ID NO: 3210667 - RNA, 17 nt, Human
agguagaaauaucugaa

SEQ ID NO: 3210668 - RNA, 17 nt, Human
aggguuggccccugccc

SEQ ID NO: 3210669 - RNA, 19 nt, Human
aggguugggaaaauccaaa

SEQ ID NO: 3210670 - RNA, 23 nt, Human
aggguuggccccugcccggcugc

SEQ ID NO: 3210671 - RNA, 18 nt, Human
aggguuggccccugcccg

SEQ ID NO: 3210672 - RNA, 14 nt, Human
uggggcugauugua

SEQ ID NO: 3210673 - RNA, 18 nt, Human
uggggcugggcccaccca

SEQ ID NO: 3210674 - RNA, 22 nt, Human
uggggcugggggaugggccuga

SEQ ID NO: 3210675 - RNA, 21 nt, Human
uggggcugggggaugggccug

SEQ ID NO: 3210676 - RNA, 18 nt, Human
uggggcugggggaugggc

SEQ ID NO: 3210677 - RNA, 16 nt, Human
uggggcugggggaugg

SEQ ID NO: 3210678 - RNA, 13 nt, Human
uggggcuggggga

SEQ ID NO: 3210679 - RNA, 20 nt, Human
uggggcugcaccggcuggcc

SEQ ID NO: 3210680 - RNA, 14 nt, Human
ugggguacccacug

SEQ ID NO: 3210681 - RNA, 21 nt, Human
ugggguagguugggagaaugu

SEQ ID NO: 3210682 - RNA, 15 nt, Human
ugggguagguuggga

SEQ ID NO: 3210683 - RNA, 17 nt, Human
uggggucacucuggcag

SEQ ID NO: 3210684 - RNA, 18 nt, Human
uggggucacucuggcagc

SEQ ID NO: 3210685 - RNA, 20 nt, Human
ugggguacccacugcucugg

SEQ ID NO: 3210686 - RNA, 22 nt, Human
uggggguucuuucuuccucugc

SEQ ID NO: 3210687 - RNA, 16 nt, Human
ugggguacccacugcu

SEQ ID NO: 3210688 - RNA, 15 nt, Human
ugggguacccacugc

SEQ ID NO: 3210689 - RNA, 14 nt, Human
uggggcccugccuc

SEQ ID NO: 3210690 - RNA, 12 nt, Human
uggggagaaagu

SEQ ID NO: 3210691 - RNA, 15 nt, Human
uggggaggggcugug

SEQ ID NO: 3210692 - RNA, 23 nt, Human
uggggaccucaggccugggggcu

SEQ ID NO: 3210693 - RNA, 18 nt, Human
uggggcggugagagggga

SEQ ID NO: 3210694 - RNA, 15 nt, Human
uggggcgcgugaggc

SEQ ID NO: 3210695 - RNA, 16 nt, Human
uggggcgcgugaggcc

SEQ ID NO: 3210696 - RNA, 17 nt, Human
uggggcgcgugaggccc

SEQ ID NO: 3210697 - RNA, 20 nt, Human
uggggcuaaagacugaucuc

SEQ ID NO: 3210698 - RNA, 23 nt, Human
uggggcuaggaaauccagggugg

SEQ ID NO: 3210699 - RNA, 15 nt, Human
uggggcccugccucc

SEQ ID NO: 3210700 - RNA, 16 nt, Human
uggggcccugccuccu

SEQ ID NO: 3210701 - RNA, 17 nt, Human
uggggccuaauaaaacu

SEQ ID NO: 3210702 - RNA, 20 nt, Human
uggggccuaauaaaacugau

SEQ ID NO: 3210703 - RNA, 21 nt, Human
uggggccuaauaaaacugaug

SEQ ID NO: 3210704 - RNA, 22 nt, Human
uggggccuaauaaaacugaugu

SEQ ID NO: 3210705 - RNA, 23 nt, Human
uggggccuaauaaaacugaugug

SEQ ID NO: 3210706 - RNA, 22 nt, Human
uggggacaggggcaggaggaag

SEQ ID NO: 3210707 - RNA, 20 nt, Human
uggggacaggggcaggagga

SEQ ID NO: 3210708 - RNA, 17 nt, Human
uggggacagagcagaac

SEQ ID NO: 3210709 - RNA, 14 nt, Human
uggggaccagagcu

SEQ ID NO: 3210710 - RNA, 15 nt, Human
uggggaccagagcug

SEQ ID NO: 3210711 - RNA, 17 nt, Human
uggggaccagagcugcc

SEQ ID NO: 3210712 - RNA, 18 nt, Human
uggggaccagagcugcca

SEQ ID NO: 3210713 - RNA, 13 nt, Human
uggggaccucagg

SEQ ID NO: 3210714 - RNA, 23 nt, Human
uggggaccagcagucugccugga

SEQ ID NO: 3210715 - RNA, 17 nt, Human
uggggacaugggucgcc

SEQ ID NO: 3210716 - RNA, 21 nt, Human
uggggaccagcagucugccug

SEQ ID NO: 3210717 - RNA, 14 nt, Human
ugggcugggcacug

SEQ ID NO: 3210718 - RNA, 18 nt, Human
ugggcuggguucuaccca

SEQ ID NO: 3210719 - RNA, 19 nt, Human
ugggcuggguucuacccag

SEQ ID NO: 3210720 - RNA, 12 nt, Human
ugggcugggcac

SEQ ID NO: 3210721 - RNA, 20 nt, Human
ugggcucccuucccaccucu

SEQ ID NO: 3210722 - RNA, 17 nt, Human
agggcuuuaaaauucuc

SEQ ID NO: 3210723 - RNA, 18 nt, Human
ugggcugaauguauguaa

SEQ ID NO: 3210724 - RNA, 21 nt, Human
ugggcugaauguauguaaaua

SEQ ID NO: 3210725 - RNA, 21 nt, Human
ugggcugcccuggugcugcca

SEQ ID NO: 3210726 - RNA, 16 nt, Human
ugggcugcccuggugc

SEQ ID NO: 3210727 - RNA, 20 nt, Human
ugggcugcccuggugcugcc

SEQ ID NO: 3210728 - RNA, 19 nt, Human
ugggcugcccuggugcugc

SEQ ID NO: 3210729 - RNA, 17 nt, Human
ugggcugcccuggugcu

SEQ ID NO: 3210730 - RNA, 18 nt, Human
ugggcucccuucccaccu

SEQ ID NO: 3210731 - RNA, 19 nt, Human
ugggcucccuucccaccuc

SEQ ID NO: 3210732 - RNA, 15 nt, Human
ugggcucccuuccca

SEQ ID NO: 3210733 - RNA, 19 nt, Human
agggcuuguaguucuuuaa

SEQ ID NO: 3210734 - RNA, 14 nt, Human
agggcuuuaaaauu

SEQ ID NO: 3210735 - RNA, 16 nt, Human
agggcuuuaaaauucu

SEQ ID NO: 3210736 - RNA, 15 nt, Human
agggcuuuaaaauuc

SEQ ID NO: 3210737 - RNA, 14 nt, Human
agggcuuguaguuc

SEQ ID NO: 3210738 - RNA, 15 nt, Human
agggcuuguaguucu

SEQ ID NO: 3210739 - RNA, 16 nt, Human
agggcuuguaguucuu

SEQ ID NO: 3210740 - RNA, 17 nt, Human
agggcuuguaguucuuu

SEQ ID NO: 3210741 - RNA, 23 nt, Human
agggcuucugccauuucugagau

SEQ ID NO: 3210742 - RNA, 17 nt, Human
agggcagggacaggaua

SEQ ID NO: 3210743 - RNA, 18 nt, Human
agggcagggacagggccg

SEQ ID NO: 3210744 - RNA, 18 nt, Human
agggcccagagagggugg

SEQ ID NO: 3210745 - RNA, 23 nt, Human
agggcccagagaggguggugacc

SEQ ID NO: 3210746 - RNA, 15 nt, Human
agggagggcuucugc

SEQ ID NO: 3210747 - RNA, 22 nt, Human
ugggcccacccaagcaggaggc

SEQ ID NO: 3210748 - RNA, 19 nt, Human
ugggcccacccaagcagga

SEQ ID NO: 3210749 - RNA, 14 nt, Human
ugggcccacauccg

SEQ ID NO: 3210750 - RNA, 19 nt, Human
agggagugacagaggcagc

SEQ ID NO: 3210751 - RNA, 16 nt, Human
agggcagauuuuaguu

SEQ ID NO: 3210752 - RNA, 15 nt, Human
agggcagaguuacuu

SEQ ID NO: 3210753 - RNA, 18 nt, Human
agggagugacagaggcag

SEQ ID NO: 3210754 - RNA, 17 nt, Human
agggagugacagaggca

SEQ ID NO: 3210755 - RNA, 17 nt, Human
agggaggugaccccagg

SEQ ID NO: 3210756 - RNA, 16 nt, Human
ugggcaacccccagcc

SEQ ID NO: 3210757 - RNA, 18 nt, Human
ugggaggucaaggcugca

SEQ ID NO: 3210758 - RNA, 19 nt, Human
ugggaggucaaggcugcag

SEQ ID NO: 3210759 - RNA, 20 nt, Human
ugggaggucaaggcugcagu

SEQ ID NO: 3210760 - RNA, 23 nt, Human
ugggaggucaaggcugcagugag

SEQ ID NO: 3210761 - RNA, 17 nt, Human
ugggaggucaaggcugc

SEQ ID NO: 3210762 - RNA, 13 nt, Human
ugggccaggagcc

SEQ ID NO: 3210763 - RNA, 18 nt, Human
ugggccagaauuucaaac

SEQ ID NO: 3210764 - RNA, 14 nt, Human
ugggccaggagccu

SEQ ID NO: 3210765 - RNA, 16 nt, Human
ugggccaggagccucc

SEQ ID NO: 3210766 - RNA, 20 nt, Human
ugggcccaaugcacuuuguu

SEQ ID NO: 3210767 - RNA, 20 nt, Human
ugggcaacccccagccugcu

SEQ ID NO: 3210768 - RNA, 17 nt, Human
ugggcaacccccagccu

SEQ ID NO: 3210769 - RNA, 13 nt, Human
ugggcacagguca

SEQ ID NO: 3210770 - RNA, 23 nt, Human
ugggcacacgcugcucugcccca

SEQ ID NO: 3210771 - RNA, 22 nt, Human
ugggcacacgcugcucugcccc

SEQ ID NO: 3210772 - RNA, 21 nt, Human
ugggcacacgcugcucugccc

SEQ ID NO: 3210773 - RNA, 20 nt, Human
ugggcacacgcugcucugcc

SEQ ID NO: 3210774 - RNA, 17 nt, Human
ugggcacacgcugcucu

SEQ ID NO: 3210775 - RNA, 15 nt, Human
ugggcacacgcugcu

SEQ ID NO: 3210776 - RNA, 12 nt, Human
ugggcacacgcu

SEQ ID NO: 3210777 - RNA, 17 nt, Human
ugggccagaauuucaaa

SEQ ID NO: 3210778 - RNA, 16 nt, Human
ugggcaccacaaaaua

SEQ ID NO: 3210779 - RNA, 18 nt, Human
ugggcaccacaaaauaua

SEQ ID NO: 3210780 - RNA, 19 nt, Human
ugucaguauguggaagugu

SEQ ID NO: 3210781 - RNA, 20 nt, Human
ugucaguauguggaagugug

SEQ ID NO: 3210782 - RNA, 18 nt, Human
ugucaguauguggaagug

SEQ ID NO: 3210783 - RNA, 22 nt, Human
ugucaguauguggaaguguggg

SEQ ID NO: 3210784 - RNA, 23 nt, Human
ugucauuugcuggagcucugccc

SEQ ID NO: 3210785 - RNA, 19 nt, Human
ugucagggcaguacaaugu

SEQ ID NO: 3210786 - RNA, 11 nt, Human
ugucaggaggc

SEQ ID NO: 3210787 - RNA, 19 nt, Human
ugucaggaaaacacccagg

SEQ ID NO: 3210788 - RNA, 19 nt, Human
ugucagcugaaccugggua

SEQ ID NO: 3210789 - RNA, 19 nt, Human
agucacugagacagcccgg

SEQ ID NO: 3210790 - RNA, 18 nt, Human
agucacugagacagcccg

SEQ ID NO: 3210791 - RNA, 18 nt, Human
agucacugcaaaaccagg

SEQ ID NO: 3210792 - RNA, 16 nt, Human
ugucagcugaaccugg

SEQ ID NO: 3210793 - RNA, 21 nt, Human
agucacugcacguuuucaucu

SEQ ID NO: 3210794 - RNA, 20 nt, Human
agucacugcacguuuucauc

SEQ ID NO: 3210795 - RNA, 13 nt, Human
agucacugcacag

SEQ ID NO: 3210796 - RNA, 15 nt, Human
aguauguggaagugu

SEQ ID NO: 3210797 - RNA, 17 nt, Human
aguauguggaagugugg

SEQ ID NO: 3210798 - RNA, 17 nt, Human
aguaugguggcuggguu

SEQ ID NO: 3210799 - RNA, 14 nt, Human
aguauaaauuugug

SEQ ID NO: 3210800 - RNA, 17 nt, Human
aguauaaauuuguguaa

SEQ ID NO: 3210801 - RNA, 23 nt, Human
aguauaaauuuguguaauauuac

SEQ ID NO: 3210802 - RNA, 20 nt, Human
aguaguuugcauuucagaaa

SEQ ID NO: 3210803 - RNA, 18 nt, Human
aguaguuugcauuucaga

SEQ ID NO: 3210804 - RNA, 16 nt, Human
aguaguuugcauuuca

SEQ ID NO: 3210805 - RNA, 15 nt, Human
aguaguuugcauuuc

SEQ ID NO: 3210806 - RNA, 14 nt, Human
aguaguuugcauuu

SEQ ID NO: 3210807 - RNA, 14 nt, Human
aguauaaagaauag

SEQ ID NO: 3210808 - RNA, 19 nt, Human
aguauguggaagugugggu

SEQ ID NO: 3210809 - RNA, 21 nt, Human
aguauuugaaaacagaaauug

SEQ ID NO: 3210810 - RNA, 20 nt, Human
aguauuugaaaacagaaauu

SEQ ID NO: 3210811 - RNA, 22 nt, Human
aguauuugaaaacagaaauugg

SEQ ID NO: 3210812 - RNA, 19 nt, Human
aguauuucuaaaguaauug

SEQ ID NO: 3210813 - RNA, 18 nt, Human
aguauuugaaaacagaaa

SEQ ID NO: 3210814 - RNA, 17 nt, Human
aguauuugaaaacagaa

SEQ ID NO: 3210815 - RNA, 13 nt, Human
aguauuugaaaac

SEQ ID NO: 3210816 - RNA, 12 nt, Human
aguauuugaaaa

SEQ ID NO: 3210817 - RNA, 13 nt, Human
agucaccaagccc

SEQ ID NO: 3210818 - RNA, 16 nt, Human
aguauuuggaauuaga

SEQ ID NO: 3210819 - RNA, 20 nt, Human
agucaccaaauagugugaaa

SEQ ID NO: 3210820 - RNA, 21 nt, Human
agucaccaaauagugugaaau

SEQ ID NO: 3210821 - RNA, 14 nt, Human
uguauucaauuaaa

SEQ ID NO: 3210822 - RNA, 17 nt, Human
uguauucaauuaaagaa

SEQ ID NO: 3210823 - RNA, 17 nt, Human
uguauucauauuuguac

SEQ ID NO: 3210824 - RNA, 16 nt, Human
uguauucauauuugua

SEQ ID NO: 3210825 - RNA, 15 nt, Human
uguauucauauuugu

SEQ ID NO: 3210826 - RNA, 22 nt, Human
uguauuuugugaguuuguuucu

SEQ ID NO: 3210827 - RNA, 15 nt, Human
uguauuuugugaguu

SEQ ID NO: 3210828 - RNA, 15 nt, Human
ugucaagccauaauu

SEQ ID NO: 3210829 - RNA, 19 nt, Human
ugucaagagggucugagga

SEQ ID NO: 3210830 - RNA, 21 nt, Human
uguauuuuuccucuuucacuu

SEQ ID NO: 3210831 - RNA, 19 nt, Human
uguauuuuuuaaugcuaau

SEQ ID NO: 3210832 - RNA, 21 nt, Human
ugucaagaauagcauuguaaa

SEQ ID NO: 3210833 - RNA, 17 nt, Human
uguauuuuuuaaugcua

SEQ ID NO: 3210834 - RNA, 19 nt, Human
aguagggguaccacugaau

SEQ ID NO: 3210835 - RNA, 21 nt, Human
aguagucucugugaggccuua

SEQ ID NO: 3210836 - RNA, 19 nt, Human
aguaggggaagaauaauuu

SEQ ID NO: 3210837 - RNA, 22 nt, Human
aguaggauaugccugcucuuug

SEQ ID NO: 3210838 - RNA, 20 nt, Human
aguaggauaugccugcucuu

SEQ ID NO: 3210839 - RNA, 15 nt, Human
aguaggcaagauggc

SEQ ID NO: 3210840 - RNA, 23 nt, Human
aguaggacaaggugcaggcaggc

SEQ ID NO: 3210841 - RNA, 17 nt, Human
aguagcuuaagaaaaaa

SEQ ID NO: 3210842 - RNA, 22 nt, Human
aguaggacaaggugcaggcagg

SEQ ID NO: 3210843 - RNA, 20 nt, Human
aguagcuuugcacuuuucua

SEQ ID NO: 3210844 - RNA, 17 nt, Human
aguaguguuacauguau

SEQ ID NO: 3210845 - RNA, 18 nt, Human
aguagugaagacuccaga

SEQ ID NO: 3210846 - RNA, 14 nt, Human
aguagugucuggau

SEQ ID NO: 3210847 - RNA, 20 nt, Human
aguagugucuggaucaguaa

SEQ ID NO: 3210848 - RNA, 14 nt, Human
aguaguguuacaug

SEQ ID NO: 3210849 - RNA, 19 nt, Human
aguagugaagacuccagaa

SEQ ID NO: 3210850 - RNA, 13 nt, Human
aguaguucuguau

SEQ ID NO: 3210851 - RNA, 13 nt, Human
aguaguuugcauu

SEQ ID NO: 3210852 - RNA, 18 nt, Human
aguaguucuguauuugaa

SEQ ID NO: 3210853 - RNA, 21 nt, Human
aguaguucuguauuugaaagu

SEQ ID NO: 3210854 - RNA, 14 nt, Human
aguaguucuguauu

SEQ ID NO: 3210855 - RNA, 15 nt, Human
aguaguucuguauuu

SEQ ID NO: 3210856 - RNA, 16 nt, Human
aguaguucuguauuug

SEQ ID NO: 3210857 - RNA, 17 nt, Human
aguaguucuguauuuga

SEQ ID NO: 3210858 - RNA, 16 nt, Human
aguaggaagacuuugg

SEQ ID NO: 3210859 - RNA, 16 nt, Human
aguagcuuaagaaaaa

SEQ ID NO: 3210860 - RNA, 17 nt, Human
aguaggaagacuuugga

SEQ ID NO: 3210861 - RNA, 18 nt, Human
aguaggaagacuuuggaa

SEQ ID NO: 3210862 - RNA, 19 nt, Human
aguaggaagacuuuggaaa

SEQ ID NO: 3210863 - RNA, 22 nt, Human
aguaggaagacuuuggaaagac

SEQ ID NO: 3210864 - RNA, 20 nt, Human
agucccugaggcaggucccc

SEQ ID NO: 3210865 - RNA, 19 nt, Human
agucccugaggcagguccc

SEQ ID NO: 3210866 - RNA, 21 nt, Human
agucccucaagccaccagaug

SEQ ID NO: 3210867 - RNA, 23 nt, Human
aguccaggacaggagaugcugug

SEQ ID NO: 3210868 - RNA, 17 nt, Human
agucaggcucucugggc

SEQ ID NO: 3210869 - RNA, 23 nt, Human
agucccugaggcagguccccaga

SEQ ID NO: 3210870 - RNA, 22 nt, Human
agucccugaggcagguccccag

SEQ ID NO: 3210871 - RNA, 18 nt, Human
agucccuguaauuguugu

SEQ ID NO: 3210872 - RNA, 16 nt, Human
agucccuguaauuguu

SEQ ID NO: 3210873 - RNA, 23 nt, Human
agucccuguaauuguuguuugua

SEQ ID NO: 3210874 - RNA, 20 nt, Human
agucccuguaauuguuguuu

SEQ ID NO: 3210875 - RNA, 23 nt, Human
aguccgaaagggacuuggaagcu

SEQ ID NO: 3210876 - RNA, 21 nt, Human
aguccgaccuggccugucugu

SEQ ID NO: 3210877 - RNA, 20 nt, Human
aguccgaccuggccugucug

SEQ ID NO: 3210878 - RNA, 13 nt, Human
agucccuuuaaag

SEQ ID NO: 3210879 - RNA, 17 nt, Human
agucucacuguugccca

SEQ ID NO: 3210880 - RNA, 16 nt, Human
agucucacuguugccc

SEQ ID NO: 3210881 - RNA, 21 nt, Human
agucuagcguagugcagcagg

SEQ ID NO: 3210882 - RNA, 16 nt, Human
agucucaaugaaauag

SEQ ID NO: 3210883 - RNA, 22 nt, Human
agucucaccauuuccccagggc

SEQ ID NO: 3210884 - RNA, 21 nt, Human
agucucaccauuuccccaggg

SEQ ID NO: 3210885 - RNA, 20 nt, Human
agucucaccauuuccccagg

SEQ ID NO: 3210886 - RNA, 23 nt, Human
agucuagcguagugcagcagggc

SEQ ID NO: 3210887 - RNA, 22 nt, Human
agucagaaguuucugccgcagc

SEQ ID NO: 3210888 - RNA, 16 nt, Human
agucagacagaugugg

SEQ ID NO: 3210889 - RNA, 23 nt, Human
ugucggcuccaguccccagaacu

SEQ ID NO: 3210890 - RNA, 12 nt, Human
ugucggcuccag

SEQ ID NO: 3210891 - RNA, 19 nt, Human
ugucggcuccaguccccag

SEQ ID NO: 3210892 - RNA, 17 nt, Human
ugucggcuccagucccc

SEQ ID NO: 3210893 - RNA, 17 nt, Human
ugucguuaaaaacagau

SEQ ID NO: 3210894 - RNA, 22 nt, Human
ugucguaguuacucucaggcau

SEQ ID NO: 3210895 - RNA, 14 nt, Human
ugucgggcaugaca

SEQ ID NO: 3210896 - RNA, 15 nt, Human
ugucgggcaugacac

SEQ ID NO: 3210897 - RNA, 12 nt, Human
ugucgggcauga

SEQ ID NO: 3210898 - RNA, 15 nt, Human
ugucgcccagucugg

SEQ ID NO: 3210899 - RNA, 14 nt, Human
ugucgcccagucug

SEQ ID NO: 3210900 - RNA, 17 nt, Human
ugucccuuuuccuuuuu

SEQ ID NO: 3210901 - RNA, 13 nt, Human
ugucauuuucauu

SEQ ID NO: 3210902 - RNA, 12 nt, Human
ugucauuuucau

SEQ ID NO: 3210903 - RNA, 20 nt, Human
ugucauuuucauuagcaaaa

SEQ ID NO: 3210904 - RNA, 19 nt, Human
ugucauuuucauuagcaaa

SEQ ID NO: 3210905 - RNA, 14 nt, Human
ugucauuuucauua

SEQ ID NO: 3210906 - RNA, 13 nt, Human
uguccgagcuuug

SEQ ID NO: 3210907 - RNA, 14 nt, Human
uguccgagcuuuga

SEQ ID NO: 3210908 - RNA, 16 nt, Human
uguccguaguaucaga

SEQ ID NO: 3210909 - RNA, 15 nt, Human
uguccgauuuuucca

SEQ ID NO: 3210910 - RNA, 14 nt, Human
uguccuacacuuga

SEQ ID NO: 3210911 - RNA, 15 nt, Human
uguccuaauggugau

SEQ ID NO: 3210912 - RNA, 18 nt, Human
uguccuaauggugaugca

SEQ ID NO: 3210913 - RNA, 15 nt, Human
ugucgcccaggcugg

SEQ ID NO: 3210914 - RNA, 16 nt, Human
ugucgcccaggcugga

SEQ ID NO: 3210915 - RNA, 21 nt, Human
uguaauuuaaaauugugaugu

SEQ ID NO: 3210916 - RNA, 22 nt, Human
uguaauuuaaaauugugaugug

SEQ ID NO: 3210917 - RNA, 19 nt, Human
uguaauuuaaggucuguuu

SEQ ID NO: 3210918 - RNA, 13 nt, Human
uguaccaaaauuu

SEQ ID NO: 3210919 - RNA, 15 nt, Human
uguaccaaaauuuua

SEQ ID NO: 3210920 - RNA, 17 nt, Human
uguaccaaaauuuuaaa

SEQ ID NO: 3210921 - RNA, 18 nt, Human
uguagaggagaaacugga

SEQ ID NO: 3210922 - RNA, 16 nt, Human
uguagaggagaaacug

SEQ ID NO: 3210923 - RNA, 13 nt, Human
uguagagugggag

SEQ ID NO: 3210924 - RNA, 21 nt, Human
aguaagcggcucaagcccagg

SEQ ID NO: 3210925 - RNA, 19 nt, Human
aguaagggaagcagaagga

SEQ ID NO: 3210926 - RNA, 19 nt, Human
aguaaggugcuuggaguuu

SEQ ID NO: 3210927 - RNA, 21 nt, Human
aguaagggaacaaguugagcu

SEQ ID NO: 3210928 - RNA, 15 nt, Human
aguaagggaagcaga

SEQ ID NO: 3210929 - RNA, 18 nt, Human
aguaaggaaugauauugc

SEQ ID NO: 3210930 - RNA, 22 nt, Human
aguaagcggcucaagcccagga

SEQ ID NO: 3210931 - RNA, 15 nt, Human
aguaaaaccacagca

SEQ ID NO: 3210932 - RNA, 20 nt, Human
aguaagccgugauuuucauu

SEQ ID NO: 3210933 - RNA, 15 nt, Human
aguaaaaauaaaauu

SEQ ID NO: 3210934 - RNA, 12 nt, Human
aguaaaaauaaa

SEQ ID NO: 3210935 - RNA, 17 nt, Human
aguaaaaauaaaauacu

SEQ ID NO: 3210936 - RNA, 11 nt, Human
agguuuuccug

SEQ ID NO: 3210937 - RNA, 14 nt, Human
agguuuucuccccc

SEQ ID NO: 3210938 - RNA, 21 nt, Human
agguuuugcacucuuguuucu

SEQ ID NO: 3210939 - RNA, 12 nt, Human
aguagagacagg

SEQ ID NO: 3210940 - RNA, 14 nt, Human
aguagaacuuugua

SEQ ID NO: 3210941 - RNA, 15 nt, Human
aguagaacuuuguau

SEQ ID NO: 3210942 - RNA, 16 nt, Human
aguagaacuuuguaua

SEQ ID NO: 3210943 - RNA, 18 nt, Human
aguagaacuuuguauagu

SEQ ID NO: 3210944 - RNA, 19 nt, Human
aguagaacuuuguauaguu

SEQ ID NO: 3210945 - RNA, 21 nt, Human
aguagaacuuuguauaguuau

SEQ ID NO: 3210946 - RNA, 22 nt, Human
aguagagguauaauugugugau

SEQ ID NO: 3210947 - RNA, 20 nt, Human
aguagagguauaauugugug

SEQ ID NO: 3210948 - RNA, 18 nt, Human
aguagagguauaauugug

SEQ ID NO: 3210949 - RNA, 17 nt, Human
aguagagguauaauugu

SEQ ID NO: 3210950 - RNA, 15 nt, Human
aguagaucuauauua

SEQ ID NO: 3210951 - RNA, 23 nt, Human
aguagaucuauauuagaucaaau

SEQ ID NO: 3210952 - RNA, 18 nt, Human
uguaggaagguuaauguu

SEQ ID NO: 3210953 - RNA, 20 nt, Human
uguaggaagguuaauguuca

SEQ ID NO: 3210954 - RNA, 17 nt, Human
aguacacugccugccuu

SEQ ID NO: 3210955 - RNA, 19 nt, Human
aguacacugccugccuuaa

SEQ ID NO: 3210956 - RNA, 12 nt, Human
aguacacugccu

SEQ ID NO: 3210957 - RNA, 13 nt, Human
aguacacugagag

SEQ ID NO: 3210958 - RNA, 21 nt, Human
aguacacugaauuuuuaugug

SEQ ID NO: 3210959 - RNA, 22 nt, Human
aguaauauuuauuaaauuuuuu

SEQ ID NO: 3210960 - RNA, 20 nt, Human
aguaaucagauuacugcuuu

SEQ ID NO: 3210961 - RNA, 22 nt, Human
aguaaucagauuacugcuuuaa

SEQ ID NO: 3210962 - RNA, 15 nt, Human
aguaauauuuauuaa

SEQ ID NO: 3210963 - RNA, 19 nt, Human
aguaauauuuauuaaauuu

SEQ ID NO: 3210964 - RNA, 13 nt, Human
aguaauauuuauu

SEQ ID NO: 3210965 - RNA, 12 nt, Human
aguaauuucagu

SEQ ID NO: 3210966 - RNA, 13 nt, Human
aguaauuucagug

SEQ ID NO: 3210967 - RNA, 14 nt, Human
aguaauuucagugu

SEQ ID NO: 3210968 - RNA, 19 nt, Human
aguaauuucaguguaaagu

SEQ ID NO: 3210969 - RNA, 22 nt, Human
aguaauuucaguguaaagugug

SEQ ID NO: 3210970 - RNA, 19 nt, Human
aguacaaugugacuuugaa

SEQ ID NO: 3210971 - RNA, 18 nt, Human
aguacaaugugacuuuga

SEQ ID NO: 3210972 - RNA, 22 nt, Human
aguacaaugugacuuugaaaau

SEQ ID NO: 3210973 - RNA, 17 nt, Human
agguccccagcuuuggc

SEQ ID NO: 3210974 - RNA, 11 nt, Human
agguccccaga

SEQ ID NO: 3210975 - RNA, 18 nt, Human
agguccccagcuuuggcu

SEQ ID NO: 3210976 - RNA, 22 nt, Human
aggucuugaacuccuggccuca

SEQ ID NO: 3210977 - RNA, 23 nt, Human
aggucuugaacuccuggccucaa

SEQ ID NO: 3210978 - RNA, 13 nt, Human
aggucuuggugcc

SEQ ID NO: 3210979 - RNA, 18 nt, Human
aggucuuggugccucugc

SEQ ID NO: 3210980 - RNA, 23 nt, Human
aggucuugcucuccuagguagcc

SEQ ID NO: 3210981 - RNA, 15 nt, Human
aggucuugcucuccu

SEQ ID NO: 3210982 - RNA, 15 nt, Human
aggugcacaagcucc

SEQ ID NO: 3210983 - RNA, 16 nt, Human
uguaaaucuaacauua

SEQ ID NO: 3210984 - RNA, 19 nt, Human
uguaaaucuaacauuauua

SEQ ID NO: 3210985 - RNA, 16 nt, Human
aggugcacaagcucca

SEQ ID NO: 3210986 - RNA, 17 nt, Human
aggugcacaagcuccaa

SEQ ID NO: 3210987 - RNA, 18 nt, Human
aggugcacaagcuccaag

SEQ ID NO: 3210988 - RNA, 20 nt, Human
aggugcacaagcuccaagcu

SEQ ID NO: 3210989 - RNA, 18 nt, Human
aggugggauccuccaggu

SEQ ID NO: 3210990 - RNA, 20 nt, Human
aggugggauccuccaggugc

SEQ ID NO: 3210991 - RNA, 21 nt, Human
aggugcacaagcuccaagcuc

SEQ ID NO: 3210992 - RNA, 23 nt, Human
aggugcacuuggggcacagggag

SEQ ID NO: 3210993 - RNA, 22 nt, Human
aggugcacuuggggcacaggga

SEQ ID NO: 3210994 - RNA, 20 nt, Human
aggugcacuuggggcacagg

SEQ ID NO: 3210995 - RNA, 14 nt, Human
agguggccacucca

SEQ ID NO: 3210996 - RNA, 17 nt, Human
agguggccacuccagac

SEQ ID NO: 3210997 - RNA, 15 nt, Human
aggugcaggcaggcu

SEQ ID NO: 3210998 - RNA, 13 nt, Human
aggugcaggcagg

SEQ ID NO: 3210999 - RNA, 23 nt, Human
agguugggagaaugucaguaugu

SEQ ID NO: 3211000 - RNA, 17 nt, Human
aggugguuauggagagg

SEQ ID NO: 3211001 - RNA, 21 nt, Human
agguggugggcauucucucuc

SEQ ID NO: 3211002 - RNA, 19 nt, Human
agguggugggcauucucuc

SEQ ID NO: 3211003 - RNA, 18 nt, Human
agguggugggcauucucu

SEQ ID NO: 3211004 - RNA, 15 nt, Human
agguugacaggaggu

SEQ ID NO: 3211005 - RNA, 14 nt, Human
agguuguagcaugg

SEQ ID NO: 3211006 - RNA, 14 nt, Human
agguuggugggggc

SEQ ID NO: 3211007 - RNA, 22 nt, Human
agguugggugcugcuaauucuu

SEQ ID NO: 3211008 - RNA, 18 nt, Human
agguugggugcugcuaau

SEQ ID NO: 3211009 - RNA, 23 nt, Human
uguaagagagaugagcacuucua

SEQ ID NO: 3211010 - RNA, 21 nt, Human
uguaacuuugguuaaaaucuc

SEQ ID NO: 3211011 - RNA, 17 nt, Human
uguaauuuaaaauugug

SEQ ID NO: 3211012 - RNA, 23 nt, Human
uguaauuguuguuuguauguaua

SEQ ID NO: 3211013 - RNA, 20 nt, Human
uguaauuguuguuuguaugu

SEQ ID NO: 3211014 - RNA, 18 nt, Human
uguaauuuaaaauuguga

SEQ ID NO: 3211015 - RNA, 20 nt, Human
uguaauuuaaaauugugaug

SEQ ID NO: 3211016 - RNA, 19 nt, Human
uguaauuguuguuuguaug

SEQ ID NO: 3211017 - RNA, 17 nt, Human
uguaauuguuguuugua

SEQ ID NO: 3211018 - RNA, 16 nt, Human
uguaauuguuguuugu

SEQ ID NO: 3211019 - RNA, 14 nt, Human
uguaauuauuugaa

SEQ ID NO: 3211020 - RNA, 13 nt, Human
uguaauuauuuga

SEQ ID NO: 3211021 - RNA, 23 nt, Human
uguaauuaaguacuauguaucaa

SEQ ID NO: 3211022 - RNA, 21 nt, Human
uguaagcguauggcuuuauuu

SEQ ID NO: 3211023 - RNA, 19 nt, Human
uguaagguauaucauucua

SEQ ID NO: 3211024 - RNA, 17 nt, Human
uguaagcguauggcuuu

SEQ ID NO: 3211025 - RNA, 22 nt, Human
uguaagauauuugcaguuuuuc

SEQ ID NO: 3211026 - RNA, 15 nt, Human
uguaagaguguuuau

SEQ ID NO: 3211027 - RNA, 16 nt, Human
uguguguguguaugug

SEQ ID NO: 3211028 - RNA, 13 nt, Human
uguguguguguau

SEQ ID NO: 3211029 - RNA, 11 nt, Human
uguguguuccu

SEQ ID NO: 3211030 - RNA, 12 nt, Human
uguguguuccug

SEQ ID NO: 3211031 - RNA, 13 nt, Human
uguguguuccugg

SEQ ID NO: 3211032 - RNA, 14 nt, Human
uguguguuccuggc

SEQ ID NO: 3211033 - RNA, 14 nt, Human
uguguguuacaaug

SEQ ID NO: 3211034 - RNA, 14 nt, Human
uguguuauuauaga

SEQ ID NO: 3211035 - RNA, 14 nt, Human
uguguuaugaagca

SEQ ID NO: 3211036 - RNA, 16 nt, Human
uguguuccaaccacug

SEQ ID NO: 3211037 - RNA, 15 nt, Human
uguguuccaaccacu

SEQ ID NO: 3211038 - RNA, 20 nt, Human
uguguuccaaacaugagguu

SEQ ID NO: 3211039 - RNA, 20 nt, Human
uguguucacuaaacucugaa

SEQ ID NO: 3211040 - RNA, 19 nt, Human
uguguucacuaaacucuga

SEQ ID NO: 3211041 - RNA, 19 nt, Human
ugugucagguggggcagcu

SEQ ID NO: 3211042 - RNA, 17 nt, Human
ugugucagguggggcag

SEQ ID NO: 3211043 - RNA, 13 nt, Human
ugugucucuuggu

SEQ ID NO: 3211044 - RNA, 11 nt, Human
ugugugugugc

SEQ ID NO: 3211045 - RNA, 14 nt, Human
uguuaacaaugccu

SEQ ID NO: 3211046 - RNA, 19 nt, Human
uguuaacaaugccuauugu

SEQ ID NO: 3211047 - RNA, 23 nt, Human
uguuaacaaugccuauuguaaua

SEQ ID NO: 3211048 - RNA, 18 nt, Human
uguguugccacuuuccaa

SEQ ID NO: 3211049 - RNA, 17 nt, Human
uguguugcuuauguugu

SEQ ID NO: 3211050 - RNA, 15 nt, Human
uguguugcuuauguu

SEQ ID NO: 3211051 - RNA, 21 nt, Human
uguuaacauggacaugaucuu

SEQ ID NO: 3211052 - RNA, 19 nt, Human
uguuaaccucugcuuuuau

SEQ ID NO: 3211053 - RNA, 19 nt, Human
uguuaaugauagcuacugu

SEQ ID NO: 3211054 - RNA, 17 nt, Human
uguuaaucuuaauguau

SEQ ID NO: 3211055 - RNA, 19 nt, Human
uguuaaucuuaauguauau

SEQ ID NO: 3211056 - RNA, 22 nt, Human
uguuaaucuuaauguauaucgu

SEQ ID NO: 3211057 - RNA, 18 nt, Human
aguggaaaaauagccugc

SEQ ID NO: 3211058 - RNA, 19 nt, Human
aguggaaaaauagccugcc

SEQ ID NO: 3211059 - RNA, 11 nt, Human
aguggaaaaau

SEQ ID NO: 3211060 - RNA, 13 nt, Human
uguggucuccacu

SEQ ID NO: 3211061 - RNA, 20 nt, Human
ugugguguuuccuggcacug

SEQ ID NO: 3211062 - RNA, 19 nt, Human
ugugucagcauagaaguaa

SEQ ID NO: 3211063 - RNA, 16 nt, Human
uguggucccaccccac

SEQ ID NO: 3211064 - RNA, 16 nt, Human
agugcuuccaaggaug

SEQ ID NO: 3211065 - RNA, 21 nt, Human
agugccuguaaucacagcuac

SEQ ID NO: 3211066 - RNA, 15 nt, Human
agugccuuacacaau

SEQ ID NO: 3211067 - RNA, 19 nt, Human
agugccuaaaauaagaaua

SEQ ID NO: 3211068 - RNA, 16 nt, Human
agugccgcucuugggg

SEQ ID NO: 3211069 - RNA, 18 nt, Human
agugccgcucuuggggac

SEQ ID NO: 3211070 - RNA, 14 nt, Human
agugccuaaaauaa

SEQ ID NO: 3211071 - RNA, 16 nt, Human
agugccgcaucucaca

SEQ ID NO: 3211072 - RNA, 18 nt, Human
agugccgcaucucacagc

SEQ ID NO: 3211073 - RNA, 19 nt, Human
agugccgcaucucacagcu

SEQ ID NO: 3211074 - RNA, 23 nt, Human
agugccgcaucucacagcuaugc

SEQ ID NO: 3211075 - RNA, 15 nt, Human
agugcugcuuugcca

SEQ ID NO: 3211076 - RNA, 18 nt, Human
agugcugcuuugccaaau

SEQ ID NO: 3211077 - RNA, 20 nt, Human
agugcugggauuacaagcgu

SEQ ID NO: 3211078 - RNA, 19 nt, Human
agugcugggauuacaggug

SEQ ID NO: 3211079 - RNA, 20 nt, Human
agugcugggauuacaggcgu

SEQ ID NO: 3211080 - RNA, 20 nt, Human
agugcugggauuacaggcau

SEQ ID NO: 3211081 - RNA, 15 nt, Human
agugcuuagcaaaaa

SEQ ID NO: 3211082 - RNA, 23 nt, Human
uguggagacugcuccugagcccc

SEQ ID NO: 3211083 - RNA, 22 nt, Human
uguggagacugcuccugagccc

SEQ ID NO: 3211084 - RNA, 18 nt, Human
ugugcucuggacaggcau

SEQ ID NO: 3211085 - RNA, 16 nt, Human
ugugcucuggacaggc

SEQ ID NO: 3211086 - RNA, 12 nt, Human
ugugcugcccug

SEQ ID NO: 3211087 - RNA, 20 nt, Human
ugugccucuagcugaauuga

SEQ ID NO: 3211088 - RNA, 18 nt, Human
ugugccucuagcugaauu

SEQ ID NO: 3211089 - RNA, 13 nt, Human
ugugcugcccugc

SEQ ID NO: 3211090 - RNA, 14 nt, Human
ugugcugcccugcc

SEQ ID NO: 3211091 - RNA, 21 nt, Human
uguggagaagcggcuggcagc

SEQ ID NO: 3211092 - RNA, 13 nt, Human
uguggagacugcu

SEQ ID NO: 3211093 - RNA, 18 nt, Human
uguggagacugcuccuga

SEQ ID NO: 3211094 - RNA, 15 nt, Human
uguggagacugcucc

SEQ ID NO: 3211095 - RNA, 15 nt, Human
ugugcugcccugccc

SEQ ID NO: 3211096 - RNA, 19 nt, Human
agucucacuguugcccagg

SEQ ID NO: 3211097 - RNA, 18 nt, Human
agucucacuguugcccag

SEQ ID NO: 3211098 - RNA, 20 nt, Human
agucucacuguugcccaggc

SEQ ID NO: 3211099 - RNA, 23 nt, Human
agucucaccauuuccccagggca

SEQ ID NO: 3211100 - RNA, 15 nt, Human
ugugcucuggacagg

SEQ ID NO: 3211101 - RNA, 23 nt, Human
ugugcucugaucauccacugugc

SEQ ID NO: 3211102 - RNA, 12 nt, Human
ugugcucugauc

SEQ ID NO: 3211103 - RNA, 22 nt, Human
ugugcucugaucauccacugug

SEQ ID NO: 3211104 - RNA, 16 nt, Human
ugugccucuagcugaa

SEQ ID NO: 3211105 - RNA, 15 nt, Human
ugugccucuagcuga

SEQ ID NO: 3211106 - RNA, 14 nt, Human
ugugccucuagcug

SEQ ID NO: 3211107 - RNA, 12 nt, Human
ugugccucugcc

SEQ ID NO: 3211108 - RNA, 21 nt, Human
agugcaauauauuuuguaugc

SEQ ID NO: 3211109 - RNA, 16 nt, Human
agugcaauauauuuug

SEQ ID NO: 3211110 - RNA, 15 nt, Human
agugcaauauauuuu

SEQ ID NO: 3211111 - RNA, 14 nt, Human
agugcaauauauuu

SEQ ID NO: 3211112 - RNA, 24 nt, Human
agugauucuccugccucagccucc

SEQ ID NO: 3211113 - RNA, 22 nt, Human
agugauucuccugccucagccu

SEQ ID NO: 3211114 - RNA, 16 nt, Human
agugagucgaggacag

SEQ ID NO: 3211115 - RNA, 16 nt, Human
agugccaaaaacaaca

SEQ ID NO: 3211116 - RNA, 14 nt, Human
agugccaaaaacaa

SEQ ID NO: 3211117 - RNA, 14 nt, Human
agugcccacaggau

SEQ ID NO: 3211118 - RNA, 13 nt, Human
agugcccaggugg

SEQ ID NO: 3211119 - RNA, 14 nt, Human
agugcaucucagcc

SEQ ID NO: 3211120 - RNA, 15 nt, Human
agugcaucucagccc

SEQ ID NO: 3211121 - RNA, 17 nt, Human
agugcaucucagcccac

SEQ ID NO: 3211122 - RNA, 16 nt, Human
agugcaucucagccca

SEQ ID NO: 3211123 - RNA, 19 nt, Human
agugcaggcccacccugcu

SEQ ID NO: 3211124 - RNA, 18 nt, Human
agugcaggcccacccugc

SEQ ID NO: 3211125 - RNA, 17 nt, Human
agugcaggcccacccug

SEQ ID NO: 3211126 - RNA, 15 nt, Human
agugcaggcccaccc

SEQ ID NO: 3211127 - RNA, 13 nt, Human
agugcaggcccac

SEQ ID NO: 3211128 - RNA, 12 nt, Human
agugcaggccca

SEQ ID NO: 3211129 - RNA, 20 nt, Human
agugcaccugggacagggag

SEQ ID NO: 3211130 - RNA, 17 nt, Human
agugcagcugaaauuga

SEQ ID NO: 3211131 - RNA, 16 nt, Human
agugcagcugaaauug

SEQ ID NO: 3211132 - RNA, 22 nt, Human
uguuuagcuacguuuacucaca

SEQ ID NO: 3211133 - RNA, 20 nt, Human
uguuuagauuuuguguuuau

SEQ ID NO: 3211134 - RNA, 20 nt, Human
uguuuaucuagauguaaauu

SEQ ID NO: 3211135 - RNA, 18 nt, Human
uguuuaucuagauguaaa

SEQ ID NO: 3211136 - RNA, 17 nt, Human
uguuuaucuagauguaa

SEQ ID NO: 3211137 - RNA, 16 nt, Human
uguuuaucuagaugua

SEQ ID NO: 3211138 - RNA, 20 nt, Human
uguuuaucccuuaagaauga

SEQ ID NO: 3211139 - RNA, 17 nt, Human
uguuuaucccuuaagaa

SEQ ID NO: 3211140 - RNA, 16 nt, Human
uguuuauucaaacuga

SEQ ID NO: 3211141 - RNA, 13 nt, Human
uguuuauucaaac

SEQ ID NO: 3211142 - RNA, 11 nt, Human
uguuuauguaa

SEQ ID NO: 3211143 - RNA, 20 nt, Human
uguuuauguaaacaaaucuu

SEQ ID NO: 3211144 - RNA, 15 nt, Human
uguuuauguaaacaa

SEQ ID NO: 3211145 - RNA, 22 nt, Human
uguuuaucuagauguaaauuuu

SEQ ID NO: 3211146 - RNA, 14 nt, Human
uguuuauugucaaa

SEQ ID NO: 3211147 - RNA, 21 nt, Human
uguuuauucuugaugaaaagc

SEQ ID NO: 3211148 - RNA, 14 nt, Human
uguuuauucuugau

SEQ ID NO: 3211149 - RNA, 13 nt, Human
uguuuauucuuga

SEQ ID NO: 3211150 - RNA, 21 nt, Human
uguuuauucaaacugaaaagc

SEQ ID NO: 3211151 - RNA, 18 nt, Human
uguuuauucaaacugaaa

SEQ ID NO: 3211152 - RNA, 20 nt, Human
uguugugaauaauuacagug

SEQ ID NO: 3211153 - RNA, 19 nt, Human
uguugugaauaauuacagu

SEQ ID NO: 3211154 - RNA, 17 nt, Human
uguugugaauaauuaca

SEQ ID NO: 3211155 - RNA, 15 nt, Human
uguugugaauaauua

SEQ ID NO: 3211156 - RNA, 16 nt, Human
uguuggggcucuuccu

SEQ ID NO: 3211157 - RNA, 13 nt, Human
uguugucucuucu

SEQ ID NO: 3211158 - RNA, 17 nt, Human
uguugucucuucuccuu

SEQ ID NO: 3211159 - RNA, 15 nt, Human
uguugucucuucucc

SEQ ID NO: 3211160 - RNA, 14 nt, Human
uguuguguguggga

SEQ ID NO: 3211161 - RNA, 15 nt, Human
uguugugugugggag

SEQ ID NO: 3211162 - RNA, 15 nt, Human
uguugugcuuucaag

SEQ ID NO: 3211163 - RNA, 14 nt, Human
uguugugugccucu

SEQ ID NO: 3211164 - RNA, 16 nt, Human
uguugugugugggagu

SEQ ID NO: 3211165 - RNA, 21 nt, Human
uguugugugccucuagcugaa

SEQ ID NO: 3211166 - RNA, 15 nt, Human
uguugugugccucua

SEQ ID NO: 3211167 - RNA, 12 nt, Human
uguuuagauuug

SEQ ID NO: 3211168 - RNA, 17 nt, Human
uguuuagauuugccaua

SEQ ID NO: 3211169 - RNA, 17 nt, Human
uguuuagauuuuguguu

SEQ ID NO: 3211170 - RNA, 15 nt, Human
uguuuagauuuugug

SEQ ID NO: 3211171 - RNA, 17 nt, Human
aguuccuagccaccgcc

SEQ ID NO: 3211172 - RNA, 24 nt, Human
aguuccccuggaagcagugcccag

SEQ ID NO: 3211173 - RNA, 23 nt, Human
aguuccccuggaagcagugccca

SEQ ID NO: 3211174 - RNA, 22 nt, Human
aguuccccuggaagcagugccc

SEQ ID NO: 3211175 - RNA, 23 nt, Human
aguuccucauuagcauuuugcua

SEQ ID NO: 3211176 - RNA, 16 nt, Human
aguucccauucuuuca

SEQ ID NO: 3211177 - RNA, 16 nt, Human
aguuccccaaauacaa

SEQ ID NO: 3211178 - RNA, 20 nt, Human
aguucccaucuccuuucucu

SEQ ID NO: 3211179 - RNA, 14 nt, Human
aguucccaagaaag

SEQ ID NO: 3211180 - RNA, 23 nt, Human
aguucccaagaaaggaaaccuuu

SEQ ID NO: 3211181 - RNA, 16 nt, Human
aguucaauucucauuu

SEQ ID NO: 3211182 - RNA, 14 nt, Human
aguuauauuuccua

SEQ ID NO: 3211183 - RNA, 15 nt, Human
aguuaucaugaauuu

SEQ ID NO: 3211184 - RNA, 16 nt, Human
aguuaucaugaauuuu

SEQ ID NO: 3211185 - RNA, 18 nt, Human
aguuaucaugaauuuuaa

SEQ ID NO: 3211186 - RNA, 20 nt, Human
aguuaucaugaauuuuaaag

SEQ ID NO: 3211187 - RNA, 22 nt, Human
aguuaucaugaauuuuaaagua

SEQ ID NO: 3211188 - RNA, 15 nt, Human
aguucaagaucaaaa

SEQ ID NO: 3211189 - RNA, 20 nt, Human
aguucaagaucaaaaaggcu

SEQ ID NO: 3211190 - RNA, 18 nt, Human
aguucaagaaaugaagag

SEQ ID NO: 3211191 - RNA, 15 nt, Human
aguucaagaaaugaa

SEQ ID NO: 3211192 - RNA, 17 nt, Human
aguucaagaaaugaaga

SEQ ID NO: 3211193 - RNA, 13 nt, Human
aguucuacagaaa

SEQ ID NO: 3211194 - RNA, 14 nt, Human
aguuccucuuuugu

SEQ ID NO: 3211195 - RNA, 22 nt, Human
aguuccucuuuugugcugcuuc

SEQ ID NO: 3211196 - RNA, 20 nt, Human
aguuccuauaacacugugaa

SEQ ID NO: 3211197 - RNA, 23 nt, Human
aguucuagugcagcugaaauuga

SEQ ID NO: 3211198 - RNA, 22 nt, Human
aguucuagugcagcugaaauug

SEQ ID NO: 3211199 - RNA, 18 nt, Human
aguucuagugcagcugaa

SEQ ID NO: 3211200 - RNA, 14 nt, Human
aguucuaccggcuu

SEQ ID NO: 3211201 - RNA, 23 nt, Human
aguucuacuucauguaauccaaa

SEQ ID NO: 3211202 - RNA, 16 nt, Human
agugugggucugugug

SEQ ID NO: 3211203 - RNA, 17 nt, Human
agugugggucugugugu

SEQ ID NO: 3211204 - RNA, 15 nt, Human
agugugggucugugu

SEQ ID NO: 3211205 - RNA, 20 nt, Human
aguggagccugacagccaga

SEQ ID NO: 3211206 - RNA, 17 nt, Human
aguggagguuuauaguu

SEQ ID NO: 3211207 - RNA, 19 nt, Human
aguggagccugacagccag

SEQ ID NO: 3211208 - RNA, 21 nt, Human
aguggacuguucccugaggug

SEQ ID NO: 3211209 - RNA, 21 nt, Human
aguggaaaauaggcuuuuuaa

SEQ ID NO: 3211210 - RNA, 23 nt, Human
aguggaaaauaggcuuuuuaauc

SEQ ID NO: 3211211 - RNA, 20 nt, Human
aguggaaacuauguguuuuu

SEQ ID NO: 3211212 - RNA, 19 nt, Human
agugugggucugugugugu

SEQ ID NO: 3211213 - RNA, 23 nt, Human
agugugggucuguguguguguau

SEQ ID NO: 3211214 - RNA, 13 nt, Human
uguuauaugaaca

SEQ ID NO: 3211215 - RNA, 14 nt, Human
uguuauaugaacau

SEQ ID NO: 3211216 - RNA, 12 nt, Human
uguuauaugaac

SEQ ID NO: 3211217 - RNA, 18 nt, Human
uguuaucauuuuuuccug

SEQ ID NO: 3211218 - RNA, 13 nt, Human
uguuaucauuuuu

SEQ ID NO: 3211219 - RNA, 15 nt, Human
uguuauaugaacaua

SEQ ID NO: 3211220 - RNA, 14 nt, Human
uguuauauuuuucu

SEQ ID NO: 3211221 - RNA, 18 nt, Human
uguuauauuuuucuuaaa

SEQ ID NO: 3211222 - RNA, 16 nt, Human
uguuauauuuuucuua

SEQ ID NO: 3211223 - RNA, 13 nt, Human
uguuauuaaaugu

SEQ ID NO: 3211224 - RNA, 14 nt, Human
uguuauuaaaugua

SEQ ID NO: 3211225 - RNA, 22 nt, Human
uguuauuauagagcagaaauuc

SEQ ID NO: 3211226 - RNA, 21 nt, Human
uguuauuauagagcagaaauu

SEQ ID NO: 3211227 - RNA, 20 nt, Human
uguuauuauagagcagaaau

SEQ ID NO: 3211228 - RNA, 16 nt, Human
uguuauucaacagcaa

SEQ ID NO: 3211229 - RNA, 13 nt, Human
uguuauucuuugc

SEQ ID NO: 3211230 - RNA, 16 nt, Human
uguuauucuuugcacu

SEQ ID NO: 3211231 - RNA, 14 nt, Human
uguuauucuuugca

SEQ ID NO: 3211232 - RNA, 20 nt, Human
uguuauugagagagaugugu

SEQ ID NO: 3211233 - RNA, 18 nt, Human
uguucuagcauggcugcc

SEQ ID NO: 3211234 - RNA, 15 nt, Human
uguucuaauggauua

SEQ ID NO: 3211235 - RNA, 18 nt, Human
uguucuuaguuugcaguu

SEQ ID NO: 3211236 - RNA, 10 nt, Human
uguucuucca

SEQ ID NO: 3211237 - RNA, 16 nt, Human
uguucuuccaaagcag

SEQ ID NO: 3211238 - RNA, 11 nt, Human
uguucuuccaa

SEQ ID NO: 3211239 - RNA, 12 nt, Human
uguucuuccugg

SEQ ID NO: 3211240 - RNA, 13 nt, Human
uguucuuccaguu

SEQ ID NO: 3211241 - RNA, 11 nt, Human
uguucuuccag

SEQ ID NO: 3211242 - RNA, 20 nt, Human
uguucuuccaaagcagagag

SEQ ID NO: 3211243 - RNA, 17 nt, Human
uguucuuccaaagcaga

SEQ ID NO: 3211244 - RNA, 22 nt, Human
uguucuuccaguuacuuuccaa

SEQ ID NO: 3211245 - RNA, 21 nt, Human
uguucuuccaguuacuuucca

SEQ ID NO: 3211246 - RNA, 20 nt, Human
uguugcccaggcuggagugc

SEQ ID NO: 3211247 - RNA, 19 nt, Human
uguugcccaggcuggagug

SEQ ID NO: 3211248 - RNA, 22 nt, Human
aguguuacuacagccuuaauau

SEQ ID NO: 3211249 - RNA, 14 nt, Human
aguguuaugagcca

SEQ ID NO: 3211250 - RNA, 14 nt, Human
aguguuauaugaac

SEQ ID NO: 3211251 - RNA, 15 nt, Human
aguguuauaugaaca

SEQ ID NO: 3211252 - RNA, 16 nt, Human
aguguuauaugaacau

SEQ ID NO: 3211253 - RNA, 20 nt, Human
aguguuauaugaacauacaa

SEQ ID NO: 3211254 - RNA, 13 nt, Human
aguguuauaugaa

SEQ ID NO: 3211255 - RNA, 18 nt, Human
uguucuuguuuuuaaguu

SEQ ID NO: 3211256 - RNA, 14 nt, Human
uguucuuguuuuua

SEQ ID NO: 3211257 - RNA, 13 nt, Human
uguugcccaggcu

SEQ ID NO: 3211258 - RNA, 15 nt, Human
uguugcccaggcugg

SEQ ID NO: 3211259 - RNA, 16 nt, Human
aguuacuguaaaaugc

SEQ ID NO: 3211260 - RNA, 21 nt, Human
aguuacuguccuguugauuaa

SEQ ID NO: 3211261 - RNA, 15 nt, Human
aguuacuguaaaaug

SEQ ID NO: 3211262 - RNA, 23 nt, Human
aguuacuuuuccuugcauacaaa

SEQ ID NO: 3211263 - RNA, 21 nt, Human
aguuacuuuuccuugcauaca

SEQ ID NO: 3211264 - RNA, 21 nt, Human
aguuacuuuccaauucuccuu

SEQ ID NO: 3211265 - RNA, 13 nt, Human
aguuacuugauaa

SEQ ID NO: 3211266 - RNA, 23 nt, Human
aguuacuuuccaauucuccuuua

SEQ ID NO: 3211267 - RNA, 22 nt, Human
aguuacuuuccaauucuccuuu

SEQ ID NO: 3211268 - RNA, 20 nt, Human
aguuacuuuuccuugcauac

SEQ ID NO: 3211269 - RNA, 18 nt, Human
aguuacuuuuccuugcau

SEQ ID NO: 3211270 - RNA, 17 nt, Human
aguuacuuuuccuugca

SEQ ID NO: 3211271 - RNA, 14 nt, Human
aguuacuuuuccuu

SEQ ID NO: 3211272 - RNA, 17 nt, Human
aguguuggaaaaaauuu

SEQ ID NO: 3211273 - RNA, 21 nt, Human
aguuacucuucaguuaagccu

SEQ ID NO: 3211274 - RNA, 15 nt, Human
aguguucagaaaaaa

SEQ ID NO: 3211275 - RNA, 20 nt, Human
aguguuauugagagagaugu

SEQ ID NO: 3211276 - RNA, 16 nt, Human
uuagccuuugucccag

SEQ ID NO: 3211277 - RNA, 15 nt, Human
uuagcgacaacagau

SEQ ID NO: 3211278 - RNA, 18 nt, Human
uuagccaagugugguaga

SEQ ID NO: 3211279 - RNA, 11 nt, Human
uuagcacagcg

SEQ ID NO: 3211280 - RNA, 17 nt, Human
uuagcaucuaauuucaa

SEQ ID NO: 3211281 - RNA, 16 nt, Human
uuagauuuuguguuua

SEQ ID NO: 3211282 - RNA, 21 nt, Human
auaauugugugauauuucaga

SEQ ID NO: 3211283 - RNA, 19 nt, Human
auaauugugugauauuuca

SEQ ID NO: 3211284 - RNA, 18 nt, Human
auaauugugugauauuuc

SEQ ID NO: 3211285 - RNA, 17 nt, Human
auaauugugugauauuu

SEQ ID NO: 3211286 - RNA, 14 nt, Human
auaauuguugcaua

SEQ ID NO: 3211287 - RNA, 23 nt, Human
auaauugugugauauuucagaaa

SEQ ID NO: 3211288 - RNA, 22 nt, Human
auaauugugugauauuucagaa

SEQ ID NO: 3211289 - RNA, 18 nt, Human
uuagauuuuguguuuauu

SEQ ID NO: 3211290 - RNA, 16 nt, Human
uuagcaaaaaaaguug

SEQ ID NO: 3211291 - RNA, 14 nt, Human
uuagcaaaaaaagu

SEQ ID NO: 3211292 - RNA, 23 nt, Human
uuagauuuuguguuuauucuuga

SEQ ID NO: 3211293 - RNA, 22 nt, Human
uuagauuuuguguuuauucuug

SEQ ID NO: 3211294 - RNA, 18 nt, Human
uuagcaaauucuguuuuu

SEQ ID NO: 3211295 - RNA, 16 nt, Human
uuagcaguuugcuuug

SEQ ID NO: 3211296 - RNA, 15 nt, Human
uuaggugaggaagca

SEQ ID NO: 3211297 - RNA, 23 nt, Human
uuagcgacaacagauuggauuuu

SEQ ID NO: 3211298 - RNA, 16 nt, Human
uuagcgacaacagauu

SEQ ID NO: 3211299 - RNA, 16 nt, Human
uuaggugaggaagcaa

SEQ ID NO: 3211300 - RNA, 18 nt, Human
uuagguuggcaaaaaggc

SEQ ID NO: 3211301 - RNA, 22 nt, Human
uuaguuugcaguuacacuaaaa

SEQ ID NO: 3211302 - RNA, 14 nt, Human
uuaguuugcauuua

SEQ ID NO: 3211303 - RNA, 15 nt, Human
uuaguuucuccaagc

SEQ ID NO: 3211304 - RNA, 20 nt, Human
uuaguuuagaacagguuuuu

SEQ ID NO: 3211305 - RNA, 16 nt, Human
uuaguuuagaacaggu

SEQ ID NO: 3211306 - RNA, 14 nt, Human
auaauacuuuguau

SEQ ID NO: 3211307 - RNA, 15 nt, Human
auaauacuuuguaua

SEQ ID NO: 3211308 - RNA, 17 nt, Human
auaauacuuuguauaca

SEQ ID NO: 3211309 - RNA, 18 nt, Human
auaauacuuuguauacaa

SEQ ID NO: 3211310 - RNA, 19 nt, Human
auaauacuuuguauacaag

SEQ ID NO: 3211311 - RNA, 21 nt, Human
auaauacuuuguauacaagua

SEQ ID NO: 3211312 - RNA, 15 nt, Human
auaauaccuuagaag

SEQ ID NO: 3211313 - RNA, 22 nt, Human
auaauacacaaaaucaaauaau

SEQ ID NO: 3211314 - RNA, 17 nt, Human
auaauacacaaaaucaa

SEQ ID NO: 3211315 - RNA, 14 nt, Human
auaauacacaaaau

SEQ ID NO: 3211316 - RNA, 13 nt, Human
auaauacugaacc

SEQ ID NO: 3211317 - RNA, 14 nt, Human
auaauacugaacca

SEQ ID NO: 3211318 - RNA, 20 nt, Human
auaauacugaaccacuugua

SEQ ID NO: 3211319 - RNA, 15 nt, Human
auaauacugaaccac

SEQ ID NO: 3211320 - RNA, 16 nt, Human
auaauacugaaccacu

SEQ ID NO: 3211321 - RNA, 14 nt, Human
auaauaauuaguaa

SEQ ID NO: 3211322 - RNA, 13 nt, Human
uuagaacagguuu

SEQ ID NO: 3211323 - RNA, 14 nt, Human
uuagaacagguuuu

SEQ ID NO: 3211324 - RNA, 20 nt, Human
auaagaauagaacaacauau

SEQ ID NO: 3211325 - RNA, 12 nt, Human
auaauaaaauca

SEQ ID NO: 3211326 - RNA, 13 nt, Human
auaauaaaaucac

SEQ ID NO: 3211327 - RNA, 23 nt, Human
auaauaaagaauagcuuuaauga

SEQ ID NO: 3211328 - RNA, 14 nt, Human
auaauaaagaauag

SEQ ID NO: 3211329 - RNA, 13 nt, Human
auaauaaagaaua

SEQ ID NO: 3211330 - RNA, 18 nt, Human
auaauagauugugaauaa

SEQ ID NO: 3211331 - RNA, 19 nt, Human
auaauagucaccugcuguu

SEQ ID NO: 3211332 - RNA, 18 nt, Human
auaauccuugauaauaua

SEQ ID NO: 3211333 - RNA, 19 nt, Human
auaauccuugauaauauau

SEQ ID NO: 3211334 - RNA, 15 nt, Human
auaauccugcaaagu

SEQ ID NO: 3211335 - RNA, 14 nt, Human
auaauccugcaaag

SEQ ID NO: 3211336 - RNA, 16 nt, Human
auaaucucuucuuaua

SEQ ID NO: 3211337 - RNA, 20 nt, Human
auaaucuggacuccucuguc

SEQ ID NO: 3211338 - RNA, 19 nt, Human
auaaucuggacuccucugu

SEQ ID NO: 3211339 - RNA, 18 nt, Human
auaaucuggacuccucug

SEQ ID NO: 3211340 - RNA, 18 nt, Human
auaauccugcaaaguaca

SEQ ID NO: 3211341 - RNA, 22 nt, Human
auaauugacaggauuauuggaa

SEQ ID NO: 3211342 - RNA, 19 nt, Human
auaauucuuuuuuauuaau

SEQ ID NO: 3211343 - RNA, 21 nt, Human
auaauucuuuuuuauuaauca

SEQ ID NO: 3211344 - RNA, 22 nt, Human
auaauucuuuuuuauuaaucac

SEQ ID NO: 3211345 - RNA, 14 nt, Human
auaauugugugaua

SEQ ID NO: 3211346 - RNA, 14 nt, Human
auaauucuuuuuua

SEQ ID NO: 3211347 - RNA, 17 nt, Human
auaauucuuuuuuauua

SEQ ID NO: 3211348 - RNA, 15 nt, Human
auaaugccuuuguaa

SEQ ID NO: 3211349 - RNA, 16 nt, Human
auaaugccuuuguaac

SEQ ID NO: 3211350 - RNA, 15 nt, Human
auaaugaaugaaaca

SEQ ID NO: 3211351 - RNA, 19 nt, Human
auaaugaucgaaaaaauaa

SEQ ID NO: 3211352 - RNA, 20 nt, Human
auaaugaucgaaaaaauaau

SEQ ID NO: 3211353 - RNA, 12 nt, Human
auaaugaaugac

SEQ ID NO: 3211354 - RNA, 15 nt, Human
auaaauaguuuauga

SEQ ID NO: 3211355 - RNA, 15 nt, Human
auaaauaguguuauu

SEQ ID NO: 3211356 - RNA, 19 nt, Human
auaaaggugugcugugucc

SEQ ID NO: 3211357 - RNA, 15 nt, Human
uuaauugucuugcac

SEQ ID NO: 3211358 - RNA, 16 nt, Human
uuaauugugugaacuu

SEQ ID NO: 3211359 - RNA, 13 nt, Human
uuaauuguauuuu

SEQ ID NO: 3211360 - RNA, 11 nt, Human
auaaauuauuu

SEQ ID NO: 3211361 - RNA, 20 nt, Human
auaaauccacccauguuauc

SEQ ID NO: 3211362 - RNA, 12 nt, Human
auaaaucauaaa

SEQ ID NO: 3211363 - RNA, 15 nt, Human
auaaaucauaaaguc

SEQ ID NO: 3211364 - RNA, 16 nt, Human
auaaaucauaaaguca

SEQ ID NO: 3211365 - RNA, 18 nt, Human
auaaaucauaaagucagu

SEQ ID NO: 3211366 - RNA, 18 nt, Human
auaaauccacccauguua

SEQ ID NO: 3211367 - RNA, 14 nt, Human
auaaccuaauuaau

SEQ ID NO: 3211368 - RNA, 15 nt, Human
auaaccuaguuaaag

SEQ ID NO: 3211369 - RNA, 17 nt, Human
auaaccuaguuaaagaa

SEQ ID NO: 3211370 - RNA, 19 nt, Human
auaaccuaguuaaagaaag

SEQ ID NO: 3211371 - RNA, 20 nt, Human
auaaccuaguuaaagaaagg

SEQ ID NO: 3211372 - RNA, 17 nt, Human
uuacccuauaucuauaa

SEQ ID NO: 3211373 - RNA, 21 nt, Human
uuaccucccuacuuucuuaga

SEQ ID NO: 3211374 - RNA, 17 nt, Human
uuaccucaacaagaaga

SEQ ID NO: 3211375 - RNA, 15 nt, Human
auaacuuauauugua

SEQ ID NO: 3211376 - RNA, 16 nt, Human
uuacaggcuccugcca

SEQ ID NO: 3211377 - RNA, 18 nt, Human
uuacaggcuccugccacc

SEQ ID NO: 3211378 - RNA, 24 nt, Human
uuacaggcgugagccaccgugccu

SEQ ID NO: 3211379 - RNA, 12 nt, Human
uuagaaacugga

SEQ ID NO: 3211380 - RNA, 22 nt, Human
uuagaaacacauaauuaacacu

SEQ ID NO: 3211381 - RNA, 14 nt, Human
uuacucuugggaca

SEQ ID NO: 3211382 - RNA, 23 nt, Human
uuagaaacuggaaauacuagauu

SEQ ID NO: 3211383 - RNA, 19 nt, Human
uuagaaacuggaaauacua

SEQ ID NO: 3211384 - RNA, 13 nt, Human
uuagaaacuggaa

SEQ ID NO: 3211385 - RNA, 23 nt, Human
uuacucuucaguuaagccuuugg

SEQ ID NO: 3211386 - RNA, 12 nt, Human
uuacucuuggga

SEQ ID NO: 3211387 - RNA, 18 nt, Human
uuaccuugaacugaaggc

SEQ ID NO: 3211388 - RNA, 20 nt, Human
uuaccuugucauuuuggucu

SEQ ID NO: 3211389 - RNA, 16 nt, Human
uuaccuugucauuuug

SEQ ID NO: 3211390 - RNA, 13 nt, Human
uuagacagucccu

SEQ ID NO: 3211391 - RNA, 20 nt, Human
uuagacagagucucacuguu

SEQ ID NO: 3211392 - RNA, 13 nt, Human
uuagacagagucu

SEQ ID NO: 3211393 - RNA, 17 nt, Human
uuagaaauugcauuucc

SEQ ID NO: 3211394 - RNA, 18 nt, Human
aguuuaaauauuaagcau

SEQ ID NO: 3211395 - RNA, 20 nt, Human
aguuuaaauauuaagcauga

SEQ ID NO: 3211396 - RNA, 14 nt, Human
aguugguauuaaua

SEQ ID NO: 3211397 - RNA, 19 nt, Human
aguugguauuaauaaaaag

SEQ ID NO: 3211398 - RNA, 17 nt, Human
aguuggucccccuucca

SEQ ID NO: 3211399 - RNA, 11 nt, Human
aguuggucccc

SEQ ID NO: 3211400 - RNA, 13 nt, Human
aguuggucccccu

SEQ ID NO: 3211401 - RNA, 13 nt, Human
uuaaaaaaaaucc

SEQ ID NO: 3211402 - RNA, 19 nt, Human
uuaaaaaaaauuugcucau

SEQ ID NO: 3211403 - RNA, 21 nt, Human
uuaaaaaaaaucaucauuauu

SEQ ID NO: 3211404 - RNA, 23 nt, Human
aguuuaauugaaagaauguaaag

SEQ ID NO: 3211405 - RNA, 21 nt, Human
uuaaaaaaaacucuuuaacuu

SEQ ID NO: 3211406 - RNA, 17 nt, Human
uuaaaaaaaacucuuua

SEQ ID NO: 3211407 - RNA, 23 nt, Human
aguugccagucaccccggccacc

SEQ ID NO: 3211408 - RNA, 20 nt, Human
aguugccagucaccccggcc

SEQ ID NO: 3211409 - RNA, 22 nt, Human
aguugccgcauauuauaucaga

SEQ ID NO: 3211410 - RNA, 19 nt, Human
aguugcccagccucuuucc

SEQ ID NO: 3211411 - RNA, 15 nt, Human
aguugcugguaaaau

SEQ ID NO: 3211412 - RNA, 17 nt, Human
aguugcugguaaaauga

SEQ ID NO: 3211413 - RNA, 18 nt, Human
aguugcugguaaaaugaa

SEQ ID NO: 3211414 - RNA, 21 nt, Human
aguugcugguaaaaugaagaa

SEQ ID NO: 3211415 - RNA, 14 nt, Human
aguugcccagccuc

SEQ ID NO: 3211416 - RNA, 16 nt, Human
aguuggggcagaggag

SEQ ID NO: 3211417 - RNA, 17 nt, Human
aguuggggacagaacuc

SEQ ID NO: 3211418 - RNA, 19 nt, Human
aguugggcuuccucauagu

SEQ ID NO: 3211419 - RNA, 21 nt, Human
aguuggaguucauucauauua

SEQ ID NO: 3211420 - RNA, 20 nt, Human
aguuggaguucauucauauu

SEQ ID NO: 3211421 - RNA, 23 nt, Human
aguuggaguucauucauauuaca

SEQ ID NO: 3211422 - RNA, 13 nt, Human
aguugggcuuccu

SEQ ID NO: 3211423 - RNA, 19 nt, Human
aguuggaguucauucauau

SEQ ID NO: 3211424 - RNA, 17 nt, Human
aguuggaguagaaugua

SEQ ID NO: 3211425 - RNA, 23 nt, Human
aguuggaaacacuaaauguuaaa

SEQ ID NO: 3211426 - RNA, 16 nt, Human
aguuggaguagaaugu

SEQ ID NO: 3211427 - RNA, 22 nt, Human
aguuggaaacacuaaauguuaa

SEQ ID NO: 3211428 - RNA, 21 nt, Human
aguuggaaacacuaaauguua

SEQ ID NO: 3211429 - RNA, 20 nt, Human
aguuggaaacacuaaauguu

SEQ ID NO: 3211430 - RNA, 19 nt, Human
aguuggaaacacuaaaugu

SEQ ID NO: 3211431 - RNA, 13 nt, Human
aguuggaaacacu

SEQ ID NO: 3211432 - RNA, 14 nt, Human
aguugcuguuuacu

SEQ ID NO: 3211433 - RNA, 23 nt, Human
aguugcugucagucuugaccucu

SEQ ID NO: 3211434 - RNA, 21 nt, Human
aguugcugucagucuugaccu

SEQ ID NO: 3211435 - RNA, 15 nt, Human
uuaacacuacucaaa

SEQ ID NO: 3211436 - RNA, 17 nt, Human
uuaacacuacucaaagc

SEQ ID NO: 3211437 - RNA, 12 nt, Human
uuaacaagaagc

SEQ ID NO: 3211438 - RNA, 15 nt, Human
uuaacaaugccuauu

SEQ ID NO: 3211439 - RNA, 19 nt, Human
uuaacaaugccuauuguaa

SEQ ID NO: 3211440 - RNA, 20 nt, Human
uuaacaaugccuauuguaau

SEQ ID NO: 3211441 - RNA, 21 nt, Human
uuaacaaugccuauuguaaua

SEQ ID NO: 3211442 - RNA, 20 nt, Human
uuaaagugaggccacugaag

SEQ ID NO: 3211443 - RNA, 20 nt, Human
uuaaaguaugcauuauuaaa

SEQ ID NO: 3211444 - RNA, 23 nt, Human
uuaaaguaugcauuauuaaauug

SEQ ID NO: 3211445 - RNA, 22 nt, Human
uuaaaguaauuguuccagagac

SEQ ID NO: 3211446 - RNA, 20 nt, Human
uuaaaguaauuguuccagag

SEQ ID NO: 3211447 - RNA, 16 nt, Human
uuaaaguaauuguucc

SEQ ID NO: 3211448 - RNA, 14 nt, Human
uuaaacaaaguuuc

SEQ ID NO: 3211449 - RNA, 17 nt, Human
uuaaacaaaguuucaga

SEQ ID NO: 3211450 - RNA, 16 nt, Human
uuaaacaauaaagcaa

SEQ ID NO: 3211451 - RNA, 13 nt, Human
uuaaacagaggau

SEQ ID NO: 3211452 - RNA, 17 nt, Human
uuaagucuaucugguau

SEQ ID NO: 3211453 - RNA, 9 nt, Human
uuaaggugg

SEQ ID NO: 3211454 - RNA, 19 nt, Human
uuaaggugagcauaaauca

SEQ ID NO: 3211455 - RNA, 20 nt, Human
uuaaggugagcauaaaucaa

SEQ ID NO: 3211456 - RNA, 13 nt, Human
uuaaggucuguuu

SEQ ID NO: 3211457 - RNA, 14 nt, Human
uuaagguguuugaa

SEQ ID NO: 3211458 - RNA, 16 nt, Human
uuaagguguuugaaaa

SEQ ID NO: 3211459 - RNA, 17 nt, Human
uuaagguguuugaaaau

SEQ ID NO: 3211460 - RNA, 22 nt, Human
uuaagguguuugaaaauaguuu

SEQ ID NO: 3211461 - RNA, 22 nt, Human
uuaagaaagacuaucuaaaugu

SEQ ID NO: 3211462 - RNA, 12 nt, Human
uuaagaaauaaa

SEQ ID NO: 3211463 - RNA, 20 nt, Human
uuaagaaagaaauacuguau

SEQ ID NO: 3211464 - RNA, 22 nt, Human
uuaagaaauagacagcaugaga

SEQ ID NO: 3211465 - RNA, 13 nt, Human
uuaagaagaaacu

SEQ ID NO: 3211466 - RNA, 16 nt, Human
uuaaucuuaauguaua

SEQ ID NO: 3211467 - RNA, 17 nt, Human
uuaaucuuaauguauau

SEQ ID NO: 3211468 - RNA, 18 nt, Human
uuaaucucuaacagugga

SEQ ID NO: 3211469 - RNA, 22 nt, Human
uuaaucugguuuauuuuuguuc

SEQ ID NO: 3211470 - RNA, 18 nt, Human
uuaaugaaagacuguaca

SEQ ID NO: 3211471 - RNA, 20 nt, Human
uuaaucuuuucuuauuuuug

SEQ ID NO: 3211472 - RNA, 19 nt, Human
uuaaugaaagacuguacaa

SEQ ID NO: 3211473 - RNA, 13 nt, Human
uuaauugaaaaga

SEQ ID NO: 3211474 - RNA, 21 nt, Human
uuaauugaaaagaaguagugu

SEQ ID NO: 3211475 - RNA, 23 nt, Human
uuaauugaaaagaaguagugucu

SEQ ID NO: 3211476 - RNA, 16 nt, Human
uuaauugaucaguuuu

SEQ ID NO: 3211477 - RNA, 17 nt, Human
uuaauugauagaauaaa

SEQ ID NO: 3211478 - RNA, 12 nt, Human
uuaauugcugag

SEQ ID NO: 3211479 - RNA, 20 nt, Human
uuaauugaaagaauguaaag

SEQ ID NO: 3211480 - RNA, 16 nt, Human
uuaauugaaagaaugu

SEQ ID NO: 3211481 - RNA, 18 nt, Human
uuaaucaugaauaugaug

SEQ ID NO: 3211482 - RNA, 12 nt, Human
uuaauauuucuu

SEQ ID NO: 3211483 - RNA, 14 nt, Human
uuaauauuucuuca

SEQ ID NO: 3211484 - RNA, 17 nt, Human
uuaauauuuuuacaugc

SEQ ID NO: 3211485 - RNA, 22 nt, Human
uuaauauuuauaggucacuuug

SEQ ID NO: 3211486 - RNA, 12 nt, Human
uuaauauuuguu

SEQ ID NO: 3211487 - RNA, 16 nt, Human
uuaauauuuguuuagu

SEQ ID NO: 3211488 - RNA, 21 nt, Human
uuaaucugggccagaauuuca

SEQ ID NO: 3211489 - RNA, 17 nt, Human
uuaaucucuaacagugg

SEQ ID NO: 3211490 - RNA, 21 nt, Human
uuaaucuacugcauuuaggga

SEQ ID NO: 3211491 - RNA, 19 nt, Human
uuaauauuuuuacaugcag

SEQ ID NO: 3211492 - RNA, 15 nt, Human
auaaaagcccaggag

SEQ ID NO: 3211493 - RNA, 13 nt, Human
auaaaagcccagg

SEQ ID NO: 3211494 - RNA, 16 nt, Human
auaaaagcccaggagc

SEQ ID NO: 3211495 - RNA, 13 nt, Human
auaaaauaacuaa

SEQ ID NO: 3211496 - RNA, 17 nt, Human
auaaaauaacuaaaaug

SEQ ID NO: 3211497 - RNA, 18 nt, Human
auaaaauaacuaaaaugu

SEQ ID NO: 3211498 - RNA, 19 nt, Human
auaaaauaacuaaaaugua

SEQ ID NO: 3211499 - RNA, 22 nt, Human
auaaaauaauuuuaucucuuuc

SEQ ID NO: 3211500 - RNA, 14 nt, Human
auaaaauauuuucu

SEQ ID NO: 3211501 - RNA, 15 nt, Human
auaaaauauuuucug

SEQ ID NO: 3211502 - RNA, 16 nt, Human
auaaaauauuuucugu

SEQ ID NO: 3211503 - RNA, 18 nt, Human
auaaaauauuuucugugu

SEQ ID NO: 3211504 - RNA, 20 nt, Human
auaaaauauuuucugugugu

SEQ ID NO: 3211505 - RNA, 21 nt, Human
auaaaauauuuucuguguguu

SEQ ID NO: 3211506 - RNA, 22 nt, Human
auaaaauauuuucuguguguuc

SEQ ID NO: 3211507 - RNA, 23 nt, Human
auaaaauauuuucuguguguucc

SEQ ID NO: 3211508 - RNA, 23 nt, Human
aguuuucugagaaagacuauuca

SEQ ID NO: 3211509 - RNA, 14 nt, Human
aguuuugacaagcu

SEQ ID NO: 3211510 - RNA, 15 nt, Human
aguuuugacaagcug

SEQ ID NO: 3211511 - RNA, 18 nt, Human
aguuuugacaagcuggcu

SEQ ID NO: 3211512 - RNA, 17 nt, Human
aguuuucuuuuaauuuu

SEQ ID NO: 3211513 - RNA, 16 nt, Human
aguuuucuuuuaauuu

SEQ ID NO: 3211514 - RNA, 18 nt, Human
aguuuucugagaaagacu

SEQ ID NO: 3211515 - RNA, 19 nt, Human
aguuuucugagaaagacua

SEQ ID NO: 3211516 - RNA, 12 nt, Human
aguuuugugaaa

SEQ ID NO: 3211517 - RNA, 14 nt, Human
aguuuugugaaauu

SEQ ID NO: 3211518 - RNA, 13 nt, Human
aguuuugugaaau

SEQ ID NO: 3211519 - RNA, 17 nt, Human
aguuuugcauaguucua

SEQ ID NO: 3211520 - RNA, 19 nt, Human
aguuuugacaagcuggcuu

SEQ ID NO: 3211521 - RNA, 21 nt, Human
aguuuugcuuuuaguuuuucu

SEQ ID NO: 3211522 - RNA, 20 nt, Human
aguuuugggaaguuaaaggg

SEQ ID NO: 3211523 - RNA, 19 nt, Human
aguuuugggaaguuaaagg

SEQ ID NO: 3211524 - RNA, 16 nt, Human
aguuuugggaaguuaa

SEQ ID NO: 3211525 - RNA, 23 nt, Human
aguuuugcuuuuaguuuuucugu

SEQ ID NO: 3211526 - RNA, 16 nt, Human
acaucuugcucugcug

SEQ ID NO: 3211527 - RNA, 15 nt, Human
acaucuugcucugcu

SEQ ID NO: 3211528 - RNA, 18 nt, Human
uaugugggggucugugug

SEQ ID NO: 3211529 - RNA, 19 nt, Human
uaugugggggucugugugu

SEQ ID NO: 3211530 - RNA, 20 nt, Human
uaugugggggucuguguguu

SEQ ID NO: 3211531 - RNA, 17 nt, Human
acaucuugcucugcuga

SEQ ID NO: 3211532 - RNA, 22 nt, Human
acaucuugcucugcugacagac

SEQ ID NO: 3211533 - RNA, 19 nt, Human
acaucuuggucagauuuga

SEQ ID NO: 3211534 - RNA, 14 nt, Human
acaucuugcucugc

SEQ ID NO: 3211535 - RNA, 16 nt, Human
acaucuuuauugaaau

SEQ ID NO: 3211536 - RNA, 18 nt, Human
acaucuuuauugaaauuc

SEQ ID NO: 3211537 - RNA, 19 nt, Human
acaucuuuauugaaauucu

SEQ ID NO: 3211538 - RNA, 22 nt, Human
acaucuuuauugaaauucuauu

SEQ ID NO: 3211539 - RNA, 13 nt, Human
uauuuuaaaauuu

SEQ ID NO: 3211540 - RNA, 15 nt, Human
uauuuuaaaauuuca

SEQ ID NO: 3211541 - RNA, 16 nt, Human
uauuuuaaaauaaacu

SEQ ID NO: 3211542 - RNA, 13 nt, Human
uauuuuaaaacaa

SEQ ID NO: 3211543 - RNA, 19 nt, Human
uauuuuaaaaucuccuaaa

SEQ ID NO: 3211544 - RNA, 21 nt, Human
uauuuuaaaagauaaauauua

SEQ ID NO: 3211545 - RNA, 19 nt, Human
uauuuguuuaguucagcaa

SEQ ID NO: 3211546 - RNA, 21 nt, Human
uauuuguuuaguucagcaaaa

SEQ ID NO: 3211547 - RNA, 14 nt, Human
uauuuguaguguua

SEQ ID NO: 3211548 - RNA, 20 nt, Human
uauuuguacuuucuguuaaa

SEQ ID NO: 3211549 - RNA, 15 nt, Human
uauuuguacuuucug

SEQ ID NO: 3211550 - RNA, 17 nt, Human
uauuuguacuuucuguu

SEQ ID NO: 3211551 - RNA, 16 nt, Human
uauuuguacuuucugu

SEQ ID NO: 3211552 - RNA, 12 nt, Human
uauuugugugcu

SEQ ID NO: 3211553 - RNA, 15 nt, Human
uauuugugugcuaaa

SEQ ID NO: 3211554 - RNA, 14 nt, Human
uauuugucucagau

SEQ ID NO: 3211555 - RNA, 20 nt, Human
uauuugucaguguagaucaa

SEQ ID NO: 3211556 - RNA, 14 nt, Human
uauuuguaugauau

SEQ ID NO: 3211557 - RNA, 20 nt, Human
uauuuguaugauauuuuaaa

SEQ ID NO: 3211558 - RNA, 17 nt, Human
uauuuguauuuauucuu

SEQ ID NO: 3211559 - RNA, 22 nt, Human
uauuuguguguucacuaaacuc

SEQ ID NO: 3211560 - RNA, 18 nt, Human
uauuugugugcuaaacgu

SEQ ID NO: 3211561 - RNA, 17 nt, Human
uauuuuuguagagccag

SEQ ID NO: 3211562 - RNA, 15 nt, Human
uauuuuuaaaggcau

SEQ ID NO: 3211563 - RNA, 18 nt, Human
uauuuuuaagaaagaaau

SEQ ID NO: 3211564 - RNA, 13 nt, Human
uauuuuucaaaau

SEQ ID NO: 3211565 - RNA, 23 nt, Human
uauuuugugaguuuguuucuuug

SEQ ID NO: 3211566 - RNA, 14 nt, Human
uauuuuguaaaaug

SEQ ID NO: 3211567 - RNA, 16 nt, Human
uauuuuguaaaaugua

SEQ ID NO: 3211568 - RNA, 17 nt, Human
uauuuuguaaaauguau

SEQ ID NO: 3211569 - RNA, 18 nt, Human
uauuuuguaaaauguauu

SEQ ID NO: 3211570 - RNA, 19 nt, Human
uauuuuguaaaauguauua

SEQ ID NO: 3211571 - RNA, 22 nt, Human
uauuuuguaaaauguauuaugu

SEQ ID NO: 3211572 - RNA, 15 nt, Human
uauuuuguaugaaau

SEQ ID NO: 3211573 - RNA, 22 nt, Human
uauuuuguaugcaagcaguuuc

SEQ ID NO: 3211574 - RNA, 20 nt, Human
uauuuuguaugcaagcaguu

SEQ ID NO: 3211575 - RNA, 16 nt, Human
uauuuuguaugcaagc

SEQ ID NO: 3211576 - RNA, 14 nt, Human
uauuuuguaugcaa

SEQ ID NO: 3211577 - RNA, 13 nt, Human
uauuuuguaugca

SEQ ID NO: 3211578 - RNA, 12 nt, Human
uauuuuguaugc

SEQ ID NO: 3211579 - RNA, 17 nt, Human
uauuuugugaguuuguu

SEQ ID NO: 3211580 - RNA, 14 nt, Human
uauuuugugaguuu

SEQ ID NO: 3211581 - RNA, 16 nt, Human
uauuuuaaucucagaa

SEQ ID NO: 3211582 - RNA, 16 nt, Human
uauuuuaauuucaagc

SEQ ID NO: 3211583 - RNA, 15 nt, Human
uauuuuaauuucaag

SEQ ID NO: 3211584 - RNA, 14 nt, Human
uauuuuaauuucaa

SEQ ID NO: 3211585 - RNA, 13 nt, Human
uauuuuaauuuca

SEQ ID NO: 3211586 - RNA, 21 nt, Human
uauuuuacuuggaaauauuaa

SEQ ID NO: 3211587 - RNA, 17 nt, Human
uauuuugauguaaagau

SEQ ID NO: 3211588 - RNA, 20 nt, Human
ucaaauaggcuauuaaaaaa

SEQ ID NO: 3211589 - RNA, 23 nt, Human
ucaaauaggcuauuaaaaaaguc

SEQ ID NO: 3211590 - RNA, 15 nt, Human
ucaaauaguugcaua

SEQ ID NO: 3211591 - RNA, 21 nt, Human
ucaaagcaccaaaauaagaaa

SEQ ID NO: 3211592 - RNA, 14 nt, Human
ucaaagugcuauua

SEQ ID NO: 3211593 - RNA, 16 nt, Human
ucaaaguggaugcaau

SEQ ID NO: 3211594 - RNA, 18 nt, Human
ucaaagucucaaugaaau

SEQ ID NO: 3211595 - RNA, 20 nt, Human
ucaaagucucaaugaaauag

SEQ ID NO: 3211596 - RNA, 22 nt, Human
ucaaagucaugauguuuuuaaa

SEQ ID NO: 3211597 - RNA, 21 nt, Human
ucaaagucaugauguuuuuaa

SEQ ID NO: 3211598 - RNA, 19 nt, Human
ucaaagucaugauguuuuu

SEQ ID NO: 3211599 - RNA, 17 nt, Human
ucaaagucaugauguuu

SEQ ID NO: 3211600 - RNA, 16 nt, Human
ucaaagucaugauguu

SEQ ID NO: 3211601 - RNA, 15 nt, Human
ucaaagucagaacaa

SEQ ID NO: 3211602 - RNA, 13 nt, Human
acaugagcaucag

SEQ ID NO: 3211603 - RNA, 15 nt, Human
acaugacucuuuauu

SEQ ID NO: 3211604 - RNA, 17 nt, Human
acaugacucuuuauugu

SEQ ID NO: 3211605 - RNA, 19 nt, Human
acaugacucuuuauugucu

SEQ ID NO: 3211606 - RNA, 20 nt, Human
acaugacucuuuauugucug

SEQ ID NO: 3211607 - RNA, 21 nt, Human
acaugacucuuuauugucugu

SEQ ID NO: 3211608 - RNA, 22 nt, Human
acaugacucuuuauugucugua

SEQ ID NO: 3211609 - RNA, 23 nt, Human
acaugacucuuuauugucuguaa

SEQ ID NO: 3211610 - RNA, 16 nt, Human
ucaaaagcugggcagg

SEQ ID NO: 3211611 - RNA, 17 nt, Human
ucaaaaguagaacuuug

SEQ ID NO: 3211612 - RNA, 18 nt, Human
ucaaaaguagaacuuugu

SEQ ID NO: 3211613 - RNA, 23 nt, Human
ucaaaaguagaacuuuguauagu

SEQ ID NO: 3211614 - RNA, 13 nt, Human
ucaaacagucuca

SEQ ID NO: 3211615 - RNA, 18 nt, Human
ucaaacacuugugacuuu

SEQ ID NO: 3211616 - RNA, 21 nt, Human
ucaaacagucucaggaaauca

SEQ ID NO: 3211617 - RNA, 20 nt, Human
ucaaacagucucaggaaauc

SEQ ID NO: 3211618 - RNA, 19 nt, Human
ucaaacacuugugacuuuu

SEQ ID NO: 3211619 - RNA, 15 nt, Human
ucaaagcaaaagugc

SEQ ID NO: 3211620 - RNA, 16 nt, Human
ucaaagcaaaagugcu

SEQ ID NO: 3211621 - RNA, 15 nt, Human
ucaaagcaaaugucu

SEQ ID NO: 3211622 - RNA, 23 nt, Human
ucaaagcaaaugucuuccuggau

SEQ ID NO: 3211623 - RNA, 20 nt, Human
ucaaagcaccaaaauaagaa

SEQ ID NO: 3211624 - RNA, 18 nt, Human
ucaaagcaccaaaauaag

SEQ ID NO: 3211625 - RNA, 14 nt, Human
acauggauucaguu

SEQ ID NO: 3211626 - RNA, 19 nt, Human
acauggauucaguuucuaa

SEQ ID NO: 3211627 - RNA, 19 nt, Human
acauggaguauaugucaag

SEQ ID NO: 3211628 - RNA, 15 nt, Human
acauggaguauaugu

SEQ ID NO: 3211629 - RNA, 18 nt, Human
acauggaauaacauguaa

SEQ ID NO: 3211630 - RNA, 14 nt, Human
acauggaaguacua

SEQ ID NO: 3211631 - RNA, 20 nt, Human
acauggaauaacauguaauu

SEQ ID NO: 3211632 - RNA, 20 nt, Human
acauggaauauauuuuaaua

SEQ ID NO: 3211633 - RNA, 19 nt, Human
acauggaaugaggguuuga

SEQ ID NO: 3211634 - RNA, 20 nt, Human
acaugagcaucaggccaggc

SEQ ID NO: 3211635 - RNA, 23 nt, Human
acaugagcaucaggccaggcccu

SEQ ID NO: 3211636 - RNA, 21 nt, Human
acaugucuuuucuugcaugag

SEQ ID NO: 3211637 - RNA, 19 nt, Human
acauuaauccacauguuuc

SEQ ID NO: 3211638 - RNA, 22 nt, Human
acauuaauccacauguuucaga

SEQ ID NO: 3211639 - RNA, 13 nt, Human
acauuaauguuga

SEQ ID NO: 3211640 - RNA, 18 nt, Human
acauuaauguugauuucu

SEQ ID NO: 3211641 - RNA, 17 nt, Human
acauuaauguugauuuc

SEQ ID NO: 3211642 - RNA, 15 nt, Human
acauuaauguugauu

SEQ ID NO: 3211643 - RNA, 14 nt, Human
acauuaauguugau

SEQ ID NO: 3211644 - RNA, 23 nt, Human
acauuaauguugauuucuaguua

SEQ ID NO: 3211645 - RNA, 22 nt, Human
acauuaauguugauuucuaguu

SEQ ID NO: 3211646 - RNA, 21 nt, Human
acauuaauguugauuucuagu

SEQ ID NO: 3211647 - RNA, 22 nt, Human
acauguauuaaauuacauuugu

SEQ ID NO: 3211648 - RNA, 21 nt, Human
acauguauuaaauuacauuug

SEQ ID NO: 3211649 - RNA, 20 nt, Human
acauguauuaaauuacauuu

SEQ ID NO: 3211650 - RNA, 19 nt, Human
acauguauuaaauuacauu

SEQ ID NO: 3211651 - RNA, 14 nt, Human
acauguauuaaauu

SEQ ID NO: 3211652 - RNA, 15 nt, Human
acaugguuugacucu

SEQ ID NO: 3211653 - RNA, 14 nt, Human
acaugguuuaaaag

SEQ ID NO: 3211654 - RNA, 21 nt, Human
acaugguuuaaaagaaaaaau

SEQ ID NO: 3211655 - RNA, 20 nt, Human
acaugguuaccucugcauaa

SEQ ID NO: 3211656 - RNA, 23 nt, Human
acaugguggggucuccucaggac

SEQ ID NO: 3211657 - RNA, 19 nt, Human
acaugguggggucuccuca

SEQ ID NO: 3211658 - RNA, 14 nt, Human
accaaaaagaaaaa

SEQ ID NO: 3211659 - RNA, 12 nt, Human
accaaaaaauau

SEQ ID NO: 3211660 - RNA, 19 nt, Human
accaaaucagcugcuacua

SEQ ID NO: 3211661 - RNA, 16 nt, Human
accaaaucagcugcua

SEQ ID NO: 3211662 - RNA, 21 nt, Human
accaaauaucaccaggacugu

SEQ ID NO: 3211663 - RNA, 16 nt, Human
accaaauagugugaaa

SEQ ID NO: 3211664 - RNA, 18 nt, Human
accaaauagugugaaaua

SEQ ID NO: 3211665 - RNA, 19 nt, Human
accaacacgagcaggcuac

SEQ ID NO: 3211666 - RNA, 11 nt, Human
accaacaccau

SEQ ID NO: 3211667 - RNA, 16 nt, Human
accaacaccaucacag

SEQ ID NO: 3211668 - RNA, 21 nt, Human
accaacaccaucacagcuugu

SEQ ID NO: 3211669 - RNA, 22 nt, Human
accaacaccaucacagcuuguu

SEQ ID NO: 3211670 - RNA, 22 nt, Human
accaacaagaauaaaggcagcu

SEQ ID NO: 3211671 - RNA, 13 nt, Human
accaaauuuuaau

SEQ ID NO: 3211672 - RNA, 14 nt, Human
accaaauuuuaauu

SEQ ID NO: 3211673 - RNA, 14 nt, Human
accaacacgagcag

SEQ ID NO: 3211674 - RNA, 15 nt, Human
accaaauuaaaaaaa

SEQ ID NO: 3211675 - RNA, 18 nt, Human
accaaauguaacuauguu

SEQ ID NO: 3211676 - RNA, 15 nt, Human
accaaaugguacaaa

SEQ ID NO: 3211677 - RNA, 13 nt, Human
accaaaugguaca

SEQ ID NO: 3211678 - RNA, 14 nt, Human
accaaauggaaaca

SEQ ID NO: 3211679 - RNA, 20 nt, Human
accaaccacugcgaccacaa

SEQ ID NO: 3211680 - RNA, 16 nt, Human
accaacauacucccau

SEQ ID NO: 3211681 - RNA, 15 nt, Human
accaacccucagagc

SEQ ID NO: 3211682 - RNA, 21 nt, Human
accaaucuuacuuuguaaauu

SEQ ID NO: 3211683 - RNA, 23 nt, Human
accaaucuuacuuuguaaauucu

SEQ ID NO: 3211684 - RNA, 17 nt, Human
accaaucuuacuuugua

SEQ ID NO: 3211685 - RNA, 18 nt, Human
accaaucuuacuuuguaa

SEQ ID NO: 3211686 - RNA, 19 nt, Human
accaaucuuacuuuguaaa

SEQ ID NO: 3211687 - RNA, 20 nt, Human
accaaucuuacuuuguaaau

SEQ ID NO: 3211688 - RNA, 15 nt, Human
accaaucuuacuuug

SEQ ID NO: 3211689 - RNA, 16 nt, Human
accaaucuuacuuugu

SEQ ID NO: 3211690 - RNA, 23 nt, Human
accacacccagcccacuucugcc

SEQ ID NO: 3211691 - RNA, 21 nt, Human
accacacccagcccacuucug

SEQ ID NO: 3211692 - RNA, 20 nt, Human
accacacccagcccacuucu

SEQ ID NO: 3211693 - RNA, 16 nt, Human
accacacccagcccac

SEQ ID NO: 3211694 - RNA, 15 nt, Human
accacacccagccca

SEQ ID NO: 3211695 - RNA, 21 nt, Human
accacacauuucacugucugu

SEQ ID NO: 3211696 - RNA, 14 nt, Human
accacacauuucac

SEQ ID NO: 3211697 - RNA, 17 nt, Human
accacacagaggcugcc

SEQ ID NO: 3211698 - RNA, 23 nt, Human
accacacaacauccaaguggccu

SEQ ID NO: 3211699 - RNA, 12 nt, Human
ucaauuuaaaaa

SEQ ID NO: 3211700 - RNA, 13 nt, Human
accacacccaacu

SEQ ID NO: 3211701 - RNA, 13 nt, Human
ucaauuuaaaaaa

SEQ ID NO: 3211702 - RNA, 21 nt, Human
ucacagaacccuuggagccaa

SEQ ID NO: 3211703 - RNA, 14 nt, Human
ucaauuuaaguguu

SEQ ID NO: 3211704 - RNA, 21 nt, Human
ucaauuuaaguguuggaaaaa

SEQ ID NO: 3211705 - RNA, 21 nt, Human
ucacagacaggaccccugcag

SEQ ID NO: 3211706 - RNA, 20 nt, Human
ucacagacaggaccccugca

SEQ ID NO: 3211707 - RNA, 15 nt, Human
ucacagacaggaccc

SEQ ID NO: 3211708 - RNA, 14 nt, Human
ucacagacaggacc

SEQ ID NO: 3211709 - RNA, 11 nt, Human
ucacagacagg

SEQ ID NO: 3211710 - RNA, 23 nt, Human
ucacagccagacuggcacaguuu

SEQ ID NO: 3211711 - RNA, 17 nt, Human
ucacagccagacuggca

SEQ ID NO: 3211712 - RNA, 20 nt, Human
ucacagccagcgaacugaca

SEQ ID NO: 3211713 - RNA, 22 nt, Human
ucacagccaggcgcuagcacag

SEQ ID NO: 3211714 - RNA, 11 nt, Human
ucacagccagg

SEQ ID NO: 3211715 - RNA, 14 nt, Human
ucacagaugggugc

SEQ ID NO: 3211716 - RNA, 15 nt, Human
ucacagaugggugcu

SEQ ID NO: 3211717 - RNA, 20 nt, Human
ucacagcuaugcaaaaagcu

SEQ ID NO: 3211718 - RNA, 17 nt, Human
ucacagcuuguuuugga

SEQ ID NO: 3211719 - RNA, 18 nt, Human
ucacauggaaugaggguu

SEQ ID NO: 3211720 - RNA, 19 nt, Human
ucacauggaaugaggguuu

SEQ ID NO: 3211721 - RNA, 15 nt, Human
ucacaucccacccca

SEQ ID NO: 3211722 - RNA, 16 nt, Human
ucaccagccccagugc

SEQ ID NO: 3211723 - RNA, 17 nt, Human
ucaccagccccagugcc

SEQ ID NO: 3211724 - RNA, 20 nt, Human
ucacauguuuucaaauggag

SEQ ID NO: 3211725 - RNA, 18 nt, Human
ucacauguuuucaaaugg

SEQ ID NO: 3211726 - RNA, 17 nt, Human
ucacauguuuucaaaug

SEQ ID NO: 3211727 - RNA, 15 nt, Human
ucacauguuuucaaa

SEQ ID NO: 3211728 - RNA, 14 nt, Human
ucacauguuuucaa

SEQ ID NO: 3211729 - RNA, 12 nt, Human
ucacauguuuuc

SEQ ID NO: 3211730 - RNA, 23 nt, Human
ucacauguggggagguuaaucua

SEQ ID NO: 3211731 - RNA, 18 nt, Human
acauuuaaaacauuaaaa

SEQ ID NO: 3211732 - RNA, 14 nt, Human
acauuuaaaacauu

SEQ ID NO: 3211733 - RNA, 23 nt, Human
acauuguaagagagaugagcacu

SEQ ID NO: 3211734 - RNA, 22 nt, Human
acauugguucuuucauuugcuu

SEQ ID NO: 3211735 - RNA, 22 nt, Human
acauugcggacagccacggcca

SEQ ID NO: 3211736 - RNA, 21 nt, Human
acauugcggacagccacggcc

SEQ ID NO: 3211737 - RNA, 18 nt, Human
acauugcuuuuaaaacua

SEQ ID NO: 3211738 - RNA, 17 nt, Human
acauugcuuuuaaaacu

SEQ ID NO: 3211739 - RNA, 15 nt, Human
acauugcuuuuaaaa

SEQ ID NO: 3211740 - RNA, 14 nt, Human
acauugcuuuuaaa

SEQ ID NO: 3211741 - RNA, 22 nt, Human
acauuggaagcagguuaaaugu

SEQ ID NO: 3211742 - RNA, 21 nt, Human
acauuggaagcagguuaaaug

SEQ ID NO: 3211743 - RNA, 23 nt, Human
acauuggaagcagguuaaauguu

SEQ ID NO: 3211744 - RNA, 20 nt, Human
acauuggaagcagguuaaau

SEQ ID NO: 3211745 - RNA, 15 nt, Human
acauuggaagcaggu

SEQ ID NO: 3211746 - RNA, 12 nt, Human
acauuggaagca

SEQ ID NO: 3211747 - RNA, 18 nt, Human
acauuuuuagccuguguc

SEQ ID NO: 3211748 - RNA, 20 nt, Human
acauuuuuauaccuguuuaa

SEQ ID NO: 3211749 - RNA, 16 nt, Human
acauuuuuauaccugu

SEQ ID NO: 3211750 - RNA, 21 nt, Human
acauuuuuauaccuguuuaaa

SEQ ID NO: 3211751 - RNA, 14 nt, Human
acauuuuuugaaau

SEQ ID NO: 3211752 - RNA, 13 nt, Human
acauuuuuugaaa

SEQ ID NO: 3211753 - RNA, 15 nt, Human
acauuuuuugaaaug

SEQ ID NO: 3211754 - RNA, 20 nt, Human
acauuuuuugaaaugcugaa

SEQ ID NO: 3211755 - RNA, 13 nt, Human
acauuuuuuucua

SEQ ID NO: 3211756 - RNA, 20 nt, Human
acauuuuuuucuaccuauaa

SEQ ID NO: 3211757 - RNA, 18 nt, Human
accaaaaaaauccagaaa

SEQ ID NO: 3211758 - RNA, 13 nt, Human
acauuuuauuaag

SEQ ID NO: 3211759 - RNA, 14 nt, Human
acauuuaaaccuuu

SEQ ID NO: 3211760 - RNA, 16 nt, Human
acauuuaaaccuuuua

SEQ ID NO: 3211761 - RNA, 22 nt, Human
acauuuaaaacauuaaaauaua

SEQ ID NO: 3211762 - RNA, 22 nt, Human
ucaauaggaaaaacugauuuuu

SEQ ID NO: 3211763 - RNA, 20 nt, Human
ucaagugauucucaugccuc

SEQ ID NO: 3211764 - RNA, 13 nt, Human
ucaaguacacuga

SEQ ID NO: 3211765 - RNA, 18 nt, Human
ucaauaggaaaaacugau

SEQ ID NO: 3211766 - RNA, 19 nt, Human
ucaauaggaaaaacugauu

SEQ ID NO: 3211767 - RNA, 17 nt, Human
ucaauaggaaaaacuga

SEQ ID NO: 3211768 - RNA, 17 nt, Human
ucaagugauucuccugc

SEQ ID NO: 3211769 - RNA, 16 nt, Human
ucaagugauucuccug

SEQ ID NO: 3211770 - RNA, 21 nt, Human
ucaagugauucucaugccuca

SEQ ID NO: 3211771 - RNA, 22 nt, Human
ucaagugauucucaugccucag

SEQ ID NO: 3211772 - RNA, 17 nt, Human
ucaagagggucugagga

SEQ ID NO: 3211773 - RNA, 21 nt, Human
ucaagagggcacugguggccc

SEQ ID NO: 3211774 - RNA, 20 nt, Human
ucaagagggcacugguggcc

SEQ ID NO: 3211775 - RNA, 12 nt, Human
acauuauuacuu

SEQ ID NO: 3211776 - RNA, 12 nt, Human
acauuauucugg

SEQ ID NO: 3211777 - RNA, 14 nt, Human
acauuaucuucugg

SEQ ID NO: 3211778 - RNA, 23 nt, Human
ucaaggauccugagccagauuuc

SEQ ID NO: 3211779 - RNA, 11 nt, Human
ucaaggcucag

SEQ ID NO: 3211780 - RNA, 11 nt, Human
ucauaaaguca

SEQ ID NO: 3211781 - RNA, 13 nt, Human
ucauaaagugaga

SEQ ID NO: 3211782 - RNA, 22 nt, Human
ucauaaagugagaaaacuguga

SEQ ID NO: 3211783 - RNA, 16 nt, Human
ucauaagauauuuuau

SEQ ID NO: 3211784 - RNA, 19 nt, Human
ucaguuguuagugugucuu

SEQ ID NO: 3211785 - RNA, 16 nt, Human
ucaguuucaacaugaa

SEQ ID NO: 3211786 - RNA, 16 nt, Human
ucaguuuauguuuugg

SEQ ID NO: 3211787 - RNA, 15 nt, Human
ucaguuuauguuuug

SEQ ID NO: 3211788 - RNA, 14 nt, Human
ucaguuuauguuuu

SEQ ID NO: 3211789 - RNA, 16 nt, Human
ucaguauguggaagug

SEQ ID NO: 3211790 - RNA, 15 nt, Human
ucaguaguuugcauu

SEQ ID NO: 3211791 - RNA, 14 nt, Human
ucaguaguuugcau

SEQ ID NO: 3211792 - RNA, 19 nt, Human
ucagugccuuauggaacac

SEQ ID NO: 3211793 - RNA, 20 nt, Human
ucagugccuuauggaacacu

SEQ ID NO: 3211794 - RNA, 22 nt, Human
ucagugccuuauggaacacucu

SEQ ID NO: 3211795 - RNA, 23 nt, Human
ucagugccuuauggaacacucug

SEQ ID NO: 3211796 - RNA, 17 nt, Human
ucagugcuagcuuauuu

SEQ ID NO: 3211797 - RNA, 18 nt, Human
ucagugccuuauggaaca

SEQ ID NO: 3211798 - RNA, 13 nt, Human
ucaguggcagcug

SEQ ID NO: 3211799 - RNA, 17 nt, Human
ucaguuguuaguguguc

SEQ ID NO: 3211800 - RNA, 15 nt, Human
ucaguggcagcugcu

SEQ ID NO: 3211801 - RNA, 14 nt, Human
ucaguggcagcugc

SEQ ID NO: 3211802 - RNA, 21 nt, Human
ucagguggggucacucuggca

SEQ ID NO: 3211803 - RNA, 22 nt, Human
ucagguggggucacucuggcag

SEQ ID NO: 3211804 - RNA, 21 nt, Human
accgaaaacguggcugcuuca

SEQ ID NO: 3211805 - RNA, 22 nt, Human
accgaaaacguggcugcuucaa

SEQ ID NO: 3211806 - RNA, 18 nt, Human
ucaggugucccugcacuu

SEQ ID NO: 3211807 - RNA, 17 nt, Human
ucaggugucccugcacu

SEQ ID NO: 3211808 - RNA, 23 nt, Human
ucagguggggucacucuggcagc

SEQ ID NO: 3211809 - RNA, 15 nt, Human
ucaggugucccugca

SEQ ID NO: 3211810 - RNA, 20 nt, Human
accgaaaacguggcugcuuc

SEQ ID NO: 3211811 - RNA, 18 nt, Human
acccuuggagcucugagu

SEQ ID NO: 3211812 - RNA, 14 nt, Human
acccuuggagcucu

SEQ ID NO: 3211813 - RNA, 20 nt, Human
acccuugccgucuaccugag

SEQ ID NO: 3211814 - RNA, 18 nt, Human
acccugcuuggcccaggg

SEQ ID NO: 3211815 - RNA, 17 nt, Human
acccugcuuggcccagg

SEQ ID NO: 3211816 - RNA, 16 nt, Human
acccugcuuggcccag

SEQ ID NO: 3211817 - RNA, 15 nt, Human
acccugcuuggccca

SEQ ID NO: 3211818 - RNA, 14 nt, Human
acccugcugagucu

SEQ ID NO: 3211819 - RNA, 13 nt, Human
ucaguaauaacuc

SEQ ID NO: 3211820 - RNA, 13 nt, Human
ucaguaagccgug

SEQ ID NO: 3211821 - RNA, 15 nt, Human
ucaguacuuguuucu

SEQ ID NO: 3211822 - RNA, 17 nt, Human
ucaguagcuuaagaaaa

SEQ ID NO: 3211823 - RNA, 19 nt, Human
ucaguagcuuaagaaaaaa

SEQ ID NO: 3211824 - RNA, 22 nt, Human
ucaggugucccugcacuugcag

SEQ ID NO: 3211825 - RNA, 19 nt, Human
ucagguuaggcaguauaaa

SEQ ID NO: 3211826 - RNA, 23 nt, Human
ucagguuaggcaguauaaagaau

SEQ ID NO: 3211827 - RNA, 17 nt, Human
ucagguugacaggaggu

SEQ ID NO: 3211828 - RNA, 14 nt, Human
ucagguuuguuuug

SEQ ID NO: 3211829 - RNA, 15 nt, Human
ucagguuuguuuugu

SEQ ID NO: 3211830 - RNA, 22 nt, Human
ucagguugucugaagucacugc

SEQ ID NO: 3211831 - RNA, 18 nt, Human
ucaguaaaauuauacugu

SEQ ID NO: 3211832 - RNA, 20 nt, Human
ucaguaaaauuauacugugu

SEQ ID NO: 3211833 - RNA, 21 nt, Human
ucaguaaaauuauacugugug

SEQ ID NO: 3211834 - RNA, 23 nt, Human
ucaguaaaauuauacugugugug

SEQ ID NO: 3211835 - RNA, 17 nt, Human
ucaguaaaccugucuga

SEQ ID NO: 3211836 - RNA, 16 nt, Human
ucaguaaaccugucug

SEQ ID NO: 3211837 - RNA, 15 nt, Human
ucaguaaacacugug

SEQ ID NO: 3211838 - RNA, 14 nt, Human
ucaguaaacacugu

SEQ ID NO: 3211839 - RNA, 14 nt, Human
acccgccccugccc

SEQ ID NO: 3211840 - RNA, 19 nt, Human
acccgcuaagagggaggga

SEQ ID NO: 3211841 - RNA, 21 nt, Human
ucagguaaucgaccugccucg

SEQ ID NO: 3211842 - RNA, 21 nt, Human
ucagguagaggugcaugccua

SEQ ID NO: 3211843 - RNA, 19 nt, Human
ucaggguuggccccugccc

SEQ ID NO: 3211844 - RNA, 18 nt, Human
ucaggguuggccccugcc

SEQ ID NO: 3211845 - RNA, 19 nt, Human
ucagguaaucgaccugccu

SEQ ID NO: 3211846 - RNA, 20 nt, Human
ucagguaaucgaccugccuc

SEQ ID NO: 3211847 - RNA, 18 nt, Human
ucagguaaucgaccugcc

SEQ ID NO: 3211848 - RNA, 19 nt, Human
ucaggccaggcccucugcc

SEQ ID NO: 3211849 - RNA, 17 nt, Human
ucaggccaggcccucug

SEQ ID NO: 3211850 - RNA, 18 nt, Human
ucaggccaggcccucugc

SEQ ID NO: 3211851 - RNA, 12 nt, Human
ucaggggugugc

SEQ ID NO: 3211852 - RNA, 19 nt, Human
ucaggggugugcggccuuu

SEQ ID NO: 3211853 - RNA, 17 nt, Human
ucaggguuggccccugc

SEQ ID NO: 3211854 - RNA, 13 nt, Human
ucaggccagcugc

SEQ ID NO: 3211855 - RNA, 12 nt, Human
ucaggccaggcc

SEQ ID NO: 3211856 - RNA, 13 nt, Human
ucaggccacuuga

SEQ ID NO: 3211857 - RNA, 13 nt, Human
ucaggccaggccc

SEQ ID NO: 3211858 - RNA, 14 nt, Human
ucaggccaggcccu

SEQ ID NO: 3211859 - RNA, 15 nt, Human
ucaggccaggcccuc

SEQ ID NO: 3211860 - RNA, 16 nt, Human
ucaggccaggcccucu

SEQ ID NO: 3211861 - RNA, 12 nt, Human
acccccagccug

SEQ ID NO: 3211862 - RNA, 13 nt, Human
acccccagccugc

SEQ ID NO: 3211863 - RNA, 18 nt, Human
ucaggcaggugggaugga

SEQ ID NO: 3211864 - RNA, 17 nt, Human
ucaggcaggugggaugg

SEQ ID NO: 3211865 - RNA, 23 nt, Human
acccugaggcccagagggccugc

SEQ ID NO: 3211866 - RNA, 11 nt, Human
acccugagggc

SEQ ID NO: 3211867 - RNA, 22 nt, Human
acccugauuauauccaguaaca

SEQ ID NO: 3211868 - RNA, 14 nt, Human
acccugccaggcac

SEQ ID NO: 3211869 - RNA, 23 nt, Human
acccugccaggcacaggcagggc

SEQ ID NO: 3211870 - RNA, 22 nt, Human
acccugccaggcacaggcaggg

SEQ ID NO: 3211871 - RNA, 21 nt, Human
acccugccaggcacaggcagg

SEQ ID NO: 3211872 - RNA, 19 nt, Human
acccugccaggcacaggca

SEQ ID NO: 3211873 - RNA, 18 nt, Human
acccugccaggcacaggc

SEQ ID NO: 3211874 - RNA, 17 nt, Human
acccugccaggcacagg

SEQ ID NO: 3211875 - RNA, 16 nt, Human
acccugccaggcacag

SEQ ID NO: 3211876 - RNA, 15 nt, Human
acccugccaggcaca

SEQ ID NO: 3211877 - RNA, 11 nt, Human
acccugaggcc

SEQ ID NO: 3211878 - RNA, 17 nt, Human
acccugaggcccagagg

SEQ ID NO: 3211879 - RNA, 19 nt, Human
acccugaggcccagagggc

SEQ ID NO: 3211880 - RNA, 21 nt, Human
acccugaggcccagagggccu

SEQ ID NO: 3211881 - RNA, 21 nt, Human
acccugacaaauuuuaauuau

SEQ ID NO: 3211882 - RNA, 21 nt, Human
acccuccuucccacucuucuc

SEQ ID NO: 3211883 - RNA, 19 nt, Human
acccgggaagggggcuggg

SEQ ID NO: 3211884 - RNA, 20 nt, Human
acccgggaagggggcuggga

SEQ ID NO: 3211885 - RNA, 22 nt, Human
acccgggaagggggcugggaca

SEQ ID NO: 3211886 - RNA, 21 nt, Human
acccuccuuucaccacaugug

SEQ ID NO: 3211887 - RNA, 11 nt, Human
acccuccuucc

SEQ ID NO: 3211888 - RNA, 15 nt, Human
acccuccuucccacu

SEQ ID NO: 3211889 - RNA, 13 nt, Human
acccuccuuccca

SEQ ID NO: 3211890 - RNA, 16 nt, Human
acccucauuguguuuc

SEQ ID NO: 3211891 - RNA, 17 nt, Human
acccucauuguguuucu

SEQ ID NO: 3211892 - RNA, 21 nt, Human
acccuccccuucccagggcaa

SEQ ID NO: 3211893 - RNA, 20 nt, Human
acccuccccuucccagggca

SEQ ID NO: 3211894 - RNA, 19 nt, Human
acccuccccuucccagggc

SEQ ID NO: 3211895 - RNA, 17 nt, Human
acccuccccuucccagg

SEQ ID NO: 3211896 - RNA, 15 nt, Human
acccuccccuuccca

SEQ ID NO: 3211897 - RNA, 13 nt, Human
ucacuuaucaguu

SEQ ID NO: 3211898 - RNA, 15 nt, Human
ucacuguugcccagg

SEQ ID NO: 3211899 - RNA, 13 nt, Human
ucacuuaaaacac

SEQ ID NO: 3211900 - RNA, 15 nt, Human
ucacuuaaaacacgu

SEQ ID NO: 3211901 - RNA, 22 nt, Human
ucacuuaaguuaguuccacuga

SEQ ID NO: 3211902 - RNA, 14 nt, Human
ucacuguugcccag

SEQ ID NO: 3211903 - RNA, 18 nt, Human
ucacugcaaccuccgccu

SEQ ID NO: 3211904 - RNA, 21 nt, Human
ucacugcaaccuucgccaccu

SEQ ID NO: 3211905 - RNA, 18 nt, Human
ucacucuuggagccugca

SEQ ID NO: 3211906 - RNA, 17 nt, Human
ucacucuuggagccugc

SEQ ID NO: 3211907 - RNA, 16 nt, Human
ucacucuuggagccug

SEQ ID NO: 3211908 - RNA, 14 nt, Human
ucacucuuggagcc

SEQ ID NO: 3211909 - RNA, 23 nt, Human
ucacugagacagcccgggcucug

SEQ ID NO: 3211910 - RNA, 23 nt, Human
ucacugaaauaaaagcuauauaa

SEQ ID NO: 3211911 - RNA, 18 nt, Human
ucacugaaauaaaagcua

SEQ ID NO: 3211912 - RNA, 14 nt, Human
ucacugaaauaaaa

SEQ ID NO: 3211913 - RNA, 21 nt, Human
ucacuauguugcccaggcagg

SEQ ID NO: 3211914 - RNA, 20 nt, Human
ucacuauguugcccaggcag

SEQ ID NO: 3211915 - RNA, 22 nt, Human
ucaccagccccagugcccacag

SEQ ID NO: 3211916 - RNA, 17 nt, Human
ucacucagcaccacuca

SEQ ID NO: 3211917 - RNA, 14 nt, Human
ucacucauuaauua

SEQ ID NO: 3211918 - RNA, 14 nt, Human
ucacucagagcagu

SEQ ID NO: 3211919 - RNA, 13 nt, Human
ucacucagagcag

SEQ ID NO: 3211920 - RNA, 19 nt, Human
ucacucagaaguccagagu

SEQ ID NO: 3211921 - RNA, 16 nt, Human
ucacucagcaccacuc

SEQ ID NO: 3211922 - RNA, 15 nt, Human
ucacucagcaccacu

SEQ ID NO: 3211923 - RNA, 14 nt, Human
ucacucagcaccac

SEQ ID NO: 3211924 - RNA, 13 nt, Human
ucacucagcacca

SEQ ID NO: 3211925 - RNA, 18 nt, Human
ucacucagaaguccagag

SEQ ID NO: 3211926 - RNA, 21 nt, Human
acccacuggacucaccucccc

SEQ ID NO: 3211927 - RNA, 20 nt, Human
acccacugcuuuuggucugu

SEQ ID NO: 3211928 - RNA, 14 nt, Human
acccacuggacuca

SEQ ID NO: 3211929 - RNA, 17 nt, Human
acccacuggacucaccu

SEQ ID NO: 3211930 - RNA, 16 nt, Human
acccaaauguucauca

SEQ ID NO: 3211931 - RNA, 13 nt, Human
acccaaagcagug

SEQ ID NO: 3211932 - RNA, 11 nt, Human
acccaaagcag

SEQ ID NO: 3211933 - RNA, 20 nt, Human
accauucuccaccugccagg

SEQ ID NO: 3211934 - RNA, 21 nt, Human
accauucuccaccugccaggg

SEQ ID NO: 3211935 - RNA, 19 nt, Human
accauucuccaccugccag

SEQ ID NO: 3211936 - RNA, 18 nt, Human
accauguuggccaggcug

SEQ ID NO: 3211937 - RNA, 18 nt, Human
accauucuccaccugcca

SEQ ID NO: 3211938 - RNA, 20 nt, Human
accauguuggccaggcugcu

SEQ ID NO: 3211939 - RNA, 22 nt, Human
accauuuugcugucccuuuucc

SEQ ID NO: 3211940 - RNA, 23 nt, Human
accauuuugcugucccuuuuccu

SEQ ID NO: 3211941 - RNA, 21 nt, Human
accauuuugggguacccacug

SEQ ID NO: 3211942 - RNA, 19 nt, Human
accaggguuggcaccuucc

SEQ ID NO: 3211943 - RNA, 21 nt, Human
accaggguuggcaccuucccc

SEQ ID NO: 3211944 - RNA, 14 nt, Human
accaggguuuaguu

SEQ ID NO: 3211945 - RNA, 17 nt, Human
accagguccagaugugc

SEQ ID NO: 3211946 - RNA, 15 nt, Human
ucacuucuucugucc

SEQ ID NO: 3211947 - RNA, 13 nt, Human
ucacuucuucugu

SEQ ID NO: 3211948 - RNA, 19 nt, Human
ucacuucuuucccuuccuc

SEQ ID NO: 3211949 - RNA, 14 nt, Human
ucacuucuuucccu

SEQ ID NO: 3211950 - RNA, 13 nt, Human
ucacuucuuuccc

SEQ ID NO: 3211951 - RNA, 21 nt, Human
ucacuucuucuguccaagcag

SEQ ID NO: 3211952 - RNA, 22 nt, Human
ucacuucuuucccuuccuccau

SEQ ID NO: 3211953 - RNA, 20 nt, Human
ucacuucuuucccuuccucc

SEQ ID NO: 3211954 - RNA, 19 nt, Human
accagguuuuguuccgccc

SEQ ID NO: 3211955 - RNA, 18 nt, Human
accaugcauuuuaccauc

SEQ ID NO: 3211956 - RNA, 22 nt, Human
accaugcucaaugaaaagguga

SEQ ID NO: 3211957 - RNA, 19 nt, Human
accaugucguaguuacucu

SEQ ID NO: 3211958 - RNA, 23 nt, Human
accaugcugucuggcacagccug

SEQ ID NO: 3211959 - RNA, 20 nt, Human
accaugcugucuggcacagc

SEQ ID NO: 3211960 - RNA, 18 nt, Human
accaugcugucuggcaca

SEQ ID NO: 3211961 - RNA, 17 nt, Human
accaugcugucuggcac

SEQ ID NO: 3211962 - RNA, 22 nt, Human
accaugcugucuggcacagccu

SEQ ID NO: 3211963 - RNA, 21 nt, Human
accaugcugucuggcacagcc

SEQ ID NO: 3211964 - RNA, 15 nt, Human
ucagaaucagaagau

SEQ ID NO: 3211965 - RNA, 23 nt, Human
ucagaaguuucugccgcagcccu

SEQ ID NO: 3211966 - RNA, 22 nt, Human
ucagagacuccugcaggcagcc

SEQ ID NO: 3211967 - RNA, 12 nt, Human
ucagaauucuca

SEQ ID NO: 3211968 - RNA, 10 nt, Human
ucagaauucu

SEQ ID NO: 3211969 - RNA, 20 nt, Human
ucagaauucucagaaucuca

SEQ ID NO: 3211970 - RNA, 21 nt, Human
ucagagcccauggcuucccug

SEQ ID NO: 3211971 - RNA, 21 nt, Human
ucagagccaccccuaaagaga

SEQ ID NO: 3211972 - RNA, 20 nt, Human
ucagagaugcauuuggaaca

SEQ ID NO: 3211973 - RNA, 19 nt, Human
ucagagauguccauuuuua

SEQ ID NO: 3211974 - RNA, 23 nt, Human
ucagagauguccauuuuuacaag

SEQ ID NO: 3211975 - RNA, 23 nt, Human
ucagagacuccugcaggcagcca

SEQ ID NO: 3211976 - RNA, 21 nt, Human
ucagaugcugugcaaauguua

SEQ ID NO: 3211977 - RNA, 19 nt, Human
ucagaugcuugcggcaaaa

SEQ ID NO: 3211978 - RNA, 22 nt, Human
ucagaugcuugcggcaaaagga

SEQ ID NO: 3211979 - RNA, 11 nt, Human
acccaggugcu

SEQ ID NO: 3211980 - RNA, 13 nt, Human
accccagguuucu

SEQ ID NO: 3211981 - RNA, 14 nt, Human
ucagauugcuuuug

SEQ ID NO: 3211982 - RNA, 18 nt, Human
ucagauuggacauaacug

SEQ ID NO: 3211983 - RNA, 18 nt, Human
ucagauuucucuuugaaa

SEQ ID NO: 3211984 - RNA, 16 nt, Human
ucagauuucucuuuga

SEQ ID NO: 3211985 - RNA, 15 nt, Human
ucagauuucucuuug

SEQ ID NO: 3211986 - RNA, 19 nt, Human
ucagauuucucuuugaaac

SEQ ID NO: 3211987 - RNA, 15 nt, Human
acccaggagccccga

SEQ ID NO: 3211988 - RNA, 13 nt, Human
acccaggagcccc

SEQ ID NO: 3211989 - RNA, 11 nt, Human
acccagccugg

SEQ ID NO: 3211990 - RNA, 17 nt, Human
acccagcgagcccuggu

SEQ ID NO: 3211991 - RNA, 16 nt, Human
acccagcgagcccugg

SEQ ID NO: 3211992 - RNA, 13 nt, Human
acccagcgagccc

SEQ ID NO: 3211993 - RNA, 16 nt, Human
uccauccuccuccuuc

SEQ ID NO: 3211994 - RNA, 20 nt, Human
uccagugaggcucugcccuu

SEQ ID NO: 3211995 - RNA, 12 nt, Human
uccagugacuuu

SEQ ID NO: 3211996 - RNA, 17 nt, Human
uccagugaggcucugcc

SEQ ID NO: 3211997 - RNA, 18 nt, Human
uccagugaggcucugccc

SEQ ID NO: 3211998 - RNA, 19 nt, Human
uccagugaggcucugcccu

SEQ ID NO: 3211999 - RNA, 14 nt, Human
acggcucacugcag

SEQ ID NO: 3212000 - RNA, 13 nt, Human
acggccuccuuuc

SEQ ID NO: 3212001 - RNA, 20 nt, Human
acggccccagcuucucagcu

SEQ ID NO: 3212002 - RNA, 18 nt, Human
acggccccagcuucucag

SEQ ID NO: 3212003 - RNA, 19 nt, Human
uccagugaaaauaagccau

SEQ ID NO: 3212004 - RNA, 17 nt, Human
uccaucugauuccagca

SEQ ID NO: 3212005 - RNA, 16 nt, Human
uccaucugauuccagc

SEQ ID NO: 3212006 - RNA, 18 nt, Human
uccauccuccuccuuccu

SEQ ID NO: 3212007 - RNA, 17 nt, Human
uccauccuccuccuucc

SEQ ID NO: 3212008 - RNA, 21 nt, Human
uccaucugguuuucucuccag

SEQ ID NO: 3212009 - RNA, 17 nt, Human
uccaucugguuuucucu

SEQ ID NO: 3212010 - RNA, 22 nt, Human
uccaugaagauguagaggagaa

SEQ ID NO: 3212011 - RNA, 23 nt, Human
uccaugacaauaugcccuuucug

SEQ ID NO: 3212012 - RNA, 19 nt, Human
uccaugaauguuccugccu

SEQ ID NO: 3212013 - RNA, 15 nt, Human
uccaugaauguuccu

SEQ ID NO: 3212014 - RNA, 22 nt, Human
uccaugaguuaucaugaauuuu

SEQ ID NO: 3212015 - RNA, 15 nt, Human
uccaugaguccccug

SEQ ID NO: 3212016 - RNA, 16 nt, Human
uccaugaguccccugu

SEQ ID NO: 3212017 - RNA, 17 nt, Human
uccaugaguccccuguu

SEQ ID NO: 3212018 - RNA, 14 nt, Human
ucccacccguggug

SEQ ID NO: 3212019 - RNA, 11 nt, Human
ucccaccccac

SEQ ID NO: 3212020 - RNA, 14 nt, Human
ucccaccccacaca

SEQ ID NO: 3212021 - RNA, 15 nt, Human
ucccacccagccugg

SEQ ID NO: 3212022 - RNA, 19 nt, Human
ucccaccaacccucagagc

SEQ ID NO: 3212023 - RNA, 16 nt, Human
ucccaccacucccugg

SEQ ID NO: 3212024 - RNA, 15 nt, Human
ucccaccacucccug

SEQ ID NO: 3212025 - RNA, 16 nt, Human
ucccaaagugcuggga

SEQ ID NO: 3212026 - RNA, 20 nt, Human
ucccaaagugcugggauuac

SEQ ID NO: 3212027 - RNA, 15 nt, Human
ucccaaagugcuggg

SEQ ID NO: 3212028 - RNA, 15 nt, Human
uccauuuuuacaagu

SEQ ID NO: 3212029 - RNA, 22 nt, Human
uccauuuuuacaaguuauagua

SEQ ID NO: 3212030 - RNA, 24 nt, Human
uccauuuuuacaaguuauaguacu

SEQ ID NO: 3212031 - RNA, 14 nt, Human
ucccaaagugcugg

SEQ ID NO: 3212032 - RNA, 20 nt, Human
uccauuuuggugucuuucuc

SEQ ID NO: 3212033 - RNA, 13 nt, Human
uccauuuuauaaa

SEQ ID NO: 3212034 - RNA, 14 nt, Human
ucccacaaaggaga

SEQ ID NO: 3212035 - RNA, 22 nt, Human
uccauuuuggugucuuucucuu

SEQ ID NO: 3212036 - RNA, 17 nt, Human
ucccacaggcccuuccu

SEQ ID NO: 3212037 - RNA, 15 nt, Human
ucccacaggcccuuc

SEQ ID NO: 3212038 - RNA, 22 nt, Human
ucccacaggcccuuccucucca

SEQ ID NO: 3212039 - RNA, 21 nt, Human
ucccacaggcccuuccucucc

SEQ ID NO: 3212040 - RNA, 21 nt, Human
ucccacagugcugggauuaca

SEQ ID NO: 3212041 - RNA, 14 nt, Human
uccaggcugggaga

SEQ ID NO: 3212042 - RNA, 17 nt, Human
uccaggcugggagagcc

SEQ ID NO: 3212043 - RNA, 18 nt, Human
uccaggcugggagagccu

SEQ ID NO: 3212044 - RNA, 22 nt, Human
uccaggcuccuuuagcgcccag

SEQ ID NO: 3212045 - RNA, 14 nt, Human
acgaucacaaauga

SEQ ID NO: 3212046 - RNA, 18 nt, Human
acgccaggggaaaaucag

SEQ ID NO: 3212047 - RNA, 15 nt, Human
acgacugcccggcag

SEQ ID NO: 3212048 - RNA, 22 nt, Human
acgacaguacuuucaaugaaca

SEQ ID NO: 3212049 - RNA, 21 nt, Human
acgacucuuuuccaaacacag

SEQ ID NO: 3212050 - RNA, 23 nt, Human
acgacucuuuuccaaacacaggc

SEQ ID NO: 3212051 - RNA, 23 nt, Human
acgccaggggaaaaucagccugc

SEQ ID NO: 3212052 - RNA, 11 nt, Human
acgccauccca

SEQ ID NO: 3212053 - RNA, 14 nt, Human
acgccaucccagcc

SEQ ID NO: 3212054 - RNA, 15 nt, Human
acgccaucccagccc

SEQ ID NO: 3212055 - RNA, 16 nt, Human
acgccaucccagcccc

SEQ ID NO: 3212056 - RNA, 17 nt, Human
acgccaucccagcccca

SEQ ID NO: 3212057 - RNA, 18 nt, Human
acgccaucccagccccaa

SEQ ID NO: 3212058 - RNA, 17 nt, Human
acgccagggaccccaga

SEQ ID NO: 3212059 - RNA, 11 nt, Human
acgccagggac

SEQ ID NO: 3212060 - RNA, 15 nt, Human
acgaucacaaaugac

SEQ ID NO: 3212061 - RNA, 16 nt, Human
acgaucacaaaugacu

SEQ ID NO: 3212062 - RNA, 17 nt, Human
acgaucacaaaugacuu

SEQ ID NO: 3212063 - RNA, 18 nt, Human
acgaucacaaaugacuuu

SEQ ID NO: 3212064 - RNA, 17 nt, Human
acgcucucuggccuucg

SEQ ID NO: 3212065 - RNA, 11 nt, Human
acgcucugcug

SEQ ID NO: 3212066 - RNA, 16 nt, Human
acgcugacuacagggc

SEQ ID NO: 3212067 - RNA, 18 nt, Human
acgcugacuacagggccg

SEQ ID NO: 3212068 - RNA, 17 nt, Human
acgcugacuacagggcc

SEQ ID NO: 3212069 - RNA, 19 nt, Human
acggagucccaccuuggcu

SEQ ID NO: 3212070 - RNA, 20 nt, Human
acggagcggauugcaaagca

SEQ ID NO: 3212071 - RNA, 19 nt, Human
acggagcggauugcaaagc

SEQ ID NO: 3212072 - RNA, 21 nt, Human
acggagcggauugcaaagcaa

SEQ ID NO: 3212073 - RNA, 20 nt, Human
acgcugcucugccccagcuu

SEQ ID NO: 3212074 - RNA, 19 nt, Human
acgcugcucugccccagcu

SEQ ID NO: 3212075 - RNA, 17 nt, Human
acgcugcucugccccag

SEQ ID NO: 3212076 - RNA, 16 nt, Human
acgcugcucugcccca

SEQ ID NO: 3212077 - RNA, 15 nt, Human
acgcugcucugcccc

SEQ ID NO: 3212078 - RNA, 14 nt, Human
acgcugcucugccc

SEQ ID NO: 3212079 - RNA, 13 nt, Human
acgcugcucugcc

SEQ ID NO: 3212080 - RNA, 18 nt, Human
acgcugccuucgguaccc

SEQ ID NO: 3212081 - RNA, 16 nt, Human
acggccaggccagagg

SEQ ID NO: 3212082 - RNA, 13 nt, Human
acggccaggccag

SEQ ID NO: 3212083 - RNA, 22 nt, Human
acggcacugagagagcgcagcc

SEQ ID NO: 3212084 - RNA, 13 nt, Human
acggccccagcuu

SEQ ID NO: 3212085 - RNA, 14 nt, Human
acgcucucuggccu

SEQ ID NO: 3212086 - RNA, 15 nt, Human
acgcucucuggccuu

SEQ ID NO: 3212087 - RNA, 16 nt, Human
acgcucucuggccuuc

SEQ ID NO: 3212088 - RNA, 13 nt, Human
acgcuacccggga

SEQ ID NO: 3212089 - RNA, 17 nt, Human
acgcuacccgggaaggg

SEQ ID NO: 3212090 - RNA, 14 nt, Human
acgcccccacuggu

SEQ ID NO: 3212091 - RNA, 18 nt, Human
acgcccacuucccugggu

SEQ ID NO: 3212092 - RNA, 15 nt, Human
acgcccacuucccug

SEQ ID NO: 3212093 - RNA, 13 nt, Human
acgcccacuuccc

SEQ ID NO: 3212094 - RNA, 18 nt, Human
acgccagggaccccagaa

SEQ ID NO: 3212095 - RNA, 23 nt, Human
acgcgugcacacaccagagccca

SEQ ID NO: 3212096 - RNA, 20 nt, Human
acgcgugcacacaccagagc

SEQ ID NO: 3212097 - RNA, 16 nt, Human
accuuccaagagccug

SEQ ID NO: 3212098 - RNA, 20 nt, Human
accuucccccucccccagcc

SEQ ID NO: 3212099 - RNA, 17 nt, Human
accuucccccuccccca

SEQ ID NO: 3212100 - RNA, 17 nt, Human
accuucccaugcccugg

SEQ ID NO: 3212101 - RNA, 15 nt, Human
accuucgccaccugg

SEQ ID NO: 3212102 - RNA, 17 nt, Human
accuucgccaccugggu

SEQ ID NO: 3212103 - RNA, 15 nt, Human
accuuccaagagccu

SEQ ID NO: 3212104 - RNA, 15 nt, Human
accuucauuuaaaaa

SEQ ID NO: 3212105 - RNA, 15 nt, Human
accuucauaagaucu

SEQ ID NO: 3212106 - RNA, 19 nt, Human
accuucaguuuuuguguuu

SEQ ID NO: 3212107 - RNA, 22 nt, Human
accuucacucuaagauguuaua

SEQ ID NO: 3212108 - RNA, 21 nt, Human
accuucacucuaagauguuau

SEQ ID NO: 3212109 - RNA, 20 nt, Human
accuucacucuaagauguua

SEQ ID NO: 3212110 - RNA, 14 nt, Human
accuucacucuaag

SEQ ID NO: 3212111 - RNA, 19 nt, Human
accuucacucuaagauguu

SEQ ID NO: 3212112 - RNA, 18 nt, Human
accuucacucuaagaugu

SEQ ID NO: 3212113 - RNA, 20 nt, Human
accuggggcugcugugaagc

SEQ ID NO: 3212114 - RNA, 21 nt, Human
accugggcucucgcggccucu

SEQ ID NO: 3212115 - RNA, 19 nt, Human
accuggggcugcugugaag

SEQ ID NO: 3212116 - RNA, 17 nt, Human
uccacgagagcgcagca

SEQ ID NO: 3212117 - RNA, 12 nt, Human
accuugccccaa

SEQ ID NO: 3212118 - RNA, 14 nt, Human
accuugccccaacc

SEQ ID NO: 3212119 - RNA, 18 nt, Human
accuugccccaacccuuc

SEQ ID NO: 3212120 - RNA, 20 nt, Human
accuugccccaacccuucuu

SEQ ID NO: 3212121 - RNA, 21 nt, Human
accuugccccaacccuucuuc

SEQ ID NO: 3212122 - RNA, 22 nt, Human
accuugccccaacccuucuuca

SEQ ID NO: 3212123 - RNA, 14 nt, Human
accuuuguccccac

SEQ ID NO: 3212124 - RNA, 15 nt, Human
accuuuguccccacc

SEQ ID NO: 3212125 - RNA, 16 nt, Human
accuuuguccccaccg

SEQ ID NO: 3212126 - RNA, 13 nt, Human
accuuugucccca

SEQ ID NO: 3212127 - RNA, 14 nt, Human
accuugcacacauc

SEQ ID NO: 3212128 - RNA, 21 nt, Human
accuugcauuuuagcuaauuu

SEQ ID NO: 3212129 - RNA, 22 nt, Human
accuugcacacaucaucuguaa

SEQ ID NO: 3212130 - RNA, 16 nt, Human
accuugcacacaucau

SEQ ID NO: 3212131 - RNA, 16 nt, Human
accuugacagggcaca

SEQ ID NO: 3212132 - RNA, 22 nt, Human
accuucuccuucaccuuugucc

SEQ ID NO: 3212133 - RNA, 14 nt, Human
accuucuccuucac

SEQ ID NO: 3212134 - RNA, 13 nt, Human
accuucugacuuu

SEQ ID NO: 3212135 - RNA, 20 nt, Human
accuggcuuuucuuucuacc

SEQ ID NO: 3212136 - RNA, 14 nt, Human
accuggcuuauuua

SEQ ID NO: 3212137 - RNA, 17 nt, Human
accuggcuuauuuaaua

SEQ ID NO: 3212138 - RNA, 15 nt, Human
accugggacagggag

SEQ ID NO: 3212139 - RNA, 22 nt, Human
accugggaaagagauuuaaacu

SEQ ID NO: 3212140 - RNA, 16 nt, Human
accugggacagggagc

SEQ ID NO: 3212141 - RNA, 17 nt, Human
accugggauuauauauc

SEQ ID NO: 3212142 - RNA, 12 nt, Human
accuggccucug

SEQ ID NO: 3212143 - RNA, 13 nt, Human
accuggccucugc

SEQ ID NO: 3212144 - RNA, 23 nt, Human
accuggcccucucugaaggaggc

SEQ ID NO: 3212145 - RNA, 15 nt, Human
accuggcccucucug

SEQ ID NO: 3212146 - RNA, 19 nt, Human
accuggcccucucugaagg

SEQ ID NO: 3212147 - RNA, 18 nt, Human
accuggcccucucugaag

SEQ ID NO: 3212148 - RNA, 17 nt, Human
uccacccaggagccccg

SEQ ID NO: 3212149 - RNA, 13 nt, Human
uccacccaccuca

SEQ ID NO: 3212150 - RNA, 18 nt, Human
uccaccaucaagccacca

SEQ ID NO: 3212151 - RNA, 12 nt, Human
uccacccaccuc

SEQ ID NO: 3212152 - RNA, 20 nt, Human
uccacccaggagccccgagg

SEQ ID NO: 3212153 - RNA, 15 nt, Human
uccaaaugcagcuuu

SEQ ID NO: 3212154 - RNA, 19 nt, Human
uccaaaugcagcuuuaaaa

SEQ ID NO: 3212155 - RNA, 15 nt, Human
uccaaauuauuucuu

SEQ ID NO: 3212156 - RNA, 17 nt, Human
uccaaauuauuucuuaa

SEQ ID NO: 3212157 - RNA, 17 nt, Human
ucauuuuuuuuaauuga

SEQ ID NO: 3212158 - RNA, 23 nt, Human
uccaaauuguuuaaauucacaau

SEQ ID NO: 3212159 - RNA, 21 nt, Human
uccaaggaagggauguauuug

SEQ ID NO: 3212160 - RNA, 23 nt, Human
uccaaggaagggauguauuugua

SEQ ID NO: 3212161 - RNA, 16 nt, Human
uccaaggacagaaggc

SEQ ID NO: 3212162 - RNA, 23 nt, Human
uccaaggacagaaggcuccugcc

SEQ ID NO: 3212163 - RNA, 18 nt, Human
uccaaggccaggccuugg

SEQ ID NO: 3212164 - RNA, 22 nt, Human
uccaaugccucuugucuuccua

SEQ ID NO: 3212165 - RNA, 21 nt, Human
uccaaugccucuugucuuccu

SEQ ID NO: 3212166 - RNA, 17 nt, Human
uccaaugccucuugucu

SEQ ID NO: 3212167 - RNA, 20 nt, Human
uccaagggguccccuccagg

SEQ ID NO: 3212168 - RNA, 14 nt, Human
uccaauguuucaag

SEQ ID NO: 3212169 - RNA, 15 nt, Human
uccaauguuucaagc

SEQ ID NO: 3212170 - RNA, 14 nt, Human
uccacauguuacug

SEQ ID NO: 3212171 - RNA, 18 nt, Human
ucauuuuuuuuuuaucag

SEQ ID NO: 3212172 - RNA, 18 nt, Human
uccaaaaaaaaaaaaaau

SEQ ID NO: 3212173 - RNA, 19 nt, Human
uccaaaaaaaaaaaaaaua

SEQ ID NO: 3212174 - RNA, 21 nt, Human
uccaaaaaaaaaaaaaauaca

SEQ ID NO: 3212175 - RNA, 22 nt, Human
uccaaaaaaaaaaaaaauacaa

SEQ ID NO: 3212176 - RNA, 23 nt, Human
uccaaaaaaaaaaaaaauacaau

SEQ ID NO: 3212177 - RNA, 14 nt, Human
ucauuuuugaauac

SEQ ID NO: 3212178 - RNA, 21 nt, Human
ucauuuuugaaacugcauuug

SEQ ID NO: 3212179 - RNA, 22 nt, Human
ucauuuuugaaacugcauuugu

SEQ ID NO: 3212180 - RNA, 19 nt, Human
ucauuuuuaguagagacag

SEQ ID NO: 3212181 - RNA, 12 nt, Human
ucauuuugcuuu

SEQ ID NO: 3212182 - RNA, 13 nt, Human
ucauuuugcuuua

SEQ ID NO: 3212183 - RNA, 19 nt, Human
ucauuuuguguugaagagc

SEQ ID NO: 3212184 - RNA, 17 nt, Human
ucauuuuguguugaaga

SEQ ID NO: 3212185 - RNA, 14 nt, Human
ucauuugucacaca

SEQ ID NO: 3212186 - RNA, 16 nt, Human
ucauuugcuuuggaag

SEQ ID NO: 3212187 - RNA, 15 nt, Human
ucauuugcuuuggaa

SEQ ID NO: 3212188 - RNA, 16 nt, Human
ucauuugucacacacu

SEQ ID NO: 3212189 - RNA, 16 nt, Human
ucauuuguaugucaaa

SEQ ID NO: 3212190 - RNA, 17 nt, Human
ucauuuguaugucaaag

SEQ ID NO: 3212191 - RNA, 13 nt, Human
ucauuuucucuuu

SEQ ID NO: 3212192 - RNA, 21 nt, Human
accugcuucucugcccagcuu

SEQ ID NO: 3212193 - RNA, 15 nt, Human
accugcuucucugcc

SEQ ID NO: 3212194 - RNA, 14 nt, Human
accugcuucucugc

SEQ ID NO: 3212195 - RNA, 12 nt, Human
accugcucuccu

SEQ ID NO: 3212196 - RNA, 23 nt, Human
accugccuguugggccaggagcc

SEQ ID NO: 3212197 - RNA, 14 nt, Human
accugcgcuucacu

SEQ ID NO: 3212198 - RNA, 13 nt, Human
accugcgcuucac

SEQ ID NO: 3212199 - RNA, 21 nt, Human
accugcgucucauacucaccu

SEQ ID NO: 3212200 - RNA, 16 nt, Human
accugcggugcuaucu

SEQ ID NO: 3212201 - RNA, 12 nt, Human
ucauaaugacuu

SEQ ID NO: 3212202 - RNA, 16 nt, Human
ucauaaguauuuggaa

SEQ ID NO: 3212203 - RNA, 19 nt, Human
accugaauuuuggcugugu

SEQ ID NO: 3212204 - RNA, 18 nt, Human
accugaagacucauucuu

SEQ ID NO: 3212205 - RNA, 17 nt, Human
accugaccccugacccc

SEQ ID NO: 3212206 - RNA, 17 nt, Human
accugacagccccuccc

SEQ ID NO: 3212207 - RNA, 12 nt, Human
accugagcccca

SEQ ID NO: 3212208 - RNA, 17 nt, Human
accugagccccaaaagg

SEQ ID NO: 3212209 - RNA, 23 nt, Human
accugaggcccuucucuccagcc

SEQ ID NO: 3212210 - RNA, 14 nt, Human
accugaggggccuc

SEQ ID NO: 3212211 - RNA, 15 nt, Human
accugccaggaagcc

SEQ ID NO: 3212212 - RNA, 18 nt, Human
accugccaggaagccagc

SEQ ID NO: 3212213 - RNA, 17 nt, Human
accugccucggccuccc

SEQ ID NO: 3212214 - RNA, 16 nt, Human
accugccaggaagcca

SEQ ID NO: 3212215 - RNA, 17 nt, Human
accugccaggaagccag

SEQ ID NO: 3212216 - RNA, 22 nt, Human
accugcaaacgcuucaguuguu

SEQ ID NO: 3212217 - RNA, 17 nt, Human
acugaaaggcuuuucaa

SEQ ID NO: 3212218 - RNA, 19 nt, Human
acugaaagguagacuuuua

SEQ ID NO: 3212219 - RNA, 14 nt, Human
acugaaaagaagga

SEQ ID NO: 3212220 - RNA, 16 nt, Human
acugaaaagaaggaaa

SEQ ID NO: 3212221 - RNA, 17 nt, Human
acugaaaagaaggaaag

SEQ ID NO: 3212222 - RNA, 19 nt, Human
acugaaaagaaggaaagau

SEQ ID NO: 3212223 - RNA, 19 nt, Human
acucuuucuauuguuucuu

SEQ ID NO: 3212224 - RNA, 18 nt, Human
uccugacgagauaagcag

SEQ ID NO: 3212225 - RNA, 15 nt, Human
uccugaagaauugaa

SEQ ID NO: 3212226 - RNA, 14 nt, Human
uccucugaggcuga

SEQ ID NO: 3212227 - RNA, 19 nt, Human
uccucuugccacugccucu

SEQ ID NO: 3212228 - RNA, 17 nt, Human
uccucuugcauuucacu

SEQ ID NO: 3212229 - RNA, 20 nt, Human
uccucugcucccccuuuucc

SEQ ID NO: 3212230 - RNA, 18 nt, Human
uccucugcuaaauugaug

SEQ ID NO: 3212231 - RNA, 15 nt, Human
uccucugcuaaauug

SEQ ID NO: 3212232 - RNA, 19 nt, Human
uccucugcucccccuuuuc

SEQ ID NO: 3212233 - RNA, 12 nt, Human
uccucugcuccc

SEQ ID NO: 3212234 - RNA, 23 nt, Human
uccucugcuaaauugauguugau

SEQ ID NO: 3212235 - RNA, 19 nt, Human
uccucugcuaaauugaugu

SEQ ID NO: 3212236 - RNA, 21 nt, Human
uccucuuuugugcugcuucuc

SEQ ID NO: 3212237 - RNA, 18 nt, Human
uccucuuuuguuguuucu

SEQ ID NO: 3212238 - RNA, 20 nt, Human
uccucuuuuguuguuucuua

SEQ ID NO: 3212239 - RNA, 22 nt, Human
uccucuuuuguuguuucuuaau

SEQ ID NO: 3212240 - RNA, 23 nt, Human
uccucuuuuguuguuucuuaauu

SEQ ID NO: 3212241 - RNA, 23 nt, Human
uccucuuuggucuacacugugcu

SEQ ID NO: 3212242 - RNA, 14 nt, Human
uccucccaccucag

SEQ ID NO: 3212243 - RNA, 13 nt, Human
uccucccaccuca

SEQ ID NO: 3212244 - RNA, 20 nt, Human
uccucccaccucagccuccc

SEQ ID NO: 3212245 - RNA, 18 nt, Human
uccucccaccucagccuc

SEQ ID NO: 3212246 - RNA, 16 nt, Human
uccucccaccucagcc

SEQ ID NO: 3212247 - RNA, 15 nt, Human
uccucccaccucagc

SEQ ID NO: 3212248 - RNA, 16 nt, Human
uccucccacugcccac

SEQ ID NO: 3212249 - RNA, 21 nt, Human
uccucccaccucagccucccg

SEQ ID NO: 3212250 - RNA, 16 nt, Human
uccucuccacugccuu

SEQ ID NO: 3212251 - RNA, 18 nt, Human
uccucuccacugccuucg

SEQ ID NO: 3212252 - RNA, 17 nt, Human
uccucuccacugccuuc

SEQ ID NO: 3212253 - RNA, 12 nt, Human
uccucucugccc

SEQ ID NO: 3212254 - RNA, 13 nt, Human
uccucucugcccu

SEQ ID NO: 3212255 - RNA, 14 nt, Human
uccucucugcccua

SEQ ID NO: 3212256 - RNA, 15 nt, Human
uccucucugcccuaa

SEQ ID NO: 3212257 - RNA, 12 nt, Human
uccucugagccu

SEQ ID NO: 3212258 - RNA, 13 nt, Human
uccucugagccuu

SEQ ID NO: 3212259 - RNA, 17 nt, Human
uccucugagccuuggga

SEQ ID NO: 3212260 - RNA, 21 nt, Human
uccucugaggaugauguacuu

SEQ ID NO: 3212261 - RNA, 17 nt, Human
acucuucucauuacuug

SEQ ID NO: 3212262 - RNA, 18 nt, Human
acucuucucauuacuugu

SEQ ID NO: 3212263 - RNA, 24 nt, Human
acucuucucauuacuuguugccua

SEQ ID NO: 3212264 - RNA, 13 nt, Human
acucuucucucug

SEQ ID NO: 3212265 - RNA, 12 nt, Human
acucuucucauu

SEQ ID NO: 3212266 - RNA, 23 nt, Human
acucuucucaucuugacagagcc

SEQ ID NO: 3212267 - RNA, 19 nt, Human
acucuucucucugcucuga

SEQ ID NO: 3212268 - RNA, 18 nt, Human
acucuucucucugcucug

SEQ ID NO: 3212269 - RNA, 17 nt, Human
acucuucucucugcucu

SEQ ID NO: 3212270 - RNA, 16 nt, Human
acucuucucucugcuc

SEQ ID NO: 3212271 - RNA, 15 nt, Human
acucuucucucugcu

SEQ ID NO: 3212272 - RNA, 14 nt, Human
acucuucucucugc

SEQ ID NO: 3212273 - RNA, 23 nt, Human
acucuucccugaacuuccugcuu

SEQ ID NO: 3212274 - RNA, 20 nt, Human
acucuuccuccaaggacaga

SEQ ID NO: 3212275 - RNA, 17 nt, Human
acucuuccuccaaggac

SEQ ID NO: 3212276 - RNA, 20 nt, Human
acucuucaguuaagccuuug

SEQ ID NO: 3212277 - RNA, 21 nt, Human
acucuucaguuaagccuuugg

SEQ ID NO: 3212278 - RNA, 19 nt, Human
acucuggcagcucagagag

SEQ ID NO: 3212279 - RNA, 19 nt, Human
acucuuauugcccacgcug

SEQ ID NO: 3212280 - RNA, 21 nt, Human
acucuuauugcccacgcugga

SEQ ID NO: 3212281 - RNA, 16 nt, Human
acucuggcagcucaga

SEQ ID NO: 3212282 - RNA, 17 nt, Human
acucuggcagcucagag

SEQ ID NO: 3212283 - RNA, 13 nt, Human
acucugcugaggg

SEQ ID NO: 3212284 - RNA, 14 nt, Human
acucugcugagggu

SEQ ID NO: 3212285 - RNA, 15 nt, Human
acucugcugaggguc

SEQ ID NO: 3212286 - RNA, 20 nt, Human
acucugcugaggguccagaa

SEQ ID NO: 3212287 - RNA, 14 nt, Human
acucugcucuugca

SEQ ID NO: 3212288 - RNA, 14 nt, Human
acucguauaugucu

SEQ ID NO: 3212289 - RNA, 15 nt, Human
acucucagaggcccc

SEQ ID NO: 3212290 - RNA, 14 nt, Human
acucucagaggccc

SEQ ID NO: 3212291 - RNA, 14 nt, Human
acucuauuuuuaca

SEQ ID NO: 3212292 - RNA, 16 nt, Human
acucuauuuuuacauu

SEQ ID NO: 3212293 - RNA, 20 nt, Human
acucuauuuuuacauuuaaa

SEQ ID NO: 3212294 - RNA, 15 nt, Human
acucgugagcgccag

SEQ ID NO: 3212295 - RNA, 15 nt, Human
acucgcgacaaugca

SEQ ID NO: 3212296 - RNA, 16 nt, Human
acucgcgacaaugcaa

SEQ ID NO: 3212297 - RNA, 18 nt, Human
acucugacaacagacuuc

SEQ ID NO: 3212298 - RNA, 20 nt, Human
acucugacaacagacuucug

SEQ ID NO: 3212299 - RNA, 22 nt, Human
acucugacaacagacuucugaa

SEQ ID NO: 3212300 - RNA, 23 nt, Human
acucugacaacagacuucugaaa

SEQ ID NO: 3212301 - RNA, 16 nt, Human
acucugccugcccuuu

SEQ ID NO: 3212302 - RNA, 14 nt, Human
acucugccugcccu

SEQ ID NO: 3212303 - RNA, 16 nt, Human
acucugcuaccuugcc

SEQ ID NO: 3212304 - RNA, 19 nt, Human
acucugcuaccuugcccca

SEQ ID NO: 3212305 - RNA, 16 nt, Human
acucugccuccucuuc

SEQ ID NO: 3212306 - RNA, 17 nt, Human
acucucagaggccccaa

SEQ ID NO: 3212307 - RNA, 16 nt, Human
acucucagaggcccca

SEQ ID NO: 3212308 - RNA, 22 nt, Human
acucucaggaaaugcugaccca

SEQ ID NO: 3212309 - RNA, 21 nt, Human
acucucaggaaaugcugaccc

SEQ ID NO: 3212310 - RNA, 13 nt, Human
acucugacaacag

SEQ ID NO: 3212311 - RNA, 17 nt, Human
acucugacaacagacuu

SEQ ID NO: 3212312 - RNA, 21 nt, Human
uccuagccaccgccuccuaca

SEQ ID NO: 3212313 - RNA, 21 nt, Human
uccuagccugugccucuggga

SEQ ID NO: 3212314 - RNA, 16 nt, Human
acuccugguccuaggc

SEQ ID NO: 3212315 - RNA, 22 nt, Human
acuccugguccuaggcuggaag

SEQ ID NO: 3212316 - RNA, 23 nt, Human
acuccugguccuaggcuggaagg

SEQ ID NO: 3212317 - RNA, 20 nt, Human
uccuagccacccaccacacu

SEQ ID NO: 3212318 - RNA, 20 nt, Human
uccuagcacuuugggaggcc

SEQ ID NO: 3212319 - RNA, 23 nt, Human
uccuacgaguaauugcauuugcu

SEQ ID NO: 3212320 - RNA, 16 nt, Human
acucgaguuacagaca

SEQ ID NO: 3212321 - RNA, 14 nt, Human
acucgagucugagg

SEQ ID NO: 3212322 - RNA, 15 nt, Human
acucgagucugaggc

SEQ ID NO: 3212323 - RNA, 18 nt, Human
acuccugucuucugcuuu

SEQ ID NO: 3212324 - RNA, 17 nt, Human
acuccugucuucugcuu

SEQ ID NO: 3212325 - RNA, 16 nt, Human
acuccugucuucugcu

SEQ ID NO: 3212326 - RNA, 15 nt, Human
acuccugucuucugc

SEQ ID NO: 3212327 - RNA, 20 nt, Human
acuccugucuucugcuuugu

SEQ ID NO: 3212328 - RNA, 19 nt, Human
acuccugucuucugcuuug

SEQ ID NO: 3212329 - RNA, 11 nt, Human
uccggccaggu

SEQ ID NO: 3212330 - RNA, 19 nt, Human
uccggccaggugccuccug

SEQ ID NO: 3212331 - RNA, 20 nt, Human
uccggccaggugccuccuga

SEQ ID NO: 3212332 - RNA, 22 nt, Human
uccggccaggugccuccugaca

SEQ ID NO: 3212333 - RNA, 18 nt, Human
uccggcaccaguagcagg

SEQ ID NO: 3212334 - RNA, 16 nt, Human
uccggcaccaguagca

SEQ ID NO: 3212335 - RNA, 15 nt, Human
uccggcuaagcaggc

SEQ ID NO: 3212336 - RNA, 17 nt, Human
uccggcuaagcaggcgc

SEQ ID NO: 3212337 - RNA, 16 nt, Human
uccggcuaagcaggcg

SEQ ID NO: 3212338 - RNA, 18 nt, Human
uccggcuaagcaggcgca

SEQ ID NO: 3212339 - RNA, 18 nt, Human
acucagaagacacugaug

SEQ ID NO: 3212340 - RNA, 17 nt, Human
acucagaagacacugau

SEQ ID NO: 3212341 - RNA, 16 nt, Human
acucagaagacacuga

SEQ ID NO: 3212342 - RNA, 15 nt, Human
acucagaagacacug

SEQ ID NO: 3212343 - RNA, 14 nt, Human
acucagaagacacu

SEQ ID NO: 3212344 - RNA, 14 nt, Human
acucaccugccccu

SEQ ID NO: 3212345 - RNA, 19 nt, Human
acucaccugccccucaacu

SEQ ID NO: 3212346 - RNA, 21 nt, Human
acucaccugccccucaacucu

SEQ ID NO: 3212347 - RNA, 16 nt, Human
acucagaaguccagag

SEQ ID NO: 3212348 - RNA, 19 nt, Human
acucagagcagucugugac

SEQ ID NO: 3212349 - RNA, 12 nt, Human
acucagagcagu

SEQ ID NO: 3212350 - RNA, 19 nt, Human
acucaucuggaguucucaa

SEQ ID NO: 3212351 - RNA, 22 nt, Human
acucaucuggaguucucaaaga

SEQ ID NO: 3212352 - RNA, 12 nt, Human
acucaucuuagg

SEQ ID NO: 3212353 - RNA, 16 nt, Human
acucauugaccugagg

SEQ ID NO: 3212354 - RNA, 17 nt, Human
acucauugaccugaggc

SEQ ID NO: 3212355 - RNA, 14 nt, Human
acuccaccaagccu

SEQ ID NO: 3212356 - RNA, 20 nt, Human
acucauuuuaaaaaauggaa

SEQ ID NO: 3212357 - RNA, 12 nt, Human
acucauuuugcu

SEQ ID NO: 3212358 - RNA, 14 nt, Human
acucauuuugcuug

SEQ ID NO: 3212359 - RNA, 19 nt, Human
acucauuuuaaugauuguu

SEQ ID NO: 3212360 - RNA, 18 nt, Human
acucauugaccugaggcc

SEQ ID NO: 3212361 - RNA, 13 nt, Human
ucccucccagcuc

SEQ ID NO: 3212362 - RNA, 13 nt, Human
ucccucuuucccu

SEQ ID NO: 3212363 - RNA, 11 nt, Human
ucccucuuucc

SEQ ID NO: 3212364 - RNA, 23 nt, Human
ucccucauuccaccuucccaugc

SEQ ID NO: 3212365 - RNA, 18 nt, Human
ucccucagucuggcccuu

SEQ ID NO: 3212366 - RNA, 15 nt, Human
ucccucagaaaauga

SEQ ID NO: 3212367 - RNA, 17 nt, Human
ucccucacucucaggaa

SEQ ID NO: 3212368 - RNA, 15 nt, Human
ucccucacucucagg

SEQ ID NO: 3212369 - RNA, 14 nt, Human
ucccucacucucag

SEQ ID NO: 3212370 - RNA, 21 nt, Human
ucccucuuucccucccuuccu

SEQ ID NO: 3212371 - RNA, 14 nt, Human
ucccugaacuuccu

SEQ ID NO: 3212372 - RNA, 21 nt, Human
ucccugaaggccccgcccagg

SEQ ID NO: 3212373 - RNA, 22 nt, Human
ucccugaaggccccgcccaggc

SEQ ID NO: 3212374 - RNA, 18 nt, Human
ucccugaaggccccgccc

SEQ ID NO: 3212375 - RNA, 17 nt, Human
ucccugaaggccccgcc

SEQ ID NO: 3212376 - RNA, 17 nt, Human
acucaccccagccccaa

SEQ ID NO: 3212377 - RNA, 19 nt, Human
acucaccucccccaucucu

SEQ ID NO: 3212378 - RNA, 20 nt, Human
acucaccucccccaucucuu

SEQ ID NO: 3212379 - RNA, 23 nt, Human
ucccugaaggccccgcccaggcu

SEQ ID NO: 3212380 - RNA, 16 nt, Human
ucccugaaguuaugug

SEQ ID NO: 3212381 - RNA, 19 nt, Human
acuaugauuuaauuugaaa

SEQ ID NO: 3212382 - RNA, 15 nt, Human
acuaugauuuggaaa

SEQ ID NO: 3212383 - RNA, 16 nt, Human
acuaugauuuggaaaa

SEQ ID NO: 3212384 - RNA, 14 nt, Human
acuauaauguaagc

SEQ ID NO: 3212385 - RNA, 13 nt, Human
acuauaauguaag

SEQ ID NO: 3212386 - RNA, 11 nt, Human
acuauaaugua

SEQ ID NO: 3212387 - RNA, 12 nt, Human
acuauaauguaa

SEQ ID NO: 3212388 - RNA, 16 nt, Human
acuauucaaacagucu

SEQ ID NO: 3212389 - RNA, 14 nt, Human
acuauucaaacagu

SEQ ID NO: 3212390 - RNA, 13 nt, Human
acuauucaaacag

SEQ ID NO: 3212391 - RNA, 12 nt, Human
acuauguaucaa

SEQ ID NO: 3212392 - RNA, 14 nt, Human
acuauguguuuuuc

SEQ ID NO: 3212393 - RNA, 18 nt, Human
acuauguguuuuucucau

SEQ ID NO: 3212394 - RNA, 13 nt, Human
acuauguugauaa

SEQ ID NO: 3212395 - RNA, 22 nt, Human
uccccuaaagccucaaaacaaa

SEQ ID NO: 3212396 - RNA, 15 nt, Human
uccccuaaagccuca

SEQ ID NO: 3212397 - RNA, 14 nt, Human
acucaaugcacuga

SEQ ID NO: 3212398 - RNA, 18 nt, Human
acucaaguugucucuuua

SEQ ID NO: 3212399 - RNA, 20 nt, Human
acucacauuuauucugcuca

SEQ ID NO: 3212400 - RNA, 19 nt, Human
acucacauuuauucugcuc

SEQ ID NO: 3212401 - RNA, 21 nt, Human
acuagacacacaaagcaguug

SEQ ID NO: 3212402 - RNA, 18 nt, Human
acuagacacacaaagcag

SEQ ID NO: 3212403 - RNA, 13 nt, Human
acuagacacacaa

SEQ ID NO: 3212404 - RNA, 14 nt, Human
acuacuuagcacuu

SEQ ID NO: 3212405 - RNA, 19 nt, Human
acuaccuuuggcuuaauuc

SEQ ID NO: 3212406 - RNA, 18 nt, Human
acuacggaauaguuggcu

SEQ ID NO: 3212407 - RNA, 22 nt, Human
acuaccuguaaugacaggccug

SEQ ID NO: 3212408 - RNA, 15 nt, Human
ucccccagccacucc

SEQ ID NO: 3212409 - RNA, 14 nt, Human
ucccccagccacuc

SEQ ID NO: 3212410 - RNA, 13 nt, Human
ucccccagccacu

SEQ ID NO: 3212411 - RNA, 13 nt, Human
acguacacacaca

SEQ ID NO: 3212412 - RNA, 13 nt, Human
ucccccacuccca

SEQ ID NO: 3212413 - RNA, 22 nt, Human
ucccccaacuucaucuggaagu

SEQ ID NO: 3212414 - RNA, 21 nt, Human
acugggcuuggggaccagagc

SEQ ID NO: 3212415 - RNA, 15 nt, Human
acugggggcagacau

SEQ ID NO: 3212416 - RNA, 15 nt, Human
acuggguacuugugg

SEQ ID NO: 3212417 - RNA, 15 nt, Human
acugggccaggggag

SEQ ID NO: 3212418 - RNA, 22 nt, Human
ucgcuggauggcggaagcugcu

SEQ ID NO: 3212419 - RNA, 18 nt, Human
ucgcucuguugcccaggc

SEQ ID NO: 3212420 - RNA, 17 nt, Human
ucgcccuggcaggcagg

SEQ ID NO: 3212421 - RNA, 13 nt, Human
ucgcccuggcagg

SEQ ID NO: 3212422 - RNA, 14 nt, Human
ucgcuccugugucu

SEQ ID NO: 3212423 - RNA, 23 nt, Human
ucgccucggaucagcugagccuu

SEQ ID NO: 3212424 - RNA, 17 nt, Human
ucgccucggaucagcug

SEQ ID NO: 3212425 - RNA, 16 nt, Human
acugaaaggcuuuuca

SEQ ID NO: 3212426 - RNA, 14 nt, Human
acugaagaggagga

SEQ ID NO: 3212427 - RNA, 15 nt, Human
acugaagaggaggag

SEQ ID NO: 3212428 - RNA, 23 nt, Human
acugaagaggaggaggagggucu

SEQ ID NO: 3212429 - RNA, 15 nt, Human
acuguacuccuccca

SEQ ID NO: 3212430 - RNA, 22 nt, Human
acuguacaaugacuuuauugca

SEQ ID NO: 3212431 - RNA, 20 nt, Human
acuguacuccucccaggcgc

SEQ ID NO: 3212432 - RNA, 13 nt, Human
acuguacuuugau

SEQ ID NO: 3212433 - RNA, 13 nt, Human
acuguauauuugu

SEQ ID NO: 3212434 - RNA, 14 nt, Human
acuguauauuugua

SEQ ID NO: 3212435 - RNA, 15 nt, Human
acuguauauuuguau

SEQ ID NO: 3212436 - RNA, 17 nt, Human
acuguauauuuguauga

SEQ ID NO: 3212437 - RNA, 19 nt, Human
acuguauauuuguaugaua

SEQ ID NO: 3212438 - RNA, 23 nt, Human
acuguacuuugauucacauguuu

SEQ ID NO: 3212439 - RNA, 22 nt, Human
acuguacuuugauucacauguu

SEQ ID NO: 3212440 - RNA, 20 nt, Human
acuguacuuugauucacaug

SEQ ID NO: 3212441 - RNA, 16 nt, Human
acuguacuuugauuca

SEQ ID NO: 3212442 - RNA, 22 nt, Human
acuguacaaaguagaagucuua

SEQ ID NO: 3212443 - RNA, 16 nt, Human
acuguacaaaguagaa

SEQ ID NO: 3212444 - RNA, 17 nt, Human
acuggguacuuguggac

SEQ ID NO: 3212445 - RNA, 23 nt, Human
acugucagcuccccucggagaag

SEQ ID NO: 3212446 - RNA, 22 nt, Human
acugucagcuccccucggagaa

SEQ ID NO: 3212447 - RNA, 23 nt, Human
acuguccuacccacccuccuuuc

SEQ ID NO: 3212448 - RNA, 23 nt, Human
acuguauugggaaguuacuguua

SEQ ID NO: 3212449 - RNA, 19 nt, Human
ucggggagaggcugaggac

SEQ ID NO: 3212450 - RNA, 22 nt, Human
ucguauagaagucuucaugaaa

SEQ ID NO: 3212451 - RNA, 20 nt, Human
ucguauagaagucuucauga

SEQ ID NO: 3212452 - RNA, 17 nt, Human
ucguauagaagucuuca

SEQ ID NO: 3212453 - RNA, 16 nt, Human
ucguauagaagucuuc

SEQ ID NO: 3212454 - RNA, 22 nt, Human
ucguacauaauacugaaccacu

SEQ ID NO: 3212455 - RNA, 14 nt, Human
ucguacauaauacu

SEQ ID NO: 3212456 - RNA, 15 nt, Human
ucguacauaauacug

SEQ ID NO: 3212457 - RNA, 15 nt, Human
ucguauucaccuuca

SEQ ID NO: 3212458 - RNA, 22 nt, Human
ucguuuaccuucaaacuuuagg

SEQ ID NO: 3212459 - RNA, 14 nt, Human
ucuaaaauuacaua

SEQ ID NO: 3212460 - RNA, 22 nt, Human
ucuaaaauugaguucuuccugu

SEQ ID NO: 3212461 - RNA, 23 nt, Human
ucuaaaauugaguucuuccugua

SEQ ID NO: 3212462 - RNA, 17 nt, Human
acuguuaauaguucagg

SEQ ID NO: 3212463 - RNA, 16 nt, Human
acuguuaacuuauuca

SEQ ID NO: 3212464 - RNA, 21 nt, Human
acuguuaauaguucagguaac

SEQ ID NO: 3212465 - RNA, 13 nt, Human
acuguuaccauug

SEQ ID NO: 3212466 - RNA, 12 nt, Human
acuguuacagua

SEQ ID NO: 3212467 - RNA, 15 nt, Human
acuguuacaguaaug

SEQ ID NO: 3212468 - RNA, 16 nt, Human
acuguuacaguaaugu

SEQ ID NO: 3212469 - RNA, 20 nt, Human
acuguuacaguaaugucaua

SEQ ID NO: 3212470 - RNA, 12 nt, Human
ucuaagauguua

SEQ ID NO: 3212471 - RNA, 16 nt, Human
ucuaagauguuauauu

SEQ ID NO: 3212472 - RNA, 14 nt, Human
ucuaagauguuaua

SEQ ID NO: 3212473 - RNA, 23 nt, Human
ucuaagauguuauauuuuucuua

SEQ ID NO: 3212474 - RNA, 22 nt, Human
ucuaagauguuauauuuuucuu

SEQ ID NO: 3212475 - RNA, 21 nt, Human
ucuaagauguuauauuuuucu

SEQ ID NO: 3212476 - RNA, 18 nt, Human
ucuaagauguuauauuuu

SEQ ID NO: 3212477 - RNA, 14 nt, Human
ucuaagaaacauug

SEQ ID NO: 3212478 - RNA, 13 nt, Human
ucuaagaaacauu

SEQ ID NO: 3212479 - RNA, 23 nt, Human
ucuaagaaacauuggaagcaggu

SEQ ID NO: 3212480 - RNA, 18 nt, Human
ucuaagaaacauuggaag

SEQ ID NO: 3212481 - RNA, 17 nt, Human
ucuaagaaacauuggaa

SEQ ID NO: 3212482 - RNA, 16 nt, Human
ucuaagaaacauugga

SEQ ID NO: 3212483 - RNA, 14 nt, Human
ucuaagaauaauaa

SEQ ID NO: 3212484 - RNA, 17 nt, Human
ucuaagaauaauaaaau

SEQ ID NO: 3212485 - RNA, 19 nt, Human
ucuaagaauaauaaaauca

SEQ ID NO: 3212486 - RNA, 16 nt, Human
ucuaagaaauaucugu

SEQ ID NO: 3212487 - RNA, 21 nt, Human
ucuaagaaauaucugugaaau

SEQ ID NO: 3212488 - RNA, 22 nt, Human
ucuaagaaauaucugugaaaua

SEQ ID NO: 3212489 - RNA, 23 nt, Human
ucuaagaaauaucugugaaauau

SEQ ID NO: 3212490 - RNA, 13 nt, Human
ucuaagaaaucaa

SEQ ID NO: 3212491 - RNA, 16 nt, Human
ucuaaagcugccagcc

SEQ ID NO: 3212492 - RNA, 17 nt, Human
ucuaaagcugccagccg

SEQ ID NO: 3212493 - RNA, 13 nt, Human
ucuaaacugcccc

SEQ ID NO: 3212494 - RNA, 16 nt, Human
ucuaaacugcccccuc

SEQ ID NO: 3212495 - RNA, 22 nt, Human
ucuaaacugcccccucugcccu

SEQ ID NO: 3212496 - RNA, 23 nt, Human
ucuaaacugcccccucugcccug

SEQ ID NO: 3212497 - RNA, 18 nt, Human
ucuaaacuaggcuccuuc

SEQ ID NO: 3212498 - RNA, 21 nt, Human
ucuaaacuuuauuccaaguca

SEQ ID NO: 3212499 - RNA, 23 nt, Human
ucuaccccucccggcccugccug

SEQ ID NO: 3212500 - RNA, 22 nt, Human
ucuaccccucccggcccugccu

SEQ ID NO: 3212501 - RNA, 21 nt, Human
ucuacccucuuagaaaaacca

SEQ ID NO: 3212502 - RNA, 14 nt, Human
ucuacccaggugcu

SEQ ID NO: 3212503 - RNA, 11 nt, Human
ucuacauuuca

SEQ ID NO: 3212504 - RNA, 12 nt, Human
ucuacauuucac

SEQ ID NO: 3212505 - RNA, 13 nt, Human
ucuacauuucaca

SEQ ID NO: 3212506 - RNA, 16 nt, Human
ucuacauuucacauua

SEQ ID NO: 3212507 - RNA, 22 nt, Human
ucuacauuucacauuauucugg

SEQ ID NO: 3212508 - RNA, 19 nt, Human
ucuaaguugaguauauuau

SEQ ID NO: 3212509 - RNA, 16 nt, Human
ucuacauacuauggaa

SEQ ID NO: 3212510 - RNA, 14 nt, Human
ucuaaguguuugcu

SEQ ID NO: 3212511 - RNA, 22 nt, Human
ucuaagucaaacacuugugacu

SEQ ID NO: 3212512 - RNA, 23 nt, Human
ucuaagucaaacacuugugacuu

SEQ ID NO: 3212513 - RNA, 20 nt, Human
ucuaagucgguuaaaaugga

SEQ ID NO: 3212514 - RNA, 18 nt, Human
ucuaagugccucacauuu

SEQ ID NO: 3212515 - RNA, 15 nt, Human
ucuaccucuuggcug

SEQ ID NO: 3212516 - RNA, 12 nt, Human
ucuaccugaggg

SEQ ID NO: 3212517 - RNA, 19 nt, Human
ucuaccugaggggccucuu

SEQ ID NO: 3212518 - RNA, 20 nt, Human
acuuagagguggggagcaga

SEQ ID NO: 3212519 - RNA, 15 nt, Human
acuuagccuuucuuu

SEQ ID NO: 3212520 - RNA, 19 nt, Human
acuuagcaucuaauuucaa

SEQ ID NO: 3212521 - RNA, 17 nt, Human
acuuagccuuuaccugu

SEQ ID NO: 3212522 - RNA, 20 nt, Human
acuuagccuuuaccugugaa

SEQ ID NO: 3212523 - RNA, 22 nt, Human
acuuagcacuucagggcagauu

SEQ ID NO: 3212524 - RNA, 21 nt, Human
acuuaucaguuugcuaauguu

SEQ ID NO: 3212525 - RNA, 21 nt, Human
acuuauauuguaagaaauacu

SEQ ID NO: 3212526 - RNA, 20 nt, Human
acuuauauuguaagaaauac

SEQ ID NO: 3212527 - RNA, 19 nt, Human
acuuauauuguaagaaaua

SEQ ID NO: 3212528 - RNA, 18 nt, Human
acuuauauuguaagaaau

SEQ ID NO: 3212529 - RNA, 17 nt, Human
acuuauauuguaagaaa

SEQ ID NO: 3212530 - RNA, 15 nt, Human
acuuauauuguaaga

SEQ ID NO: 3212531 - RNA, 16 nt, Human
acuucaggcucuucuc

SEQ ID NO: 3212532 - RNA, 17 nt, Human
acuuccauaaucuggac

SEQ ID NO: 3212533 - RNA, 17 nt, Human
acuuccacugccauccu

SEQ ID NO: 3212534 - RNA, 18 nt, Human
acuuccaauuuacauacu

SEQ ID NO: 3212535 - RNA, 15 nt, Human
acuuccaaagaaagu

SEQ ID NO: 3212536 - RNA, 16 nt, Human
acuuccaaagaaaguu

SEQ ID NO: 3212537 - RNA, 17 nt, Human
acuuccaaagaaaguuc

SEQ ID NO: 3212538 - RNA, 18 nt, Human
acuuccaaagaaaguucu

SEQ ID NO: 3212539 - RNA, 16 nt, Human
acuucaucccucuggg

SEQ ID NO: 3212540 - RNA, 15 nt, Human
acuucaucuggaagu

SEQ ID NO: 3212541 - RNA, 16 nt, Human
acuucaucuggaaguu

SEQ ID NO: 3212542 - RNA, 21 nt, Human
acuucagggcagauuuuaguu

SEQ ID NO: 3212543 - RNA, 20 nt, Human
acuucagggcagauuuuagu

SEQ ID NO: 3212544 - RNA, 19 nt, Human
acuucagggcagauuuuag

SEQ ID NO: 3212545 - RNA, 18 nt, Human
acuucagggcagauuuua

SEQ ID NO: 3212546 - RNA, 17 nt, Human
acuucagggcagauuuu

SEQ ID NO: 3212547 - RNA, 16 nt, Human
acuucagggcagauuu

SEQ ID NO: 3212548 - RNA, 18 nt, Human
acuucaggcucuucuccu

SEQ ID NO: 3212549 - RNA, 17 nt, Human
acuucaggcucuucucc

SEQ ID NO: 3212550 - RNA, 20 nt, Human
acuucaggcucuucuccuuu

SEQ ID NO: 3212551 - RNA, 17 nt, Human
acuucauugaaaauaua

SEQ ID NO: 3212552 - RNA, 14 nt, Human
acuucauugaaaau

SEQ ID NO: 3212553 - RNA, 22 nt, Human
acuucauguaauuuuauuuuaa

SEQ ID NO: 3212554 - RNA, 23 nt, Human
acuucauguaauuuuauuuuaaa

SEQ ID NO: 3212555 - RNA, 13 nt, Human
ucuauaaacacug

SEQ ID NO: 3212556 - RNA, 21 nt, Human
ucuauaauauuuguguguuca

SEQ ID NO: 3212557 - RNA, 17 nt, Human
ucuauaaacacuguuug

SEQ ID NO: 3212558 - RNA, 15 nt, Human
ucuauaaacacuguu

SEQ ID NO: 3212559 - RNA, 14 nt, Human
ucuauaaacacugu

SEQ ID NO: 3212560 - RNA, 20 nt, Human
ucuauagcaucacuuaaaac

SEQ ID NO: 3212561 - RNA, 15 nt, Human
ucuauaauuuuacaa

SEQ ID NO: 3212562 - RNA, 14 nt, Human
ucuauaauuuuaca

SEQ ID NO: 3212563 - RNA, 17 nt, Human
ucuauagcaucacuuaa

SEQ ID NO: 3212564 - RNA, 19 nt, Human
ucuauagcaucacuuaaaa

SEQ ID NO: 3212565 - RNA, 17 nt, Human
ucuaguguuugauuguc

SEQ ID NO: 3212566 - RNA, 16 nt, Human
ucuagcuuuguuuagu

SEQ ID NO: 3212567 - RNA, 22 nt, Human
ucuagcuuuuuaauuaagcaaa

SEQ ID NO: 3212568 - RNA, 22 nt, Human
ucuagcugaauugagccuaaaa

SEQ ID NO: 3212569 - RNA, 14 nt, Human
ucuaguuauuuauu

SEQ ID NO: 3212570 - RNA, 16 nt, Human
ucuaguuauuuauucu

SEQ ID NO: 3212571 - RNA, 21 nt, Human
acuuccccaauaucuugcuug

SEQ ID NO: 3212572 - RNA, 18 nt, Human
acuuccccaauaucuugc

SEQ ID NO: 3212573 - RNA, 14 nt, Human
ucuagaugauuuuu

SEQ ID NO: 3212574 - RNA, 21 nt, Human
ucuagaugauuuuuugaaagu

SEQ ID NO: 3212575 - RNA, 22 nt, Human
ucuagaugauuuuuugaaaguu

SEQ ID NO: 3212576 - RNA, 16 nt, Human
ucuagauguaaauuuu

SEQ ID NO: 3212577 - RNA, 11 nt, Human
ucuagauguaa

SEQ ID NO: 3212578 - RNA, 16 nt, Human
ucuagauuaauacucu

SEQ ID NO: 3212579 - RNA, 20 nt, Human
ucuagauuaauacucuauuu

SEQ ID NO: 3212580 - RNA, 17 nt, Human
ucuagauuaccaugaag

SEQ ID NO: 3212581 - RNA, 19 nt, Human
ucuagaucuuugugccaaa

SEQ ID NO: 3212582 - RNA, 22 nt, Human
acuuccccaauaucuugcuuga

SEQ ID NO: 3212583 - RNA, 13 nt, Human
ucuagccagagga

SEQ ID NO: 3212584 - RNA, 18 nt, Human
ucuagcacuuccuugcca

SEQ ID NO: 3212585 - RNA, 15 nt, Human
ucuagcguagugcag

SEQ ID NO: 3212586 - RNA, 10 nt, Human
ucuagcugaa

SEQ ID NO: 3212587 - RNA, 15 nt, Human
ucuagcuaugcugua

SEQ ID NO: 3212588 - RNA, 19 nt, Human
ucuagcuaugcuguaucug

SEQ ID NO: 3212589 - RNA, 14 nt, Human
ucuagcccugcccg

SEQ ID NO: 3212590 - RNA, 14 nt, Human
ucuagcacuuccuu

SEQ ID NO: 3212591 - RNA, 17 nt, Human
ucuagcacuuccuugcc

SEQ ID NO: 3212592 - RNA, 15 nt, Human
ucuagcacuuccuug

SEQ ID NO: 3212593 - RNA, 16 nt, Human
acuuccgucacauccc

SEQ ID NO: 3212594 - RNA, 17 nt, Human
ucucacuccuaccuggu

SEQ ID NO: 3212595 - RNA, 16 nt, Human
ucucacuccuaccugg

SEQ ID NO: 3212596 - RNA, 17 nt, Human
acuucgggaggucgagg

SEQ ID NO: 3212597 - RNA, 20 nt, Human
acuucgggaggucgaggcag

SEQ ID NO: 3212598 - RNA, 17 nt, Human
acuuccugcuuccucag

SEQ ID NO: 3212599 - RNA, 16 nt, Human
acuuccugcuuccuca

SEQ ID NO: 3212600 - RNA, 23 nt, Human
acuuccugauugguuucucuucu

SEQ ID NO: 3212601 - RNA, 22 nt, Human
acuuccugauugguuucucuuc

SEQ ID NO: 3212602 - RNA, 21 nt, Human
acuuccugauugguuucucuu

SEQ ID NO: 3212603 - RNA, 13 nt, Human
acuucuaaguaaa

SEQ ID NO: 3212604 - RNA, 19 nt, Human
acuucuaaguaaaaccaca

SEQ ID NO: 3212605 - RNA, 18 nt, Human
acuucuaaguaaaaccac

SEQ ID NO: 3212606 - RNA, 18 nt, Human
acuucuccacccugcucu

SEQ ID NO: 3212607 - RNA, 23 nt, Human
acuucgccaagguuguagcaugg

SEQ ID NO: 3212608 - RNA, 17 nt, Human
ucucaaaacugcacugu

SEQ ID NO: 3212609 - RNA, 20 nt, Human
ucucacauggaaugaggguu

SEQ ID NO: 3212610 - RNA, 22 nt, Human
ucucacauggaaugaggguuug

SEQ ID NO: 3212611 - RNA, 13 nt, Human
ucucacuccuacc

SEQ ID NO: 3212612 - RNA, 23 nt, Human
ucucacauuuuuauaccuguuua

SEQ ID NO: 3212613 - RNA, 16 nt, Human
ucucaaaaaaagaaaa

SEQ ID NO: 3212614 - RNA, 16 nt, Human
ucuauuuuucucuuca

SEQ ID NO: 3212615 - RNA, 16 nt, Human
ucuauuguuucuuuca

SEQ ID NO: 3212616 - RNA, 15 nt, Human
ucuauuguccaaagu

SEQ ID NO: 3212617 - RNA, 12 nt, Human
ucuauauaaaau

SEQ ID NO: 3212618 - RNA, 14 nt, Human
ucuauauaaaauaa

SEQ ID NO: 3212619 - RNA, 15 nt, Human
ucuauauaaaauaac

SEQ ID NO: 3212620 - RNA, 23 nt, Human
ucuauauaaaauaacuaaaaugu

SEQ ID NO: 3212621 - RNA, 15 nt, Human
acuugucggcuccag

SEQ ID NO: 3212622 - RNA, 14 nt, Human
acuugucuuuggac

SEQ ID NO: 3212623 - RNA, 14 nt, Human
acuuguaugaaaga

SEQ ID NO: 3212624 - RNA, 23 nt, Human
acuuggaagcacaccaaucuuac

SEQ ID NO: 3212625 - RNA, 15 nt, Human
acuuggaaauauuaa

SEQ ID NO: 3212626 - RNA, 16 nt, Human
acuuggaaauauuaaa

SEQ ID NO: 3212627 - RNA, 19 nt, Human
acuuggaaauauuaaaaga

SEQ ID NO: 3212628 - RNA, 14 nt, Human
acuuggaagcuccg

SEQ ID NO: 3212629 - RNA, 21 nt, Human
acuugccauuccaaaauauua

SEQ ID NO: 3212630 - RNA, 16 nt, Human
acuugcccugaccaug

SEQ ID NO: 3212631 - RNA, 20 nt, Human
acuugcccugaccaugcauu

SEQ ID NO: 3212632 - RNA, 21 nt, Human
acuugcccugaccaugcauuu

SEQ ID NO: 3212633 - RNA, 19 nt, Human
acuugcauuuuugcaggag

SEQ ID NO: 3212634 - RNA, 18 nt, Human
acuugcauuuuugcagga

SEQ ID NO: 3212635 - RNA, 17 nt, Human
acuugcauuuuugcagg

SEQ ID NO: 3212636 - RNA, 14 nt, Human
acuugcauuuuugc

SEQ ID NO: 3212637 - RNA, 23 nt, Human
acuugauaagggacugauguuug

SEQ ID NO: 3212638 - RNA, 21 nt, Human
acuugaacccgggaggcagag

SEQ ID NO: 3212639 - RNA, 23 nt, Human
acuugaacccgggaggcagaggu

SEQ ID NO: 3212640 - RNA, 22 nt, Human
acuugaguggagguuuauaguu

SEQ ID NO: 3212641 - RNA, 21 nt, Human
acuugaguaaaauacucuuuu

SEQ ID NO: 3212642 - RNA, 18 nt, Human
acuugaguaaaauacucu

SEQ ID NO: 3212643 - RNA, 20 nt, Human
acuugaagccugcuccuucc

SEQ ID NO: 3212644 - RNA, 19 nt, Human
acuugaagccugcuccuuc

SEQ ID NO: 3212645 - RNA, 16 nt, Human
acuugaagccugcucc

SEQ ID NO: 3212646 - RNA, 14 nt, Human
acuugaagccugcu

SEQ ID NO: 3212647 - RNA, 16 nt, Human
ucuggcagcucagaga

SEQ ID NO: 3212648 - RNA, 17 nt, Human
ucuggcagcucagagag

SEQ ID NO: 3212649 - RNA, 20 nt, Human
ucuggcagaguugaagacag

SEQ ID NO: 3212650 - RNA, 23 nt, Human
ucuggcagaguugaagacagagc

SEQ ID NO: 3212651 - RNA, 18 nt, Human
ucuggcagcucagagagg

SEQ ID NO: 3212652 - RNA, 21 nt, Human
ucuggcagcucagagagggug

SEQ ID NO: 3212653 - RNA, 17 nt, Human
ucuggcacagccugcac

SEQ ID NO: 3212654 - RNA, 16 nt, Human
ucuggcacagccugca

SEQ ID NO: 3212655 - RNA, 15 nt, Human
ucuggcacagccugc

SEQ ID NO: 3212656 - RNA, 22 nt, Human
ucugcuuugggguuuaucagaa

SEQ ID NO: 3212657 - RNA, 15 nt, Human
ucugcuuuguugugu

SEQ ID NO: 3212658 - RNA, 13 nt, Human
ucugcuuuuaucu

SEQ ID NO: 3212659 - RNA, 22 nt, Human
ucugcuuuuaucucagauguua

SEQ ID NO: 3212660 - RNA, 22 nt, Human
ucugcuuuguugugugccucua

SEQ ID NO: 3212661 - RNA, 18 nt, Human
ucugcuuuguugugugcc

SEQ ID NO: 3212662 - RNA, 14 nt, Human
ucugccugucuccc

SEQ ID NO: 3212663 - RNA, 12 nt, Human
ucugccugucuc

SEQ ID NO: 3212664 - RNA, 14 nt, Human
ucuggcacagccug

SEQ ID NO: 3212665 - RNA, 13 nt, Human
ucuggcacagccu

SEQ ID NO: 3212666 - RNA, 22 nt, Human
ucuggcaauggaugaacugaaa

SEQ ID NO: 3212667 - RNA, 23 nt, Human
agaagugacgguuccuacacagg

SEQ ID NO: 3212668 - RNA, 17 nt, Human
agaagugacgguuccua

SEQ ID NO: 3212669 - RNA, 16 nt, Human
agaagugacgguuccu

SEQ ID NO: 3212670 - RNA, 23 nt, Human
agaagcucccugaaguaagcaaa

SEQ ID NO: 3212671 - RNA, 20 nt, Human
agaaguucuuugauucugua

SEQ ID NO: 3212672 - RNA, 15 nt, Human
agaaguucuuugauu

SEQ ID NO: 3212673 - RNA, 22 nt, Human
agaaguuugagaucagccuggg

SEQ ID NO: 3212674 - RNA, 13 nt, Human
agaaguuucuguc

SEQ ID NO: 3212675 - RNA, 21 nt, Human
agaaguucuuugauucuguaa

SEQ ID NO: 3212676 - RNA, 17 nt, Human
agaaguuuaaggaauau

SEQ ID NO: 3212677 - RNA, 16 nt, Human
agaaguuuaaggaaua

SEQ ID NO: 3212678 - RNA, 15 nt, Human
agaaguuuaaggaau

SEQ ID NO: 3212679 - RNA, 13 nt, Human
agaaguuuaaaua

SEQ ID NO: 3212680 - RNA, 12 nt, Human
agaaguuuaaau

SEQ ID NO: 3212681 - RNA, 13 nt, Human
agaauaaacuggc

SEQ ID NO: 3212682 - RNA, 20 nt, Human
agaauaaacuuacauauuua

SEQ ID NO: 3212683 - RNA, 23 nt, Human
agaauaaagccuugugaucacuu

SEQ ID NO: 3212684 - RNA, 15 nt, Human
agaauaaaggcagcu

SEQ ID NO: 3212685 - RNA, 23 nt, Human
agaauagggcccaugggagggag

SEQ ID NO: 3212686 - RNA, 16 nt, Human
agaaucaauuuaagug

SEQ ID NO: 3212687 - RNA, 21 nt, Human
agaauaggacuuguuuuuguu

SEQ ID NO: 3212688 - RNA, 17 nt, Human
agaauaggacuuguuuu

SEQ ID NO: 3212689 - RNA, 16 nt, Human
agaauaggacuuguuu

SEQ ID NO: 3212690 - RNA, 15 nt, Human
agaauaggacuuguu

SEQ ID NO: 3212691 - RNA, 14 nt, Human
agaauacugaugga

SEQ ID NO: 3212692 - RNA, 11 nt, Human
agaauacugau

SEQ ID NO: 3212693 - RNA, 15 nt, Human
agaauaauuugguau

SEQ ID NO: 3212694 - RNA, 14 nt, Human
ucugaaguuauauu

SEQ ID NO: 3212695 - RNA, 18 nt, Human
ucugaaguuauauuuccu

SEQ ID NO: 3212696 - RNA, 17 nt, Human
ucugaaguuauauuucc

SEQ ID NO: 3212697 - RNA, 19 nt, Human
ucugaauaagcacuuuuua

SEQ ID NO: 3212698 - RNA, 15 nt, Human
ucugaaucuucugaa

SEQ ID NO: 3212699 - RNA, 18 nt, Human
ucugaauaagcacuuuuu

SEQ ID NO: 3212700 - RNA, 15 nt, Human
ucugaauaagcacuu

SEQ ID NO: 3212701 - RNA, 19 nt, Human
ucugaaguuauauuuccua

SEQ ID NO: 3212702 - RNA, 13 nt, Human
agaaauuaacuua

SEQ ID NO: 3212703 - RNA, 17 nt, Human
ucugaaucuucugaaac

SEQ ID NO: 3212704 - RNA, 13 nt, Human
agaaauuagggcu

SEQ ID NO: 3212705 - RNA, 20 nt, Human
agaaauuagggcucuaauuu

SEQ ID NO: 3212706 - RNA, 19 nt, Human
agaaauuagggcucuaauu

SEQ ID NO: 3212707 - RNA, 23 nt, Human
agaaauuagggcucuaauuuccu

SEQ ID NO: 3212708 - RNA, 22 nt, Human
agaaauuagggcucuaauuucc

SEQ ID NO: 3212709 - RNA, 21 nt, Human
agaaauuagggcucuaauuuc

SEQ ID NO: 3212710 - RNA, 17 nt, Human
agaacucccuuucaaca

SEQ ID NO: 3212711 - RNA, 15 nt, Human
agaacucccuuucaa

SEQ ID NO: 3212712 - RNA, 16 nt, Human
agaacucccuuucaac

SEQ ID NO: 3212713 - RNA, 18 nt, Human
agaacugcagucacugca

SEQ ID NO: 3212714 - RNA, 16 nt, Human
agaacugcagucacug

SEQ ID NO: 3212715 - RNA, 19 nt, Human
agaaccuuuugagugccuu

SEQ ID NO: 3212716 - RNA, 23 nt, Human
agaaccuuuugagugccuuacac

SEQ ID NO: 3212717 - RNA, 22 nt, Human
agaacgccagggaccccagaau

SEQ ID NO: 3212718 - RNA, 19 nt, Human
agaacuaucuucaucugag

SEQ ID NO: 3212719 - RNA, 18 nt, Human
agaacuaucuucaucuga

SEQ ID NO: 3212720 - RNA, 13 nt, Human
agaacuaucuuca

SEQ ID NO: 3212721 - RNA, 17 nt, Human
agaacuaucuucaucug

SEQ ID NO: 3212722 - RNA, 14 nt, Human
agaacuaucuucau

SEQ ID NO: 3212723 - RNA, 20 nt, Human
agaacuaccuggauuuguau

SEQ ID NO: 3212724 - RNA, 16 nt, Human
agaacgcugauuuaaa

SEQ ID NO: 3212725 - RNA, 19 nt, Human
agaagcaacccaaauguuc

SEQ ID NO: 3212726 - RNA, 17 nt, Human
agaacuuuguauaguua

SEQ ID NO: 3212727 - RNA, 13 nt, Human
agaacuuuguaua

SEQ ID NO: 3212728 - RNA, 15 nt, Human
agaacuuuguauagu

SEQ ID NO: 3212729 - RNA, 16 nt, Human
agaagcagaggaagga

SEQ ID NO: 3212730 - RNA, 17 nt, Human
agaacuugaagccugcu

SEQ ID NO: 3212731 - RNA, 23 nt, Human
agaacugcagucacugcacguuu

SEQ ID NO: 3212732 - RNA, 22 nt, Human
agaacuugaagccugcuccuuc

SEQ ID NO: 3212733 - RNA, 14 nt, Human
agaacuugcugccu

SEQ ID NO: 3212734 - RNA, 17 nt, Human
agaacuuguuuaauaaa

SEQ ID NO: 3212735 - RNA, 12 nt, Human
agaacuuguuua

SEQ ID NO: 3212736 - RNA, 15 nt, Human
agaacuugcugccuc

SEQ ID NO: 3212737 - RNA, 12 nt, Human
agaacuuuguau

SEQ ID NO: 3212738 - RNA, 18 nt, Human
agaagccacccaaagcag

SEQ ID NO: 3212739 - RNA, 17 nt, Human
agaagccacccaaagca

SEQ ID NO: 3212740 - RNA, 20 nt, Human
ucugcccauccugccccuga

SEQ ID NO: 3212741 - RNA, 18 nt, Human
ucugcccagcuuuucauu

SEQ ID NO: 3212742 - RNA, 17 nt, Human
ucugcccagcuuuucau

SEQ ID NO: 3212743 - RNA, 23 nt, Human
ucugcccacucccugcaaccuga

SEQ ID NO: 3212744 - RNA, 13 nt, Human
ucugcccagcuuu

SEQ ID NO: 3212745 - RNA, 23 nt, Human
agaagcccaggaaaggcuccagg

SEQ ID NO: 3212746 - RNA, 12 nt, Human
ucugcccuuggu

SEQ ID NO: 3212747 - RNA, 22 nt, Human
ucugcccugcgggucacaggag

SEQ ID NO: 3212748 - RNA, 22 nt, Human
ucugccccaaguuuugugaaau

SEQ ID NO: 3212749 - RNA, 16 nt, Human
ucugccccaaguuuug

SEQ ID NO: 3212750 - RNA, 15 nt, Human
ucugccccaaguuuu

SEQ ID NO: 3212751 - RNA, 18 nt, Human
ucugccccagcuugggca

SEQ ID NO: 3212752 - RNA, 14 nt, Human
ucugccccagcuug

SEQ ID NO: 3212753 - RNA, 23 nt, Human
acuuuggaaagaguaggaagacu

SEQ ID NO: 3212754 - RNA, 14 nt, Human
acuuuguauaguua

SEQ ID NO: 3212755 - RNA, 17 nt, Human
acuuuguauaguuaugu

SEQ ID NO: 3212756 - RNA, 18 nt, Human
acuuuguauaguuaugua

SEQ ID NO: 3212757 - RNA, 21 nt, Human
acuuuguauaguuauguaaau

SEQ ID NO: 3212758 - RNA, 12 nt, Human
acuuuguauagu

SEQ ID NO: 3212759 - RNA, 14 nt, Human
acuuuguauacaag

SEQ ID NO: 3212760 - RNA, 16 nt, Human
acuuuguauacaagua

SEQ ID NO: 3212761 - RNA, 19 nt, Human
acuuuggaaaguagaaaag

SEQ ID NO: 3212762 - RNA, 13 nt, Human
acuuuggaaagag

SEQ ID NO: 3212763 - RNA, 14 nt, Human
acuuuggaaagagu

SEQ ID NO: 3212764 - RNA, 23 nt, Human
acuuuggaaagacuuuuccaacc

SEQ ID NO: 3212765 - RNA, 23 nt, Human
acuuugauucacauguuuucaaa

SEQ ID NO: 3212766 - RNA, 19 nt, Human
acuuugauucacauguuuu

SEQ ID NO: 3212767 - RNA, 18 nt, Human
acuuugauucacauguuu

SEQ ID NO: 3212768 - RNA, 17 nt, Human
acuuugauucacauguu

SEQ ID NO: 3212769 - RNA, 13 nt, Human
acuuugauucaca

SEQ ID NO: 3212770 - RNA, 12 nt, Human
acuuugauguca

SEQ ID NO: 3212771 - RNA, 16 nt, Human
acuuugaugucagcag

SEQ ID NO: 3212772 - RNA, 17 nt, Human
acuuugaugucagcagu

SEQ ID NO: 3212773 - RNA, 22 nt, Human
acuuugaugucagcaguugcug

SEQ ID NO: 3212774 - RNA, 10 nt, Human
acuuugaaau

SEQ ID NO: 3212775 - RNA, 17 nt, Human
acuuugaguuaagucua

SEQ ID NO: 3212776 - RNA, 10 nt, Human
acuuugaugu

SEQ ID NO: 3212777 - RNA, 11 nt, Human
acuuugauguc

SEQ ID NO: 3212778 - RNA, 13 nt, Human
acuuugcauuguc

SEQ ID NO: 3212779 - RNA, 16 nt, Human
acuuugcauugucugu

SEQ ID NO: 3212780 - RNA, 22 nt, Human
acuuugcagcacagcugagagg

SEQ ID NO: 3212781 - RNA, 14 nt, Human
acuuuaaaaauuua

SEQ ID NO: 3212782 - RNA, 19 nt, Human
acuuuaaaaauuuacuaca

SEQ ID NO: 3212783 - RNA, 16 nt, Human
acuuuaaaaauuuacu

SEQ ID NO: 3212784 - RNA, 16 nt, Human
acuuucuuuagucuuu

SEQ ID NO: 3212785 - RNA, 16 nt, Human
acuuucuucuucccau

SEQ ID NO: 3212786 - RNA, 16 nt, Human
acuuuaaaaggagcca

SEQ ID NO: 3212787 - RNA, 15 nt, Human
acuuguuuuuguaaa

SEQ ID NO: 3212788 - RNA, 23 nt, Human
acuuguuuuuguuuuuguuuugu

SEQ ID NO: 3212789 - RNA, 21 nt, Human
acuuguuuuuguaaagaaaaa

SEQ ID NO: 3212790 - RNA, 20 nt, Human
acuuguuuuuguaaagaaaa

SEQ ID NO: 3212791 - RNA, 16 nt, Human
acuuguuuuuguaaag

SEQ ID NO: 3212792 - RNA, 16 nt, Human
acuuguuuucugggaa

SEQ ID NO: 3212793 - RNA, 14 nt, Human
acuuguggacacag

SEQ ID NO: 3212794 - RNA, 17 nt, Human
acuugugcacaggcaga

SEQ ID NO: 3212795 - RNA, 23 nt, Human
acuugugacuuuugcuuuaauuc

SEQ ID NO: 3212796 - RNA, 13 nt, Human
acuugucuuucug

SEQ ID NO: 3212797 - RNA, 19 nt, Human
acuugugacuuuugcuuua

SEQ ID NO: 3212798 - RNA, 17 nt, Human
acuugugacuuuugcuu

SEQ ID NO: 3212799 - RNA, 14 nt, Human
acuugugacuuuug

SEQ ID NO: 3212800 - RNA, 23 nt, Human
acuugucuuucugggguuuuucu

SEQ ID NO: 3212801 - RNA, 16 nt, Human
acuugucuuucugggg

SEQ ID NO: 3212802 - RNA, 14 nt, Human
acuugucuuucugg

SEQ ID NO: 3212803 - RNA, 19 nt, Human
ucucuccauuucacuggcu

SEQ ID NO: 3212804 - RNA, 12 nt, Human
ucucucaggcca

SEQ ID NO: 3212805 - RNA, 15 nt, Human
ucucggcucacugca

SEQ ID NO: 3212806 - RNA, 20 nt, Human
ucucggaucaggcucccagg

SEQ ID NO: 3212807 - RNA, 19 nt, Human
ucucgcucuguugcccagg

SEQ ID NO: 3212808 - RNA, 18 nt, Human
ucucgcucuguugcccag

SEQ ID NO: 3212809 - RNA, 21 nt, Human
ucucgcucuguugcccaggcu

SEQ ID NO: 3212810 - RNA, 21 nt, Human
ucucgcggccucuucucucag

SEQ ID NO: 3212811 - RNA, 20 nt, Human
ucucgcuauugucaccaggg

SEQ ID NO: 3212812 - RNA, 17 nt, Human
ucucgaacuccugaccu

SEQ ID NO: 3212813 - RNA, 17 nt, Human
ucuccuugguuauauuu

SEQ ID NO: 3212814 - RNA, 16 nt, Human
acuuuguguucaccuu

SEQ ID NO: 3212815 - RNA, 20 nt, Human
acuuugucuaagaaacauug

SEQ ID NO: 3212816 - RNA, 19 nt, Human
acuuugucuaagaaacauu

SEQ ID NO: 3212817 - RNA, 16 nt, Human
acuuugucuaagaaac

SEQ ID NO: 3212818 - RNA, 23 nt, Human
acuuuguauaguuauguaaauaa

SEQ ID NO: 3212819 - RNA, 15 nt, Human
acuuuguauuguccu

SEQ ID NO: 3212820 - RNA, 24 nt, Human
acuuuguauuguccuauuaguguu

SEQ ID NO: 3212821 - RNA, 18 nt, Human
agaaaaaaacauucuauc

SEQ ID NO: 3212822 - RNA, 22 nt, Human
agaaaaaaacauucuaucuacu

SEQ ID NO: 3212823 - RNA, 14 nt, Human
agaaaaaaaagaaa

SEQ ID NO: 3212824 - RNA, 19 nt, Human
agaaaaaaaaagaaaaaag

SEQ ID NO: 3212825 - RNA, 16 nt, Human
agaaaaaaaaagaaaa

SEQ ID NO: 3212826 - RNA, 18 nt, Human
agaaaaaaaaagaaaaaa

SEQ ID NO: 3212827 - RNA, 17 nt, Human
agaaaaaaaaagaaaaa

SEQ ID NO: 3212828 - RNA, 21 nt, Human
ucuccuuggugucgggcauga

SEQ ID NO: 3212829 - RNA, 23 nt, Human
ucuccuuggugucgggcaugaca

SEQ ID NO: 3212830 - RNA, 17 nt, Human
ucuccuuagcuucuggc

SEQ ID NO: 3212831 - RNA, 20 nt, Human
agaaaaaaaugucaaaagua

SEQ ID NO: 3212832 - RNA, 19 nt, Human
agaaaaaaaugucaaaagu

SEQ ID NO: 3212833 - RNA, 13 nt, Human
agaaaaaaauguc

SEQ ID NO: 3212834 - RNA, 19 nt, Human
ucuccuuaagagacaauuu

SEQ ID NO: 3212835 - RNA, 18 nt, Human
ucuccuuaagagacaauu

SEQ ID NO: 3212836 - RNA, 16 nt, Human
ucucuugguccugcug

SEQ ID NO: 3212837 - RNA, 17 nt, Human
ucucuugguccugcugc

SEQ ID NO: 3212838 - RNA, 18 nt, Human
ucucuugguccugcugca

SEQ ID NO: 3212839 - RNA, 21 nt, Human
agaaaacaaaaaacgaaugaa

SEQ ID NO: 3212840 - RNA, 21 nt, Human
agaaaacaaaaccaaaaguua

SEQ ID NO: 3212841 - RNA, 17 nt, Human
agaaaaaugagccuggc

SEQ ID NO: 3212842 - RNA, 16 nt, Human
agaaaaaugugaauuu

SEQ ID NO: 3212843 - RNA, 16 nt, Human
agaaaaauuucacgau

SEQ ID NO: 3212844 - RNA, 12 nt, Human
agaaaacaaaaa

SEQ ID NO: 3212845 - RNA, 18 nt, Human
agaaaaaugagccuggca

SEQ ID NO: 3212846 - RNA, 19 nt, Human
agaaaaacaaugguaacau

SEQ ID NO: 3212847 - RNA, 22 nt, Human
agaaaaacaaugguaacauuuu

SEQ ID NO: 3212848 - RNA, 13 nt, Human
agaaaaacaaauc

SEQ ID NO: 3212849 - RNA, 19 nt, Human
agaaaaaauauuuucccua

SEQ ID NO: 3212850 - RNA, 17 nt, Human
agaaaaaauauuuuccu

SEQ ID NO: 3212851 - RNA, 23 nt, Human
agaaaaaauauuuuccugccagg

SEQ ID NO: 3212852 - RNA, 20 nt, Human
agaaacacauaauuaacacu

SEQ ID NO: 3212853 - RNA, 18 nt, Human
agaaacacccacaggcau

SEQ ID NO: 3212854 - RNA, 14 nt, Human
agaaacauuggaag

SEQ ID NO: 3212855 - RNA, 13 nt, Human
agaaacauuggaa

SEQ ID NO: 3212856 - RNA, 16 nt, Human
agaaacauuggaagca

SEQ ID NO: 3212857 - RNA, 15 nt, Human
agaaacuggaacucu

SEQ ID NO: 3212858 - RNA, 22 nt, Human
agaaacugucuagcacuuccuu

SEQ ID NO: 3212859 - RNA, 17 nt, Human
agaaacugucuagcacu

SEQ ID NO: 3212860 - RNA, 23 nt, Human
agaaacugucuagcacuuccuug

SEQ ID NO: 3212861 - RNA, 21 nt, Human
agaaacuuaaauuuuaguucu

SEQ ID NO: 3212862 - RNA, 15 nt, Human
agaaacaauuucugu

SEQ ID NO: 3212863 - RNA, 14 nt, Human
agaaacaauuucug

SEQ ID NO: 3212864 - RNA, 13 nt, Human
agaaacaauuucu

SEQ ID NO: 3212865 - RNA, 19 nt, Human
agaaaagauguagauuuau

SEQ ID NO: 3212866 - RNA, 13 nt, Human
agaaaagagagaa

SEQ ID NO: 3212867 - RNA, 16 nt, Human
agaaauaguucuguga

SEQ ID NO: 3212868 - RNA, 15 nt, Human
agaaauaguucugug

SEQ ID NO: 3212869 - RNA, 13 nt, Human
agaaauagacaaa

SEQ ID NO: 3212870 - RNA, 14 nt, Human
agaaauagacaaaa

SEQ ID NO: 3212871 - RNA, 17 nt, Human
agaaauagacaaaaagu

SEQ ID NO: 3212872 - RNA, 18 nt, Human
agaaauagacaaaaagua

SEQ ID NO: 3212873 - RNA, 21 nt, Human
agaaauagacaaaaaguauau

SEQ ID NO: 3212874 - RNA, 22 nt, Human
agaaauagacaaaaaguauauu

SEQ ID NO: 3212875 - RNA, 13 nt, Human
agaaauacuguac

SEQ ID NO: 3212876 - RNA, 16 nt, Human
agaaauacuguacaau

SEQ ID NO: 3212877 - RNA, 14 nt, Human
agaaauacuguaca

SEQ ID NO: 3212878 - RNA, 20 nt, Human
agaaauacagauaaaugauu

SEQ ID NO: 3212879 - RNA, 20 nt, Human
agaaaucuauagaaaguguu

SEQ ID NO: 3212880 - RNA, 19 nt, Human
agaaaucuauagaaagugu

SEQ ID NO: 3212881 - RNA, 21 nt, Human
agaaaucuauagaaaguguuc

SEQ ID NO: 3212882 - RNA, 18 nt, Human
ucugaaggcuggguucug

SEQ ID NO: 3212883 - RNA, 20 nt, Human
ucugaaggaggccaccuccu

SEQ ID NO: 3212884 - RNA, 19 nt, Human
ucugaaggaggccaccucc

SEQ ID NO: 3212885 - RNA, 18 nt, Human
ucugaaggaggccaccuc

SEQ ID NO: 3212886 - RNA, 22 nt, Human
ucugaaggacauugcggacagc

SEQ ID NO: 3212887 - RNA, 17 nt, Human
ucugaaggaggccaccu

SEQ ID NO: 3212888 - RNA, 15 nt, Human
agaaaucuaagcugu

SEQ ID NO: 3212889 - RNA, 17 nt, Human
agaaagcagaacaguga

SEQ ID NO: 3212890 - RNA, 18 nt, Human
agaaagcagaacagugau

SEQ ID NO: 3212891 - RNA, 15 nt, Human
agaaagcaagaugua

SEQ ID NO: 3212892 - RNA, 21 nt, Human
agaaagcaaaauuauguuugc

SEQ ID NO: 3212893 - RNA, 17 nt, Human
agaaagcaaaauuaugu

SEQ ID NO: 3212894 - RNA, 15 nt, Human
agaaagcaaaauuau

SEQ ID NO: 3212895 - RNA, 20 nt, Human
agaaagcagaacagugauua

SEQ ID NO: 3212896 - RNA, 15 nt, Human
agaaagcauauugac

SEQ ID NO: 3212897 - RNA, 16 nt, Human
agaaagcauauugacu

SEQ ID NO: 3212898 - RNA, 17 nt, Human
agaaagcauauugacuu

SEQ ID NO: 3212899 - RNA, 19 nt, Human
agaaauaaugucaaaaaua

SEQ ID NO: 3212900 - RNA, 18 nt, Human
agaaauacagauaaauga

SEQ ID NO: 3212901 - RNA, 16 nt, Human
agaaagacuauucaaa

SEQ ID NO: 3212902 - RNA, 23 nt, Human
agaaagacuauucaaacagucuc

SEQ ID NO: 3212903 - RNA, 22 nt, Human
agaaagacuaucuaaauguuga

SEQ ID NO: 3212904 - RNA, 20 nt, Human
agaaagacuaucuaaauguu

SEQ ID NO: 3212905 - RNA, 16 nt, Human
ucuuuaacuuguaaua

SEQ ID NO: 3212906 - RNA, 12 nt, Human
ucuuuaacuugu

SEQ ID NO: 3212907 - RNA, 15 nt, Human
ucuugguccugcugc

SEQ ID NO: 3212908 - RNA, 17 nt, Human
ucuugguccugcugcag

SEQ ID NO: 3212909 - RNA, 19 nt, Human
ucuugguccugcugcaguu

SEQ ID NO: 3212910 - RNA, 14 nt, Human
ucuugguauuugga

SEQ ID NO: 3212911 - RNA, 22 nt, Human
ucuugguauuuggauaucuguu

SEQ ID NO: 3212912 - RNA, 17 nt, Human
ucuuuccugaggcuggg

SEQ ID NO: 3212913 - RNA, 15 nt, Human
ucuuucucugaggac

SEQ ID NO: 3212914 - RNA, 13 nt, Human
ucuuucucugagg

SEQ ID NO: 3212915 - RNA, 18 nt, Human
ucuuucuaaugugugaau

SEQ ID NO: 3212916 - RNA, 14 nt, Human
ucuuucuaagaaau

SEQ ID NO: 3212917 - RNA, 16 nt, Human
ucuuuccugaggcugg

SEQ ID NO: 3212918 - RNA, 12 nt, Human
ucuuuauugucu

SEQ ID NO: 3212919 - RNA, 13 nt, Human
ucuuuauugucug

SEQ ID NO: 3212920 - RNA, 14 nt, Human
ucuuuauugucugu

SEQ ID NO: 3212921 - RNA, 16 nt, Human
ucuuuauugucuguaa

SEQ ID NO: 3212922 - RNA, 17 nt, Human
ucuuuauugucuguaaa

SEQ ID NO: 3212923 - RNA, 12 nt, Human
ucuuuauugaaa

SEQ ID NO: 3212924 - RNA, 14 nt, Human
ucuuuauugaaauu

SEQ ID NO: 3212925 - RNA, 15 nt, Human
ucuuuauugaaauuc

SEQ ID NO: 3212926 - RNA, 21 nt, Human
ucuugggcaauauucucugua

SEQ ID NO: 3212927 - RNA, 17 nt, Human
ucuugggcaauauucuc

SEQ ID NO: 3212928 - RNA, 24 nt, Human
ucuugggcaauauucucuguacau

SEQ ID NO: 3212929 - RNA, 22 nt, Human
ucuugggcaauauucucuguac

SEQ ID NO: 3212930 - RNA, 16 nt, Human
ucuugggggaaaauac

SEQ ID NO: 3212931 - RNA, 17 nt, Human
ucuuggucagauuugaa

SEQ ID NO: 3212932 - RNA, 14 nt, Human
ucuugguccugcug

SEQ ID NO: 3212933 - RNA, 22 nt, Human
ucuugcaauggcagccuuggca

SEQ ID NO: 3212934 - RNA, 18 nt, Human
ucuugcaauggcagccuu

SEQ ID NO: 3212935 - RNA, 19 nt, Human
ucuugcaauggcagccuug

SEQ ID NO: 3212936 - RNA, 16 nt, Human
ucuuggccuuacugua

SEQ ID NO: 3212937 - RNA, 23 nt, Human
ucuugauucguagauuuaauaac

SEQ ID NO: 3212938 - RNA, 13 nt, Human
ucuugauucauaa

SEQ ID NO: 3212939 - RNA, 20 nt, Human
ucuugaguuguuuuuguaua

SEQ ID NO: 3212940 - RNA, 21 nt, Human
ucuugaguuguuuuuguauau

SEQ ID NO: 3212941 - RNA, 15 nt, Human
ucuugacucuugccu

SEQ ID NO: 3212942 - RNA, 13 nt, Human
ucuugagccuggg

SEQ ID NO: 3212943 - RNA, 16 nt, Human
ucuugagccugggagg

SEQ ID NO: 3212944 - RNA, 15 nt, Human
agacuauucaaacag

SEQ ID NO: 3212945 - RNA, 14 nt, Human
agacuauucaaaca

SEQ ID NO: 3212946 - RNA, 12 nt, Human
agacuauucaaa

SEQ ID NO: 3212947 - RNA, 21 nt, Human
agaccuucuccuucaccuuug

SEQ ID NO: 3212948 - RNA, 23 nt, Human
agaccuucuccuucaccuuuguc

SEQ ID NO: 3212949 - RNA, 15 nt, Human
agaccuucuccuuca

SEQ ID NO: 3212950 - RNA, 18 nt, Human
agaccuucuccuucaccu

SEQ ID NO: 3212951 - RNA, 11 nt, Human
agaccuucucc

SEQ ID NO: 3212952 - RNA, 20 nt, Human
agaccuggggcugcugugaa

SEQ ID NO: 3212953 - RNA, 19 nt, Human
agacccccuggagacuaac

SEQ ID NO: 3212954 - RNA, 15 nt, Human
agacccccuggagac

SEQ ID NO: 3212955 - RNA, 14 nt, Human
agacccccuggaga

SEQ ID NO: 3212956 - RNA, 13 nt, Human
agacccccuggag

SEQ ID NO: 3212957 - RNA, 17 nt, Human
agacaucaacagauaaa

SEQ ID NO: 3212958 - RNA, 18 nt, Human
agacaucaacagauaaau

SEQ ID NO: 3212959 - RNA, 14 nt, Human
agacauauuuacaa

SEQ ID NO: 3212960 - RNA, 14 nt, Human
agacauagaauuaa

SEQ ID NO: 3212961 - RNA, 21 nt, Human
agacauagaauuaacacauga

SEQ ID NO: 3212962 - RNA, 21 nt, Human
ucuucugaacuuggcgcugcc

SEQ ID NO: 3212963 - RNA, 12 nt, Human
ucuucugcuuca

SEQ ID NO: 3212964 - RNA, 16 nt, Human
ucuucugcucuuucuu

SEQ ID NO: 3212965 - RNA, 18 nt, Human
ucuucugcucuuucuucu

SEQ ID NO: 3212966 - RNA, 22 nt, Human
ucuucugcucuuucuucuucca

SEQ ID NO: 3212967 - RNA, 23 nt, Human
ucuucuguacgucugacaggcaa

SEQ ID NO: 3212968 - RNA, 15 nt, Human
ucuucuguacgucug

SEQ ID NO: 3212969 - RNA, 18 nt, Human
ucuucuggguuccuuccu

SEQ ID NO: 3212970 - RNA, 15 nt, Human
ucuucuguaauauuu

SEQ ID NO: 3212971 - RNA, 18 nt, Human
ucuucuguaauauuuaca

SEQ ID NO: 3212972 - RNA, 20 nt, Human
ucuucuguggguuucuaaag

SEQ ID NO: 3212973 - RNA, 12 nt, Human
ucuucuguccaa

SEQ ID NO: 3212974 - RNA, 12 nt, Human
ucuucuguguuu

SEQ ID NO: 3212975 - RNA, 12 nt, Human
ucuucucucaga

SEQ ID NO: 3212976 - RNA, 13 nt, Human
ucuucucucagac

SEQ ID NO: 3212977 - RNA, 21 nt, Human
ucuuccucugcuaaauugaug

SEQ ID NO: 3212978 - RNA, 14 nt, Human
ucuucucucugcuc

SEQ ID NO: 3212979 - RNA, 12 nt, Human
ucuucucucugc

SEQ ID NO: 3212980 - RNA, 17 nt, Human
ucuucucucugcucuga

SEQ ID NO: 3212981 - RNA, 15 nt, Human
ucuuccucccucccu

SEQ ID NO: 3212982 - RNA, 14 nt, Human
ucuuccuccugaca

SEQ ID NO: 3212983 - RNA, 12 nt, Human
ucuuccuccuga

SEQ ID NO: 3212984 - RNA, 20 nt, Human
ucuuccuccaaggacagaag

SEQ ID NO: 3212985 - RNA, 14 nt, Human
ucuuccucugcuga

SEQ ID NO: 3212986 - RNA, 19 nt, Human
ucuuccucugcuaaauuga

SEQ ID NO: 3212987 - RNA, 12 nt, Human
ucuuccucugcu

SEQ ID NO: 3212988 - RNA, 11 nt, Human
ucuuccucugc

SEQ ID NO: 3212989 - RNA, 19 nt, Human
ucuucccuacaguugaaaa

SEQ ID NO: 3212990 - RNA, 14 nt, Human
ucuuccucccuccc

SEQ ID NO: 3212991 - RNA, 16 nt, Human
ucuuccuccaaggaca

SEQ ID NO: 3212992 - RNA, 14 nt, Human
ucuucccauggugc

SEQ ID NO: 3212993 - RNA, 13 nt, Human
ucuuccccaggaa

SEQ ID NO: 3212994 - RNA, 14 nt, Human
agaaucacuugaac

SEQ ID NO: 3212995 - RNA, 16 nt, Human
agaaucagaagauagu

SEQ ID NO: 3212996 - RNA, 17 nt, Human
agaaucagaagauaguc

SEQ ID NO: 3212997 - RNA, 22 nt, Human
agaaucaccuaauuaauuucag

SEQ ID NO: 3212998 - RNA, 19 nt, Human
agaaucaccuaauuaauuu

SEQ ID NO: 3212999 - RNA, 16 nt, Human
agaaucacaggcuggg

SEQ ID NO: 3213000 - RNA, 15 nt, Human
agaaucacaggcugg

SEQ ID NO: 3213001 - RNA, 13 nt, Human
agaaucacaggcu

SEQ ID NO: 3213002 - RNA, 19 nt, Human
ucuucaacugaccagccuc

SEQ ID NO: 3213003 - RNA, 16 nt, Human
ucuucaacugaccagc

SEQ ID NO: 3213004 - RNA, 15 nt, Human
ucuucaacucccugc

SEQ ID NO: 3213005 - RNA, 17 nt, Human
ucuucagagacuccugc

SEQ ID NO: 3213006 - RNA, 18 nt, Human
ucuucagagacuccugca

SEQ ID NO: 3213007 - RNA, 12 nt, Human
ucuucagagacu

SEQ ID NO: 3213008 - RNA, 20 nt, Human
ucuucagagacuccugcagg

SEQ ID NO: 3213009 - RNA, 15 nt, Human
ucuuccaggcuggga

SEQ ID NO: 3213010 - RNA, 17 nt, Human
ucuuccaggcugggaga

SEQ ID NO: 3213011 - RNA, 20 nt, Human
ucuuccaggcugggagagcc

SEQ ID NO: 3213012 - RNA, 21 nt, Human
ucuucccaacuugccuuugaa

SEQ ID NO: 3213013 - RNA, 18 nt, Human
ucuucccaacuugccuuu

SEQ ID NO: 3213014 - RNA, 19 nt, Human
agagauguguaauuuuucu

SEQ ID NO: 3213015 - RNA, 22 nt, Human
agagcaaccccuggaccccagc

SEQ ID NO: 3213016 - RNA, 21 nt, Human
agagcaaccccuggaccccag

SEQ ID NO: 3213017 - RNA, 18 nt, Human
agagcaaccccuggaccc

SEQ ID NO: 3213018 - RNA, 19 nt, Human
agagcaagacgcugugcug

SEQ ID NO: 3213019 - RNA, 23 nt, Human
agagcaagacgcugugcugcccu

SEQ ID NO: 3213020 - RNA, 20 nt, Human
agagauggcuuacaaaaaga

SEQ ID NO: 3213021 - RNA, 23 nt, Human
agagauggcuuacaaaaagaaau

SEQ ID NO: 3213022 - RNA, 23 nt, Human
agagauguccauuuuuacaaguu

SEQ ID NO: 3213023 - RNA, 13 nt, Human
agagauguguaau

SEQ ID NO: 3213024 - RNA, 18 nt, Human
agagauguguaauuuuuc

SEQ ID NO: 3213025 - RNA, 14 nt, Human
agagauguguaauu

SEQ ID NO: 3213026 - RNA, 16 nt, Human
agagaugucucuuaua

SEQ ID NO: 3213027 - RNA, 23 nt, Human
agagacuccugcaggcagccagg

SEQ ID NO: 3213028 - RNA, 15 nt, Human
agagagaaagcauau

SEQ ID NO: 3213029 - RNA, 22 nt, Human
agagaucaaccccuucgcuccu

SEQ ID NO: 3213030 - RNA, 13 nt, Human
agagauauuuugu

SEQ ID NO: 3213031 - RNA, 14 nt, Human
agagauauuuugua

SEQ ID NO: 3213032 - RNA, 15 nt, Human
agagauauuuuguaa

SEQ ID NO: 3213033 - RNA, 16 nt, Human
agagauauuuuguaaa

SEQ ID NO: 3213034 - RNA, 15 nt, Human
ugaaagacuguacaa

SEQ ID NO: 3213035 - RNA, 13 nt, Human
ugaaagacuguac

SEQ ID NO: 3213036 - RNA, 23 nt, Human
ugaaacuuugagaucuaaaaaua

SEQ ID NO: 3213037 - RNA, 22 nt, Human
ugaaacuuugagaucuaaaaau

SEQ ID NO: 3213038 - RNA, 16 nt, Human
ugaaagaauguaaagc

SEQ ID NO: 3213039 - RNA, 15 nt, Human
ugaaagaauguaaag

SEQ ID NO: 3213040 - RNA, 14 nt, Human
ugaaagaauguaaa

SEQ ID NO: 3213041 - RNA, 14 nt, Human
ugaaacuuugagau

SEQ ID NO: 3213042 - RNA, 12 nt, Human
ugaaacuuugag

SEQ ID NO: 3213043 - RNA, 16 nt, Human
agagacuccagcuggg

SEQ ID NO: 3213044 - RNA, 15 nt, Human
agagacuccugcagg

SEQ ID NO: 3213045 - RNA, 17 nt, Human
agagacuccugcaggca

SEQ ID NO: 3213046 - RNA, 18 nt, Human
agagacuccugcaggcag

SEQ ID NO: 3213047 - RNA, 19 nt, Human
agagacuccugcaggcagc

SEQ ID NO: 3213048 - RNA, 20 nt, Human
agagacuccugcaggcagcc

SEQ ID NO: 3213049 - RNA, 21 nt, Human
agagacuccugcaggcagcca

SEQ ID NO: 3213050 - RNA, 22 nt, Human
agagacuccugcaggcagccag

SEQ ID NO: 3213051 - RNA, 19 nt, Human
agagcaguugagaggacac

SEQ ID NO: 3213052 - RNA, 22 nt, Human
agagcaccuuagacagucccug

SEQ ID NO: 3213053 - RNA, 21 nt, Human
agagcaccuuagacagucccu

SEQ ID NO: 3213054 - RNA, 24 nt, Human
agagcaaccccuggaccccagccu

SEQ ID NO: 3213055 - RNA, 23 nt, Human
agagcaaccccuggaccccagcc

SEQ ID NO: 3213056 - RNA, 23 nt, Human
agagcaccuuagacagucccugc

SEQ ID NO: 3213057 - RNA, 19 nt, Human
agagcagcuccuuccuagc

SEQ ID NO: 3213058 - RNA, 13 nt, Human
agagcagccagga

SEQ ID NO: 3213059 - RNA, 19 nt, Human
agagcagcaaggucuugcu

SEQ ID NO: 3213060 - RNA, 12 nt, Human
agagcugaacag

SEQ ID NO: 3213061 - RNA, 23 nt, Human
agagcuauggacagcauugccag

SEQ ID NO: 3213062 - RNA, 19 nt, Human
agagcuauggacagcauug

SEQ ID NO: 3213063 - RNA, 14 nt, Human
agagcuaggcaggg

SEQ ID NO: 3213064 - RNA, 14 nt, Human
agagcuagagaaau

SEQ ID NO: 3213065 - RNA, 13 nt, Human
agagccuuccagg

SEQ ID NO: 3213066 - RNA, 15 nt, Human
agagccuuccagggg

SEQ ID NO: 3213067 - RNA, 17 nt, Human
agagccuuccaggggug

SEQ ID NO: 3213068 - RNA, 20 nt, Human
agagcuagcagcagggaggg

SEQ ID NO: 3213069 - RNA, 12 nt, Human
ugaaacuuggau

SEQ ID NO: 3213070 - RNA, 17 nt, Human
ugaaacugacuugcugu

SEQ ID NO: 3213071 - RNA, 19 nt, Human
ugaaacuccagaugccaca

SEQ ID NO: 3213072 - RNA, 18 nt, Human
ugaaacuccagaugccac

SEQ ID NO: 3213073 - RNA, 17 nt, Human
ugaaacuccagaugcca

SEQ ID NO: 3213074 - RNA, 16 nt, Human
ugaaacgcaaccacca

SEQ ID NO: 3213075 - RNA, 19 nt, Human
ugaaaaucgugacaacacu

SEQ ID NO: 3213076 - RNA, 17 nt, Human
ugaaaauguauguguaa

SEQ ID NO: 3213077 - RNA, 12 nt, Human
ugaaaauauuua

SEQ ID NO: 3213078 - RNA, 11 nt, Human
ugaaaauauuu

SEQ ID NO: 3213079 - RNA, 14 nt, Human
ugaaaauauuuaaa

SEQ ID NO: 3213080 - RNA, 13 nt, Human
ugaaaauauuuaa

SEQ ID NO: 3213081 - RNA, 16 nt, Human
ugaaaaucgugacaac

SEQ ID NO: 3213082 - RNA, 14 nt, Human
ugaaaaggccaaga

SEQ ID NO: 3213083 - RNA, 21 nt, Human
ugaaaagcuuuguuuguucuu

SEQ ID NO: 3213084 - RNA, 17 nt, Human
ugaaaagcuuuguuugu

SEQ ID NO: 3213085 - RNA, 18 nt, Human
ugaaaaguaauauuuauu

SEQ ID NO: 3213086 - RNA, 19 nt, Human
ugaaaaguaauauuuauua

SEQ ID NO: 3213087 - RNA, 20 nt, Human
ugaaaaguaauauuuauuaa

SEQ ID NO: 3213088 - RNA, 21 nt, Human
ugaaaaguaauauuuauuaaa

SEQ ID NO: 3213089 - RNA, 20 nt, Human
ugaaaauaguuuauuuuaaa

SEQ ID NO: 3213090 - RNA, 22 nt, Human
ugaaaauaguuuauuuuaaaac

SEQ ID NO: 3213091 - RNA, 23 nt, Human
ugaaaauaguuuauuuuaaaaca

SEQ ID NO: 3213092 - RNA, 16 nt, Human
ugaaaauaucggggag

SEQ ID NO: 3213093 - RNA, 13 nt, Human
ugaaaauauauac

SEQ ID NO: 3213094 - RNA, 19 nt, Human
ugaaaaaugagauugaaug

SEQ ID NO: 3213095 - RNA, 20 nt, Human
ugaaaaaucugcuguuaacu

SEQ ID NO: 3213096 - RNA, 22 nt, Human
ugaaaaaguucugcagauaaac

SEQ ID NO: 3213097 - RNA, 20 nt, Human
ugaaaaaggaggaagagaaa

SEQ ID NO: 3213098 - RNA, 22 nt, Human
ugaaaaaggaggaagagaaaaa

SEQ ID NO: 3213099 - RNA, 20 nt, Human
ugaaaaaauuuaaaaguaaa

SEQ ID NO: 3213100 - RNA, 17 nt, Human
ugaaaaaagcaguucuu

SEQ ID NO: 3213101 - RNA, 16 nt, Human
ugaaaaaagcaguucu

SEQ ID NO: 3213102 - RNA, 16 nt, Human
ugaaaaaggaggaaga

SEQ ID NO: 3213103 - RNA, 17 nt, Human
ucuuuuaaauuagaaaa

SEQ ID NO: 3213104 - RNA, 19 nt, Human
ucuuuuaaauuagaaaaua

SEQ ID NO: 3213105 - RNA, 20 nt, Human
ucuuuuaaauuagaaaauau

SEQ ID NO: 3213106 - RNA, 21 nt, Human
ucuuuuaaauuagaaaauauu

SEQ ID NO: 3213107 - RNA, 22 nt, Human
ugaaaaaaaaaaugcugaacau

SEQ ID NO: 3213108 - RNA, 17 nt, Human
ucuuuuaaaaaguauug

SEQ ID NO: 3213109 - RNA, 16 nt, Human
ucuuuuaaaaaguauu

SEQ ID NO: 3213110 - RNA, 14 nt, Human
ucuuuuaaaaagua

SEQ ID NO: 3213111 - RNA, 13 nt, Human
ucuuuuaaaaagu

SEQ ID NO: 3213112 - RNA, 14 nt, Human
ucuuuguuaauuug

SEQ ID NO: 3213113 - RNA, 20 nt, Human
ucuuucugcacacaaauauu

SEQ ID NO: 3213114 - RNA, 21 nt, Human
ucuuucugguuguuuuuaaac

SEQ ID NO: 3213115 - RNA, 13 nt, Human
agagacaggcagg

SEQ ID NO: 3213116 - RNA, 22 nt, Human
agagacaggcaggugaucugcu

SEQ ID NO: 3213117 - RNA, 12 nt, Human
agagacaggcag

SEQ ID NO: 3213118 - RNA, 13 nt, Human
ucuuucucuuuua

SEQ ID NO: 3213119 - RNA, 22 nt, Human
ucuuuggucuacacugugcuga

SEQ ID NO: 3213120 - RNA, 20 nt, Human
agagacaggguuucaccaug

SEQ ID NO: 3213121 - RNA, 14 nt, Human
ucuuuguggcuucc

SEQ ID NO: 3213122 - RNA, 19 nt, Human
agagaccacccauaucaug

SEQ ID NO: 3213123 - RNA, 17 nt, Human
agaguauuuuuguauuc

SEQ ID NO: 3213124 - RNA, 21 nt, Human
agagucaacuacacaaagcag

SEQ ID NO: 3213125 - RNA, 22 nt, Human
agagucaacuacacaaagcagg

SEQ ID NO: 3213126 - RNA, 15 nt, Human
agagucacuggaaca

SEQ ID NO: 3213127 - RNA, 23 nt, Human
agaguuuagcuguaacaguucuu

SEQ ID NO: 3213128 - RNA, 22 nt, Human
agaguuuagcuguaacaguucu

SEQ ID NO: 3213129 - RNA, 19 nt, Human
agaguuucguggcuucagg

SEQ ID NO: 3213130 - RNA, 17 nt, Human
agaguuucuuuacauug

SEQ ID NO: 3213131 - RNA, 17 nt, Human
agaguuugccuuauaaa

SEQ ID NO: 3213132 - RNA, 18 nt, Human
agauaauauuaaggaaga

SEQ ID NO: 3213133 - RNA, 22 nt, Human
agauaauauuaaggaagacaau

SEQ ID NO: 3213134 - RNA, 20 nt, Human
agauacaggaaaagcugcug

SEQ ID NO: 3213135 - RNA, 11 nt, Human
agauauuuuau

SEQ ID NO: 3213136 - RNA, 13 nt, Human
agauauuugcacc

SEQ ID NO: 3213137 - RNA, 18 nt, Human
agauauuugcaguuuuuc

SEQ ID NO: 3213138 - RNA, 18 nt, Human
agaucaaaagguuaauaa

SEQ ID NO: 3213139 - RNA, 20 nt, Human
agaucaaaaaggcuuauaaa

SEQ ID NO: 3213140 - RNA, 16 nt, Human
agaucaaaaaggcuua

SEQ ID NO: 3213141 - RNA, 19 nt, Human
agaucaaaaaggcuuauaa

SEQ ID NO: 3213142 - RNA, 14 nt, Human
agaucaaaaaggcu

SEQ ID NO: 3213143 - RNA, 15 nt, Human
agaucaaaaaggcuu

SEQ ID NO: 3213144 - RNA, 11 nt, Human
ugaauuuggag

SEQ ID NO: 3213145 - RNA, 14 nt, Human
agaucaaauaguug

SEQ ID NO: 3213146 - RNA, 19 nt, Human
agaucaaauaguugcauag

SEQ ID NO: 3213147 - RNA, 13 nt, Human
ugaauuuuaaagu

SEQ ID NO: 3213148 - RNA, 14 nt, Human
ugaauuuuaaagua

SEQ ID NO: 3213149 - RNA, 16 nt, Human
ugaauuuuaaaguaug

SEQ ID NO: 3213150 - RNA, 22 nt, Human
ugaauuuuaaaguaugcauuau

SEQ ID NO: 3213151 - RNA, 18 nt, Human
ugaauuuuuaugugugau

SEQ ID NO: 3213152 - RNA, 15 nt, Human
ugaauuuuuaugugu

SEQ ID NO: 3213153 - RNA, 23 nt, Human
ugaauuuuuauauauauaucugu

SEQ ID NO: 3213154 - RNA, 22 nt, Human
ugacacauuacaagccuggaaa

SEQ ID NO: 3213155 - RNA, 21 nt, Human
ugacacgacuucuguuucaca

SEQ ID NO: 3213156 - RNA, 17 nt, Human
ugacaccccacuuagcc

SEQ ID NO: 3213157 - RNA, 17 nt, Human
ugacaccaucuuuuauu

SEQ ID NO: 3213158 - RNA, 21 nt, Human
ugacaccaucuuuuauucuuu

SEQ ID NO: 3213159 - RNA, 18 nt, Human
ugacacacagcucugucc

SEQ ID NO: 3213160 - RNA, 16 nt, Human
ugacacacagcucugu

SEQ ID NO: 3213161 - RNA, 14 nt, Human
ugacaaagcuuccc

SEQ ID NO: 3213162 - RNA, 19 nt, Human
ugacacacagcucuguccu

SEQ ID NO: 3213163 - RNA, 12 nt, Human
ugaagccuuugu

SEQ ID NO: 3213164 - RNA, 23 nt, Human
agaggugugcaagagagggaugc

SEQ ID NO: 3213165 - RNA, 22 nt, Human
agaggugugcaagagagggaug

SEQ ID NO: 3213166 - RNA, 16 nt, Human
agagguggggagcaga

SEQ ID NO: 3213167 - RNA, 15 nt, Human
agagguuaagguggg

SEQ ID NO: 3213168 - RNA, 15 nt, Human
agaguauggauugaa

SEQ ID NO: 3213169 - RNA, 17 nt, Human
ugaaaguauguuuuacu

SEQ ID NO: 3213170 - RNA, 21 nt, Human
ugaaagucaguuuaagaggcu

SEQ ID NO: 3213171 - RNA, 14 nt, Human
ugaaagucaguuua

SEQ ID NO: 3213172 - RNA, 22 nt, Human
agagggacuguucuuuuguccc

SEQ ID NO: 3213173 - RNA, 16 nt, Human
agagggagggagggcu

SEQ ID NO: 3213174 - RNA, 14 nt, Human
agaggcugucuguu

SEQ ID NO: 3213175 - RNA, 23 nt, Human
ugaauguaugcuucauacaggga

SEQ ID NO: 3213176 - RNA, 20 nt, Human
ugaauguaugcuucauacag

SEQ ID NO: 3213177 - RNA, 19 nt, Human
ugaauguaugcuucauaca

SEQ ID NO: 3213178 - RNA, 14 nt, Human
ugaauguaugcuuc

SEQ ID NO: 3213179 - RNA, 13 nt, Human
ugaauguauguaa

SEQ ID NO: 3213180 - RNA, 14 nt, Human
ugaauguauguaaa

SEQ ID NO: 3213181 - RNA, 18 nt, Human
ugaauauugccauuaugc

SEQ ID NO: 3213182 - RNA, 16 nt, Human
ugaauauugccauuau

SEQ ID NO: 3213183 - RNA, 15 nt, Human
ugaauaguauugugu

SEQ ID NO: 3213184 - RNA, 12 nt, Human
ugaauauaaaaa

SEQ ID NO: 3213185 - RNA, 13 nt, Human
ugaauauaaaaaa

SEQ ID NO: 3213186 - RNA, 14 nt, Human
ugaauaugauuaaa

SEQ ID NO: 3213187 - RNA, 15 nt, Human
ugaauaugauuaaaa

SEQ ID NO: 3213188 - RNA, 21 nt, Human
ugaauaugauuaaaaauauca

SEQ ID NO: 3213189 - RNA, 22 nt, Human
ugaauaugauuaaaaauaucaa

SEQ ID NO: 3213190 - RNA, 13 nt, Human
ugaauaugauuaa

SEQ ID NO: 3213191 - RNA, 18 nt, Human
ugaauacugcuugaauaa

SEQ ID NO: 3213192 - RNA, 21 nt, Human
ugaauacugcuugaauaaaca

SEQ ID NO: 3213193 - RNA, 13 nt, Human
ugaauacugcuug

SEQ ID NO: 3213194 - RNA, 15 nt, Human
ugaauacugcuugaa

SEQ ID NO: 3213195 - RNA, 16 nt, Human
ugaauacugcuugaau

SEQ ID NO: 3213196 - RNA, 13 nt, Human
ugaauacuugaac

SEQ ID NO: 3213197 - RNA, 15 nt, Human
ugaauacuugaacca

SEQ ID NO: 3213198 - RNA, 16 nt, Human
ugaauacuugaaccau

SEQ ID NO: 3213199 - RNA, 19 nt, Human
ugaauacuugaaccauaaa

SEQ ID NO: 3213200 - RNA, 14 nt, Human
ugaagucacacagu

SEQ ID NO: 3213201 - RNA, 14 nt, Human
ugaagucacugcac

SEQ ID NO: 3213202 - RNA, 15 nt, Human
ugaagggguuuucuu

SEQ ID NO: 3213203 - RNA, 23 nt, Human
ugaagguagcauucuuuggaguu

SEQ ID NO: 3213204 - RNA, 16 nt, Human
ugaauaaagacaccua

SEQ ID NO: 3213205 - RNA, 15 nt, Human
ugaauaaagacaccu

SEQ ID NO: 3213206 - RNA, 16 nt, Human
ugaagucacugcacag

SEQ ID NO: 3213207 - RNA, 15 nt, Human
ugaagucacugcaca

SEQ ID NO: 3213208 - RNA, 20 nt, Human
ugaccuuccaagagccugag

SEQ ID NO: 3213209 - RNA, 19 nt, Human
ugaccuuccaagagccuga

SEQ ID NO: 3213210 - RNA, 18 nt, Human
ugaccuuccaagagccug

SEQ ID NO: 3213211 - RNA, 16 nt, Human
ugaccuuaaaugcaac

SEQ ID NO: 3213212 - RNA, 14 nt, Human
ugaccuuaaaugca

SEQ ID NO: 3213213 - RNA, 18 nt, Human
ugaccugaggcccuucuc

SEQ ID NO: 3213214 - RNA, 19 nt, Human
ugaccugaggcccuucucu

SEQ ID NO: 3213215 - RNA, 17 nt, Human
ugaccugaggcccuucu

SEQ ID NO: 3213216 - RNA, 20 nt, Human
ugaccccugcccagaucagc

SEQ ID NO: 3213217 - RNA, 23 nt, Human
ugaccccucauagcccucacccu

SEQ ID NO: 3213218 - RNA, 13 nt, Human
ugaccccugccca

SEQ ID NO: 3213219 - RNA, 12 nt, Human
ugacuccugguc

SEQ ID NO: 3213220 - RNA, 14 nt, Human
ugacuccugguccu

SEQ ID NO: 3213221 - RNA, 22 nt, Human
ugacucccccaguccccuuccc

SEQ ID NO: 3213222 - RNA, 19 nt, Human
ugacucccccaguccccuu

SEQ ID NO: 3213223 - RNA, 18 nt, Human
ugacucccccaguccccu

SEQ ID NO: 3213224 - RNA, 14 nt, Human
ugacuaggaaaaaa

SEQ ID NO: 3213225 - RNA, 14 nt, Human
agauguuuaaaaca

SEQ ID NO: 3213226 - RNA, 15 nt, Human
agauguuuaaaacac

SEQ ID NO: 3213227 - RNA, 16 nt, Human
agauguuuaaaacacc

SEQ ID NO: 3213228 - RNA, 14 nt, Human
ugacccaugcugcc

SEQ ID NO: 3213229 - RNA, 15 nt, Human
ugacccaugcugccc

SEQ ID NO: 3213230 - RNA, 12 nt, Human
ugacccaugcug

SEQ ID NO: 3213231 - RNA, 13 nt, Human
agauuaagaaaua

SEQ ID NO: 3213232 - RNA, 16 nt, Human
ugacccaugcugcccu

SEQ ID NO: 3213233 - RNA, 21 nt, Human
ugacccaugcugcccugugag

SEQ ID NO: 3213234 - RNA, 19 nt, Human
ugacccaugggcaggagac

SEQ ID NO: 3213235 - RNA, 18 nt, Human
ugacccaugggcaggaga

SEQ ID NO: 3213236 - RNA, 16 nt, Human
ugacccaugggcagga

SEQ ID NO: 3213237 - RNA, 14 nt, Human
agaugcagcucuuc

SEQ ID NO: 3213238 - RNA, 13 nt, Human
agaugcagcucuu

SEQ ID NO: 3213239 - RNA, 18 nt, Human
agaugcagcucuuccugg

SEQ ID NO: 3213240 - RNA, 17 nt, Human
agaugcagcucuuccug

SEQ ID NO: 3213241 - RNA, 16 nt, Human
agaugcagcucuuccu

SEQ ID NO: 3213242 - RNA, 17 nt, Human
ugacacuuaaaaauggu

SEQ ID NO: 3213243 - RNA, 16 nt, Human
ugacacuuaaaaaugg

SEQ ID NO: 3213244 - RNA, 16 nt, Human
agaugccgcauuugga

SEQ ID NO: 3213245 - RNA, 20 nt, Human
agaugcugacuguacuccuc

SEQ ID NO: 3213246 - RNA, 23 nt, Human
agaugcugacuguacuccuccca

SEQ ID NO: 3213247 - RNA, 15 nt, Human
ugacuucuaaguaaa

SEQ ID NO: 3213248 - RNA, 23 nt, Human
ugacuucuaaguaaaaccacagc

SEQ ID NO: 3213249 - RNA, 22 nt, Human
ugacuucuaaguaaaaccacag

SEQ ID NO: 3213250 - RNA, 18 nt, Human
agauuccagagaguggcu

SEQ ID NO: 3213251 - RNA, 22 nt, Human
agauucauauuuacuucuuaua

SEQ ID NO: 3213252 - RNA, 19 nt, Human
agauucauauuuacuucuu

SEQ ID NO: 3213253 - RNA, 15 nt, Human
agauucccugagcag

SEQ ID NO: 3213254 - RNA, 13 nt, Human
agauuggaaggaa

SEQ ID NO: 3213255 - RNA, 15 nt, Human
agauuggaucaagua

SEQ ID NO: 3213256 - RNA, 17 nt, Human
agauuggaucaaguauu

SEQ ID NO: 3213257 - RNA, 22 nt, Human
agauuggaucaaguauuacuaa

SEQ ID NO: 3213258 - RNA, 22 nt, Human
agauuggauuuuauguugacau

SEQ ID NO: 3213259 - RNA, 17 nt, Human
agauuggauuuuauguu

SEQ ID NO: 3213260 - RNA, 15 nt, Human
agauuggauuuuaug

SEQ ID NO: 3213261 - RNA, 22 nt, Human
agauugcuguguguugccuggg

SEQ ID NO: 3213262 - RNA, 23 nt, Human
agauuggacauaacugacuuagu

SEQ ID NO: 3213263 - RNA, 13 nt, Human
agauuuuaguuuu

SEQ ID NO: 3213264 - RNA, 20 nt, Human
agauuuuaguuuuauuuucu

SEQ ID NO: 3213265 - RNA, 15 nt, Human
agauuuuaguuuuau

SEQ ID NO: 3213266 - RNA, 14 nt, Human
agauuucuguucag

SEQ ID NO: 3213267 - RNA, 15 nt, Human
agauuucucuuugaa

SEQ ID NO: 3213268 - RNA, 12 nt, Human
agauuucuguuc

SEQ ID NO: 3213269 - RNA, 11 nt, Human
agauuucuguu

SEQ ID NO: 3213270 - RNA, 14 nt, Human
agauuucucuuuga

SEQ ID NO: 3213271 - RNA, 23 nt, Human
agauuggauuuuauguugacauu

SEQ ID NO: 3213272 - RNA, 20 nt, Human
agauuucucauuugccaaua

SEQ ID NO: 3213273 - RNA, 23 nt, Human
agauuuuaguuuuauuuucuaaa

SEQ ID NO: 3213274 - RNA, 14 nt, Human
agauuuuauagugu

SEQ ID NO: 3213275 - RNA, 22 nt, Human
agauuuuaguuuuauuuucuaa

SEQ ID NO: 3213276 - RNA, 21 nt, Human
agauuuugaaauuuuuauuaa

SEQ ID NO: 3213277 - RNA, 22 nt, Human
agauuuuguguuuauucuugau

SEQ ID NO: 3213278 - RNA, 20 nt, Human
agauuuuguguuuauucuug

SEQ ID NO: 3213279 - RNA, 19 nt, Human
agauuuuguguuuauucuu

SEQ ID NO: 3213280 - RNA, 18 nt, Human
agauuuuguguuuauucu

SEQ ID NO: 3213281 - RNA, 23 nt, Human
agauuuuguguuuauucuugaug

SEQ ID NO: 3213282 - RNA, 23 nt, Human
agcaacgcaggcccccaggugcc

SEQ ID NO: 3213283 - RNA, 18 nt, Human
agcaaaaaaaguuguaug

SEQ ID NO: 3213284 - RNA, 15 nt, Human
agcaaaaaaaguugu

SEQ ID NO: 3213285 - RNA, 16 nt, Human
agcaaaaaauaaugac

SEQ ID NO: 3213286 - RNA, 20 nt, Human
agcaaaaaaaguuguaugau

SEQ ID NO: 3213287 - RNA, 14 nt, Human
agcaacgcaggccc

SEQ ID NO: 3213288 - RNA, 21 nt, Human
agcaacuaaaaugugucuugc

SEQ ID NO: 3213289 - RNA, 13 nt, Human
agcaagacgcugu

SEQ ID NO: 3213290 - RNA, 16 nt, Human
agcaagacgcugugcu

SEQ ID NO: 3213291 - RNA, 17 nt, Human
agcaagacgcugugcug

SEQ ID NO: 3213292 - RNA, 20 nt, Human
agcaagacgcugugcugccc

SEQ ID NO: 3213293 - RNA, 21 nt, Human
agcaagacgcugugcugcccu

SEQ ID NO: 3213294 - RNA, 22 nt, Human
agcaagacgcugugcugcccug

SEQ ID NO: 3213295 - RNA, 23 nt, Human
agcaagacgcugugcugcccugc

SEQ ID NO: 3213296 - RNA, 18 nt, Human
agcaagagagcagcaagg

SEQ ID NO: 3213297 - RNA, 23 nt, Human
agcaagagagcagcaaggucuug

SEQ ID NO: 3213298 - RNA, 15 nt, Human
agcaagauguacuau

SEQ ID NO: 3213299 - RNA, 22 nt, Human
agcaagaggcaagcugaaauuu

SEQ ID NO: 3213300 - RNA, 19 nt, Human
aaccaccacacccagccca

SEQ ID NO: 3213301 - RNA, 15 nt, Human
aaccaagucaaguga

SEQ ID NO: 3213302 - RNA, 22 nt, Human
aaccaagguagaaugaccuugu

SEQ ID NO: 3213303 - RNA, 20 nt, Human
aaccaagguagaaugaccuu

SEQ ID NO: 3213304 - RNA, 13 nt, Human
gucucgaacuccu

SEQ ID NO: 3213305 - RNA, 18 nt, Human
gucucgaacuccugaccu

SEQ ID NO: 3213306 - RNA, 18 nt, Human
aaccaagccguggcuucc

SEQ ID NO: 3213307 - RNA, 19 nt, Human
gucucgaacuccugaccuu

SEQ ID NO: 3213308 - RNA, 16 nt, Human
aaccaagccguggcuu

SEQ ID NO: 3213309 - RNA, 17 nt, Human
aacaguuggcaugcauc

SEQ ID NO: 3213310 - RNA, 13 nt, Human
aacaguguuuuca

SEQ ID NO: 3213311 - RNA, 18 nt, Human
gucuccgaaaugcugucu

SEQ ID NO: 3213312 - RNA, 16 nt, Human
gucuccgaaaugcugu

SEQ ID NO: 3213313 - RNA, 17 nt, Human
aaccaccagaagcccag

SEQ ID NO: 3213314 - RNA, 14 nt, Human
aaccaccagaagcc

SEQ ID NO: 3213315 - RNA, 21 nt, Human
aaccaccacacccagcccacu

SEQ ID NO: 3213316 - RNA, 12 nt, Human
aaccaucauuga

SEQ ID NO: 3213317 - RNA, 15 nt, Human
aaccauaguuacugu

SEQ ID NO: 3213318 - RNA, 23 nt, Human
aaccaagguagaaugaccuugua

SEQ ID NO: 3213319 - RNA, 20 nt, Human
aaccauaguuacuguaaaau

SEQ ID NO: 3213320 - RNA, 18 nt, Human
aaccauaguuacuguaaa

SEQ ID NO: 3213321 - RNA, 17 nt, Human
aaccauaguuacuguaa

SEQ ID NO: 3213322 - RNA, 16 nt, Human
aaccauaguuacugua

SEQ ID NO: 3213323 - RNA, 17 nt, Human
aaccaucauugaaaucu

SEQ ID NO: 3213324 - RNA, 18 nt, Human
aaccaucauugaaaucuu

SEQ ID NO: 3213325 - RNA, 23 nt, Human
aaccauaguuacuguaaaaugca

SEQ ID NO: 3213326 - RNA, 13 nt, Human
aaccauuaaaguc

SEQ ID NO: 3213327 - RNA, 14 nt, Human
aaccauuaaaguca

SEQ ID NO: 3213328 - RNA, 15 nt, Human
aaccauuaaagucag

SEQ ID NO: 3213329 - RNA, 17 nt, Human
aaccauucaaaaauuuc

SEQ ID NO: 3213330 - RNA, 19 nt, Human
aaccauucaaaaauuucac

SEQ ID NO: 3213331 - RNA, 15 nt, Human
aacccacccuuucua

SEQ ID NO: 3213332 - RNA, 13 nt, Human
aacccaauaguug

SEQ ID NO: 3213333 - RNA, 18 nt, Human
aacccaaguccaagcaua

SEQ ID NO: 3213334 - RNA, 23 nt, Human
aacccaaauguucaucaaugaau

SEQ ID NO: 3213335 - RNA, 14 nt, Human
aaccauuuucauua

SEQ ID NO: 3213336 - RNA, 23 nt, Human
aaccauuguucugacacgacuuc

SEQ ID NO: 3213337 - RNA, 12 nt, Human
aaccauuuaucu

SEQ ID NO: 3213338 - RNA, 15 nt, Human
aaccauuuaucuuga

SEQ ID NO: 3213339 - RNA, 13 nt, Human
aaccauuuaucuu

SEQ ID NO: 3213340 - RNA, 19 nt, Human
aaccauuuaucuugaagga

SEQ ID NO: 3213341 - RNA, 19 nt, Human
aaccauuugaaaccccugu

SEQ ID NO: 3213342 - RNA, 20 nt, Human
aaccccuggcuccaggccag

SEQ ID NO: 3213343 - RNA, 20 nt, Human
aaccccuggaccccagccuc

SEQ ID NO: 3213344 - RNA, 16 nt, Human
aaccccuggaccccag

SEQ ID NO: 3213345 - RNA, 23 nt, Human
aaccccucgcccagucccagcag

SEQ ID NO: 3213346 - RNA, 20 nt, Human
aaccccucgcccagucccag

SEQ ID NO: 3213347 - RNA, 16 nt, Human
aaccccucgcccaguc

SEQ ID NO: 3213348 - RNA, 15 nt, Human
aaccccucgcccagu

SEQ ID NO: 3213349 - RNA, 12 nt, Human
aaccccucgccc

SEQ ID NO: 3213350 - RNA, 17 nt, Human
aaccccccauuucuucc

SEQ ID NO: 3213351 - RNA, 10 nt, Human
aacccagcuc

SEQ ID NO: 3213352 - RNA, 17 nt, Human
aaccccauaccuacauu

SEQ ID NO: 3213353 - RNA, 18 nt, Human
aaccugagccccaaaagg

SEQ ID NO: 3213354 - RNA, 11 nt, Human
aaccugacccc

SEQ ID NO: 3213355 - RNA, 17 nt, Human
aaccucgcuccaacucc

SEQ ID NO: 3213356 - RNA, 12 nt, Human
aaccccuuccca

SEQ ID NO: 3213357 - RNA, 17 nt, Human
aaccccuguaggccuca

SEQ ID NO: 3213358 - RNA, 17 nt, Human
gucuggcacagccugca

SEQ ID NO: 3213359 - RNA, 16 nt, Human
gucuggcacagccugc

SEQ ID NO: 3213360 - RNA, 13 nt, Human
gucuggcacagcc

SEQ ID NO: 3213361 - RNA, 20 nt, Human
aaccugagccccaaaaggua

SEQ ID NO: 3213362 - RNA, 14 nt, Human
gucuggcccuuccu

SEQ ID NO: 3213363 - RNA, 19 nt, Human
gucuguaaaucuaacauua

SEQ ID NO: 3213364 - RNA, 19 nt, Human
gucuuccuuugcuucccuu

SEQ ID NO: 3213365 - RNA, 19 nt, Human
gucugucccaguuaacugu

SEQ ID NO: 3213366 - RNA, 18 nt, Human
gucuuuggacccugaggc

SEQ ID NO: 3213367 - RNA, 13 nt, Human
gucuuuagcuauu

SEQ ID NO: 3213368 - RNA, 16 nt, Human
gucuuuagcuauuacu

SEQ ID NO: 3213369 - RNA, 17 nt, Human
aaccuguagaaucaauu

SEQ ID NO: 3213370 - RNA, 18 nt, Human
aaccuguagaaucaauuu

SEQ ID NO: 3213371 - RNA, 22 nt, Human
aaccuguagaaucaauuuaagu

SEQ ID NO: 3213372 - RNA, 23 nt, Human
aaccuggucacaggacucugccu

SEQ ID NO: 3213373 - RNA, 16 nt, Human
gucuuuugguuaugaa

SEQ ID NO: 3213374 - RNA, 20 nt, Human
aacucaucuggaguucucaa

SEQ ID NO: 3213375 - RNA, 12 nt, Human
aacuccuggccu

SEQ ID NO: 3213376 - RNA, 19 nt, Human
aacucgguguccccaccau

SEQ ID NO: 3213377 - RNA, 18 nt, Human
aacucgguguccccacca

SEQ ID NO: 3213378 - RNA, 17 nt, Human
aacucgguguccccacc

SEQ ID NO: 3213379 - RNA, 16 nt, Human
aacucgguguccccac

SEQ ID NO: 3213380 - RNA, 24 nt, Human
aacucgguguccccaccaucugcu

SEQ ID NO: 3213381 - RNA, 23 nt, Human
aacucgguguccccaccaucugc

SEQ ID NO: 3213382 - RNA, 22 nt, Human
aacucgguguccccaccaucug

SEQ ID NO: 3213383 - RNA, 21 nt, Human
aacucgguguccccaccaucu

SEQ ID NO: 3213384 - RNA, 17 nt, Human
aacucauuuugcuugug

SEQ ID NO: 3213385 - RNA, 20 nt, Human
aacucauugcaucauuuaca

SEQ ID NO: 3213386 - RNA, 15 nt, Human
aacucuccuccagag

SEQ ID NO: 3213387 - RNA, 18 nt, Human
aacucuccuccagaguca

SEQ ID NO: 3213388 - RNA, 16 nt, Human
aacucuccucugcugc

SEQ ID NO: 3213389 - RNA, 14 nt, Human
aacucuauuuagau

SEQ ID NO: 3213390 - RNA, 24 nt, Human
aacucuauggucuuauauuuacaa

SEQ ID NO: 3213391 - RNA, 23 nt, Human
gugaaccaccacacccagcccac

SEQ ID NO: 3213392 - RNA, 22 nt, Human
gugaaccaccacacccagccca

SEQ ID NO: 3213393 - RNA, 19 nt, Human
aacuacugaaugaagcagu

SEQ ID NO: 3213394 - RNA, 21 nt, Human
aacuacugaaugaagcaguau

SEQ ID NO: 3213395 - RNA, 23 nt, Human
aacuacugaaugaagcaguauuu

SEQ ID NO: 3213396 - RNA, 20 nt, Human
aacuacuaccuguaaugaca

SEQ ID NO: 3213397 - RNA, 19 nt, Human
aaccuuggcuuggcccugg

SEQ ID NO: 3213398 - RNA, 18 nt, Human
aaccuugaaaacuuuaug

SEQ ID NO: 3213399 - RNA, 11 nt, Human
aaccugucuga

SEQ ID NO: 3213400 - RNA, 16 nt, Human
aaccugucuuuuggga

SEQ ID NO: 3213401 - RNA, 14 nt, Human
aaccugucuuuugg

SEQ ID NO: 3213402 - RNA, 18 nt, Human
aaccugugagcugcacca

SEQ ID NO: 3213403 - RNA, 21 nt, Human
aacuaugauuuggaaaauaaa

SEQ ID NO: 3213404 - RNA, 16 nt, Human
aacuaugauuuggaaa

SEQ ID NO: 3213405 - RNA, 13 nt, Human
aacuaucuucauc

SEQ ID NO: 3213406 - RNA, 20 nt, Human
aacuagacucccaagcugga

SEQ ID NO: 3213407 - RNA, 23 nt, Human
aacuagacucccaagcuggacua

SEQ ID NO: 3213408 - RNA, 13 nt, Human
aacuuccaauuua

SEQ ID NO: 3213409 - RNA, 14 nt, Human
aacuucauguaauu

SEQ ID NO: 3213410 - RNA, 16 nt, Human
aacuucauguaauuuu

SEQ ID NO: 3213411 - RNA, 13 nt, Human
aacuuccaaagaa

SEQ ID NO: 3213412 - RNA, 14 nt, Human
aacuuccaaagaaa

SEQ ID NO: 3213413 - RNA, 15 nt, Human
aacuuccaaagaaag

SEQ ID NO: 3213414 - RNA, 16 nt, Human
aacuuccaaagaaagu

SEQ ID NO: 3213415 - RNA, 17 nt, Human
aacuuccaaagaaaguu

SEQ ID NO: 3213416 - RNA, 14 nt, Human
aacuguauauuugu

SEQ ID NO: 3213417 - RNA, 16 nt, Human
aacuguauauuuguau

SEQ ID NO: 3213418 - RNA, 12 nt, Human
aacuucaggaaa

SEQ ID NO: 3213419 - RNA, 16 nt, Human
aacuucaucuggaagu

SEQ ID NO: 3213420 - RNA, 16 nt, Human
aacuucaucugucugu

SEQ ID NO: 3213421 - RNA, 22 nt, Human
aacuguacuuugauucacaugu

SEQ ID NO: 3213422 - RNA, 20 nt, Human
aacuguacuuugauucacau

SEQ ID NO: 3213423 - RNA, 19 nt, Human
aacuguacuuugauucaca

SEQ ID NO: 3213424 - RNA, 18 nt, Human
aacuguacuuugauucac

SEQ ID NO: 3213425 - RNA, 17 nt, Human
aacuguacuuugauuca

SEQ ID NO: 3213426 - RNA, 15 nt, Human
aacuguacuuugauu

SEQ ID NO: 3213427 - RNA, 13 nt, Human
aacuguacuuuga

SEQ ID NO: 3213428 - RNA, 14 nt, Human
aacuggugauauau

SEQ ID NO: 3213429 - RNA, 15 nt, Human
aacuguaaaauacuu

SEQ ID NO: 3213430 - RNA, 20 nt, Human
aacugguuauuuaaaaugua

SEQ ID NO: 3213431 - RNA, 20 nt, Human
aacuguaauuauuugaauga

SEQ ID NO: 3213432 - RNA, 18 nt, Human
aacuguaauuauuugaau

SEQ ID NO: 3213433 - RNA, 15 nt, Human
aacuguaauuauuug

SEQ ID NO: 3213434 - RNA, 14 nt, Human
gugaugagaggaaa

SEQ ID NO: 3213435 - RNA, 16 nt, Human
gugaugagaggaaauc

SEQ ID NO: 3213436 - RNA, 17 nt, Human
gugaugggaaagcauug

SEQ ID NO: 3213437 - RNA, 19 nt, Human
gugauggcgaaagagggua

SEQ ID NO: 3213438 - RNA, 22 nt, Human
gugaugcgcaugucacggaggg

SEQ ID NO: 3213439 - RNA, 17 nt, Human
gugaugcgcaguugcug

SEQ ID NO: 3213440 - RNA, 15 nt, Human
gugaugcgcaguugc

SEQ ID NO: 3213441 - RNA, 14 nt, Human
gugauggggcccug

SEQ ID NO: 3213442 - RNA, 16 nt, Human
gugauggggcccugcc

SEQ ID NO: 3213443 - RNA, 17 nt, Human
gugauggggcccugccu

SEQ ID NO: 3213444 - RNA, 18 nt, Human
gugauggggcccugccuc

SEQ ID NO: 3213445 - RNA, 12 nt, Human
gugcaagagagg

SEQ ID NO: 3213446 - RNA, 22 nt, Human
gugcaaugaccuuucaauagga

SEQ ID NO: 3213447 - RNA, 19 nt, Human
gugauggggcccugccucc

SEQ ID NO: 3213448 - RNA, 16 nt, Human
gugaugguuccccugu

SEQ ID NO: 3213449 - RNA, 14 nt, Human
gugaugguuccccu

SEQ ID NO: 3213450 - RNA, 21 nt, Human
gugcacacaccagagcccacc

SEQ ID NO: 3213451 - RNA, 22 nt, Human
gugcaugcugucccuuacguga

SEQ ID NO: 3213452 - RNA, 13 nt, Human
gugcacaggcaga

SEQ ID NO: 3213453 - RNA, 12 nt, Human
gugcacaggcag

SEQ ID NO: 3213454 - RNA, 22 nt, Human
gugccuccugacacaccugcag

SEQ ID NO: 3213455 - RNA, 16 nt, Human
gugccucuagcugaau

SEQ ID NO: 3213456 - RNA, 15 nt, Human
gugccucuagcugaa

SEQ ID NO: 3213457 - RNA, 14 nt, Human
gugccucuagcuga

SEQ ID NO: 3213458 - RNA, 13 nt, Human
gugccucuagcug

SEQ ID NO: 3213459 - RNA, 16 nt, Human
gugccucugcaguacu

SEQ ID NO: 3213460 - RNA, 19 nt, Human
gugcauguguguucaugca

SEQ ID NO: 3213461 - RNA, 15 nt, Human
gugccacauuuucuu

SEQ ID NO: 3213462 - RNA, 19 nt, Human
aacugggcauauuucuaau

SEQ ID NO: 3213463 - RNA, 21 nt, Human
aacuggguacuuguggacaca

SEQ ID NO: 3213464 - RNA, 16 nt, Human
aacuggguacuugugg

SEQ ID NO: 3213465 - RNA, 19 nt, Human
aacuggacugguucaaaug

SEQ ID NO: 3213466 - RNA, 11 nt, Human
aacuggcugca

SEQ ID NO: 3213467 - RNA, 19 nt, Human
aacugcacugucaagauga

SEQ ID NO: 3213468 - RNA, 21 nt, Human
aacugcacaugauuucacaaa

SEQ ID NO: 3213469 - RNA, 20 nt, Human
aacugcacaugauuucacaa

SEQ ID NO: 3213470 - RNA, 23 nt, Human
aacugcacaugauuucacaaaua

SEQ ID NO: 3213471 - RNA, 19 nt, Human
aacugcacaugauuucaca

SEQ ID NO: 3213472 - RNA, 18 nt, Human
aacugcacaugauuucac

SEQ ID NO: 3213473 - RNA, 17 nt, Human
aacugcacaugauuuca

SEQ ID NO: 3213474 - RNA, 16 nt, Human
aacugcacaugauuuc

SEQ ID NO: 3213475 - RNA, 17 nt, Human
aacugcaaccuuguuua

SEQ ID NO: 3213476 - RNA, 18 nt, Human
aacugcaaccuuguuuau

SEQ ID NO: 3213477 - RNA, 15 nt, Human
aacugcugacuguuu

SEQ ID NO: 3213478 - RNA, 23 nt, Human
aacugcucuugggcaauauucuc

SEQ ID NO: 3213479 - RNA, 22 nt, Human
aacugcucuugggcaauauucu

SEQ ID NO: 3213480 - RNA, 20 nt, Human
aacugcucuugggcaauauu

SEQ ID NO: 3213481 - RNA, 19 nt, Human
aacugcucuugggcaauau

SEQ ID NO: 3213482 - RNA, 20 nt, Human
aacugcugacuguuuucucu

SEQ ID NO: 3213483 - RNA, 21 nt, Human
aacugcugacuguuuucucuu

SEQ ID NO: 3213484 - RNA, 23 nt, Human
aacugcugacuguuuucucuuga

SEQ ID NO: 3213485 - RNA, 21 nt, Human
aacugcuuucuuucguuuguu

SEQ ID NO: 3213486 - RNA, 15 nt, Human
aacugcuuucuuucg

SEQ ID NO: 3213487 - RNA, 19 nt, Human
aacugcuuccuuucuugau

SEQ ID NO: 3213488 - RNA, 23 nt, Human
aacugcuuccuauaauuuugaua

SEQ ID NO: 3213489 - RNA, 22 nt, Human
aacugcuuccuauaauuuugau

SEQ ID NO: 3213490 - RNA, 18 nt, Human
aacugcuuccuauaauuu

SEQ ID NO: 3213491 - RNA, 19 nt, Human
aacuggaaauacuagauuu

SEQ ID NO: 3213492 - RNA, 21 nt, Human
aacucuucaaucucuugcacu

SEQ ID NO: 3213493 - RNA, 23 nt, Human
aacucugagagauuuggggcuaa

SEQ ID NO: 3213494 - RNA, 22 nt, Human
aacucuguuacacuuuuuggaa

SEQ ID NO: 3213495 - RNA, 16 nt, Human
aacucuguuacacuuu

SEQ ID NO: 3213496 - RNA, 23 nt, Human
aacucuguuacacuuuuuggaag

SEQ ID NO: 3213497 - RNA, 22 nt, Human
gugagucgaggacagggaggug

SEQ ID NO: 3213498 - RNA, 15 nt, Human
gugagucgaggacag

SEQ ID NO: 3213499 - RNA, 22 nt, Human
aacucugacaacagacuucuga

SEQ ID NO: 3213500 - RNA, 23 nt, Human
aacucugacaacagacuucugaa

SEQ ID NO: 3213501 - RNA, 16 nt, Human
aacucugacaacagac

SEQ ID NO: 3213502 - RNA, 20 nt, Human
aacucugacaacagacuucu

SEQ ID NO: 3213503 - RNA, 21 nt, Human
gugagaugcuagaacucccuu

SEQ ID NO: 3213504 - RNA, 21 nt, Human
gugaacuuggugccuaauguu

SEQ ID NO: 3213505 - RNA, 14 nt, Human
gugaacuuggaagc

SEQ ID NO: 3213506 - RNA, 17 nt, Human
gugaacuugggccacug

SEQ ID NO: 3213507 - RNA, 19 nt, Human
gugaacuugggccacugug

SEQ ID NO: 3213508 - RNA, 17 nt, Human
gugaggccagagacaca

SEQ ID NO: 3213509 - RNA, 22 nt, Human
gugaggccagagacacaagccu

SEQ ID NO: 3213510 - RNA, 13 nt, Human
gugaggccagaga

SEQ ID NO: 3213511 - RNA, 18 nt, Human
gugaggguaaguauuuuc

SEQ ID NO: 3213512 - RNA, 13 nt, Human
gucagaaucagaa

SEQ ID NO: 3213513 - RNA, 23 nt, Human
gucagaaguuucugccgcagccc

SEQ ID NO: 3213514 - RNA, 13 nt, Human
gucacagccaggc

SEQ ID NO: 3213515 - RNA, 21 nt, Human
gucacacaguauuacuucugc

SEQ ID NO: 3213516 - RNA, 22 nt, Human
gucacacaguauuacuucugcu

SEQ ID NO: 3213517 - RNA, 12 nt, Human
gucacagccagg

SEQ ID NO: 3213518 - RNA, 15 nt, Human
gucaggccgggcaga

SEQ ID NO: 3213519 - RNA, 14 nt, Human
gucaggccgggcag

SEQ ID NO: 3213520 - RNA, 22 nt, Human
gucaggccgggcagagcacagc

SEQ ID NO: 3213521 - RNA, 19 nt, Human
gucaggccgggcagagcac

SEQ ID NO: 3213522 - RNA, 17 nt, Human
gucaggccgggcagagc

SEQ ID NO: 3213523 - RNA, 16 nt, Human
gucaggccgggcagag

SEQ ID NO: 3213524 - RNA, 14 nt, Human
gucaggcucucugg

SEQ ID NO: 3213525 - RNA, 20 nt, Human
gucaggcuaauguuggcaga

SEQ ID NO: 3213526 - RNA, 20 nt, Human
gucaggcucucugggcugac

SEQ ID NO: 3213527 - RNA, 19 nt, Human
gucaggcucucugggcuga

SEQ ID NO: 3213528 - RNA, 16 nt, Human
gucaggcucucugggc

SEQ ID NO: 3213529 - RNA, 13 nt, Human
gucaguuguauca

SEQ ID NO: 3213530 - RNA, 19 nt, Human
gucaguuguguuuuuuaag

SEQ ID NO: 3213531 - RNA, 15 nt, Human
gucagugugacugau

SEQ ID NO: 3213532 - RNA, 21 nt, Human
gucauaaagugagaaaacugu

SEQ ID NO: 3213533 - RNA, 22 nt, Human
gucauaaagugagaaaacugug

SEQ ID NO: 3213534 - RNA, 21 nt, Human
gucaguauguggaaguguggg

SEQ ID NO: 3213535 - RNA, 17 nt, Human
gucaguauguggaagug

SEQ ID NO: 3213536 - RNA, 18 nt, Human
aaauuuguuauaaugaau

SEQ ID NO: 3213537 - RNA, 12 nt, Human
aaauuuguguaa

SEQ ID NO: 3213538 - RNA, 15 nt, Human
aaauuuguguaauau

SEQ ID NO: 3213539 - RNA, 10 nt, Human
aaauuuuaaa

SEQ ID NO: 3213540 - RNA, 13 nt, Human
aaauuuuaaaaaa

SEQ ID NO: 3213541 - RNA, 14 nt, Human
aaauuuuaaaaaag

SEQ ID NO: 3213542 - RNA, 12 nt, Human
aaauuuuaaagc

SEQ ID NO: 3213543 - RNA, 22 nt, Human
aaauuuuaaagccauucugauu

SEQ ID NO: 3213544 - RNA, 15 nt, Human
aaauuuuaacuaaau

SEQ ID NO: 3213545 - RNA, 16 nt, Human
aaauuuuaagcuagga

SEQ ID NO: 3213546 - RNA, 19 nt, Human
aaauuuguuuaaaguauac

SEQ ID NO: 3213547 - RNA, 16 nt, Human
aaauuugucugaaaca

SEQ ID NO: 3213548 - RNA, 18 nt, Human
aaauuugucugaaacauu

SEQ ID NO: 3213549 - RNA, 19 nt, Human
aaauuugucugaaacauuu

SEQ ID NO: 3213550 - RNA, 21 nt, Human
aaauuugucugaaacauuuca

SEQ ID NO: 3213551 - RNA, 17 nt, Human
gucaguuuauguuuugg

SEQ ID NO: 3213552 - RNA, 15 nt, Human
aacaaggcaaggcug

SEQ ID NO: 3213553 - RNA, 16 nt, Human
aacaaggcaaggcugu

SEQ ID NO: 3213554 - RNA, 13 nt, Human
aaauuuuuuugua

SEQ ID NO: 3213555 - RNA, 14 nt, Human
aaauuuuuuuguau

SEQ ID NO: 3213556 - RNA, 17 nt, Human
aaauuuuuuuguaugaa

SEQ ID NO: 3213557 - RNA, 18 nt, Human
aaauuuuuuuguaugaaa

SEQ ID NO: 3213558 - RNA, 19 nt, Human
aaauuuuuuuguaugaaaa

SEQ ID NO: 3213559 - RNA, 12 nt, Human
aaauuuuuuugu

SEQ ID NO: 3213560 - RNA, 13 nt, Human
aaauuuuuuggca

SEQ ID NO: 3213561 - RNA, 18 nt, Human
aaauuuuguaagggagca

SEQ ID NO: 3213562 - RNA, 14 nt, Human
aaauuuuagaaaua

SEQ ID NO: 3213563 - RNA, 15 nt, Human
aaauuuuagaaauau

SEQ ID NO: 3213564 - RNA, 22 nt, Human
aaauuuuaggcaaguuuucccu

SEQ ID NO: 3213565 - RNA, 13 nt, Human
aaauuuugaaaag

SEQ ID NO: 3213566 - RNA, 14 nt, Human
aaauuuugaaaagu

SEQ ID NO: 3213567 - RNA, 17 nt, Human
aaauuuugaaaaguaau

SEQ ID NO: 3213568 - RNA, 18 nt, Human
aaauuuugaaaaguaaua

SEQ ID NO: 3213569 - RNA, 21 nt, Human
aaauuuugaaaaguaauauuu

SEQ ID NO: 3213570 - RNA, 18 nt, Human
aacaaggcaaggcuguca

SEQ ID NO: 3213571 - RNA, 21 nt, Human
aacaaggcaaggcugucaauu

SEQ ID NO: 3213572 - RNA, 22 nt, Human
aacaaguugagcuaugacuuaa

SEQ ID NO: 3213573 - RNA, 17 nt, Human
aacaaguugagcuauga

SEQ ID NO: 3213574 - RNA, 21 nt, Human
aacaaguugagcuaugacuua

SEQ ID NO: 3213575 - RNA, 14 nt, Human
aacaaguugagcua

SEQ ID NO: 3213576 - RNA, 16 nt, Human
aacaagucccuguaau

SEQ ID NO: 3213577 - RNA, 16 nt, Human
aacaagcauauaaaau

SEQ ID NO: 3213578 - RNA, 17 nt, Human
aacaagcauauaaaaug

SEQ ID NO: 3213579 - RNA, 22 nt, Human
aacaauucucccgggacucugc

SEQ ID NO: 3213580 - RNA, 23 nt, Human
aacaauucucccgggacucugca

SEQ ID NO: 3213581 - RNA, 15 nt, Human
aacaauuaauugucu

SEQ ID NO: 3213582 - RNA, 20 nt, Human
aacaauucaaagaaucaccu

SEQ ID NO: 3213583 - RNA, 13 nt, Human
aacaaugguaaca

SEQ ID NO: 3213584 - RNA, 20 nt, Human
aacaaugguaacauuuuuca

SEQ ID NO: 3213585 - RNA, 16 nt, Human
aacagauaaauaguuu

SEQ ID NO: 3213586 - RNA, 23 nt, Human
aacagaacucgguguccccacca

SEQ ID NO: 3213587 - RNA, 15 nt, Human
aacagugauuaccag

SEQ ID NO: 3213588 - RNA, 22 nt, Human
aacagugauuaccagggacuga

SEQ ID NO: 3213589 - RNA, 23 nt, Human
aacagugcaccugggacagggag

SEQ ID NO: 3213590 - RNA, 22 nt, Human
aacagggauugauuuuaaaaug

SEQ ID NO: 3213591 - RNA, 21 nt, Human
aacagggauugauuuuaaaau

SEQ ID NO: 3213592 - RNA, 19 nt, Human
aacagggauugauuuuaaa

SEQ ID NO: 3213593 - RNA, 17 nt, Human
aacagggauugauuuua

SEQ ID NO: 3213594 - RNA, 16 nt, Human
aacagggauugauuuu

SEQ ID NO: 3213595 - RNA, 23 nt, Human
aacagggucucuagugcugugaa

SEQ ID NO: 3213596 - RNA, 22 nt, Human
aacagggucucuagugcuguga

SEQ ID NO: 3213597 - RNA, 20 nt, Human
aacagggucucuagugcugu

SEQ ID NO: 3213598 - RNA, 18 nt, Human
aacagggucucuagugcu

SEQ ID NO: 3213599 - RNA, 13 nt, Human
aacagggucucua

SEQ ID NO: 3213600 - RNA, 12 nt, Human
guccuacucugu

SEQ ID NO: 3213601 - RNA, 20 nt, Human
gucccuuucuucucccccau

SEQ ID NO: 3213602 - RNA, 15 nt, Human
gucccuuucuucucc

SEQ ID NO: 3213603 - RNA, 15 nt, Human
guccuacccacccuc

SEQ ID NO: 3213604 - RNA, 16 nt, Human
guccuacccacccucc

SEQ ID NO: 3213605 - RNA, 16 nt, Human
gucccccuuccaugga

SEQ ID NO: 3213606 - RNA, 18 nt, Human
gucccccuuccauggacu

SEQ ID NO: 3213607 - RNA, 14 nt, Human
gucccccuuccaug

SEQ ID NO: 3213608 - RNA, 18 nt, Human
gucccccugacaacacuc

SEQ ID NO: 3213609 - RNA, 23 nt, Human
gucccuuucgacuugcauuuuug

SEQ ID NO: 3213610 - RNA, 15 nt, Human
aacacagcaagggug

SEQ ID NO: 3213611 - RNA, 21 nt, Human
aacacaaauuaugcuaagaau

SEQ ID NO: 3213612 - RNA, 12 nt, Human
gucauuuucauu

SEQ ID NO: 3213613 - RNA, 13 nt, Human
gucauuuucauua

SEQ ID NO: 3213614 - RNA, 19 nt, Human
gucauuuugcagaggcuau

SEQ ID NO: 3213615 - RNA, 20 nt, Human
gucauuuuguguugaagagc

SEQ ID NO: 3213616 - RNA, 17 nt, Human
gucauuuuggucuaagg

SEQ ID NO: 3213617 - RNA, 18 nt, Human
gucauuuuguguugaaga

SEQ ID NO: 3213618 - RNA, 13 nt, Human
guccaagaagccc

SEQ ID NO: 3213619 - RNA, 15 nt, Human
guccaagaagcccag

SEQ ID NO: 3213620 - RNA, 16 nt, Human
guccaagaagcccagg

SEQ ID NO: 3213621 - RNA, 20 nt, Human
guccaagaagcccaggaaag

SEQ ID NO: 3213622 - RNA, 17 nt, Human
guccaagaagcccagga

SEQ ID NO: 3213623 - RNA, 18 nt, Human
guccaagaagcccaggaa

SEQ ID NO: 3213624 - RNA, 16 nt, Human
gucccaccuuggcugc

SEQ ID NO: 3213625 - RNA, 15 nt, Human
gucccaccuuggcug

SEQ ID NO: 3213626 - RNA, 14 nt, Human
gucccaccuuggcu

SEQ ID NO: 3213627 - RNA, 23 nt, Human
gucccccaacuucaucuggaagu

SEQ ID NO: 3213628 - RNA, 20 nt, Human
gucccaccccacacacgcca

SEQ ID NO: 3213629 - RNA, 13 nt, Human
guccauagcugug

SEQ ID NO: 3213630 - RNA, 17 nt, Human
guccauaauguucugcu

SEQ ID NO: 3213631 - RNA, 16 nt, Human
guccauagcuguggug

SEQ ID NO: 3213632 - RNA, 21 nt, Human
gucccaccccacacacgccag

SEQ ID NO: 3213633 - RNA, 13 nt, Human
guccauagagagc

SEQ ID NO: 3213634 - RNA, 14 nt, Human
guccauagagagca

SEQ ID NO: 3213635 - RNA, 12 nt, Human
aaauucugauuu

SEQ ID NO: 3213636 - RNA, 14 nt, Human
aaauucugauuucu

SEQ ID NO: 3213637 - RNA, 16 nt, Human
aaauucugauuucuuu

SEQ ID NO: 3213638 - RNA, 17 nt, Human
aaauucugauuucuuuu

SEQ ID NO: 3213639 - RNA, 20 nt, Human
aaauucugauuucuuuucac

SEQ ID NO: 3213640 - RNA, 16 nt, Human
aaauuauuuguaagau

SEQ ID NO: 3213641 - RNA, 21 nt, Human
aaauuauuuguaagauauuug

SEQ ID NO: 3213642 - RNA, 12 nt, Human
aaauuauuucuu

SEQ ID NO: 3213643 - RNA, 13 nt, Human
aaauuauuucuua

SEQ ID NO: 3213644 - RNA, 14 nt, Human
aaauuauuucuuaa

SEQ ID NO: 3213645 - RNA, 15 nt, Human
aaauuauuucuuaau

SEQ ID NO: 3213646 - RNA, 20 nt, Human
aaauuauuucuuaauuauua

SEQ ID NO: 3213647 - RNA, 22 nt, Human
aaauuauuucuuaauuauuaua

SEQ ID NO: 3213648 - RNA, 22 nt, Human
aaauucugauuucuuuucacca

SEQ ID NO: 3213649 - RNA, 15 nt, Human
aaauugugauguguc

SEQ ID NO: 3213650 - RNA, 12 nt, Human
aaauugugaugu

SEQ ID NO: 3213651 - RNA, 14 nt, Human
aaauugucuuuaaa

SEQ ID NO: 3213652 - RNA, 20 nt, Human
aaauugucuuuaaaaacugu

SEQ ID NO: 3213653 - RNA, 22 nt, Human
aaauugucuuuaaaaacuguuu

SEQ ID NO: 3213654 - RNA, 16 nt, Human
aaauugucuuaaugga

SEQ ID NO: 3213655 - RNA, 12 nt, Human
aaauuuauguga

SEQ ID NO: 3213656 - RNA, 19 nt, Human
aaauuguuuaguggaaaau

SEQ ID NO: 3213657 - RNA, 23 nt, Human
aaauuguuguccgguuuacuuua

SEQ ID NO: 3213658 - RNA, 13 nt, Human
aaauuguuuagug

SEQ ID NO: 3213659 - RNA, 22 nt, Human
aaauuguuguccgguuuacuuu

SEQ ID NO: 3213660 - RNA, 19 nt, Human
aaauuguuacuccauauau

SEQ ID NO: 3213661 - RNA, 15 nt, Human
aaauuuaugugaugg

SEQ ID NO: 3213662 - RNA, 15 nt, Human
aaauuuauugaggaa

SEQ ID NO: 3213663 - RNA, 21 nt, Human
aaauuuauuagcccugcauuu

SEQ ID NO: 3213664 - RNA, 19 nt, Human
aaauuuauuuacugcuagu

SEQ ID NO: 3213665 - RNA, 14 nt, Human
aaauuuauuuacug

SEQ ID NO: 3213666 - RNA, 23 nt, Human
aaauuuauugaggaaaaauaugu

SEQ ID NO: 3213667 - RNA, 20 nt, Human
aaauuuauugaggaaaaaua

SEQ ID NO: 3213668 - RNA, 19 nt, Human
aaauuuauugaggaaaaau

SEQ ID NO: 3213669 - RNA, 16 nt, Human
aaauuuauugaggaaa

SEQ ID NO: 3213670 - RNA, 13 nt, Human
guauuuuuaaagg

SEQ ID NO: 3213671 - RNA, 23 nt, Human
gucaaaaguagaacuuuguauag

SEQ ID NO: 3213672 - RNA, 14 nt, Human
gucaaaacuuuaaa

SEQ ID NO: 3213673 - RNA, 16 nt, Human
gucaaaaguagaacuu

SEQ ID NO: 3213674 - RNA, 17 nt, Human
gucaaaaguagaacuuu

SEQ ID NO: 3213675 - RNA, 22 nt, Human
guauuuuguuuuugucuuaaaa

SEQ ID NO: 3213676 - RNA, 21 nt, Human
aaauuuauuuacugcuagucu

SEQ ID NO: 3213677 - RNA, 22 nt, Human
aaauuuauuucaauauuagcaa

SEQ ID NO: 3213678 - RNA, 15 nt, Human
aaauuuauuuccaau

SEQ ID NO: 3213679 - RNA, 19 nt, Human
aaauuuauuuccaauguuu

SEQ ID NO: 3213680 - RNA, 19 nt, Human
guauuuuuaauuaacuuug

SEQ ID NO: 3213681 - RNA, 17 nt, Human
aaauuucacgauucauu

SEQ ID NO: 3213682 - RNA, 21 nt, Human
aaauuucacgauucauuuuug

SEQ ID NO: 3213683 - RNA, 21 nt, Human
gucaacaaguaugaauaaaga

SEQ ID NO: 3213684 - RNA, 22 nt, Human
gucaaagcuuugacucuauaag

SEQ ID NO: 3213685 - RNA, 17 nt, Human
gucaaacauuaguacuu

SEQ ID NO: 3213686 - RNA, 11 nt, Human
gucaaacauua

SEQ ID NO: 3213687 - RNA, 14 nt, Human
gucaaacgugaaaa

SEQ ID NO: 3213688 - RNA, 19 nt, Human
gucaaacauuaguacuuua

SEQ ID NO: 3213689 - RNA, 17 nt, Human
gucaaacgugaaaaugc

SEQ ID NO: 3213690 - RNA, 15 nt, Human
gucaaacgugaaaau

SEQ ID NO: 3213691 - RNA, 15 nt, Human
aaauguguuuugguc

SEQ ID NO: 3213692 - RNA, 16 nt, Human
aaauguguuuuggucc

SEQ ID NO: 3213693 - RNA, 16 nt, Human
aaauuaagaagaaacu

SEQ ID NO: 3213694 - RNA, 15 nt, Human
aaauuaagaagaaac

SEQ ID NO: 3213695 - RNA, 14 nt, Human
aaauuaagaagaaa

SEQ ID NO: 3213696 - RNA, 13 nt, Human
aaauuaagaagaa

SEQ ID NO: 3213697 - RNA, 12 nt, Human
aaaugugugugu

SEQ ID NO: 3213698 - RNA, 23 nt, Human
aaauguguguuuuuuuaggguuu

SEQ ID NO: 3213699 - RNA, 23 nt, Human
aaaugugugugaugugacauuug

SEQ ID NO: 3213700 - RNA, 22 nt, Human
aaaugugugugaugugacauuu

SEQ ID NO: 3213701 - RNA, 19 nt, Human
aaaugugugagugcaugua

SEQ ID NO: 3213702 - RNA, 14 nt, Human
aaauguguguaugu

SEQ ID NO: 3213703 - RNA, 20 nt, Human
aaaugugugugaugugacau

SEQ ID NO: 3213704 - RNA, 19 nt, Human
aaaugugugugaugugaca

SEQ ID NO: 3213705 - RNA, 18 nt, Human
aaaugugugugaugugac

SEQ ID NO: 3213706 - RNA, 15 nt, Human
aaaugugugugaugu

SEQ ID NO: 3213707 - RNA, 22 nt, Human
aaauuauguuuuacuguucauu

SEQ ID NO: 3213708 - RNA, 18 nt, Human
aaauuauaccuguugcuu

SEQ ID NO: 3213709 - RNA, 23 nt, Human
aaauuauaauguauucauauuug

SEQ ID NO: 3213710 - RNA, 19 nt, Human
aaauuauaauguauucaua

SEQ ID NO: 3213711 - RNA, 17 nt, Human
aaauuauaauguauuca

SEQ ID NO: 3213712 - RNA, 15 nt, Human
aaauuauaauguauu

SEQ ID NO: 3213713 - RNA, 14 nt, Human
aaauuauaauguau

SEQ ID NO: 3213714 - RNA, 12 nt, Human
aaauuauaaugu

SEQ ID NO: 3213715 - RNA, 23 nt, Human
aaauuagggcucuaauuuccuua

SEQ ID NO: 3213716 - RNA, 15 nt, Human
aaauuaguucccauu

SEQ ID NO: 3213717 - RNA, 21 nt, Human
aaauuagggcucuaauuuccu

SEQ ID NO: 3213718 - RNA, 20 nt, Human
aaauuagggcucuaauuucc

SEQ ID NO: 3213719 - RNA, 11 nt, Human
aaauuaauauc

SEQ ID NO: 3213720 - RNA, 12 nt, Human
aaauuaauaucu

SEQ ID NO: 3213721 - RNA, 19 nt, Human
aaauuagggcucuaauuuc

SEQ ID NO: 3213722 - RNA, 18 nt, Human
aaauuagggcucuaauuu

SEQ ID NO: 3213723 - RNA, 17 nt, Human
aaauuaagguguuugaa

SEQ ID NO: 3213724 - RNA, 19 nt, Human
aaauuaagguguuugaaaa

SEQ ID NO: 3213725 - RNA, 21 nt, Human
aaauuaagguguuugaaaaua

SEQ ID NO: 3213726 - RNA, 23 nt, Human
aaauuaagguguuugaaaauagu

SEQ ID NO: 3213727 - RNA, 12 nt, Human
aaauuaaggugu

SEQ ID NO: 3213728 - RNA, 13 nt, Human
guaugucaaagcu

SEQ ID NO: 3213729 - RNA, 15 nt, Human
guauguauaauucaa

SEQ ID NO: 3213730 - RNA, 11 nt, Human
guauguauaau

SEQ ID NO: 3213731 - RNA, 16 nt, Human
guauguaaauagguuu

SEQ ID NO: 3213732 - RNA, 13 nt, Human
aaauguaugcauu

SEQ ID NO: 3213733 - RNA, 20 nt, Human
aaaugucaaaaguagaacuu

SEQ ID NO: 3213734 - RNA, 23 nt, Human
aaaugucaaaaguagaacuuugu

SEQ ID NO: 3213735 - RNA, 15 nt, Human
aaaugucaaauguga

SEQ ID NO: 3213736 - RNA, 11 nt, Human
aaauguauuau

SEQ ID NO: 3213737 - RNA, 13 nt, Human
aaauguauuaugu

SEQ ID NO: 3213738 - RNA, 14 nt, Human
aaauguauuauguc

SEQ ID NO: 3213739 - RNA, 23 nt, Human
aaauguauuauguccugugagau

SEQ ID NO: 3213740 - RNA, 19 nt, Human
aaaugucuaguuguaacac

SEQ ID NO: 3213741 - RNA, 22 nt, Human
aaauguccaguaagaucacugu

SEQ ID NO: 3213742 - RNA, 21 nt, Human
aaauguccaguaagaucacug

SEQ ID NO: 3213743 - RNA, 20 nt, Human
aaaugucaugagauugcugu

SEQ ID NO: 3213744 - RNA, 21 nt, Human
aaaugucuuuccaaauuauuu

SEQ ID NO: 3213745 - RNA, 16 nt, Human
aaaugugaauuacuaa

SEQ ID NO: 3213746 - RNA, 15 nt, Human
aaaugugaauuacua

SEQ ID NO: 3213747 - RNA, 23 nt, Human
aaaugugaauuacuaacuucuaa

SEQ ID NO: 3213748 - RNA, 22 nt, Human
aaaugugaauuacuaacuucua

SEQ ID NO: 3213749 - RNA, 20 nt, Human
aaaugugagugguugaauau

SEQ ID NO: 3213750 - RNA, 21 nt, Human
guaugcuucauacagggaugg

SEQ ID NO: 3213751 - RNA, 13 nt, Human
guaugguggcugg

SEQ ID NO: 3213752 - RNA, 14 nt, Human
guaugguggcuggg

SEQ ID NO: 3213753 - RNA, 16 nt, Human
guaugguggcuggguu

SEQ ID NO: 3213754 - RNA, 15 nt, Human
guaugguggcugggu

SEQ ID NO: 3213755 - RNA, 15 nt, Human
guaugcuucauacag

SEQ ID NO: 3213756 - RNA, 14 nt, Human
guaugcuucauaca

SEQ ID NO: 3213757 - RNA, 13 nt, Human
guaugcuucauac

SEQ ID NO: 3213758 - RNA, 12 nt, Human
guaugcuucaua

SEQ ID NO: 3213759 - RNA, 16 nt, Human
guaugcauuauuaaau

SEQ ID NO: 3213760 - RNA, 17 nt, Human
guaugcauuauuaaauu

SEQ ID NO: 3213761 - RNA, 18 nt, Human
guaugcauuauuaaauug

SEQ ID NO: 3213762 - RNA, 15 nt, Human
guaugcgugugugug

SEQ ID NO: 3213763 - RNA, 15 nt, Human
guauccagaauggaa

SEQ ID NO: 3213764 - RNA, 15 nt, Human
guauccaaugaaaua

SEQ ID NO: 3213765 - RNA, 19 nt, Human
guaucccaugagccucagc

SEQ ID NO: 3213766 - RNA, 22 nt, Human
guaucaggugcugccauccagg

SEQ ID NO: 3213767 - RNA, 14 nt, Human
guaucaguguuuau

SEQ ID NO: 3213768 - RNA, 19 nt, Human
guaucaguguuuaugugcu

SEQ ID NO: 3213769 - RNA, 24 nt, Human
guaucaguguuuaugugcuauuaa

SEQ ID NO: 3213770 - RNA, 14 nt, Human
guaucaugaagccu

SEQ ID NO: 3213771 - RNA, 15 nt, Human
guauaaguggugugu

SEQ ID NO: 3213772 - RNA, 13 nt, Human
guauaauacuuug

SEQ ID NO: 3213773 - RNA, 22 nt, Human
guauaauacuuuguauacaagu

SEQ ID NO: 3213774 - RNA, 13 nt, Human
guauaauauugaa

SEQ ID NO: 3213775 - RNA, 15 nt, Human
guauaauauugaaaa

SEQ ID NO: 3213776 - RNA, 12 nt, Human
guauaauaggcu

SEQ ID NO: 3213777 - RNA, 13 nt, Human
guauaauguuuau

SEQ ID NO: 3213778 - RNA, 15 nt, Human
guauaauguuuauua

SEQ ID NO: 3213779 - RNA, 18 nt, Human
guauaauguuuauuaaau

SEQ ID NO: 3213780 - RNA, 20 nt, Human
guauaauguuuauuaaaugc

SEQ ID NO: 3213781 - RNA, 19 nt, Human
guauauugcacaauuauaa

SEQ ID NO: 3213782 - RNA, 13 nt, Human
guauauugguuuu

SEQ ID NO: 3213783 - RNA, 16 nt, Human
guauauuuuauaucaa

SEQ ID NO: 3213784 - RNA, 19 nt, Human
guauauugguuuuaugaug

SEQ ID NO: 3213785 - RNA, 17 nt, Human
guauauuugauuuauua

SEQ ID NO: 3213786 - RNA, 15 nt, Human
guauauuuguaugau

SEQ ID NO: 3213787 - RNA, 18 nt, Human
guauauuuguaugauauu

SEQ ID NO: 3213788 - RNA, 18 nt, Human
guauauuugauuuauuaa

SEQ ID NO: 3213789 - RNA, 19 nt, Human
guauauuugauuuauuaac

SEQ ID NO: 3213790 - RNA, 20 nt, Human
guauauuugauuuauuaacu

SEQ ID NO: 3213791 - RNA, 23 nt, Human
guauauuugauuuauuaacuuaa

SEQ ID NO: 3213792 - RNA, 18 nt, Human
guaucaggugcugccauc

SEQ ID NO: 3213793 - RNA, 16 nt, Human
guaucaggugcugcca

SEQ ID NO: 3213794 - RNA, 15 nt, Human
guaucaaaauuacau

SEQ ID NO: 3213795 - RNA, 14 nt, Human
guaucaaauacauu

SEQ ID NO: 3213796 - RNA, 13 nt, Human
guaucaaauacau

SEQ ID NO: 3213797 - RNA, 15 nt, Human
guauauuuuauuuca

SEQ ID NO: 3213798 - RNA, 17 nt, Human
guauauuuuauuucaau

SEQ ID NO: 3213799 - RNA, 20 nt, Human
guauauuuuauuucaaugua

SEQ ID NO: 3213800 - RNA, 22 nt, Human
guauauuuuauuucaauguaau

SEQ ID NO: 3213801 - RNA, 22 nt, Human
guauauuuuuaucuauauaaaa

SEQ ID NO: 3213802 - RNA, 20 nt, Human
guaguugaggaaagcacaga

SEQ ID NO: 3213803 - RNA, 19 nt, Human
guaguugaggaaagcacag

SEQ ID NO: 3213804 - RNA, 17 nt, Human
guaguucuuuaaacugu

SEQ ID NO: 3213805 - RNA, 18 nt, Human
aaauguaacuguuaccau

SEQ ID NO: 3213806 - RNA, 18 nt, Human
aaauguaacuauguuuua

SEQ ID NO: 3213807 - RNA, 14 nt, Human
aaauguaacuguua

SEQ ID NO: 3213808 - RNA, 11 nt, Human
aaauguaacug

SEQ ID NO: 3213809 - RNA, 13 nt, Human
aaauguaacuguc

SEQ ID NO: 3213810 - RNA, 21 nt, Human
aaauguaacuguccguaguau

SEQ ID NO: 3213811 - RNA, 20 nt, Human
aaaugguuuggugcuuuuua

SEQ ID NO: 3213812 - RNA, 18 nt, Human
aaaugguauccagaaugg

SEQ ID NO: 3213813 - RNA, 17 nt, Human
aaaugguaucaaaauua

SEQ ID NO: 3213814 - RNA, 21 nt, Human
aaaugguaucaaaauuacaua

SEQ ID NO: 3213815 - RNA, 22 nt, Human
guaacaggaaaauuuuaaaaau

SEQ ID NO: 3213816 - RNA, 12 nt, Human
guaacaggcaga

SEQ ID NO: 3213817 - RNA, 20 nt, Human
guaacaggaaaauuuuaaaa

SEQ ID NO: 3213818 - RNA, 14 nt, Human
guaacacaggccac

SEQ ID NO: 3213819 - RNA, 19 nt, Human
aagaggcaagcugaaauuu

SEQ ID NO: 3213820 - RNA, 23 nt, Human
aagaggaaugaaguacucauaca

SEQ ID NO: 3213821 - RNA, 13 nt, Human
aagaggaggagga

SEQ ID NO: 3213822 - RNA, 16 nt, Human
aagaggaggaggaggg

SEQ ID NO: 3213823 - RNA, 21 nt, Human
guggccucccaacucacccca

SEQ ID NO: 3213824 - RNA, 22 nt, Human
guggccucccaacucaccccag

SEQ ID NO: 3213825 - RNA, 15 nt, Human
guggccucccaacuc

SEQ ID NO: 3213826 - RNA, 23 nt, Human
guggccucgaacuccuggcacua

SEQ ID NO: 3213827 - RNA, 18 nt, Human
guggccugacucccccag

SEQ ID NO: 3213828 - RNA, 13 nt, Human
guggccugccagu

SEQ ID NO: 3213829 - RNA, 16 nt, Human
guggccuggcuugucu

SEQ ID NO: 3213830 - RNA, 13 nt, Human
gugggacacccug

SEQ ID NO: 3213831 - RNA, 19 nt, Human
guggccuacaaaucaguaa

SEQ ID NO: 3213832 - RNA, 15 nt, Human
gugggacacccugug

SEQ ID NO: 3213833 - RNA, 14 nt, Human
gugggagcugccug

SEQ ID NO: 3213834 - RNA, 22 nt, Human
guggcgaaaucccugcucacug

SEQ ID NO: 3213835 - RNA, 20 nt, Human
guggcgaaaucccugcucac

SEQ ID NO: 3213836 - RNA, 17 nt, Human
guggcgaaaucccugcu

SEQ ID NO: 3213837 - RNA, 15 nt, Human
guggggucacucugg

SEQ ID NO: 3213838 - RNA, 15 nt, Human
guggggcucccgccu

SEQ ID NO: 3213839 - RNA, 18 nt, Human
gugggagcugccuguuca

SEQ ID NO: 3213840 - RNA, 15 nt, Human
gugggagcugccugu

SEQ ID NO: 3213841 - RNA, 17 nt, Human
gugggaagggcuacacc

SEQ ID NO: 3213842 - RNA, 22 nt, Human
guggggccggggcuucugugca

SEQ ID NO: 3213843 - RNA, 17 nt, Human
aacuugcuuaaauguga

SEQ ID NO: 3213844 - RNA, 16 nt, Human
aacuugcuuaaaugug

SEQ ID NO: 3213845 - RNA, 15 nt, Human
aacuugcuuaaaugu

SEQ ID NO: 3213846 - RNA, 14 nt, Human
aacuugcuuaaaug

SEQ ID NO: 3213847 - RNA, 12 nt, Human
aacuugcuuaaa

SEQ ID NO: 3213848 - RNA, 13 nt, Human
aagacgcugugcu

SEQ ID NO: 3213849 - RNA, 16 nt, Human
aagacgcaccagccca

SEQ ID NO: 3213850 - RNA, 15 nt, Human
aagacgcugugcugc

SEQ ID NO: 3213851 - RNA, 17 nt, Human
aagacgcugugcugccc

SEQ ID NO: 3213852 - RNA, 18 nt, Human
aagacgcugugcugcccu

SEQ ID NO: 3213853 - RNA, 19 nt, Human
aagacgcugugcugcccug

SEQ ID NO: 3213854 - RNA, 15 nt, Human
aagaccuucuccuuc

SEQ ID NO: 3213855 - RNA, 14 nt, Human
aacuugcugccucg

SEQ ID NO: 3213856 - RNA, 12 nt, Human
aacuugcugccu

SEQ ID NO: 3213857 - RNA, 15 nt, Human
aacuugccuuugaag

SEQ ID NO: 3213858 - RNA, 14 nt, Human
aacuugccuuugaa

SEQ ID NO: 3213859 - RNA, 18 nt, Human
aagaccuucuccuucacc

SEQ ID NO: 3213860 - RNA, 19 nt, Human
aagaccuucuccuucaccu

SEQ ID NO: 3213861 - RNA, 23 nt, Human
aacuugcaagggcggccuuuccc

SEQ ID NO: 3213862 - RNA, 11 nt, Human
aacuugccuuu

SEQ ID NO: 3213863 - RNA, 22 nt, Human
aagagcaucaguacuuguuucu

SEQ ID NO: 3213864 - RNA, 22 nt, Human
aagagcagcuccuuccuagccu

SEQ ID NO: 3213865 - RNA, 12 nt, Human
guguguaugugg

SEQ ID NO: 3213866 - RNA, 16 nt, Human
gugugguagagugugc

SEQ ID NO: 3213867 - RNA, 14 nt, Human
gugugggucugugu

SEQ ID NO: 3213868 - RNA, 21 nt, Human
gugugggggccccgucucagg

SEQ ID NO: 3213869 - RNA, 19 nt, Human
gugugggggccccgucuca

SEQ ID NO: 3213870 - RNA, 14 nt, Human
gugugggggccccg

SEQ ID NO: 3213871 - RNA, 20 nt, Human
gugugucacccuuaggccag

SEQ ID NO: 3213872 - RNA, 20 nt, Human
gugugugaaaaugugugugu

SEQ ID NO: 3213873 - RNA, 13 nt, Human
guguguauguggg

SEQ ID NO: 3213874 - RNA, 15 nt, Human
guguguauguggggg

SEQ ID NO: 3213875 - RNA, 23 nt, Human
guguguauguguguuucuguccu

SEQ ID NO: 3213876 - RNA, 22 nt, Human
gugugacaaggauugcuacugu

SEQ ID NO: 3213877 - RNA, 20 nt, Human
gugucagguggggcagcuug

SEQ ID NO: 3213878 - RNA, 19 nt, Human
gugucauagaauagcaugu

SEQ ID NO: 3213879 - RNA, 19 nt, Human
gugucaguuuauguuuugg

SEQ ID NO: 3213880 - RNA, 17 nt, Human
aagauguacuauaacau

SEQ ID NO: 3213881 - RNA, 17 nt, Human
aagaugguuaaacauuu

SEQ ID NO: 3213882 - RNA, 13 nt, Human
aagauguagagga

SEQ ID NO: 3213883 - RNA, 14 nt, Human
guguauuuucaguc

SEQ ID NO: 3213884 - RNA, 20 nt, Human
gugucaagagggucugagga

SEQ ID NO: 3213885 - RNA, 16 nt, Human
gugucagcauagaagu

SEQ ID NO: 3213886 - RNA, 15 nt, Human
gugucaagcuuccug

SEQ ID NO: 3213887 - RNA, 14 nt, Human
gugucaaguggcaa

SEQ ID NO: 3213888 - RNA, 14 nt, Human
aagaggcugcagcc

SEQ ID NO: 3213889 - RNA, 23 nt, Human
aagagggagggagggcuccagac

SEQ ID NO: 3213890 - RNA, 12 nt, Human
aagaguaggaag

SEQ ID NO: 3213891 - RNA, 19 nt, Human
gugggguagguugggagaa

SEQ ID NO: 3213892 - RNA, 20 nt, Human
guggggucuccucaggacca

SEQ ID NO: 3213893 - RNA, 17 nt, Human
guggggucacucuggca

SEQ ID NO: 3213894 - RNA, 20 nt, Human
guggggucacucuggcagcu

SEQ ID NO: 3213895 - RNA, 21 nt, Human
guggggucacucuggcagcuc

SEQ ID NO: 3213896 - RNA, 22 nt, Human
guggggucacucuggcagcuca

SEQ ID NO: 3213897 - RNA, 18 nt, Human
aagaucucagugguuaag

SEQ ID NO: 3213898 - RNA, 21 nt, Human
aagaucgguuaacaaauaaca

SEQ ID NO: 3213899 - RNA, 20 nt, Human
aagaucgguuaacaaauaac

SEQ ID NO: 3213900 - RNA, 14 nt, Human
aagaucucuuucua

SEQ ID NO: 3213901 - RNA, 15 nt, Human
aagaucucuuucuaa

SEQ ID NO: 3213902 - RNA, 19 nt, Human
aagaucucuuucuaaagac

SEQ ID NO: 3213903 - RNA, 14 nt, Human
aagaugaaaauauu

SEQ ID NO: 3213904 - RNA, 13 nt, Human
aagaugaaaauau

SEQ ID NO: 3213905 - RNA, 13 nt, Human
aagaguaggaaga

SEQ ID NO: 3213906 - RNA, 12 nt, Human
aagaucuaaauc

SEQ ID NO: 3213907 - RNA, 19 nt, Human
aagaucgguuaacaaauaa

SEQ ID NO: 3213908 - RNA, 18 nt, Human
aagaucgguuaacaaaua

SEQ ID NO: 3213909 - RNA, 19 nt, Human
aagaugcuucucacugcca

SEQ ID NO: 3213910 - RNA, 18 nt, Human
aagauggcugugccucug

SEQ ID NO: 3213911 - RNA, 23 nt, Human
aagauggcugugccucugccugu

SEQ ID NO: 3213912 - RNA, 21 nt, Human
aagauggcugugccucugccu

SEQ ID NO: 3213913 - RNA, 20 nt, Human
aagauggcugugccucugcc

SEQ ID NO: 3213914 - RNA, 17 nt, Human
aagaugcuucucacugc

SEQ ID NO: 3213915 - RNA, 16 nt, Human
aagaugcuucucacug

SEQ ID NO: 3213916 - RNA, 19 nt, Human
aagcccaguucagcuuggg

SEQ ID NO: 3213917 - RNA, 18 nt, Human
aagcccaguucagcuugg

SEQ ID NO: 3213918 - RNA, 13 nt, Human
aagcccaggaggg

SEQ ID NO: 3213919 - RNA, 16 nt, Human
aagcccaggagcccau

SEQ ID NO: 3213920 - RNA, 13 nt, Human
aagccaagaggca

SEQ ID NO: 3213921 - RNA, 15 nt, Human
aagcccaggagccca

SEQ ID NO: 3213922 - RNA, 14 nt, Human
aagcccaggagccc

SEQ ID NO: 3213923 - RNA, 19 nt, Human
aagcccaggaaaggcucca

SEQ ID NO: 3213924 - RNA, 22 nt, Human
aagcccaggaaaggcuccagga

SEQ ID NO: 3213925 - RNA, 22 nt, Human
aagccaagaggcugcagccagg

SEQ ID NO: 3213926 - RNA, 18 nt, Human
aagccaagaggcugcagc

SEQ ID NO: 3213927 - RNA, 14 nt, Human
aagcccaggaaagg

SEQ ID NO: 3213928 - RNA, 17 nt, Human
aagcccaggaaaggcuc

SEQ ID NO: 3213929 - RNA, 22 nt, Human
aagccaaagcuaggccuggcca

SEQ ID NO: 3213930 - RNA, 20 nt, Human
aagccaaagcuaggccuggc

SEQ ID NO: 3213931 - RNA, 14 nt, Human
aagccaaaauuaag

SEQ ID NO: 3213932 - RNA, 17 nt, Human
aagccaaaauuaaggug

SEQ ID NO: 3213933 - RNA, 20 nt, Human
aagccaaaauuaagguguuu

SEQ ID NO: 3213934 - RNA, 22 nt, Human
aagccaaaauuaagguguuuga

SEQ ID NO: 3213935 - RNA, 20 nt, Human
aagccgcuggggccaguugg

SEQ ID NO: 3213936 - RNA, 23 nt, Human
aagcccuuccaugucgccucugc

SEQ ID NO: 3213937 - RNA, 20 nt, Human
aagcccuuccaugucgccuc

SEQ ID NO: 3213938 - RNA, 15 nt, Human
aagcccuuccauguc

SEQ ID NO: 3213939 - RNA, 19 nt, Human
aagcccugagcuuucugcu

SEQ ID NO: 3213940 - RNA, 15 nt, Human
aagccccauuaacug

SEQ ID NO: 3213941 - RNA, 18 nt, Human
aagcaguggagcccagga

SEQ ID NO: 3213942 - RNA, 17 nt, Human
aagcaguggauacgugu

SEQ ID NO: 3213943 - RNA, 22 nt, Human
aagcaguuucaauaaaguuuga

SEQ ID NO: 3213944 - RNA, 20 nt, Human
aagcaguuucaauaaaguuu

SEQ ID NO: 3213945 - RNA, 19 nt, Human
aagcaguuucaauaaaguu

SEQ ID NO: 3213946 - RNA, 12 nt, Human
aagcaguuucaa

SEQ ID NO: 3213947 - RNA, 14 nt, Human
aagcaguuucaaua

SEQ ID NO: 3213948 - RNA, 13 nt, Human
aagcaguuucaau

SEQ ID NO: 3213949 - RNA, 13 nt, Human
aagcauauaaaau

SEQ ID NO: 3213950 - RNA, 14 nt, Human
aagcauaaagcuca

SEQ ID NO: 3213951 - RNA, 20 nt, Human
aagcagugcaugcugucccu

SEQ ID NO: 3213952 - RNA, 14 nt, Human
aagcagugcccagg

SEQ ID NO: 3213953 - RNA, 13 nt, Human
aagcagugcccag

SEQ ID NO: 3213954 - RNA, 18 nt, Human
aagcagugcccagguggc

SEQ ID NO: 3213955 - RNA, 16 nt, Human
aagcagugcccaggug

SEQ ID NO: 3213956 - RNA, 15 nt, Human
aagcagugcccaggu

SEQ ID NO: 3213957 - RNA, 14 nt, Human
aagcagugcaugcu

SEQ ID NO: 3213958 - RNA, 15 nt, Human
aagcagugcaugcug

SEQ ID NO: 3213959 - RNA, 21 nt, Human
gugugugcgccuacaggagug

SEQ ID NO: 3213960 - RNA, 14 nt, Human
gugugugcagagcu

SEQ ID NO: 3213961 - RNA, 15 nt, Human
gugugugaugugaca

SEQ ID NO: 3213962 - RNA, 17 nt, Human
gugugugcagagcugaa

SEQ ID NO: 3213963 - RNA, 12 nt, Human
aagcagugcaug

SEQ ID NO: 3213964 - RNA, 20 nt, Human
aagcaguauauuaguauuau

SEQ ID NO: 3213965 - RNA, 12 nt, Human
aagcaguauuuu

SEQ ID NO: 3213966 - RNA, 13 nt, Human
aagcaguauuuug

SEQ ID NO: 3213967 - RNA, 15 nt, Human
aagcaguauuuuggu

SEQ ID NO: 3213968 - RNA, 17 nt, Human
aagcaucuaaggacaag

SEQ ID NO: 3213969 - RNA, 15 nt, Human
aagcaucuaaggaca

SEQ ID NO: 3213970 - RNA, 13 nt, Human
aagcaucuaagga

SEQ ID NO: 3213971 - RNA, 13 nt, Human
aagcauuguaaau

SEQ ID NO: 3213972 - RNA, 16 nt, Human
aagcauuuacuuugug

SEQ ID NO: 3213973 - RNA, 13 nt, Human
aagcauuucaaag

SEQ ID NO: 3213974 - RNA, 17 nt, Human
aagcauuuuguaauaau

SEQ ID NO: 3213975 - RNA, 14 nt, Human
aagcauuuuguaau

SEQ ID NO: 3213976 - RNA, 22 nt, Human
aagcuagacgagcaggcuucuu

SEQ ID NO: 3213977 - RNA, 12 nt, Human
aagcuaggccug

SEQ ID NO: 3213978 - RNA, 22 nt, Human
aagcuauucaguaauaacucua

SEQ ID NO: 3213979 - RNA, 23 nt, Human
aagcuaggaaaagaaaucuauag

SEQ ID NO: 3213980 - RNA, 21 nt, Human
aagcuaggaaaagaaaucuau

SEQ ID NO: 3213981 - RNA, 20 nt, Human
aagcuaggaaaagaaaucua

SEQ ID NO: 3213982 - RNA, 19 nt, Human
aagcuaggaaaagaaaucu

SEQ ID NO: 3213983 - RNA, 16 nt, Human
aagcuagcaaauagua

SEQ ID NO: 3213984 - RNA, 13 nt, Human
guucagcuccagc

SEQ ID NO: 3213985 - RNA, 14 nt, Human
guucaagaucaaaa

SEQ ID NO: 3213986 - RNA, 20 nt, Human
guucaagaucaaaaaggcuu

SEQ ID NO: 3213987 - RNA, 18 nt, Human
aagccucaaaacaaaggc

SEQ ID NO: 3213988 - RNA, 16 nt, Human
aagccucaaaacaaag

SEQ ID NO: 3213989 - RNA, 15 nt, Human
aagccucaaaacaaa

SEQ ID NO: 3213990 - RNA, 18 nt, Human
aagccuagauguuuuaua

SEQ ID NO: 3213991 - RNA, 13 nt, Human
aagccuaaagauu

SEQ ID NO: 3213992 - RNA, 12 nt, Human
aagccuaaagau

SEQ ID NO: 3213993 - RNA, 17 nt, Human
aagcucaaaugaaaugu

SEQ ID NO: 3213994 - RNA, 18 nt, Human
aagcucaaaugaaaugua

SEQ ID NO: 3213995 - RNA, 19 nt, Human
aagcucaaaugaaauguau

SEQ ID NO: 3213996 - RNA, 12 nt, Human
aagcucagggcc

SEQ ID NO: 3213997 - RNA, 13 nt, Human
aagcucagggccu

SEQ ID NO: 3213998 - RNA, 16 nt, Human
aagcucagggccuggc

SEQ ID NO: 3213999 - RNA, 17 nt, Human
aagcucagggccuggcu

SEQ ID NO: 3214000 - RNA, 17 nt, Human
aagcuccaagcucccag

SEQ ID NO: 3214001 - RNA, 18 nt, Human
aagcuccaagcucccagg

SEQ ID NO: 3214002 - RNA, 18 nt, Human
aagcucagggccuggcuc

SEQ ID NO: 3214003 - RNA, 19 nt, Human
aagcucagggccuggcuca

SEQ ID NO: 3214004 - RNA, 20 nt, Human
aagcucagggccuggcucag

SEQ ID NO: 3214005 - RNA, 14 nt, Human
guuaagauuccuaa

SEQ ID NO: 3214006 - RNA, 18 nt, Human
guuaagagaaaugagcuu

SEQ ID NO: 3214007 - RNA, 11 nt, Human
guuaagagaaa

SEQ ID NO: 3214008 - RNA, 12 nt, Human
guuaagagaaau

SEQ ID NO: 3214009 - RNA, 12 nt, Human
guuaagcaucua

SEQ ID NO: 3214010 - RNA, 17 nt, Human
guuacuuuuccuugcau

SEQ ID NO: 3214011 - RNA, 14 nt, Human
guuagaaaaaugga

SEQ ID NO: 3214012 - RNA, 14 nt, Human
guuacuuuuccuug

SEQ ID NO: 3214013 - RNA, 21 nt, Human
guuacuuuccaauucuccuuu

SEQ ID NO: 3214014 - RNA, 20 nt, Human
guuacuuuccaauucuccuu

SEQ ID NO: 3214015 - RNA, 13 nt, Human
guuacuuuuccuu

SEQ ID NO: 3214016 - RNA, 19 nt, Human
guuaggcauugugggaagg

SEQ ID NO: 3214017 - RNA, 20 nt, Human
guuaggcauugugggaaggg

SEQ ID NO: 3214018 - RNA, 14 nt, Human
guuaggcaguauaa

SEQ ID NO: 3214019 - RNA, 22 nt, Human
guuaggccaaagacaaauagua

SEQ ID NO: 3214020 - RNA, 19 nt, Human
guuaggccaaagacaaaua

SEQ ID NO: 3214021 - RNA, 15 nt, Human
guuagaauguaaggu

SEQ ID NO: 3214022 - RNA, 16 nt, Human
guuauucuuugcacuu

SEQ ID NO: 3214023 - RNA, 15 nt, Human
guuauucuuugcacu

SEQ ID NO: 3214024 - RNA, 13 nt, Human
guuauucuuugca

SEQ ID NO: 3214025 - RNA, 12 nt, Human
guuauucuuugc

SEQ ID NO: 3214026 - RNA, 22 nt, Human
guuauucaacagcaagugugaa

SEQ ID NO: 3214027 - RNA, 23 nt, Human
guuauuuuuauuuauuuaaauuu

SEQ ID NO: 3214028 - RNA, 19 nt, Human
guuauuuuuauaagaaaac

SEQ ID NO: 3214029 - RNA, 20 nt, Human
guuauuuugauguaaagaug

SEQ ID NO: 3214030 - RNA, 19 nt, Human
guuauugagagagaugugu

SEQ ID NO: 3214031 - RNA, 21 nt, Human
guuauugagagagauguguaa

SEQ ID NO: 3214032 - RNA, 20 nt, Human
guuauugagagagaugugua

SEQ ID NO: 3214033 - RNA, 22 nt, Human
guuauugagagagauguguaau

SEQ ID NO: 3214034 - RNA, 20 nt, Human
guucaagaaaugaagagcug

SEQ ID NO: 3214035 - RNA, 13 nt, Human
guucaagaaauga

SEQ ID NO: 3214036 - RNA, 12 nt, Human
guucaaaugugu

SEQ ID NO: 3214037 - RNA, 20 nt, Human
guucaaagucaugauguuuu

SEQ ID NO: 3214038 - RNA, 19 nt, Human
guucaaagucaugauguuu

SEQ ID NO: 3214039 - RNA, 18 nt, Human
guucaaagucaugauguu

SEQ ID NO: 3214040 - RNA, 16 nt, Human
guucaaaccugugaag

SEQ ID NO: 3214041 - RNA, 13 nt, Human
guucaaagucaug

SEQ ID NO: 3214042 - RNA, 15 nt, Human
aaggcuccaggagca

SEQ ID NO: 3214043 - RNA, 16 nt, Human
aaggcuccaggagcag

SEQ ID NO: 3214044 - RNA, 18 nt, Human
aaggcuccaggagcagcc

SEQ ID NO: 3214045 - RNA, 15 nt, Human
guuuauuuuaaaaca

SEQ ID NO: 3214046 - RNA, 16 nt, Human
guuuauuuuaaaacaa

SEQ ID NO: 3214047 - RNA, 19 nt, Human
aaggcuccaggagcagcca

SEQ ID NO: 3214048 - RNA, 22 nt, Human
aaggcuccaggagcagccacau

SEQ ID NO: 3214049 - RNA, 16 nt, Human
aaggcucgagcaugcc

SEQ ID NO: 3214050 - RNA, 18 nt, Human
aaggcucgagcaugccug

SEQ ID NO: 3214051 - RNA, 19 nt, Human
aaggcucgagcaugccugg

SEQ ID NO: 3214052 - RNA, 20 nt, Human
aaggcucgagcaugccugga

SEQ ID NO: 3214053 - RNA, 22 nt, Human
aaggcucgagcaugccuggaug

SEQ ID NO: 3214054 - RNA, 15 nt, Human
aaggcuccugccccc

SEQ ID NO: 3214055 - RNA, 15 nt, Human
guuuacaguguuccg

SEQ ID NO: 3214056 - RNA, 13 nt, Human
guuuacaguguuc

SEQ ID NO: 3214057 - RNA, 13 nt, Human
guuuauugucaaa

SEQ ID NO: 3214058 - RNA, 21 nt, Human
guuuauuggugaguuaggaac

SEQ ID NO: 3214059 - RNA, 13 nt, Human
guuuacagugaag

SEQ ID NO: 3214060 - RNA, 17 nt, Human
guuuacagugaagaaag

SEQ ID NO: 3214061 - RNA, 15 nt, Human
guugggccaggagcc

SEQ ID NO: 3214062 - RNA, 17 nt, Human
guugggccaggagccuc

SEQ ID NO: 3214063 - RNA, 13 nt, Human
guugggcuggugu

SEQ ID NO: 3214064 - RNA, 13 nt, Human
aaguaagcaaaga

SEQ ID NO: 3214065 - RNA, 20 nt, Human
aaguaagggaagcagaagga

SEQ ID NO: 3214066 - RNA, 20 nt, Human
aaggucauuuccauguaugc

SEQ ID NO: 3214067 - RNA, 14 nt, Human
aaggucauuuccau

SEQ ID NO: 3214068 - RNA, 22 nt, Human
aaggucaccucacucagcacca

SEQ ID NO: 3214069 - RNA, 19 nt, Human
aaggucaccucacucagca

SEQ ID NO: 3214070 - RNA, 18 nt, Human
aaggucaccucacucagc

SEQ ID NO: 3214071 - RNA, 17 nt, Human
aaggucaccucacucag

SEQ ID NO: 3214072 - RNA, 15 nt, Human
aaggucaccucacuc

SEQ ID NO: 3214073 - RNA, 14 nt, Human
aaggucaccucacu

SEQ ID NO: 3214074 - RNA, 18 nt, Human
guuucugaaagggacgcu

SEQ ID NO: 3214075 - RNA, 21 nt, Human
guuucucuucuccccuuccau

SEQ ID NO: 3214076 - RNA, 13 nt, Human
guuucucuucucc

SEQ ID NO: 3214077 - RNA, 19 nt, Human
guuucuauguguagggcgg

SEQ ID NO: 3214078 - RNA, 20 nt, Human
aaguaaggugcuuggaguuu

SEQ ID NO: 3214079 - RNA, 13 nt, Human
guuucuauuuucu

SEQ ID NO: 3214080 - RNA, 20 nt, Human
guuucucuucuagaugauuu

SEQ ID NO: 3214081 - RNA, 23 nt, Human
guuucuauuuucucugauacuuu

SEQ ID NO: 3214082 - RNA, 23 nt, Human
aaggcucugagcaaauguggcuc

SEQ ID NO: 3214083 - RNA, 22 nt, Human
aaggggcccaaauucuuucagu

SEQ ID NO: 3214084 - RNA, 24 nt, Human
aagggucuccgaaaugcugucuuu

SEQ ID NO: 3214085 - RNA, 23 nt, Human
aagggucuccgaaaugcugucuu

SEQ ID NO: 3214086 - RNA, 18 nt, Human
aagguacuuucauauuuu

SEQ ID NO: 3214087 - RNA, 22 nt, Human
aagguacuuucauauuuuaaac

SEQ ID NO: 3214088 - RNA, 19 nt, Human
aagguacuuucauauuuua

SEQ ID NO: 3214089 - RNA, 20 nt, Human
aagguagaaauaucugaaaa

SEQ ID NO: 3214090 - RNA, 22 nt, Human
guuuacauagucugaagugaag

SEQ ID NO: 3214091 - RNA, 17 nt, Human
aagguagaaugaccuug

SEQ ID NO: 3214092 - RNA, 13 nt, Human
aagguagaaugac

SEQ ID NO: 3214093 - RNA, 22 nt, Human
aaggcccuaucuguuuacagug

SEQ ID NO: 3214094 - RNA, 23 nt, Human
aaggcccuguuagugcacugauu

SEQ ID NO: 3214095 - RNA, 18 nt, Human
aaggccccaagguuuaca

SEQ ID NO: 3214096 - RNA, 21 nt, Human
aaggcccagagagaagagccc

SEQ ID NO: 3214097 - RNA, 15 nt, Human
aaggcauuucccacc

SEQ ID NO: 3214098 - RNA, 17 nt, Human
aaggauaccuucuuauu

SEQ ID NO: 3214099 - RNA, 19 nt, Human
aaggauaccuucuuauuua

SEQ ID NO: 3214100 - RNA, 15 nt, Human
aaggauacaggcugg

SEQ ID NO: 3214101 - RNA, 23 nt, Human
aaggaguuucuuuagcugacaga

SEQ ID NO: 3214102 - RNA, 12 nt, Human
aaggcaugaagg

SEQ ID NO: 3214103 - RNA, 23 nt, Human
guuggaaacacuaaauguuaaag

SEQ ID NO: 3214104 - RNA, 13 nt, Human
guuggaaaaaauu

SEQ ID NO: 3214105 - RNA, 15 nt, Human
guuggaaaaaauuug

SEQ ID NO: 3214106 - RNA, 22 nt, Human
guuggaaacacuaaauguuaaa

SEQ ID NO: 3214107 - RNA, 20 nt, Human
guuggaaacacuaaauguua

SEQ ID NO: 3214108 - RNA, 19 nt, Human
guuggaaacacuaaauguu

SEQ ID NO: 3214109 - RNA, 18 nt, Human
guuggaaacacuaaaugu

SEQ ID NO: 3214110 - RNA, 16 nt, Human
guuggaaacacuaaau

SEQ ID NO: 3214111 - RNA, 15 nt, Human
guuggaaacacuaaa

SEQ ID NO: 3214112 - RNA, 14 nt, Human
guuggaaacacuaa

SEQ ID NO: 3214113 - RNA, 17 nt, Human
guuggaaaauaucuuug

SEQ ID NO: 3214114 - RNA, 19 nt, Human
guugcccaggcaggucuug

SEQ ID NO: 3214115 - RNA, 23 nt, Human
guugccuauaagccaaaauuaag

SEQ ID NO: 3214116 - RNA, 13 nt, Human
guugcccaggcug

SEQ ID NO: 3214117 - RNA, 12 nt, Human
guugcccaggcu

SEQ ID NO: 3214118 - RNA, 23 nt, Human
guugcccaggcaggucuugaacu

SEQ ID NO: 3214119 - RNA, 22 nt, Human
aaggccuaauucuaugccuguc

SEQ ID NO: 3214120 - RNA, 23 nt, Human
aaggaaccaaagcgaauuuuaaa

SEQ ID NO: 3214121 - RNA, 22 nt, Human
aaggaaccaaagcgaauuuuaa

SEQ ID NO: 3214122 - RNA, 22 nt, Human
aaggaaauaccaguucugggca

SEQ ID NO: 3214123 - RNA, 15 nt, Human
aaggaaagagggagg

SEQ ID NO: 3214124 - RNA, 12 nt, Human
aaggaaagcugu

SEQ ID NO: 3214125 - RNA, 18 nt, Human
aaggaaagcuguguuuau

SEQ ID NO: 3214126 - RNA, 14 nt, Human
aagcuccaucucca

SEQ ID NO: 3214127 - RNA, 15 nt, Human
aaggaagacuucauc

SEQ ID NO: 3214128 - RNA, 13 nt, Human
aaggaagcacaug

SEQ ID NO: 3214129 - RNA, 14 nt, Human
aaggaagacuucau

SEQ ID NO: 3214130 - RNA, 17 nt, Human
aaggaagaaauuaacuu

SEQ ID NO: 3214131 - RNA, 16 nt, Human
aaggaagacaguucua

SEQ ID NO: 3214132 - RNA, 11 nt, Human
aaggaagaaau

SEQ ID NO: 3214133 - RNA, 17 nt, Human
aaggaauaccugucccc

SEQ ID NO: 3214134 - RNA, 21 nt, Human
aaggaauaaauugcuccuuga

SEQ ID NO: 3214135 - RNA, 16 nt, Human
aaggaagcacaugccu

SEQ ID NO: 3214136 - RNA, 20 nt, Human
aaggaggggauagagagaga

SEQ ID NO: 3214137 - RNA, 19 nt, Human
aaggaggcuccaggcagca

SEQ ID NO: 3214138 - RNA, 18 nt, Human
aaggaggcuccaggcagc

SEQ ID NO: 3214139 - RNA, 17 nt, Human
aaggaggcuccaggcag

SEQ ID NO: 3214140 - RNA, 14 nt, Human
aaggaggcuccagg

SEQ ID NO: 3214141 - RNA, 19 nt, Human
aaggaggccaccuccuaaa

SEQ ID NO: 3214142 - RNA, 16 nt, Human
aaggaggccaccuccu

SEQ ID NO: 3214143 - RNA, 12 nt, Human
aaggaggccacc

SEQ ID NO: 3214144 - RNA, 15 nt, Human
aaggaggccaccucc

SEQ ID NO: 3214145 - RNA, 14 nt, Human
aaggaggccaccuc

SEQ ID NO: 3214146 - RNA, 22 nt, Human
aaggagcucacuguggugucug

SEQ ID NO: 3214147 - RNA, 11 nt, Human
aaggagagcua

SEQ ID NO: 3214148 - RNA, 18 nt, Human
aaggaauaccuguccccc

SEQ ID NO: 3214149 - RNA, 20 nt, Human
aaggaauagaucuaugauug

SEQ ID NO: 3214150 - RNA, 18 nt, Human
uaaaaguuugaaaagcaa

SEQ ID NO: 3214151 - RNA, 20 nt, Human
uaaaaguuugaaaagcaaua

SEQ ID NO: 3214152 - RNA, 16 nt, Human
uaaaauaauuuuguaa

SEQ ID NO: 3214153 - RNA, 15 nt, Human
uaaaauaauuuugua

SEQ ID NO: 3214154 - RNA, 22 nt, Human
uaaaauaauuuuaucucuuucu

SEQ ID NO: 3214155 - RNA, 14 nt, Human
uaaaauaauuuugu

SEQ ID NO: 3214156 - RNA, 13 nt, Human
uaaaauaauuuug

SEQ ID NO: 3214157 - RNA, 21 nt, Human
uaaaauaauuuuguaauguau

SEQ ID NO: 3214158 - RNA, 22 nt, Human
uaaaauacuucuuuuuacaaug

SEQ ID NO: 3214159 - RNA, 13 nt, Human
uaaaauacuucuu

SEQ ID NO: 3214160 - RNA, 21 nt, Human
uaaaauacuguagauaauuaa

SEQ ID NO: 3214161 - RNA, 20 nt, Human
uaaaauacuguagauaauua

SEQ ID NO: 3214162 - RNA, 17 nt, Human
uaaaauacuguagauaa

SEQ ID NO: 3214163 - RNA, 16 nt, Human
uaaaauacuguagaua

SEQ ID NO: 3214164 - RNA, 14 nt, Human
uaaaauacuguaga

SEQ ID NO: 3214165 - RNA, 12 nt, Human
uaaaauacugua

SEQ ID NO: 3214166 - RNA, 18 nt, Human
aagugauucuccugccuc

SEQ ID NO: 3214167 - RNA, 17 nt, Human
aagugauucuccugccu

SEQ ID NO: 3214168 - RNA, 16 nt, Human
aagugauucuccugcc

SEQ ID NO: 3214169 - RNA, 15 nt, Human
aagugauucuccugc

SEQ ID NO: 3214170 - RNA, 19 nt, Human
aagugauucuccugccuca

SEQ ID NO: 3214171 - RNA, 21 nt, Human
aagugauucucaugccucagc

SEQ ID NO: 3214172 - RNA, 19 nt, Human
aagugauucucaugccuca

SEQ ID NO: 3214173 - RNA, 18 nt, Human
aagugccucacauuuuuu

SEQ ID NO: 3214174 - RNA, 23 nt, Human
aagugccucacauuuuuuucuac

SEQ ID NO: 3214175 - RNA, 16 nt, Human
aagugaggaugaaaaa

SEQ ID NO: 3214176 - RNA, 18 nt, Human
aagugaggaaaucaaagu

SEQ ID NO: 3214177 - RNA, 21 nt, Human
aagugaggaaaucaaagugcu

SEQ ID NO: 3214178 - RNA, 15 nt, Human
aagugaggccacuga

SEQ ID NO: 3214179 - RNA, 16 nt, Human
aagugaggccacugaa

SEQ ID NO: 3214180 - RNA, 18 nt, Human
aagugaggccacugaaga

SEQ ID NO: 3214181 - RNA, 21 nt, Human
aagugaggccacugaagagga

SEQ ID NO: 3214182 - RNA, 20 nt, Human
aagugauucucaugccucag

SEQ ID NO: 3214183 - RNA, 15 nt, Human
aagugagagcugggu

SEQ ID NO: 3214184 - RNA, 20 nt, Human
uaaaauauuuaugaagaaaa

SEQ ID NO: 3214185 - RNA, 18 nt, Human
uaaaauauuuaugaagaa

SEQ ID NO: 3214186 - RNA, 17 nt, Human
uaaaauauuuaugaaga

SEQ ID NO: 3214187 - RNA, 16 nt, Human
uaaaauauuuaugaag

SEQ ID NO: 3214188 - RNA, 15 nt, Human
uaaaauauuuaugaa

SEQ ID NO: 3214189 - RNA, 14 nt, Human
uaaaauauuuauga

SEQ ID NO: 3214190 - RNA, 22 nt, Human
uaaaauauuccugcauuuguga

SEQ ID NO: 3214191 - RNA, 13 nt, Human
uaaaauauuccug

SEQ ID NO: 3214192 - RNA, 13 nt, Human
uaaaauaugcacu

SEQ ID NO: 3214193 - RNA, 23 nt, Human
uaaaauaugcacuaagucucuuu

SEQ ID NO: 3214194 - RNA, 19 nt, Human
uaaaauaugcacuaagucu

SEQ ID NO: 3214195 - RNA, 14 nt, Human
uaaaauaugcacua

SEQ ID NO: 3214196 - RNA, 17 nt, Human
uaaaaaguguuuaaaug

SEQ ID NO: 3214197 - RNA, 19 nt, Human
uaaaaauaaagcacaaacc

SEQ ID NO: 3214198 - RNA, 12 nt, Human
uaaaaauaaagc

SEQ ID NO: 3214199 - RNA, 13 nt, Human
uaaaaauaacugu

SEQ ID NO: 3214200 - RNA, 16 nt, Human
uaaaaauaacuguaau

SEQ ID NO: 3214201 - RNA, 15 nt, Human
uaaaaauaacuguaa

SEQ ID NO: 3214202 - RNA, 17 nt, Human
uaaaaauaacuguaauu

SEQ ID NO: 3214203 - RNA, 14 nt, Human
uaaaaaguguuuaa

SEQ ID NO: 3214204 - RNA, 19 nt, Human
guuuuugauagcauuguaa

SEQ ID NO: 3214205 - RNA, 15 nt, Human
uaaaaaguggaaaaa

SEQ ID NO: 3214206 - RNA, 19 nt, Human
guuuuugaaggcagaaagc

SEQ ID NO: 3214207 - RNA, 20 nt, Human
guuuuugaaggcagaaagca

SEQ ID NO: 3214208 - RNA, 15 nt, Human
guuuuucuucucccu

SEQ ID NO: 3214209 - RNA, 17 nt, Human
guuuuucuuuucuugga

SEQ ID NO: 3214210 - RNA, 20 nt, Human
guuuuucuuuucuuggacac

SEQ ID NO: 3214211 - RNA, 16 nt, Human
guuuuucuuaauauau

SEQ ID NO: 3214212 - RNA, 12 nt, Human
uaaaagaauugu

SEQ ID NO: 3214213 - RNA, 23 nt, Human
uaaaagaauauuuuaacuuccuu

SEQ ID NO: 3214214 - RNA, 16 nt, Human
uaaaagaauauuuuaa

SEQ ID NO: 3214215 - RNA, 22 nt, Human
uaaaacuugauguguuaucucu

SEQ ID NO: 3214216 - RNA, 20 nt, Human
uaaaacuugauguguuaucu

SEQ ID NO: 3214217 - RNA, 12 nt, Human
aagugagagagg

SEQ ID NO: 3214218 - RNA, 14 nt, Human
aagugagagcuggg

SEQ ID NO: 3214219 - RNA, 18 nt, Human
guuuuuccuaucauguua

SEQ ID NO: 3214220 - RNA, 20 nt, Human
guuuuuccuaucauguuaac

SEQ ID NO: 3214221 - RNA, 16 nt, Human
guuuuucauuuuaaaa

SEQ ID NO: 3214222 - RNA, 21 nt, Human
aagugaaaaaggaggaagaga

SEQ ID NO: 3214223 - RNA, 20 nt, Human
aagucuuuuaaaaaguauug

SEQ ID NO: 3214224 - RNA, 12 nt, Human
aagugaaaacuu

SEQ ID NO: 3214225 - RNA, 10 nt, Human
aagugaaauu

SEQ ID NO: 3214226 - RNA, 20 nt, Human
aagugaaauuuauugaggaa

SEQ ID NO: 3214227 - RNA, 15 nt, Human
aagugaaauuuauug

SEQ ID NO: 3214228 - RNA, 12 nt, Human
aagugaaauuua

SEQ ID NO: 3214229 - RNA, 11 nt, Human
aagugaaauuu

SEQ ID NO: 3214230 - RNA, 14 nt, Human
aagugaaaauauag

SEQ ID NO: 3214231 - RNA, 12 nt, Human
aagugaaaauau

SEQ ID NO: 3214232 - RNA, 19 nt, Human
aagucuuuuaaaaaguauu

SEQ ID NO: 3214233 - RNA, 17 nt, Human
aagucuuuuaaaaagua

SEQ ID NO: 3214234 - RNA, 16 nt, Human
aagucuuuuaaaaagu

SEQ ID NO: 3214235 - RNA, 12 nt, Human
aagucuuuuaaa

SEQ ID NO: 3214236 - RNA, 11 nt, Human
aagucuuugcu

SEQ ID NO: 3214237 - RNA, 17 nt, Human
aagucuugccuauauuu

SEQ ID NO: 3214238 - RNA, 14 nt, Human
aagucuucaugaaa

SEQ ID NO: 3214239 - RNA, 13 nt, Human
aagucuucaugaa

SEQ ID NO: 3214240 - RNA, 22 nt, Human
aagucuucaugaaaugcuaugu

SEQ ID NO: 3214241 - RNA, 19 nt, Human
aagucuucaugaaaugcua

SEQ ID NO: 3214242 - RNA, 18 nt, Human
aagucuucaugaaaugcu

SEQ ID NO: 3214243 - RNA, 16 nt, Human
aagucuucaugaaaug

SEQ ID NO: 3214244 - RNA, 21 nt, Human
aagucaugcuccccugugcca

SEQ ID NO: 3214245 - RNA, 19 nt, Human
aagucaugcuccccugugc

SEQ ID NO: 3214246 - RNA, 15 nt, Human
aagucaugcuccccu

SEQ ID NO: 3214247 - RNA, 21 nt, Human
aagucaugcguuuaaucacau

SEQ ID NO: 3214248 - RNA, 23 nt, Human
guuuuggauuuggagagaaauau

SEQ ID NO: 3214249 - RNA, 15 nt, Human
guuuugcuuccccuc

SEQ ID NO: 3214250 - RNA, 22 nt, Human
guuuugcacucuuguuucuccc

SEQ ID NO: 3214251 - RNA, 22 nt, Human
aaguaauauuuauuaaauuuuu

SEQ ID NO: 3214252 - RNA, 14 nt, Human
aaguaauauuuauu

SEQ ID NO: 3214253 - RNA, 22 nt, Human
guuuugccauguuggccaggcu

SEQ ID NO: 3214254 - RNA, 21 nt, Human
guuuugccauguuggccaggc

SEQ ID NO: 3214255 - RNA, 20 nt, Human
guuuugccauguuggccagg

SEQ ID NO: 3214256 - RNA, 16 nt, Human
guuuugccauguuggc

SEQ ID NO: 3214257 - RNA, 15 nt, Human
guuucugccgcagcc

SEQ ID NO: 3214258 - RNA, 13 nt, Human
guuuugcacucuu

SEQ ID NO: 3214259 - RNA, 14 nt, Human
guuucugccgcagc

SEQ ID NO: 3214260 - RNA, 19 nt, Human
aaguauuuaagccuaaaga

SEQ ID NO: 3214261 - RNA, 17 nt, Human
aaguauuaauucucuuu

SEQ ID NO: 3214262 - RNA, 16 nt, Human
aaguauuacuaaauug

SEQ ID NO: 3214263 - RNA, 17 nt, Human
aaguauuacuaaauuga

SEQ ID NO: 3214264 - RNA, 21 nt, Human
aaguauuuaagccuaaagauu

SEQ ID NO: 3214265 - RNA, 20 nt, Human
aaguauuuaagccuaaagau

SEQ ID NO: 3214266 - RNA, 21 nt, Human
aaguacauuuuuugaaaugcu

SEQ ID NO: 3214267 - RNA, 18 nt, Human
aaguacagguacuuuguc

SEQ ID NO: 3214268 - RNA, 17 nt, Human
aaguacauuuuuugaaa

SEQ ID NO: 3214269 - RNA, 16 nt, Human
aaguacauuuuuugaa

SEQ ID NO: 3214270 - RNA, 15 nt, Human
aaguacagguacuuu

SEQ ID NO: 3214271 - RNA, 23 nt, Human
aaguacacugaauuuuuaugugu

SEQ ID NO: 3214272 - RNA, 13 nt, Human
aaguacagaauuu

SEQ ID NO: 3214273 - RNA, 14 nt, Human
aaguacagaauuug

SEQ ID NO: 3214274 - RNA, 16 nt, Human
aaguacagaauuugaa

SEQ ID NO: 3214275 - RNA, 19 nt, Human
aaguacagaauuugaauua

SEQ ID NO: 3214276 - RNA, 12 nt, Human
uaccucuuuugc

SEQ ID NO: 3214277 - RNA, 13 nt, Human
uaccugaagucuu

SEQ ID NO: 3214278 - RNA, 14 nt, Human
uaccugaagucuuu

SEQ ID NO: 3214279 - RNA, 13 nt, Human
uaccugaggggcc

SEQ ID NO: 3214280 - RNA, 15 nt, Human
uaccugaggggccuc

SEQ ID NO: 3214281 - RNA, 16 nt, Human
uaccugaagucuuugu

SEQ ID NO: 3214282 - RNA, 19 nt, Human
uaccugaagggguuuucuu

SEQ ID NO: 3214283 - RNA, 18 nt, Human
uaccugaagggguuuucu

SEQ ID NO: 3214284 - RNA, 21 nt, Human
uaccugaagggguuuucuuga

SEQ ID NO: 3214285 - RNA, 13 nt, Human
uaccucuuggcug

SEQ ID NO: 3214286 - RNA, 15 nt, Human
uaccucuuuggaaaa

SEQ ID NO: 3214287 - RNA, 14 nt, Human
uaccucuuuggaaa

SEQ ID NO: 3214288 - RNA, 23 nt, Human
uacccuauaucuauaaacacugu

SEQ ID NO: 3214289 - RNA, 23 nt, Human
uacccgggaagggggcugggaca

SEQ ID NO: 3214290 - RNA, 16 nt, Human
uacccuauaucuauaa

SEQ ID NO: 3214291 - RNA, 13 nt, Human
uacccuauaucua

SEQ ID NO: 3214292 - RNA, 21 nt, Human
uaccuuaaauuaguacagcac

SEQ ID NO: 3214293 - RNA, 13 nt, Human
aauuacauauacu

SEQ ID NO: 3214294 - RNA, 11 nt, Human
aauuacaguuu

SEQ ID NO: 3214295 - RNA, 23 nt, Human
aauuacagugccuaaaauaagaa

SEQ ID NO: 3214296 - RNA, 19 nt, Human
aauuacaguggauugcuca

SEQ ID NO: 3214297 - RNA, 19 nt, Human
aauuacagugccuaaaaua

SEQ ID NO: 3214298 - RNA, 12 nt, Human
aauuacauuugu

SEQ ID NO: 3214299 - RNA, 19 nt, Human
aauuacauuuguaauuuaa

SEQ ID NO: 3214300 - RNA, 18 nt, Human
aauuacauuuguaauuua

SEQ ID NO: 3214301 - RNA, 17 nt, Human
aauuacauuuguaauuu

SEQ ID NO: 3214302 - RNA, 15 nt, Human
aauuacauuuguaau

SEQ ID NO: 3214303 - RNA, 17 nt, Human
aauuacaggaaguacug

SEQ ID NO: 3214304 - RNA, 22 nt, Human
uaccuuaaaauuugaaacauug

SEQ ID NO: 3214305 - RNA, 21 nt, Human
uaccuuaaaauuugaaacauu

SEQ ID NO: 3214306 - RNA, 20 nt, Human
uaccuuaaaauuugaaacau

SEQ ID NO: 3214307 - RNA, 18 nt, Human
uaccuuaaaauuugaaac

SEQ ID NO: 3214308 - RNA, 17 nt, Human
uaccuuaaaauuugaaa

SEQ ID NO: 3214309 - RNA, 16 nt, Human
uaccuuaaaauuugaa

SEQ ID NO: 3214310 - RNA, 15 nt, Human
uaccuuaaaauuuga

SEQ ID NO: 3214311 - RNA, 12 nt, Human
uaccuuaaaauu

SEQ ID NO: 3214312 - RNA, 19 nt, Human
aauuacaggaaguacugga

SEQ ID NO: 3214313 - RNA, 20 nt, Human
aauuacaggaaguacuggag

SEQ ID NO: 3214314 - RNA, 16 nt, Human
uaccugaggggccucu

SEQ ID NO: 3214315 - RNA, 16 nt, Human
uaccugaguugaagag

SEQ ID NO: 3214316 - RNA, 17 nt, Human
uaccugaguugaagagg

SEQ ID NO: 3214317 - RNA, 15 nt, Human
uaccugugaaguguu

SEQ ID NO: 3214318 - RNA, 14 nt, Human
uaccuguuuaaauu

SEQ ID NO: 3214319 - RNA, 13 nt, Human
uaccuguuuaaau

SEQ ID NO: 3214320 - RNA, 16 nt, Human
aauuagauccauuaau

SEQ ID NO: 3214321 - RNA, 17 nt, Human
aauuagauccauuaauu

SEQ ID NO: 3214322 - RNA, 11 nt, Human
aauuaugugac

SEQ ID NO: 3214323 - RNA, 18 nt, Human
aauuagaacccuugcaca

SEQ ID NO: 3214324 - RNA, 11 nt, Human
aauuagaaaau

SEQ ID NO: 3214325 - RNA, 14 nt, Human
aauuagaaaauauu

SEQ ID NO: 3214326 - RNA, 16 nt, Human
aauuagaaaauauucu

SEQ ID NO: 3214327 - RNA, 18 nt, Human
aauuagaaaauauucucu

SEQ ID NO: 3214328 - RNA, 19 nt, Human
aauuagaaaauauucucua

SEQ ID NO: 3214329 - RNA, 14 nt, Human
aauuacuuugguag

SEQ ID NO: 3214330 - RNA, 15 nt, Human
aauuaccauuuguua

SEQ ID NO: 3214331 - RNA, 17 nt, Human
aauuauugauugcuuuu

SEQ ID NO: 3214332 - RNA, 14 nt, Human
aauuauugauugcu

SEQ ID NO: 3214333 - RNA, 21 nt, Human
aauuauuuauuaaaugcccag

SEQ ID NO: 3214334 - RNA, 22 nt, Human
aauuauguuugccacuuugcaa

SEQ ID NO: 3214335 - RNA, 19 nt, Human
aauuauguugaaaagagua

SEQ ID NO: 3214336 - RNA, 13 nt, Human
aauuauuauaaaa

SEQ ID NO: 3214337 - RNA, 15 nt, Human
aauuauuauaaaaau

SEQ ID NO: 3214338 - RNA, 17 nt, Human
aauuauuauaaaaauau

SEQ ID NO: 3214339 - RNA, 22 nt, Human
aauuauuauaaaaauauuaaga

SEQ ID NO: 3214340 - RNA, 11 nt, Human
aauucaguugu

SEQ ID NO: 3214341 - RNA, 20 nt, Human
aauucaggcauauuuuaacu

SEQ ID NO: 3214342 - RNA, 17 nt, Human
aauucaguuguuagugu

SEQ ID NO: 3214343 - RNA, 22 nt, Human
aauucaguuguuagugugucuu

SEQ ID NO: 3214344 - RNA, 23 nt, Human
aauucagugaugugccuaaauaa

SEQ ID NO: 3214345 - RNA, 14 nt, Human
aauucaguuuuuuu

SEQ ID NO: 3214346 - RNA, 12 nt, Human
aauuauuuuaaa

SEQ ID NO: 3214347 - RNA, 14 nt, Human
aauuauuugaauga

SEQ ID NO: 3214348 - RNA, 12 nt, Human
aauuauuugaau

SEQ ID NO: 3214349 - RNA, 22 nt, Human
aauuauuuauuaaaugcccagc

SEQ ID NO: 3214350 - RNA, 11 nt, Human
aauuauuucug

SEQ ID NO: 3214351 - RNA, 22 nt, Human
aauuauuucugucacaguaaaa

SEQ ID NO: 3214352 - RNA, 17 nt, Human
aauuauuucuuaauuau

SEQ ID NO: 3214353 - RNA, 15 nt, Human
aauuauuuuaaaaga

SEQ ID NO: 3214354 - RNA, 20 nt, Human
aauucaauaguaauauaaua

SEQ ID NO: 3214355 - RNA, 18 nt, Human
aauucaauaguaauauaa

SEQ ID NO: 3214356 - RNA, 16 nt, Human
aauucaauaguaauau

SEQ ID NO: 3214357 - RNA, 15 nt, Human
aauucaauaguaaua

SEQ ID NO: 3214358 - RNA, 18 nt, Human
uacauuucacauuauucu

SEQ ID NO: 3214359 - RNA, 21 nt, Human
uacauucucaguuuuucuuaa

SEQ ID NO: 3214360 - RNA, 20 nt, Human
uacauucucaguuuuucuua

SEQ ID NO: 3214361 - RNA, 17 nt, Human
uacauucucaguuuuuc

SEQ ID NO: 3214362 - RNA, 15 nt, Human
uacauucucaguuuu

SEQ ID NO: 3214363 - RNA, 19 nt, Human
uacauuucuaagucaaaca

SEQ ID NO: 3214364 - RNA, 14 nt, Human
uacauuucgauguu

SEQ ID NO: 3214365 - RNA, 22 nt, Human
uacauuuccgccacaucccucu

SEQ ID NO: 3214366 - RNA, 12 nt, Human
uaccagcagagc

SEQ ID NO: 3214367 - RNA, 22 nt, Human
uaccagcagagcaccuuagaca

SEQ ID NO: 3214368 - RNA, 13 nt, Human
uaccagcagagca

SEQ ID NO: 3214369 - RNA, 14 nt, Human
uaccagcagagcac

SEQ ID NO: 3214370 - RNA, 16 nt, Human
uaccaugccauuuaaa

SEQ ID NO: 3214371 - RNA, 14 nt, Human
uaccauuaaaauau

SEQ ID NO: 3214372 - RNA, 13 nt, Human
uaccauuaaaaua

SEQ ID NO: 3214373 - RNA, 19 nt, Human
uacccccugcaaagcccag

SEQ ID NO: 3214374 - RNA, 23 nt, Human
uacccccugcaaagcccagcuug

SEQ ID NO: 3214375 - RNA, 15 nt, Human
uacccccugcaaagc

SEQ ID NO: 3214376 - RNA, 17 nt, Human
uaccauuaaaauaugca

SEQ ID NO: 3214377 - RNA, 15 nt, Human
uaccauuaaaauaug

SEQ ID NO: 3214378 - RNA, 21 nt, Human
uaccauuaaaauaugcacuaa

SEQ ID NO: 3214379 - RNA, 19 nt, Human
uaccagggacugaggggag

SEQ ID NO: 3214380 - RNA, 17 nt, Human
uacagggaugguguuca

SEQ ID NO: 3214381 - RNA, 15 nt, Human
uacagagaugucucu

SEQ ID NO: 3214382 - RNA, 22 nt, Human
uacagagaugucucuuauaucu

SEQ ID NO: 3214383 - RNA, 16 nt, Human
uacagagaugucucuu

SEQ ID NO: 3214384 - RNA, 21 nt, Human
aaugugcugaaugguuuucaa

SEQ ID NO: 3214385 - RNA, 13 nt, Human
aauguucaucaau

SEQ ID NO: 3214386 - RNA, 14 nt, Human
aauguuauguauau

SEQ ID NO: 3214387 - RNA, 13 nt, Human
aauguuauaaagu

SEQ ID NO: 3214388 - RNA, 17 nt, Human
aauguuaguuaguguag

SEQ ID NO: 3214389 - RNA, 16 nt, Human
aauguucaucaaugaa

SEQ ID NO: 3214390 - RNA, 20 nt, Human
aauguucaucaaugaaugaa

SEQ ID NO: 3214391 - RNA, 19 nt, Human
aauguucauacugaugugu

SEQ ID NO: 3214392 - RNA, 21 nt, Human
aauguuccugccuccuugaua

SEQ ID NO: 3214393 - RNA, 23 nt, Human
aauguuggcagaugcagcucuuc

SEQ ID NO: 3214394 - RNA, 20 nt, Human
aauguuggcagaugcagcuc

SEQ ID NO: 3214395 - RNA, 17 nt, Human
aauuaaguacuauguau

SEQ ID NO: 3214396 - RNA, 16 nt, Human
aauuaaguacuaugua

SEQ ID NO: 3214397 - RNA, 13 nt, Human
aauuaaguacuau

SEQ ID NO: 3214398 - RNA, 21 nt, Human
aauguugugaauaauuacagu

SEQ ID NO: 3214399 - RNA, 20 nt, Human
aauguugugaauaauuacag

SEQ ID NO: 3214400 - RNA, 18 nt, Human
aauguugugaauaauuac

SEQ ID NO: 3214401 - RNA, 17 nt, Human
aauguugugaauaauua

SEQ ID NO: 3214402 - RNA, 13 nt, Human
aauguugugaaua

SEQ ID NO: 3214403 - RNA, 12 nt, Human
aauguugugaau

SEQ ID NO: 3214404 - RNA, 19 nt, Human
uaauuuaaaauugugaugu

SEQ ID NO: 3214405 - RNA, 20 nt, Human
uaauuuaaaauugugaugug

SEQ ID NO: 3214406 - RNA, 18 nt, Human
uaauuuaaaugauuuaaa

SEQ ID NO: 3214407 - RNA, 22 nt, Human
uaauuauuauucagaaaugacu

SEQ ID NO: 3214408 - RNA, 16 nt, Human
uaauuuaguuguuucu

SEQ ID NO: 3214409 - RNA, 17 nt, Human
uaauuuaguuguuucua

SEQ ID NO: 3214410 - RNA, 19 nt, Human
uaauuuaguuguuucuaga

SEQ ID NO: 3214411 - RNA, 20 nt, Human
uaauuuaggaguuuugagaa

SEQ ID NO: 3214412 - RNA, 18 nt, Human
uaauuuaaggucuguuug

SEQ ID NO: 3214413 - RNA, 23 nt, Human
uaauuuaaggucuguuugcuguu

SEQ ID NO: 3214414 - RNA, 22 nt, Human
uaauuuaaggucuguuugcugu

SEQ ID NO: 3214415 - RNA, 21 nt, Human
uaauuuaaggucuguuugcug

SEQ ID NO: 3214416 - RNA, 16 nt, Human
aaugauuucauucaau

SEQ ID NO: 3214417 - RNA, 11 nt, Human
aaugcaaacca

SEQ ID NO: 3214418 - RNA, 12 nt, Human
aaugcaaaccau

SEQ ID NO: 3214419 - RNA, 14 nt, Human
aaugcaaaaaaucu

SEQ ID NO: 3214420 - RNA, 20 nt, Human
aaugcaaaacacaaaacaaa

SEQ ID NO: 3214421 - RNA, 19 nt, Human
aaugcacauauagacacau

SEQ ID NO: 3214422 - RNA, 15 nt, Human
uaauuauuauaaaaa

SEQ ID NO: 3214423 - RNA, 16 nt, Human
uaauuauuauaaaaau

SEQ ID NO: 3214424 - RNA, 18 nt, Human
uaauuauuauaaaaauau

SEQ ID NO: 3214425 - RNA, 19 nt, Human
uaauuauuauaaaaauauu

SEQ ID NO: 3214426 - RNA, 18 nt, Human
aaugcacugggaaaaagu

SEQ ID NO: 3214427 - RNA, 11 nt, Human
aaugagccugg

SEQ ID NO: 3214428 - RNA, 18 nt, Human
aaugagcagcuuuagcaa

SEQ ID NO: 3214429 - RNA, 21 nt, Human
aaugagaucucauuaaaaggu

SEQ ID NO: 3214430 - RNA, 18 nt, Human
aaugagcaauaucugcua

SEQ ID NO: 3214431 - RNA, 19 nt, Human
aaugacuuccccaauaucu

SEQ ID NO: 3214432 - RNA, 11 nt, Human
aaugacuuuau

SEQ ID NO: 3214433 - RNA, 21 nt, Human
aaugacuuccccaauaucuug

SEQ ID NO: 3214434 - RNA, 13 nt, Human
aaugacuuuauua

SEQ ID NO: 3214435 - RNA, 14 nt, Human
aaugacuuuauuau

SEQ ID NO: 3214436 - RNA, 15 nt, Human
aaugacuuuauuauu

SEQ ID NO: 3214437 - RNA, 17 nt, Human
aaugacuuuauuauuua

SEQ ID NO: 3214438 - RNA, 22 nt, Human
aaugacuaagaggaaaguacau

SEQ ID NO: 3214439 - RNA, 21 nt, Human
aaugaccuuucaauaggaaaa

SEQ ID NO: 3214440 - RNA, 20 nt, Human
aaugaccuuucaauaggaaa

SEQ ID NO: 3214441 - RNA, 20 nt, Human
aaucuguauaauacuuugua

SEQ ID NO: 3214442 - RNA, 21 nt, Human
aaucuguauaauacuuuguau

SEQ ID NO: 3214443 - RNA, 22 nt, Human
aaugaguuucuuagacuuuucc

SEQ ID NO: 3214444 - RNA, 17 nt, Human
aaugauucaaaaaguca

SEQ ID NO: 3214445 - RNA, 12 nt, Human
aaugauucaaaa

SEQ ID NO: 3214446 - RNA, 16 nt, Human
aaugagugaauugaau

SEQ ID NO: 3214447 - RNA, 19 nt, Human
aaugaguuucuuagacuuu

SEQ ID NO: 3214448 - RNA, 14 nt, Human
aaugaguuucuuag

SEQ ID NO: 3214449 - RNA, 21 nt, Human
aaugaguuucacagugugauu

SEQ ID NO: 3214450 - RNA, 18 nt, Human
aaugaguccaaacuggaa

SEQ ID NO: 3214451 - RNA, 24 nt, Human
aaugauuucagcucacugcaaccu

SEQ ID NO: 3214452 - RNA, 22 nt, Human
aaugauugcuuuuaaaauuuua

SEQ ID NO: 3214453 - RNA, 18 nt, Human
aaugauuguuuaaagguu

SEQ ID NO: 3214454 - RNA, 14 nt, Human
aaugauuuaaauuu

SEQ ID NO: 3214455 - RNA, 14 nt, Human
aaugauuguuuaaa

SEQ ID NO: 3214456 - RNA, 13 nt, Human
aaugauuguuuaa

SEQ ID NO: 3214457 - RNA, 20 nt, Human
aaugauugcuuuuaaaauuu

SEQ ID NO: 3214458 - RNA, 19 nt, Human
aaugauugcuuuuaaaauu

SEQ ID NO: 3214459 - RNA, 16 nt, Human
aaugauugcuuuuaaa

SEQ ID NO: 3214460 - RNA, 15 nt, Human
aaugauugcuuuuaa

SEQ ID NO: 3214461 - RNA, 12 nt, Human
aaugauugcuuu

SEQ ID NO: 3214462 - RNA, 20 nt, Human
aaugauugaaaauaaugcug

SEQ ID NO: 3214463 - RNA, 13 nt, Human
aaugauugaaaau

SEQ ID NO: 3214464 - RNA, 21 nt, Human
aaugauucaaaaagucacagu

SEQ ID NO: 3214465 - RNA, 18 nt, Human
aaugaggucagagccugc

SEQ ID NO: 3214466 - RNA, 16 nt, Human
aaugaggucagagccu

SEQ ID NO: 3214467 - RNA, 15 nt, Human
aaugagggggcucag

SEQ ID NO: 3214468 - RNA, 16 nt, Human
aaugagggggcucagu

SEQ ID NO: 3214469 - RNA, 12 nt, Human
aaugagccuggc

SEQ ID NO: 3214470 - RNA, 13 nt, Human
aaugagccuggca

SEQ ID NO: 3214471 - RNA, 17 nt, Human
uacagagacagaaagca

SEQ ID NO: 3214472 - RNA, 23 nt, Human
uacagagcagacaguuaagagaa

SEQ ID NO: 3214473 - RNA, 19 nt, Human
uacagagcccacgccccca

SEQ ID NO: 3214474 - RNA, 22 nt, Human
uacagagcccacgcccccacug

SEQ ID NO: 3214475 - RNA, 21 nt, Human
aauguaauugauuguauauag

SEQ ID NO: 3214476 - RNA, 18 nt, Human
aauguaauuaaacuguua

SEQ ID NO: 3214477 - RNA, 19 nt, Human
aauguaauuaaacuguuaa

SEQ ID NO: 3214478 - RNA, 19 nt, Human
uacacccaugaaagaaaac

SEQ ID NO: 3214479 - RNA, 14 nt, Human
uacagacaaagcgu

SEQ ID NO: 3214480 - RNA, 15 nt, Human
uacagacaaagcgug

SEQ ID NO: 3214481 - RNA, 13 nt, Human
uacagacaaagcg

SEQ ID NO: 3214482 - RNA, 17 nt, Human
uacaccgggccuggaga

SEQ ID NO: 3214483 - RNA, 15 nt, Human
uacaccgggccugga

SEQ ID NO: 3214484 - RNA, 20 nt, Human
aauguaagggaaacugccag

SEQ ID NO: 3214485 - RNA, 23 nt, Human
aauguaagguauaucauucuaaa

SEQ ID NO: 3214486 - RNA, 17 nt, Human
aauguaagguauaucau

SEQ ID NO: 3214487 - RNA, 12 nt, Human
aauguaaauaaa

SEQ ID NO: 3214488 - RNA, 19 nt, Human
aauguaaaggucacuuuuc

SEQ ID NO: 3214489 - RNA, 16 nt, Human
aaugguuuucaaaaua

SEQ ID NO: 3214490 - RNA, 22 nt, Human
aauguaaagcaaccaaaaagaa

SEQ ID NO: 3214491 - RNA, 16 nt, Human
aauggaagacagcucu

SEQ ID NO: 3214492 - RNA, 20 nt, Human
aauggaguuaaacuuuagug

SEQ ID NO: 3214493 - RNA, 21 nt, Human
aauggaguuggaguucauuca

SEQ ID NO: 3214494 - RNA, 19 nt, Human
aauggaguuggaguucauu

SEQ ID NO: 3214495 - RNA, 13 nt, Human
aauggaguuggag

SEQ ID NO: 3214496 - RNA, 14 nt, Human
aaugguuuucaaaa

SEQ ID NO: 3214497 - RNA, 17 nt, Human
aaugguuuggugcuuuu

SEQ ID NO: 3214498 - RNA, 21 nt, Human
aaugguuuggugcuuuuuaua

SEQ ID NO: 3214499 - RNA, 23 nt, Human
aaugguuuggugcuuuuuauaaa

SEQ ID NO: 3214500 - RNA, 13 nt, Human
aauggaugaaauc

SEQ ID NO: 3214501 - RNA, 12 nt, Human
aauggaugaaau

SEQ ID NO: 3214502 - RNA, 13 nt, Human
aauggaagacagc

SEQ ID NO: 3214503 - RNA, 22 nt, Human
aaugcuggcuguuggcuggggg

SEQ ID NO: 3214504 - RNA, 20 nt, Human
aaugcaugcuuuccauauuu

SEQ ID NO: 3214505 - RNA, 21 nt, Human
aaugcuggcuguuggcugggg

SEQ ID NO: 3214506 - RNA, 13 nt, Human
aaugcaugcuuuc

SEQ ID NO: 3214507 - RNA, 18 nt, Human
aaugcaugcuuuccauau

SEQ ID NO: 3214508 - RNA, 16 nt, Human
aaugcaugcuuuccau

SEQ ID NO: 3214509 - RNA, 15 nt, Human
aaugcaucuuugaug

SEQ ID NO: 3214510 - RNA, 18 nt, Human
aaugcaucuuugaugugu

SEQ ID NO: 3214511 - RNA, 19 nt, Human
aaugcaucuuugauguguu

SEQ ID NO: 3214512 - RNA, 20 nt, Human
aaugcaucuuugauguguug

SEQ ID NO: 3214513 - RNA, 14 nt, Human
aaugcaucuuugau

SEQ ID NO: 3214514 - RNA, 11 nt, Human
uaauuuuuccu

SEQ ID NO: 3214515 - RNA, 15 nt, Human
uaauuuuucuguaua

SEQ ID NO: 3214516 - RNA, 15 nt, Human
uaauuuuuguauuuu

SEQ ID NO: 3214517 - RNA, 14 nt, Human
uaauuuuucuguau

SEQ ID NO: 3214518 - RNA, 12 nt, Human
uaauuuuucugu

SEQ ID NO: 3214519 - RNA, 14 nt, Human
uaauuuuugcuuuu

SEQ ID NO: 3214520 - RNA, 15 nt, Human
uaauuuuugcuuuua

SEQ ID NO: 3214521 - RNA, 18 nt, Human
uaauuuuugcuuuuagaa

SEQ ID NO: 3214522 - RNA, 20 nt, Human
uaauuuuugcuuuuagaaaa

SEQ ID NO: 3214523 - RNA, 22 nt, Human
uaauuuuuuuuuuccuuuuaaa

SEQ ID NO: 3214524 - RNA, 13 nt, Human
uacaaugacuuua

SEQ ID NO: 3214525 - RNA, 18 nt, Human
uaauuuuuuugagacaga

SEQ ID NO: 3214526 - RNA, 14 nt, Human
uacaaugugacuuu

SEQ ID NO: 3214527 - RNA, 17 nt, Human
uacaaugugacuuugaa

SEQ ID NO: 3214528 - RNA, 16 nt, Human
uacaaugugacuuuga

SEQ ID NO: 3214529 - RNA, 18 nt, Human
uacaaugacuuuauugca

SEQ ID NO: 3214530 - RNA, 14 nt, Human
uacaaugacuuuau

SEQ ID NO: 3214531 - RNA, 20 nt, Human
uacaaugugacuuugaaaau

SEQ ID NO: 3214532 - RNA, 20 nt, Human
uaaggaauaugggagaaaua

SEQ ID NO: 3214533 - RNA, 21 nt, Human
uaaggaaugauauugcugaag

SEQ ID NO: 3214534 - RNA, 14 nt, Human
uaaggaauauggga

SEQ ID NO: 3214535 - RNA, 17 nt, Human
uaaggaauaccuguccc

SEQ ID NO: 3214536 - RNA, 18 nt, Human
uaaggaauaccugucccc

SEQ ID NO: 3214537 - RNA, 18 nt, Human
uaaggacugacugaggca

SEQ ID NO: 3214538 - RNA, 19 nt, Human
uaaggacugacugaggcag

SEQ ID NO: 3214539 - RNA, 14 nt, Human
uaaggacugacuga

SEQ ID NO: 3214540 - RNA, 14 nt, Human
uaaggacuuccuga

SEQ ID NO: 3214541 - RNA, 13 nt, Human
uaaggacuuccug

SEQ ID NO: 3214542 - RNA, 13 nt, Human
uaaggaagacaau

SEQ ID NO: 3214543 - RNA, 9 nt, Human
uaaggaaua

SEQ ID NO: 3214544 - RNA, 21 nt, Human
uaagcauaagcuuaugcuuaa

SEQ ID NO: 3214545 - RNA, 12 nt, Human
uaagcaguauau

SEQ ID NO: 3214546 - RNA, 21 nt, Human
uaagcaguauauuaguauuau

SEQ ID NO: 3214547 - RNA, 18 nt, Human
uaagcaggcgcaagggag

SEQ ID NO: 3214548 - RNA, 16 nt, Human
uaagcaggcgcaaggg

SEQ ID NO: 3214549 - RNA, 14 nt, Human
uaagcuauucagua

SEQ ID NO: 3214550 - RNA, 21 nt, Human
uaagcuauucaguaauaacuc

SEQ ID NO: 3214551 - RNA, 22 nt, Human
uaagauguuauauuuuucuuaa

SEQ ID NO: 3214552 - RNA, 21 nt, Human
uaagauguuauauuuuucuua

SEQ ID NO: 3214553 - RNA, 15 nt, Human
uaagauuauaauugu

SEQ ID NO: 3214554 - RNA, 14 nt, Human
uaagauuauaauug

SEQ ID NO: 3214555 - RNA, 15 nt, Human
uaagauguguucuua

SEQ ID NO: 3214556 - RNA, 17 nt, Human
uaagauguguucuuauu

SEQ ID NO: 3214557 - RNA, 14 nt, Human
uaagauguuauauu

SEQ ID NO: 3214558 - RNA, 19 nt, Human
uaagauguuauauuuuucu

SEQ ID NO: 3214559 - RNA, 15 nt, Human
uaagauguuauauuu

SEQ ID NO: 3214560 - RNA, 15 nt, Human
uaagcaaaaugugau

SEQ ID NO: 3214561 - RNA, 14 nt, Human
uaagcaaaauguga

SEQ ID NO: 3214562 - RNA, 14 nt, Human
uaagauucauauuu

SEQ ID NO: 3214563 - RNA, 11 nt, Human
aaucagccugc

SEQ ID NO: 3214564 - RNA, 18 nt, Human
aaucagcauucucacucc

SEQ ID NO: 3214565 - RNA, 15 nt, Human
aaucacuguguauau

SEQ ID NO: 3214566 - RNA, 16 nt, Human
aaucacuguguauauu

SEQ ID NO: 3214567 - RNA, 17 nt, Human
aaucacuguguauauuu

SEQ ID NO: 3214568 - RNA, 18 nt, Human
aaucacuguguauauuug

SEQ ID NO: 3214569 - RNA, 19 nt, Human
aaucagcauucucacuccu

SEQ ID NO: 3214570 - RNA, 12 nt, Human
aaucagcauucu

SEQ ID NO: 3214571 - RNA, 16 nt, Human
aaucacucagagcagu

SEQ ID NO: 3214572 - RNA, 15 nt, Human
aaucacucagagcag

SEQ ID NO: 3214573 - RNA, 12 nt, Human
aaucacucagag

SEQ ID NO: 3214574 - RNA, 13 nt, Human
aaucacuguguau

SEQ ID NO: 3214575 - RNA, 14 nt, Human
aaucacuguguaua

SEQ ID NO: 3214576 - RNA, 10 nt, Human
aaucacugug

SEQ ID NO: 3214577 - RNA, 13 nt, Human
aaucagccugcuc

SEQ ID NO: 3214578 - RNA, 18 nt, Human
aaucagccugcuccagcu

SEQ ID NO: 3214579 - RNA, 19 nt, Human
aaucagccugcuccagcug

SEQ ID NO: 3214580 - RNA, 19 nt, Human
aaucacuguguauauuuga

SEQ ID NO: 3214581 - RNA, 11 nt, Human
aaucagcugcu

SEQ ID NO: 3214582 - RNA, 12 nt, Human
aaucagcugcuu

SEQ ID NO: 3214583 - RNA, 13 nt, Human
aaucagcugcuuu

SEQ ID NO: 3214584 - RNA, 16 nt, Human
aaucagcugcuuuguu

SEQ ID NO: 3214585 - RNA, 17 nt, Human
aaucagcugcuuuguua

SEQ ID NO: 3214586 - RNA, 18 nt, Human
aaucagcugcuuuguuac

SEQ ID NO: 3214587 - RNA, 19 nt, Human
aaucagcugcuuuguuacc

SEQ ID NO: 3214588 - RNA, 18 nt, Human
aaucagguccugcucagc

SEQ ID NO: 3214589 - RNA, 11 nt, Human
aaucaguaauu

SEQ ID NO: 3214590 - RNA, 16 nt, Human
aaucaguaaacacugu

SEQ ID NO: 3214591 - RNA, 14 nt, Human
aaucaguaaacacu

SEQ ID NO: 3214592 - RNA, 21 nt, Human
aaucaguagcuuaagaaaaaa

SEQ ID NO: 3214593 - RNA, 16 nt, Human
aauauuuauuaaauuu

SEQ ID NO: 3214594 - RNA, 13 nt, Human
aauauuuucugug

SEQ ID NO: 3214595 - RNA, 14 nt, Human
aauauuuucugugu

SEQ ID NO: 3214596 - RNA, 15 nt, Human
aauauuuucugugug

SEQ ID NO: 3214597 - RNA, 16 nt, Human
aauauuuucugugugu

SEQ ID NO: 3214598 - RNA, 17 nt, Human
aauauuuucuguguguu

SEQ ID NO: 3214599 - RNA, 18 nt, Human
aauauuuucuguguguuc

SEQ ID NO: 3214600 - RNA, 19 nt, Human
aauauuuucuguguguucc

SEQ ID NO: 3214601 - RNA, 20 nt, Human
aauauuuucuguguguuccu

SEQ ID NO: 3214602 - RNA, 21 nt, Human
aauauuuucuguguguuccug

SEQ ID NO: 3214603 - RNA, 22 nt, Human
aauauuuucuguguguuccugg

SEQ ID NO: 3214604 - RNA, 23 nt, Human
aauauuuucuguguguuccuggc

SEQ ID NO: 3214605 - RNA, 15 nt, Human
aauauuuauagguca

SEQ ID NO: 3214606 - RNA, 22 nt, Human
aauauuuaugaagaaaauacuu

SEQ ID NO: 3214607 - RNA, 18 nt, Human
aauauuuaugaagaaaau

SEQ ID NO: 3214608 - RNA, 15 nt, Human
aauauuuaugaagaa

SEQ ID NO: 3214609 - RNA, 14 nt, Human
aauauuuaugaaga

SEQ ID NO: 3214610 - RNA, 13 nt, Human
aauauuuaugaag

SEQ ID NO: 3214611 - RNA, 15 nt, Human
aauauuuauuaaauu

SEQ ID NO: 3214612 - RNA, 12 nt, Human
aauauuuauuaa

SEQ ID NO: 3214613 - RNA, 18 nt, Human
uaaguaaaaccacagcag

SEQ ID NO: 3214614 - RNA, 17 nt, Human
uaaguaaaaccacagca

SEQ ID NO: 3214615 - RNA, 16 nt, Human
uaaguaaaaccacagc

SEQ ID NO: 3214616 - RNA, 18 nt, Human
uaagguuaccuuuguucc

SEQ ID NO: 3214617 - RNA, 15 nt, Human
uaaguaaaaccacag

SEQ ID NO: 3214618 - RNA, 13 nt, Human
uaaguaaaaccac

SEQ ID NO: 3214619 - RNA, 22 nt, Human
uaaggagaaucauguuucuuug

SEQ ID NO: 3214620 - RNA, 20 nt, Human
uaaggagaaucauguuucuu

SEQ ID NO: 3214621 - RNA, 17 nt, Human
uaaggagaaucauguuu

SEQ ID NO: 3214622 - RNA, 21 nt, Human
uaaggauacaggcuggaaagu

SEQ ID NO: 3214623 - RNA, 15 nt, Human
uaaggauaaaucaua

SEQ ID NO: 3214624 - RNA, 22 nt, Human
uaaggauaaaucauaaagucag

SEQ ID NO: 3214625 - RNA, 17 nt, Human
uaaggauacaggcugga

SEQ ID NO: 3214626 - RNA, 16 nt, Human
uaaggauacaggcugg

SEQ ID NO: 3214627 - RNA, 16 nt, Human
uaaguuaauguauaua

SEQ ID NO: 3214628 - RNA, 20 nt, Human
uaaguuaauguauauaaaaa

SEQ ID NO: 3214629 - RNA, 21 nt, Human
uaaguuaauguauauaaaaau

SEQ ID NO: 3214630 - RNA, 14 nt, Human
uaaguguuggaaaa

SEQ ID NO: 3214631 - RNA, 17 nt, Human
uaaguguuggaaaaaau

SEQ ID NO: 3214632 - RNA, 19 nt, Human
uaaguuaguuccacugaga

SEQ ID NO: 3214633 - RNA, 17 nt, Human
uaaguuaguuccacuga

SEQ ID NO: 3214634 - RNA, 21 nt, Human
uaaguauucuuauuuaaugaa

SEQ ID NO: 3214635 - RNA, 15 nt, Human
uaauaaaaagacaac

SEQ ID NO: 3214636 - RNA, 20 nt, Human
uaaguuaguuccacugagac

SEQ ID NO: 3214637 - RNA, 18 nt, Human
aaucuaugauuccaggug

SEQ ID NO: 3214638 - RNA, 15 nt, Human
aaucuaugauuccag

SEQ ID NO: 3214639 - RNA, 18 nt, Human
aaucugggccagaauuuc

SEQ ID NO: 3214640 - RNA, 11 nt, Human
aaucuguaaaa

SEQ ID NO: 3214641 - RNA, 12 nt, Human
aaucucaaaauu

SEQ ID NO: 3214642 - RNA, 13 nt, Human
aaucucaaaauua

SEQ ID NO: 3214643 - RNA, 14 nt, Human
aaucucaaaauuag

SEQ ID NO: 3214644 - RNA, 17 nt, Human
aaucuauagaaaguguu

SEQ ID NO: 3214645 - RNA, 16 nt, Human
aaucuauagaaagugu

SEQ ID NO: 3214646 - RNA, 23 nt, Human
aaucuauagaaaguguucuguua

SEQ ID NO: 3214647 - RNA, 18 nt, Human
aaucuauagaaaguguuc

SEQ ID NO: 3214648 - RNA, 19 nt, Human
aaucgggguauaauaggcu

SEQ ID NO: 3214649 - RNA, 15 nt, Human
aaucgggguauaaua

SEQ ID NO: 3214650 - RNA, 21 nt, Human
aaucgcuuuccuaaaacagua

SEQ ID NO: 3214651 - RNA, 20 nt, Human
aaucccuguguuaauuuaag

SEQ ID NO: 3214652 - RNA, 13 nt, Human
aaucauaaaguca

SEQ ID NO: 3214653 - RNA, 14 nt, Human
aaucauaaagucag

SEQ ID NO: 3214654 - RNA, 22 nt, Human
aaucaguuauacaguuauaaaa

SEQ ID NO: 3214655 - RNA, 17 nt, Human
aaucccauuuaaaaaaa

SEQ ID NO: 3214656 - RNA, 12 nt, Human
aaucccaggaug

SEQ ID NO: 3214657 - RNA, 13 nt, Human
aaucccagcgcac

SEQ ID NO: 3214658 - RNA, 18 nt, Human
aaucccuguguuaauuua

SEQ ID NO: 3214659 - RNA, 19 nt, Human
aaucccuguguuaauuuaa

SEQ ID NO: 3214660 - RNA, 18 nt, Human
aaucccugcucacugcag

SEQ ID NO: 3214661 - RNA, 13 nt, Human
aaucccugcucac

SEQ ID NO: 3214662 - RNA, 22 nt, Human
aauauauuuaaagggaaauuga

SEQ ID NO: 3214663 - RNA, 18 nt, Human
aauauauuuuguaugcaa

SEQ ID NO: 3214664 - RNA, 17 nt, Human
aauauauuuuguaugca

SEQ ID NO: 3214665 - RNA, 16 nt, Human
aauauauuuuguaugc

SEQ ID NO: 3214666 - RNA, 14 nt, Human
aauauauuuuguau

SEQ ID NO: 3214667 - RNA, 13 nt, Human
aauauauuuugua

SEQ ID NO: 3214668 - RNA, 12 nt, Human
aauauauuuuag

SEQ ID NO: 3214669 - RNA, 20 nt, Human
aauauauuuuguaugcaagc

SEQ ID NO: 3214670 - RNA, 13 nt, Human
aauaucaaauuaa

SEQ ID NO: 3214671 - RNA, 18 nt, Human
uaacagggauugauuuua

SEQ ID NO: 3214672 - RNA, 17 nt, Human
uaacagggauugauuuu

SEQ ID NO: 3214673 - RNA, 23 nt, Human
uaacagggucucuagugcuguga

SEQ ID NO: 3214674 - RNA, 19 nt, Human
uaacauguaauuaaguacu

SEQ ID NO: 3214675 - RNA, 17 nt, Human
uaacauguaauuaagua

SEQ ID NO: 3214676 - RNA, 19 nt, Human
uaacaugugaaaagaauag

SEQ ID NO: 3214677 - RNA, 14 nt, Human
uaacgcaaccaagu

SEQ ID NO: 3214678 - RNA, 23 nt, Human
uaacgcaccgacuagacacacaa

SEQ ID NO: 3214679 - RNA, 23 nt, Human
aauaguguuauugagagagaugu

SEQ ID NO: 3214680 - RNA, 22 nt, Human
aauaguguuauugagagagaug

SEQ ID NO: 3214681 - RNA, 14 nt, Human
aauauauuuaaagg

SEQ ID NO: 3214682 - RNA, 19 nt, Human
aauauauuuaaagggaaau

SEQ ID NO: 3214683 - RNA, 15 nt, Human
aauauauuuaaaggg

SEQ ID NO: 3214684 - RNA, 16 nt, Human
aauagcuacagugcau

SEQ ID NO: 3214685 - RNA, 21 nt, Human
aauagugccgcaauaaacaua

SEQ ID NO: 3214686 - RNA, 18 nt, Human
aauagucauuugugaauu

SEQ ID NO: 3214687 - RNA, 22 nt, Human
uaacgugugcuguguuugcucc

SEQ ID NO: 3214688 - RNA, 17 nt, Human
uaacgugugcuguguuu

SEQ ID NO: 3214689 - RNA, 15 nt, Human
uaacgugugcugugu

SEQ ID NO: 3214690 - RNA, 17 nt, Human
uaacuuacccuguauau

SEQ ID NO: 3214691 - RNA, 21 nt, Human
uaacuuagacucuaguauuua

SEQ ID NO: 3214692 - RNA, 15 nt, Human
uaacuuauucaaaga

SEQ ID NO: 3214693 - RNA, 17 nt, Human
uaacuuauucaaagaga

SEQ ID NO: 3214694 - RNA, 17 nt, Human
uaacuuagagcuuuuuu

SEQ ID NO: 3214695 - RNA, 16 nt, Human
uaacuuaguuuugcau

SEQ ID NO: 3214696 - RNA, 15 nt, Human
uaacuuaguuuugca

SEQ ID NO: 3214697 - RNA, 17 nt, Human
uaacuuauauuguaaga

SEQ ID NO: 3214698 - RNA, 17 nt, Human
uaacuuaguuuugcaua

SEQ ID NO: 3214699 - RNA, 21 nt, Human
uaacuuauauuguaagaaaua

SEQ ID NO: 3214700 - RNA, 20 nt, Human
uaacuuauauuguaagaaau

SEQ ID NO: 3214701 - RNA, 19 nt, Human
uaacuuauauuguaagaaa

SEQ ID NO: 3214702 - RNA, 18 nt, Human
uaacuuauauuguaagaa

SEQ ID NO: 3214703 - RNA, 13 nt, Human
uaagaagugaaaa

SEQ ID NO: 3214704 - RNA, 23 nt, Human
uaagaauuuuuuauuuuuuggua

SEQ ID NO: 3214705 - RNA, 15 nt, Human
uaagaauuuuuuauu

SEQ ID NO: 3214706 - RNA, 21 nt, Human
uaacuuccuuggacucauuuu

SEQ ID NO: 3214707 - RNA, 14 nt, Human
uaacuucuaaaacu

SEQ ID NO: 3214708 - RNA, 12 nt, Human
uaacuucuaaaa

SEQ ID NO: 3214709 - RNA, 18 nt, Human
uaacuucuaaaacuguac

SEQ ID NO: 3214710 - RNA, 17 nt, Human
uaacuucuaaaacugua

SEQ ID NO: 3214711 - RNA, 16 nt, Human
uaacuucuaaaacugu

SEQ ID NO: 3214712 - RNA, 15 nt, Human
uaacuucuaaaacug

SEQ ID NO: 3214713 - RNA, 19 nt, Human
uaacuugggagugugguuu

SEQ ID NO: 3214714 - RNA, 12 nt, Human
uaacuugggagu

SEQ ID NO: 3214715 - RNA, 23 nt, Human
uaacuucuaaaacuguacuuuga

SEQ ID NO: 3214716 - RNA, 20 nt, Human
uaacuucuaaaacuguacuu

SEQ ID NO: 3214717 - RNA, 16 nt, Human
uaacuugucuuuggac

SEQ ID NO: 3214718 - RNA, 20 nt, Human
uaacuugucuuuggacccug

SEQ ID NO: 3214719 - RNA, 15 nt, Human
uaacuuguaauaaac

SEQ ID NO: 3214720 - RNA, 14 nt, Human
uaacuuguaauaaa

SEQ ID NO: 3214721 - RNA, 15 nt, Human
aauagagaugagcuu

SEQ ID NO: 3214722 - RNA, 18 nt, Human
aauagagaugagcuuucu

SEQ ID NO: 3214723 - RNA, 19 nt, Human
aauagagaugagcuuucuu

SEQ ID NO: 3214724 - RNA, 20 nt, Human
aauagccugccucuucucua

SEQ ID NO: 3214725 - RNA, 15 nt, Human
aauagcaauauucuu

SEQ ID NO: 3214726 - RNA, 16 nt, Human
aauagcacuuaaauuc

SEQ ID NO: 3214727 - RNA, 21 nt, Human
aauagcaaguggcauaaagca

SEQ ID NO: 3214728 - RNA, 15 nt, Human
aauaccugucccccu

SEQ ID NO: 3214729 - RNA, 18 nt, Human
aauaccugucccccugac

SEQ ID NO: 3214730 - RNA, 19 nt, Human
aauaccugucccccugaca

SEQ ID NO: 3214731 - RNA, 18 nt, Human
aauagacccacaagaggc

SEQ ID NO: 3214732 - RNA, 13 nt, Human
aauaccaguucug

SEQ ID NO: 3214733 - RNA, 17 nt, Human
aauacaugaugauuuca

SEQ ID NO: 3214734 - RNA, 18 nt, Human
aauacagauaaaugauuc

SEQ ID NO: 3214735 - RNA, 13 nt, Human
aauacagauaaau

SEQ ID NO: 3214736 - RNA, 15 nt, Human
aauacagacuggaug

SEQ ID NO: 3214737 - RNA, 18 nt, Human
aauaccaugccauuuaaa

SEQ ID NO: 3214738 - RNA, 22 nt, Human
aauacauucuuuuugcucuaaa

SEQ ID NO: 3214739 - RNA, 13 nt, Human
aauacauucuuuu

SEQ ID NO: 3214740 - RNA, 17 nt, Human
aauacauuuaaaacauu

SEQ ID NO: 3214741 - RNA, 14 nt, Human
aauacauuuaaaac

SEQ ID NO: 3214742 - RNA, 23 nt, Human
aauacauuuaaaacauuaaaaua

SEQ ID NO: 3214743 - RNA, 22 nt, Human
aauacauuuaaaacauuaaaau

SEQ ID NO: 3214744 - RNA, 21 nt, Human
aauacauuuaaaacauuaaaa

SEQ ID NO: 3214745 - RNA, 20 nt, Human
aauacauuuaaaacauuaaa

SEQ ID NO: 3214746 - RNA, 17 nt, Human
uaacaaugccuauugua

SEQ ID NO: 3214747 - RNA, 18 nt, Human
uaacaaugccuauuguaa

SEQ ID NO: 3214748 - RNA, 21 nt, Human
uaacaaugccuauuguaauau

SEQ ID NO: 3214749 - RNA, 22 nt, Human
uaacaaagaaccuaacauuuau

SEQ ID NO: 3214750 - RNA, 13 nt, Human
aauacagaggcaa

SEQ ID NO: 3214751 - RNA, 15 nt, Human
aauacagaaucuugu

SEQ ID NO: 3214752 - RNA, 21 nt, Human
uaaauuaugugaccauaaugu

SEQ ID NO: 3214753 - RNA, 22 nt, Human
uaaauuaugugaccauaaugua

SEQ ID NO: 3214754 - RNA, 16 nt, Human
uaaauuauguuuuacu

SEQ ID NO: 3214755 - RNA, 17 nt, Human
uaaauuauugaugaaaa

SEQ ID NO: 3214756 - RNA, 16 nt, Human
aagugccuuugcagcu

SEQ ID NO: 3214757 - RNA, 18 nt, Human
uaaaugaaaaucgugaca

SEQ ID NO: 3214758 - RNA, 16 nt, Human
uaaaugugcuuuuaaa

SEQ ID NO: 3214759 - RNA, 13 nt, Human
uaaauguuaaaga

SEQ ID NO: 3214760 - RNA, 14 nt, Human
uaaauguuaaagau

SEQ ID NO: 3214761 - RNA, 17 nt, Human
uaaauguuaaagaugua

SEQ ID NO: 3214762 - RNA, 16 nt, Human
uaaauguuaaagaugu

SEQ ID NO: 3214763 - RNA, 20 nt, Human
uaaaugugugagugcaugua

SEQ ID NO: 3214764 - RNA, 11 nt, Human
uaaaugugugu

SEQ ID NO: 3214765 - RNA, 13 nt, Human
uaaauguguguau

SEQ ID NO: 3214766 - RNA, 14 nt, Human
uaaauguguguaug

SEQ ID NO: 3214767 - RNA, 15 nt, Human
uaaauguguguaugu

SEQ ID NO: 3214768 - RNA, 16 nt, Human
uaaauguguguaugug

SEQ ID NO: 3214769 - RNA, 13 nt, Human
uaaaugugguaaa

SEQ ID NO: 3214770 - RNA, 18 nt, Human
uaaauguuauagcugcau

SEQ ID NO: 3214771 - RNA, 22 nt, Human
uaaauguuaaagauguagcaaa

SEQ ID NO: 3214772 - RNA, 21 nt, Human
uaaauguuaaagauguagcaa

SEQ ID NO: 3214773 - RNA, 18 nt, Human
uaaauguuaaagauguag

SEQ ID NO: 3214774 - RNA, 14 nt, Human
uaucagcacgugug

SEQ ID NO: 3214775 - RNA, 14 nt, Human
uaucagauugcuuu

SEQ ID NO: 3214776 - RNA, 15 nt, Human
uaucagauugcuuuu

SEQ ID NO: 3214777 - RNA, 17 nt, Human
uaucagauugcuuuugu

SEQ ID NO: 3214778 - RNA, 20 nt, Human
uaucagauugcuuuugugca

SEQ ID NO: 3214779 - RNA, 14 nt, Human
uaucagagaugucc

SEQ ID NO: 3214780 - RNA, 17 nt, Human
uaucagaauucucagaa

SEQ ID NO: 3214781 - RNA, 10 nt, Human
uaucagaauu

SEQ ID NO: 3214782 - RNA, 19 nt, Human
uauccaacaucaacaucuu

SEQ ID NO: 3214783 - RNA, 14 nt, Human
uaucagcaaagaaa

SEQ ID NO: 3214784 - RNA, 14 nt, Human
uauccaaugaaaua

SEQ ID NO: 3214785 - RNA, 16 nt, Human
uaucuauaaacacugu

SEQ ID NO: 3214786 - RNA, 13 nt, Human
uaucuauauaaaa

SEQ ID NO: 3214787 - RNA, 14 nt, Human
uaucuauauaaaau

SEQ ID NO: 3214788 - RNA, 15 nt, Human
uaucuauauaaaaua

SEQ ID NO: 3214789 - RNA, 18 nt, Human
uaucuauauaaaauaacu

SEQ ID NO: 3214790 - RNA, 21 nt, Human
uaucaaaggcacauggaauau

SEQ ID NO: 3214791 - RNA, 23 nt, Human
uaucaaauacauuuaaaacauua

SEQ ID NO: 3214792 - RNA, 19 nt, Human
acagaccgaacuguuguau

SEQ ID NO: 3214793 - RNA, 18 nt, Human
acagaccgaacuguugua

SEQ ID NO: 3214794 - RNA, 20 nt, Human
uaucacaaaucuuaacuuga

SEQ ID NO: 3214795 - RNA, 16 nt, Human
uaucacaaaucuuaac

SEQ ID NO: 3214796 - RNA, 14 nt, Human
uaucacaaaucuua

SEQ ID NO: 3214797 - RNA, 17 nt, Human
uaucaaauuaauugugu

SEQ ID NO: 3214798 - RNA, 18 nt, Human
uaucaaugugucuuucua

SEQ ID NO: 3214799 - RNA, 22 nt, Human
uaucaaugugucuuucuaagaa

SEQ ID NO: 3214800 - RNA, 15 nt, Human
uaucaaauuaauugu

SEQ ID NO: 3214801 - RNA, 16 nt, Human
uaucaaauuaauugug

SEQ ID NO: 3214802 - RNA, 14 nt, Human
uaucaaauuaauug

SEQ ID NO: 3214803 - RNA, 16 nt, Human
acacuugagaugauuu

SEQ ID NO: 3214804 - RNA, 19 nt, Human
acacuugagaugauuucca

SEQ ID NO: 3214805 - RNA, 21 nt, Human
acacuuuuucuuuacaaacaa

SEQ ID NO: 3214806 - RNA, 19 nt, Human
acagaaagcagaacaguga

SEQ ID NO: 3214807 - RNA, 15 nt, Human
acagacagcccucca

SEQ ID NO: 3214808 - RNA, 18 nt, Human
acagacaggaccccugca

SEQ ID NO: 3214809 - RNA, 13 nt, Human
acagacaggaccc

SEQ ID NO: 3214810 - RNA, 14 nt, Human
acacuuccauaauc

SEQ ID NO: 3214811 - RNA, 17 nt, Human
acacuucaguuaucuug

SEQ ID NO: 3214812 - RNA, 22 nt, Human
acacuucaggcucuucuccuuu

SEQ ID NO: 3214813 - RNA, 19 nt, Human
acacuucaggcucuucucc

SEQ ID NO: 3214814 - RNA, 15 nt, Human
acacuucaggcucuu

SEQ ID NO: 3214815 - RNA, 21 nt, Human
acacuuacacuuuaugcacaa

SEQ ID NO: 3214816 - RNA, 18 nt, Human
acacuuacacuuuaugca

SEQ ID NO: 3214817 - RNA, 23 nt, Human
acacuuaagguugggugcugcua

SEQ ID NO: 3214818 - RNA, 15 nt, Human
acacuuagcuggaga

SEQ ID NO: 3214819 - RNA, 17 nt, Human
acacucauugaccugag

SEQ ID NO: 3214820 - RNA, 16 nt, Human
acacuuacacuuuaug

SEQ ID NO: 3214821 - RNA, 14 nt, Human
acacuuaauucugu

SEQ ID NO: 3214822 - RNA, 16 nt, Human
acacuuaauucuguuc

SEQ ID NO: 3214823 - RNA, 11 nt, Human
uauauauuucc

SEQ ID NO: 3214824 - RNA, 16 nt, Human
uauaucguuaucacug

SEQ ID NO: 3214825 - RNA, 17 nt, Human
uauaucguuaucacugu

SEQ ID NO: 3214826 - RNA, 20 nt, Human
uauaucguuaucacugugca

SEQ ID NO: 3214827 - RNA, 15 nt, Human
uauaucuaaaucugu

SEQ ID NO: 3214828 - RNA, 19 nt, Human
uauauccuuuucuguguuu

SEQ ID NO: 3214829 - RNA, 13 nt, Human
uauauccuuuucu

SEQ ID NO: 3214830 - RNA, 16 nt, Human
acacucauugaccuga

SEQ ID NO: 3214831 - RNA, 18 nt, Human
uauaucuauaaacacugu

SEQ ID NO: 3214832 - RNA, 19 nt, Human
uauaucuaaaucuguccaa

SEQ ID NO: 3214833 - RNA, 20 nt, Human
uauaucuauaaacacuguuu

SEQ ID NO: 3214834 - RNA, 15 nt, Human
uauauagcauuuaug

SEQ ID NO: 3214835 - RNA, 17 nt, Human
uauagguccuuuagaaa

SEQ ID NO: 3214836 - RNA, 18 nt, Human
uauauagcauuuauggua

SEQ ID NO: 3214837 - RNA, 21 nt, Human
uauauaugcacuuaauuuguu

SEQ ID NO: 3214838 - RNA, 16 nt, Human
uauaggugcuacaaaa

SEQ ID NO: 3214839 - RNA, 15 nt, Human
uauaggcaccuacca

SEQ ID NO: 3214840 - RNA, 19 nt, Human
uauaggaauugacccacaa

SEQ ID NO: 3214841 - RNA, 13 nt, Human
uauagcuuuauuu

SEQ ID NO: 3214842 - RNA, 16 nt, Human
uauaggagacuuguag

SEQ ID NO: 3214843 - RNA, 17 nt, Human
uauaggagacuuguagu

SEQ ID NO: 3214844 - RNA, 14 nt, Human
uauagcaucacuua

SEQ ID NO: 3214845 - RNA, 15 nt, Human
uauagauuaaaucau

SEQ ID NO: 3214846 - RNA, 15 nt, Human
uauagcaucacuuaa

SEQ ID NO: 3214847 - RNA, 16 nt, Human
uauagcaucacuuaaa

SEQ ID NO: 3214848 - RNA, 17 nt, Human
uauagcaucacuuaaaa

SEQ ID NO: 3214849 - RNA, 18 nt, Human
uauagcaucacuuaaaac

SEQ ID NO: 3214850 - RNA, 19 nt, Human
uauacauguuuauguaaac

SEQ ID NO: 3214851 - RNA, 15 nt, Human
uauacaugaaauuca

SEQ ID NO: 3214852 - RNA, 18 nt, Human
uauacauguuuauguaaa

SEQ ID NO: 3214853 - RNA, 17 nt, Human
uauacauguuuauguaa

SEQ ID NO: 3214854 - RNA, 16 nt, Human
uauacauguuuaugua

SEQ ID NO: 3214855 - RNA, 15 nt, Human
uauacauguuuaugu

SEQ ID NO: 3214856 - RNA, 16 nt, Human
uauacaucacguuaaa

SEQ ID NO: 3214857 - RNA, 18 nt, Human
uauaauuuaccugaaguc

SEQ ID NO: 3214858 - RNA, 22 nt, Human
uauacacuuacacuuuaugcac

SEQ ID NO: 3214859 - RNA, 21 nt, Human
uauacacuuacacuuuaugca

SEQ ID NO: 3214860 - RNA, 14 nt, Human
uauaauuguugcau

SEQ ID NO: 3214861 - RNA, 16 nt, Human
uauaauuguugcauag

SEQ ID NO: 3214862 - RNA, 15 nt, Human
uauaauuguugcaua

SEQ ID NO: 3214863 - RNA, 17 nt, Human
acacucaaaucaagaaa

SEQ ID NO: 3214864 - RNA, 19 nt, Human
uauaacuauguugauaaaa

SEQ ID NO: 3214865 - RNA, 22 nt, Human
uauaacucaaggauaccuucuu

SEQ ID NO: 3214866 - RNA, 17 nt, Human
uagucacugagacagcc

SEQ ID NO: 3214867 - RNA, 13 nt, Human
acacucaaaucaa

SEQ ID NO: 3214868 - RNA, 21 nt, Human
acacucaaaagcugggcaggu

SEQ ID NO: 3214869 - RNA, 15 nt, Human
acacuaaugaggaaa

SEQ ID NO: 3214870 - RNA, 22 nt, Human
acacuaaugaggaaacugcacu

SEQ ID NO: 3214871 - RNA, 24 nt, Human
uaugauagguuauuuugauguaaa

SEQ ID NO: 3214872 - RNA, 19 nt, Human
uaugccccaccaaggcuga

SEQ ID NO: 3214873 - RNA, 18 nt, Human
acagcggcuggacuugga

SEQ ID NO: 3214874 - RNA, 22 nt, Human
acagcuaaucagcauucucacu

SEQ ID NO: 3214875 - RNA, 23 nt, Human
uauggucuaauguuuaagcagaa

SEQ ID NO: 3214876 - RNA, 17 nt, Human
uauggucuaauguuuaa

SEQ ID NO: 3214877 - RNA, 16 nt, Human
uauggucuaauguuua

SEQ ID NO: 3214878 - RNA, 13 nt, Human
uauggucuaaugu

SEQ ID NO: 3214879 - RNA, 21 nt, Human
uaugguaggaacugcugggcu

SEQ ID NO: 3214880 - RNA, 16 nt, Human
uaugguagaaaaauuu

SEQ ID NO: 3214881 - RNA, 18 nt, Human
uaugguagaaaaauuuca

SEQ ID NO: 3214882 - RNA, 19 nt, Human
uaugguagaaaaauuucac

SEQ ID NO: 3214883 - RNA, 22 nt, Human
uaugguagaaaaauuucacgau

SEQ ID NO: 3214884 - RNA, 14 nt, Human
uaugggagaaauag

SEQ ID NO: 3214885 - RNA, 23 nt, Human
uauggccaggaaguagcacaggc

SEQ ID NO: 3214886 - RNA, 23 nt, Human
uaugggacucaaugcacugacau

SEQ ID NO: 3214887 - RNA, 16 nt, Human
uaugggacucaaugca

SEQ ID NO: 3214888 - RNA, 22 nt, Human
uauggccaggaaguagcacagg

SEQ ID NO: 3214889 - RNA, 23 nt, Human
acagcccgauccuccccuggacu

SEQ ID NO: 3214890 - RNA, 21 nt, Human
acagcccgauccuccccugga

SEQ ID NO: 3214891 - RNA, 20 nt, Human
uaugaaaacauggaacagug

SEQ ID NO: 3214892 - RNA, 21 nt, Human
uaugaaaacauggaacagugu

SEQ ID NO: 3214893 - RNA, 13 nt, Human
uaugaaaacaugg

SEQ ID NO: 3214894 - RNA, 18 nt, Human
uaugaaaacauggaacag

SEQ ID NO: 3214895 - RNA, 18 nt, Human
acagcaagggugauggga

SEQ ID NO: 3214896 - RNA, 15 nt, Human
acagcaagugugaau

SEQ ID NO: 3214897 - RNA, 16 nt, Human
acagcaagugugaaua

SEQ ID NO: 3214898 - RNA, 21 nt, Human
acagauuuggaaagacuggac

SEQ ID NO: 3214899 - RNA, 15 nt, Human
acagauuuggaaaga

SEQ ID NO: 3214900 - RNA, 14 nt, Human
acagauuuggaaag

SEQ ID NO: 3214901 - RNA, 15 nt, Human
acagauuugagcuca

SEQ ID NO: 3214902 - RNA, 22 nt, Human
acagauuugagcucagcccugg

SEQ ID NO: 3214903 - RNA, 23 nt, Human
acagcccuccaucuaaacugccc

SEQ ID NO: 3214904 - RNA, 16 nt, Human
acagcccgauccuccc

SEQ ID NO: 3214905 - RNA, 19 nt, Human
acagccccucccuccucug

SEQ ID NO: 3214906 - RNA, 18 nt, Human
acagccccucccuccucu

SEQ ID NO: 3214907 - RNA, 16 nt, Human
acagccccucccuccu

SEQ ID NO: 3214908 - RNA, 15 nt, Human
acagcccgggcucug

SEQ ID NO: 3214909 - RNA, 14 nt, Human
acagccccuccucc

SEQ ID NO: 3214910 - RNA, 16 nt, Human
acagccccuccuccau

SEQ ID NO: 3214911 - RNA, 19 nt, Human
acagcacgggggccaagga

SEQ ID NO: 3214912 - RNA, 15 nt, Human
acagcuguugacucu

SEQ ID NO: 3214913 - RNA, 14 nt, Human
acagcuguugacuc

SEQ ID NO: 3214914 - RNA, 13 nt, Human
acagcuguugacu

SEQ ID NO: 3214915 - RNA, 12 nt, Human
acagcuuagaau

SEQ ID NO: 3214916 - RNA, 19 nt, Human
acagcuaaugggacacuaa

SEQ ID NO: 3214917 - RNA, 17 nt, Human
acagcuaaugggacacu

SEQ ID NO: 3214918 - RNA, 16 nt, Human
acagcuaaugggacac

SEQ ID NO: 3214919 - RNA, 15 nt, Human
acagcuaaugggaca

SEQ ID NO: 3214920 - RNA, 14 nt, Human
acagcuaugcaaaa

SEQ ID NO: 3214921 - RNA, 21 nt, Human
acagcuaugcaaaaagcuagu

SEQ ID NO: 3214922 - RNA, 21 nt, Human
acagcuucauuuccugugucu

SEQ ID NO: 3214923 - RNA, 19 nt, Human
acagcuucauuuccugugu

SEQ ID NO: 3214924 - RNA, 17 nt, Human
acagcuucauuuccugu

SEQ ID NO: 3214925 - RNA, 20 nt, Human
acagcuugaccgugaggcca

SEQ ID NO: 3214926 - RNA, 21 nt, Human
acagcuugaccgugaggccag

SEQ ID NO: 3214927 - RNA, 17 nt, Human
acagcuugaccgugagg

SEQ ID NO: 3214928 - RNA, 21 nt, Human
acaggaaaagcugcugacagu

SEQ ID NO: 3214929 - RNA, 20 nt, Human
acaggaaaagcugcugacag

SEQ ID NO: 3214930 - RNA, 19 nt, Human
acaggaaaagcugcugaca

SEQ ID NO: 3214931 - RNA, 18 nt, Human
acaggaaaagcugcugac

SEQ ID NO: 3214932 - RNA, 22 nt, Human
acagcuugaccgugaggccaga

SEQ ID NO: 3214933 - RNA, 23 nt, Human
acagcuugaccgugaggccagag

SEQ ID NO: 3214934 - RNA, 17 nt, Human
acaggcccggcuccagg

SEQ ID NO: 3214935 - RNA, 16 nt, Human
acaggcccggcuccag

SEQ ID NO: 3214936 - RNA, 13 nt, Human
acaggcagggcag

SEQ ID NO: 3214937 - RNA, 12 nt, Human
acaggcagggca

SEQ ID NO: 3214938 - RNA, 23 nt, Human
acaggcagggcaggaccagccca

SEQ ID NO: 3214939 - RNA, 22 nt, Human
acaggcagggcaggaccagccc

SEQ ID NO: 3214940 - RNA, 21 nt, Human
acaggcagggcaggaccagcc

SEQ ID NO: 3214941 - RNA, 18 nt, Human
acaggcagggcaggacca

SEQ ID NO: 3214942 - RNA, 15 nt, Human
acaggcagauacagg

SEQ ID NO: 3214943 - RNA, 19 nt, Human
acaggagaugcugugcccc

SEQ ID NO: 3214944 - RNA, 18 nt, Human
acaggagaugcugugccc

SEQ ID NO: 3214945 - RNA, 14 nt, Human
acaggagaugcugu

SEQ ID NO: 3214946 - RNA, 15 nt, Human
acaggacucugccuc

SEQ ID NO: 3214947 - RNA, 16 nt, Human
acaggacucugccucc

SEQ ID NO: 3214948 - RNA, 17 nt, Human
acaggagaagaaagaac

SEQ ID NO: 3214949 - RNA, 20 nt, Human
acaggaaaauuuuaaaaaua

SEQ ID NO: 3214950 - RNA, 22 nt, Human
acaggcccggcuccaggcuccu

SEQ ID NO: 3214951 - RNA, 21 nt, Human
acaggcccggcuccaggcucc

SEQ ID NO: 3214952 - RNA, 20 nt, Human
acaggcccggcuccaggcuc

SEQ ID NO: 3214953 - RNA, 18 nt, Human
acaggcccggcuccaggc

SEQ ID NO: 3214954 - RNA, 22 nt, Human
acaggcccuuccucuccacugc

SEQ ID NO: 3214955 - RNA, 15 nt, Human
acaggcccuuccucu

SEQ ID NO: 3214956 - RNA, 13 nt, Human
acaggcccuuccu

SEQ ID NO: 3214957 - RNA, 23 nt, Human
acaggcccuccucccucccagcu

SEQ ID NO: 3214958 - RNA, 22 nt, Human
acaggcccuccucccucccagc

SEQ ID NO: 3214959 - RNA, 22 nt, Human
uaugugauuuuuuuucccauuu

SEQ ID NO: 3214960 - RNA, 21 nt, Human
uaugugauuuuuuuucccauu

SEQ ID NO: 3214961 - RNA, 16 nt, Human
acaggcgaaagaaaac

SEQ ID NO: 3214962 - RNA, 20 nt, Human
uaugucgucgagcucccccc

SEQ ID NO: 3214963 - RNA, 18 nt, Human
uauguccugugagaugug

SEQ ID NO: 3214964 - RNA, 20 nt, Human
uauguccugugagaugugua

SEQ ID NO: 3214965 - RNA, 22 nt, Human
uauguccugugagauguguauc

SEQ ID NO: 3214966 - RNA, 20 nt, Human
aauuugucugaaacauuuca

SEQ ID NO: 3214967 - RNA, 22 nt, Human
aauuugucugaaacauuucaua

SEQ ID NO: 3214968 - RNA, 21 nt, Human
uagacauuugcuaugagcugg

SEQ ID NO: 3214969 - RNA, 22 nt, Human
aauuuggaaacuaauaaaauau

SEQ ID NO: 3214970 - RNA, 23 nt, Human
aauuuggaaacuaauaaaauauu

SEQ ID NO: 3214971 - RNA, 19 nt, Human
aauuuggaccauuuuccug

SEQ ID NO: 3214972 - RNA, 18 nt, Human
aauuuggagcacaaaauu

SEQ ID NO: 3214973 - RNA, 19 nt, Human
aauuuggagcacaaaauuc

SEQ ID NO: 3214974 - RNA, 20 nt, Human
aauuuggagcacaaaauuca

SEQ ID NO: 3214975 - RNA, 21 nt, Human
aauuuggagcacaaaauucaa

SEQ ID NO: 3214976 - RNA, 22 nt, Human
aauuuggaggcuggaguaauca

SEQ ID NO: 3214977 - RNA, 17 nt, Human
uagacagucccugccaa

SEQ ID NO: 3214978 - RNA, 21 nt, Human
uagacagucccugccaaugga

SEQ ID NO: 3214979 - RNA, 14 nt, Human
uagacaucuguccu

SEQ ID NO: 3214980 - RNA, 16 nt, Human
uagacagucccugcca

SEQ ID NO: 3214981 - RNA, 10 nt, Human
uagacagagu

SEQ ID NO: 3214982 - RNA, 16 nt, Human
uagacacacaaagcag

SEQ ID NO: 3214983 - RNA, 15 nt, Human
uagacacacaaagca

SEQ ID NO: 3214984 - RNA, 12 nt, Human
uagacacacaaa

SEQ ID NO: 3214985 - RNA, 23 nt, Human
uagaauuuuaagccuuuguugaa

SEQ ID NO: 3214986 - RNA, 13 nt, Human
uagacaaaaagua

SEQ ID NO: 3214987 - RNA, 14 nt, Human
uagacaaaaaguau

SEQ ID NO: 3214988 - RNA, 15 nt, Human
uagacaaaaaguaua

SEQ ID NO: 3214989 - RNA, 16 nt, Human
uagacaaaaaguauau

SEQ ID NO: 3214990 - RNA, 20 nt, Human
uagacaaaaaguauauuaaa

SEQ ID NO: 3214991 - RNA, 12 nt, Human
uagacaaaguac

SEQ ID NO: 3214992 - RNA, 14 nt, Human
uagacaaaguacau

SEQ ID NO: 3214993 - RNA, 21 nt, Human
uagaaggaaaaccuagaaaac

SEQ ID NO: 3214994 - RNA, 21 nt, Human
uagaaguaacuggugauauau

SEQ ID NO: 3214995 - RNA, 16 nt, Human
aauuccacacccucac

SEQ ID NO: 3214996 - RNA, 16 nt, Human
aauucauucauacuua

SEQ ID NO: 3214997 - RNA, 19 nt, Human
aauucauucauacuuaaaa

SEQ ID NO: 3214998 - RNA, 23 nt, Human
uacuuugauauuuucaacgcagc

SEQ ID NO: 3214999 - RNA, 14 nt, Human
aauuccacagcugc

SEQ ID NO: 3215000 - RNA, 12 nt, Human
aauuccacagcu

SEQ ID NO: 3215001 - RNA, 13 nt, Human
aauuccacagcug

SEQ ID NO: 3215002 - RNA, 14 nt, Human
uacuuuguaaauuc

SEQ ID NO: 3215003 - RNA, 20 nt, Human
uacuuugguagcugggaaag

SEQ ID NO: 3215004 - RNA, 23 nt, Human
uacuuugguagcugggaaagcau

SEQ ID NO: 3215005 - RNA, 18 nt, Human
uacuuugguuucugagca

SEQ ID NO: 3215006 - RNA, 17 nt, Human
uacuuuguaaauucuga

SEQ ID NO: 3215007 - RNA, 18 nt, Human
uacuuuguaaauucugau

SEQ ID NO: 3215008 - RNA, 19 nt, Human
uacuuuguaaauucugauu

SEQ ID NO: 3215009 - RNA, 22 nt, Human
uacuuuguaaauucugauuucu

SEQ ID NO: 3215010 - RNA, 12 nt, Human
uacuuuguauug

SEQ ID NO: 3215011 - RNA, 16 nt, Human
uacuuuguauacaagu

SEQ ID NO: 3215012 - RNA, 22 nt, Human
aauucauggcaugcuuaaauuu

SEQ ID NO: 3215013 - RNA, 12 nt, Human
uacuuugauuca

SEQ ID NO: 3215014 - RNA, 15 nt, Human
uacuuugauucacau

SEQ ID NO: 3215015 - RNA, 14 nt, Human
uacuuugauucaca

SEQ ID NO: 3215016 - RNA, 23 nt, Human
uacuuugauucacauguuuucaa

SEQ ID NO: 3215017 - RNA, 12 nt, Human
uacuuugcauug

SEQ ID NO: 3215018 - RNA, 16 nt, Human
uacuuugcauugucug

SEQ ID NO: 3215019 - RNA, 18 nt, Human
uacuuugcauugucuguc

SEQ ID NO: 3215020 - RNA, 20 nt, Human
uacuuugauucacauguuuu

SEQ ID NO: 3215021 - RNA, 17 nt, Human
uacuuugauucacaugu

SEQ ID NO: 3215022 - RNA, 21 nt, Human
uacuuugauucacauguuuuc

SEQ ID NO: 3215023 - RNA, 12 nt, Human
uagaaaaaugga

SEQ ID NO: 3215024 - RNA, 13 nt, Human
uagaaaaauuuca

SEQ ID NO: 3215025 - RNA, 17 nt, Human
uagaaaaauuucacgau

SEQ ID NO: 3215026 - RNA, 19 nt, Human
uagaaaacauuuggcagaa

SEQ ID NO: 3215027 - RNA, 14 nt, Human
uagaaaaacaaauc

SEQ ID NO: 3215028 - RNA, 14 nt, Human
uacuuuguauuguc

SEQ ID NO: 3215029 - RNA, 16 nt, Human
uacuuuguauuguccu

SEQ ID NO: 3215030 - RNA, 22 nt, Human
uacuuuuccuugcauacaaaca

SEQ ID NO: 3215031 - RNA, 21 nt, Human
uacuuuuccuugcauacaaac

SEQ ID NO: 3215032 - RNA, 11 nt, Human
uacuuuuccuu

SEQ ID NO: 3215033 - RNA, 15 nt, Human
uacuuuuccuugcau

SEQ ID NO: 3215034 - RNA, 14 nt, Human
uagaagaagugugu

SEQ ID NO: 3215035 - RNA, 16 nt, Human
uagaacuuuguauagu

SEQ ID NO: 3215036 - RNA, 16 nt, Human
uagaagaaagauguuu

SEQ ID NO: 3215037 - RNA, 22 nt, Human
uagaagaaugcaugcuuuccau

SEQ ID NO: 3215038 - RNA, 16 nt, Human
uagaagaaugcaugcu

SEQ ID NO: 3215039 - RNA, 16 nt, Human
uagaagaauauuguau

SEQ ID NO: 3215040 - RNA, 17 nt, Human
uagaagaauauuguauu

SEQ ID NO: 3215041 - RNA, 14 nt, Human
uagaagaaugcaug

SEQ ID NO: 3215042 - RNA, 15 nt, Human
uagaacucccuuuca

SEQ ID NO: 3215043 - RNA, 12 nt, Human
uagaacuuugua

SEQ ID NO: 3215044 - RNA, 13 nt, Human
uagaacuuuguau

SEQ ID NO: 3215045 - RNA, 14 nt, Human
uagaacuuuguaua

SEQ ID NO: 3215046 - RNA, 16 nt, Human
uagaacucccuuucaa

SEQ ID NO: 3215047 - RNA, 17 nt, Human
uagaacucccuuucaac

SEQ ID NO: 3215048 - RNA, 17 nt, Human
uagaaacaccaaaaaaa

SEQ ID NO: 3215049 - RNA, 21 nt, Human
uagaaacacauaauuaacacu

SEQ ID NO: 3215050 - RNA, 20 nt, Human
uagaaacacauaauuaacac

SEQ ID NO: 3215051 - RNA, 16 nt, Human
uagaaacacauaauua

SEQ ID NO: 3215052 - RNA, 21 nt, Human
uagaaaaggugauaaaaucau

SEQ ID NO: 3215053 - RNA, 12 nt, Human
uagaaaagguga

SEQ ID NO: 3215054 - RNA, 22 nt, Human
uagaaaaggugauaaaaucaua

SEQ ID NO: 3215055 - RNA, 13 nt, Human
uagaaaauauucu

SEQ ID NO: 3215056 - RNA, 16 nt, Human
uagaaaauauucucua

SEQ ID NO: 3215057 - RNA, 18 nt, Human
uagaaaauauucucuauu

SEQ ID NO: 3215058 - RNA, 14 nt, Human
uagaaaagugaauu

SEQ ID NO: 3215059 - RNA, 17 nt, Human
uagaaaagugaauugaa

SEQ ID NO: 3215060 - RNA, 18 nt, Human
uagaaaagugaauugaag

SEQ ID NO: 3215061 - RNA, 13 nt, Human
uagaaaacuuugu

SEQ ID NO: 3215062 - RNA, 11 nt, Human
uagaaaaggca

SEQ ID NO: 3215063 - RNA, 14 nt, Human
uagaaaacuuuguu

SEQ ID NO: 3215064 - RNA, 13 nt, Human
acaaaaacacagc

SEQ ID NO: 3215065 - RNA, 13 nt, Human
aauuuuagaaaua

SEQ ID NO: 3215066 - RNA, 17 nt, Human
acaaaaaacgaaugaaa

SEQ ID NO: 3215067 - RNA, 15 nt, Human
acaaaaacacagcaa

SEQ ID NO: 3215068 - RNA, 14 nt, Human
acaaaaacacagca

SEQ ID NO: 3215069 - RNA, 16 nt, Human
acaaaaagcauaaaaa

SEQ ID NO: 3215070 - RNA, 19 nt, Human
acaaaaauucucaguucuc

SEQ ID NO: 3215071 - RNA, 10 nt, Human
acaaaaggca

SEQ ID NO: 3215072 - RNA, 22 nt, Human
acaaaaccacaguguaccauua

SEQ ID NO: 3215073 - RNA, 15 nt, Human
acaaaaccacagugu

SEQ ID NO: 3215074 - RNA, 19 nt, Human
acaaaaccaaaaguuauua

SEQ ID NO: 3215075 - RNA, 16 nt, Human
acaaaaccaaaaguua

SEQ ID NO: 3215076 - RNA, 14 nt, Human
acaaaaccaaaagu

SEQ ID NO: 3215077 - RNA, 15 nt, Human
acaaaacaaauccug

SEQ ID NO: 3215078 - RNA, 12 nt, Human
acaaaacaaauc

SEQ ID NO: 3215079 - RNA, 23 nt, Human
acaaauaacaacuuuuuuuucuu

SEQ ID NO: 3215080 - RNA, 19 nt, Human
acaaauacaauacauagga

SEQ ID NO: 3215081 - RNA, 16 nt, Human
acaaaauacauucuuu

SEQ ID NO: 3215082 - RNA, 14 nt, Human
acaaaauacauucu

SEQ ID NO: 3215083 - RNA, 13 nt, Human
acaaaauaaauug

SEQ ID NO: 3215084 - RNA, 12 nt, Human
acaaaauauaca

SEQ ID NO: 3215085 - RNA, 16 nt, Human
acaaaauauugaaagg

SEQ ID NO: 3215086 - RNA, 13 nt, Human
acaaaaucaaaua

SEQ ID NO: 3215087 - RNA, 22 nt, Human
uagagcggagaaaggaagggcu

SEQ ID NO: 3215088 - RNA, 21 nt, Human
uagaggccugaaauccugguu

SEQ ID NO: 3215089 - RNA, 14 nt, Human
uagagccagggucu

SEQ ID NO: 3215090 - RNA, 21 nt, Human
acaaauaguaggcaagauggc

SEQ ID NO: 3215091 - RNA, 19 nt, Human
acaaauaguaggcaagaug

SEQ ID NO: 3215092 - RNA, 17 nt, Human
acaaauaguaggcaaga

SEQ ID NO: 3215093 - RNA, 24 nt, Human
uagaggggaaaagagaugaugaaa

SEQ ID NO: 3215094 - RNA, 14 nt, Human
uagcaaaaaaaguu

SEQ ID NO: 3215095 - RNA, 13 nt, Human
uagcaaaaaaagu

SEQ ID NO: 3215096 - RNA, 23 nt, Human
uagcaaaaaaaguuguaugaucu

SEQ ID NO: 3215097 - RNA, 21 nt, Human
uagcaaaaaaaguuguaugau

SEQ ID NO: 3215098 - RNA, 20 nt, Human
uagcaaaaaaaguuguauga

SEQ ID NO: 3215099 - RNA, 18 nt, Human
uagcaaaaaaaguuguau

SEQ ID NO: 3215100 - RNA, 15 nt, Human
uagcacagacccugc

SEQ ID NO: 3215101 - RNA, 20 nt, Human
uagcacagacccugcccugu

SEQ ID NO: 3215102 - RNA, 21 nt, Human
uagcacagacccugcccugug

SEQ ID NO: 3215103 - RNA, 14 nt, Human
uagcacagacccug

SEQ ID NO: 3215104 - RNA, 22 nt, Human
uagcaaacccugucaaacauua

SEQ ID NO: 3215105 - RNA, 21 nt, Human
uagcaaacccugucaaacauu

SEQ ID NO: 3215106 - RNA, 20 nt, Human
uagcaaacccugucaaacau

SEQ ID NO: 3215107 - RNA, 19 nt, Human
uagcaaacccugucaaaca

SEQ ID NO: 3215108 - RNA, 17 nt, Human
uagcaaacccugucaaa

SEQ ID NO: 3215109 - RNA, 22 nt, Human
uagcacagacccugcccugugg

SEQ ID NO: 3215110 - RNA, 12 nt, Human
uagccaaggcca

SEQ ID NO: 3215111 - RNA, 23 nt, Human
uagccaaaugacugaaagcacug

SEQ ID NO: 3215112 - RNA, 18 nt, Human
uagccaacggccccagcu

SEQ ID NO: 3215113 - RNA, 19 nt, Human
uagcacuuaaauuccucaa

SEQ ID NO: 3215114 - RNA, 15 nt, Human
uagccaaaaugugag

SEQ ID NO: 3215115 - RNA, 21 nt, Human
uagcacuuccuugccagucuu

SEQ ID NO: 3215116 - RNA, 16 nt, Human
uagccaaaaugugagu

SEQ ID NO: 3215117 - RNA, 23 nt, Human
uagccaaaaugugagugguugaa

SEQ ID NO: 3215118 - RNA, 20 nt, Human
uagcacuuccuugccagucu

SEQ ID NO: 3215119 - RNA, 21 nt, Human
uagcacuucagggcagauuuu

SEQ ID NO: 3215120 - RNA, 13 nt, Human
uagccaaaaugug

SEQ ID NO: 3215121 - RNA, 18 nt, Human
uagccaccgccuccuaca

SEQ ID NO: 3215122 - RNA, 18 nt, Human
uagccacccaccacacug

SEQ ID NO: 3215123 - RNA, 21 nt, Human
uagccaacggccccagcuucu

SEQ ID NO: 3215124 - RNA, 13 nt, Human
uagccaaggccaa

SEQ ID NO: 3215125 - RNA, 20 nt, Human
uagccaacggccccagcuuc

SEQ ID NO: 3215126 - RNA, 19 nt, Human
uagccaacggccccagcuu

SEQ ID NO: 3215127 - RNA, 19 nt, Human
uagccaccgccuccuacag

SEQ ID NO: 3215128 - RNA, 17 nt, Human
uagccaccugaguuccu

SEQ ID NO: 3215129 - RNA, 14 nt, Human
uagccaccugaguu

SEQ ID NO: 3215130 - RNA, 12 nt, Human
acaaaucaguaa

SEQ ID NO: 3215131 - RNA, 13 nt, Human
acaaaucaguaau

SEQ ID NO: 3215132 - RNA, 15 nt, Human
acaaaucaguaauuu

SEQ ID NO: 3215133 - RNA, 16 nt, Human
acaaaucaguaauuuu

SEQ ID NO: 3215134 - RNA, 20 nt, Human
acaaauauuucuagacacuu

SEQ ID NO: 3215135 - RNA, 13 nt, Human
uaguaaucuguau

SEQ ID NO: 3215136 - RNA, 14 nt, Human
uaguaaucuguaua

SEQ ID NO: 3215137 - RNA, 14 nt, Human
uaguagagacaggg

SEQ ID NO: 3215138 - RNA, 14 nt, Human
uagucacugagaca

SEQ ID NO: 3215139 - RNA, 13 nt, Human
uaguagagacggg

SEQ ID NO: 3215140 - RNA, 22 nt, Human
uaguagagacaggguuuugcca

SEQ ID NO: 3215141 - RNA, 15 nt, Human
uaguagagacagggu

SEQ ID NO: 3215142 - RNA, 19 nt, Human
acacaguaccauuuaaugg

SEQ ID NO: 3215143 - RNA, 21 nt, Human
acacaggggacacccagaaac

SEQ ID NO: 3215144 - RNA, 16 nt, Human
uaguaaaaauaaaauu

SEQ ID NO: 3215145 - RNA, 13 nt, Human
uaguaaaaauaaa

SEQ ID NO: 3215146 - RNA, 23 nt, Human
uaguaauauauuuaaagggaaau

SEQ ID NO: 3215147 - RNA, 19 nt, Human
uaguaauauauuuaaaggg

SEQ ID NO: 3215148 - RNA, 18 nt, Human
uaguaauauauuuaaagg

SEQ ID NO: 3215149 - RNA, 17 nt, Human
uaguaauauauuuaaag

SEQ ID NO: 3215150 - RNA, 16 nt, Human
uaguaauauauuuaaa

SEQ ID NO: 3215151 - RNA, 13 nt, Human
uaguaauauauuu

SEQ ID NO: 3215152 - RNA, 21 nt, Human
uaguaauauaauacacaaaau

SEQ ID NO: 3215153 - RNA, 14 nt, Human
uaguaauauaauac

SEQ ID NO: 3215154 - RNA, 15 nt, Human
uaguaauauaauaca

SEQ ID NO: 3215155 - RNA, 16 nt, Human
acacaggcccggcucc

SEQ ID NO: 3215156 - RNA, 18 nt, Human
acacaggcccggcuccag

SEQ ID NO: 3215157 - RNA, 17 nt, Human
acacaggcccggcucca

SEQ ID NO: 3215158 - RNA, 22 nt, Human
acacacacgcgugcacacacca

SEQ ID NO: 3215159 - RNA, 23 nt, Human
acacacagauuugagcucagccc

SEQ ID NO: 3215160 - RNA, 22 nt, Human
acacaggcccggcuccaggcuc

SEQ ID NO: 3215161 - RNA, 21 nt, Human
acacaggcccggcuccaggcu

SEQ ID NO: 3215162 - RNA, 20 nt, Human
acacaggcccggcuccaggc

SEQ ID NO: 3215163 - RNA, 19 nt, Human
acacaggcccggcuccagg

SEQ ID NO: 3215164 - RNA, 24 nt, Human
acacaggcccggcuccaggcuccu

SEQ ID NO: 3215165 - RNA, 23 nt, Human
acacaggcccggcuccaggcucc

SEQ ID NO: 3215166 - RNA, 19 nt, Human
acacaggccacccugugca

SEQ ID NO: 3215167 - RNA, 16 nt, Human
acacaggccacccugu

SEQ ID NO: 3215168 - RNA, 17 nt, Human
acacaacggcagugaag

SEQ ID NO: 3215169 - RNA, 16 nt, Human
acacaaauuaugcuaa

SEQ ID NO: 3215170 - RNA, 22 nt, Human
acacaaauuaugcuaagaauuu

SEQ ID NO: 3215171 - RNA, 21 nt, Human
acacaaauuaugcuaagaauu

SEQ ID NO: 3215172 - RNA, 19 nt, Human
acaaugcaaaccaucauug

SEQ ID NO: 3215173 - RNA, 21 nt, Human
acaaugcaaaccaucauugaa

SEQ ID NO: 3215174 - RNA, 23 nt, Human
acaaugcaaaccaucauugaaau

SEQ ID NO: 3215175 - RNA, 22 nt, Human
acacaagugcaguagugcaguu

SEQ ID NO: 3215176 - RNA, 13 nt, Human
acacaagugcagu

SEQ ID NO: 3215177 - RNA, 15 nt, Human
uaggguuauaauaau

SEQ ID NO: 3215178 - RNA, 15 nt, Human
uagggugggccuuca

SEQ ID NO: 3215179 - RNA, 17 nt, Human
uaggguuauaauaaugu

SEQ ID NO: 3215180 - RNA, 19 nt, Human
uaggguaagugagagaggg

SEQ ID NO: 3215181 - RNA, 17 nt, Human
uagggguaccacugaau

SEQ ID NO: 3215182 - RNA, 13 nt, Human
uaggguccugggg

SEQ ID NO: 3215183 - RNA, 13 nt, Human
uaggguacaugug

SEQ ID NO: 3215184 - RNA, 11 nt, Human
acaaugcaaac

SEQ ID NO: 3215185 - RNA, 16 nt, Human
acaaugcaaaccauca

SEQ ID NO: 3215186 - RNA, 17 nt, Human
acaaugcaaaccaucau

SEQ ID NO: 3215187 - RNA, 18 nt, Human
acaaugcaaaccaucauu

SEQ ID NO: 3215188 - RNA, 14 nt, Human
acaaugacuuuauu

SEQ ID NO: 3215189 - RNA, 13 nt, Human
acaaugacuuuau

SEQ ID NO: 3215190 - RNA, 13 nt, Human
uaggguuucugau

SEQ ID NO: 3215191 - RNA, 14 nt, Human
acaaaucugucugc

SEQ ID NO: 3215192 - RNA, 22 nt, Human
acaaaucugcaaagcauguuuu

SEQ ID NO: 3215193 - RNA, 19 nt, Human
acaaaucugcaaagcaugu

SEQ ID NO: 3215194 - RNA, 13 nt, Human
acaaaugacuuua

SEQ ID NO: 3215195 - RNA, 12 nt, Human
acaaaugacuuu

SEQ ID NO: 3215196 - RNA, 15 nt, Human
acaaaucuuuccaua

SEQ ID NO: 3215197 - RNA, 17 nt, Human
acaaaugacugucucuu

SEQ ID NO: 3215198 - RNA, 20 nt, Human
uagccuuagaagucacacag

SEQ ID NO: 3215199 - RNA, 12 nt, Human
acaaucagcugc

SEQ ID NO: 3215200 - RNA, 13 nt, Human
acaaucagcugcu

SEQ ID NO: 3215201 - RNA, 14 nt, Human
acaaucagcugcuu

SEQ ID NO: 3215202 - RNA, 14 nt, Human
acaauauuucugau

SEQ ID NO: 3215203 - RNA, 19 nt, Human
acaauauuugugugcuaaa

SEQ ID NO: 3215204 - RNA, 18 nt, Human
acaauauuugugugcuaa

SEQ ID NO: 3215205 - RNA, 14 nt, Human
acaauauuugugug

SEQ ID NO: 3215206 - RNA, 12 nt, Human
acaauauuugug

SEQ ID NO: 3215207 - RNA, 21 nt, Human
uagccuuagaagucacacagu

SEQ ID NO: 3215208 - RNA, 20 nt, Human
uagccugugccucugggacu

SEQ ID NO: 3215209 - RNA, 14 nt, Human
uagcgcccaguugg

SEQ ID NO: 3215210 - RNA, 17 nt, Human
uagcgcccaguugggug

SEQ ID NO: 3215211 - RNA, 14 nt, Human
uagcguguguagau

SEQ ID NO: 3215212 - RNA, 18 nt, Human
uagcguguguagauagua

SEQ ID NO: 3215213 - RNA, 22 nt, Human
uagcguuuaaggugagcauaaa

SEQ ID NO: 3215214 - RNA, 13 nt, Human
uaggaaaaacuga

SEQ ID NO: 3215215 - RNA, 14 nt, Human
uaggaaaaacugau

SEQ ID NO: 3215216 - RNA, 20 nt, Human
uagcuuuuuaauuaagcaaa

SEQ ID NO: 3215217 - RNA, 21 nt, Human
uagcuuucugagcaagaggau

SEQ ID NO: 3215218 - RNA, 13 nt, Human
uagcuuuucccuu

SEQ ID NO: 3215219 - RNA, 23 nt, Human
uagcuuuaaugauaugcuuguaa

SEQ ID NO: 3215220 - RNA, 19 nt, Human
uagcgcuauaguuacuguc

SEQ ID NO: 3215221 - RNA, 14 nt, Human
uagcuucagucauu

SEQ ID NO: 3215222 - RNA, 16 nt, Human
uagcuucagucauuaa

SEQ ID NO: 3215223 - RNA, 21 nt, Human
uagcuucagucauuaaauuac

SEQ ID NO: 3215224 - RNA, 14 nt, Human
uagcuaagccaaga

SEQ ID NO: 3215225 - RNA, 13 nt, Human
uaggauguugaaa

SEQ ID NO: 3215226 - RNA, 19 nt, Human
uaggauguauauuuuauau

SEQ ID NO: 3215227 - RNA, 23 nt, Human
uaggauguauauuuuauauaaag

SEQ ID NO: 3215228 - RNA, 12 nt, Human
uaggauucacac

SEQ ID NO: 3215229 - RNA, 21 nt, Human
uaggauucacaccccaccugc

SEQ ID NO: 3215230 - RNA, 20 nt, Human
uaggauucacaccccaccug

SEQ ID NO: 3215231 - RNA, 22 nt, Human
uaggauucacaccccaccugcg

SEQ ID NO: 3215232 - RNA, 15 nt, Human
uaggcaguauaaaga

SEQ ID NO: 3215233 - RNA, 20 nt, Human
uaggcagggugucugccccc

SEQ ID NO: 3215234 - RNA, 17 nt, Human
uaggcagggugucugcc

SEQ ID NO: 3215235 - RNA, 16 nt, Human
uaggcauaugcuucuu

SEQ ID NO: 3215236 - RNA, 19 nt, Human
uaggcaguauaaagaauag

SEQ ID NO: 3215237 - RNA, 16 nt, Human
uaggcaguauaaagaa

SEQ ID NO: 3215238 - RNA, 21 nt, Human
uaggauaugccugcucuuugg

SEQ ID NO: 3215239 - RNA, 18 nt, Human
uaggauaugccugcucuu

SEQ ID NO: 3215240 - RNA, 17 nt, Human
uaggauaugccugcucu

SEQ ID NO: 3215241 - RNA, 17 nt, Human
uaggaugggcuucugug

SEQ ID NO: 3215242 - RNA, 16 nt, Human
uaggaaaaacugauuu

SEQ ID NO: 3215243 - RNA, 17 nt, Human
uaggaaaaacugauuuu

SEQ ID NO: 3215244 - RNA, 22 nt, Human
uaggaaaagaaaucuauagaaa

SEQ ID NO: 3215245 - RNA, 21 nt, Human
uaggaaaagaaaucuauagaa

SEQ ID NO: 3215246 - RNA, 16 nt, Human
uaggaaaagaaaucua

SEQ ID NO: 3215247 - RNA, 15 nt, Human
uaggaaaagaaaucu

SEQ ID NO: 3215248 - RNA, 17 nt, Human
uagggcccaugggaggg

SEQ ID NO: 3215249 - RNA, 16 nt, Human
uagggcucuaauuucc

SEQ ID NO: 3215250 - RNA, 17 nt, Human
uaggggaagaauaauuu

SEQ ID NO: 3215251 - RNA, 15 nt, Human
uaggggaagaauaau

SEQ ID NO: 3215252 - RNA, 17 nt, Human
uagggcucuaauuuccu

SEQ ID NO: 3215253 - RNA, 16 nt, Human
uagggguaccacugaa

SEQ ID NO: 3215254 - RNA, 14 nt, Human
uaggggaaugaggg

SEQ ID NO: 3215255 - RNA, 17 nt, Human
uaggggaaugagggggc

SEQ ID NO: 3215256 - RNA, 13 nt, Human
uagggaagauaau

SEQ ID NO: 3215257 - RNA, 19 nt, Human
uagggauggggcugugggg

SEQ ID NO: 3215258 - RNA, 15 nt, Human
uagggaguauucuaa

SEQ ID NO: 3215259 - RNA, 18 nt, Human
caagccuggucagcccaa

SEQ ID NO: 3215260 - RNA, 17 nt, Human
caagccuggucagccca

SEQ ID NO: 3215261 - RNA, 16 nt, Human
caagccuggucagccc

SEQ ID NO: 3215262 - RNA, 15 nt, Human
caagccuggucagcc

SEQ ID NO: 3215263 - RNA, 12 nt, Human
caagccugguca

SEQ ID NO: 3215264 - RNA, 15 nt, Human
caagauaccuuuuuu

SEQ ID NO: 3215265 - RNA, 12 nt, Human
caagauagaaag

SEQ ID NO: 3215266 - RNA, 17 nt, Human
caagccuuggcucuacc

SEQ ID NO: 3215267 - RNA, 23 nt, Human
caagaguggccccaccuggcccu

SEQ ID NO: 3215268 - RNA, 22 nt, Human
caagaguggccccaccuggccc

SEQ ID NO: 3215269 - RNA, 21 nt, Human
caagaguggccccaccuggcc

SEQ ID NO: 3215270 - RNA, 20 nt, Human
caagaguggccccaccuggc

SEQ ID NO: 3215271 - RNA, 19 nt, Human
caagaguggccccaccugg

SEQ ID NO: 3215272 - RNA, 18 nt, Human
caagaguggccccaccug

SEQ ID NO: 3215273 - RNA, 17 nt, Human
caagaguggccccaccu

SEQ ID NO: 3215274 - RNA, 16 nt, Human
caagaguggccccacc

SEQ ID NO: 3215275 - RNA, 16 nt, Human
caagagucuggggacc

SEQ ID NO: 3215276 - RNA, 15 nt, Human
caagaguggccccac

SEQ ID NO: 3215277 - RNA, 14 nt, Human
caagaguggcccca

SEQ ID NO: 3215278 - RNA, 20 nt, Human
caagcugcacccucaggcag

SEQ ID NO: 3215279 - RNA, 17 nt, Human
caagcgauucucuugcc

SEQ ID NO: 3215280 - RNA, 22 nt, Human
caagcugcacccucaggcaggu

SEQ ID NO: 3215281 - RNA, 21 nt, Human
caagcuggucccacucagucc

SEQ ID NO: 3215282 - RNA, 17 nt, Human
caagcgauucuucugcu

SEQ ID NO: 3215283 - RNA, 15 nt, Human
caagcgauucuucug

SEQ ID NO: 3215284 - RNA, 21 nt, Human
caagcugcacccucaggcagg

SEQ ID NO: 3215285 - RNA, 18 nt, Human
caagcgauucuucugcuu

SEQ ID NO: 3215286 - RNA, 23 nt, Human
caagcuggucccacucaguccau

SEQ ID NO: 3215287 - RNA, 22 nt, Human
caagcuggucccacucagucca

SEQ ID NO: 3215288 - RNA, 21 nt, Human
caagcuuuuacaacagugcug

SEQ ID NO: 3215289 - RNA, 15 nt, Human
caagcuuuuccuaau

SEQ ID NO: 3215290 - RNA, 17 nt, Human
caaggcugcagugagcc

SEQ ID NO: 3215291 - RNA, 22 nt, Human
caaggcugcagugagccgagau

SEQ ID NO: 3215292 - RNA, 17 nt, Human
caaggauccugagccag

SEQ ID NO: 3215293 - RNA, 15 nt, Human
caaggcugcagugag

SEQ ID NO: 3215294 - RNA, 20 nt, Human
caaggauccugagccagauu

SEQ ID NO: 3215295 - RNA, 18 nt, Human
caaggauccugagccaga

SEQ ID NO: 3215296 - RNA, 19 nt, Human
caaggauccugagccagau

SEQ ID NO: 3215297 - RNA, 14 nt, Human
caauaccccaugga

SEQ ID NO: 3215298 - RNA, 18 nt, Human
caauaagaacaaauacaa

SEQ ID NO: 3215299 - RNA, 22 nt, Human
caauaaauuuugaaaaguaaua

SEQ ID NO: 3215300 - RNA, 15 nt, Human
caauaguugaauuag

SEQ ID NO: 3215301 - RNA, 14 nt, Human
caauaggaaaaacu

SEQ ID NO: 3215302 - RNA, 18 nt, Human
caauagcauuagaaauaa

SEQ ID NO: 3215303 - RNA, 16 nt, Human
caauaggaaaaacuga

SEQ ID NO: 3215304 - RNA, 17 nt, Human
caauaggaaaaacugau

SEQ ID NO: 3215305 - RNA, 15 nt, Human
caauaggaaaaacug

SEQ ID NO: 3215306 - RNA, 16 nt, Human
caaggcuugcugcaga

SEQ ID NO: 3215307 - RNA, 15 nt, Human
caaggcuugcugcag

SEQ ID NO: 3215308 - RNA, 20 nt, Human
caaggcuugcugcagauacu

SEQ ID NO: 3215309 - RNA, 21 nt, Human
caagggugaugggaaagcauu

SEQ ID NO: 3215310 - RNA, 19 nt, Human
caaggguagggugggccuu

SEQ ID NO: 3215311 - RNA, 23 nt, Human
caagggaaaauaaaaaaagaaaa

SEQ ID NO: 3215312 - RNA, 21 nt, Human
caagggaaaauaaaaaaagaa

SEQ ID NO: 3215313 - RNA, 23 nt, Human
caagggugaugggaaagcauugu

SEQ ID NO: 3215314 - RNA, 13 nt, Human
caauaaaguuuga

SEQ ID NO: 3215315 - RNA, 18 nt, Human
caauaaaguuugaucuuc

SEQ ID NO: 3215316 - RNA, 14 nt, Human
caauaaaguuugau

SEQ ID NO: 3215317 - RNA, 21 nt, Human
caauaaaguuugaucuuccuc

SEQ ID NO: 3215318 - RNA, 20 nt, Human
caauaaaguuugaucuuccu

SEQ ID NO: 3215319 - RNA, 11 nt, Human
caauaaauuuu

SEQ ID NO: 3215320 - RNA, 13 nt, Human
caauaaauuuuga

SEQ ID NO: 3215321 - RNA, 14 nt, Human
caauaaauuuugaa

SEQ ID NO: 3215322 - RNA, 15 nt, Human
caauaaauuuugaaa

SEQ ID NO: 3215323 - RNA, 16 nt, Human
caauaaauuuugaaaa

SEQ ID NO: 3215324 - RNA, 17 nt, Human
caauaaauuuugaaaag

SEQ ID NO: 3215325 - RNA, 18 nt, Human
caauaaauuuugaaaagu

SEQ ID NO: 3215326 - RNA, 23 nt, Human
caauaaaguuugaucuuccucug

SEQ ID NO: 3215327 - RNA, 12 nt, Human
cacagagaaagu

SEQ ID NO: 3215328 - RNA, 14 nt, Human
cacacuccagcugg

SEQ ID NO: 3215329 - RNA, 20 nt, Human
cacagagaaaguacuucucc

SEQ ID NO: 3215330 - RNA, 19 nt, Human
cacagagaaaguacuucuc

SEQ ID NO: 3215331 - RNA, 21 nt, Human
cacacucccgagacggcacug

SEQ ID NO: 3215332 - RNA, 13 nt, Human
cacagaggcugcc

SEQ ID NO: 3215333 - RNA, 15 nt, Human
cacagaggacacaga

SEQ ID NO: 3215334 - RNA, 19 nt, Human
cacagaggacacagagaag

SEQ ID NO: 3215335 - RNA, 23 nt, Human
cacagaugggugcuuggaggaag

SEQ ID NO: 3215336 - RNA, 21 nt, Human
cacagcaguugaaaagacucc

SEQ ID NO: 3215337 - RNA, 19 nt, Human
cacagcaguugaaaagacu

SEQ ID NO: 3215338 - RNA, 16 nt, Human
cacagauuugagcuca

SEQ ID NO: 3215339 - RNA, 17 nt, Human
cacagauuugagcucag

SEQ ID NO: 3215340 - RNA, 18 nt, Human
cacagauuugagcucagc

SEQ ID NO: 3215341 - RNA, 22 nt, Human
cacagauuugagcucagcccug

SEQ ID NO: 3215342 - RNA, 18 nt, Human
cacagccagacuggcaca

SEQ ID NO: 3215343 - RNA, 17 nt, Human
cacagccagacuggcac

SEQ ID NO: 3215344 - RNA, 21 nt, Human
cacagcucuucuccaggcugu

SEQ ID NO: 3215345 - RNA, 14 nt, Human
cacagcugagaggc

SEQ ID NO: 3215346 - RNA, 22 nt, Human
caauuuuucuuauuucauuucu

SEQ ID NO: 3215347 - RNA, 19 nt, Human
caauuuuugguugaauaaa

SEQ ID NO: 3215348 - RNA, 18 nt, Human
caauuuuugguugaauaa

SEQ ID NO: 3215349 - RNA, 21 nt, Human
caauuuuuuaagugaaaauau

SEQ ID NO: 3215350 - RNA, 20 nt, Human
caauuuuuuaagugaaaaua

SEQ ID NO: 3215351 - RNA, 15 nt, Human
cacaaaauauacaaa

SEQ ID NO: 3215352 - RNA, 14 nt, Human
cacaaacagaggcc

SEQ ID NO: 3215353 - RNA, 18 nt, Human
cacaaagcccuuccaugu

SEQ ID NO: 3215354 - RNA, 13 nt, Human
cacaaacagaggc

SEQ ID NO: 3215355 - RNA, 13 nt, Human
cacaaaauucaaa

SEQ ID NO: 3215356 - RNA, 18 nt, Human
caauuacaggaaguacug

SEQ ID NO: 3215357 - RNA, 15 nt, Human
caauuacauguuugg

SEQ ID NO: 3215358 - RNA, 15 nt, Human
caauuacuuuagaaa

SEQ ID NO: 3215359 - RNA, 17 nt, Human
caauuacuuuagaaaau

SEQ ID NO: 3215360 - RNA, 15 nt, Human
caauuacuuugguag

SEQ ID NO: 3215361 - RNA, 15 nt, Human
caauuagauuucuca

SEQ ID NO: 3215362 - RNA, 18 nt, Human
caauucccaccuaugagu

SEQ ID NO: 3215363 - RNA, 22 nt, Human
caauuccaugacaauaugcccu

SEQ ID NO: 3215364 - RNA, 19 nt, Human
caaugugaaaagaaaaaug

SEQ ID NO: 3215365 - RNA, 23 nt, Human
caauaucuucguuaguaaucugu

SEQ ID NO: 3215366 - RNA, 15 nt, Human
caauaucuugcuuga

SEQ ID NO: 3215367 - RNA, 22 nt, Human
caaugugaaaagaaaaaugagc

SEQ ID NO: 3215368 - RNA, 22 nt, Human
caauaucuugcuugaacuuaca

SEQ ID NO: 3215369 - RNA, 19 nt, Human
caauaucuugcuugaacuu

SEQ ID NO: 3215370 - RNA, 16 nt, Human
caauaucuugcuugaa

SEQ ID NO: 3215371 - RNA, 14 nt, Human
caauguucucucuu

SEQ ID NO: 3215372 - RNA, 15 nt, Human
caauguuaaauuaau

SEQ ID NO: 3215373 - RNA, 23 nt, Human
caaugugugccgagcccuugccc

SEQ ID NO: 3215374 - RNA, 22 nt, Human
caaugugugccgagcccuugcc

SEQ ID NO: 3215375 - RNA, 15 nt, Human
caauguguauaaauu

SEQ ID NO: 3215376 - RNA, 16 nt, Human
caauguguauaaauug

SEQ ID NO: 3215377 - RNA, 17 nt, Human
caauguguauaaauugu

SEQ ID NO: 3215378 - RNA, 15 nt, Human
caaugugucuuucua

SEQ ID NO: 3215379 - RNA, 22 nt, Human
caaugugucuuucuaagaaauc

SEQ ID NO: 3215380 - RNA, 17 nt, Human
caauuacaggaaguacu

SEQ ID NO: 3215381 - RNA, 12 nt, Human
caauguuucaag

SEQ ID NO: 3215382 - RNA, 11 nt, Human
caauguuuaca

SEQ ID NO: 3215383 - RNA, 20 nt, Human
caauguuaaauuaauuauaa

SEQ ID NO: 3215384 - RNA, 20 nt, Human
cacaagaaaugaaagcaggg

SEQ ID NO: 3215385 - RNA, 17 nt, Human
cacaaguuaagauucuu

SEQ ID NO: 3215386 - RNA, 19 nt, Human
cacaaguuaagauucuugg

SEQ ID NO: 3215387 - RNA, 20 nt, Human
cacaaguuaagauucuuggu

SEQ ID NO: 3215388 - RNA, 18 nt, Human
cacaagaaaugaaagcag

SEQ ID NO: 3215389 - RNA, 13 nt, Human
cacaaaggagagc

SEQ ID NO: 3215390 - RNA, 12 nt, Human
cacacaaagcag

SEQ ID NO: 3215391 - RNA, 19 nt, Human
cacacaaaaaaagaccugu

SEQ ID NO: 3215392 - RNA, 15 nt, Human
cacacaaaaaaagac

SEQ ID NO: 3215393 - RNA, 22 nt, Human
cacaauugaauuaguuuuuucu

SEQ ID NO: 3215394 - RNA, 11 nt, Human
cacaauuccau

SEQ ID NO: 3215395 - RNA, 13 nt, Human
cacacaaaaaaag

SEQ ID NO: 3215396 - RNA, 16 nt, Human
cacaauuagauuucuc

SEQ ID NO: 3215397 - RNA, 17 nt, Human
cacaauuagauuucuca

SEQ ID NO: 3215398 - RNA, 17 nt, Human
cacacacgcgugcacac

SEQ ID NO: 3215399 - RNA, 19 nt, Human
caaagugcugggauuacaa

SEQ ID NO: 3215400 - RNA, 13 nt, Human
caaagugcuggga

SEQ ID NO: 3215401 - RNA, 14 nt, Human
caaagagaaaacau

SEQ ID NO: 3215402 - RNA, 14 nt, Human
caaaguuagagaac

SEQ ID NO: 3215403 - RNA, 17 nt, Human
caaaguuagagaacuaa

SEQ ID NO: 3215404 - RNA, 24 nt, Human
caaaguuagagaacuaaacuaguu

SEQ ID NO: 3215405 - RNA, 20 nt, Human
caaaguucccuacuuccugu

SEQ ID NO: 3215406 - RNA, 17 nt, Human
caaauaaaauucccuaa

SEQ ID NO: 3215407 - RNA, 21 nt, Human
caaauaaaauucccuaaagcc

SEQ ID NO: 3215408 - RNA, 23 nt, Human
caaagugcugggauuacaagcgu

SEQ ID NO: 3215409 - RNA, 19 nt, Human
caaaguggugagaggcauc

SEQ ID NO: 3215410 - RNA, 18 nt, Human
caaagugcugggauuaca

SEQ ID NO: 3215411 - RNA, 21 nt, Human
caaaguuaaacgugaugugcu

SEQ ID NO: 3215412 - RNA, 19 nt, Human
caaauaaaguaguaaaaga

SEQ ID NO: 3215413 - RNA, 18 nt, Human
caaauaaaguuaaaagua

SEQ ID NO: 3215414 - RNA, 19 nt, Human
caaauaaaguuaaaaguaa

SEQ ID NO: 3215415 - RNA, 12 nt, Human
caaauaugcaaa

SEQ ID NO: 3215416 - RNA, 14 nt, Human
caaauaacaacuuu

SEQ ID NO: 3215417 - RNA, 13 nt, Human
caaauaacaacuu

SEQ ID NO: 3215418 - RNA, 16 nt, Human
caaauaucucuauuua

SEQ ID NO: 3215419 - RNA, 17 nt, Human
caaauaucucuauuuaa

SEQ ID NO: 3215420 - RNA, 13 nt, Human
caaauaugcaaag

SEQ ID NO: 3215421 - RNA, 19 nt, Human
caaauauuucuagacacuu

SEQ ID NO: 3215422 - RNA, 16 nt, Human
caaauaacaacuuuuu

SEQ ID NO: 3215423 - RNA, 17 nt, Human
caaaucaaucuguaaaa

SEQ ID NO: 3215424 - RNA, 14 nt, Human
caaauguucaucaa

SEQ ID NO: 3215425 - RNA, 18 nt, Human
caaauguucaucaaugaa

SEQ ID NO: 3215426 - RNA, 23 nt, Human
caaauggaaaugggcagagcaga

SEQ ID NO: 3215427 - RNA, 20 nt, Human
caaaucaaucuguaaaacua

SEQ ID NO: 3215428 - RNA, 22 nt, Human
caaauggaaaugggcagagcag

SEQ ID NO: 3215429 - RNA, 19 nt, Human
caaauggauuccuguuuca

SEQ ID NO: 3215430 - RNA, 18 nt, Human
caaauggaguuggaguuc

SEQ ID NO: 3215431 - RNA, 21 nt, Human
caaauggaguuggaguucauu

SEQ ID NO: 3215432 - RNA, 19 nt, Human
caaauggaguuggaguuca

SEQ ID NO: 3215433 - RNA, 17 nt, Human
caacagccacucagaaa

SEQ ID NO: 3215434 - RNA, 19 nt, Human
caacagccaauauuuaaaa

SEQ ID NO: 3215435 - RNA, 17 nt, Human
caacauacucccaucug

SEQ ID NO: 3215436 - RNA, 19 nt, Human
caacauacucccaucugug

SEQ ID NO: 3215437 - RNA, 12 nt, Human
caacaggcuggg

SEQ ID NO: 3215438 - RNA, 20 nt, Human
caacauacucccaucuguga

SEQ ID NO: 3215439 - RNA, 16 nt, Human
caacauacucccaucu

SEQ ID NO: 3215440 - RNA, 12 nt, Human
caacauauacaa

SEQ ID NO: 3215441 - RNA, 18 nt, Human
caaccugcucuccucuug

SEQ ID NO: 3215442 - RNA, 23 nt, Human
caaccugcucuccucuugccacu

SEQ ID NO: 3215443 - RNA, 21 nt, Human
caaccugcucuccucuugcca

SEQ ID NO: 3215444 - RNA, 20 nt, Human
caaccuucuguggcucacag

SEQ ID NO: 3215445 - RNA, 14 nt, Human
caaccuuggcuugg

SEQ ID NO: 3215446 - RNA, 19 nt, Human
caaccuucuguggcucaca

SEQ ID NO: 3215447 - RNA, 17 nt, Human
caaccuucuguggcuca

SEQ ID NO: 3215448 - RNA, 16 nt, Human
caaccuucuguggcuc

SEQ ID NO: 3215449 - RNA, 16 nt, Human
caaccuggucacagga

SEQ ID NO: 3215450 - RNA, 17 nt, Human
caaauuuuaauuuuugc

SEQ ID NO: 3215451 - RNA, 19 nt, Human
caaauuucucuguuccaua

SEQ ID NO: 3215452 - RNA, 12 nt, Human
caaauuaauugu

SEQ ID NO: 3215453 - RNA, 16 nt, Human
caaauuaauuguguga

SEQ ID NO: 3215454 - RNA, 19 nt, Human
caaauuaauugugugaacu

SEQ ID NO: 3215455 - RNA, 20 nt, Human
caaauuaauugugugaacuu

SEQ ID NO: 3215456 - RNA, 23 nt, Human
caacagauuggauuuuauguuga

SEQ ID NO: 3215457 - RNA, 21 nt, Human
caacagauuggauuuuauguu

SEQ ID NO: 3215458 - RNA, 20 nt, Human
caacagauuggauuuuaugu

SEQ ID NO: 3215459 - RNA, 15 nt, Human
caacagauuggauuu

SEQ ID NO: 3215460 - RNA, 15 nt, Human
caacacuuuaauggg

SEQ ID NO: 3215461 - RNA, 15 nt, Human
caagaaaugaaagca

SEQ ID NO: 3215462 - RNA, 17 nt, Human
caagaaaugaaagcagg

SEQ ID NO: 3215463 - RNA, 19 nt, Human
caagaaaugaaagcaggga

SEQ ID NO: 3215464 - RNA, 13 nt, Human
caagaagcccagg

SEQ ID NO: 3215465 - RNA, 21 nt, Human
caagaagcaauguuauaaagu

SEQ ID NO: 3215466 - RNA, 13 nt, Human
caagaaaugaaga

SEQ ID NO: 3215467 - RNA, 12 nt, Human
caagaaaugaag

SEQ ID NO: 3215468 - RNA, 17 nt, Human
caagaaaugaagagcug

SEQ ID NO: 3215469 - RNA, 22 nt, Human
caacuaaaaugugucuugcugu

SEQ ID NO: 3215470 - RNA, 18 nt, Human
caacuaaaguuguacuuu

SEQ ID NO: 3215471 - RNA, 17 nt, Human
caacuugccuuugaaga

SEQ ID NO: 3215472 - RNA, 20 nt, Human
caacuaaaguuguacuuuaa

SEQ ID NO: 3215473 - RNA, 19 nt, Human
caacuugccuuugaagagu

SEQ ID NO: 3215474 - RNA, 16 nt, Human
caacuuguaaaugugg

SEQ ID NO: 3215475 - RNA, 12 nt, Human
caacuugggaac

SEQ ID NO: 3215476 - RNA, 15 nt, Human
caaccuuggcuuggc

SEQ ID NO: 3215477 - RNA, 22 nt, Human
caaccuuggcuuggcccuggca

SEQ ID NO: 3215478 - RNA, 13 nt, Human
caaccuuguuuau

SEQ ID NO: 3215479 - RNA, 21 nt, Human
caaccuuguuuauuaaauugc

SEQ ID NO: 3215480 - RNA, 21 nt, Human
caagaccuucuccuucaccuu

SEQ ID NO: 3215481 - RNA, 23 nt, Human
caagaccuucuccuucaccuuug

SEQ ID NO: 3215482 - RNA, 13 nt, Human
caagacgcugugc

SEQ ID NO: 3215483 - RNA, 16 nt, Human
caacuugccuuugaag

SEQ ID NO: 3215484 - RNA, 21 nt, Human
caagagagcagcaaggucuug

SEQ ID NO: 3215485 - RNA, 15 nt, Human
caagagagcagcaag

SEQ ID NO: 3215486 - RNA, 17 nt, Human
caagagcuuaacagugu

SEQ ID NO: 3215487 - RNA, 15 nt, Human
caagaggcaagcuga

SEQ ID NO: 3215488 - RNA, 19 nt, Human
caagaggcaagcugaaauu

SEQ ID NO: 3215489 - RNA, 20 nt, Human
caagaggcaagcugaaauuu

SEQ ID NO: 3215490 - RNA, 18 nt, Human
caaaauaagaaaagaugu

SEQ ID NO: 3215491 - RNA, 16 nt, Human
caaaauaagaaaagau

SEQ ID NO: 3215492 - RNA, 23 nt, Human
caaaauacauucuuuuugcucua

SEQ ID NO: 3215493 - RNA, 20 nt, Human
caaaauacauucuuuuugcu

SEQ ID NO: 3215494 - RNA, 22 nt, Human
caaaauaagaaaagauguagau

SEQ ID NO: 3215495 - RNA, 14 nt, Human
caaaauaauaaaaa

SEQ ID NO: 3215496 - RNA, 17 nt, Human
caaaauaauaaaaauca

SEQ ID NO: 3215497 - RNA, 11 nt, Human
caaaauacauu

SEQ ID NO: 3215498 - RNA, 22 nt, Human
caaaauacaugaugauuucaga

SEQ ID NO: 3215499 - RNA, 19 nt, Human
caaaauacaugaugauuuc

SEQ ID NO: 3215500 - RNA, 13 nt, Human
caaaauaaauugg

SEQ ID NO: 3215501 - RNA, 15 nt, Human
caaaauaagaaaaga

SEQ ID NO: 3215502 - RNA, 14 nt, Human
caaaauaagaaaag

SEQ ID NO: 3215503 - RNA, 21 nt, Human
caaaaucgaugcagugcuucc

SEQ ID NO: 3215504 - RNA, 14 nt, Human
caaaauauacaaaa

SEQ ID NO: 3215505 - RNA, 18 nt, Human
caaaauauacaaaacuuu

SEQ ID NO: 3215506 - RNA, 18 nt, Human
caaaauauugagcagaau

SEQ ID NO: 3215507 - RNA, 18 nt, Human
caaaacugcacugucaag

SEQ ID NO: 3215508 - RNA, 17 nt, Human
caaaacugcacugucaa

SEQ ID NO: 3215509 - RNA, 14 nt, Human
caaaacugcacugu

SEQ ID NO: 3215510 - RNA, 23 nt, Human
caaaacucuccucugcugcuggc

SEQ ID NO: 3215511 - RNA, 22 nt, Human
caaaaguuauuaaaauuguugu

SEQ ID NO: 3215512 - RNA, 18 nt, Human
caaaaguuauuaaaauug

SEQ ID NO: 3215513 - RNA, 16 nt, Human
caaaaguuauuaaaau

SEQ ID NO: 3215514 - RNA, 12 nt, Human
caaaaguuauua

SEQ ID NO: 3215515 - RNA, 14 nt, Human
caaaaguuucucuu

SEQ ID NO: 3215516 - RNA, 18 nt, Human
caaaaguuuguuugcuua

SEQ ID NO: 3215517 - RNA, 15 nt, Human
caaaacgguuuuacu

SEQ ID NO: 3215518 - RNA, 21 nt, Human
caaaacgguuuuacugcagcu

SEQ ID NO: 3215519 - RNA, 23 nt, Human
auuuuauuuugaaauggaaauua

SEQ ID NO: 3215520 - RNA, 22 nt, Human
auuuuauuuugaaauggaaauu

SEQ ID NO: 3215521 - RNA, 15 nt, Human
caaaacucuccucug

SEQ ID NO: 3215522 - RNA, 16 nt, Human
caaaacucuccucugc

SEQ ID NO: 3215523 - RNA, 21 nt, Human
caaacucuugaccucagguga

SEQ ID NO: 3215524 - RNA, 16 nt, Human
caaacugaaaagcuga

SEQ ID NO: 3215525 - RNA, 20 nt, Human
caaacucuugaccucaggug

SEQ ID NO: 3215526 - RNA, 19 nt, Human
caaacucuugaccucaggu

SEQ ID NO: 3215527 - RNA, 17 nt, Human
caaacucuugaccucag

SEQ ID NO: 3215528 - RNA, 22 nt, Human
caaaccuuucuauaauuuuaca

SEQ ID NO: 3215529 - RNA, 13 nt, Human
caaaccugugaag

SEQ ID NO: 3215530 - RNA, 20 nt, Human
caaaccuuucuauaauuuua

SEQ ID NO: 3215531 - RNA, 19 nt, Human
caaaccuuucuauaauuuu

SEQ ID NO: 3215532 - RNA, 13 nt, Human
caaaccuuucccc

SEQ ID NO: 3215533 - RNA, 12 nt, Human
caaaccuuuccc

SEQ ID NO: 3215534 - RNA, 15 nt, Human
caaaccuuuaacuaa

SEQ ID NO: 3215535 - RNA, 13 nt, Human
caaacagaggccg

SEQ ID NO: 3215536 - RNA, 21 nt, Human
caaacacuugugacuuuugcu

SEQ ID NO: 3215537 - RNA, 20 nt, Human
caaacaagcauauaaaaugg

SEQ ID NO: 3215538 - RNA, 18 nt, Human
caaacaagcauauaaaau

SEQ ID NO: 3215539 - RNA, 16 nt, Human
caaacaagcauauaaa

SEQ ID NO: 3215540 - RNA, 21 nt, Human
caaacaaaagcugaacacauu

SEQ ID NO: 3215541 - RNA, 11 nt, Human
caaaaugaaac

SEQ ID NO: 3215542 - RNA, 22 nt, Human
caaaaugaaacgcaaccaccac

SEQ ID NO: 3215543 - RNA, 21 nt, Human
caaaaugagcccuguccugcc

SEQ ID NO: 3215544 - RNA, 20 nt, Human
caaaaugagaucucauuaaa

SEQ ID NO: 3215545 - RNA, 12 nt, Human
caaaauuuuaaa

SEQ ID NO: 3215546 - RNA, 14 nt, Human
caaaauuuuaaaaa

SEQ ID NO: 3215547 - RNA, 16 nt, Human
caaaauuuuaaaaaag

SEQ ID NO: 3215548 - RNA, 15 nt, Human
cacaggcccuuccuc

SEQ ID NO: 3215549 - RNA, 19 nt, Human
cacaggcccuuccucucca

SEQ ID NO: 3215550 - RNA, 18 nt, Human
cacaggcccuuccucucc

SEQ ID NO: 3215551 - RNA, 17 nt, Human
cacaggcccuuccucuc

SEQ ID NO: 3215552 - RNA, 16 nt, Human
cacaggcccuuccucu

SEQ ID NO: 3215553 - RNA, 12 nt, Human
cacagcugcuca

SEQ ID NO: 3215554 - RNA, 22 nt, Human
cacagcugcucaauaaaguaca

SEQ ID NO: 3215555 - RNA, 18 nt, Human
cacagcugcucugugacc

SEQ ID NO: 3215556 - RNA, 14 nt, Human
cacagcuuguuuug

SEQ ID NO: 3215557 - RNA, 16 nt, Human
cacagcuuguuuugga

SEQ ID NO: 3215558 - RNA, 20 nt, Human
cacagcuuguuuuggacuuu

SEQ ID NO: 3215559 - RNA, 16 nt, Human
cacaggaaaagaauuu

SEQ ID NO: 3215560 - RNA, 19 nt, Human
cacagugcaucucagccca

SEQ ID NO: 3215561 - RNA, 18 nt, Human
cacagugcaucucagccc

SEQ ID NO: 3215562 - RNA, 17 nt, Human
cacagugcaucucagcc

SEQ ID NO: 3215563 - RNA, 21 nt, Human
cacaggcccuuccucuccacu

SEQ ID NO: 3215564 - RNA, 17 nt, Human
cacaguucaauucucau

SEQ ID NO: 3215565 - RNA, 15 nt, Human
cacaguuauuacaua

SEQ ID NO: 3215566 - RNA, 13 nt, Human
cacaguuauuaca

SEQ ID NO: 3215567 - RNA, 13 nt, Human
ugaaacagacuug

SEQ ID NO: 3215568 - RNA, 24 nt, Human
ugaaacauguugccaaaauggugg

SEQ ID NO: 3215569 - RNA, 20 nt, Human
ugaaacaugcuuguguuucu

SEQ ID NO: 3215570 - RNA, 12 nt, Human
ugaaacaugcuu

SEQ ID NO: 3215571 - RNA, 14 nt, Human
ugaaacagacuugu

SEQ ID NO: 3215572 - RNA, 23 nt, Human
ugaacuggguacuuguggacaca

SEQ ID NO: 3215573 - RNA, 19 nt, Human
ugaacuuacaggugauuaa

SEQ ID NO: 3215574 - RNA, 12 nt, Human
ugaacuuaacau

SEQ ID NO: 3215575 - RNA, 14 nt, Human
ugaacuuaacaugc

SEQ ID NO: 3215576 - RNA, 15 nt, Human
ugaacuuaacaugcu

SEQ ID NO: 3215577 - RNA, 17 nt, Human
ugaacuuaacaugcugu

SEQ ID NO: 3215578 - RNA, 19 nt, Human
ugaacuuaacaugcugugu

SEQ ID NO: 3215579 - RNA, 21 nt, Human
ugaacuuaacaugcuguguaa

SEQ ID NO: 3215580 - RNA, 17 nt, Human
ugaacuguuagaaugua

SEQ ID NO: 3215581 - RNA, 16 nt, Human
ugaacuguuagaaugu

SEQ ID NO: 3215582 - RNA, 14 nt, Human
ugaacuguuagaau

SEQ ID NO: 3215583 - RNA, 13 nt, Human
ugaacuguuagaa

SEQ ID NO: 3215584 - RNA, 17 nt, Human
ugaaacauugcuuuuaa

SEQ ID NO: 3215585 - RNA, 16 nt, Human
ugaaacauugcuuuua

SEQ ID NO: 3215586 - RNA, 19 nt, Human
ugaacuuccugcuuccuca

SEQ ID NO: 3215587 - RNA, 20 nt, Human
ugaagacucauucuucugua

SEQ ID NO: 3215588 - RNA, 19 nt, Human
ugaagacucauucuucugu

SEQ ID NO: 3215589 - RNA, 16 nt, Human
ugaaggaaccaaagcg

SEQ ID NO: 3215590 - RNA, 16 nt, Human
ugaaggcuggguucug

SEQ ID NO: 3215591 - RNA, 19 nt, Human
ugaaggccccgcccaggcu

SEQ ID NO: 3215592 - RNA, 20 nt, Human
ugaaggccccgcccaggcuu

SEQ ID NO: 3215593 - RNA, 13 nt, Human
ugaaggaaaaauu

SEQ ID NO: 3215594 - RNA, 14 nt, Human
ugaaggaaaaauuc

SEQ ID NO: 3215595 - RNA, 18 nt, Human
ugaaggccccgcccaggc

SEQ ID NO: 3215596 - RNA, 20 nt, Human
ugaagagaagggcagggcug

SEQ ID NO: 3215597 - RNA, 22 nt, Human
ugaagagaagggcagggcugag

SEQ ID NO: 3215598 - RNA, 14 nt, Human
ugaagacuccagaa

SEQ ID NO: 3215599 - RNA, 13 nt, Human
ugaagacuccaga

SEQ ID NO: 3215600 - RNA, 15 nt, Human
ugaagagcuagagaa

SEQ ID NO: 3215601 - RNA, 18 nt, Human
ugaagagcuggggagaau

SEQ ID NO: 3215602 - RNA, 17 nt, Human
ugaagagcuggggagaa

SEQ ID NO: 3215603 - RNA, 23 nt, Human
ugaagagcaagagagcagcaagg

SEQ ID NO: 3215604 - RNA, 15 nt, Human
ugaagacuccagaaa

SEQ ID NO: 3215605 - RNA, 12 nt, Human
ugaagagacaga

SEQ ID NO: 3215606 - RNA, 19 nt, Human
ugaagagacagagacaagu

SEQ ID NO: 3215607 - RNA, 21 nt, Human
ugaagagacagagacaaguaa

SEQ ID NO: 3215608 - RNA, 23 nt, Human
ugaagagacagagacaaguaauu

SEQ ID NO: 3215609 - RNA, 18 nt, Human
ugaagagcuguugauggg

SEQ ID NO: 3215610 - RNA, 20 nt, Human
ugaaggcuggguucugaucc

SEQ ID NO: 3215611 - RNA, 21 nt, Human
ugaaggcuggguucugauccu

SEQ ID NO: 3215612 - RNA, 13 nt, Human
ugaaguuucaagu

SEQ ID NO: 3215613 - RNA, 21 nt, Human
ugaaguuucaaguuuuaaagu

SEQ ID NO: 3215614 - RNA, 22 nt, Human
ugaaguuucaaguuuuaaaguu

SEQ ID NO: 3215615 - RNA, 23 nt, Human
ugaaguuucaaguuuuaaaguuc

SEQ ID NO: 3215616 - RNA, 21 nt, Human
ugaaucagaauaaccuucaaa

SEQ ID NO: 3215617 - RNA, 17 nt, Human
ugaaucagacaguggau

SEQ ID NO: 3215618 - RNA, 22 nt, Human
ugaaguuugauaaauaguguua

SEQ ID NO: 3215619 - RNA, 20 nt, Human
ugaaguuugauaaauagugu

SEQ ID NO: 3215620 - RNA, 15 nt, Human
ugaaguuugauaaau

SEQ ID NO: 3215621 - RNA, 14 nt, Human
ugaaguuugauaaa

SEQ ID NO: 3215622 - RNA, 12 nt, Human
ugaaucuguaca

SEQ ID NO: 3215623 - RNA, 14 nt, Human
ugaaucuguacaga

SEQ ID NO: 3215624 - RNA, 13 nt, Human
ugaaucuguacag

SEQ ID NO: 3215625 - RNA, 19 nt, Human
ugaaucugagagaugcugu

SEQ ID NO: 3215626 - RNA, 16 nt, Human
ugaaucuuggugucua

SEQ ID NO: 3215627 - RNA, 22 nt, Human
ugaaucuucugaaaccaaaugu

SEQ ID NO: 3215628 - RNA, 14 nt, Human
ugaaucuucugaaa

SEQ ID NO: 3215629 - RNA, 15 nt, Human
ugaaugaauggcuaa

SEQ ID NO: 3215630 - RNA, 23 nt, Human
ugaaugaugauccuaggcauuug

SEQ ID NO: 3215631 - RNA, 16 nt, Human
ugaaugaagcaguauu

SEQ ID NO: 3215632 - RNA, 22 nt, Human
ugacagagagagauacucuggg

SEQ ID NO: 3215633 - RNA, 21 nt, Human
ugacagagagagauacucugg

SEQ ID NO: 3215634 - RNA, 20 nt, Human
ugacagagagagauacucug

SEQ ID NO: 3215635 - RNA, 18 nt, Human
ugacagacacaggcccgg

SEQ ID NO: 3215636 - RNA, 17 nt, Human
ugacagacacaggcccg

SEQ ID NO: 3215637 - RNA, 22 nt, Human
ugacagagcaagugagacccug

SEQ ID NO: 3215638 - RNA, 23 nt, Human
ugacagagagagauacucuggga

SEQ ID NO: 3215639 - RNA, 14 nt, Human
ugacagagccugcc

SEQ ID NO: 3215640 - RNA, 20 nt, Human
ugacagagccugccccagcg

SEQ ID NO: 3215641 - RNA, 16 nt, Human
ugacagagccugcccc

SEQ ID NO: 3215642 - RNA, 23 nt, Human
ugacaucaacugcaucaagaugu

SEQ ID NO: 3215643 - RNA, 23 nt, Human
ugacagagccugccccagcgcug

SEQ ID NO: 3215644 - RNA, 22 nt, Human
ugacagagccugccccagcgcu

SEQ ID NO: 3215645 - RNA, 18 nt, Human
ugacauccacaaaugcag

SEQ ID NO: 3215646 - RNA, 18 nt, Human
ugacaucacuggcauggu

SEQ ID NO: 3215647 - RNA, 17 nt, Human
ugacaucacuggcaugg

SEQ ID NO: 3215648 - RNA, 16 nt, Human
ugacaucacuggcaug

SEQ ID NO: 3215649 - RNA, 14 nt, Human
ugacaucacuggca

SEQ ID NO: 3215650 - RNA, 15 nt, Human
ugacauauuggcucu

SEQ ID NO: 3215651 - RNA, 15 nt, Human
ugacauauuuuugcu

SEQ ID NO: 3215652 - RNA, 16 nt, Human
ugaccacugcagaaga

SEQ ID NO: 3215653 - RNA, 17 nt, Human
ugaccacugcagaagac

SEQ ID NO: 3215654 - RNA, 20 nt, Human
ugaccagcaccaucucuccu

SEQ ID NO: 3215655 - RNA, 22 nt, Human
ugaccagccuccaugcugccuc

SEQ ID NO: 3215656 - RNA, 15 nt, Human
ugaccaucauuucac

SEQ ID NO: 3215657 - RNA, 21 nt, Human
ugaccagccuccaugcugccu

SEQ ID NO: 3215658 - RNA, 22 nt, Human
ugacaucucuauuccccacccu

SEQ ID NO: 3215659 - RNA, 15 nt, Human
ugacauggaaaugaa

SEQ ID NO: 3215660 - RNA, 16 nt, Human
ugacauggaaaugaag

SEQ ID NO: 3215661 - RNA, 19 nt, Human
ugacauguguuggcagccu

SEQ ID NO: 3215662 - RNA, 15 nt, Human
ugacacacagcucug

SEQ ID NO: 3215663 - RNA, 14 nt, Human
ugacacacagcucu

SEQ ID NO: 3215664 - RNA, 16 nt, Human
ugacacaacuguguga

SEQ ID NO: 3215665 - RNA, 22 nt, Human
ugacacaacugugugauuaaaa

SEQ ID NO: 3215666 - RNA, 13 nt, Human
ugacagacacagg

SEQ ID NO: 3215667 - RNA, 16 nt, Human
ugacagacacaggccc

SEQ ID NO: 3215668 - RNA, 14 nt, Human
ugacagacacaggc

SEQ ID NO: 3215669 - RNA, 16 nt, Human
ugacaaccauuaaagu

SEQ ID NO: 3215670 - RNA, 17 nt, Human
ugacaaccauuaaaguc

SEQ ID NO: 3215671 - RNA, 19 nt, Human
ugacaaccauuaaagucag

SEQ ID NO: 3215672 - RNA, 21 nt, Human
ugacaaccauuaaagucagaa

SEQ ID NO: 3215673 - RNA, 23 nt, Human
ugacaaggauugcuacuguccua

SEQ ID NO: 3215674 - RNA, 18 nt, Human
ugacaaggauugcuacug

SEQ ID NO: 3215675 - RNA, 17 nt, Human
ugacaaguuuaaaggcu

SEQ ID NO: 3215676 - RNA, 13 nt, Human
ugacaacacucau

SEQ ID NO: 3215677 - RNA, 15 nt, Human
ugacaaauguuucua

SEQ ID NO: 3215678 - RNA, 14 nt, Human
ugacaaauguuucu

SEQ ID NO: 3215679 - RNA, 23 nt, Human
ugacaacacucauugaccugagg

SEQ ID NO: 3215680 - RNA, 15 nt, Human
ugacaacagacuucu

SEQ ID NO: 3215681 - RNA, 21 nt, Human
ugacaaauguuucuaagguaa

SEQ ID NO: 3215682 - RNA, 17 nt, Human
ugacaaauuuuaauuau

SEQ ID NO: 3215683 - RNA, 19 nt, Human
ugacaaauguuucuaaggu

SEQ ID NO: 3215684 - RNA, 17 nt, Human
ugacaaauguuucuaag

SEQ ID NO: 3215685 - RNA, 18 nt, Human
ugacaacagacuucugaa

SEQ ID NO: 3215686 - RNA, 19 nt, Human
ugacaacagacuucugaaa

SEQ ID NO: 3215687 - RNA, 13 nt, Human
ugaauuguaagga

SEQ ID NO: 3215688 - RNA, 21 nt, Human
ugaauuguaaggaaugauuaa

SEQ ID NO: 3215689 - RNA, 19 nt, Human
ugaauuaauuaauuuggag

SEQ ID NO: 3215690 - RNA, 21 nt, Human
ugacucuuucuauuguuucuu

SEQ ID NO: 3215691 - RNA, 16 nt, Human
ugacucuuuauugucu

SEQ ID NO: 3215692 - RNA, 17 nt, Human
ugacucuuuauugucug

SEQ ID NO: 3215693 - RNA, 18 nt, Human
ugacucuuuauugucugu

SEQ ID NO: 3215694 - RNA, 20 nt, Human
ugacucuuuauugucuguaa

SEQ ID NO: 3215695 - RNA, 21 nt, Human
ugacucuuuauugucuguaaa

SEQ ID NO: 3215696 - RNA, 19 nt, Human
ugacugaacgauccuucaa

SEQ ID NO: 3215697 - RNA, 21 nt, Human
ugacugaacgauccuucaaag

SEQ ID NO: 3215698 - RNA, 22 nt, Human
ugacugaacgauccuucaaagu

SEQ ID NO: 3215699 - RNA, 22 nt, Human
ugacucuugaguuguuuuugua

SEQ ID NO: 3215700 - RNA, 23 nt, Human
ugacucuugaguuguuuuuguau

SEQ ID NO: 3215701 - RNA, 14 nt, Human
ugacugaacuguaa

SEQ ID NO: 3215702 - RNA, 16 nt, Human
ugacuuuccucuuugg

SEQ ID NO: 3215703 - RNA, 14 nt, Human
ugacuuugaaaaua

SEQ ID NO: 3215704 - RNA, 14 nt, Human
ugacugggggcaga

SEQ ID NO: 3215705 - RNA, 14 nt, Human
ugacucuugaguug

SEQ ID NO: 3215706 - RNA, 18 nt, Human
ugacucuuccccaggaag

SEQ ID NO: 3215707 - RNA, 19 nt, Human
ugacucuugaguuguuuuu

SEQ ID NO: 3215708 - RNA, 21 nt, Human
ugacucuugaguuguuuuugu

SEQ ID NO: 3215709 - RNA, 14 nt, Human
ugacuacagggccg

SEQ ID NO: 3215710 - RNA, 13 nt, Human
ugacuacagggcc

SEQ ID NO: 3215711 - RNA, 17 nt, Human
ugacgugucaggaaaac

SEQ ID NO: 3215712 - RNA, 13 nt, Human
ugaccauucucca

SEQ ID NO: 3215713 - RNA, 15 nt, Human
ugaccaugcauuuua

SEQ ID NO: 3215714 - RNA, 19 nt, Human
ugaccaugcauuuuaccau

SEQ ID NO: 3215715 - RNA, 15 nt, Human
ugagcaggauuuuaa

SEQ ID NO: 3215716 - RNA, 12 nt, Human
ugagcagcaccc

SEQ ID NO: 3215717 - RNA, 20 nt, Human
ugagcaggauuuuaaucuuu

SEQ ID NO: 3215718 - RNA, 15 nt, Human
ugagauacuuugcau

SEQ ID NO: 3215719 - RNA, 18 nt, Human
ugagauacuuugcauugu

SEQ ID NO: 3215720 - RNA, 21 nt, Human
ugagauacuuugcauugucug

SEQ ID NO: 3215721 - RNA, 22 nt, Human
ugagauacuuugcauugucugu

SEQ ID NO: 3215722 - RNA, 14 nt, Human
ugagaggggaacag

SEQ ID NO: 3215723 - RNA, 19 nt, Human
ugagaggcugucuguugua

SEQ ID NO: 3215724 - RNA, 18 nt, Human
ugagaggggaacagacug

SEQ ID NO: 3215725 - RNA, 14 nt, Human
ugagaccaaccugg

SEQ ID NO: 3215726 - RNA, 12 nt, Human
ugagaccugccc

SEQ ID NO: 3215727 - RNA, 13 nt, Human
ugagaccugcccc

SEQ ID NO: 3215728 - RNA, 14 nt, Human
ugagaccugccccu

SEQ ID NO: 3215729 - RNA, 15 nt, Human
ugagaccugccccuc

SEQ ID NO: 3215730 - RNA, 22 nt, Human
ugagaccugccccuccucucug

SEQ ID NO: 3215731 - RNA, 20 nt, Human
ugagaaagacuauucaaaca

SEQ ID NO: 3215732 - RNA, 15 nt, Human
ugagaaauaaaguuu

SEQ ID NO: 3215733 - RNA, 13 nt, Human
ugagacauauuua

SEQ ID NO: 3215734 - RNA, 22 nt, Human
ugacuuuucuguccgagcuuug

SEQ ID NO: 3215735 - RNA, 23 nt, Human
ugacuuuucaaguauuuaagccu

SEQ ID NO: 3215736 - RNA, 16 nt, Human
ugacuuuucaaguauu

SEQ ID NO: 3215737 - RNA, 21 nt, Human
ugacuuuugcuuuaauuccau

SEQ ID NO: 3215738 - RNA, 17 nt, Human
ugacuuuugcuuuaauu

SEQ ID NO: 3215739 - RNA, 16 nt, Human
ugacuuuugcuuuaau

SEQ ID NO: 3215740 - RNA, 14 nt, Human
ugacuuuugcuuua

SEQ ID NO: 3215741 - RNA, 13 nt, Human
ugacuuuugcuuu

SEQ ID NO: 3215742 - RNA, 15 nt, Human
ugacuuuuuuucacu

SEQ ID NO: 3215743 - RNA, 18 nt, Human
ugagaaaaccccuuccca

SEQ ID NO: 3215744 - RNA, 14 nt, Human
ugagaaaacuguga

SEQ ID NO: 3215745 - RNA, 22 nt, Human
ugagaaaacugugaccaaguau

SEQ ID NO: 3215746 - RNA, 22 nt, Human
ugaggaugaaaaaauaacacug

SEQ ID NO: 3215747 - RNA, 21 nt, Human
ugaggauuaguuuagaacagg

SEQ ID NO: 3215748 - RNA, 19 nt, Human
ugaggauuaguuuagaaca

SEQ ID NO: 3215749 - RNA, 20 nt, Human
ugaggauuaguuuagaacag

SEQ ID NO: 3215750 - RNA, 17 nt, Human
ugaggauuaguuuagaa

SEQ ID NO: 3215751 - RNA, 13 nt, Human
ugaggaugaugua

SEQ ID NO: 3215752 - RNA, 14 nt, Human
ugaggaugauguac

SEQ ID NO: 3215753 - RNA, 15 nt, Human
ugagcugcaccaggu

SEQ ID NO: 3215754 - RNA, 23 nt, Human
ugagcuuaagaauuuugagcagg

SEQ ID NO: 3215755 - RNA, 17 nt, Human
ugagcuuacguaguucu

SEQ ID NO: 3215756 - RNA, 18 nt, Human
ugagcuuacguaguucua

SEQ ID NO: 3215757 - RNA, 21 nt, Human
ugaggaggccuugggcucugc

SEQ ID NO: 3215758 - RNA, 15 nt, Human
ugaggaguaaaauuc

SEQ ID NO: 3215759 - RNA, 16 nt, Human
ugaggaguaaaauuca

SEQ ID NO: 3215760 - RNA, 23 nt, Human
ugaggaggccuugggcucugcug

SEQ ID NO: 3215761 - RNA, 22 nt, Human
ugagccgagaucacgccacugc

SEQ ID NO: 3215762 - RNA, 23 nt, Human
ugagcagggcucagcggggacag

SEQ ID NO: 3215763 - RNA, 22 nt, Human
ugagcagggcucagcggggaca

SEQ ID NO: 3215764 - RNA, 20 nt, Human
ugagcagggcucagcgggga

SEQ ID NO: 3215765 - RNA, 23 nt, Human
ugagccgagaucacgccacugca

SEQ ID NO: 3215766 - RNA, 14 nt, Human
ugagccgcagagaa

SEQ ID NO: 3215767 - RNA, 11 nt, Human
ugagcucagga

SEQ ID NO: 3215768 - RNA, 19 nt, Human
ugagcucaggaguuugaga

SEQ ID NO: 3215769 - RNA, 11 nt, Human
ugagcucagcc

SEQ ID NO: 3215770 - RNA, 12 nt, Human
ugagcucagccc

SEQ ID NO: 3215771 - RNA, 17 nt, Human
ugagcugaaagaggcca

SEQ ID NO: 3215772 - RNA, 20 nt, Human
ugagcucagcccuggugggc

SEQ ID NO: 3215773 - RNA, 13 nt, Human
ugaggcagguccc

SEQ ID NO: 3215774 - RNA, 20 nt, Human
ugaggcagcacgugcacaaa

SEQ ID NO: 3215775 - RNA, 18 nt, Human
ugaggcucugcccuuggu

SEQ ID NO: 3215776 - RNA, 15 nt, Human
ugaggcugggcuccc

SEQ ID NO: 3215777 - RNA, 16 nt, Human
ugaggcugggcucccu

SEQ ID NO: 3215778 - RNA, 16 nt, Human
ugaggcucugcccuug

SEQ ID NO: 3215779 - RNA, 15 nt, Human
ugaggcucugcccuu

SEQ ID NO: 3215780 - RNA, 19 nt, Human
ugaggucagagccugcagu

SEQ ID NO: 3215781 - RNA, 18 nt, Human
ugaggucagagccugcag

SEQ ID NO: 3215782 - RNA, 21 nt, Human
ugaggcugggcucccuuccca

SEQ ID NO: 3215783 - RNA, 21 nt, Human
ugaggugaugaagacagcccg

SEQ ID NO: 3215784 - RNA, 21 nt, Human
ugaggugggaggaucucuuga

SEQ ID NO: 3215785 - RNA, 20 nt, Human
ugagucccaggcugagccuc

SEQ ID NO: 3215786 - RNA, 21 nt, Human
ugagucccaggcugagccuca

SEQ ID NO: 3215787 - RNA, 19 nt, Human
ugagucccaggcugagccu

SEQ ID NO: 3215788 - RNA, 14 nt, Human
ugaaaauucagugg

SEQ ID NO: 3215789 - RNA, 13 nt, Human
ugaaaauugaaaa

SEQ ID NO: 3215790 - RNA, 16 nt, Human
ugaaaauugaaaagua

SEQ ID NO: 3215791 - RNA, 17 nt, Human
ugaaaauugaaaaguac

SEQ ID NO: 3215792 - RNA, 18 nt, Human
ugaaaauugccuuucugu

SEQ ID NO: 3215793 - RNA, 23 nt, Human
ugaaaauugccuuucuguguuua

SEQ ID NO: 3215794 - RNA, 22 nt, Human
ugaaaauugccuuucuguguuu

SEQ ID NO: 3215795 - RNA, 19 nt, Human
ugaaaauugccuuucugug

SEQ ID NO: 3215796 - RNA, 19 nt, Human
ugaaaagaaaaaugagccu

SEQ ID NO: 3215797 - RNA, 15 nt, Human
ugaaaagaaaaauga

SEQ ID NO: 3215798 - RNA, 20 nt, Human
ugaaaagaaaaaugagccug

SEQ ID NO: 3215799 - RNA, 20 nt, Human
ugaaaauuaggauuucauga

SEQ ID NO: 3215800 - RNA, 22 nt, Human
ugaaaacacuguucucugcccu

SEQ ID NO: 3215801 - RNA, 23 nt, Human
ugaaaacacuguucucugcccuc

SEQ ID NO: 3215802 - RNA, 15 nt, Human
ugaaaacagaaauug

SEQ ID NO: 3215803 - RNA, 14 nt, Human
ugaaaacagaaauu

SEQ ID NO: 3215804 - RNA, 22 nt, Human
ugaaaacagaaauugguaccuu

SEQ ID NO: 3215805 - RNA, 21 nt, Human
ugaaaacagaaauugguaccu

SEQ ID NO: 3215806 - RNA, 18 nt, Human
ugaaaacagaaauuggua

SEQ ID NO: 3215807 - RNA, 17 nt, Human
ugaaaacagaaauuggu

SEQ ID NO: 3215808 - RNA, 18 nt, Human
ugaaaaccaacaccauca

SEQ ID NO: 3215809 - RNA, 17 nt, Human
ugaaaacacuguucucu

SEQ ID NO: 3215810 - RNA, 20 nt, Human
ugaaaacacuguucucugcc

SEQ ID NO: 3215811 - RNA, 21 nt, Human
ugaaaacacuguucucugccc

SEQ ID NO: 3215812 - RNA, 15 nt, Human
ucuuuuguuguuucu

SEQ ID NO: 3215813 - RNA, 18 nt, Human
ucuuuuguuguuucuuaa

SEQ ID NO: 3215814 - RNA, 13 nt, Human
ucuuuuuaaagcu

SEQ ID NO: 3215815 - RNA, 21 nt, Human
ucuuuuguuuuuugaaguguu

SEQ ID NO: 3215816 - RNA, 18 nt, Human
ucuuuuguuuuuugaagu

SEQ ID NO: 3215817 - RNA, 19 nt, Human
ucuuuuguuacucuuggga

SEQ ID NO: 3215818 - RNA, 21 nt, Human
ucuuuuguccugcaucaucuu

SEQ ID NO: 3215819 - RNA, 13 nt, Human
ucuuuuccucgcu

SEQ ID NO: 3215820 - RNA, 19 nt, Human
ucuuuuccaaacacaggca

SEQ ID NO: 3215821 - RNA, 12 nt, Human
ucuuucccuccc

SEQ ID NO: 3215822 - RNA, 14 nt, Human
ucuuuccaaauuau

SEQ ID NO: 3215823 - RNA, 18 nt, Human
ucuuuccaaauuauuucu

SEQ ID NO: 3215824 - RNA, 19 nt, Human
ucuuuccaaauuauuucuu

SEQ ID NO: 3215825 - RNA, 20 nt, Human
ucuuuccaaauuauuucuua

SEQ ID NO: 3215826 - RNA, 13 nt, Human
ucuuucccucccu

SEQ ID NO: 3215827 - RNA, 14 nt, Human
ucuuugaauuuuca

SEQ ID NO: 3215828 - RNA, 13 nt, Human
ucuuugaauuuuc

SEQ ID NO: 3215829 - RNA, 13 nt, Human
ucuuguguguuua

SEQ ID NO: 3215830 - RNA, 17 nt, Human
ucuuguguauuucaguu

SEQ ID NO: 3215831 - RNA, 14 nt, Human
ucuuuggacccuga

SEQ ID NO: 3215832 - RNA, 15 nt, Human
ucuuuggacccugag

SEQ ID NO: 3215833 - RNA, 13 nt, Human
ucuuuggacccug

SEQ ID NO: 3215834 - RNA, 22 nt, Human
ucuuugcccuuuacuugucuuu

SEQ ID NO: 3215835 - RNA, 15 nt, Human
ucuuugcccuuuacu

SEQ ID NO: 3215836 - RNA, 13 nt, Human
ucuuugcccuuua

SEQ ID NO: 3215837 - RNA, 17 nt, Human
ucuuugcagacaggcaa

SEQ ID NO: 3215838 - RNA, 14 nt, Human
ucuuugcagacagg

SEQ ID NO: 3215839 - RNA, 18 nt, Human
ucuuugcacuuuuucuua

SEQ ID NO: 3215840 - RNA, 21 nt, Human
ucuuugcccccaaacccccau

SEQ ID NO: 3215841 - RNA, 20 nt, Human
ucuuugccaucucugcucca

SEQ ID NO: 3215842 - RNA, 19 nt, Human
ucuuugccaucucugcucc

SEQ ID NO: 3215843 - RNA, 18 nt, Human
ucuuugccaucucugcuc

SEQ ID NO: 3215844 - RNA, 17 nt, Human
ucuuugccaucucugcu

SEQ ID NO: 3215845 - RNA, 16 nt, Human
ucuuugccaucucugc

SEQ ID NO: 3215846 - RNA, 13 nt, Human
ucuuugccaucuc

SEQ ID NO: 3215847 - RNA, 20 nt, Human
ucuuugcacuuuuucuuaau

SEQ ID NO: 3215848 - RNA, 23 nt, Human
ucuuugagugaagcugggagaac

SEQ ID NO: 3215849 - RNA, 21 nt, Human
ucuuugaauuuucauuuuaca

SEQ ID NO: 3215850 - RNA, 19 nt, Human
ucuuugaauuuucauuuua

SEQ ID NO: 3215851 - RNA, 16 nt, Human
ucuuugaauuuucauu

SEQ ID NO: 3215852 - RNA, 15 nt, Human
ucuuugaauuuucau

SEQ ID NO: 3215853 - RNA, 13 nt, Human
ucuuugcagacag

SEQ ID NO: 3215854 - RNA, 22 nt, Human
ucuucauuaccucagugagaag

SEQ ID NO: 3215855 - RNA, 19 nt, Human
ucuucauuuuuuuuaauug

SEQ ID NO: 3215856 - RNA, 21 nt, Human
ucuuccaaagcagagagcauu

SEQ ID NO: 3215857 - RNA, 16 nt, Human
ucuucauguucaauua

SEQ ID NO: 3215858 - RNA, 16 nt, Human
ucuucauguucccacu

SEQ ID NO: 3215859 - RNA, 14 nt, Human
ucuucauguuccca

SEQ ID NO: 3215860 - RNA, 19 nt, Human
ucuucauguucccacuuca

SEQ ID NO: 3215861 - RNA, 20 nt, Human
ucuucauguaaauugacugu

SEQ ID NO: 3215862 - RNA, 23 nt, Human
ucuucauguaaauugacuguacu

SEQ ID NO: 3215863 - RNA, 22 nt, Human
ucuucaguuaagccuuuggaaa

SEQ ID NO: 3215864 - RNA, 19 nt, Human
ucuucaguuaagccuuugg

SEQ ID NO: 3215865 - RNA, 20 nt, Human
ucuucaguuaagccuuugga

SEQ ID NO: 3215866 - RNA, 22 nt, Human
ucuuauccaacaucaacaucuu

SEQ ID NO: 3215867 - RNA, 16 nt, Human
ucuuaucucagauauu

SEQ ID NO: 3215868 - RNA, 20 nt, Human
ucuuauacagauaaaacaug

SEQ ID NO: 3215869 - RNA, 21 nt, Human
ucuuauauuuacaacacuuua

SEQ ID NO: 3215870 - RNA, 21 nt, Human
ucuucagagacuccugcaggc

SEQ ID NO: 3215871 - RNA, 21 nt, Human
ucuuaucucagauauuugcac

SEQ ID NO: 3215872 - RNA, 20 nt, Human
ucuuaucucagauauuugca

SEQ ID NO: 3215873 - RNA, 11 nt, Human
ucugugugugu

SEQ ID NO: 3215874 - RNA, 14 nt, Human
ucuuagauguauau

SEQ ID NO: 3215875 - RNA, 15 nt, Human
ucuuagauguauaua

SEQ ID NO: 3215876 - RNA, 20 nt, Human
ucugugucagguggggcagc

SEQ ID NO: 3215877 - RNA, 17 nt, Human
ucugugucagguggggc

SEQ ID NO: 3215878 - RNA, 20 nt, Human
ucuuagguuggcaaaaaggc

SEQ ID NO: 3215879 - RNA, 23 nt, Human
ucuuagguuggcaaaaaggcagg

SEQ ID NO: 3215880 - RNA, 20 nt, Human
ucuuguaucuggauucaaau

SEQ ID NO: 3215881 - RNA, 23 nt, Human
ucuugcucugcugacagacacag

SEQ ID NO: 3215882 - RNA, 15 nt, Human
ucuugcucugcugac

SEQ ID NO: 3215883 - RNA, 23 nt, Human
ucuugcauggcaaggacugcagg

SEQ ID NO: 3215884 - RNA, 14 nt, Human
ucuugcauuucacu

SEQ ID NO: 3215885 - RNA, 23 nt, Human
ucuugcauuuaaaagacagcuuu

SEQ ID NO: 3215886 - RNA, 17 nt, Human
ucuugccacugccucuu

SEQ ID NO: 3215887 - RNA, 16 nt, Human
ucuugccacugccucu

SEQ ID NO: 3215888 - RNA, 14 nt, Human
ucuugcucugcuga

SEQ ID NO: 3215889 - RNA, 18 nt, Human
ucuugaacugagcuugga

SEQ ID NO: 3215890 - RNA, 16 nt, Human
ucuugaaggaaaaauu

SEQ ID NO: 3215891 - RNA, 15 nt, Human
ucuugcaugaggcua

SEQ ID NO: 3215892 - RNA, 22 nt, Human
ucuugaaggaaaaauucaauag

SEQ ID NO: 3215893 - RNA, 19 nt, Human
ucuugaaggaaaaauucaa

SEQ ID NO: 3215894 - RNA, 18 nt, Human
ucuugaaggaaaaauuca

SEQ ID NO: 3215895 - RNA, 17 nt, Human
ucuugaaggaaaaauuc

SEQ ID NO: 3215896 - RNA, 13 nt, Human
ucuugaagacuuu

SEQ ID NO: 3215897 - RNA, 22 nt, Human
ucuugaagacuuuucuuucagc

SEQ ID NO: 3215898 - RNA, 15 nt, Human
ucuugaacugagcuu

SEQ ID NO: 3215899 - RNA, 17 nt, Human
ucuugaacugagcuugg

SEQ ID NO: 3215900 - RNA, 16 nt, Human
ucuucuuggucucagu

SEQ ID NO: 3215901 - RNA, 17 nt, Human
ucuuccaaccauuuauc

SEQ ID NO: 3215902 - RNA, 19 nt, Human
ucuuccaaccauuuaucuu

SEQ ID NO: 3215903 - RNA, 12 nt, Human
ucugagagcugu

SEQ ID NO: 3215904 - RNA, 18 nt, Human
ucugagaggacuuuucuu

SEQ ID NO: 3215905 - RNA, 19 nt, Human
ucugacccaugcugcccug

SEQ ID NO: 3215906 - RNA, 20 nt, Human
ucugacccaugcugcccugu

SEQ ID NO: 3215907 - RNA, 22 nt, Human
ucugacccaugcugcccuguga

SEQ ID NO: 3215908 - RNA, 23 nt, Human
ucugacccaugcugcccugugag

SEQ ID NO: 3215909 - RNA, 16 nt, Human
ucucauagguuaaaaa

SEQ ID NO: 3215910 - RNA, 17 nt, Human
ucucauagguuaaaaaa

SEQ ID NO: 3215911 - RNA, 10 nt, Human
ucucaucaug

SEQ ID NO: 3215912 - RNA, 15 nt, Human
ucucaucaugucuau

SEQ ID NO: 3215913 - RNA, 18 nt, Human
ucucaucaugucuauugu

SEQ ID NO: 3215914 - RNA, 21 nt, Human
ucugcaagaauugaagcagga

SEQ ID NO: 3215915 - RNA, 23 nt, Human
ucugcaaagcauguuuugcaugu

SEQ ID NO: 3215916 - RNA, 16 nt, Human
ucugcaaagcauguuu

SEQ ID NO: 3215917 - RNA, 20 nt, Human
ucugauuucuuuucaccauu

SEQ ID NO: 3215918 - RNA, 13 nt, Human
ucugauuucaggg

SEQ ID NO: 3215919 - RNA, 21 nt, Human
ucugaggaauccagacccggc

SEQ ID NO: 3215920 - RNA, 18 nt, Human
ucugaggaauccagaccc

SEQ ID NO: 3215921 - RNA, 22 nt, Human
ucugaggaauccagacccggcu

SEQ ID NO: 3215922 - RNA, 16 nt, Human
ucugauuuauuuugua

SEQ ID NO: 3215923 - RNA, 20 nt, Human
ucugauuuauuuuguaugaa

SEQ ID NO: 3215924 - RNA, 22 nt, Human
ucugauuuauuuuguaugaaau

SEQ ID NO: 3215925 - RNA, 23 nt, Human
ucugauuuauuuuguaugaaaua

SEQ ID NO: 3215926 - RNA, 13 nt, Human
ucugcccacuccc

SEQ ID NO: 3215927 - RNA, 14 nt, Human
ucugcccacucccu

SEQ ID NO: 3215928 - RNA, 17 nt, Human
ucugcccaccucggccu

SEQ ID NO: 3215929 - RNA, 12 nt, Human
ucugccucccau

SEQ ID NO: 3215930 - RNA, 13 nt, Human
ucugccucccauc

SEQ ID NO: 3215931 - RNA, 15 nt, Human
ucugccucccaucac

SEQ ID NO: 3215932 - RNA, 23 nt, Human
ucugccauauucuguuggccagu

SEQ ID NO: 3215933 - RNA, 22 nt, Human
ucugccauauucuguuggccag

SEQ ID NO: 3215934 - RNA, 12 nt, Human
ucugcccacucc

SEQ ID NO: 3215935 - RNA, 14 nt, Human
ucugccauuucaug

SEQ ID NO: 3215936 - RNA, 18 nt, Human
ucugccauauucuguugg

SEQ ID NO: 3215937 - RNA, 20 nt, Human
ucugccugaagucacacagu

SEQ ID NO: 3215938 - RNA, 21 nt, Human
ucugccugaggggcagccugc

SEQ ID NO: 3215939 - RNA, 23 nt, Human
ucugccugaggggcagccugccu

SEQ ID NO: 3215940 - RNA, 22 nt, Human
ucugccugaggggcagccugcc

SEQ ID NO: 3215941 - RNA, 19 nt, Human
ucugccugaagucacacag

SEQ ID NO: 3215942 - RNA, 22 nt, Human
ucugccucugacacacagcucu

SEQ ID NO: 3215943 - RNA, 21 nt, Human
ucugccucugacacacagcuc

SEQ ID NO: 3215944 - RNA, 23 nt, Human
ucugccucugacacacagcucug

SEQ ID NO: 3215945 - RNA, 14 nt, Human
ucugccucugaugu

SEQ ID NO: 3215946 - RNA, 20 nt, Human
ucugccucugauguauuuug

SEQ ID NO: 3215947 - RNA, 18 nt, Human
ucugccucugauguauuu

SEQ ID NO: 3215948 - RNA, 16 nt, Human
ucugccucccaucacc

SEQ ID NO: 3215949 - RNA, 17 nt, Human
ucugccucccaucaccc

SEQ ID NO: 3215950 - RNA, 20 nt, Human
ucugccucccaucacccgcu

SEQ ID NO: 3215951 - RNA, 21 nt, Human
ucugccucccaucacccgcua

SEQ ID NO: 3215952 - RNA, 18 nt, Human
ucugccucugacacacag

SEQ ID NO: 3215953 - RNA, 15 nt, Human
ucugccucugacaca

SEQ ID NO: 3215954 - RNA, 15 nt, Human
ucugccuccucuuca

SEQ ID NO: 3215955 - RNA, 16 nt, Human
ucuggaaugcaguggu

SEQ ID NO: 3215956 - RNA, 14 nt, Human
ucugcugcuggcug

SEQ ID NO: 3215957 - RNA, 15 nt, Human
ucugcugcuggcugg

SEQ ID NO: 3215958 - RNA, 17 nt, Human
ucugcugcuggcugguu

SEQ ID NO: 3215959 - RNA, 15 nt, Human
ucuggacuccucugu

SEQ ID NO: 3215960 - RNA, 18 nt, Human
ucuggacuccucugucca

SEQ ID NO: 3215961 - RNA, 16 nt, Human
ucuggacuccucuguc

SEQ ID NO: 3215962 - RNA, 23 nt, Human
ucuggaccccaucugugaauaag

SEQ ID NO: 3215963 - RNA, 21 nt, Human
ucuggaccccaucugugaaua

SEQ ID NO: 3215964 - RNA, 22 nt, Human
ucuggacuguggguuugugggg

SEQ ID NO: 3215965 - RNA, 22 nt, Human
ucuggacuccucuguccaggca

SEQ ID NO: 3215966 - RNA, 20 nt, Human
ucugccugcccaggccccug

SEQ ID NO: 3215967 - RNA, 18 nt, Human
ucugccugcccaggcccc

SEQ ID NO: 3215968 - RNA, 17 nt, Human
ucugccugcccaggccc

SEQ ID NO: 3215969 - RNA, 16 nt, Human
ucugccugcccaggcc

SEQ ID NO: 3215970 - RNA, 21 nt, Human
ucugcuccucuccccagcaag

SEQ ID NO: 3215971 - RNA, 11 nt, Human
ucugcugcugg

SEQ ID NO: 3215972 - RNA, 13 nt, Human
ucugcugcuggcu

SEQ ID NO: 3215973 - RNA, 22 nt, Human
ucugcugauccucccaggcuuc

SEQ ID NO: 3215974 - RNA, 23 nt, Human
ucugcucuuucuucuuccacaca

SEQ ID NO: 3215975 - RNA, 15 nt, Human
ucugcugcagagcag

SEQ ID NO: 3215976 - RNA, 16 nt, Human
ucugcugcagagcagu

SEQ ID NO: 3215977 - RNA, 22 nt, Human
ucugcugaugacccccccagcu

SEQ ID NO: 3215978 - RNA, 22 nt, Human
ucugcugcagagcaguaaggga

SEQ ID NO: 3215979 - RNA, 13 nt, Human
ucugcugaaggaa

SEQ ID NO: 3215980 - RNA, 13 nt, Human
ucugcucuugcau

SEQ ID NO: 3215981 - RNA, 14 nt, Human
ucuggcugcagagc

SEQ ID NO: 3215982 - RNA, 15 nt, Human
ucuggcugcagagca

SEQ ID NO: 3215983 - RNA, 16 nt, Human
ucuggugaccuuccaa

SEQ ID NO: 3215984 - RNA, 23 nt, Human
ucuggugaccuuccaagagccug

SEQ ID NO: 3215985 - RNA, 18 nt, Human
ucuggugaccuuccaaga

SEQ ID NO: 3215986 - RNA, 16 nt, Human
ucuggugacuuuccuc

SEQ ID NO: 3215987 - RNA, 16 nt, Human
ucuguaaaauggaaaa

SEQ ID NO: 3215988 - RNA, 14 nt, Human
ucugucucagucca

SEQ ID NO: 3215989 - RNA, 18 nt, Human
ucuguguauuuucaguca

SEQ ID NO: 3215990 - RNA, 13 nt, Human
ucugucuaggaau

SEQ ID NO: 3215991 - RNA, 16 nt, Human
ucugucgcccagucug

SEQ ID NO: 3215992 - RNA, 17 nt, Human
ucugucgcccagucugg

SEQ ID NO: 3215993 - RNA, 12 nt, Human
ucuguccuggga

SEQ ID NO: 3215994 - RNA, 14 nt, Human
ucuguacagagccc

SEQ ID NO: 3215995 - RNA, 15 nt, Human
ucuguacagagccca

SEQ ID NO: 3215996 - RNA, 20 nt, Human
ucuguccuacucugugucag

SEQ ID NO: 3215997 - RNA, 23 nt, Human
uccacuuagaaauugcauuuccu

SEQ ID NO: 3215998 - RNA, 21 nt, Human
uccacuuagaaauugcauuuc

SEQ ID NO: 3215999 - RNA, 22 nt, Human
uccacugugccaugugccaggu

SEQ ID NO: 3216000 - RNA, 21 nt, Human
uccacugugccaugugccagg

SEQ ID NO: 3216001 - RNA, 14 nt, Human
uccacccugcucuc

SEQ ID NO: 3216002 - RNA, 13 nt, Human
uccacccugcucu

SEQ ID NO: 3216003 - RNA, 21 nt, Human
uccacccugcucuccgaccag

SEQ ID NO: 3216004 - RNA, 14 nt, Human
uccacuuucuagcc

SEQ ID NO: 3216005 - RNA, 13 nt, Human
uccagagcugcca

SEQ ID NO: 3216006 - RNA, 15 nt, Human
uccagagcugcuucc

SEQ ID NO: 3216007 - RNA, 15 nt, Human
uccagagcugccagu

SEQ ID NO: 3216008 - RNA, 20 nt, Human
uccagagcauuccagucagg

SEQ ID NO: 3216009 - RNA, 12 nt, Human
uccagagcauuc

SEQ ID NO: 3216010 - RNA, 19 nt, Human
uccagagaguggcuccucc

SEQ ID NO: 3216011 - RNA, 22 nt, Human
uccagagaguggcuccucccgg

SEQ ID NO: 3216012 - RNA, 19 nt, Human
uccaggacaggagaugcug

SEQ ID NO: 3216013 - RNA, 18 nt, Human
uccaggacaggagaugcu

SEQ ID NO: 3216014 - RNA, 17 nt, Human
uccaggacccugccagg

SEQ ID NO: 3216015 - RNA, 15 nt, Human
uccaggacccugcca

SEQ ID NO: 3216016 - RNA, 14 nt, Human
uccaggacccugcc

SEQ ID NO: 3216017 - RNA, 22 nt, Human
uccaggacaggagaugcugugc

SEQ ID NO: 3216018 - RNA, 22 nt, Human
uccaggacccugccaggcacag

SEQ ID NO: 3216019 - RNA, 21 nt, Human
uccaggacccugccaggcaca

SEQ ID NO: 3216020 - RNA, 19 nt, Human
uccaggacccugccaggca

SEQ ID NO: 3216021 - RNA, 18 nt, Human
uccaggacccugccaggc

SEQ ID NO: 3216022 - RNA, 22 nt, Human
uccagcuggccgggagccugau

SEQ ID NO: 3216023 - RNA, 15 nt, Human
uccagcuggccggga

SEQ ID NO: 3216024 - RNA, 21 nt, Human
uccagcuggccgggagccuga

SEQ ID NO: 3216025 - RNA, 19 nt, Human
uccagcaauucuccugccu

SEQ ID NO: 3216026 - RNA, 20 nt, Human
uccagcaauucuccugccuc

SEQ ID NO: 3216027 - RNA, 18 nt, Human
uccagcaauucuccugcc

SEQ ID NO: 3216028 - RNA, 16 nt, Human
uccagagcugcuuccc

SEQ ID NO: 3216029 - RNA, 15 nt, Human
uccagaugccacaau

SEQ ID NO: 3216030 - RNA, 22 nt, Human
uccagauuuuuuacagcugccu

SEQ ID NO: 3216031 - RNA, 22 nt, Human
uccaagcccaguucagcuuggg

SEQ ID NO: 3216032 - RNA, 15 nt, Human
uccaagccagcaagc

SEQ ID NO: 3216033 - RNA, 23 nt, Human
uccaagccucucuggcacuuuga

SEQ ID NO: 3216034 - RNA, 20 nt, Human
uccacaagagcccaggccuc

SEQ ID NO: 3216035 - RNA, 19 nt, Human
uccacaagagcccaggccu

SEQ ID NO: 3216036 - RNA, 21 nt, Human
uccacaagagcccaggccucc

SEQ ID NO: 3216037 - RNA, 20 nt, Human
uccacaccucacucugcuac

SEQ ID NO: 3216038 - RNA, 12 nt, Human
uccacacccgcg

SEQ ID NO: 3216039 - RNA, 13 nt, Human
uccaagagccuga

SEQ ID NO: 3216040 - RNA, 14 nt, Human
uccaagagccugag

SEQ ID NO: 3216041 - RNA, 19 nt, Human
uccaagaccuucuccuuca

SEQ ID NO: 3216042 - RNA, 20 nt, Human
uccaagaccuucuccuucac

SEQ ID NO: 3216043 - RNA, 14 nt, Human
uccaagcaggacau

SEQ ID NO: 3216044 - RNA, 15 nt, Human
uccaagaagcccagg

SEQ ID NO: 3216045 - RNA, 16 nt, Human
uccaagaagcccagga

SEQ ID NO: 3216046 - RNA, 14 nt, Human
uccaagaagcccag

SEQ ID NO: 3216047 - RNA, 12 nt, Human
uccaagaagccc

SEQ ID NO: 3216048 - RNA, 23 nt, Human
ucaugucaaauauuuagauguaa

SEQ ID NO: 3216049 - RNA, 17 nt, Human
ucccaacucaccccagc

SEQ ID NO: 3216050 - RNA, 18 nt, Human
ucccaacucaccccagcc

SEQ ID NO: 3216051 - RNA, 19 nt, Human
ucccaacucaccccagccc

SEQ ID NO: 3216052 - RNA, 21 nt, Human
ucccaacucaccccagcccca

SEQ ID NO: 3216053 - RNA, 14 nt, Human
ucccaacuuguaaa

SEQ ID NO: 3216054 - RNA, 20 nt, Human
ucccaagaaaggaaaccuuu

SEQ ID NO: 3216055 - RNA, 18 nt, Human
uccaugugaucucauugu

SEQ ID NO: 3216056 - RNA, 19 nt, Human
uccaugugaaacauguugc

SEQ ID NO: 3216057 - RNA, 18 nt, Human
uccaugucgccucugcau

SEQ ID NO: 3216058 - RNA, 17 nt, Human
uccaugucgccucugca

SEQ ID NO: 3216059 - RNA, 19 nt, Human
uccaugucgccucugcauu

SEQ ID NO: 3216060 - RNA, 16 nt, Human
uccaugucgccucugc

SEQ ID NO: 3216061 - RNA, 20 nt, Human
uccagggcucaacacuguga

SEQ ID NO: 3216062 - RNA, 17 nt, Human
uccagggcucaacacug

SEQ ID NO: 3216063 - RNA, 23 nt, Human
uccauaaucuggacuccucuguc

SEQ ID NO: 3216064 - RNA, 22 nt, Human
uccauaaucuggacuccucugu

SEQ ID NO: 3216065 - RNA, 15 nt, Human
uccauagagagcaag

SEQ ID NO: 3216066 - RNA, 17 nt, Human
uccauagagagcaagac

SEQ ID NO: 3216067 - RNA, 15 nt, Human
uccauaauguucugc

SEQ ID NO: 3216068 - RNA, 17 nt, Human
uccauaauguucugcua

SEQ ID NO: 3216069 - RNA, 16 nt, Human
uccauaauguucugcu

SEQ ID NO: 3216070 - RNA, 19 nt, Human
uccauacacacgcugccuu

SEQ ID NO: 3216071 - RNA, 18 nt, Human
uccauacacacgcugccu

SEQ ID NO: 3216072 - RNA, 14 nt, Human
uccauacacacgcu

SEQ ID NO: 3216073 - RNA, 20 nt, Human
uccauagagagcaagacgcu

SEQ ID NO: 3216074 - RNA, 15 nt, Human
uccauagcuguggug

SEQ ID NO: 3216075 - RNA, 14 nt, Human
uccauagugacuuu

SEQ ID NO: 3216076 - RNA, 15 nt, Human
uccauagugacuuuu

SEQ ID NO: 3216077 - RNA, 19 nt, Human
uccauauaagcccuugauu

SEQ ID NO: 3216078 - RNA, 14 nt, Human
uccauauuauugug

SEQ ID NO: 3216079 - RNA, 16 nt, Human
uccaugaugauaguug

SEQ ID NO: 3216080 - RNA, 18 nt, Human
uccauauuagaaaacuuu

SEQ ID NO: 3216081 - RNA, 17 nt, Human
uccauauuagaaaacuu

SEQ ID NO: 3216082 - RNA, 15 nt, Human
uccauauuagaaaac

SEQ ID NO: 3216083 - RNA, 13 nt, Human
uccauauuagaaa

SEQ ID NO: 3216084 - RNA, 19 nt, Human
uccauauccauagugacuu

SEQ ID NO: 3216085 - RNA, 12 nt, Human
uccauauccaua

SEQ ID NO: 3216086 - RNA, 17 nt, Human
ucccaggcauuccccag

SEQ ID NO: 3216087 - RNA, 18 nt, Human
ucccaggcauuccccagg

SEQ ID NO: 3216088 - RNA, 16 nt, Human
ucccaggauguacaag

SEQ ID NO: 3216089 - RNA, 15 nt, Human
ucccaggcaaauaaa

SEQ ID NO: 3216090 - RNA, 18 nt, Human
ucccaggcaaauaaaauu

SEQ ID NO: 3216091 - RNA, 20 nt, Human
ucccaggcaaauaaaauucc

SEQ ID NO: 3216092 - RNA, 15 nt, Human
ucccacuucugccag

SEQ ID NO: 3216093 - RNA, 16 nt, Human
ucccacuucugccaga

SEQ ID NO: 3216094 - RNA, 12 nt, Human
ucccacuccaag

SEQ ID NO: 3216095 - RNA, 16 nt, Human
ucccacuccaagccag

SEQ ID NO: 3216096 - RNA, 14 nt, Human
ucccacuccaagcc

SEQ ID NO: 3216097 - RNA, 19 nt, Human
ucccacuccaagccagcaa

SEQ ID NO: 3216098 - RNA, 18 nt, Human
ucccacuccaagccagca

SEQ ID NO: 3216099 - RNA, 13 nt, Human
ucccacucuucuc

SEQ ID NO: 3216100 - RNA, 17 nt, Human
ucccacuucaaaacaaa

SEQ ID NO: 3216101 - RNA, 13 nt, Human
ucccacugcccac

SEQ ID NO: 3216102 - RNA, 15 nt, Human
ucccacucuucucau

SEQ ID NO: 3216103 - RNA, 16 nt, Human
ucccaugagccucagc

SEQ ID NO: 3216104 - RNA, 15 nt, Human
ucccaugagccucag

SEQ ID NO: 3216105 - RNA, 21 nt, Human
ucccagggagcaagggcaggg

SEQ ID NO: 3216106 - RNA, 19 nt, Human
ucccagggagcaagggcag

SEQ ID NO: 3216107 - RNA, 16 nt, Human
ucccagggagcaaggg

SEQ ID NO: 3216108 - RNA, 19 nt, Human
ucccaggcugagccucagu

SEQ ID NO: 3216109 - RNA, 18 nt, Human
ucccaggcugagccucag

SEQ ID NO: 3216110 - RNA, 14 nt, Human
ucccacucagucca

SEQ ID NO: 3216111 - RNA, 20 nt, Human
ucccaccucucucacuccuu

SEQ ID NO: 3216112 - RNA, 18 nt, Human
ucccaccuuggcugcagg

SEQ ID NO: 3216113 - RNA, 21 nt, Human
ucccaccuuggcugcagggag

SEQ ID NO: 3216114 - RNA, 19 nt, Human
ucccaccuuggcugcaggg

SEQ ID NO: 3216115 - RNA, 17 nt, Human
ucccaccucucucacuc

SEQ ID NO: 3216116 - RNA, 18 nt, Human
ucccaccucucucacucc

SEQ ID NO: 3216117 - RNA, 14 nt, Human
ucccaccucucuca

SEQ ID NO: 3216118 - RNA, 16 nt, Human
ucccaccucagccucc

SEQ ID NO: 3216119 - RNA, 20 nt, Human
ucccaacuugccuuugaaga

SEQ ID NO: 3216120 - RNA, 14 nt, Human
ucccaacuugccuu

SEQ ID NO: 3216121 - RNA, 18 nt, Human
ucccaccucagccucccg

SEQ ID NO: 3216122 - RNA, 14 nt, Human
ucaguucucuucac

SEQ ID NO: 3216123 - RNA, 17 nt, Human
ucaguucucuucacuca

SEQ ID NO: 3216124 - RNA, 15 nt, Human
ucauacucaccucac

SEQ ID NO: 3216125 - RNA, 16 nt, Human
ucauacucgagucuga

SEQ ID NO: 3216126 - RNA, 17 nt, Human
ucauacucgagucugag

SEQ ID NO: 3216127 - RNA, 16 nt, Human
ucauacuccuaugcuu

SEQ ID NO: 3216128 - RNA, 20 nt, Human
ucauacuccuaugcuuuagc

SEQ ID NO: 3216129 - RNA, 17 nt, Human
ucauacuccuaugcuuu

SEQ ID NO: 3216130 - RNA, 15 nt, Human
ucauacugauguguu

SEQ ID NO: 3216131 - RNA, 14 nt, Human
ucauacugaugugu

SEQ ID NO: 3216132 - RNA, 13 nt, Human
ucauacuuaaaaa

SEQ ID NO: 3216133 - RNA, 14 nt, Human
ucauacuuaaaaau

SEQ ID NO: 3216134 - RNA, 15 nt, Human
ucauacuuaaaaauu

SEQ ID NO: 3216135 - RNA, 16 nt, Human
ucauacuuaaaaauuu

SEQ ID NO: 3216136 - RNA, 19 nt, Human
ucauacuuaaaaauuuauu

SEQ ID NO: 3216137 - RNA, 17 nt, Human
ucaucauauuauacaga

SEQ ID NO: 3216138 - RNA, 14 nt, Human
ucaucauauuauac

SEQ ID NO: 3216139 - RNA, 14 nt, Human
ucaucuggaguucu

SEQ ID NO: 3216140 - RNA, 20 nt, Human
ucaucuggaguucucaaaga

SEQ ID NO: 3216141 - RNA, 12 nt, Human
ucaucuggaagu

SEQ ID NO: 3216142 - RNA, 13 nt, Human
ucaucuggaaguu

SEQ ID NO: 3216143 - RNA, 17 nt, Human
ucauggagaaccaccua

SEQ ID NO: 3216144 - RNA, 21 nt, Human
ucauggagaaccaccuacccc

SEQ ID NO: 3216145 - RNA, 18 nt, Human
ucagugugacugaucucu

SEQ ID NO: 3216146 - RNA, 17 nt, Human
ucagucugauucccaag

SEQ ID NO: 3216147 - RNA, 19 nt, Human
ucaguccucaaagcuuuuu

SEQ ID NO: 3216148 - RNA, 16 nt, Human
ucaguuaagccuuugg

SEQ ID NO: 3216149 - RNA, 17 nt, Human
ucaguuaagccuuugga

SEQ ID NO: 3216150 - RNA, 15 nt, Human
ucaguguuuggugca

SEQ ID NO: 3216151 - RNA, 15 nt, Human
ucaguguuucugggg

SEQ ID NO: 3216152 - RNA, 12 nt, Human
ucaguguuucau

SEQ ID NO: 3216153 - RNA, 14 nt, Human
ucaguguuuaugug

SEQ ID NO: 3216154 - RNA, 18 nt, Human
ucaguguuuaugugcuau

SEQ ID NO: 3216155 - RNA, 18 nt, Human
ucaguccaugaagaugua

SEQ ID NO: 3216156 - RNA, 15 nt, Human
ucaguccauagcaga

SEQ ID NO: 3216157 - RNA, 23 nt, Human
ucaguccaagggguccccuccag

SEQ ID NO: 3216158 - RNA, 18 nt, Human
ucaguccccgugaaggag

SEQ ID NO: 3216159 - RNA, 13 nt, Human
ucagucauuaaau

SEQ ID NO: 3216160 - RNA, 17 nt, Human
ucagguggggucacucu

SEQ ID NO: 3216161 - RNA, 20 nt, Human
ucagguggggucacucuggc

SEQ ID NO: 3216162 - RNA, 15 nt, Human
ucaggugcugccauc

SEQ ID NO: 3216163 - RNA, 21 nt, Human
ucagguggggcagcuugaggg

SEQ ID NO: 3216164 - RNA, 16 nt, Human
ucagguggggcagcuu

SEQ ID NO: 3216165 - RNA, 15 nt, Human
ucagguggggcagcu

SEQ ID NO: 3216166 - RNA, 20 nt, Human
ucaggugcugccauccaggu

SEQ ID NO: 3216167 - RNA, 18 nt, Human
ucaggugcugccauccag

SEQ ID NO: 3216168 - RNA, 14 nt, Human
ucagguggggcagc

SEQ ID NO: 3216169 - RNA, 22 nt, Human
ucagccucccaaagugcuggga

SEQ ID NO: 3216170 - RNA, 12 nt, Human
ucagccucccga

SEQ ID NO: 3216171 - RNA, 16 nt, Human
ucagccugcuccagcu

SEQ ID NO: 3216172 - RNA, 21 nt, Human
ucagccucccacagugcuggg

SEQ ID NO: 3216173 - RNA, 16 nt, Human
ucagccucccacagug

SEQ ID NO: 3216174 - RNA, 21 nt, Human
ucagcuccccucggagaagag

SEQ ID NO: 3216175 - RNA, 22 nt, Human
ucagcuccccucggagaagagc

SEQ ID NO: 3216176 - RNA, 21 nt, Human
ucagcuccagcucaccagccc

SEQ ID NO: 3216177 - RNA, 18 nt, Human
ucagcuccagcucaccag

SEQ ID NO: 3216178 - RNA, 15 nt, Human
ucagcuccagcucac

SEQ ID NO: 3216179 - RNA, 22 nt, Human
ucaggagcuccauacacacgcu

SEQ ID NO: 3216180 - RNA, 18 nt, Human
ucaggaggccaagguggg

SEQ ID NO: 3216181 - RNA, 16 nt, Human
ucagcugcugaaacaa

SEQ ID NO: 3216182 - RNA, 12 nt, Human
ucagcugcucag

SEQ ID NO: 3216183 - RNA, 15 nt, Human
ucagcugcuuuguua

SEQ ID NO: 3216184 - RNA, 16 nt, Human
ucagcugcuuuguuac

SEQ ID NO: 3216185 - RNA, 17 nt, Human
ucagcugcuuuguuacc

SEQ ID NO: 3216186 - RNA, 15 nt, Human
ucagcugcuacuacu

SEQ ID NO: 3216187 - RNA, 20 nt, Human
ucagaucauuaucagccugu

SEQ ID NO: 3216188 - RNA, 15 nt, Human
ucagauauuugcacc

SEQ ID NO: 3216189 - RNA, 14 nt, Human
ucagauauuugcac

SEQ ID NO: 3216190 - RNA, 13 nt, Human
ucagauauuugca

SEQ ID NO: 3216191 - RNA, 21 nt, Human
ucagcaccacucaagaccaaa

SEQ ID NO: 3216192 - RNA, 20 nt, Human
ucagcaccacucaagaccaa

SEQ ID NO: 3216193 - RNA, 15 nt, Human
ucagcaccacucaag

SEQ ID NO: 3216194 - RNA, 13 nt, Human
ucagcaccacuca

SEQ ID NO: 3216195 - RNA, 24 nt, Human
ucagcacauaggguucccacgaag

SEQ ID NO: 3216196 - RNA, 21 nt, Human
ucagcacauaggguucccacg

SEQ ID NO: 3216197 - RNA, 23 nt, Human
uaucauucuaaagauagaguaaa

SEQ ID NO: 3216198 - RNA, 17 nt, Human
uaucauucuaaagauag

SEQ ID NO: 3216199 - RNA, 16 nt, Human
uaucauucuaaagaua

SEQ ID NO: 3216200 - RNA, 14 nt, Human
uaucauucuaaaga

SEQ ID NO: 3216201 - RNA, 18 nt, Human
ucagcaugaaaaugugug

SEQ ID NO: 3216202 - RNA, 20 nt, Human
ucagcaugaaaauguguguu

SEQ ID NO: 3216203 - RNA, 23 nt, Human
ucagcaucugaccucuaccuuca

SEQ ID NO: 3216204 - RNA, 12 nt, Human
ucagccucccaa

SEQ ID NO: 3216205 - RNA, 18 nt, Human
ucagcauccuggcacccg

SEQ ID NO: 3216206 - RNA, 17 nt, Human
ucagcauccuggcaccc

SEQ ID NO: 3216207 - RNA, 16 nt, Human
ucagcauccuggcacc

SEQ ID NO: 3216208 - RNA, 15 nt, Human
ucagcauccuggcac

SEQ ID NO: 3216209 - RNA, 13 nt, Human
ucagcaggcagcc

SEQ ID NO: 3216210 - RNA, 12 nt, Human
ucagcaggcagc

SEQ ID NO: 3216211 - RNA, 14 nt, Human
ucagcaguugcugg

SEQ ID NO: 3216212 - RNA, 16 nt, Human
ucagcaguugcuggua

SEQ ID NO: 3216213 - RNA, 17 nt, Human
ucagcaguugcugguaa

SEQ ID NO: 3216214 - RNA, 18 nt, Human
ucagcaguugcugguaaa

SEQ ID NO: 3216215 - RNA, 19 nt, Human
ucagcaguugcugguaaaa

SEQ ID NO: 3216216 - RNA, 20 nt, Human
ucagcaguugcugguaaaau

SEQ ID NO: 3216217 - RNA, 22 nt, Human
ucagcaguugcugguaaaauga

SEQ ID NO: 3216218 - RNA, 23 nt, Human
ucagcaguugcugguaaaaugaa

SEQ ID NO: 3216219 - RNA, 13 nt, Human
ucagcaguugcug

SEQ ID NO: 3216220 - RNA, 17 nt, Human
ucagcagugagagcaga

SEQ ID NO: 3216221 - RNA, 16 nt, Human
ucagcaggcagccuug

SEQ ID NO: 3216222 - RNA, 15 nt, Human
ucagcaggcagccuu

SEQ ID NO: 3216223 - RNA, 19 nt, Human
uccugucccucauccauag

SEQ ID NO: 3216224 - RNA, 20 nt, Human
uccuuaccagcagagcaccu

SEQ ID NO: 3216225 - RNA, 21 nt, Human
uccuuaccagcagagcaccuu

SEQ ID NO: 3216226 - RNA, 20 nt, Human
uccugaggggagacagagca

SEQ ID NO: 3216227 - RNA, 19 nt, Human
uccugucaucugagaauga

SEQ ID NO: 3216228 - RNA, 23 nt, Human
uccugaggggagacagagcaacc

SEQ ID NO: 3216229 - RNA, 24 nt, Human
uccuuaggguuuucucucuauuuc

SEQ ID NO: 3216230 - RNA, 14 nt, Human
uccuuaucaaagga

SEQ ID NO: 3216231 - RNA, 15 nt, Human
uccuuaucaaaggac

SEQ ID NO: 3216232 - RNA, 15 nt, Human
uccuuacuuuuaagg

SEQ ID NO: 3216233 - RNA, 15 nt, Human
uccuuaucuagcugc

SEQ ID NO: 3216234 - RNA, 14 nt, Human
uccuuaucuagcug

SEQ ID NO: 3216235 - RNA, 17 nt, Human
uccuuaucaaaggacac

SEQ ID NO: 3216236 - RNA, 22 nt, Human
uccuugaaaacacuguucucug

SEQ ID NO: 3216237 - RNA, 23 nt, Human
uccuugaaaacacuguucucugc

SEQ ID NO: 3216238 - RNA, 17 nt, Human
uccuugcaucaauuuuu

SEQ ID NO: 3216239 - RNA, 13 nt, Human
uccuucuuugccc

SEQ ID NO: 3216240 - RNA, 19 nt, Human
uccuucuuugcccuuuacu

SEQ ID NO: 3216241 - RNA, 15 nt, Human
uccuugcaucaauuu

SEQ ID NO: 3216242 - RNA, 18 nt, Human
uccuuggugucgggcaug

SEQ ID NO: 3216243 - RNA, 21 nt, Human
uccuuggugucgggcaugaca

SEQ ID NO: 3216244 - RNA, 22 nt, Human
uccuugcugcaaggcucuuccu

SEQ ID NO: 3216245 - RNA, 18 nt, Human
uccuuugugaggaagccg

SEQ ID NO: 3216246 - RNA, 22 nt, Human
uccuuugugaggaagccgcugg

SEQ ID NO: 3216247 - RNA, 17 nt, Human
uccuuugugaggaagcc

SEQ ID NO: 3216248 - RNA, 15 nt, Human
ucggccuccauccug

SEQ ID NO: 3216249 - RNA, 16 nt, Human
ucggccuccauccuga

SEQ ID NO: 3216250 - RNA, 23 nt, Human
ucgcccagucccagcagccagcc

SEQ ID NO: 3216251 - RNA, 10 nt, Human
ucgcccauga

SEQ ID NO: 3216252 - RNA, 22 nt, Human
ucgcccaugagagcgcagcccg

SEQ ID NO: 3216253 - RNA, 23 nt, Human
ucgcccagucuggaaugcagugg

SEQ ID NO: 3216254 - RNA, 19 nt, Human
ucgcccagucuggaaugca

SEQ ID NO: 3216255 - RNA, 14 nt, Human
ucgcccagucugga

SEQ ID NO: 3216256 - RNA, 15 nt, Human
uccuuuucuguguuu

SEQ ID NO: 3216257 - RNA, 18 nt, Human
uccuuuucgcaggauucu

SEQ ID NO: 3216258 - RNA, 21 nt, Human
uccuuuguauucugucuucau

SEQ ID NO: 3216259 - RNA, 15 nt, Human
uccuuuguauucugu

SEQ ID NO: 3216260 - RNA, 18 nt, Human
uccuuuguauucugucuu

SEQ ID NO: 3216261 - RNA, 17 nt, Human
uccuuuguauucugucu

SEQ ID NO: 3216262 - RNA, 22 nt, Human
uccuuuucgcaggauucuuccu

SEQ ID NO: 3216263 - RNA, 14 nt, Human
uccuuuucuguguu

SEQ ID NO: 3216264 - RNA, 23 nt, Human
ucgcaggauucuuccucccuccc

SEQ ID NO: 3216265 - RNA, 21 nt, Human
ucgcaggauucuuccucccuc

SEQ ID NO: 3216266 - RNA, 22 nt, Human
ucgcauagaaaucaauaauuug

SEQ ID NO: 3216267 - RNA, 20 nt, Human
ucgcaggccucccugccagu

SEQ ID NO: 3216268 - RNA, 19 nt, Human
ucgcaggccucccugccag

SEQ ID NO: 3216269 - RNA, 15 nt, Human
ucgcaggccucccug

SEQ ID NO: 3216270 - RNA, 17 nt, Human
ucgcaggauucuuccuc

SEQ ID NO: 3216271 - RNA, 22 nt, Human
ucucaguuuuucuuaauauaua

SEQ ID NO: 3216272 - RNA, 21 nt, Human
ucucaguuuuucuuaauauau

SEQ ID NO: 3216273 - RNA, 18 nt, Human
ucucaguuuuucuuaaua

SEQ ID NO: 3216274 - RNA, 12 nt, Human
ucucaguuuuuc

SEQ ID NO: 3216275 - RNA, 15 nt, Human
ucucaguuuuucuua

SEQ ID NO: 3216276 - RNA, 13 nt, Human
ucucaguuuuucu

SEQ ID NO: 3216277 - RNA, 15 nt, Human
ucucacuguugccca

SEQ ID NO: 3216278 - RNA, 14 nt, Human
ucucacuguugccc

SEQ ID NO: 3216279 - RNA, 19 nt, Human
ucucagaccgucuuccucc

SEQ ID NO: 3216280 - RNA, 14 nt, Human
ucucagaggcccca

SEQ ID NO: 3216281 - RNA, 17 nt, Human
ucucagauauuugcacc

SEQ ID NO: 3216282 - RNA, 14 nt, Human
ucucagauauuugc

SEQ ID NO: 3216283 - RNA, 14 nt, Human
ucucagauguuaaa

SEQ ID NO: 3216284 - RNA, 18 nt, Human
ucucagauguuaaaauaa

SEQ ID NO: 3216285 - RNA, 19 nt, Human
ucucagauguuaaaauaaa

SEQ ID NO: 3216286 - RNA, 20 nt, Human
ucucagauguuaaaauaaau

SEQ ID NO: 3216287 - RNA, 18 nt, Human
ucuauauuagaucaaaua

SEQ ID NO: 3216288 - RNA, 22 nt, Human
ucuauauuauugcccaugauau

SEQ ID NO: 3216289 - RNA, 14 nt, Human
ucuaucugguauua

SEQ ID NO: 3216290 - RNA, 21 nt, Human
ucuaucugguauuaaaugcca

SEQ ID NO: 3216291 - RNA, 10 nt, Human
ucuaucuacu

SEQ ID NO: 3216292 - RNA, 22 nt, Human
ucuaucuuugagcgcccacuag

SEQ ID NO: 3216293 - RNA, 16 nt, Human
ucucacacaugagcau

SEQ ID NO: 3216294 - RNA, 22 nt, Human
ucucaauuuuugguugaauaaa

SEQ ID NO: 3216295 - RNA, 13 nt, Human
ucucaauuuuugg

SEQ ID NO: 3216296 - RNA, 20 nt, Human
ucucacugccaugccagcuu

SEQ ID NO: 3216297 - RNA, 22 nt, Human
ucucacucugucgcccagucug

SEQ ID NO: 3216298 - RNA, 21 nt, Human
ucucacacaugagcaucaggc

SEQ ID NO: 3216299 - RNA, 23 nt, Human
ucucacucugucgcccagucugg

SEQ ID NO: 3216300 - RNA, 18 nt, Human
ucuacucuagggaaaaac

SEQ ID NO: 3216301 - RNA, 18 nt, Human
ucuaggaggucucuaaga

SEQ ID NO: 3216302 - RNA, 20 nt, Human
ucuacucgaguuacagacaa

SEQ ID NO: 3216303 - RNA, 21 nt, Human
ucuacucgaguuacagacaaa

SEQ ID NO: 3216304 - RNA, 15 nt, Human
ucuacucauuuuaau

SEQ ID NO: 3216305 - RNA, 12 nt, Human
ucuagggaaaaa

SEQ ID NO: 3216306 - RNA, 19 nt, Human
ucuacuaaaaauacaaaaa

SEQ ID NO: 3216307 - RNA, 15 nt, Human
ucuacuaaaaauaca

SEQ ID NO: 3216308 - RNA, 19 nt, Human
ucuaauuuuauuuugugaa

SEQ ID NO: 3216309 - RNA, 14 nt, Human
ucuacuauuuaugu

SEQ ID NO: 3216310 - RNA, 12 nt, Human
ucuacuaaaaau

SEQ ID NO: 3216311 - RNA, 14 nt, Human
ucuaauuugcugcu

SEQ ID NO: 3216312 - RNA, 15 nt, Human
ucuaauuugcugcug

SEQ ID NO: 3216313 - RNA, 21 nt, Human
ucuaauuggcuuuacuauuuu

SEQ ID NO: 3216314 - RNA, 14 nt, Human
ucuaauauguaaca

SEQ ID NO: 3216315 - RNA, 18 nt, Human
ucgucgagcuccccccag

SEQ ID NO: 3216316 - RNA, 21 nt, Human
ucuaauggauuauaaucagaa

SEQ ID NO: 3216317 - RNA, 23 nt, Human
ucccucuacugggagccuaccca

SEQ ID NO: 3216318 - RNA, 18 nt, Human
ucccuccgggucuuccua

SEQ ID NO: 3216319 - RNA, 15 nt, Human
ucccucuccagcagg

SEQ ID NO: 3216320 - RNA, 16 nt, Human
ucccucucugcuggac

SEQ ID NO: 3216321 - RNA, 14 nt, Human
ucccugccaaugga

SEQ ID NO: 3216322 - RNA, 16 nt, Human
ucccugccaauggacu

SEQ ID NO: 3216323 - RNA, 13 nt, Human
ucccucuggggcu

SEQ ID NO: 3216324 - RNA, 17 nt, Human
ucccucuggggcuguuc

SEQ ID NO: 3216325 - RNA, 20 nt, Human
ucccugcacuugcagacucu

SEQ ID NO: 3216326 - RNA, 22 nt, Human
ucccucuacugggagccuaccc

SEQ ID NO: 3216327 - RNA, 18 nt, Human
ucccucuacugggagccu

SEQ ID NO: 3216328 - RNA, 20 nt, Human
ucccuccgcggcgggcccug

SEQ ID NO: 3216329 - RNA, 13 nt, Human
ucccucccuuggg

SEQ ID NO: 3216330 - RNA, 14 nt, Human
ucccucccuugggg

SEQ ID NO: 3216331 - RNA, 18 nt, Human
ucccucccuuccucuuuc

SEQ ID NO: 3216332 - RNA, 17 nt, Human
ucccuacuuccugugac

SEQ ID NO: 3216333 - RNA, 22 nt, Human
ucccaugagccucagcauccug

SEQ ID NO: 3216334 - RNA, 22 nt, Human
ucccuaccgagucucuucucca

SEQ ID NO: 3216335 - RNA, 21 nt, Human
ucccuaccgagucucuucucc

SEQ ID NO: 3216336 - RNA, 19 nt, Human
ucccuaccgagucucuucu

SEQ ID NO: 3216337 - RNA, 21 nt, Human
uccgacuugugcacaggcaga

SEQ ID NO: 3216338 - RNA, 14 nt, Human
uccgccccugagcc

SEQ ID NO: 3216339 - RNA, 17 nt, Human
uccgccccugagcccac

SEQ ID NO: 3216340 - RNA, 16 nt, Human
uccgccccugagccca

SEQ ID NO: 3216341 - RNA, 15 nt, Human
uccgccccugagccc

SEQ ID NO: 3216342 - RNA, 21 nt, Human
uccgcuuucuacccagcgagc

SEQ ID NO: 3216343 - RNA, 20 nt, Human
uccgcuuucuacccagcgag

SEQ ID NO: 3216344 - RNA, 21 nt, Human
uccgccccugagcccacugug

SEQ ID NO: 3216345 - RNA, 20 nt, Human
uccgccccugagcccacugu

SEQ ID NO: 3216346 - RNA, 19 nt, Human
uccgccccugagcccacug

SEQ ID NO: 3216347 - RNA, 18 nt, Human
uccgccccugagcccacu

SEQ ID NO: 3216348 - RNA, 22 nt, Human
uccgaaagggacuuggaagcuc

SEQ ID NO: 3216349 - RNA, 17 nt, Human
uccgaccagacaccuug

SEQ ID NO: 3216350 - RNA, 17 nt, Human
uccgaaaugcugucuuu

SEQ ID NO: 3216351 - RNA, 14 nt, Human
uccgaaaucagcag

SEQ ID NO: 3216352 - RNA, 20 nt, Human
uccgaaaugcugucuuucuu

SEQ ID NO: 3216353 - RNA, 19 nt, Human
uccgaccuggccugucugu

SEQ ID NO: 3216354 - RNA, 21 nt, Human
uccgaaagggacuuggaagcu

SEQ ID NO: 3216355 - RNA, 17 nt, Human
ucccuucuuuuucuucu

SEQ ID NO: 3216356 - RNA, 16 nt, Human
ucccuggcuuccuuac

SEQ ID NO: 3216357 - RNA, 15 nt, Human
ucccuggcuuccuua

SEQ ID NO: 3216358 - RNA, 17 nt, Human
ucccuggcuuccuuacu

SEQ ID NO: 3216359 - RNA, 12 nt, Human
ucccuggcuucc

SEQ ID NO: 3216360 - RNA, 18 nt, Human
ucccugccccucccuuca

SEQ ID NO: 3216361 - RNA, 16 nt, Human
ucccugccccccagcc

SEQ ID NO: 3216362 - RNA, 14 nt, Human
ucccugccccuccc

SEQ ID NO: 3216363 - RNA, 17 nt, Human
ucccuucccaccucucu

SEQ ID NO: 3216364 - RNA, 21 nt, Human
ucccuucccacuggaggcaug

SEQ ID NO: 3216365 - RNA, 21 nt, Human
ucccuucucuuccaggcagcc

SEQ ID NO: 3216366 - RNA, 20 nt, Human
ucccuucucuuccaggcagc

SEQ ID NO: 3216367 - RNA, 16 nt, Human
ucccuucucuuccagg

SEQ ID NO: 3216368 - RNA, 12 nt, Human
ucccuucucuuc

SEQ ID NO: 3216369 - RNA, 15 nt, Human
ucccuucucuuccag

SEQ ID NO: 3216370 - RNA, 14 nt, Human
ucccuucucuucca

SEQ ID NO: 3216371 - RNA, 14 nt, Human
ucccuucccaccuc

SEQ ID NO: 3216372 - RNA, 16 nt, Human
ucccuucccaccucuc

SEQ ID NO: 3216373 - RNA, 21 nt, Human
uccucuaggaggucucuaaga

SEQ ID NO: 3216374 - RNA, 17 nt, Human
uccucuaggaggucucu

SEQ ID NO: 3216375 - RNA, 21 nt, Human
uccuccuuuucacaguucucu

SEQ ID NO: 3216376 - RNA, 13 nt, Human
uccuccuggacuc

SEQ ID NO: 3216377 - RNA, 14 nt, Human
uccuccugcugcca

SEQ ID NO: 3216378 - RNA, 15 nt, Human
uccuccugcugccag

SEQ ID NO: 3216379 - RNA, 17 nt, Human
uccucugcugcuggcug

SEQ ID NO: 3216380 - RNA, 14 nt, Human
uccucuauccuggg

SEQ ID NO: 3216381 - RNA, 13 nt, Human
uccucuguacaga

SEQ ID NO: 3216382 - RNA, 15 nt, Human
uccucuggccugugu

SEQ ID NO: 3216383 - RNA, 15 nt, Human
uccugaggcuccacu

SEQ ID NO: 3216384 - RNA, 14 nt, Human
uccugagccagauu

SEQ ID NO: 3216385 - RNA, 18 nt, Human
uccugagccagauuucac

SEQ ID NO: 3216386 - RNA, 19 nt, Human
uccugagccagauuucacu

SEQ ID NO: 3216387 - RNA, 17 nt, Human
uccugagccagauuuca

SEQ ID NO: 3216388 - RNA, 17 nt, Human
uccucuguccaggcacu

SEQ ID NO: 3216389 - RNA, 23 nt, Human
uccucuguacagagcccacgccc

SEQ ID NO: 3216390 - RNA, 19 nt, Human
uccucuguacagagcccac

SEQ ID NO: 3216391 - RNA, 16 nt, Human
uccugaggcuccacuu

SEQ ID NO: 3216392 - RNA, 21 nt, Human
uccugaggcuccacuuggucu

SEQ ID NO: 3216393 - RNA, 12 nt, Human
uccugaggcugg

SEQ ID NO: 3216394 - RNA, 15 nt, Human
uccugaggcugggcu

SEQ ID NO: 3216395 - RNA, 16 nt, Human
uccugaggcugggcuc

SEQ ID NO: 3216396 - RNA, 17 nt, Human
uccugaggcugggcucc

SEQ ID NO: 3216397 - RNA, 19 nt, Human
uccugaggcugggcucccu

SEQ ID NO: 3216398 - RNA, 16 nt, Human
uccuaagcuauucagu

SEQ ID NO: 3216399 - RNA, 20 nt, Human
uccuaagauguguucuuauu

SEQ ID NO: 3216400 - RNA, 23 nt, Human
uccuaagauguguucuuauuuuu

SEQ ID NO: 3216401 - RNA, 21 nt, Human
uccggaacguagucggcacag

SEQ ID NO: 3216402 - RNA, 14 nt, Human
uccuaguuccacca

SEQ ID NO: 3216403 - RNA, 17 nt, Human
uccuaguuccaccauca

SEQ ID NO: 3216404 - RNA, 12 nt, Human
uccuaguuccac

SEQ ID NO: 3216405 - RNA, 21 nt, Human
uccuaguuccaccaucaagcc

SEQ ID NO: 3216406 - RNA, 17 nt, Human
uccuaucagaaguuucu

SEQ ID NO: 3216407 - RNA, 13 nt, Human
uccuaugcuuuag

SEQ ID NO: 3216408 - RNA, 12 nt, Human
uccuauuucaga

SEQ ID NO: 3216409 - RNA, 15 nt, Human
uccuauuuagacaug

SEQ ID NO: 3216410 - RNA, 20 nt, Human
uccuauuucagaaguuuaaa

SEQ ID NO: 3216411 - RNA, 16 nt, Human
uccuauuucagaaguu

SEQ ID NO: 3216412 - RNA, 14 nt, Human
uccuauuucagaag

SEQ ID NO: 3216413 - RNA, 13 nt, Human
uccuauuucagaa

SEQ ID NO: 3216414 - RNA, 14 nt, Human
uccuccaggugcac

SEQ ID NO: 3216415 - RNA, 18 nt, Human
uccuccaggugcacaagc

SEQ ID NO: 3216416 - RNA, 20 nt, Human
uccuccaggugcacaagcuc

SEQ ID NO: 3216417 - RNA, 22 nt, Human
uccuccaggugcacaagcucca

SEQ ID NO: 3216418 - RNA, 12 nt, Human
uccuccaggugc

SEQ ID NO: 3216419 - RNA, 13 nt, Human
uccuccaggugca

SEQ ID NO: 3216420 - RNA, 10 nt, Human
uccuccaggu

SEQ ID NO: 3216421 - RNA, 12 nt, Human
uccuccucagau

SEQ ID NO: 3216422 - RNA, 16 nt, Human
uccuccugacacccca

SEQ ID NO: 3216423 - RNA, 21 nt, Human
uccuccugacaccccacuuag

SEQ ID NO: 3216424 - RNA, 18 nt, Human
uccuccugacaccccacu

SEQ ID NO: 3216425 - RNA, 22 nt, Human
uccuccugacaccccacuuagc

SEQ ID NO: 3216426 - RNA, 14 nt, Human
uggaauaucuacuu

SEQ ID NO: 3216427 - RNA, 20 nt, Human
uggaaugaugggucaguugu

SEQ ID NO: 3216428 - RNA, 15 nt, Human
uggaaugcacucaga

SEQ ID NO: 3216429 - RNA, 13 nt, Human
uggaaugaggguu

SEQ ID NO: 3216430 - RNA, 13 nt, Human
uggacaugcacag

SEQ ID NO: 3216431 - RNA, 19 nt, Human
uggacaugcacagcuaaca

SEQ ID NO: 3216432 - RNA, 20 nt, Human
uggacuaacuugucuuugga

SEQ ID NO: 3216433 - RNA, 18 nt, Human
uggacucaccucccccau

SEQ ID NO: 3216434 - RNA, 20 nt, Human
uggacucaccucccccaucu

SEQ ID NO: 3216435 - RNA, 19 nt, Human
uggaauaacauguaauuaa

SEQ ID NO: 3216436 - RNA, 15 nt, Human
uggaauaacauguaa

SEQ ID NO: 3216437 - RNA, 14 nt, Human
uggaauaacaugua

SEQ ID NO: 3216438 - RNA, 23 nt, Human
uggaauaaaaauuccagaaugaa

SEQ ID NO: 3216439 - RNA, 18 nt, Human
uggaauaaaaauuccaga

SEQ ID NO: 3216440 - RNA, 17 nt, Human
uggaauaaggagaauga

SEQ ID NO: 3216441 - RNA, 20 nt, Human
uggaaagaguaggaagacuu

SEQ ID NO: 3216442 - RNA, 21 nt, Human
uggaacauaaaauacaauguu

SEQ ID NO: 3216443 - RNA, 20 nt, Human
uggaacauaaaauacaaugu

SEQ ID NO: 3216444 - RNA, 14 nt, Human
uggaaaacuuaguu

SEQ ID NO: 3216445 - RNA, 18 nt, Human
uggaaaaugccaugaauu

SEQ ID NO: 3216446 - RNA, 18 nt, Human
uggaaacacuaaauguua

SEQ ID NO: 3216447 - RNA, 17 nt, Human
uggaaacacuaaauguu

SEQ ID NO: 3216448 - RNA, 16 nt, Human
uggaaacacuaaaugu

SEQ ID NO: 3216449 - RNA, 13 nt, Human
uggaaacacuaaa

SEQ ID NO: 3216450 - RNA, 17 nt, Human
uggaaacagcucgacuu

SEQ ID NO: 3216451 - RNA, 23 nt, Human
uggaaacacuaaauguuaaagau

SEQ ID NO: 3216452 - RNA, 22 nt, Human
uggaaacacuaaauguuaaaga

SEQ ID NO: 3216453 - RNA, 20 nt, Human
uggaaacacuaaauguuaaa

SEQ ID NO: 3216454 - RNA, 19 nt, Human
uggaaacacuaaauguuaa

SEQ ID NO: 3216455 - RNA, 22 nt, Human
uggaaacagcucgacuuuaaaa

SEQ ID NO: 3216456 - RNA, 20 nt, Human
uggaaacagaggaccagcac

SEQ ID NO: 3216457 - RNA, 18 nt, Human
uggaaacagaggaccagc

SEQ ID NO: 3216458 - RNA, 21 nt, Human
uggaaagacuuuuccaacccu

SEQ ID NO: 3216459 - RNA, 17 nt, Human
uggaaaaauagccugcc

SEQ ID NO: 3216460 - RNA, 20 nt, Human
uggaaaaauagccugccucu

SEQ ID NO: 3216461 - RNA, 13 nt, Human
uggaaaaaugcca

SEQ ID NO: 3216462 - RNA, 19 nt, Human
uggaaaaaugccaucaaau

SEQ ID NO: 3216463 - RNA, 14 nt, Human
ugcuuuagacuuga

SEQ ID NO: 3216464 - RNA, 15 nt, Human
ugcuuuagacuugaa

SEQ ID NO: 3216465 - RNA, 16 nt, Human
ugcuuuagacuugaaa

SEQ ID NO: 3216466 - RNA, 22 nt, Human
ugcuuucuuucguuuguuuguu

SEQ ID NO: 3216467 - RNA, 15 nt, Human
ugcuuucuuucguuu

SEQ ID NO: 3216468 - RNA, 17 nt, Human
ugcuuuaauuuuagcaa

SEQ ID NO: 3216469 - RNA, 15 nt, Human
ugcuuuaauuuuagc

SEQ ID NO: 3216470 - RNA, 14 nt, Human
ugcuuuaauuuuag

SEQ ID NO: 3216471 - RNA, 21 nt, Human
uggccagaugcaccagcccuu

SEQ ID NO: 3216472 - RNA, 20 nt, Human
uggccagaugcaccagcccu

SEQ ID NO: 3216473 - RNA, 17 nt, Human
uggccacuccagacccc

SEQ ID NO: 3216474 - RNA, 23 nt, Human
uggcagcugcgguccacccagga

SEQ ID NO: 3216475 - RNA, 21 nt, Human
uggcaccuucccccuccccca

SEQ ID NO: 3216476 - RNA, 13 nt, Human
uggcagcugcuuu

SEQ ID NO: 3216477 - RNA, 19 nt, Human
uggcaggaguuggaagugu

SEQ ID NO: 3216478 - RNA, 21 nt, Human
uggcaggacacugcagaacag

SEQ ID NO: 3216479 - RNA, 21 nt, Human
uggcacccggccccugcuggu

SEQ ID NO: 3216480 - RNA, 22 nt, Human
uggcaccuccucggcuggcugu

SEQ ID NO: 3216481 - RNA, 13 nt, Human
uggcaccuucccc

SEQ ID NO: 3216482 - RNA, 23 nt, Human
uggcaccugucugcuccagcucu

SEQ ID NO: 3216483 - RNA, 21 nt, Human
uggcaccugucugcuccagcu

SEQ ID NO: 3216484 - RNA, 19 nt, Human
uggcaccugucugcuccag

SEQ ID NO: 3216485 - RNA, 18 nt, Human
uggcaccugucugcucca

SEQ ID NO: 3216486 - RNA, 14 nt, Human
uggcaccugucugc

SEQ ID NO: 3216487 - RNA, 13 nt, Human
uggcaccugucug

SEQ ID NO: 3216488 - RNA, 20 nt, Human
uggcagguaggaauauuaua

SEQ ID NO: 3216489 - RNA, 17 nt, Human
uggcagguaggaauauu

SEQ ID NO: 3216490 - RNA, 23 nt, Human
uggcagguaggaauauuauauuu

SEQ ID NO: 3216491 - RNA, 14 nt, Human
uggcaggugagcaa

SEQ ID NO: 3216492 - RNA, 22 nt, Human
uggcaggugauguccuguaaac

SEQ ID NO: 3216493 - RNA, 12 nt, Human
uggagggaaagc

SEQ ID NO: 3216494 - RNA, 13 nt, Human
uggagggccuggg

SEQ ID NO: 3216495 - RNA, 12 nt, Human
uggagggccugg

SEQ ID NO: 3216496 - RNA, 22 nt, Human
uggagggccugggccuggcucc

SEQ ID NO: 3216497 - RNA, 18 nt, Human
uggagggccugggccugg

SEQ ID NO: 3216498 - RNA, 17 nt, Human
uggagggccugggccug

SEQ ID NO: 3216499 - RNA, 15 nt, Human
uggagggccugggcc

SEQ ID NO: 3216500 - RNA, 15 nt, Human
uggaggaccugcccg

SEQ ID NO: 3216501 - RNA, 12 nt, Human
uggaggaaggaa

SEQ ID NO: 3216502 - RNA, 18 nt, Human
uggaggaaggaaacccag

SEQ ID NO: 3216503 - RNA, 15 nt, Human
uggaggaagaacuga

SEQ ID NO: 3216504 - RNA, 17 nt, Human
uggaggaagaacugaaa

SEQ ID NO: 3216505 - RNA, 20 nt, Human
uggaggaagaacugaaaggc

SEQ ID NO: 3216506 - RNA, 15 nt, Human
uggacuccugcacac

SEQ ID NO: 3216507 - RNA, 14 nt, Human
uggacuccucuguc

SEQ ID NO: 3216508 - RNA, 15 nt, Human
uggacuccucugucc

SEQ ID NO: 3216509 - RNA, 14 nt, Human
uggacucuaaaguc

SEQ ID NO: 3216510 - RNA, 18 nt, Human
uggauccuugucaguugu

SEQ ID NO: 3216511 - RNA, 12 nt, Human
uggaucaggaaa

SEQ ID NO: 3216512 - RNA, 19 nt, Human
uggcaacaaacugcacaug

SEQ ID NO: 3216513 - RNA, 18 nt, Human
uggcaacaaacugcacau

SEQ ID NO: 3216514 - RNA, 17 nt, Human
uggcaacaaacugcaca

SEQ ID NO: 3216515 - RNA, 13 nt, Human
uggcaacaaacug

SEQ ID NO: 3216516 - RNA, 15 nt, Human
uggcaacaaacugca

SEQ ID NO: 3216517 - RNA, 14 nt, Human
uggcaacaaacugc

SEQ ID NO: 3216518 - RNA, 17 nt, Human
uggauuuggagagaaau

SEQ ID NO: 3216519 - RNA, 16 nt, Human
uggauuuggagagaaa

SEQ ID NO: 3216520 - RNA, 22 nt, Human
uggauuuggagagaaauauuuu

SEQ ID NO: 3216521 - RNA, 21 nt, Human
uggauuuggagagaaauauuu

SEQ ID NO: 3216522 - RNA, 20 nt, Human
uggauuuggagagaaauauu

SEQ ID NO: 3216523 - RNA, 19 nt, Human
uggauuuggagagaaauau

SEQ ID NO: 3216524 - RNA, 22 nt, Human
uggauuuuauguugacauuugu

SEQ ID NO: 3216525 - RNA, 16 nt, Human
uggauuuuauguugac

SEQ ID NO: 3216526 - RNA, 15 nt, Human
uggauuuuauguuga

SEQ ID NO: 3216527 - RNA, 13 nt, Human
uggauuuuauguu

SEQ ID NO: 3216528 - RNA, 20 nt, Human
uggggauugggccccugcca

SEQ ID NO: 3216529 - RNA, 16 nt, Human
ugggggaugggccuga

SEQ ID NO: 3216530 - RNA, 21 nt, Human
ugggggaucacagccucugaa

SEQ ID NO: 3216531 - RNA, 20 nt, Human
ugggggaucacagccucuga

SEQ ID NO: 3216532 - RNA, 20 nt, Human
uggggauucagauuucucuu

SEQ ID NO: 3216533 - RNA, 18 nt, Human
uggggauucagauuucuc

SEQ ID NO: 3216534 - RNA, 16 nt, Human
uggggauucagauuuc

SEQ ID NO: 3216535 - RNA, 13 nt, Human
uggggauucagau

SEQ ID NO: 3216536 - RNA, 18 nt, Human
ugggggucuguguguuua

SEQ ID NO: 3216537 - RNA, 15 nt, Human
ugggggucugugugu

SEQ ID NO: 3216538 - RNA, 23 nt, Human
ugggggcucagcaaggccaccuc

SEQ ID NO: 3216539 - RNA, 11 nt, Human
ugggggaugua

SEQ ID NO: 3216540 - RNA, 17 nt, Human
ugggggaugggccugag

SEQ ID NO: 3216541 - RNA, 18 nt, Human
ugggggcucagcaaggcc

SEQ ID NO: 3216542 - RNA, 17 nt, Human
ugggggcucagcaaggc

SEQ ID NO: 3216543 - RNA, 17 nt, Human
ugggggcugggcagagg

SEQ ID NO: 3216544 - RNA, 18 nt, Human
ugggggcugggcagagga

SEQ ID NO: 3216545 - RNA, 15 nt, Human
ugggcuucaguggca

SEQ ID NO: 3216546 - RNA, 21 nt, Human
uggggaaacaacauuuauaug

SEQ ID NO: 3216547 - RNA, 16 nt, Human
ugggcagaggaaagca

SEQ ID NO: 3216548 - RNA, 22 nt, Human
ugggcagaucucccacaugcca

SEQ ID NO: 3216549 - RNA, 22 nt, Human
ugggcuaagugauccucccacc

SEQ ID NO: 3216550 - RNA, 20 nt, Human
ugggcgugagaccugccccu

SEQ ID NO: 3216551 - RNA, 23 nt, Human
ugggcuggguucuacccaggugc

SEQ ID NO: 3216552 - RNA, 17 nt, Human
ugggcuggugucaccug

SEQ ID NO: 3216553 - RNA, 16 nt, Human
ugggcuaguugggcuu

SEQ ID NO: 3216554 - RNA, 18 nt, Human
uggguggggggcuucaua

SEQ ID NO: 3216555 - RNA, 21 nt, Human
uggguggggggcuucauacac

SEQ ID NO: 3216556 - RNA, 20 nt, Human
uggguggggggcuucauaca

SEQ ID NO: 3216557 - RNA, 19 nt, Human
ugggguuuaucagaauucu

SEQ ID NO: 3216558 - RNA, 16 nt, Human
uggguaacuagggaag

SEQ ID NO: 3216559 - RNA, 15 nt, Human
uggguucuacccagg

SEQ ID NO: 3216560 - RNA, 16 nt, Human
uggguucuacccaggu

SEQ ID NO: 3216561 - RNA, 22 nt, Human
uggguucuacccaggugcuagg

SEQ ID NO: 3216562 - RNA, 14 nt, Human
uggguguggcgcag

SEQ ID NO: 3216563 - RNA, 14 nt, Human
uggguuagacugcc

SEQ ID NO: 3216564 - RNA, 20 nt, Human
uggguuagacugccagcucu

SEQ ID NO: 3216565 - RNA, 19 nt, Human
uggguuagacugccagcuc

SEQ ID NO: 3216566 - RNA, 16 nt, Human
uggguuagacugccag

SEQ ID NO: 3216567 - RNA, 15 nt, Human
uggguuagacugcca

SEQ ID NO: 3216568 - RNA, 15 nt, Human
ugguauuaaaugcca

SEQ ID NO: 3216569 - RNA, 16 nt, Human
ugguauuaauaaaaag

SEQ ID NO: 3216570 - RNA, 22 nt, Human
ugguauauccuuuucuguguuu

SEQ ID NO: 3216571 - RNA, 14 nt, Human
ugguaucaaaauua

SEQ ID NO: 3216572 - RNA, 16 nt, Human
ugguaucaaaauuaca

SEQ ID NO: 3216573 - RNA, 18 nt, Human
ugguaucaaaauuacaua

SEQ ID NO: 3216574 - RNA, 21 nt, Human
uggguuucuaaagcugccagc

SEQ ID NO: 3216575 - RNA, 17 nt, Human
uggguuucuaaagcugc

SEQ ID NO: 3216576 - RNA, 18 nt, Human
uggguuucuaaagcugcc

SEQ ID NO: 3216577 - RNA, 17 nt, Human
ugguaguuucugugguu

SEQ ID NO: 3216578 - RNA, 15 nt, Human
ugguaguuucugugg

SEQ ID NO: 3216579 - RNA, 14 nt, Human
ugggagauguggaa

SEQ ID NO: 3216580 - RNA, 13 nt, Human
ugggagcaaaaga

SEQ ID NO: 3216581 - RNA, 14 nt, Human
ugggagcugccugu

SEQ ID NO: 3216582 - RNA, 13 nt, Human
ugggagcugccug

SEQ ID NO: 3216583 - RNA, 12 nt, Human
ugggagcugccu

SEQ ID NO: 3216584 - RNA, 18 nt, Human
ugggagauuuuuuugagu

SEQ ID NO: 3216585 - RNA, 12 nt, Human
ugggacacccug

SEQ ID NO: 3216586 - RNA, 22 nt, Human
ugggacaacuguagaggcaguu

SEQ ID NO: 3216587 - RNA, 16 nt, Human
ugggacgcucugcugu

SEQ ID NO: 3216588 - RNA, 15 nt, Human
ugggacgcucugcug

SEQ ID NO: 3216589 - RNA, 21 nt, Human
ugggagugaggaugucugggc

SEQ ID NO: 3216590 - RNA, 14 nt, Human
ugggauccuccagg

SEQ ID NO: 3216591 - RNA, 15 nt, Human
ugggauccuccaggu

SEQ ID NO: 3216592 - RNA, 15 nt, Human
ugggagugagcuggu

SEQ ID NO: 3216593 - RNA, 20 nt, Human
ugggaguaguuggagcauug

SEQ ID NO: 3216594 - RNA, 22 nt, Human
ugggagcugccuguucagcucc

SEQ ID NO: 3216595 - RNA, 21 nt, Human
ugggagcugccuguucagcuc

SEQ ID NO: 3216596 - RNA, 17 nt, Human
ugggagcugccuguuca

SEQ ID NO: 3216597 - RNA, 18 nt, Human
ugggauuacaggcuccug

SEQ ID NO: 3216598 - RNA, 16 nt, Human
ugggauuacaggugug

SEQ ID NO: 3216599 - RNA, 18 nt, Human
ugggauccuccaggugca

SEQ ID NO: 3216600 - RNA, 13 nt, Human
ugggauccuggag

SEQ ID NO: 3216601 - RNA, 15 nt, Human
ugggcagaggaaagc

SEQ ID NO: 3216602 - RNA, 17 nt, Human
ugggauuauauaucccu

SEQ ID NO: 3216603 - RNA, 17 nt, Human
ugggauuacagguguga

SEQ ID NO: 3216604 - RNA, 16 nt, Human
uggcuucggacaaaau

SEQ ID NO: 3216605 - RNA, 18 nt, Human
uggcuucggacaaaauau

SEQ ID NO: 3216606 - RNA, 20 nt, Human
uggcuucggacaaaauaucu

SEQ ID NO: 3216607 - RNA, 22 nt, Human
uggcuuccuaaaauucagugga

SEQ ID NO: 3216608 - RNA, 21 nt, Human
uggcugggggccucagugcca

SEQ ID NO: 3216609 - RNA, 16 nt, Human
uggcugcuucaaggau

SEQ ID NO: 3216610 - RNA, 21 nt, Human
uggcugcuucaaggauccuga

SEQ ID NO: 3216611 - RNA, 17 nt, Human
uggcccauguauggcca

SEQ ID NO: 3216612 - RNA, 21 nt, Human
uggcccauguauggccaggaa

SEQ ID NO: 3216613 - RNA, 18 nt, Human
uggcccauguauggccag

SEQ ID NO: 3216614 - RNA, 23 nt, Human
uggccccaccuggcccucucuga

SEQ ID NO: 3216615 - RNA, 12 nt, Human
uggccccaccug

SEQ ID NO: 3216616 - RNA, 18 nt, Human
uggccccacaccagcccc

SEQ ID NO: 3216617 - RNA, 19 nt, Human
uggccccaccuggcccucu

SEQ ID NO: 3216618 - RNA, 17 nt, Human
uggccccaccuggcccu

SEQ ID NO: 3216619 - RNA, 16 nt, Human
uggccccaccuggccc

SEQ ID NO: 3216620 - RNA, 13 nt, Human
uggccccaccugg

SEQ ID NO: 3216621 - RNA, 18 nt, Human
ugccaggauggaaugaug

SEQ ID NO: 3216622 - RNA, 15 nt, Human
ugccaggcacaggca

SEQ ID NO: 3216623 - RNA, 14 nt, Human
ugccaggcacaggc

SEQ ID NO: 3216624 - RNA, 22 nt, Human
ugccaggcacaggcagggcagg

SEQ ID NO: 3216625 - RNA, 21 nt, Human
ugccaggcacaggcagggcag

SEQ ID NO: 3216626 - RNA, 20 nt, Human
ugccaggcacaggcagggca

SEQ ID NO: 3216627 - RNA, 19 nt, Human
ugccaggcacaggcagggc

SEQ ID NO: 3216628 - RNA, 18 nt, Human
ugccaggcacaggcaggg

SEQ ID NO: 3216629 - RNA, 17 nt, Human
ugccaggcacaggcagg

SEQ ID NO: 3216630 - RNA, 16 nt, Human
ugccaggcacaggcag

SEQ ID NO: 3216631 - RNA, 21 nt, Human
ugccacuaccccuugauuuuc

SEQ ID NO: 3216632 - RNA, 22 nt, Human
ugccagguuuuuggucugaccc

SEQ ID NO: 3216633 - RNA, 19 nt, Human
ugccagguuuuuggucuga

SEQ ID NO: 3216634 - RNA, 18 nt, Human
ugccagguuuuuggucug

SEQ ID NO: 3216635 - RNA, 20 nt, Human
ugccacuaaauugacacuua

SEQ ID NO: 3216636 - RNA, 19 nt, Human
ugccacccuggggagaaag

SEQ ID NO: 3216637 - RNA, 22 nt, Human
ugccacuacggaauaguuggcu

SEQ ID NO: 3216638 - RNA, 20 nt, Human
ugccacuaccccuugauuuu

SEQ ID NO: 3216639 - RNA, 15 nt, Human
ugccacccugcugag

SEQ ID NO: 3216640 - RNA, 14 nt, Human
ugcaucaagaugug

SEQ ID NO: 3216641 - RNA, 14 nt, Human
ugcauaucuucauc

SEQ ID NO: 3216642 - RNA, 17 nt, Human
ugcccacccuccacucu

SEQ ID NO: 3216643 - RNA, 20 nt, Human
ugccauccagguucagcuug

SEQ ID NO: 3216644 - RNA, 21 nt, Human
ugccauccagguucagcuugu

SEQ ID NO: 3216645 - RNA, 13 nt, Human
ugcccacucccug

SEQ ID NO: 3216646 - RNA, 13 nt, Human
ugcccaccuggcc

SEQ ID NO: 3216647 - RNA, 20 nt, Human
ugcccaggcuggagugcagu

SEQ ID NO: 3216648 - RNA, 15 nt, Human
ugcccaggcuggagu

SEQ ID NO: 3216649 - RNA, 17 nt, Human
ugcccaggccugccugu

SEQ ID NO: 3216650 - RNA, 18 nt, Human
ugcccaggcuggagugca

SEQ ID NO: 3216651 - RNA, 14 nt, Human
ugcccacucccugc

SEQ ID NO: 3216652 - RNA, 15 nt, Human
ugcccacucccugca

SEQ ID NO: 3216653 - RNA, 16 nt, Human
ugcccacucccugcaa

SEQ ID NO: 3216654 - RNA, 11 nt, Human
ugcccaggcug

SEQ ID NO: 3216655 - RNA, 15 nt, Human
ugcccaguacauuua

SEQ ID NO: 3216656 - RNA, 19 nt, Human
ugcccaguacauuuaaauu

SEQ ID NO: 3216657 - RNA, 19 nt, Human
ugcccagguggcuguggaa

SEQ ID NO: 3216658 - RNA, 17 nt, Human
ugcccagguggcugugg

SEQ ID NO: 3216659 - RNA, 17 nt, Human
ugcccaugcugggcucc

SEQ ID NO: 3216660 - RNA, 14 nt, Human
ugcccaugcugggc

SEQ ID NO: 3216661 - RNA, 15 nt, Human
ugccccagcuugggc

SEQ ID NO: 3216662 - RNA, 15 nt, Human
ugccccagggcuccc

SEQ ID NO: 3216663 - RNA, 23 nt, Human
ugccccucaacucuccuccagag

SEQ ID NO: 3216664 - RNA, 17 nt, Human
ugccccuggcagccccu

SEQ ID NO: 3216665 - RNA, 19 nt, Human
ugccccucaacucuccucc

SEQ ID NO: 3216666 - RNA, 22 nt, Human
ugcagagcagugggccuggcca

SEQ ID NO: 3216667 - RNA, 13 nt, Human
ugcagagcugaag

SEQ ID NO: 3216668 - RNA, 21 nt, Human
ugcagagcaggaaacaugacu

SEQ ID NO: 3216669 - RNA, 17 nt, Human
ugcagagcaguaaggga

SEQ ID NO: 3216670 - RNA, 18 nt, Human
ugcagagcaguaagggaa

SEQ ID NO: 3216671 - RNA, 11 nt, Human
ugcagagcugc

SEQ ID NO: 3216672 - RNA, 19 nt, Human
ugcagaggcuaugggaaga

SEQ ID NO: 3216673 - RNA, 23 nt, Human
ugcagcacagcugagaggcuguc

SEQ ID NO: 3216674 - RNA, 12 nt, Human
ugcacuuuguuc

SEQ ID NO: 3216675 - RNA, 14 nt, Human
ugcacuuuguucug

SEQ ID NO: 3216676 - RNA, 21 nt, Human
ugcacuuucagacucucucug

SEQ ID NO: 3216677 - RNA, 14 nt, Human
ugcacuuucagacu

SEQ ID NO: 3216678 - RNA, 16 nt, Human
ugcacuggccuucuga

SEQ ID NO: 3216679 - RNA, 17 nt, Human
ugcacuggccuucugau

SEQ ID NO: 3216680 - RNA, 21 nt, Human
ugcacuggccuucugaugaaa

SEQ ID NO: 3216681 - RNA, 22 nt, Human
ugcaccgggccacagagaaagu

SEQ ID NO: 3216682 - RNA, 17 nt, Human
ugcaccgggccacagag

SEQ ID NO: 3216683 - RNA, 19 nt, Human
ugaguccccuguuuguuuc

SEQ ID NO: 3216684 - RNA, 23 nt, Human
ugcaccggcuggccuggccccuc

SEQ ID NO: 3216685 - RNA, 15 nt, Human
ugcaccgggccacag

SEQ ID NO: 3216686 - RNA, 14 nt, Human
ugcaccgggccaca

SEQ ID NO: 3216687 - RNA, 15 nt, Human
ugcacgcuggggaag

SEQ ID NO: 3216688 - RNA, 14 nt, Human
ugcacgcuggggaa

SEQ ID NO: 3216689 - RNA, 22 nt, Human
ugcacgcugggcaaugagaauc

SEQ ID NO: 3216690 - RNA, 13 nt, Human
ugcacugacucug

SEQ ID NO: 3216691 - RNA, 12 nt, Human
ugcacugacucu

SEQ ID NO: 3216692 - RNA, 17 nt, Human
ugcacugacucuggaaa

SEQ ID NO: 3216693 - RNA, 16 nt, Human
ugcacugacucuggaa

SEQ ID NO: 3216694 - RNA, 15 nt, Human
ugcacugacucugga

SEQ ID NO: 3216695 - RNA, 14 nt, Human
ugcacugacucugg

SEQ ID NO: 3216696 - RNA, 13 nt, Human
ugcaguugccagu

SEQ ID NO: 3216697 - RNA, 14 nt, Human
ugcaguugccaguc

SEQ ID NO: 3216698 - RNA, 18 nt, Human
ugcauauaacuuauauug

SEQ ID NO: 3216699 - RNA, 17 nt, Human
ugcauauauauaugugu

SEQ ID NO: 3216700 - RNA, 15 nt, Human
ugcauauauauaugu

SEQ ID NO: 3216701 - RNA, 13 nt, Human
ugcauauauauau

SEQ ID NO: 3216702 - RNA, 21 nt, Human
ugcauauaacuuauauuguaa

SEQ ID NO: 3216703 - RNA, 20 nt, Human
ugcauauaacuuauauugua

SEQ ID NO: 3216704 - RNA, 22 nt, Human
ugcauauaacuuauauuguaag

SEQ ID NO: 3216705 - RNA, 22 nt, Human
ugcagugguaugaucacggcuc

SEQ ID NO: 3216706 - RNA, 13 nt, Human
ugcagugcugcuu

SEQ ID NO: 3216707 - RNA, 16 nt, Human
ugcagugcugcuuugc

SEQ ID NO: 3216708 - RNA, 22 nt, Human
ugcaguggcgaaaucccugcuc

SEQ ID NO: 3216709 - RNA, 19 nt, Human
ugcagugagccgagauugu

SEQ ID NO: 3216710 - RNA, 17 nt, Human
ugcaggcccacccugcu

SEQ ID NO: 3216711 - RNA, 13 nt, Human
ugcaggcaggcug

SEQ ID NO: 3216712 - RNA, 11 nt, Human
ugcaggcaggc

SEQ ID NO: 3216713 - RNA, 15 nt, Human
ugcaggcccacccug

SEQ ID NO: 3216714 - RNA, 14 nt, Human
ugcaggcccacccu

SEQ ID NO: 3216715 - RNA, 13 nt, Human
ugcaggcccaccc

SEQ ID NO: 3216716 - RNA, 12 nt, Human
ugcaggcccacc

SEQ ID NO: 3216717 - RNA, 16 nt, Human
ugcagugcuuccaagg

SEQ ID NO: 3216718 - RNA, 13 nt, Human
ugcaggcagccag

SEQ ID NO: 3216719 - RNA, 14 nt, Human
ugcaggcagccagg

SEQ ID NO: 3216720 - RNA, 19 nt, Human
ugcaggcagccaggccaca

SEQ ID NO: 3216721 - RNA, 10 nt, Human
ugcaggcagg

SEQ ID NO: 3216722 - RNA, 15 nt, Human
ugcaggcagccaggc

SEQ ID NO: 3216723 - RNA, 21 nt, Human
ugcaggauucucaccagcugu

SEQ ID NO: 3216724 - RNA, 17 nt, Human
ugcaggauucucaccag

SEQ ID NO: 3216725 - RNA, 14 nt, Human
ugcagcagggcagu

SEQ ID NO: 3216726 - RNA, 22 nt, Human
ugccucuccgccccugagccca

SEQ ID NO: 3216727 - RNA, 21 nt, Human
ugccucuccgccccugagccc

SEQ ID NO: 3216728 - RNA, 20 nt, Human
ugccucuccgccccugagcc

SEQ ID NO: 3216729 - RNA, 15 nt, Human
ugccucuccgccccu

SEQ ID NO: 3216730 - RNA, 19 nt, Human
ugccugacagagggaugga

SEQ ID NO: 3216731 - RNA, 13 nt, Human
ugccucuugucuu

SEQ ID NO: 3216732 - RNA, 19 nt, Human
ugccucgaacuggcugcaa

SEQ ID NO: 3216733 - RNA, 18 nt, Human
ugccucgaacuggcugca

SEQ ID NO: 3216734 - RNA, 20 nt, Human
ugccucgaacuggcugcaaa

SEQ ID NO: 3216735 - RNA, 12 nt, Human
ugccucuagcug

SEQ ID NO: 3216736 - RNA, 14 nt, Human
ugccucuagcugaa

SEQ ID NO: 3216737 - RNA, 13 nt, Human
ugccucuagcuga

SEQ ID NO: 3216738 - RNA, 18 nt, Human
ugccccuggcagccccug

SEQ ID NO: 3216739 - RNA, 14 nt, Human
ugccccuggccuug

SEQ ID NO: 3216740 - RNA, 19 nt, Human
ugccccuggccuugggauc

SEQ ID NO: 3216741 - RNA, 15 nt, Human
ugccccuggccuugg

SEQ ID NO: 3216742 - RNA, 15 nt, Human
ugccugaggggcagc

SEQ ID NO: 3216743 - RNA, 18 nt, Human
ugccugaggggcagccug

SEQ ID NO: 3216744 - RNA, 16 nt, Human
ugccugaggggcagcc

SEQ ID NO: 3216745 - RNA, 21 nt, Human
ugccugggaucccucauccuc

SEQ ID NO: 3216746 - RNA, 22 nt, Human
ugccugaggggcagccugccuu

SEQ ID NO: 3216747 - RNA, 18 nt, Human
ugccugggcagaaggaag

SEQ ID NO: 3216748 - RNA, 17 nt, Human
ugccugguccucacacu

SEQ ID NO: 3216749 - RNA, 18 nt, Human
ugccuguaaucacagcua

SEQ ID NO: 3216750 - RNA, 15 nt, Human
ugccugguggcagcu

SEQ ID NO: 3216751 - RNA, 14 nt, Human
ugccugguggcagc

SEQ ID NO: 3216752 - RNA, 14 nt, Human
ugccugugaacuga

SEQ ID NO: 3216753 - RNA, 17 nt, Human
ugccugugaacugaacu

SEQ ID NO: 3216754 - RNA, 18 nt, Human
ugccugugaacugaacuc

SEQ ID NO: 3216755 - RNA, 21 nt, Human
ugccugugaacugaacucuga

SEQ ID NO: 3216756 - RNA, 19 nt, Human
ugccuucgguacccaccac

SEQ ID NO: 3216757 - RNA, 18 nt, Human
ugccuucgguacccacca

SEQ ID NO: 3216758 - RNA, 21 nt, Human
ugcgaucuggguucacugcaa

SEQ ID NO: 3216759 - RNA, 20 nt, Human
ugcgaucuggguucacugca

SEQ ID NO: 3216760 - RNA, 19 nt, Human
ugcgaucuggguucacugc

SEQ ID NO: 3216761 - RNA, 15 nt, Human
ugcgaucuggguuca

SEQ ID NO: 3216762 - RNA, 14 nt, Human
ugcgaucuggguuc

SEQ ID NO: 3216763 - RNA, 16 nt, Human
ugcgccuacaggagug

SEQ ID NO: 3216764 - RNA, 14 nt, Human
ugcgccuacaggag

SEQ ID NO: 3216765 - RNA, 22 nt, Human
ugcgccuacaggagugagcacu

SEQ ID NO: 3216766 - RNA, 13 nt, Human
ugcgccuacagga

SEQ ID NO: 3216767 - RNA, 19 nt, Human
ugcuaaacguguauguuuu

SEQ ID NO: 3216768 - RNA, 18 nt, Human
ugcuaaacguguauguuu

SEQ ID NO: 3216769 - RNA, 17 nt, Human
ugcuaaacguguauguu

SEQ ID NO: 3216770 - RNA, 15 nt, Human
ugcuaaaugugaaug

SEQ ID NO: 3216771 - RNA, 23 nt, Human
ugcuaaacguguauguuuuucag

SEQ ID NO: 3216772 - RNA, 22 nt, Human
ugcuaaacguguauguuuuuca

SEQ ID NO: 3216773 - RNA, 21 nt, Human
ugcuaaauugauguugaugca

SEQ ID NO: 3216774 - RNA, 18 nt, Human
ugcuaaauugauguugau

SEQ ID NO: 3216775 - RNA, 17 nt, Human
ugcuaaauugauguuga

SEQ ID NO: 3216776 - RNA, 16 nt, Human
ugcuaaauugauguug

SEQ ID NO: 3216777 - RNA, 15 nt, Human
ugcuaaauugauguu

SEQ ID NO: 3216778 - RNA, 12 nt, Human
ugcuaaauuuca

SEQ ID NO: 3216779 - RNA, 22 nt, Human
ugcuaagacucaguggggaggg

SEQ ID NO: 3216780 - RNA, 16 nt, Human
ugcucacauaucuguc

SEQ ID NO: 3216781 - RNA, 15 nt, Human
ugcucacauaucugu

SEQ ID NO: 3216782 - RNA, 14 nt, Human
ugcuccucucccca

SEQ ID NO: 3216783 - RNA, 20 nt, Human
ugcucagcagugagagcaga

SEQ ID NO: 3216784 - RNA, 15 nt, Human
ugcucacaguuauua

SEQ ID NO: 3216785 - RNA, 17 nt, Human
ugcucagcagugagagc

SEQ ID NO: 3216786 - RNA, 15 nt, Human
ugcucagcagugaga

SEQ ID NO: 3216787 - RNA, 17 nt, Human
ugcucuccaagcccagu

SEQ ID NO: 3216788 - RNA, 22 nt, Human
ugcucucaccuugguuccuggg

SEQ ID NO: 3216789 - RNA, 21 nt, Human
ugcucuccucuugccacugcc

SEQ ID NO: 3216790 - RNA, 18 nt, Human
ugcucuccucuugccacu

SEQ ID NO: 3216791 - RNA, 14 nt, Human
ugcucuccucuugc

SEQ ID NO: 3216792 - RNA, 16 nt, Human
ugcucuccucuugcca

SEQ ID NO: 3216793 - RNA, 17 nt, Human
ugcugaaacaacaaaua

SEQ ID NO: 3216794 - RNA, 22 nt, Human
ugcucuccucuugccacugccu

SEQ ID NO: 3216795 - RNA, 17 nt, Human
ugcuccucuccccagca

SEQ ID NO: 3216796 - RNA, 18 nt, Human
ugcuccuuucuuguuuua

SEQ ID NO: 3216797 - RNA, 22 nt, Human
ugcucgccucggaucagcugag

SEQ ID NO: 3216798 - RNA, 18 nt, Human
ugcucucaaaccccugac

SEQ ID NO: 3216799 - RNA, 20 nt, Human
ugcucucaccuugguuccug

SEQ ID NO: 3216800 - RNA, 21 nt, Human
ugcucucaaaccccugaccuc

SEQ ID NO: 3216801 - RNA, 20 nt, Human
ugcucucaaaccccugaccu

SEQ ID NO: 3216802 - RNA, 19 nt, Human
ugcucucaaaccccugacc

SEQ ID NO: 3216803 - RNA, 13 nt, Human
ugcugauuuuauu

SEQ ID NO: 3216804 - RNA, 17 nt, Human
ugcugauuuuauucuug

SEQ ID NO: 3216805 - RNA, 16 nt, Human
ugcugauuuuauucuu

SEQ ID NO: 3216806 - RNA, 19 nt, Human
ugcugauuuuauucuugau

SEQ ID NO: 3216807 - RNA, 18 nt, Human
ugcugauuuuauucuuga

SEQ ID NO: 3216808 - RNA, 15 nt, Human
ugcugauggugcaau

SEQ ID NO: 3216809 - RNA, 17 nt, Human
ugcugauggugcaauga

SEQ ID NO: 3216810 - RNA, 13 nt, Human
ugcugauggugca

SEQ ID NO: 3216811 - RNA, 12 nt, Human
ugcugaaggcuc

SEQ ID NO: 3216812 - RNA, 23 nt, Human
ugcugaaggaauaaauugcuccu

SEQ ID NO: 3216813 - RNA, 19 nt, Human
ugcugaacauugcauauaa

SEQ ID NO: 3216814 - RNA, 21 nt, Human
ugcugaacauugcauauaacu

SEQ ID NO: 3216815 - RNA, 22 nt, Human
ugcugaacauuggagaaucuca

SEQ ID NO: 3216816 - RNA, 16 nt, Human
ugcugaagaaucuacu

SEQ ID NO: 3216817 - RNA, 14 nt, Human
ugcugaacauugga

SEQ ID NO: 3216818 - RNA, 13 nt, Human
ugcugaaggcucg

SEQ ID NO: 3216819 - RNA, 19 nt, Human
ugcugacagacacaggccc

SEQ ID NO: 3216820 - RNA, 23 nt, Human
ugcugacagacacaggcccggcu

SEQ ID NO: 3216821 - RNA, 22 nt, Human
ugcugacagacacaggcccggc

SEQ ID NO: 3216822 - RNA, 16 nt, Human
ugcugcaguugccagu

SEQ ID NO: 3216823 - RNA, 18 nt, Human
ugcugcaguugccaguca

SEQ ID NO: 3216824 - RNA, 23 nt, Human
ugcugcaguugccagucaccccg

SEQ ID NO: 3216825 - RNA, 18 nt, Human
ugcugcuaauucuuugca

SEQ ID NO: 3216826 - RNA, 14 nt, Human
ugcugcuaauucuu

SEQ ID NO: 3216827 - RNA, 21 nt, Human
ugcugcuaauucuuugcaaaa

SEQ ID NO: 3216828 - RNA, 13 nt, Human
ugcugcuggcugg

SEQ ID NO: 3216829 - RNA, 16 nt, Human
ugcugcuuugauauau

SEQ ID NO: 3216830 - RNA, 14 nt, Human
ugcugcuuugauau

SEQ ID NO: 3216831 - RNA, 19 nt, Human
ugcuggaacucuugacagc

SEQ ID NO: 3216832 - RNA, 12 nt, Human
ugcuggaaagag

SEQ ID NO: 3216833 - RNA, 22 nt, Human
uguacgacgucagauguuuaaa

SEQ ID NO: 3216834 - RNA, 23 nt, Human
uguacgacgucagauguuuaaaa

SEQ ID NO: 3216835 - RNA, 15 nt, Human
uguacgucugacagg

SEQ ID NO: 3216836 - RNA, 14 nt, Human
uguaccucugccuc

SEQ ID NO: 3216837 - RNA, 19 nt, Human
uguacugcauaugaaagga

SEQ ID NO: 3216838 - RNA, 18 nt, Human
uguagauacaaucagcug

SEQ ID NO: 3216839 - RNA, 19 nt, Human
uguagauacaaucagcugc

SEQ ID NO: 3216840 - RNA, 20 nt, Human
uguagauacaaucagcugcu

SEQ ID NO: 3216841 - RNA, 21 nt, Human
uguagauacaaucagcugcuu

SEQ ID NO: 3216842 - RNA, 20 nt, Human
uguagaucaacucauguuaa

SEQ ID NO: 3216843 - RNA, 15 nt, Human
uguagauuuauuuca

SEQ ID NO: 3216844 - RNA, 16 nt, Human
uguagauuuauuucau

SEQ ID NO: 3216845 - RNA, 23 nt, Human
uguagccucaaucgagugagaca

SEQ ID NO: 3216846 - RNA, 22 nt, Human
uguaauaaacccuuaacuggca

SEQ ID NO: 3216847 - RNA, 14 nt, Human
uguaauaaacccuu

SEQ ID NO: 3216848 - RNA, 23 nt, Human
uguaauaaacccuuaacuggcau

SEQ ID NO: 3216849 - RNA, 14 nt, Human
uggucacagccagg

SEQ ID NO: 3216850 - RNA, 23 nt, Human
ugguauuggccauaagcaacaau

SEQ ID NO: 3216851 - RNA, 17 nt, Human
uggucacagccaggcgc

SEQ ID NO: 3216852 - RNA, 15 nt, Human
uggucacagccaggc

SEQ ID NO: 3216853 - RNA, 14 nt, Human
uguaaucaacaugg

SEQ ID NO: 3216854 - RNA, 23 nt, Human
uguaauauagaaaaaaacauucu

SEQ ID NO: 3216855 - RNA, 19 nt, Human
uguaauauuacuuuaacau

SEQ ID NO: 3216856 - RNA, 13 nt, Human
uguaauauuuaca

SEQ ID NO: 3216857 - RNA, 14 nt, Human
uguaauauuuacaa

SEQ ID NO: 3216858 - RNA, 15 nt, Human
uguaauauuuacaau

SEQ ID NO: 3216859 - RNA, 17 nt, Human
uguaauauuuacaaugu

SEQ ID NO: 3216860 - RNA, 19 nt, Human
uguaauauuuacaauguau

SEQ ID NO: 3216861 - RNA, 21 nt, Human
uguaauauuuacaauguauua

SEQ ID NO: 3216862 - RNA, 14 nt, Human
uguaaucuuguuga

SEQ ID NO: 3216863 - RNA, 19 nt, Human
uguaaucuuguugauaaaa

SEQ ID NO: 3216864 - RNA, 15 nt, Human
uguaccgcaauguga

SEQ ID NO: 3216865 - RNA, 16 nt, Human
uguaccgcaaugugac

SEQ ID NO: 3216866 - RNA, 18 nt, Human
uguacagagcccacgccc

SEQ ID NO: 3216867 - RNA, 16 nt, Human
uguacagagcccacgc

SEQ ID NO: 3216868 - RNA, 17 nt, Human
uguacagagcccacgcc

SEQ ID NO: 3216869 - RNA, 13 nt, Human
uguacagagccca

SEQ ID NO: 3216870 - RNA, 18 nt, Human
uguacaaugacuuuauug

SEQ ID NO: 3216871 - RNA, 15 nt, Human
uguaauguugugaau

SEQ ID NO: 3216872 - RNA, 14 nt, Human
uguaauguugugaa

SEQ ID NO: 3216873 - RNA, 16 nt, Human
uguacaaggacagccc

SEQ ID NO: 3216874 - RNA, 20 nt, Human
uguacaaggacagccccucc

SEQ ID NO: 3216875 - RNA, 23 nt, Human
uguacaaggacagccccuccucc

SEQ ID NO: 3216876 - RNA, 16 nt, Human
uguccuacccacccuc

SEQ ID NO: 3216877 - RNA, 17 nt, Human
uguccuacucuguguca

SEQ ID NO: 3216878 - RNA, 12 nt, Human
uguccuacucug

SEQ ID NO: 3216879 - RNA, 16 nt, Human
uguccccgacccuugc

SEQ ID NO: 3216880 - RNA, 20 nt, Human
uguccuacccacccuccuuu

SEQ ID NO: 3216881 - RNA, 18 nt, Human
uguccccaccgcagacag

SEQ ID NO: 3216882 - RNA, 19 nt, Human
uguccccaccgcagacagg

SEQ ID NO: 3216883 - RNA, 22 nt, Human
uguccccaccgcagacaggacc

SEQ ID NO: 3216884 - RNA, 13 nt, Human
uguccccaccgca

SEQ ID NO: 3216885 - RNA, 15 nt, Human
ugucccccaacuuca

SEQ ID NO: 3216886 - RNA, 16 nt, Human
ugucauuugagcaggg

SEQ ID NO: 3216887 - RNA, 22 nt, Human
ugucauuucauguccuguguca

SEQ ID NO: 3216888 - RNA, 18 nt, Human
ugucauuucauguccugu

SEQ ID NO: 3216889 - RNA, 16 nt, Human
uguccaguaagaucac

SEQ ID NO: 3216890 - RNA, 17 nt, Human
uguccaguaagaucacu

SEQ ID NO: 3216891 - RNA, 19 nt, Human
uguccaguaagaucacugu

SEQ ID NO: 3216892 - RNA, 20 nt, Human
uguccaguaagaucacuguu

SEQ ID NO: 3216893 - RNA, 21 nt, Human
uguccaguaagaucacuguuu

SEQ ID NO: 3216894 - RNA, 22 nt, Human
uguccaguaagaucacuguuua

SEQ ID NO: 3216895 - RNA, 23 nt, Human
ugucccaaaaagaaaggagggga

SEQ ID NO: 3216896 - RNA, 16 nt, Human
ugucccaacuuguaaa

SEQ ID NO: 3216897 - RNA, 13 nt, Human
ugucaccugaaga

SEQ ID NO: 3216898 - RNA, 20 nt, Human
ugucaccugcuucucugccc

SEQ ID NO: 3216899 - RNA, 18 nt, Human
ugucaccugcuucucugc

SEQ ID NO: 3216900 - RNA, 17 nt, Human
ugucaccugcuucucug

SEQ ID NO: 3216901 - RNA, 16 nt, Human
ugucaucugagaauga

SEQ ID NO: 3216902 - RNA, 14 nt, Human
ugucaucugagaau

SEQ ID NO: 3216903 - RNA, 19 nt, Human
ugucaucugagaaugaaca

SEQ ID NO: 3216904 - RNA, 20 nt, Human
ugucaugcagaguauuucua

SEQ ID NO: 3216905 - RNA, 14 nt, Human
ugucaugugcagau

SEQ ID NO: 3216906 - RNA, 22 nt, Human
ugucacccuuaggccagcacca

SEQ ID NO: 3216907 - RNA, 20 nt, Human
ugucacccgaucgccagcaa

SEQ ID NO: 3216908 - RNA, 12 nt, Human
ugucacaggcag

SEQ ID NO: 3216909 - RNA, 21 nt, Human
ugucacaggaaggcugucuca

SEQ ID NO: 3216910 - RNA, 17 nt, Human
ugucacacacuuuggcu

SEQ ID NO: 3216911 - RNA, 13 nt, Human
ugucacacacuuu

SEQ ID NO: 3216912 - RNA, 18 nt, Human
uguauuguuguaaaaugu

SEQ ID NO: 3216913 - RNA, 20 nt, Human
uguauuuauuuaguauuuau

SEQ ID NO: 3216914 - RNA, 15 nt, Human
uguauuuauucuuuu

SEQ ID NO: 3216915 - RNA, 14 nt, Human
uguauuuauucuuu

SEQ ID NO: 3216916 - RNA, 19 nt, Human
uguauuuuacuaauaaaau

SEQ ID NO: 3216917 - RNA, 17 nt, Human
uguaugaucugugccuu

SEQ ID NO: 3216918 - RNA, 16 nt, Human
uguaugaucugugccu

SEQ ID NO: 3216919 - RNA, 12 nt, Human
uguaguucuuua

SEQ ID NO: 3216920 - RNA, 14 nt, Human
uguaguucuuuaaa

SEQ ID NO: 3216921 - RNA, 15 nt, Human
uguaguucuuuaaac

SEQ ID NO: 3216922 - RNA, 17 nt, Human
uguaguucuuuaaacug

SEQ ID NO: 3216923 - RNA, 22 nt, Human
uguaguuugaggaaauuugcag

SEQ ID NO: 3216924 - RNA, 13 nt, Human
uguauucuguaaa

SEQ ID NO: 3216925 - RNA, 13 nt, Human
uguauucugucuu

SEQ ID NO: 3216926 - RNA, 14 nt, Human
uguauucuguaaaa

SEQ ID NO: 3216927 - RNA, 17 nt, Human
uguauucugucuucauc

SEQ ID NO: 3216928 - RNA, 16 nt, Human
uguauucugucuucau

SEQ ID NO: 3216929 - RNA, 19 nt, Human
uguauuguccuauuagugu

SEQ ID NO: 3216930 - RNA, 14 nt, Human
uguauuguccuauu

SEQ ID NO: 3216931 - RNA, 16 nt, Human
uguauuguuagauguu

SEQ ID NO: 3216932 - RNA, 17 nt, Human
uguauuguuagauguuu

SEQ ID NO: 3216933 - RNA, 19 nt, Human
uguauuguuagauguuugu

SEQ ID NO: 3216934 - RNA, 21 nt, Human
ugucuuuccacuccuccuagc

SEQ ID NO: 3216935 - RNA, 15 nt, Human
ugucuuucuaagaaa

SEQ ID NO: 3216936 - RNA, 16 nt, Human
ugucuuucuaagaaau

SEQ ID NO: 3216937 - RNA, 17 nt, Human
ugucuuucuaagaaauc

SEQ ID NO: 3216938 - RNA, 16 nt, Human
ugucugucccaguuaa

SEQ ID NO: 3216939 - RNA, 18 nt, Human
ugucuguaaaucuaacau

SEQ ID NO: 3216940 - RNA, 21 nt, Human
ugucuguaaaucuaacauuau

SEQ ID NO: 3216941 - RNA, 22 nt, Human
ugucuguaaaucuaacauuauu

SEQ ID NO: 3216942 - RNA, 16 nt, Human
ugucuuuggacccuga

SEQ ID NO: 3216943 - RNA, 21 nt, Human
ugucuuuucuugcaugaggcu

SEQ ID NO: 3216944 - RNA, 14 nt, Human
ugucuuuggacccu

SEQ ID NO: 3216945 - RNA, 13 nt, Human
ugucuuucugggg

SEQ ID NO: 3216946 - RNA, 23 nt, Human
ugucuuuucuugcaugaggcuag

SEQ ID NO: 3216947 - RNA, 20 nt, Human
ugucuuuucuuugccaucuc

SEQ ID NO: 3216948 - RNA, 19 nt, Human
ugucuuuucuuugccaucu

SEQ ID NO: 3216949 - RNA, 17 nt, Human
ugucuuucuugcucccu

SEQ ID NO: 3216950 - RNA, 23 nt, Human
ugugaaaagaaaaaugagccugg

SEQ ID NO: 3216951 - RNA, 21 nt, Human
ugugaaaagaaaaaugagccu

SEQ ID NO: 3216952 - RNA, 16 nt, Human
ugugaaaaugugugug

SEQ ID NO: 3216953 - RNA, 12 nt, Human
ugugaagcugga

SEQ ID NO: 3216954 - RNA, 21 nt, Human
ugugaagcuggaacugcggga

SEQ ID NO: 3216955 - RNA, 18 nt, Human
ugugaaggaccuucacuc

SEQ ID NO: 3216956 - RNA, 22 nt, Human
ugugaaggauuauggaaaaaua

SEQ ID NO: 3216957 - RNA, 23 nt, Human
ugugaaggauuauggaaaaauaa

SEQ ID NO: 3216958 - RNA, 13 nt, Human
ugugaaggaccuu

SEQ ID NO: 3216959 - RNA, 22 nt, Human
ugugaagcuuaagggucauaug

SEQ ID NO: 3216960 - RNA, 20 nt, Human
ugucuggcacagccugcacu

SEQ ID NO: 3216961 - RNA, 18 nt, Human
ugucuggcacagccugca

SEQ ID NO: 3216962 - RNA, 17 nt, Human
ugucuggcacagccugc

SEQ ID NO: 3216963 - RNA, 14 nt, Human
ugucuggaucagua

SEQ ID NO: 3216964 - RNA, 15 nt, Human
ugucuggaucaguaa

SEQ ID NO: 3216965 - RNA, 20 nt, Human
ugucuggaucaguaaaauua

SEQ ID NO: 3216966 - RNA, 21 nt, Human
ugucuggaucaguaaaauuau

SEQ ID NO: 3216967 - RNA, 16 nt, Human
ugucugaagucacugc

SEQ ID NO: 3216968 - RNA, 18 nt, Human
ugucugaagucacugcac

SEQ ID NO: 3216969 - RNA, 17 nt, Human
ugucugaagucacugca

SEQ ID NO: 3216970 - RNA, 23 nt, Human
ugucugcuggucacuucuucugu

SEQ ID NO: 3216971 - RNA, 22 nt, Human
ugucugcuggucacuucuucug

SEQ ID NO: 3216972 - RNA, 21 nt, Human
ugucugcuggucacuucuucu

SEQ ID NO: 3216973 - RNA, 18 nt, Human
ugucugcuggucacuucu

SEQ ID NO: 3216974 - RNA, 19 nt, Human
ugucugaagucacugcaca

SEQ ID NO: 3216975 - RNA, 17 nt, Human
ugucugcuccagcucug

SEQ ID NO: 3216976 - RNA, 14 nt, Human
uguccuccugcugc

SEQ ID NO: 3216977 - RNA, 20 nt, Human
uguccucuuuuguuguuucu

SEQ ID NO: 3216978 - RNA, 22 nt, Human
uguccucuuuuguuguuucuua

SEQ ID NO: 3216979 - RNA, 18 nt, Human
uguccuccugcugccagu

SEQ ID NO: 3216980 - RNA, 17 nt, Human
uguccuccugcugccag

SEQ ID NO: 3216981 - RNA, 15 nt, Human
ugugauauuccccuu

SEQ ID NO: 3216982 - RNA, 13 nt, Human
ugugauauuucag

SEQ ID NO: 3216983 - RNA, 22 nt, Human
ugugauauuucagaaauacaga

SEQ ID NO: 3216984 - RNA, 20 nt, Human
ugugauauuucagaaauaca

SEQ ID NO: 3216985 - RNA, 16 nt, Human
ugugauauuucagaaa

SEQ ID NO: 3216986 - RNA, 14 nt, Human
ugugauauuucaga

SEQ ID NO: 3216987 - RNA, 16 nt, Human
ugugcacaggcagagc

SEQ ID NO: 3216988 - RNA, 14 nt, Human
ugugcacaggcaga

SEQ ID NO: 3216989 - RNA, 13 nt, Human
ugugcacaggcag

SEQ ID NO: 3216990 - RNA, 12 nt, Human
ugugcacaggca

SEQ ID NO: 3216991 - RNA, 17 nt, Human
ugugagucaccaagccc

SEQ ID NO: 3216992 - RNA, 15 nt, Human
ugugagucaccaagc

SEQ ID NO: 3216993 - RNA, 21 nt, Human
ugugagucaccaagcccaguu

SEQ ID NO: 3216994 - RNA, 19 nt, Human
ugugagucaccaagcccag

SEQ ID NO: 3216995 - RNA, 13 nt, Human
ugugagugugaau

SEQ ID NO: 3216996 - RNA, 20 nt, Human
ugugagugugaauauaaaug

SEQ ID NO: 3216997 - RNA, 14 nt, Human
ugugagugguugaa

SEQ ID NO: 3216998 - RNA, 16 nt, Human
ugugaaggaccuucac

SEQ ID NO: 3216999 - RNA, 13 nt, Human
ugugaauuacuaa

SEQ ID NO: 3217000 - RNA, 15 nt, Human
ugugaauuacuaacu

SEQ ID NO: 3217001 - RNA, 17 nt, Human
ugugaauuacuaacuuc

SEQ ID NO: 3217002 - RNA, 16 nt, Human
ugugaauuacuaacuu

SEQ ID NO: 3217003 - RNA, 20 nt, Human
ugugaauuacuaacuucuaa

SEQ ID NO: 3217004 - RNA, 19 nt, Human
ugugaauuacuaacuucua

SEQ ID NO: 3217005 - RNA, 15 nt, Human
ugugacauguuuuau

SEQ ID NO: 3217006 - RNA, 10 nt, Human
ugugacauuu

SEQ ID NO: 3217007 - RNA, 15 nt, Human
ugugacauuugucau

SEQ ID NO: 3217008 - RNA, 19 nt, Human
ugugacauuugucauuuuc

SEQ ID NO: 3217009 - RNA, 18 nt, Human
ugugacauuugucauuuu

SEQ ID NO: 3217010 - RNA, 13 nt, Human
ugugaggaagccg

SEQ ID NO: 3217011 - RNA, 18 nt, Human
ugugaggaagccgcuggg

SEQ ID NO: 3217012 - RNA, 21 nt, Human
ugugacauuugucauuuucau

SEQ ID NO: 3217013 - RNA, 20 nt, Human
ugugacauuugucauuuuca

SEQ ID NO: 3217014 - RNA, 15 nt, Human
ugugaccaaguauaa

SEQ ID NO: 3217015 - RNA, 19 nt, Human
ugugaccaaguauaaacuu

SEQ ID NO: 3217016 - RNA, 22 nt, Human
ugugacauuugucauuuucauu

SEQ ID NO: 3217017 - RNA, 20 nt, Human
ugugaggaagccgcuggggc

SEQ ID NO: 3217018 - RNA, 12 nt, Human
ugugaggaagcc

SEQ ID NO: 3217019 - RNA, 12 nt, Human
ugugaggcagga

SEQ ID NO: 3217020 - RNA, 14 nt, Human
ugugaggcaggaga

SEQ ID NO: 3217021 - RNA, 17 nt, Human
ugugccuuggugugcug

SEQ ID NO: 3217022 - RNA, 14 nt, Human
ugugcacguacaca

SEQ ID NO: 3217023 - RNA, 20 nt, Human
ugugcacuuuuuuucuauau

SEQ ID NO: 3217024 - RNA, 14 nt, Human
ugugcuuguuaacu

SEQ ID NO: 3217025 - RNA, 13 nt, Human
ugugcuuucaaga

SEQ ID NO: 3217026 - RNA, 14 nt, Human
ugugcuuucaagau

SEQ ID NO: 3217027 - RNA, 19 nt, Human
uguggaaauuaagaagaaa

SEQ ID NO: 3217028 - RNA, 16 nt, Human
ugugccuuuugccauc

SEQ ID NO: 3217029 - RNA, 20 nt, Human
ugugccuuuuuuauaucuug

SEQ ID NO: 3217030 - RNA, 14 nt, Human
ugugccuuuuuuau

SEQ ID NO: 3217031 - RNA, 14 nt, Human
ugugcgccuacagg

SEQ ID NO: 3217032 - RNA, 19 nt, Human
ugugcgccuacaggaguga

SEQ ID NO: 3217033 - RNA, 21 nt, Human
ugugcucagaauuauuaauua

SEQ ID NO: 3217034 - RNA, 14 nt, Human
ugugcucagaauua

SEQ ID NO: 3217035 - RNA, 16 nt, Human
ugugcuauuaauauuu

SEQ ID NO: 3217036 - RNA, 17 nt, Human
ugugcuauuaauauuug

SEQ ID NO: 3217037 - RNA, 18 nt, Human
ugugcuauuaauauuugu

SEQ ID NO: 3217038 - RNA, 22 nt, Human
ugugcgcauaggccugcuuugu

SEQ ID NO: 3217039 - RNA, 19 nt, Human
ugugcgcauaggccugcuu

SEQ ID NO: 3217040 - RNA, 14 nt, Human
ugugggagugugua

SEQ ID NO: 3217041 - RNA, 15 nt, Human
ugugggaguguguaa

SEQ ID NO: 3217042 - RNA, 10 nt, Human
uguggcucac

SEQ ID NO: 3217043 - RNA, 20 nt, Human
uguggcuccacacacacaaa

SEQ ID NO: 3217044 - RNA, 12 nt, Human
uguggcuccaca

SEQ ID NO: 3217045 - RNA, 17 nt, Human
uguggcuaaaaaagcug

SEQ ID NO: 3217046 - RNA, 23 nt, Human
uguggcgcagcauauucaggaag

SEQ ID NO: 3217047 - RNA, 16 nt, Human
uguggccucuucugag

SEQ ID NO: 3217048 - RNA, 18 nt, Human
uguggccucuucugagcu

SEQ ID NO: 3217049 - RNA, 14 nt, Human
uguggccugccagu

SEQ ID NO: 3217050 - RNA, 15 nt, Human
uguggaagugugggu

SEQ ID NO: 3217051 - RNA, 18 nt, Human
uguggacacagcucuucu

SEQ ID NO: 3217052 - RNA, 19 nt, Human
uguggacacagcucuucuc

SEQ ID NO: 3217053 - RNA, 16 nt, Human
uguggacacagcucuu

SEQ ID NO: 3217054 - RNA, 19 nt, Human
uguguaauuuaaaauugug

SEQ ID NO: 3217055 - RNA, 22 nt, Human
uguguaauuuaaaauugugaug

SEQ ID NO: 3217056 - RNA, 23 nt, Human
uguguaauuuaaaauugugaugu

SEQ ID NO: 3217057 - RNA, 14 nt, Human
uguguaauuuuucu

SEQ ID NO: 3217058 - RNA, 12 nt, Human
uguguaauuuuu

SEQ ID NO: 3217059 - RNA, 19 nt, Human
uguguaauuuuucuguaua

SEQ ID NO: 3217060 - RNA, 17 nt, Human
uguguaauuuuucugua

SEQ ID NO: 3217061 - RNA, 15 nt, Human
uguguaauuuuucug

SEQ ID NO: 3217062 - RNA, 12 nt, Human
uguguagggcgg

SEQ ID NO: 3217063 - RNA, 18 nt, Human
uguguagcugcaaaaaua

SEQ ID NO: 3217064 - RNA, 11 nt, Human
uguguaauuua

SEQ ID NO: 3217065 - RNA, 18 nt, Human
uguguaauuuaaaauugu

SEQ ID NO: 3217066 - RNA, 13 nt, Human
uguguaauauuac

SEQ ID NO: 3217067 - RNA, 23 nt, Human
uguguaauauuacuuuaacaugc

SEQ ID NO: 3217068 - RNA, 22 nt, Human
ugugggcgugagaccugccccu

SEQ ID NO: 3217069 - RNA, 15 nt, Human
ugugggcaaaagagu

SEQ ID NO: 3217070 - RNA, 20 nt, Human
ugugggcgugagaccugccc

SEQ ID NO: 3217071 - RNA, 21 nt, Human
ugugggcgugagaccugcccc

SEQ ID NO: 3217072 - RNA, 16 nt, Human
uguucuuuugucccag

SEQ ID NO: 3217073 - RNA, 12 nt, Human
uguucuuuucaa

SEQ ID NO: 3217074 - RNA, 12 nt, Human
uguugaaaaaau

SEQ ID NO: 3217075 - RNA, 13 nt, Human
uguugaaaaaauu

SEQ ID NO: 3217076 - RNA, 15 nt, Human
uguugaaaaaauuua

SEQ ID NO: 3217077 - RNA, 21 nt, Human
uguugaaaaaauuuaaaagua

SEQ ID NO: 3217078 - RNA, 17 nt, Human
uguucuggcucuuccag

SEQ ID NO: 3217079 - RNA, 20 nt, Human
uguucuggcucuuccaggcu

SEQ ID NO: 3217080 - RNA, 21 nt, Human
uguucuggcucuuccaggcug

SEQ ID NO: 3217081 - RNA, 15 nt, Human
uguucugcuuuccuc

SEQ ID NO: 3217082 - RNA, 20 nt, Human
uguugacaucacuggcaugg

SEQ ID NO: 3217083 - RNA, 20 nt, Human
uguugaaaagaguaguacuu

SEQ ID NO: 3217084 - RNA, 15 nt, Human
uguugaagccuuugu

SEQ ID NO: 3217085 - RNA, 15 nt, Human
uguugacauuuguuu

SEQ ID NO: 3217086 - RNA, 22 nt, Human
uguugaccaggcaccuccccuc

SEQ ID NO: 3217087 - RNA, 21 nt, Human
uguugaccaggcaccuccccu

SEQ ID NO: 3217088 - RNA, 22 nt, Human
uguugacucuaguacugugaau

SEQ ID NO: 3217089 - RNA, 19 nt, Human
uguugacucuaguacugug

SEQ ID NO: 3217090 - RNA, 13 nt, Human
uguucucugcccu

SEQ ID NO: 3217091 - RNA, 14 nt, Human
uguucucugcccuc

SEQ ID NO: 3217092 - RNA, 15 nt, Human
uguucucugcccucc

SEQ ID NO: 3217093 - RNA, 13 nt, Human
uguucuggcucuu

SEQ ID NO: 3217094 - RNA, 16 nt, Human
uguucuggcucuucca

SEQ ID NO: 3217095 - RNA, 12 nt, Human
uguucuggcucu

SEQ ID NO: 3217096 - RNA, 20 nt, Human
uguucugcuaaauuucaaau

SEQ ID NO: 3217097 - RNA, 19 nt, Human
uguucaucauccuaagcua

SEQ ID NO: 3217098 - RNA, 15 nt, Human
uguucucucuucucc

SEQ ID NO: 3217099 - RNA, 16 nt, Human
uguucucucuucucca

SEQ ID NO: 3217100 - RNA, 12 nt, Human
uguuuacagugu

SEQ ID NO: 3217101 - RNA, 13 nt, Human
uguuuaagcagaa

SEQ ID NO: 3217102 - RNA, 18 nt, Human
uguuuaagcagaauugga

SEQ ID NO: 3217103 - RNA, 14 nt, Human
uguuuaagcagaau

SEQ ID NO: 3217104 - RNA, 17 nt, Human
uguuuaauaaagcgaaa

SEQ ID NO: 3217105 - RNA, 21 nt, Human
uguuuaagugaauugacuuau

SEQ ID NO: 3217106 - RNA, 19 nt, Human
uguuuaagcagaauuggaa

SEQ ID NO: 3217107 - RNA, 17 nt, Human
uguuuaagacacuuccg

SEQ ID NO: 3217108 - RNA, 19 nt, Human
uguuuaagacacuuccguc

SEQ ID NO: 3217109 - RNA, 18 nt, Human
uguuuaagacacuuccgu

SEQ ID NO: 3217110 - RNA, 14 nt, Human
uguuuaaaaucauu

SEQ ID NO: 3217111 - RNA, 23 nt, Human
uguuuaaagguuucuauuuucuc

SEQ ID NO: 3217112 - RNA, 15 nt, Human
uguuggccucugcaa

SEQ ID NO: 3217113 - RNA, 17 nt, Human
uguuggcugggggccuc

SEQ ID NO: 3217114 - RNA, 18 nt, Human
uguuuaaaaucauuucug

SEQ ID NO: 3217115 - RNA, 17 nt, Human
uguuuaaaaucauuucu

SEQ ID NO: 3217116 - RNA, 19 nt, Human
uguuggcugggggccucag

SEQ ID NO: 3217117 - RNA, 15 nt, Human
uguuggcagaugcag

SEQ ID NO: 3217118 - RNA, 16 nt, Human
uguuggccaggcuggu

SEQ ID NO: 3217119 - RNA, 15 nt, Human
uguuggccaggcugg

SEQ ID NO: 3217120 - RNA, 14 nt, Human
uguuggcagccucu

SEQ ID NO: 3217121 - RNA, 23 nt, Human
uguuggcagaugcagcucuuccu

SEQ ID NO: 3217122 - RNA, 18 nt, Human
uguuggccaggcugcucu

SEQ ID NO: 3217123 - RNA, 14 nt, Human
uguugauucucucc

SEQ ID NO: 3217124 - RNA, 16 nt, Human
uguugauuaaagauga

SEQ ID NO: 3217125 - RNA, 20 nt, Human
uguugauuaauuucugccau

SEQ ID NO: 3217126 - RNA, 15 nt, Human
uguugauuaaagaug

SEQ ID NO: 3217127 - RNA, 16 nt, Human
uguugaugcuguauuc

SEQ ID NO: 3217128 - RNA, 23 nt, Human
uguugaugggaugauugaagaaa

SEQ ID NO: 3217129 - RNA, 21 nt, Human
uguugaugggaugauugaaga

SEQ ID NO: 3217130 - RNA, 23 nt, Human
uguugaugcaauccuuacaaaug

SEQ ID NO: 3217131 - RNA, 22 nt, Human
uguugaugcaauccuuacaaau

SEQ ID NO: 3217132 - RNA, 21 nt, Human
uguugaugcaauccuuacaaa

SEQ ID NO: 3217133 - RNA, 20 nt, Human
uguugaugcaauccuuacaa

SEQ ID NO: 3217134 - RNA, 16 nt, Human
ugugugggagugugua

SEQ ID NO: 3217135 - RNA, 20 nt, Human
uguguggagucauuucugau

SEQ ID NO: 3217136 - RNA, 17 nt, Human
ugugugugaaaaugugu

SEQ ID NO: 3217137 - RNA, 16 nt, Human
uguguuuauugucaaa

SEQ ID NO: 3217138 - RNA, 19 nt, Human
ugugugugcuuauguauga

SEQ ID NO: 3217139 - RNA, 13 nt, Human
uguguuuauuguc

SEQ ID NO: 3217140 - RNA, 13 nt, Human
ugugugugaugug

SEQ ID NO: 3217141 - RNA, 15 nt, Human
ugugugugaugugac

SEQ ID NO: 3217142 - RNA, 14 nt, Human
ugugugugauguga

SEQ ID NO: 3217143 - RNA, 18 nt, Human
ugugugugaugugacauu

SEQ ID NO: 3217144 - RNA, 21 nt, Human
uguguuucuguccuguaacug

SEQ ID NO: 3217145 - RNA, 14 nt, Human
ugugugggagugug

SEQ ID NO: 3217146 - RNA, 15 nt, Human
ugugugggagugugu

SEQ ID NO: 3217147 - RNA, 17 nt, Human
uguguggagucauuucu

SEQ ID NO: 3217148 - RNA, 13 nt, Human
ugugugcucucca

SEQ ID NO: 3217149 - RNA, 15 nt, Human
ugugugcuuauguau

SEQ ID NO: 3217150 - RNA, 17 nt, Human
ugugugcuaaacgugua

SEQ ID NO: 3217151 - RNA, 19 nt, Human
ugugugcacguacacacac

SEQ ID NO: 3217152 - RNA, 15 nt, Human
ugugugauuaaaagg

SEQ ID NO: 3217153 - RNA, 14 nt, Human
ugugugauugaagg

SEQ ID NO: 3217154 - RNA, 11 nt, Human
uguguaugugg

SEQ ID NO: 3217155 - RNA, 12 nt, Human
uguguauguggg

SEQ ID NO: 3217156 - RNA, 18 nt, Human
uguguaugcgugugugug

SEQ ID NO: 3217157 - RNA, 16 nt, Human
ugugugauauuucaga

SEQ ID NO: 3217158 - RNA, 22 nt, Human
uguguaugugaguauucucauu

SEQ ID NO: 3217159 - RNA, 20 nt, Human
ugugugauauuucagaaaua

SEQ ID NO: 3217160 - RNA, 18 nt, Human
ugugugauauuucagaaa

SEQ ID NO: 3217161 - RNA, 19 nt, Human
ugugugaugugacauuugu

SEQ ID NO: 3217162 - RNA, 17 nt, Human
ugugugaugugacauuu

SEQ ID NO: 3217163 - RNA, 15 nt, Human
ugugugaugugacau

SEQ ID NO: 3217164 - RNA, 14 nt, Human
ugugugaugugaca

SEQ ID NO: 3217165 - RNA, 18 nt, Human
uguucagcuccagcucac

SEQ ID NO: 3217166 - RNA, 18 nt, Human
uguucagcguuuugcaag

SEQ ID NO: 3217167 - RNA, 19 nt, Human
uguucagccacugagggac

SEQ ID NO: 3217168 - RNA, 21 nt, Human
uguucagcuccagcucaccag

SEQ ID NO: 3217169 - RNA, 20 nt, Human
uguucagcuccagcucacca

SEQ ID NO: 3217170 - RNA, 18 nt, Human
uguucagccacugaggga

SEQ ID NO: 3217171 - RNA, 21 nt, Human
uguuaggccaaagacaaauag

SEQ ID NO: 3217172 - RNA, 15 nt, Human
uguucagaaaaaagg

SEQ ID NO: 3217173 - RNA, 12 nt, Human
uguucagaaaaa

SEQ ID NO: 3217174 - RNA, 21 nt, Human
uguuaaaagaugaaaauauuu

SEQ ID NO: 3217175 - RNA, 13 nt, Human
uguuaaaauaaau

SEQ ID NO: 3217176 - RNA, 13 nt, Human
uguguuuuucuca

SEQ ID NO: 3217177 - RNA, 14 nt, Human
uguguuuuuuaaga

SEQ ID NO: 3217178 - RNA, 15 nt, Human
uguguuuuuuaagau

SEQ ID NO: 3217179 - RNA, 12 nt, Human
uguuaccuuaaa

SEQ ID NO: 3217180 - RNA, 13 nt, Human
uguuaccuuaaaa

SEQ ID NO: 3217181 - RNA, 14 nt, Human
uguuaccuuaaaac

SEQ ID NO: 3217182 - RNA, 17 nt, Human
uguuaccuuaaaacuag

SEQ ID NO: 3217183 - RNA, 23 nt, Human
uguuaccccaagcgcccuggccc

SEQ ID NO: 3217184 - RNA, 23 nt, Human
uguuaccauuggaaauuucacgu

SEQ ID NO: 3217185 - RNA, 18 nt, Human
uguuaccauuggaaauuu

SEQ ID NO: 3217186 - RNA, 23 nt, Human
uguuaaaaugcaugauugcagaa

SEQ ID NO: 3217187 - RNA, 22 nt, Human
uguuaaaauuauaccuguugcu

SEQ ID NO: 3217188 - RNA, 14 nt, Human
uguuacucuuggga

SEQ ID NO: 3217189 - RNA, 18 nt, Human
uguuacucuugggacauc

SEQ ID NO: 3217190 - RNA, 17 nt, Human
uguuacucuugggacau

SEQ ID NO: 3217191 - RNA, 20 nt, Human
uguuacuggauaaauuguuu

SEQ ID NO: 3217192 - RNA, 17 nt, Human
uguuagccccauaauuu

SEQ ID NO: 3217193 - RNA, 19 nt, Human
uguuaggccaaagacaaau

SEQ ID NO: 3217194 - RNA, 13 nt, Human
uuaacuuuaccau

SEQ ID NO: 3217195 - RNA, 13 nt, Human
uuaagauggcaau

SEQ ID NO: 3217196 - RNA, 21 nt, Human
uuaagauggcaauuacuuugg

SEQ ID NO: 3217197 - RNA, 12 nt, Human
uuaagauucuug

SEQ ID NO: 3217198 - RNA, 16 nt, Human
uuaagauuauaauugu

SEQ ID NO: 3217199 - RNA, 15 nt, Human
uuaagauuauaauug

SEQ ID NO: 3217200 - RNA, 14 nt, Human
uuaagauuauaauu

SEQ ID NO: 3217201 - RNA, 13 nt, Human
uuaaaugcccagc

SEQ ID NO: 3217202 - RNA, 20 nt, Human
uuaaaugcaaccauuugaaa

SEQ ID NO: 3217203 - RNA, 19 nt, Human
uuaaauguagcuucaguca

SEQ ID NO: 3217204 - RNA, 21 nt, Human
uuaaauguagcuucagucauu

SEQ ID NO: 3217205 - RNA, 22 nt, Human
uuaaauguagcuucagucauua

SEQ ID NO: 3217206 - RNA, 20 nt, Human
uuaaaugucaaaugugaauu

SEQ ID NO: 3217207 - RNA, 19 nt, Human
uuaaaugucaaaugugaau

SEQ ID NO: 3217208 - RNA, 18 nt, Human
uuaaaugugaauuacuaa

SEQ ID NO: 3217209 - RNA, 16 nt, Human
uuaaaugugaauuacu

SEQ ID NO: 3217210 - RNA, 12 nt, Human
uuaaaugugaau

SEQ ID NO: 3217211 - RNA, 11 nt, Human
uuaaaugugaa

SEQ ID NO: 3217212 - RNA, 21 nt, Human
uuaaaugugugagugcaugua

SEQ ID NO: 3217213 - RNA, 22 nt, Human
uuaaaugugaauuacuaacuuc

SEQ ID NO: 3217214 - RNA, 21 nt, Human
uuaaaugugaauuacuaacuu

SEQ ID NO: 3217215 - RNA, 13 nt, Human
uuaaauguuaugu

SEQ ID NO: 3217216 - RNA, 16 nt, Human
uuaaauguuauguaua

SEQ ID NO: 3217217 - RNA, 14 nt, Human
uuaaauguuaugua

SEQ ID NO: 3217218 - RNA, 15 nt, Human
uuaagcaugacagaa

SEQ ID NO: 3217219 - RNA, 17 nt, Human
uuaagcaugacagaaaa

SEQ ID NO: 3217220 - RNA, 15 nt, Human
uuaagcagaauugga

SEQ ID NO: 3217221 - RNA, 19 nt, Human
uuaagcccacaguauauuu

SEQ ID NO: 3217222 - RNA, 15 nt, Human
uuaagccuaaagauu

SEQ ID NO: 3217223 - RNA, 20 nt, Human
uuaagccuaaagauuuugau

SEQ ID NO: 3217224 - RNA, 16 nt, Human
uuaagccuaaagauuu

SEQ ID NO: 3217225 - RNA, 23 nt, Human
uuaauacuguuauucuuugcacu

SEQ ID NO: 3217226 - RNA, 21 nt, Human
uuaauacuguuauucuuugca

SEQ ID NO: 3217227 - RNA, 14 nt, Human
uuaauacucuauuu

SEQ ID NO: 3217228 - RNA, 14 nt, Human
uuaauacuguuauu

SEQ ID NO: 3217229 - RNA, 20 nt, Human
uuaauacuguuauucuuugc

SEQ ID NO: 3217230 - RNA, 18 nt, Human
uuaauacuguuauucuuu

SEQ ID NO: 3217231 - RNA, 20 nt, Human
uuaauaaucaagagccuuaa

SEQ ID NO: 3217232 - RNA, 22 nt, Human
uuaauaauagauugugaauaau

SEQ ID NO: 3217233 - RNA, 22 nt, Human
uuaauuaaaacacaacaucuuu

SEQ ID NO: 3217234 - RNA, 19 nt, Human
uuaaugagcaauaucugcu

SEQ ID NO: 3217235 - RNA, 22 nt, Human
uuaauuaagcaaagcacccauu

SEQ ID NO: 3217236 - RNA, 22 nt, Human
uuaauuaaccccauaauuagau

SEQ ID NO: 3217237 - RNA, 20 nt, Human
uuaauuaauuuggagcacaa

SEQ ID NO: 3217238 - RNA, 16 nt, Human
uuacaaccuagaagua

SEQ ID NO: 3217239 - RNA, 13 nt, Human
uuacaagaagaac

SEQ ID NO: 3217240 - RNA, 16 nt, Human
uuacaagaagaacuca

SEQ ID NO: 3217241 - RNA, 19 nt, Human
uuacaacugaccaaguuuc

SEQ ID NO: 3217242 - RNA, 14 nt, Human
uuacaacacuuuaa

SEQ ID NO: 3217243 - RNA, 24 nt, Human
uuacaaauuauaauguauucauau

SEQ ID NO: 3217244 - RNA, 23 nt, Human
uuacaaauuauaauguauucaua

SEQ ID NO: 3217245 - RNA, 13 nt, Human
uuacaaccuagaa

SEQ ID NO: 3217246 - RNA, 21 nt, Human
uuacaaauuauaauguauuca

SEQ ID NO: 3217247 - RNA, 17 nt, Human
uuacauuuaaaccuuuu

SEQ ID NO: 3217248 - RNA, 23 nt, Human
uuacauugccguggcaucuuaaa

SEQ ID NO: 3217249 - RNA, 13 nt, Human
uuacauucaguug

SEQ ID NO: 3217250 - RNA, 19 nt, Human
uuacauuuguauuuuucca

SEQ ID NO: 3217251 - RNA, 16 nt, Human
uuacacuuuuuggaag

SEQ ID NO: 3217252 - RNA, 20 nt, Human
uuacacuuuaugcacaaaau

SEQ ID NO: 3217253 - RNA, 13 nt, Human
uuacacuuuaugc

SEQ ID NO: 3217254 - RNA, 21 nt, Human
uuacacuguuauuuucagcau

SEQ ID NO: 3217255 - RNA, 22 nt, Human
uuacacuguuauuuucagcaug

SEQ ID NO: 3217256 - RNA, 23 nt, Human
uuacacuguuauuuucagcauga

SEQ ID NO: 3217257 - RNA, 22 nt, Human
uuacacuggcaaugguaguuuc

SEQ ID NO: 3217258 - RNA, 23 nt, Human
uuacacuggcaaugguaguuucu

SEQ ID NO: 3217259 - RNA, 20 nt, Human
uuacacuggcaaugguaguu

SEQ ID NO: 3217260 - RNA, 21 nt, Human
uuacacuggcaaugguaguuu

SEQ ID NO: 3217261 - RNA, 15 nt, Human
uguuuacuugaauag

SEQ ID NO: 3217262 - RNA, 19 nt, Human
uguuuacuugaauaguauu

SEQ ID NO: 3217263 - RNA, 22 nt, Human
uguuuacuugaauaguauugug

SEQ ID NO: 3217264 - RNA, 12 nt, Human
uguuucuguccu

SEQ ID NO: 3217265 - RNA, 11 nt, Human
uguuucugggg

SEQ ID NO: 3217266 - RNA, 16 nt, Human
uguuuuaagaggcagg

SEQ ID NO: 3217267 - RNA, 14 nt, Human
uguuuguucuuguu

SEQ ID NO: 3217268 - RNA, 16 nt, Human
uguuuguucuuguuuu

SEQ ID NO: 3217269 - RNA, 16 nt, Human
uguuugugugucaagu

SEQ ID NO: 3217270 - RNA, 22 nt, Human
uuaaaaaaaaaccugagcccca

SEQ ID NO: 3217271 - RNA, 14 nt, Human
uguuuuuguauauu

SEQ ID NO: 3217272 - RNA, 21 nt, Human
uguuuuuguauauugguuuua

SEQ ID NO: 3217273 - RNA, 13 nt, Human
uguuuuuguaaag

SEQ ID NO: 3217274 - RNA, 16 nt, Human
uguuuuuguaaagaaa

SEQ ID NO: 3217275 - RNA, 14 nt, Human
uguuuuuguaaaga

SEQ ID NO: 3217276 - RNA, 15 nt, Human
uuaaaaaaaaaaguc

SEQ ID NO: 3217277 - RNA, 16 nt, Human
uuaaaaaaaaaaguca

SEQ ID NO: 3217278 - RNA, 21 nt, Human
uuaaaaaaaaaagucaccaaa

SEQ ID NO: 3217279 - RNA, 12 nt, Human
uguuuuuguaua

SEQ ID NO: 3217280 - RNA, 13 nt, Human
uguuuuuguauau

SEQ ID NO: 3217281 - RNA, 17 nt, Human
uguuuuuguaaagaaaa

SEQ ID NO: 3217282 - RNA, 12 nt, Human
uguuuuucugcu

SEQ ID NO: 3217283 - RNA, 16 nt, Human
uguuuuuaaguuugca

SEQ ID NO: 3217284 - RNA, 16 nt, Human
uguuuuugaaggcaga

SEQ ID NO: 3217285 - RNA, 14 nt, Human
uguuuuucugcuuu

SEQ ID NO: 3217286 - RNA, 15 nt, Human
uguuuuucugcuuua

SEQ ID NO: 3217287 - RNA, 18 nt, Human
uguuuuucugcuuuagac

SEQ ID NO: 3217288 - RNA, 19 nt, Human
uguuuuucugcuuuagacu

SEQ ID NO: 3217289 - RNA, 20 nt, Human
uguuuuugaaggcagaaagc

SEQ ID NO: 3217290 - RNA, 18 nt, Human
uguuuuugaaggcagaaa

SEQ ID NO: 3217291 - RNA, 19 nt, Human
uguuuuaacaagaagcaau

SEQ ID NO: 3217292 - RNA, 17 nt, Human
uguuuuaagaggcaggg

SEQ ID NO: 3217293 - RNA, 16 nt, Human
uguuuuuaaaaucuua

SEQ ID NO: 3217294 - RNA, 15 nt, Human
uguuuuuaaaaucuu

SEQ ID NO: 3217295 - RNA, 12 nt, Human
uguuuuuaagau

SEQ ID NO: 3217296 - RNA, 19 nt, Human
uguuuuuaaaaucuuauua

SEQ ID NO: 3217297 - RNA, 17 nt, Human
uguuuuuaaaaucuuau

SEQ ID NO: 3217298 - RNA, 21 nt, Human
uguuuuuaaaaucuuauuaaa

SEQ ID NO: 3217299 - RNA, 18 nt, Human
uuaaaauacacacucaaa

SEQ ID NO: 3217300 - RNA, 16 nt, Human
uuaaacuuccaaagaa

SEQ ID NO: 3217301 - RNA, 17 nt, Human
uuaaacuuccaaagaaa

SEQ ID NO: 3217302 - RNA, 18 nt, Human
uuaaacuuccaaagaaag

SEQ ID NO: 3217303 - RNA, 16 nt, Human
uuaaagaaaaaaaugu

SEQ ID NO: 3217304 - RNA, 21 nt, Human
uuaaacuuuagugcuacagaa

SEQ ID NO: 3217305 - RNA, 14 nt, Human
uuaaaacccaagug

SEQ ID NO: 3217306 - RNA, 16 nt, Human
uuaaaaaaaaauugua

SEQ ID NO: 3217307 - RNA, 19 nt, Human
uuaaaaaaaaauuguaucu

SEQ ID NO: 3217308 - RNA, 16 nt, Human
uuaaaacuacuuagca

SEQ ID NO: 3217309 - RNA, 19 nt, Human
uuaaaacuaggcauuugua

SEQ ID NO: 3217310 - RNA, 20 nt, Human
uuaaaacuaggcauuuguaa

SEQ ID NO: 3217311 - RNA, 21 nt, Human
uuaaaacuaggcauuuguaaa

SEQ ID NO: 3217312 - RNA, 22 nt, Human
uuaaaacuaggcauuuguaaau

SEQ ID NO: 3217313 - RNA, 23 nt, Human
uuaaaacuaggcauuuguaaaua

SEQ ID NO: 3217314 - RNA, 22 nt, Human
uuaaaacuaguuagauucacuu

SEQ ID NO: 3217315 - RNA, 14 nt, Human
uuaaaagaaaaaau

SEQ ID NO: 3217316 - RNA, 16 nt, Human
uuaaaagaaaaaauga

SEQ ID NO: 3217317 - RNA, 18 nt, Human
uuaaaagaaaaaaugaca

SEQ ID NO: 3217318 - RNA, 20 nt, Human
uuaaaacugcaguuuucaga

SEQ ID NO: 3217319 - RNA, 14 nt, Human
uuaaaacuucaucu

SEQ ID NO: 3217320 - RNA, 14 nt, Human
uuaaaauaaauggu

SEQ ID NO: 3217321 - RNA, 16 nt, Human
uuaaaauaaacuuucu

SEQ ID NO: 3217322 - RNA, 13 nt, Human
uuaaaauaaacuu

SEQ ID NO: 3217323 - RNA, 18 nt, Human
uuaaagccauucugauua

SEQ ID NO: 3217324 - RNA, 17 nt, Human
uuaaagaaacaugguuu

SEQ ID NO: 3217325 - RNA, 23 nt, Human
uuaaagaaaaaaaugucaaaagu

SEQ ID NO: 3217326 - RNA, 15 nt, Human
uuaaaugcccagccc

SEQ ID NO: 3217327 - RNA, 16 nt, Human
uuaaaugcccagcccc

SEQ ID NO: 3217328 - RNA, 14 nt, Human
uuaaaugcccagcc

SEQ ID NO: 3217329 - RNA, 16 nt, Human
uuaaaugauuuaaauu

SEQ ID NO: 3217330 - RNA, 22 nt, Human
uuaaaucauacuccuaugcuuu

SEQ ID NO: 3217331 - RNA, 23 nt, Human
uaauaagcuaguugaauacuuga

SEQ ID NO: 3217332 - RNA, 16 nt, Human
uaauaagcuaguugaa

SEQ ID NO: 3217333 - RNA, 17 nt, Human
uaauaagcuaguugaau

SEQ ID NO: 3217334 - RNA, 20 nt, Human
uaauaagcuaguugaauacu

SEQ ID NO: 3217335 - RNA, 21 nt, Human
uaauaagcuaguugaauacuu

SEQ ID NO: 3217336 - RNA, 12 nt, Human
uaauaagcuagu

SEQ ID NO: 3217337 - RNA, 20 nt, Human
uaagugguacuaacuuuccu

SEQ ID NO: 3217338 - RNA, 16 nt, Human
uaagugguguguguau

SEQ ID NO: 3217339 - RNA, 15 nt, Human
uaaguggugugugua

SEQ ID NO: 3217340 - RNA, 18 nt, Human
uaagugguuuuaauaaaa

SEQ ID NO: 3217341 - RNA, 14 nt, Human
uaagugaaauuuau

SEQ ID NO: 3217342 - RNA, 13 nt, Human
uaagugaaauuua

SEQ ID NO: 3217343 - RNA, 21 nt, Human
uaagugaggaaaucaaagugc

SEQ ID NO: 3217344 - RNA, 19 nt, Human
uaagugaggaaaucaaagu

SEQ ID NO: 3217345 - RNA, 12 nt, Human
uaagugagagag

SEQ ID NO: 3217346 - RNA, 23 nt, Human
uaagugaggaugaaaaaauaaca

SEQ ID NO: 3217347 - RNA, 22 nt, Human
uaagugccaggauggaaugaug

SEQ ID NO: 3217348 - RNA, 19 nt, Human
uaagugccucacauuuuuu

SEQ ID NO: 3217349 - RNA, 13 nt, Human
uaagugaaauaag

SEQ ID NO: 3217350 - RNA, 20 nt, Human
uaagucuugccuauauuuuc

SEQ ID NO: 3217351 - RNA, 12 nt, Human
uaagugaaauuu

SEQ ID NO: 3217352 - RNA, 11 nt, Human
uaagugaaauu

SEQ ID NO: 3217353 - RNA, 15 nt, Human
uaagugaaaauauag

SEQ ID NO: 3217354 - RNA, 17 nt, Human
uaagucuugccuauauu

SEQ ID NO: 3217355 - RNA, 20 nt, Human
uaagucuuacauaaaccauu

SEQ ID NO: 3217356 - RNA, 17 nt, Human
uaagucucuuuuuuaca

SEQ ID NO: 3217357 - RNA, 14 nt, Human
uaagucucuuuuuu

SEQ ID NO: 3217358 - RNA, 21 nt, Human
uaagucucuuuuuuacaaagg

SEQ ID NO: 3217359 - RNA, 20 nt, Human
uaagucucuuuuuuacaaag

SEQ ID NO: 3217360 - RNA, 19 nt, Human
uaagucucuuuuuuacaaa

SEQ ID NO: 3217361 - RNA, 18 nt, Human
uaagucucuuuuuuacaa

SEQ ID NO: 3217362 - RNA, 16 nt, Human
uaagucucaagguagg

SEQ ID NO: 3217363 - RNA, 21 nt, Human
uaagucuaucugguauuaaau

SEQ ID NO: 3217364 - RNA, 22 nt, Human
uaagucuaucugguauuaaaug

SEQ ID NO: 3217365 - RNA, 17 nt, Human
uaaggguaucuggugac

SEQ ID NO: 3217366 - RNA, 24 nt, Human
uaagggucauauguuugcuuguau

SEQ ID NO: 3217367 - RNA, 17 nt, Human
uaaggucagcucagagc

SEQ ID NO: 3217368 - RNA, 22 nt, Human
uaagguauaucauucuaaagau

SEQ ID NO: 3217369 - RNA, 21 nt, Human
uaagguauaucauucuaaaga

SEQ ID NO: 3217370 - RNA, 20 nt, Human
uaagguauaucauucuaaag

SEQ ID NO: 3217371 - RNA, 13 nt, Human
uaaggucuguuug

SEQ ID NO: 3217372 - RNA, 18 nt, Human
uaagggacugauguuugu

SEQ ID NO: 3217373 - RNA, 17 nt, Human
uaagggacugauguuug

SEQ ID NO: 3217374 - RNA, 16 nt, Human
uaagggacugauguuu

SEQ ID NO: 3217375 - RNA, 15 nt, Human
uaagggacugauguu

SEQ ID NO: 3217376 - RNA, 22 nt, Human
uaaggggaauuaacaauugcca

SEQ ID NO: 3217377 - RNA, 18 nt, Human
uaaggggaauuaacaauu

SEQ ID NO: 3217378 - RNA, 22 nt, Human
uaagggacugauguuugugcag

SEQ ID NO: 3217379 - RNA, 15 nt, Human
uaaggugugcucuga

SEQ ID NO: 3217380 - RNA, 12 nt, Human
uaagguguuuga

SEQ ID NO: 3217381 - RNA, 20 nt, Human
uaagguggguacgggagggu

SEQ ID NO: 3217382 - RNA, 22 nt, Human
uaaggucuguuugcuguugcug

SEQ ID NO: 3217383 - RNA, 19 nt, Human
uaaggucuguuugcuguug

SEQ ID NO: 3217384 - RNA, 18 nt, Human
uaaggucuguuugcuguu

SEQ ID NO: 3217385 - RNA, 23 nt, Human
uaagucagaaacuaaaacaaaua

SEQ ID NO: 3217386 - RNA, 14 nt, Human
uaaguauuuggaau

SEQ ID NO: 3217387 - RNA, 13 nt, Human
uaaguauuuggaa

SEQ ID NO: 3217388 - RNA, 21 nt, Human
uaaguauuuuccuguugucaa

SEQ ID NO: 3217389 - RNA, 20 nt, Human
uaaguauuuuccuguuguca

SEQ ID NO: 3217390 - RNA, 20 nt, Human
uaagguguuugaaaauaguu

SEQ ID NO: 3217391 - RNA, 21 nt, Human
uaagguguuugaaaauaguuu

SEQ ID NO: 3217392 - RNA, 15 nt, Human
uaagguguuugaaaa

SEQ ID NO: 3217393 - RNA, 16 nt, Human
uaagguguuugaaaau

SEQ ID NO: 3217394 - RNA, 17 nt, Human
uaagguguuugaaaaua

SEQ ID NO: 3217395 - RNA, 18 nt, Human
uaagguguuugaaaauag

SEQ ID NO: 3217396 - RNA, 16 nt, Human
uaaggauguucuagca

SEQ ID NO: 3217397 - RNA, 16 nt, Human
uaagcuaguugaauac

SEQ ID NO: 3217398 - RNA, 18 nt, Human
uaagcuaguugaauacuu

SEQ ID NO: 3217399 - RNA, 19 nt, Human
uaagcuaguugaauacuug

SEQ ID NO: 3217400 - RNA, 20 nt, Human
uaagcuaguugaauacuuga

SEQ ID NO: 3217401 - RNA, 22 nt, Human
uaagcuaggaaaagaaaucuau

SEQ ID NO: 3217402 - RNA, 20 nt, Human
uaagcuaggaaaagaaaucu

SEQ ID NO: 3217403 - RNA, 17 nt, Human
uaagcuaggaaaagaaa

SEQ ID NO: 3217404 - RNA, 13 nt, Human
uaagcuaggaaaa

SEQ ID NO: 3217405 - RNA, 21 nt, Human
uaagcuaguugaauacuugaa

SEQ ID NO: 3217406 - RNA, 22 nt, Human
uaagcuaguugaauacuugaac

SEQ ID NO: 3217407 - RNA, 15 nt, Human
uaagggaaaaaucaa

SEQ ID NO: 3217408 - RNA, 17 nt, Human
uaagggaacaaguugag

SEQ ID NO: 3217409 - RNA, 23 nt, Human
uaagggaacaaguugagcuauga

SEQ ID NO: 3217410 - RNA, 20 nt, Human
uaagggaaaaaucaaguauu

SEQ ID NO: 3217411 - RNA, 17 nt, Human
uaagggaaaagauaaag

SEQ ID NO: 3217412 - RNA, 15 nt, Human
uaagaggcagggucu

SEQ ID NO: 3217413 - RNA, 12 nt, Human
uaagaggcaggg

SEQ ID NO: 3217414 - RNA, 19 nt, Human
uaagccauucugacucaua

SEQ ID NO: 3217415 - RNA, 14 nt, Human
uaagccaugagaau

SEQ ID NO: 3217416 - RNA, 20 nt, Human
uaagccauucugacucauau

SEQ ID NO: 3217417 - RNA, 18 nt, Human
uaagcccacaguauauuu

SEQ ID NO: 3217418 - RNA, 22 nt, Human
uaagcguauggcuuuauuuuuu

SEQ ID NO: 3217419 - RNA, 15 nt, Human
uaagcguauggcuuu

SEQ ID NO: 3217420 - RNA, 16 nt, Human
uaagcguauggcuuua

SEQ ID NO: 3217421 - RNA, 20 nt, Human
uaagcggcucaagcccagga

SEQ ID NO: 3217422 - RNA, 17 nt, Human
uaagccaugagaauguu

SEQ ID NO: 3217423 - RNA, 23 nt, Human
uaauaaucauuggauucugagag

SEQ ID NO: 3217424 - RNA, 12 nt, Human
uaauaaucaaga

SEQ ID NO: 3217425 - RNA, 14 nt, Human
uaauaaucaagagc

SEQ ID NO: 3217426 - RNA, 19 nt, Human
uaauaaucaagagccuuaa

SEQ ID NO: 3217427 - RNA, 20 nt, Human
uaauaaucaagagccuuaaa

SEQ ID NO: 3217428 - RNA, 22 nt, Human
uaauaaucaagagccuuaaaac

SEQ ID NO: 3217429 - RNA, 16 nt, Human
uaauaauccugcaaag

SEQ ID NO: 3217430 - RNA, 14 nt, Human
uaauaucacucauu

SEQ ID NO: 3217431 - RNA, 16 nt, Human
uaauaucacucauuaa

SEQ ID NO: 3217432 - RNA, 17 nt, Human
uaauaucacucauuaau

SEQ ID NO: 3217433 - RNA, 18 nt, Human
uaauaucacucauuaauu

SEQ ID NO: 3217434 - RNA, 21 nt, Human
uaauaucacucauuaauuaac

SEQ ID NO: 3217435 - RNA, 14 nt, Human
uaauaugaaauuuu

SEQ ID NO: 3217436 - RNA, 16 nt, Human
uaauaucuucauuucu

SEQ ID NO: 3217437 - RNA, 15 nt, Human
uaauaucuuucugca

SEQ ID NO: 3217438 - RNA, 19 nt, Human
uaauaucuuucugcacaca

SEQ ID NO: 3217439 - RNA, 22 nt, Human
uaauaucuuucugcacacaaau

SEQ ID NO: 3217440 - RNA, 20 nt, Human
uaauaugcuuauaaccuagu

SEQ ID NO: 3217441 - RNA, 14 nt, Human
uaaucuacugcauu

SEQ ID NO: 3217442 - RNA, 16 nt, Human
uaaucuacugcauuua

SEQ ID NO: 3217443 - RNA, 15 nt, Human
uaaucuggacuccuc

SEQ ID NO: 3217444 - RNA, 18 nt, Human
uaaucuggacuccucugu

SEQ ID NO: 3217445 - RNA, 17 nt, Human
uaaucuggacuccucug

SEQ ID NO: 3217446 - RNA, 18 nt, Human
uaaucugggccagaauuu

SEQ ID NO: 3217447 - RNA, 23 nt, Human
uaaucugggccagaauuucaaac

SEQ ID NO: 3217448 - RNA, 18 nt, Human
uaaucuguauaauacuuu

SEQ ID NO: 3217449 - RNA, 22 nt, Human
uaaucuggacuccucuguccag

SEQ ID NO: 3217450 - RNA, 21 nt, Human
uaaucuggacuccucugucca

SEQ ID NO: 3217451 - RNA, 20 nt, Human
uaaucuggacuccucugucc

SEQ ID NO: 3217452 - RNA, 19 nt, Human
uaaucuggacuccucuguc

SEQ ID NO: 3217453 - RNA, 20 nt, Human
uaauauuaaggaagacaaug

SEQ ID NO: 3217454 - RNA, 22 nt, Human
uaaugcuaaucuugugaaaaua

SEQ ID NO: 3217455 - RNA, 17 nt, Human
uaaugcuaaucuuguga

SEQ ID NO: 3217456 - RNA, 15 nt, Human
uaauggggcggugag

SEQ ID NO: 3217457 - RNA, 13 nt, Human
uaauggaugaaau

SEQ ID NO: 3217458 - RNA, 16 nt, Human
uaauggaugaaaucau

SEQ ID NO: 3217459 - RNA, 15 nt, Human
uaauggaugaaauca

SEQ ID NO: 3217460 - RNA, 22 nt, Human
uaauggauuauaaucagaaugg

SEQ ID NO: 3217461 - RNA, 17 nt, Human
uaauggaugaaaucaua

SEQ ID NO: 3217462 - RNA, 16 nt, Human
uaaugcuuugguucug

SEQ ID NO: 3217463 - RNA, 11 nt, Human
uaaugcuuugg

SEQ ID NO: 3217464 - RNA, 21 nt, Human
uaauggaaaaugccaugaauu

SEQ ID NO: 3217465 - RNA, 23 nt, Human
uaauguugugaauaauuacagug

SEQ ID NO: 3217466 - RNA, 21 nt, Human
uaauguugugaauaauuacag

SEQ ID NO: 3217467 - RNA, 19 nt, Human
uaauguugugaauaauuac

SEQ ID NO: 3217468 - RNA, 18 nt, Human
uaauguugugaauaauua

SEQ ID NO: 3217469 - RNA, 13 nt, Human
uaauguugugaau

SEQ ID NO: 3217470 - RNA, 16 nt, Human
uaauguugugaauaau

SEQ ID NO: 3217471 - RNA, 14 nt, Human
uaauguugugaaua

SEQ ID NO: 3217472 - RNA, 18 nt, Human
uaauguugauuucuaguu

SEQ ID NO: 3217473 - RNA, 17 nt, Human
uaauguugauuucuagu

SEQ ID NO: 3217474 - RNA, 14 nt, Human
uaauguugauuucu

SEQ ID NO: 3217475 - RNA, 13 nt, Human
uaauguugauuuc

SEQ ID NO: 3217476 - RNA, 22 nt, Human
uaauguugaacaaaauaaauug

SEQ ID NO: 3217477 - RNA, 18 nt, Human
uaauguugaacaaaauaa

SEQ ID NO: 3217478 - RNA, 13 nt, Human
uaauguugaacaa

SEQ ID NO: 3217479 - RNA, 17 nt, Human
uaauguugaacaaaaua

SEQ ID NO: 3217480 - RNA, 16 nt, Human
uaauguugaacaaaau

SEQ ID NO: 3217481 - RNA, 17 nt, Human
uaauuaaguacuaugua

SEQ ID NO: 3217482 - RNA, 14 nt, Human
uaauuaaguacuau

SEQ ID NO: 3217483 - RNA, 14 nt, Human
uaauuagauccauu

SEQ ID NO: 3217484 - RNA, 17 nt, Human
uaauuagauccauuaau

SEQ ID NO: 3217485 - RNA, 18 nt, Human
uaauuagauccauuaauu

SEQ ID NO: 3217486 - RNA, 20 nt, Human
uaauuagauccauuaauuua

SEQ ID NO: 3217487 - RNA, 23 nt, Human
uaauuagauccauuaauuuaaau

SEQ ID NO: 3217488 - RNA, 20 nt, Human
uaaauuucgcuucuuagaac

SEQ ID NO: 3217489 - RNA, 18 nt, Human
uaaauuuauuuacugcua

SEQ ID NO: 3217490 - RNA, 15 nt, Human
uaaauuuauuuacug

SEQ ID NO: 3217491 - RNA, 14 nt, Human
uaaauuuauuuacu

SEQ ID NO: 3217492 - RNA, 13 nt, Human
uaaauuuauguga

SEQ ID NO: 3217493 - RNA, 20 nt, Human
uaaauugacacuuaaaaaug

SEQ ID NO: 3217494 - RNA, 18 nt, Human
uaacaccaugauuaacca

SEQ ID NO: 3217495 - RNA, 19 nt, Human
uaacacuacucaaagcaaa

SEQ ID NO: 3217496 - RNA, 14 nt, Human
uaacacuacucaaa

SEQ ID NO: 3217497 - RNA, 22 nt, Human
uaacacucuaggauguauauuu

SEQ ID NO: 3217498 - RNA, 16 nt, Human
uaaaugugccuucauu

SEQ ID NO: 3217499 - RNA, 11 nt, Human
uaaaugugaau

SEQ ID NO: 3217500 - RNA, 15 nt, Human
uaaaugugaauuacu

SEQ ID NO: 3217501 - RNA, 13 nt, Human
uaaaugugaauua

SEQ ID NO: 3217502 - RNA, 22 nt, Human
uaaaugugaauuacuaacuucu

SEQ ID NO: 3217503 - RNA, 11 nt, Human
uaaauuauuuu

SEQ ID NO: 3217504 - RNA, 15 nt, Human
uaaauucaaaccuaa

SEQ ID NO: 3217505 - RNA, 19 nt, Human
uaaauuccucaacaguguu

SEQ ID NO: 3217506 - RNA, 20 nt, Human
uaaauuccucaacaguguuu

SEQ ID NO: 3217507 - RNA, 22 nt, Human
uaaauuccucaacaguguuuuc

SEQ ID NO: 3217508 - RNA, 20 nt, Human
uaaauucugauuucuuuuca

SEQ ID NO: 3217509 - RNA, 15 nt, Human
uaaauucugauuucu

SEQ ID NO: 3217510 - RNA, 16 nt, Human
uaaauucugauuucuu

SEQ ID NO: 3217511 - RNA, 11 nt, Human
uaaauucugau

SEQ ID NO: 3217512 - RNA, 12 nt, Human
uaaauucugauu

SEQ ID NO: 3217513 - RNA, 13 nt, Human
uaaauucugauuu

SEQ ID NO: 3217514 - RNA, 14 nt, Human
uaaauucugauuuc

SEQ ID NO: 3217515 - RNA, 12 nt, Human
uaaaguuguacu

SEQ ID NO: 3217516 - RNA, 13 nt, Human
uaaaugcccagcc

SEQ ID NO: 3217517 - RNA, 13 nt, Human
uaaaguuucaaaa

SEQ ID NO: 3217518 - RNA, 12 nt, Human
uaaaguuucaaa

SEQ ID NO: 3217519 - RNA, 20 nt, Human
uaaaguuucaaaaaucugaa

SEQ ID NO: 3217520 - RNA, 19 nt, Human
uaaaguuucaaaaaucuga

SEQ ID NO: 3217521 - RNA, 18 nt, Human
uaaaguuucaaaaaucug

SEQ ID NO: 3217522 - RNA, 17 nt, Human
uaaaguuucaaaaaucu

SEQ ID NO: 3217523 - RNA, 22 nt, Human
uaaaguuguacuuuaaaaauuu

SEQ ID NO: 3217524 - RNA, 16 nt, Human
uaaaguuguacuuuaa

SEQ ID NO: 3217525 - RNA, 13 nt, Human
uaaaguuguacuu

SEQ ID NO: 3217526 - RNA, 17 nt, Human
uaaaguugguauuaaua

SEQ ID NO: 3217527 - RNA, 19 nt, Human
uaaaguugguauuaauaaa

SEQ ID NO: 3217528 - RNA, 20 nt, Human
uaaaguugguauuaauaaaa

SEQ ID NO: 3217529 - RNA, 14 nt, Human
uaaaugcccagccc

SEQ ID NO: 3217530 - RNA, 15 nt, Human
uaaaugcccagcccc

SEQ ID NO: 3217531 - RNA, 16 nt, Human
uaaaugcccagccccu

SEQ ID NO: 3217532 - RNA, 17 nt, Human
uaaaugcccagccccuu

SEQ ID NO: 3217533 - RNA, 20 nt, Human
uaaaugguuuggugcuuuuu

SEQ ID NO: 3217534 - RNA, 21 nt, Human
uaaaugguuuggugcuuuuua

SEQ ID NO: 3217535 - RNA, 22 nt, Human
uaaaugguuuggugcuuuuuau

SEQ ID NO: 3217536 - RNA, 20 nt, Human
uaaaugucuaguuguaacac

SEQ ID NO: 3217537 - RNA, 22 nt, Human
uaaaugucucuuuaaugucaca

SEQ ID NO: 3217538 - RNA, 17 nt, Human
uaaaugucaaaugugaa

SEQ ID NO: 3217539 - RNA, 18 nt, Human
uaaauguaguucauacuu

SEQ ID NO: 3217540 - RNA, 21 nt, Human
uaaauguagcuucagucauua

SEQ ID NO: 3217541 - RNA, 23 nt, Human
uaaauguagcuucagucauuaaa

SEQ ID NO: 3217542 - RNA, 14 nt, Human
uaagaaaucaagua

SEQ ID NO: 3217543 - RNA, 15 nt, Human
uaagaaaucaaguaa

SEQ ID NO: 3217544 - RNA, 16 nt, Human
uaagaaacauuggaag

SEQ ID NO: 3217545 - RNA, 15 nt, Human
uaagaaacauuggaa

SEQ ID NO: 3217546 - RNA, 13 nt, Human
uaagaaacauugg

SEQ ID NO: 3217547 - RNA, 12 nt, Human
uaagaaacauug

SEQ ID NO: 3217548 - RNA, 21 nt, Human
uaagaaacauuggaagcaggu

SEQ ID NO: 3217549 - RNA, 19 nt, Human
uaagaaaauagagaugagc

SEQ ID NO: 3217550 - RNA, 21 nt, Human
uaagaaaauagagaugagcuu

SEQ ID NO: 3217551 - RNA, 21 nt, Human
uaagagcuuccaauuuuccuu

SEQ ID NO: 3217552 - RNA, 18 nt, Human
uaagaggaaaguacauuu

SEQ ID NO: 3217553 - RNA, 15 nt, Human
uaagaggaaaguaca

SEQ ID NO: 3217554 - RNA, 19 nt, Human
uaagaggaaaguacauuuu

SEQ ID NO: 3217555 - RNA, 23 nt, Human
uaagaacccauggaaaaaugcca

SEQ ID NO: 3217556 - RNA, 19 nt, Human
uaagaaccuuuugagugcc

SEQ ID NO: 3217557 - RNA, 17 nt, Human
uaagaacaaaagaagca

SEQ ID NO: 3217558 - RNA, 13 nt, Human
uaacugugguguu

SEQ ID NO: 3217559 - RNA, 13 nt, Human
uaacuguuaccau

SEQ ID NO: 3217560 - RNA, 11 nt, Human
uaacuguuacc

SEQ ID NO: 3217561 - RNA, 14 nt, Human
uaacuguuacagua

SEQ ID NO: 3217562 - RNA, 17 nt, Human
uaacuguuacaguaaug

SEQ ID NO: 3217563 - RNA, 20 nt, Human
uaacuguuacaguaauguca

SEQ ID NO: 3217564 - RNA, 21 nt, Human
uaacuguuacaguaaugucau

SEQ ID NO: 3217565 - RNA, 19 nt, Human
uaacuguuaccauuggaaa

SEQ ID NO: 3217566 - RNA, 18 nt, Human
uaacuguuaccauuggaa

SEQ ID NO: 3217567 - RNA, 15 nt, Human
uaacuguuaccauug

SEQ ID NO: 3217568 - RNA, 14 nt, Human
uaacuguuaccauu

SEQ ID NO: 3217569 - RNA, 23 nt, Human
uaacugcucuugggcaauauucu

SEQ ID NO: 3217570 - RNA, 19 nt, Human
uaagaaaaagcaaaaggca

SEQ ID NO: 3217571 - RNA, 16 nt, Human
uaagaaaagauguaga

SEQ ID NO: 3217572 - RNA, 16 nt, Human
uaaccacuucagcuga

SEQ ID NO: 3217573 - RNA, 13 nt, Human
uaacccagaaaau

SEQ ID NO: 3217574 - RNA, 16 nt, Human
uaaccagacacaaacu

SEQ ID NO: 3217575 - RNA, 16 nt, Human
uaacacugugaagagc

SEQ ID NO: 3217576 - RNA, 15 nt, Human
uaacacugugaagag

SEQ ID NO: 3217577 - RNA, 19 nt, Human
uaacauucuauuucaacuu

SEQ ID NO: 3217578 - RNA, 15 nt, Human
uaacauucuauuuca

SEQ ID NO: 3217579 - RNA, 15 nt, Human
uaacauuuuucaaua

SEQ ID NO: 3217580 - RNA, 19 nt, Human
uaacauuuuucaauagcgu

SEQ ID NO: 3217581 - RNA, 21 nt, Human
uaacuccuaguagggguacca

SEQ ID NO: 3217582 - RNA, 22 nt, Human
uaacucaaggauaccuucuuau

SEQ ID NO: 3217583 - RNA, 23 nt, Human
uaacucaaggauaccuucuuauu

SEQ ID NO: 3217584 - RNA, 15 nt, Human
uaacuauguuuaaag

SEQ ID NO: 3217585 - RNA, 16 nt, Human
uaacuauguugauaaa

SEQ ID NO: 3217586 - RNA, 16 nt, Human
uaacccagaaaaucug

SEQ ID NO: 3217587 - RNA, 13 nt, Human
uaacugaauuugg

SEQ ID NO: 3217588 - RNA, 11 nt, Human
uaacugcucuu

SEQ ID NO: 3217589 - RNA, 15 nt, Human
uaacugacuuaguuc

SEQ ID NO: 3217590 - RNA, 19 nt, Human
uaacugcucuugggcaaua

SEQ ID NO: 3217591 - RNA, 16 nt, Human
uaacugcucuugggca

SEQ ID NO: 3217592 - RNA, 15 nt, Human
uaacugcucuugggc

SEQ ID NO: 3217593 - RNA, 12 nt, Human
uaacugcucuug

SEQ ID NO: 3217594 - RNA, 16 nt, Human
uaacugaaauaaaaaa

SEQ ID NO: 3217595 - RNA, 14 nt, Human
guuuuaaaauacug

SEQ ID NO: 3217596 - RNA, 16 nt, Human
guuuuaaaagccuugg

SEQ ID NO: 3217597 - RNA, 21 nt, Human
guuuuaaaauacuguagauaa

SEQ ID NO: 3217598 - RNA, 19 nt, Human
guuuuaaaauacuguagau

SEQ ID NO: 3217599 - RNA, 18 nt, Human
guuuuaaaauacuguaga

SEQ ID NO: 3217600 - RNA, 16 nt, Human
guuuuaaaauacugua

SEQ ID NO: 3217601 - RNA, 20 nt, Human
guuuguuucugaaagggacg

SEQ ID NO: 3217602 - RNA, 16 nt, Human
guuuguuucuuugaau

SEQ ID NO: 3217603 - RNA, 14 nt, Human
guuuguuccagaau

SEQ ID NO: 3217604 - RNA, 14 nt, Human
guuuguuuguuuca

SEQ ID NO: 3217605 - RNA, 15 nt, Human
guuuguuuugugaau

SEQ ID NO: 3217606 - RNA, 23 nt, Human
guuuguuuuuuguuuuucugcuu

SEQ ID NO: 3217607 - RNA, 17 nt, Human
guuuucaaaauaaaaau

SEQ ID NO: 3217608 - RNA, 18 nt, Human
guuuucaaccucuagaau

SEQ ID NO: 3217609 - RNA, 23 nt, Human
guuuucaacucuucccugaacuu

SEQ ID NO: 3217610 - RNA, 19 nt, Human
guuuucaaccucuagaauu

SEQ ID NO: 3217611 - RNA, 13 nt, Human
guuuucaaaugga

SEQ ID NO: 3217612 - RNA, 16 nt, Human
guuuucaaauggaguu

SEQ ID NO: 3217613 - RNA, 14 nt, Human
guuuucaaauggag

SEQ ID NO: 3217614 - RNA, 21 nt, Human
guuuuauuuucuaaaguacug

SEQ ID NO: 3217615 - RNA, 12 nt, Human
guuuucacucuu

SEQ ID NO: 3217616 - RNA, 11 nt, Human
guuuucacucu

SEQ ID NO: 3217617 - RNA, 16 nt, Human
guuuucagaagaaaua

SEQ ID NO: 3217618 - RNA, 18 nt, Human
guuuucagaagaaauaaa

SEQ ID NO: 3217619 - RNA, 20 nt, Human
guuuuccagguuuaagcugu

SEQ ID NO: 3217620 - RNA, 22 nt, Human
guuuucagcuaggaacaaaucu

SEQ ID NO: 3217621 - RNA, 19 nt, Human
guuuuccaugaguccccug

SEQ ID NO: 3217622 - RNA, 20 nt, Human
guuuuccaugaguccccugu

SEQ ID NO: 3217623 - RNA, 21 nt, Human
guuuuccgcauucuuuguaca

SEQ ID NO: 3217624 - RNA, 16 nt, Human
guuuucccugaaguua

SEQ ID NO: 3217625 - RNA, 15 nt, Human
guuuucccugaaguu

SEQ ID NO: 3217626 - RNA, 21 nt, Human
guuuuguaaacuuugaaauau

SEQ ID NO: 3217627 - RNA, 18 nt, Human
guuuuguaaacuuugaaa

SEQ ID NO: 3217628 - RNA, 21 nt, Human
guuuugguccacuuuuccagu

SEQ ID NO: 3217629 - RNA, 16 nt, Human
guuuugguccacuuuu

SEQ ID NO: 3217630 - RNA, 16 nt, Human
guuuuguaaacuuuga

SEQ ID NO: 3217631 - RNA, 19 nt, Human
guuuuguugcacugaaguu

SEQ ID NO: 3217632 - RNA, 18 nt, Human
guuuuguugcacugaagu

SEQ ID NO: 3217633 - RNA, 10 nt, Human
guuuuguugc

SEQ ID NO: 3217634 - RNA, 11 nt, Human
guuucuuagac

SEQ ID NO: 3217635 - RNA, 15 nt, Human
guuucuuaauuugga

SEQ ID NO: 3217636 - RNA, 16 nt, Human
guuucuuaauuuggaa

SEQ ID NO: 3217637 - RNA, 18 nt, Human
guuucuuaauuuggaaac

SEQ ID NO: 3217638 - RNA, 22 nt, Human
guuuccuaaaauaucugggugg

SEQ ID NO: 3217639 - RNA, 15 nt, Human
guuuccuaaauccaa

SEQ ID NO: 3217640 - RNA, 21 nt, Human
guuuccuaaauccaaccauuu

SEQ ID NO: 3217641 - RNA, 11 nt, Human
guuugaaaagc

SEQ ID NO: 3217642 - RNA, 15 nt, Human
guuugaaaagcaaua

SEQ ID NO: 3217643 - RNA, 20 nt, Human
guuugaaaagcaauauugua

SEQ ID NO: 3217644 - RNA, 16 nt, Human
guuucuuuuugaaucu

SEQ ID NO: 3217645 - RNA, 13 nt, Human
guuucuuuuugaa

SEQ ID NO: 3217646 - RNA, 13 nt, Human
guuugaaaauagu

SEQ ID NO: 3217647 - RNA, 16 nt, Human
guuugaaaauaguuua

SEQ ID NO: 3217648 - RNA, 17 nt, Human
guuugagaucagccugg

SEQ ID NO: 3217649 - RNA, 18 nt, Human
guuuguuucugaaaggga

SEQ ID NO: 3217650 - RNA, 16 nt, Human
guuuguauguauaauu

SEQ ID NO: 3217651 - RNA, 14 nt, Human
guuuguauguauaa

SEQ ID NO: 3217652 - RNA, 13 nt, Human
guuugguucaaau

SEQ ID NO: 3217653 - RNA, 15 nt, Human
guuuguaacaagaaa

SEQ ID NO: 3217654 - RNA, 22 nt, Human
guuugguucaaauguguuuugg

SEQ ID NO: 3217655 - RNA, 16 nt, Human
guuugauucagacagc

SEQ ID NO: 3217656 - RNA, 20 nt, Human
guuugauucagacagcugcc

SEQ ID NO: 3217657 - RNA, 18 nt, Human
guuuggggaugagaaagg

SEQ ID NO: 3217658 - RNA, 16 nt, Human
guuuggugcaaaguau

SEQ ID NO: 3217659 - RNA, 13 nt, Human
guuuggugcuuuu

SEQ ID NO: 3217660 - RNA, 15 nt, Human
guuugguccuguagg

SEQ ID NO: 3217661 - RNA, 14 nt, Human
guugugaauaauua

SEQ ID NO: 3217662 - RNA, 13 nt, Human
guugugaauaauu

SEQ ID NO: 3217663 - RNA, 17 nt, Human
guugucucuucuccuua

SEQ ID NO: 3217664 - RNA, 14 nt, Human
guugucucuucucc

SEQ ID NO: 3217665 - RNA, 22 nt, Human
guugucugaagucacugcacag

SEQ ID NO: 3217666 - RNA, 19 nt, Human
guugucugaagucacugca

SEQ ID NO: 3217667 - RNA, 12 nt, Human
guugucucuucu

SEQ ID NO: 3217668 - RNA, 12 nt, Human
guuguguguggg

SEQ ID NO: 3217669 - RNA, 13 nt, Human
guuguguguggga

SEQ ID NO: 3217670 - RNA, 14 nt, Human
guugugugugggag

SEQ ID NO: 3217671 - RNA, 16 nt, Human
guugugugugggagug

SEQ ID NO: 3217672 - RNA, 22 nt, Human
guugugugugggaguguguaau

SEQ ID NO: 3217673 - RNA, 14 nt, Human
guugugguuaaucu

SEQ ID NO: 3217674 - RNA, 21 nt, Human
guugugugccucuagcugaau

SEQ ID NO: 3217675 - RNA, 10 nt, Human
guugugugcc

SEQ ID NO: 3217676 - RNA, 19 nt, Human
guuguccgguuuacuuuaa

SEQ ID NO: 3217677 - RNA, 12 nt, Human
guugucagcuga

SEQ ID NO: 3217678 - RNA, 19 nt, Human
guuggcugggggccucagu

SEQ ID NO: 3217679 - RNA, 18 nt, Human
guugucaagaauagcauu

SEQ ID NO: 3217680 - RNA, 14 nt, Human
guugucaagaauag

SEQ ID NO: 3217681 - RNA, 22 nt, Human
guugucaagaauagcauuguaa

SEQ ID NO: 3217682 - RNA, 12 nt, Human
guuggcuggggg

SEQ ID NO: 3217683 - RNA, 14 nt, Human
guuggccccugccc

SEQ ID NO: 3217684 - RNA, 13 nt, Human
guuggccccugcc

SEQ ID NO: 3217685 - RNA, 20 nt, Human
guuggccccugcccggcugc

SEQ ID NO: 3217686 - RNA, 13 nt, Human
guuggccucugca

SEQ ID NO: 3217687 - RNA, 16 nt, Human
guuuagaagaagugug

SEQ ID NO: 3217688 - RNA, 14 nt, Human
guuuagaauugaag

SEQ ID NO: 3217689 - RNA, 15 nt, Human
guuuagaacagguuu

SEQ ID NO: 3217690 - RNA, 15 nt, Human
guuuacucacagcca

SEQ ID NO: 3217691 - RNA, 17 nt, Human
guuuagaaagcuugccc

SEQ ID NO: 3217692 - RNA, 12 nt, Human
guuuagaacagg

SEQ ID NO: 3217693 - RNA, 21 nt, Human
guuuaccuggcuuauuuaaua

SEQ ID NO: 3217694 - RNA, 22 nt, Human
guuguuugaugcauuaaaagaa

SEQ ID NO: 3217695 - RNA, 19 nt, Human
guuguuucuuaauuuggaa

SEQ ID NO: 3217696 - RNA, 20 nt, Human
guuguuucuuaauuuggaaa

SEQ ID NO: 3217697 - RNA, 19 nt, Human
guuguucuuggcaauaaau

SEQ ID NO: 3217698 - RNA, 21 nt, Human
guuguucuuggcaauaaauuu

SEQ ID NO: 3217699 - RNA, 16 nt, Human
guuuagaauugaaggu

SEQ ID NO: 3217700 - RNA, 18 nt, Human
guuuauaguuaaucuaua

SEQ ID NO: 3217701 - RNA, 17 nt, Human
guuuauaguuaaucuau

SEQ ID NO: 3217702 - RNA, 15 nt, Human
guuuaguuugcauuu

SEQ ID NO: 3217703 - RNA, 16 nt, Human
guuuaguuugcauuua

SEQ ID NO: 3217704 - RNA, 21 nt, Human
guuuagugugguuuucuguuu

SEQ ID NO: 3217705 - RNA, 15 nt, Human
guuucauccuuccca

SEQ ID NO: 3217706 - RNA, 17 nt, Human
guuucauccuucccacu

SEQ ID NO: 3217707 - RNA, 22 nt, Human
guuucauauucaugcaaguauu

SEQ ID NO: 3217708 - RNA, 14 nt, Human
guuucauccuuccc

SEQ ID NO: 3217709 - RNA, 19 nt, Human
guuuauauggaagaaagua

SEQ ID NO: 3217710 - RNA, 21 nt, Human
guuuauauggaagaaaguaag

SEQ ID NO: 3217711 - RNA, 19 nt, Human
guuuauaucuccuuuguau

SEQ ID NO: 3217712 - RNA, 15 nt, Human
guuuauaucuccuuu

SEQ ID NO: 3217713 - RNA, 18 nt, Human
guuuaucuagauguaaau

SEQ ID NO: 3217714 - RNA, 17 nt, Human
guuuaucuagauguaaa

SEQ ID NO: 3217715 - RNA, 15 nt, Human
guuuaucuagaugua

SEQ ID NO: 3217716 - RNA, 22 nt, Human
guuuaucgcccuggcaggcagg

SEQ ID NO: 3217717 - RNA, 22 nt, Human
guuuaucccuuaagaaugaguu

SEQ ID NO: 3217718 - RNA, 17 nt, Human
guuuaucccuuaagaau

SEQ ID NO: 3217719 - RNA, 16 nt, Human
guuuaucccuuaagaa

SEQ ID NO: 3217720 - RNA, 21 nt, Human
guuuaucagaaagggcagaag

SEQ ID NO: 3217721 - RNA, 17 nt, Human
uaaagccauucugauua

SEQ ID NO: 3217722 - RNA, 11 nt, Human
uaaagccucaa

SEQ ID NO: 3217723 - RNA, 12 nt, Human
uaaagaaaacug

SEQ ID NO: 3217724 - RNA, 22 nt, Human
uaaagaaaaauauuuaauguug

SEQ ID NO: 3217725 - RNA, 21 nt, Human
uaaagaaaaauauuuaauguu

SEQ ID NO: 3217726 - RNA, 14 nt, Human
uaaagaaacauggu

SEQ ID NO: 3217727 - RNA, 21 nt, Human
uaaagcaagcucacuugcuuu

SEQ ID NO: 3217728 - RNA, 19 nt, Human
uaaagcaagcucacuugcu

SEQ ID NO: 3217729 - RNA, 21 nt, Human
uaaaggcccuaucuguuuaca

SEQ ID NO: 3217730 - RNA, 15 nt, Human
uaaaggccucugccu

SEQ ID NO: 3217731 - RNA, 21 nt, Human
uaaaggcagcuguugucucuu

SEQ ID NO: 3217732 - RNA, 20 nt, Human
uaaaggcagcuguugucucu

SEQ ID NO: 3217733 - RNA, 15 nt, Human
uaaaggcagcuguug

SEQ ID NO: 3217734 - RNA, 23 nt, Human
uaaaggaaucuagccagugaaca

SEQ ID NO: 3217735 - RNA, 14 nt, Human
uaaagcugaaaacu

SEQ ID NO: 3217736 - RNA, 16 nt, Human
uaaagcuuuugaugug

SEQ ID NO: 3217737 - RNA, 23 nt, Human
uaaaggccucugccucacaacau

SEQ ID NO: 3217738 - RNA, 20 nt, Human
uaaaggccucugccucacaa

SEQ ID NO: 3217739 - RNA, 17 nt, Human
uaaaguucauugcaauu

SEQ ID NO: 3217740 - RNA, 13 nt, Human
uaaagugugugau

SEQ ID NO: 3217741 - RNA, 12 nt, Human
uaaacacucagc

SEQ ID NO: 3217742 - RNA, 14 nt, Human
uaaacacucagcug

SEQ ID NO: 3217743 - RNA, 15 nt, Human
uaaacacucagcugu

SEQ ID NO: 3217744 - RNA, 16 nt, Human
uaaacacucagcuguu

SEQ ID NO: 3217745 - RNA, 17 nt, Human
uaaacacucagcuguuc

SEQ ID NO: 3217746 - RNA, 22 nt, Human
uaaacacucagcuguucagauu

SEQ ID NO: 3217747 - RNA, 17 nt, Human
uaaacaucagguuaggc

SEQ ID NO: 3217748 - RNA, 16 nt, Human
uaaacaucagguuagg

SEQ ID NO: 3217749 - RNA, 20 nt, Human
uaaacaucagguuaggcagu

SEQ ID NO: 3217750 - RNA, 19 nt, Human
uaaacaucagguuaggcag

SEQ ID NO: 3217751 - RNA, 21 nt, Human
uaaacaucagguuaggcagua

SEQ ID NO: 3217752 - RNA, 14 nt, Human
uaaaaucuuauuaa

SEQ ID NO: 3217753 - RNA, 17 nt, Human
uaaaaucuuauuaaagu

SEQ ID NO: 3217754 - RNA, 15 nt, Human
uaaaaucuuauuaaa

SEQ ID NO: 3217755 - RNA, 22 nt, Human
uaaaaucuuauuaaaguuucaa

SEQ ID NO: 3217756 - RNA, 21 nt, Human
uaaaaucuuauuaaaguuuca

SEQ ID NO: 3217757 - RNA, 19 nt, Human
uaaaaucuuauuaaaguuu

SEQ ID NO: 3217758 - RNA, 18 nt, Human
uaaaaucuuauuaaaguu

SEQ ID NO: 3217759 - RNA, 23 nt, Human
uaaaaucuuauuaaaguuucaaa

SEQ ID NO: 3217760 - RNA, 16 nt, Human
uaaaaucuugaaaaug

SEQ ID NO: 3217761 - RNA, 21 nt, Human
uaaaaucauaaguauuuggaa

SEQ ID NO: 3217762 - RNA, 14 nt, Human
uaaagaaaaaaaug

SEQ ID NO: 3217763 - RNA, 16 nt, Human
uaaagaaaaaaauguc

SEQ ID NO: 3217764 - RNA, 17 nt, Human
uaaagaaaaaaauguca

SEQ ID NO: 3217765 - RNA, 20 nt, Human
uaaagaaaaaaaugucaaaa

SEQ ID NO: 3217766 - RNA, 22 nt, Human
uaaagaaaaaaaugucaaaagu

SEQ ID NO: 3217767 - RNA, 20 nt, Human
uaaagaaaaauauuuaaugu

SEQ ID NO: 3217768 - RNA, 17 nt, Human
uaaagaaaaauauuuaa

SEQ ID NO: 3217769 - RNA, 15 nt, Human
uaaagaaaaauauuu

SEQ ID NO: 3217770 - RNA, 14 nt, Human
uaaagaaaaauauu

SEQ ID NO: 3217771 - RNA, 22 nt, Human
uaaacuugguuuuuaaaaaacu

SEQ ID NO: 3217772 - RNA, 22 nt, Human
uaaacuuggugcuuauugauau

SEQ ID NO: 3217773 - RNA, 14 nt, Human
uaaacuguuaacuu

SEQ ID NO: 3217774 - RNA, 21 nt, Human
uaaacuguuaacuuauucaaa

SEQ ID NO: 3217775 - RNA, 13 nt, Human
uaaacuuccaaag

SEQ ID NO: 3217776 - RNA, 15 nt, Human
uaaacuuccaaagaa

SEQ ID NO: 3217777 - RNA, 17 nt, Human
uaaacuuccaaagaaag

SEQ ID NO: 3217778 - RNA, 21 nt, Human
uaaacuuccaaagaaaguucu

SEQ ID NO: 3217779 - RNA, 11 nt, Human
uaaacauuuuc

SEQ ID NO: 3217780 - RNA, 17 nt, Human
uaaacugucgugucaua

SEQ ID NO: 3217781 - RNA, 19 nt, Human
guuuuguuuccuuucacug

SEQ ID NO: 3217782 - RNA, 21 nt, Human
guuuuuaaggguuuguggaaa

SEQ ID NO: 3217783 - RNA, 17 nt, Human
guuuuuaaguuugcacu

SEQ ID NO: 3217784 - RNA, 22 nt, Human
uaaaaacagauuuggaaagacu

SEQ ID NO: 3217785 - RNA, 20 nt, Human
uaaaaacagauuuggaaaga

SEQ ID NO: 3217786 - RNA, 22 nt, Human
uaaaaagauaaaaaaacagcuu

SEQ ID NO: 3217787 - RNA, 12 nt, Human
uaaaaagauaau

SEQ ID NO: 3217788 - RNA, 16 nt, Human
uaaaaagauaaucuca

SEQ ID NO: 3217789 - RNA, 23 nt, Human
uaaaaagauaaucucagugcuuu

SEQ ID NO: 3217790 - RNA, 15 nt, Human
uaaaaaugguuuaaa

SEQ ID NO: 3217791 - RNA, 18 nt, Human
uaaaaaugguuuaaaugg

SEQ ID NO: 3217792 - RNA, 19 nt, Human
uaaaaaugguuuaaauggu

SEQ ID NO: 3217793 - RNA, 12 nt, Human
uaaaaagcccaa

SEQ ID NO: 3217794 - RNA, 20 nt, Human
uaaaaagcccaaccucuucc

SEQ ID NO: 3217795 - RNA, 16 nt, Human
uaaaaagcccaaccuc

SEQ ID NO: 3217796 - RNA, 15 nt, Human
uaaaacaacacucac

SEQ ID NO: 3217797 - RNA, 19 nt, Human
uaaaaauuccagaaugaag

SEQ ID NO: 3217798 - RNA, 21 nt, Human
uaaaaauucuagauuaccaug

SEQ ID NO: 3217799 - RNA, 18 nt, Human
uaaaaauuagccuaagau

SEQ ID NO: 3217800 - RNA, 16 nt, Human
uaaaaauuccagaaug

SEQ ID NO: 3217801 - RNA, 14 nt, Human
uaaaaauuccagaa

SEQ ID NO: 3217802 - RNA, 17 nt, Human
uaaaaauuacuguguua

SEQ ID NO: 3217803 - RNA, 19 nt, Human
uaaaaauuuacuacaauau

SEQ ID NO: 3217804 - RNA, 15 nt, Human
uaaaaauuuacuaca

SEQ ID NO: 3217805 - RNA, 22 nt, Human
uaaaacacaacaucuuuuucua

SEQ ID NO: 3217806 - RNA, 23 nt, Human
uaaaacacaacaucuuuuucuac

SEQ ID NO: 3217807 - RNA, 17 nt, Human
uaaaacacaacaucuuu

SEQ ID NO: 3217808 - RNA, 19 nt, Human
uaaaacacuucauugaaaa

SEQ ID NO: 3217809 - RNA, 19 nt, Human
uaaaacacuuccauaaucu

SEQ ID NO: 3217810 - RNA, 19 nt, Human
uaaaacagaguaaucuugu

SEQ ID NO: 3217811 - RNA, 17 nt, Human
uaaaacagaguaaucuu

SEQ ID NO: 3217812 - RNA, 17 nt, Human
uaaaagauaaauauuau

SEQ ID NO: 3217813 - RNA, 19 nt, Human
uaaaacauuaaaauauaau

SEQ ID NO: 3217814 - RNA, 16 nt, Human
uaaaacauuaaaauau

SEQ ID NO: 3217815 - RNA, 15 nt, Human
uaaaacauuaaaaua

SEQ ID NO: 3217816 - RNA, 21 nt, Human
uaaaacaguuggcaugcaucc

SEQ ID NO: 3217817 - RNA, 22 nt, Human
uaaaacaguuggcaugcauccc

SEQ ID NO: 3217818 - RNA, 15 nt, Human
uaaaacaucauuccu

SEQ ID NO: 3217819 - RNA, 18 nt, Human
uaaaacaugacuccuaca

SEQ ID NO: 3217820 - RNA, 12 nt, Human
uaaaacauuaaa

SEQ ID NO: 3217821 - RNA, 16 nt, Human
uaaaacaucauuccuu

SEQ ID NO: 3217822 - RNA, 17 nt, Human
uaaaacaucauuccuuu

SEQ ID NO: 3217823 - RNA, 20 nt, Human
uaaaacaucauuccuuuuua

SEQ ID NO: 3217824 - RNA, 22 nt, Human
uaaaagagaccacccauaucau

SEQ ID NO: 3217825 - RNA, 23 nt, Human
uaaaagagaccacccauaucaug

SEQ ID NO: 3217826 - RNA, 22 nt, Human
uaaaaucauuucugcaucagcu

SEQ ID NO: 3217827 - RNA, 18 nt, Human
uaaaaucauuucugcauc

SEQ ID NO: 3217828 - RNA, 13 nt, Human
uaaaaucauuucu

SEQ ID NO: 3217829 - RNA, 10 nt, Human
uaaaaucauu

SEQ ID NO: 3217830 - RNA, 12 nt, Human
uaaaaggugacc

SEQ ID NO: 3217831 - RNA, 16 nt, Human
uaaaaucauaaguauu

SEQ ID NO: 3217832 - RNA, 21 nt, Human
uaaaagguaugcaaucaaauc

SEQ ID NO: 3217833 - RNA, 12 nt, Human
uaaaaggagcca

SEQ ID NO: 3217834 - RNA, 21 nt, Human
uaaaagcagcauaaagaauuu

SEQ ID NO: 3217835 - RNA, 18 nt, Human
uaaaagcagcauaaagaa

SEQ ID NO: 3217836 - RNA, 19 nt, Human
uaaaagcacaaaggaauga

SEQ ID NO: 3217837 - RNA, 16 nt, Human
uaaaagcaacaucagc

SEQ ID NO: 3217838 - RNA, 18 nt, Human
uaaaagcaacaucagcuu

SEQ ID NO: 3217839 - RNA, 19 nt, Human
uaaaagcaacaucagcuug

SEQ ID NO: 3217840 - RNA, 20 nt, Human
uaaaagcaacaucagcuuga

SEQ ID NO: 3217841 - RNA, 20 nt, Human
uauauuuguaaauuuaugug

SEQ ID NO: 3217842 - RNA, 23 nt, Human
uauauuuggaugcagaguucagg

SEQ ID NO: 3217843 - RNA, 16 nt, Human
uauauuugauuuauua

SEQ ID NO: 3217844 - RNA, 17 nt, Human
uauauuugauuuauuaa

SEQ ID NO: 3217845 - RNA, 20 nt, Human
uauauuugauuuauuaacuu

SEQ ID NO: 3217846 - RNA, 22 nt, Human
uauauuugauuuauuaacuuaa

SEQ ID NO: 3217847 - RNA, 13 nt, Human
uauauuugauuua

SEQ ID NO: 3217848 - RNA, 14 nt, Human
uauaugaaaacuaa

SEQ ID NO: 3217849 - RNA, 19 nt, Human
uauaugaacuuaacaugcu

SEQ ID NO: 3217850 - RNA, 22 nt, Human
uauaugaacuuaacaugcugug

SEQ ID NO: 3217851 - RNA, 19 nt, Human
uauaugaacauacaaaugc

SEQ ID NO: 3217852 - RNA, 15 nt, Human
uauauggaagaaagu

SEQ ID NO: 3217853 - RNA, 16 nt, Human
uauauggaagaaagua

SEQ ID NO: 3217854 - RNA, 21 nt, Human
uauauuuuuuguuaaaugauu

SEQ ID NO: 3217855 - RNA, 19 nt, Human
uauauuuuuuguuaaauga

SEQ ID NO: 3217856 - RNA, 16 nt, Human
uauauuuuuuuaacuu

SEQ ID NO: 3217857 - RNA, 19 nt, Human
uaucaaaaagauaucaaag

SEQ ID NO: 3217858 - RNA, 22 nt, Human
uauauuuuauuuuuagaauuuu

SEQ ID NO: 3217859 - RNA, 17 nt, Human
uauauuuuauuucaaug

SEQ ID NO: 3217860 - RNA, 18 nt, Human
uauauuuuauuucaaugu

SEQ ID NO: 3217861 - RNA, 13 nt, Human
uauauuuguauua

SEQ ID NO: 3217862 - RNA, 18 nt, Human
uauauuuuauuuuuagaa

SEQ ID NO: 3217863 - RNA, 21 nt, Human
uauauuuuguaugcaagcagu

SEQ ID NO: 3217864 - RNA, 17 nt, Human
uauauuuuguaugcaag

SEQ ID NO: 3217865 - RNA, 16 nt, Human
uauauuuuguaugcaa

SEQ ID NO: 3217866 - RNA, 15 nt, Human
uauauuuuguaugca

SEQ ID NO: 3217867 - RNA, 13 nt, Human
uaucaguuugcua

SEQ ID NO: 3217868 - RNA, 18 nt, Human
uaucaguuuuauagcuuu

SEQ ID NO: 3217869 - RNA, 20 nt, Human
uaucaggugcugccauccag

SEQ ID NO: 3217870 - RNA, 17 nt, Human
uaucaggugcugccauc

SEQ ID NO: 3217871 - RNA, 14 nt, Human
uaucaaaagaaaga

SEQ ID NO: 3217872 - RNA, 20 nt, Human
uaucaaacuacuuuuuaaca

SEQ ID NO: 3217873 - RNA, 19 nt, Human
uaucaggugcugccaucca

SEQ ID NO: 3217874 - RNA, 23 nt, Human
uaucaugcacacaauuagauuuc

SEQ ID NO: 3217875 - RNA, 18 nt, Human
uaucaucacguauguuau

SEQ ID NO: 3217876 - RNA, 20 nt, Human
uaucaucacguauguuauac

SEQ ID NO: 3217877 - RNA, 21 nt, Human
uaucaucacguauguuauaca

SEQ ID NO: 3217878 - RNA, 13 nt, Human
uaucauguuaacc

SEQ ID NO: 3217879 - RNA, 21 nt, Human
uauaucuuggcagguaggaau

SEQ ID NO: 3217880 - RNA, 13 nt, Human
uauauaaaauaac

SEQ ID NO: 3217881 - RNA, 14 nt, Human
uauauaaaauaacu

SEQ ID NO: 3217882 - RNA, 12 nt, Human
uauauaaaaaug

SEQ ID NO: 3217883 - RNA, 15 nt, Human
uauauaaaaauggcu

SEQ ID NO: 3217884 - RNA, 11 nt, Human
uauauaaaaau

SEQ ID NO: 3217885 - RNA, 22 nt, Human
uauaguauuugaaaacagaaau

SEQ ID NO: 3217886 - RNA, 14 nt, Human
uauagugcaauaua

SEQ ID NO: 3217887 - RNA, 11 nt, Human
uauaguauuug

SEQ ID NO: 3217888 - RNA, 14 nt, Human
uauaguauuugaaa

SEQ ID NO: 3217889 - RNA, 13 nt, Human
uauaguauuugaa

SEQ ID NO: 3217890 - RNA, 20 nt, Human
uauaguauuugaaaacagaa

SEQ ID NO: 3217891 - RNA, 18 nt, Human
uauaguauuugaaaacag

SEQ ID NO: 3217892 - RNA, 17 nt, Human
uauaguauuugaaaaca

SEQ ID NO: 3217893 - RNA, 15 nt, Human
uauaguauuugaaaa

SEQ ID NO: 3217894 - RNA, 15 nt, Human
uauagauauaaugaa

SEQ ID NO: 3217895 - RNA, 20 nt, Human
uauagauauaaugaacaaaa

SEQ ID NO: 3217896 - RNA, 21 nt, Human
uauagauauaaugaacaaaau

SEQ ID NO: 3217897 - RNA, 23 nt, Human
uauagauauaaugaacaaaauua

SEQ ID NO: 3217898 - RNA, 20 nt, Human
uauagagucauuguaauguu

SEQ ID NO: 3217899 - RNA, 15 nt, Human
uauagagcagaaauu

SEQ ID NO: 3217900 - RNA, 18 nt, Human
uauagagcagaaauucug

SEQ ID NO: 3217901 - RNA, 17 nt, Human
uauagagcagaaauucu

SEQ ID NO: 3217902 - RNA, 18 nt, Human
uauagagucauuguaaug

SEQ ID NO: 3217903 - RNA, 20 nt, Human
uauagagcagaaauucuguu

SEQ ID NO: 3217904 - RNA, 19 nt, Human
uauagagcagaaauucugu

SEQ ID NO: 3217905 - RNA, 13 nt, Human
uauagaagucuuc

SEQ ID NO: 3217906 - RNA, 20 nt, Human
uauagaagaaugcaugcuuu

SEQ ID NO: 3217907 - RNA, 18 nt, Human
uauagaagaaugcaugcu

SEQ ID NO: 3217908 - RNA, 13 nt, Human
uauagaagaaugc

SEQ ID NO: 3217909 - RNA, 23 nt, Human
uauagaaaguguucuguuacaaa

SEQ ID NO: 3217910 - RNA, 22 nt, Human
uauagaaaguguucuguuacaa

SEQ ID NO: 3217911 - RNA, 21 nt, Human
uauagaaaguguucuguuaca

SEQ ID NO: 3217912 - RNA, 20 nt, Human
uauagaaaguguucuguuac

SEQ ID NO: 3217913 - RNA, 14 nt, Human
uauagaaaguguuc

SEQ ID NO: 3217914 - RNA, 12 nt, Human
uauagaaagugu

SEQ ID NO: 3217915 - RNA, 23 nt, Human
uauagaagucuucaugaaaugcu

SEQ ID NO: 3217916 - RNA, 22 nt, Human
uauagaagucuucaugaaaugc

SEQ ID NO: 3217917 - RNA, 21 nt, Human
uauagaagucuucaugaaaug

SEQ ID NO: 3217918 - RNA, 19 nt, Human
uauagaagucuucaugaaa

SEQ ID NO: 3217919 - RNA, 16 nt, Human
uauagaagucuucaug

SEQ ID NO: 3217920 - RNA, 15 nt, Human
uauagaagucuucau

SEQ ID NO: 3217921 - RNA, 14 nt, Human
uauagaagucuuca

SEQ ID NO: 3217922 - RNA, 18 nt, Human
uauagacaggagaagaaa

SEQ ID NO: 3217923 - RNA, 21 nt, Human
uauagacaggagaagaaagaa

SEQ ID NO: 3217924 - RNA, 20 nt, Human
uauagacaggagaagaaaga

SEQ ID NO: 3217925 - RNA, 16 nt, Human
uauagaaaaaaacauu

SEQ ID NO: 3217926 - RNA, 20 nt, Human
uauagaaaaaaacauucuau

SEQ ID NO: 3217927 - RNA, 18 nt, Human
uauagaaagcaagaugua

SEQ ID NO: 3217928 - RNA, 11 nt, Human
uauagaaagug

SEQ ID NO: 3217929 - RNA, 22 nt, Human
uauagaaagcaagauguacuau

SEQ ID NO: 3217930 - RNA, 12 nt, Human
uauacuuuagua

SEQ ID NO: 3217931 - RNA, 19 nt, Human
uauacuuuaguagacauuu

SEQ ID NO: 3217932 - RNA, 22 nt, Human
uauacuuguuuuuguaaagaaa

SEQ ID NO: 3217933 - RNA, 20 nt, Human
uauacuuguuuuuguaaaga

SEQ ID NO: 3217934 - RNA, 14 nt, Human
uauaaaguauucuu

SEQ ID NO: 3217935 - RNA, 15 nt, Human
uauaaaguauucuuu

SEQ ID NO: 3217936 - RNA, 18 nt, Human
uauaaaguauucuuuuuc

SEQ ID NO: 3217937 - RNA, 22 nt, Human
uauaaacaugcuugcauuauau

SEQ ID NO: 3217938 - RNA, 18 nt, Human
uauaaacagaagugacug

SEQ ID NO: 3217939 - RNA, 13 nt, Human
uauaaacacuguu

SEQ ID NO: 3217940 - RNA, 12 nt, Human
uauaaacacugu

SEQ ID NO: 3217941 - RNA, 14 nt, Human
uaguuugaggaaau

SEQ ID NO: 3217942 - RNA, 13 nt, Human
uaguuugaggaaa

SEQ ID NO: 3217943 - RNA, 20 nt, Human
uaguuugaggaaauuugcag

SEQ ID NO: 3217944 - RNA, 19 nt, Human
uaguuugaggaaauuugca

SEQ ID NO: 3217945 - RNA, 22 nt, Human
uauaaacaagaaugaagguuuu

SEQ ID NO: 3217946 - RNA, 12 nt, Human
uauaaacagcuu

SEQ ID NO: 3217947 - RNA, 22 nt, Human
uaguauuaucuuguucaggaaa

SEQ ID NO: 3217948 - RNA, 23 nt, Human
uaguauuaucuuguucaggaaaa

SEQ ID NO: 3217949 - RNA, 17 nt, Human
uaguagggguaccacug

SEQ ID NO: 3217950 - RNA, 16 nt, Human
uaguagggguaccacu

SEQ ID NO: 3217951 - RNA, 16 nt, Human
uaguaugguggcuggg

SEQ ID NO: 3217952 - RNA, 20 nt, Human
uaguggcuuaaaacaacacu

SEQ ID NO: 3217953 - RNA, 19 nt, Human
uaguggccaucauuucugg

SEQ ID NO: 3217954 - RNA, 18 nt, Human
uaguggccaucauuucug

SEQ ID NO: 3217955 - RNA, 20 nt, Human
uaguauuuauggguggauuu

SEQ ID NO: 3217956 - RNA, 15 nt, Human
uaguggcauggagaa

SEQ ID NO: 3217957 - RNA, 20 nt, Human
uaguuguuugauucagacag

SEQ ID NO: 3217958 - RNA, 21 nt, Human
uaguugaauacuugaaccaua

SEQ ID NO: 3217959 - RNA, 19 nt, Human
uaguugaauacuugaacca

SEQ ID NO: 3217960 - RNA, 20 nt, Human
uaguugaauacuugaaccau

SEQ ID NO: 3217961 - RNA, 14 nt, Human
uaguuguuaaguuu

SEQ ID NO: 3217962 - RNA, 21 nt, Human
uaguuguuucuagacuauaaa

SEQ ID NO: 3217963 - RNA, 21 nt, Human
uaguuguuugauucagacagc

SEQ ID NO: 3217964 - RNA, 22 nt, Human
uaguuguuugauucagacagcu

SEQ ID NO: 3217965 - RNA, 13 nt, Human
uaguugaauacuu

SEQ ID NO: 3217966 - RNA, 15 nt, Human
uaguugaauacuuga

SEQ ID NO: 3217967 - RNA, 16 nt, Human
uaguugaauacuugaa

SEQ ID NO: 3217968 - RNA, 17 nt, Human
uaguugaauacuugaac

SEQ ID NO: 3217969 - RNA, 12 nt, Human
uaguucuuuaaa

SEQ ID NO: 3217970 - RNA, 15 nt, Human
uaguucuuuaaacug

SEQ ID NO: 3217971 - RNA, 20 nt, Human
uaguucuuuaaacugucgug

SEQ ID NO: 3217972 - RNA, 16 nt, Human
uaguucuguauuugaa

SEQ ID NO: 3217973 - RNA, 17 nt, Human
uaguucuguauuugaaa

SEQ ID NO: 3217974 - RNA, 19 nt, Human
uaguucuguauuugaaagu

SEQ ID NO: 3217975 - RNA, 21 nt, Human
uaguucuguauuugaaagugc

SEQ ID NO: 3217976 - RNA, 11 nt, Human
uaguucuguga

SEQ ID NO: 3217977 - RNA, 17 nt, Human
uaguucuuacugcuuaa

SEQ ID NO: 3217978 - RNA, 20 nt, Human
uagguuaaaaaaaaaaguca

SEQ ID NO: 3217979 - RNA, 22 nt, Human
uagguuauuuugauguaaagau

SEQ ID NO: 3217980 - RNA, 13 nt, Human
uagguguggggga

SEQ ID NO: 3217981 - RNA, 17 nt, Human
uaggugugggggaagca

SEQ ID NO: 3217982 - RNA, 14 nt, Human
uaguaggauaugcc

SEQ ID NO: 3217983 - RNA, 13 nt, Human
uaguaggcaagau

SEQ ID NO: 3217984 - RNA, 21 nt, Human
uaguaggauaugccugcucuu

SEQ ID NO: 3217985 - RNA, 14 nt, Human
uaggcuuuuuaauc

SEQ ID NO: 3217986 - RNA, 17 nt, Human
uaggucugauauucaaa

SEQ ID NO: 3217987 - RNA, 16 nt, Human
uaggugacagagugag

SEQ ID NO: 3217988 - RNA, 11 nt, Human
uaggugacaga

SEQ ID NO: 3217989 - RNA, 18 nt, Human
uaggugcuacaaaaacac

SEQ ID NO: 3217990 - RNA, 23 nt, Human
uaggugcuacaaaaacacagcaa

SEQ ID NO: 3217991 - RNA, 22 nt, Human
uaggugcuacaaaaacacagca

SEQ ID NO: 3217992 - RNA, 20 nt, Human
uaggugcuacaaaaacacag

SEQ ID NO: 3217993 - RNA, 17 nt, Human
uaggcucugccugacag

SEQ ID NO: 3217994 - RNA, 12 nt, Human
uaggcuggaagg

SEQ ID NO: 3217995 - RNA, 18 nt, Human
uaggcuggaaggaggaag

SEQ ID NO: 3217996 - RNA, 20 nt, Human
uagcugcauuugucuggccu

SEQ ID NO: 3217997 - RNA, 17 nt, Human
uagcuguacuucuugaa

SEQ ID NO: 3217998 - RNA, 23 nt, Human
uagcuguacuucuugaauauaaa

SEQ ID NO: 3217999 - RNA, 12 nt, Human
uagcuguaaggc

SEQ ID NO: 3218000 - RNA, 19 nt, Human
uagcuguaaggcaugaagg

SEQ ID NO: 3218001 - RNA, 17 nt, Human
uagcuguaaggcaugaa

SEQ ID NO: 3218002 - RNA, 13 nt, Human
uagccccauaauu

SEQ ID NO: 3218003 - RNA, 15 nt, Human
uagccagugaacaua

SEQ ID NO: 3218004 - RNA, 23 nt, Human
uagccccucuccccgcaguguuu

SEQ ID NO: 3218005 - RNA, 14 nt, Human
uagcccccucuucc

SEQ ID NO: 3218006 - RNA, 15 nt, Human
uagcccccucuuccc

SEQ ID NO: 3218007 - RNA, 18 nt, Human
uagccgugucacgggcau

SEQ ID NO: 3218008 - RNA, 22 nt, Human
uagccuaagauauacuuguuuu

SEQ ID NO: 3218009 - RNA, 19 nt, Human
uagccuaagauauacuugu

SEQ ID NO: 3218010 - RNA, 18 nt, Human
uagccuaagauauacuug

SEQ ID NO: 3218011 - RNA, 14 nt, Human
uagccuaagauaua

SEQ ID NO: 3218012 - RNA, 17 nt, Human
uagccugccucuucucu

SEQ ID NO: 3218013 - RNA, 15 nt, Human
uagccuggugguuuu

SEQ ID NO: 3218014 - RNA, 21 nt, Human
uagcucaggugucccugcacu

SEQ ID NO: 3218015 - RNA, 20 nt, Human
uagcucaggugucccugcac

SEQ ID NO: 3218016 - RNA, 18 nt, Human
uagccugugccucuggga

SEQ ID NO: 3218017 - RNA, 16 nt, Human
uagcucaggugucccu

SEQ ID NO: 3218018 - RNA, 17 nt, Human
uagcugggacuacaggc

SEQ ID NO: 3218019 - RNA, 15 nt, Human
uagcugggacuacag

SEQ ID NO: 3218020 - RNA, 12 nt, Human
uagcugggacua

SEQ ID NO: 3218021 - RNA, 15 nt, Human
uagcugcaaaaauaa

SEQ ID NO: 3218022 - RNA, 21 nt, Human
uagcugcagauaaguggccuu

SEQ ID NO: 3218023 - RNA, 14 nt, Human
uagcucuuuuccua

SEQ ID NO: 3218024 - RNA, 17 nt, Human
uagcugacagaaucucu

SEQ ID NO: 3218025 - RNA, 15 nt, Human
uagauagcagccugg

SEQ ID NO: 3218026 - RNA, 19 nt, Human
uagauagcagccuggcucc

SEQ ID NO: 3218027 - RNA, 20 nt, Human
uagauagcagccuggcuccc

SEQ ID NO: 3218028 - RNA, 23 nt, Human
uagauuaauacucuauuuuuaca

SEQ ID NO: 3218029 - RNA, 22 nt, Human
uagauuaguacuggauuauuca

SEQ ID NO: 3218030 - RNA, 21 nt, Human
uagauuaguacuggauuauuc

SEQ ID NO: 3218031 - RNA, 21 nt, Human
uagauuccauuuacugcauuc

SEQ ID NO: 3218032 - RNA, 16 nt, Human
uagauuccauuuacug

SEQ ID NO: 3218033 - RNA, 14 nt, Human
uagauuuauuucau

SEQ ID NO: 3218034 - RNA, 15 nt, Human
uagauuuauuucauc

SEQ ID NO: 3218035 - RNA, 21 nt, Human
uagauuugccauagaguacac

SEQ ID NO: 3218036 - RNA, 23 nt, Human
uagauuucucacacucuaacugu

SEQ ID NO: 3218037 - RNA, 13 nt, Human
uagauuugggaga

SEQ ID NO: 3218038 - RNA, 11 nt, Human
uagcagggaaa

SEQ ID NO: 3218039 - RNA, 20 nt, Human
uagcagcugacuuucaaagu

SEQ ID NO: 3218040 - RNA, 15 nt, Human
uagcagccuggcucc

SEQ ID NO: 3218041 - RNA, 16 nt, Human
uagcagccuggcuccc

SEQ ID NO: 3218042 - RNA, 20 nt, Human
uagcagccuggcuccccugg

SEQ ID NO: 3218043 - RNA, 21 nt, Human
uagcagccuggcuccccuggg

SEQ ID NO: 3218044 - RNA, 17 nt, Human
uagcaucacuuaaaaca

SEQ ID NO: 3218045 - RNA, 18 nt, Human
uagcaucacuuaaaacac

SEQ ID NO: 3218046 - RNA, 23 nt, Human
uagcaucacuuaaaacacguuuu

SEQ ID NO: 3218047 - RNA, 22 nt, Human
uagcauauauguguccauuucc

SEQ ID NO: 3218048 - RNA, 15 nt, Human
uagcaucacuuaaaa

SEQ ID NO: 3218049 - RNA, 22 nt, Human
uagcauaugacaaauguuucua

SEQ ID NO: 3218050 - RNA, 21 nt, Human
uagcauaugacaaauguuucu

SEQ ID NO: 3218051 - RNA, 14 nt, Human
uagcauaugacaaa

SEQ ID NO: 3218052 - RNA, 19 nt, Human
uagcauaugacaaauguuu

SEQ ID NO: 3218053 - RNA, 18 nt, Human
uagcauaugacaaauguu

SEQ ID NO: 3218054 - RNA, 20 nt, Human
uagacccacuggacucaccu

SEQ ID NO: 3218055 - RNA, 16 nt, Human
uagaauugaagguuuu

SEQ ID NO: 3218056 - RNA, 17 nt, Human
uagaauugaagguuuuu

SEQ ID NO: 3218057 - RNA, 14 nt, Human
uagacuauaaaugu

SEQ ID NO: 3218058 - RNA, 15 nt, Human
uagacuauaaauguu

SEQ ID NO: 3218059 - RNA, 22 nt, Human
uagacuauaaauguugcuaugu

SEQ ID NO: 3218060 - RNA, 14 nt, Human
uagacuacuguuca

SEQ ID NO: 3218061 - RNA, 16 nt, Human
uagacucuaguauuua

SEQ ID NO: 3218062 - RNA, 21 nt, Human
uagacuucagggagucagcug

SEQ ID NO: 3218063 - RNA, 23 nt, Human
uagacuucagggagucagcuguu

SEQ ID NO: 3218064 - RNA, 24 nt, Human
uagacuucagggagucagcuguuu

SEQ ID NO: 3218065 - RNA, 12 nt, Human
uagagugggagc

SEQ ID NO: 3218066 - RNA, 15 nt, Human
uagagucugagggcu

SEQ ID NO: 3218067 - RNA, 21 nt, Human
uagagucugagggcuuguagu

SEQ ID NO: 3218068 - RNA, 16 nt, Human
uagaggugcaugccua

SEQ ID NO: 3218069 - RNA, 13 nt, Human
uagaggugcaugc

SEQ ID NO: 3218070 - RNA, 22 nt, Human
uagagacagagcgacagagcag

SEQ ID NO: 3218071 - RNA, 21 nt, Human
uagagguauaauugugugaua

SEQ ID NO: 3218072 - RNA, 17 nt, Human
uagagguauaauugugu

SEQ ID NO: 3218073 - RNA, 16 nt, Human
uagagguauaauugug

SEQ ID NO: 3218074 - RNA, 15 nt, Human
uagagguauaauugu

SEQ ID NO: 3218075 - RNA, 22 nt, Human
uagagaaggacccggaggggcc

SEQ ID NO: 3218076 - RNA, 13 nt, Human
uagagaaggaccc

SEQ ID NO: 3218077 - RNA, 10 nt, Human
uagacuugaa

SEQ ID NO: 3218078 - RNA, 12 nt, Human
uagacuugaaaa

SEQ ID NO: 3218079 - RNA, 18 nt, Human
uagacuucuguuuucaau

SEQ ID NO: 3218080 - RNA, 17 nt, Human
uagacuucuguuuucaa

SEQ ID NO: 3218081 - RNA, 16 nt, Human
uagacuucuguuuuca

SEQ ID NO: 3218082 - RNA, 15 nt, Human
uagacuucuguuuuc

SEQ ID NO: 3218083 - RNA, 12 nt, Human
uagaauagcaug

SEQ ID NO: 3218084 - RNA, 17 nt, Human
uagaauagcauguugua

SEQ ID NO: 3218085 - RNA, 18 nt, Human
uagaauagcauguuguag

SEQ ID NO: 3218086 - RNA, 20 nt, Human
uagaauagcauguuguagau

SEQ ID NO: 3218087 - RNA, 14 nt, Human
uagaaucaauuuaa

SEQ ID NO: 3218088 - RNA, 16 nt, Human
uagaaucaauuuaagu

SEQ ID NO: 3218089 - RNA, 20 nt, Human
uagaagucuuagauguauau

SEQ ID NO: 3218090 - RNA, 19 nt, Human
uacuuguuuuuguaaagaa

SEQ ID NO: 3218091 - RNA, 16 nt, Human
uacuuguuuuuguaaa

SEQ ID NO: 3218092 - RNA, 13 nt, Human
uacuuguuucuau

SEQ ID NO: 3218093 - RNA, 15 nt, Human
uacuuguuuuuguaa

SEQ ID NO: 3218094 - RNA, 24 nt, Human
uagaagucuucaugaaaugcuaug

SEQ ID NO: 3218095 - RNA, 15 nt, Human
uagaagucuucauga

SEQ ID NO: 3218096 - RNA, 20 nt, Human
uagaagucuucaugaaaugc

SEQ ID NO: 3218097 - RNA, 18 nt, Human
uagaagucuucaugaaau

SEQ ID NO: 3218098 - RNA, 22 nt, Human
uagaagucuucaugaaaugcua

SEQ ID NO: 3218099 - RNA, 21 nt, Human
uagaagucuucaugaaaugcu

SEQ ID NO: 3218100 - RNA, 14 nt, Human
uacuugucuuucug

SEQ ID NO: 3218101 - RNA, 17 nt, Human
uacuuguugccuauaag

SEQ ID NO: 3218102 - RNA, 14 nt, Human
uacuuguugccuau

SEQ ID NO: 3218103 - RNA, 15 nt, Human
uagaauuaacacaug

SEQ ID NO: 3218104 - RNA, 16 nt, Human
uagaauuaacacauga

SEQ ID NO: 3218105 - RNA, 18 nt, Human
uagaauuaacacaugauc

SEQ ID NO: 3218106 - RNA, 15 nt, Human
uagaauuaccauuug

SEQ ID NO: 3218107 - RNA, 16 nt, Human
uagaauuaccauuugu

SEQ ID NO: 3218108 - RNA, 17 nt, Human
uagaauuaccauuuguu

SEQ ID NO: 3218109 - RNA, 19 nt, Human
uagaauuaccauuuguuaa

SEQ ID NO: 3218110 - RNA, 16 nt, Human
uagaauguuucauuug

SEQ ID NO: 3218111 - RNA, 23 nt, Human
uagaauguaguuugaggaaauuu

SEQ ID NO: 3218112 - RNA, 21 nt, Human
uagaauguaguuugaggaaau

SEQ ID NO: 3218113 - RNA, 12 nt, Human
uagaauguaguu

SEQ ID NO: 3218114 - RNA, 14 nt, Human
uagaauguaguuug

SEQ ID NO: 3218115 - RNA, 15 nt, Human
uagaauggugauuuu

SEQ ID NO: 3218116 - RNA, 19 nt, Human
uagaauggugauuuuaaau

SEQ ID NO: 3218117 - RNA, 18 nt, Human
uagaauggugauuuuaaa

SEQ ID NO: 3218118 - RNA, 17 nt, Human
uagaauggugauuuuaa

SEQ ID NO: 3218119 - RNA, 16 nt, Human
uagaauggugauuuua

SEQ ID NO: 3218120 - RNA, 21 nt, Human
uagaauggugauuuuaaaugu

SEQ ID NO: 3218121 - RNA, 20 nt, Human
uagaauggugauuuuaaaug

SEQ ID NO: 3218122 - RNA, 21 nt, Human
uagaaugaccuuguaauguaa

SEQ ID NO: 3218123 - RNA, 20 nt, Human
uagaaugaccuuguaaugua

SEQ ID NO: 3218124 - RNA, 19 nt, Human
uagaaugaccuuguaaugu

SEQ ID NO: 3218125 - RNA, 17 nt, Human
uagaaugaccuuguaau

SEQ ID NO: 3218126 - RNA, 16 nt, Human
uagaaugaccuuguaa

SEQ ID NO: 3218127 - RNA, 15 nt, Human
uagaaugaccuugua

SEQ ID NO: 3218128 - RNA, 13 nt, Human
uagaaucccugug

SEQ ID NO: 3218129 - RNA, 15 nt, Human
uagaaucccuguguu

SEQ ID NO: 3218130 - RNA, 16 nt, Human
uagaaucccuguguua

SEQ ID NO: 3218131 - RNA, 20 nt, Human
uagaaucccuguguuaauuu

SEQ ID NO: 3218132 - RNA, 14 nt, Human
uacaggaaguacug

SEQ ID NO: 3218133 - RNA, 15 nt, Human
uacaggaaguacugg

SEQ ID NO: 3218134 - RNA, 22 nt, Human
uacaggaaguacuggagaaaau

SEQ ID NO: 3218135 - RNA, 15 nt, Human
uacaggagugagcac

SEQ ID NO: 3218136 - RNA, 17 nt, Human
uacaguugaaaaacagc

SEQ ID NO: 3218137 - RNA, 19 nt, Human
uacaguugaaaaacagcug

SEQ ID NO: 3218138 - RNA, 20 nt, Human
uacaguugaaaaacagcuga

SEQ ID NO: 3218139 - RNA, 18 nt, Human
uacaggaagguagaaaua

SEQ ID NO: 3218140 - RNA, 13 nt, Human
uacaggaaguacu

SEQ ID NO: 3218141 - RNA, 20 nt, Human
uacagcuugaccgugaggcc

SEQ ID NO: 3218142 - RNA, 13 nt, Human
uacagcugccugc

SEQ ID NO: 3218143 - RNA, 14 nt, Human
uacagcugccugca

SEQ ID NO: 3218144 - RNA, 20 nt, Human
uacagcucccccagcucccc

SEQ ID NO: 3218145 - RNA, 18 nt, Human
uacagcucccccagcucc

SEQ ID NO: 3218146 - RNA, 17 nt, Human
uacagcucccccagcuc

SEQ ID NO: 3218147 - RNA, 16 nt, Human
uacagcucccccagcu

SEQ ID NO: 3218148 - RNA, 14 nt, Human
uacagcucccccag

SEQ ID NO: 3218149 - RNA, 21 nt, Human
uacacugagagccuuuuugaa

SEQ ID NO: 3218150 - RNA, 16 nt, Human
uacacuucaguuaucu

SEQ ID NO: 3218151 - RNA, 18 nt, Human
uacacuugagaugauuuc

SEQ ID NO: 3218152 - RNA, 18 nt, Human
uacagcuaaucagcauuc

SEQ ID NO: 3218153 - RNA, 16 nt, Human
uacagcuaaucagcau

SEQ ID NO: 3218154 - RNA, 16 nt, Human
uacacuuacacuuuau

SEQ ID NO: 3218155 - RNA, 22 nt, Human
uacacugugcugagucugaagg

SEQ ID NO: 3218156 - RNA, 23 nt, Human
uacacugugcugagucugaaggc

SEQ ID NO: 3218157 - RNA, 16 nt, Human
uacacugccugccuua

SEQ ID NO: 3218158 - RNA, 13 nt, Human
uacacuguuauuu

SEQ ID NO: 3218159 - RNA, 15 nt, Human
uacacuguuauuuuc

SEQ ID NO: 3218160 - RNA, 21 nt, Human
uacacuguuauuuucagcaug

SEQ ID NO: 3218161 - RNA, 16 nt, Human
uacauaaacaaguccu

SEQ ID NO: 3218162 - RNA, 13 nt, Human
uacauaaacauca

SEQ ID NO: 3218163 - RNA, 23 nt, Human
uacauaaaccauuuuuguuacuc

SEQ ID NO: 3218164 - RNA, 12 nt, Human
uacauaaacauc

SEQ ID NO: 3218165 - RNA, 16 nt, Human
uacauaagauaaaugu

SEQ ID NO: 3218166 - RNA, 22 nt, Human
uacauggaauaacauguaauua

SEQ ID NO: 3218167 - RNA, 19 nt, Human
uacauggaauaacauguaa

SEQ ID NO: 3218168 - RNA, 18 nt, Human
uacauggaauaacaugua

SEQ ID NO: 3218169 - RNA, 14 nt, Human
uacauggaauaaca

SEQ ID NO: 3218170 - RNA, 16 nt, Human
uacaugccauugaaaa

SEQ ID NO: 3218171 - RNA, 16 nt, Human
uacaugcuuugugaac

SEQ ID NO: 3218172 - RNA, 15 nt, Human
uacaugcuuugugaa

SEQ ID NO: 3218173 - RNA, 14 nt, Human
uacaugcuuguuga

SEQ ID NO: 3218174 - RNA, 14 nt, Human
uacaugaaauucaa

SEQ ID NO: 3218175 - RNA, 18 nt, Human
uacaugcacacucaugug

SEQ ID NO: 3218176 - RNA, 14 nt, Human
uacacuccagugag

SEQ ID NO: 3218177 - RNA, 20 nt, Human
uacacauauaaauugucuua

SEQ ID NO: 3218178 - RNA, 22 nt, Human
uacacaucagccaucaacuaaa

SEQ ID NO: 3218179 - RNA, 21 nt, Human
uacacugugcugagucugaag

SEQ ID NO: 3218180 - RNA, 23 nt, Human
uacacugaauuuuuaugugugau

SEQ ID NO: 3218181 - RNA, 22 nt, Human
uacacugaauuuuuauguguga

SEQ ID NO: 3218182 - RNA, 20 nt, Human
uacacugaauuuuuaugugu

SEQ ID NO: 3218183 - RNA, 18 nt, Human
uacacugaauuuuuaugu

SEQ ID NO: 3218184 - RNA, 16 nt, Human
uacacacucaaaucaa

SEQ ID NO: 3218185 - RNA, 23 nt, Human
uacacacgcugccuucgguaccc

SEQ ID NO: 3218186 - RNA, 17 nt, Human
uacacacgcugccuucg

SEQ ID NO: 3218187 - RNA, 17 nt, Human
uacacacucaaaucaag

SEQ ID NO: 3218188 - RNA, 22 nt, Human
uacacaggacagggguuccuuc

SEQ ID NO: 3218189 - RNA, 21 nt, Human
uacacaggacagggguuccuu

SEQ ID NO: 3218190 - RNA, 14 nt, Human
uacacaggacaggg

SEQ ID NO: 3218191 - RNA, 19 nt, Human
uacaauuucuuuugguuca

SEQ ID NO: 3218192 - RNA, 23 nt, Human
uacacaaugguuuucuugugugu

SEQ ID NO: 3218193 - RNA, 11 nt, Human
uacacacacac

SEQ ID NO: 3218194 - RNA, 17 nt, Human
uacaauuucuuuugguu

SEQ ID NO: 3218195 - RNA, 20 nt, Human
uacaacuaacgcaaccaagu

SEQ ID NO: 3218196 - RNA, 19 nt, Human
uacaaaugcaucuuugaug

SEQ ID NO: 3218197 - RNA, 21 nt, Human
uacaaaugcaucuuugaugug

SEQ ID NO: 3218198 - RNA, 23 nt, Human
uacaaaugccuccaaaguauugu

SEQ ID NO: 3218199 - RNA, 15 nt, Human
uacaaauuauaaugu

SEQ ID NO: 3218200 - RNA, 22 nt, Human
uacaaauuauaauguauucaua

SEQ ID NO: 3218201 - RNA, 18 nt, Human
uacaaauuauaauguauu

SEQ ID NO: 3218202 - RNA, 16 nt, Human
uacaaauuauaaugua

SEQ ID NO: 3218203 - RNA, 16 nt, Human
uacaaauuuuucugug

SEQ ID NO: 3218204 - RNA, 15 nt, Human
uacaaauuuuucugu

SEQ ID NO: 3218205 - RNA, 12 nt, Human
uacaaccuucau

SEQ ID NO: 3218206 - RNA, 15 nt, Human
uacaaccuucauuua

SEQ ID NO: 3218207 - RNA, 18 nt, Human
uacaacacuuuaaugggu

SEQ ID NO: 3218208 - RNA, 19 nt, Human
uacaacaccaaaaaauauc

SEQ ID NO: 3218209 - RNA, 18 nt, Human
uacaacaccaaaaaauau

SEQ ID NO: 3218210 - RNA, 16 nt, Human
uacaacaccaaaaaau

SEQ ID NO: 3218211 - RNA, 15 nt, Human
uaauucuaugccugu

SEQ ID NO: 3218212 - RNA, 13 nt, Human
uaauuuuguguaa

SEQ ID NO: 3218213 - RNA, 20 nt, Human
uaauuuuguguaagaaauac

SEQ ID NO: 3218214 - RNA, 19 nt, Human
uaauuuuguguaagaaaua

SEQ ID NO: 3218215 - RNA, 19 nt, Human
uaauuuuuaaaugcaguua

SEQ ID NO: 3218216 - RNA, 15 nt, Human
uaauuuuuaaaugca

SEQ ID NO: 3218217 - RNA, 13 nt, Human
uaauuuuuaaaug

SEQ ID NO: 3218218 - RNA, 20 nt, Human
uacaaacaagcauauaaaau

SEQ ID NO: 3218219 - RNA, 19 nt, Human
uacaaacaagcauauaaaa

SEQ ID NO: 3218220 - RNA, 18 nt, Human
uacaaacaagcauauaaa

SEQ ID NO: 3218221 - RNA, 17 nt, Human
uacaaacaagcauauaa

SEQ ID NO: 3218222 - RNA, 15 nt, Human
uacaaacaagcauau

SEQ ID NO: 3218223 - RNA, 14 nt, Human
uacaaacaagcaua

SEQ ID NO: 3218224 - RNA, 15 nt, Human
uacaaaucaguaauu

SEQ ID NO: 3218225 - RNA, 13 nt, Human
uacaaaugauugc

SEQ ID NO: 3218226 - RNA, 16 nt, Human
uacaaaugcaucuuug

SEQ ID NO: 3218227 - RNA, 23 nt, Human
uacaaaugauugcuuuuaaaauu

SEQ ID NO: 3218228 - RNA, 17 nt, Human
uacaaaugcaucuuuga

SEQ ID NO: 3218229 - RNA, 18 nt, Human
uacaaaugcaucuuugau

SEQ ID NO: 3218230 - RNA, 21 nt, Human
uacaaaugauugcuuuuaaaa

SEQ ID NO: 3218231 - RNA, 20 nt, Human
uacaaaugauugcuuuuaaa

SEQ ID NO: 3218232 - RNA, 19 nt, Human
uacaaaugauugcuuuuaa

SEQ ID NO: 3218233 - RNA, 18 nt, Human
uacaaaugauugcuuuua

SEQ ID NO: 3218234 - RNA, 18 nt, Human
uacaaaguagaagucuua

SEQ ID NO: 3218235 - RNA, 14 nt, Human
uacaaaguagaagu

SEQ ID NO: 3218236 - RNA, 16 nt, Human
uacaaaggcuguauuc

SEQ ID NO: 3218237 - RNA, 17 nt, Human
uacaaaggcuguauuca

SEQ ID NO: 3218238 - RNA, 20 nt, Human
uaccaaaaaaauuacaguuu

SEQ ID NO: 3218239 - RNA, 15 nt, Human
uacccacugcucugg

SEQ ID NO: 3218240 - RNA, 22 nt, Human
uacauuuuuugaaaugcugaaa

SEQ ID NO: 3218241 - RNA, 16 nt, Human
uacauuuuuugaaaug

SEQ ID NO: 3218242 - RNA, 15 nt, Human
uacauuuuuugaaau

SEQ ID NO: 3218243 - RNA, 13 nt, Human
uacauuuuuugaa

SEQ ID NO: 3218244 - RNA, 20 nt, Human
uacauuuuuagccuguguca

SEQ ID NO: 3218245 - RNA, 22 nt, Human
uaccuaacgaaguauccuucag

SEQ ID NO: 3218246 - RNA, 13 nt, Human
uaccgucuacauu

SEQ ID NO: 3218247 - RNA, 17 nt, Human
uaccgucuacauuucac

SEQ ID NO: 3218248 - RNA, 17 nt, Human
uaccggagagagaaugu

SEQ ID NO: 3218249 - RNA, 18 nt, Human
uaccggagagagaaugua

SEQ ID NO: 3218250 - RNA, 22 nt, Human
uaccgagucucuucuccacugg

SEQ ID NO: 3218251 - RNA, 21 nt, Human
uaccgagucucuucuccacug

SEQ ID NO: 3218252 - RNA, 18 nt, Human
uaccgagucucuucucca

SEQ ID NO: 3218253 - RNA, 17 nt, Human
uaccgagucucuucucc

SEQ ID NO: 3218254 - RNA, 15 nt, Human
uaccgacaagcacag

SEQ ID NO: 3218255 - RNA, 18 nt, Human
uaccucaacaagaagaau

SEQ ID NO: 3218256 - RNA, 19 nt, Human
uaccucaacaagaagaauu

SEQ ID NO: 3218257 - RNA, 16 nt, Human
uaccuaucaucuuaag

SEQ ID NO: 3218258 - RNA, 16 nt, Human
uaccuacuuucuucag

SEQ ID NO: 3218259 - RNA, 15 nt, Human
uaccuacauacaauu

SEQ ID NO: 3218260 - RNA, 23 nt, Human
uaccuuuguucccaaauuucaua

SEQ ID NO: 3218261 - RNA, 14 nt, Human
uaccuucaaacuuu

SEQ ID NO: 3218262 - RNA, 15 nt, Human
uaccuucaaacuuua

SEQ ID NO: 3218263 - RNA, 16 nt, Human
uaccuucaaacuuuag

SEQ ID NO: 3218264 - RNA, 18 nt, Human
uaccucggugccuuccuc

SEQ ID NO: 3218265 - RNA, 14 nt, Human
uaccucucugucau

SEQ ID NO: 3218266 - RNA, 18 nt, Human
uaccucugcauaaauauu

SEQ ID NO: 3218267 - RNA, 13 nt, Human
uacuaacuuuccu

SEQ ID NO: 3218268 - RNA, 14 nt, Human
uacuaaggaaucuu

SEQ ID NO: 3218269 - RNA, 18 nt, Human
uacgaaaagaggggaaga

SEQ ID NO: 3218270 - RNA, 21 nt, Human
uacgaaaagaggggaagagac

SEQ ID NO: 3218271 - RNA, 19 nt, Human
uaccuuuuuuuuucuuuuu

SEQ ID NO: 3218272 - RNA, 15 nt, Human
uaccuuuuuuuuucu

SEQ ID NO: 3218273 - RNA, 14 nt, Human
uacugccuccccca

SEQ ID NO: 3218274 - RNA, 23 nt, Human
uacugccaaccucgcuccaacuc

SEQ ID NO: 3218275 - RNA, 19 nt, Human
uacugccaaccucgcucca

SEQ ID NO: 3218276 - RNA, 22 nt, Human
uacugcccaggccugccuguuc

SEQ ID NO: 3218277 - RNA, 21 nt, Human
uacugcccaggccugccuguu

SEQ ID NO: 3218278 - RNA, 20 nt, Human
uacugcccaggccugccugu

SEQ ID NO: 3218279 - RNA, 19 nt, Human
uacugcccaggccugccug

SEQ ID NO: 3218280 - RNA, 17 nt, Human
uacugcauaugaaagga

SEQ ID NO: 3218281 - RNA, 14 nt, Human
uacugcauucuucu

SEQ ID NO: 3218282 - RNA, 16 nt, Human
uacugccaaccucgcu

SEQ ID NO: 3218283 - RNA, 13 nt, Human
uacugccaaccuc

SEQ ID NO: 3218284 - RNA, 15 nt, Human
uacugcauuuaggga

SEQ ID NO: 3218285 - RNA, 18 nt, Human
uacugcauuuagggagua

SEQ ID NO: 3218286 - RNA, 18 nt, Human
uacugcauucuucugauc

SEQ ID NO: 3218287 - RNA, 17 nt, Human
uacugcauucuucugau

SEQ ID NO: 3218288 - RNA, 14 nt, Human
uacugauuucagua

SEQ ID NO: 3218289 - RNA, 18 nt, Human
uacugauuucaguaaguc

SEQ ID NO: 3218290 - RNA, 19 nt, Human
uacugauuucaguaagucu

SEQ ID NO: 3218291 - RNA, 21 nt, Human
uacugauuugggcugaaugua

SEQ ID NO: 3218292 - RNA, 22 nt, Human
uacugauuugggcugaauguau

SEQ ID NO: 3218293 - RNA, 23 nt, Human
uacugauuugggcugaauguaug

SEQ ID NO: 3218294 - RNA, 16 nt, Human
uacugcaaacuauuua

SEQ ID NO: 3218295 - RNA, 22 nt, Human
uacucgaguuacagacaaagcg

SEQ ID NO: 3218296 - RNA, 18 nt, Human
uacucgaguuacagacaa

SEQ ID NO: 3218297 - RNA, 12 nt, Human
uacuccucccag

SEQ ID NO: 3218298 - RNA, 22 nt, Human
uacuacaguccucccaucucac

SEQ ID NO: 3218299 - RNA, 20 nt, Human
uacuacaguccucccaucuc

SEQ ID NO: 3218300 - RNA, 22 nt, Human
uacuaaggauacaggcuggaaa

SEQ ID NO: 3218301 - RNA, 20 nt, Human
uacuaaggauacaggcugga

SEQ ID NO: 3218302 - RNA, 19 nt, Human
uacuaaggauacaggcugg

SEQ ID NO: 3218303 - RNA, 12 nt, Human
uacuaaggauac

SEQ ID NO: 3218304 - RNA, 15 nt, Human
uacucauuagaauua

SEQ ID NO: 3218305 - RNA, 13 nt, Human
uacuuguggacac

SEQ ID NO: 3218306 - RNA, 17 nt, Human
uacuuaaauguuaugua

SEQ ID NO: 3218307 - RNA, 19 nt, Human
uacuuaaauguuauguaua

SEQ ID NO: 3218308 - RNA, 18 nt, Human
uacuuaaauguuauguau

SEQ ID NO: 3218309 - RNA, 18 nt, Human
uacuuaaaaauuuauuag

SEQ ID NO: 3218310 - RNA, 19 nt, Human
uacuguuuaagugaauuga

SEQ ID NO: 3218311 - RNA, 13 nt, Human
uacuguuauucuu

SEQ ID NO: 3218312 - RNA, 15 nt, Human
uacuguuauucuuug

SEQ ID NO: 3218313 - RNA, 14 nt, Human
uacuguuauucuuu

SEQ ID NO: 3218314 - RNA, 16 nt, Human
uacuguucagcuuuua

SEQ ID NO: 3218315 - RNA, 20 nt, Human
uacuguuauucuuugcacuu

SEQ ID NO: 3218316 - RNA, 17 nt, Human
uacuguuauucuuugca

SEQ ID NO: 3218317 - RNA, 16 nt, Human
uacuguuauucuuugc

SEQ ID NO: 3218318 - RNA, 12 nt, Human
uacuugaaccau

SEQ ID NO: 3218319 - RNA, 16 nt, Human
uacuugaaccauaaaa

SEQ ID NO: 3218320 - RNA, 17 nt, Human
uacuugaaccauaaaau

SEQ ID NO: 3218321 - RNA, 19 nt, Human
uacuugaaccauaaaaugu

SEQ ID NO: 3218322 - RNA, 20 nt, Human
uacuugaaccauaaaauguc

SEQ ID NO: 3218323 - RNA, 21 nt, Human
uacuugaaccauaaaaugucc

SEQ ID NO: 3218324 - RNA, 21 nt, Human
uacugucuucaguaagccgug

SEQ ID NO: 3218325 - RNA, 14 nt, Human
uacugugacuuuau

SEQ ID NO: 3218326 - RNA, 10 nt, Human
uacuguguua

SEQ ID NO: 3218327 - RNA, 14 nt, Human
uacuguuacuugau

SEQ ID NO: 3218328 - RNA, 17 nt, Human
uacuguuacuugauaac

SEQ ID NO: 3218329 - RNA, 15 nt, Human
uacuguuacuugaua

SEQ ID NO: 3218330 - RNA, 23 nt, Human
uacugucagcuccccucggagaa

SEQ ID NO: 3218331 - RNA, 16 nt, Human
uacuguccuacccacc

SEQ ID NO: 3218332 - RNA, 18 nt, Human
uacugcuugaauaaacac

SEQ ID NO: 3218333 - RNA, 17 nt, Human
uacugcuuuaaucagaa

SEQ ID NO: 3218334 - RNA, 20 nt, Human
uacugcuuaauucaaauaau

SEQ ID NO: 3218335 - RNA, 19 nt, Human
uacugcuuaauucaaauaa

SEQ ID NO: 3218336 - RNA, 13 nt, Human
uacugcuuaauuc

SEQ ID NO: 3218337 - RNA, 19 nt, Human
uacugcuagucuuaagaac

SEQ ID NO: 3218338 - RNA, 22 nt, Human
guguacauggaauaacauguaa

SEQ ID NO: 3218339 - RNA, 15 nt, Human
guguaccauuaaaau

SEQ ID NO: 3218340 - RNA, 18 nt, Human
guguagauuuuauagugu

SEQ ID NO: 3218341 - RNA, 20 nt, Human
guguagauuuuauagugugu

SEQ ID NO: 3218342 - RNA, 22 nt, Human
guguaauuuaaaauugugaugu

SEQ ID NO: 3218343 - RNA, 23 nt, Human
guguaauuuaaaauugugaugug

SEQ ID NO: 3218344 - RNA, 20 nt, Human
guguaauuuaaaauugugau

SEQ ID NO: 3218345 - RNA, 23 nt, Human
guguacagaauuuuucuucauua

SEQ ID NO: 3218346 - RNA, 16 nt, Human
guguaauuuuucugua

SEQ ID NO: 3218347 - RNA, 15 nt, Human
guguaauuuuucugu

SEQ ID NO: 3218348 - RNA, 17 nt, Human
guguacauggaauaaca

SEQ ID NO: 3218349 - RNA, 20 nt, Human
guguaugugaguauucucau

SEQ ID NO: 3218350 - RNA, 20 nt, Human
gugucccaaaaagaaaggag

SEQ ID NO: 3218351 - RNA, 22 nt, Human
guguccccaccaucugcugucu

SEQ ID NO: 3218352 - RNA, 20 nt, Human
guguccccaccaucugcugu

SEQ ID NO: 3218353 - RNA, 18 nt, Human
guguccccaccaucugcu

SEQ ID NO: 3218354 - RNA, 17 nt, Human
guguccccaccaucugc

SEQ ID NO: 3218355 - RNA, 13 nt, Human
guguccccaccau

SEQ ID NO: 3218356 - RNA, 12 nt, Human
guguccccacca

SEQ ID NO: 3218357 - RNA, 11 nt, Human
guguccccacc

SEQ ID NO: 3218358 - RNA, 18 nt, Human
gugucccugcacuugcag

SEQ ID NO: 3218359 - RNA, 16 nt, Human
gugucccugcacuugc

SEQ ID NO: 3218360 - RNA, 13 nt, Human
gugucccugcacu

SEQ ID NO: 3218361 - RNA, 14 nt, Human
guguaucaguguuu

SEQ ID NO: 3218362 - RNA, 15 nt, Human
guguaucaguguuua

SEQ ID NO: 3218363 - RNA, 19 nt, Human
guguaucaguguuuaugug

SEQ ID NO: 3218364 - RNA, 12 nt, Human
guguauauuuga

SEQ ID NO: 3218365 - RNA, 13 nt, Human
guguauauuugau

SEQ ID NO: 3218366 - RNA, 14 nt, Human
guguauauuugauu

SEQ ID NO: 3218367 - RNA, 17 nt, Human
guguauauuugauuuau

SEQ ID NO: 3218368 - RNA, 17 nt, Human
guguagcugcaaaaaua

SEQ ID NO: 3218369 - RNA, 23 nt, Human
guguagcugcaaaaauaaucaug

SEQ ID NO: 3218370 - RNA, 18 nt, Human
guggucuccacuggggau

SEQ ID NO: 3218371 - RNA, 17 nt, Human
guggucccaccccacac

SEQ ID NO: 3218372 - RNA, 18 nt, Human
gugguccuaaucuucuga

SEQ ID NO: 3218373 - RNA, 14 nt, Human
guggucccacccca

SEQ ID NO: 3218374 - RNA, 12 nt, Human
gugguccaaaua

SEQ ID NO: 3218375 - RNA, 15 nt, Human
guggucccaccccac

SEQ ID NO: 3218376 - RNA, 16 nt, Human
guggucccaccccaca

SEQ ID NO: 3218377 - RNA, 19 nt, Human
gugguaugaucacggcuca

SEQ ID NO: 3218378 - RNA, 17 nt, Human
gugguagagugugccug

SEQ ID NO: 3218379 - RNA, 14 nt, Human
guggucuuuuccuc

SEQ ID NO: 3218380 - RNA, 19 nt, Human
guggugcgaucuggguuca

SEQ ID NO: 3218381 - RNA, 21 nt, Human
guguaaguauucuuauuuaau

SEQ ID NO: 3218382 - RNA, 12 nt, Human
guguaauauuac

SEQ ID NO: 3218383 - RNA, 14 nt, Human
guguaauauuacuu

SEQ ID NO: 3218384 - RNA, 21 nt, Human
guggugagaggcauccaguau

SEQ ID NO: 3218385 - RNA, 17 nt, Human
guggugaccucugccug

SEQ ID NO: 3218386 - RNA, 14 nt, Human
guggugaccucugc

SEQ ID NO: 3218387 - RNA, 13 nt, Human
guggggaggggcu

SEQ ID NO: 3218388 - RNA, 15 nt, Human
guggggaccucaggc

SEQ ID NO: 3218389 - RNA, 18 nt, Human
guggggaccucaggccug

SEQ ID NO: 3218390 - RNA, 15 nt, Human
gugggugugagcagc

SEQ ID NO: 3218391 - RNA, 23 nt, Human
guggguuucuaaagcugccagcc

SEQ ID NO: 3218392 - RNA, 18 nt, Human
guggguuuguggggggag

SEQ ID NO: 3218393 - RNA, 19 nt, Human
guggguuuguggggggagg

SEQ ID NO: 3218394 - RNA, 17 nt, Human
guggggcagcuugaggg

SEQ ID NO: 3218395 - RNA, 13 nt, Human
guggggcagcuug

SEQ ID NO: 3218396 - RNA, 13 nt, Human
gugggccuggcca

SEQ ID NO: 3218397 - RNA, 17 nt, Human
gugggcccaaugcacuu

SEQ ID NO: 3218398 - RNA, 17 nt, Human
gugggcauucucucucc

SEQ ID NO: 3218399 - RNA, 15 nt, Human
gugggcuaguugggc

SEQ ID NO: 3218400 - RNA, 19 nt, Human
gugggccuucagggaguga

SEQ ID NO: 3218401 - RNA, 21 nt, Human
gugggcgugagaccugccccu

SEQ ID NO: 3218402 - RNA, 22 nt, Human
gugggcgugagaccugccccuc

SEQ ID NO: 3218403 - RNA, 18 nt, Human
gugggcgugagaccugcc

SEQ ID NO: 3218404 - RNA, 17 nt, Human
guggcuggaucugugag

SEQ ID NO: 3218405 - RNA, 23 nt, Human
guggcugcuucaaggauccugag

SEQ ID NO: 3218406 - RNA, 19 nt, Human
guggcuggguuggagggug

SEQ ID NO: 3218407 - RNA, 15 nt, Human
guggcugcuucaagg

SEQ ID NO: 3218408 - RNA, 16 nt, Human
guggcugcuucaagga

SEQ ID NO: 3218409 - RNA, 19 nt, Human
guggcugcuucaaggaucc

SEQ ID NO: 3218410 - RNA, 22 nt, Human
guggcugcuucaaggauccuga

SEQ ID NO: 3218411 - RNA, 20 nt, Human
guggcuucccgcucagcccu

SEQ ID NO: 3218412 - RNA, 19 nt, Human
guggcuucccgcucagccc

SEQ ID NO: 3218413 - RNA, 18 nt, Human
guggcuucccgcucagcc

SEQ ID NO: 3218414 - RNA, 22 nt, Human
guggcuuaaaacaacacucaca

SEQ ID NO: 3218415 - RNA, 20 nt, Human
gugcuacaaaaacacagcaa

SEQ ID NO: 3218416 - RNA, 15 nt, Human
gugcuacaaaaacac

SEQ ID NO: 3218417 - RNA, 14 nt, Human
guggcucacgccug

SEQ ID NO: 3218418 - RNA, 12 nt, Human
guggcugcuuca

SEQ ID NO: 3218419 - RNA, 14 nt, Human
guggcugcuucaag

SEQ ID NO: 3218420 - RNA, 20 nt, Human
guggcuccucccggugccca

SEQ ID NO: 3218421 - RNA, 13 nt, Human
guggcuccucccg

SEQ ID NO: 3218422 - RNA, 21 nt, Human
guggcucaagucuggccccac

SEQ ID NO: 3218423 - RNA, 20 nt, Human
guggcucaagucuggcccca

SEQ ID NO: 3218424 - RNA, 15 nt, Human
gugucgggcaugaca

SEQ ID NO: 3218425 - RNA, 14 nt, Human
guguccggucccug

SEQ ID NO: 3218426 - RNA, 23 nt, Human
gugucccugcacuugcagacucu

SEQ ID NO: 3218427 - RNA, 20 nt, Human
guguccuccugggguucuuu

SEQ ID NO: 3218428 - RNA, 14 nt, Human
gugucucuuggucc

SEQ ID NO: 3218429 - RNA, 17 nt, Human
gugucucccuucauccu

SEQ ID NO: 3218430 - RNA, 14 nt, Human
gugucuggcugcag

SEQ ID NO: 3218431 - RNA, 13 nt, Human
gugucugcccccu

SEQ ID NO: 3218432 - RNA, 16 nt, Human
gugucuggaucaguaa

SEQ ID NO: 3218433 - RNA, 20 nt, Human
gugucuggaucaguaaaauu

SEQ ID NO: 3218434 - RNA, 22 nt, Human
gugucucuugguccugcugcag

SEQ ID NO: 3218435 - RNA, 18 nt, Human
gugucucuugguccugcu

SEQ ID NO: 3218436 - RNA, 19 nt, Human
gugucucuugguccugcug

SEQ ID NO: 3218437 - RNA, 20 nt, Human
gugucucuugguccugcugc

SEQ ID NO: 3218438 - RNA, 21 nt, Human
gugucucuugguccugcugca

SEQ ID NO: 3218439 - RNA, 20 nt, Human
gugugagucaccaagcccag

SEQ ID NO: 3218440 - RNA, 17 nt, Human
gugugagugcauguacu

SEQ ID NO: 3218441 - RNA, 17 nt, Human
gugugauauuucagaaa

SEQ ID NO: 3218442 - RNA, 15 nt, Human
gugugauauuucaga

SEQ ID NO: 3218443 - RNA, 22 nt, Human
gugugauauuucagaaauacag

SEQ ID NO: 3218444 - RNA, 12 nt, Human
gugugcauaaua

SEQ ID NO: 3218445 - RNA, 17 nt, Human
gugugggaguguguaau

SEQ ID NO: 3218446 - RNA, 21 nt, Human
guguggagucauuucugauuu

SEQ ID NO: 3218447 - RNA, 17 nt, Human
guguggagucauuucug

SEQ ID NO: 3218448 - RNA, 13 nt, Human
guguggagaagcg

SEQ ID NO: 3218449 - RNA, 20 nt, Human
guguggaaauuaagaagaaa

SEQ ID NO: 3218450 - RNA, 21 nt, Human
guguggagaagcggcuggcag

SEQ ID NO: 3218451 - RNA, 16 nt, Human
guguguuuaugugugu

SEQ ID NO: 3218452 - RNA, 14 nt, Human
guguguuuaugugu

SEQ ID NO: 3218453 - RNA, 15 nt, Human
guguguuuaugugug

SEQ ID NO: 3218454 - RNA, 15 nt, Human
guguguuucugaucu

SEQ ID NO: 3218455 - RNA, 15 nt, Human
guguguuucuguccu

SEQ ID NO: 3218456 - RNA, 19 nt, Human
guguguuucuguccuguaa

SEQ ID NO: 3218457 - RNA, 12 nt, Human
guguguugugug

SEQ ID NO: 3218458 - RNA, 14 nt, Human
guguguugugugug

SEQ ID NO: 3218459 - RNA, 17 nt, Human
guguguuguguguggga

SEQ ID NO: 3218460 - RNA, 19 nt, Human
guguguugugcuuucaaga

SEQ ID NO: 3218461 - RNA, 14 nt, Human
guguguugcuuaug

SEQ ID NO: 3218462 - RNA, 12 nt, Human
gugugcucugau

SEQ ID NO: 3218463 - RNA, 15 nt, Human
gugugcuaaaaauga

SEQ ID NO: 3218464 - RNA, 22 nt, Human
gugugcuaaacguguauguuuu

SEQ ID NO: 3218465 - RNA, 22 nt, Human
gugugcucugaucauccacugu

SEQ ID NO: 3218466 - RNA, 15 nt, Human
gugugcucugaucau

SEQ ID NO: 3218467 - RNA, 19 nt, Human
guguggaaauuaagaagaa

SEQ ID NO: 3218468 - RNA, 18 nt, Human
gugugcccagcuuauaaa

SEQ ID NO: 3218469 - RNA, 13 nt, Human
gugugcccagcuu

SEQ ID NO: 3218470 - RNA, 23 nt, Human
gugugccucuagcugaauugagc

SEQ ID NO: 3218471 - RNA, 17 nt, Human
gugugccucuagcugaa

SEQ ID NO: 3218472 - RNA, 16 nt, Human
gugugccucuagcuga

SEQ ID NO: 3218473 - RNA, 14 nt, Human
gugugccucuagcu

SEQ ID NO: 3218474 - RNA, 13 nt, Human
gugugccucuagc

SEQ ID NO: 3218475 - RNA, 11 nt, Human
gugugccucua

SEQ ID NO: 3218476 - RNA, 17 nt, Human
guuaaacucgcucacug

SEQ ID NO: 3218477 - RNA, 13 nt, Human
guuaaagauguag

SEQ ID NO: 3218478 - RNA, 16 nt, Human
guuaaagauguagcaa

SEQ ID NO: 3218479 - RNA, 15 nt, Human
guuaaagaaaggaaa

SEQ ID NO: 3218480 - RNA, 21 nt, Human
guuaaagugaggccacugaag

SEQ ID NO: 3218481 - RNA, 22 nt, Human
guuaaagugaggccacugaaga

SEQ ID NO: 3218482 - RNA, 18 nt, Human
guuaaaggugaacauugg

SEQ ID NO: 3218483 - RNA, 21 nt, Human
guuaaagggaagaaaacacug

SEQ ID NO: 3218484 - RNA, 16 nt, Human
guuaaagggaagaaaa

SEQ ID NO: 3218485 - RNA, 16 nt, Human
guuaaaagaugaaaau

SEQ ID NO: 3218486 - RNA, 14 nt, Human
guuaaaagaugaaa

SEQ ID NO: 3218487 - RNA, 13 nt, Human
guuaaaaaaaaaa

SEQ ID NO: 3218488 - RNA, 20 nt, Human
guuaaaaacagauuuggaaa

SEQ ID NO: 3218489 - RNA, 20 nt, Human
guuaaaagaugaaaauauuu

SEQ ID NO: 3218490 - RNA, 13 nt, Human
guuaaaauuauac

SEQ ID NO: 3218491 - RNA, 14 nt, Human
guuaaaauggauuu

SEQ ID NO: 3218492 - RNA, 13 nt, Human
guuacagacaaag

SEQ ID NO: 3218493 - RNA, 22 nt, Human
guuacacuguuauuuucagcau

SEQ ID NO: 3218494 - RNA, 22 nt, Human
guuacacuuuuuggaagugaaa

SEQ ID NO: 3218495 - RNA, 18 nt, Human
guuacacuuuuuggaagu

SEQ ID NO: 3218496 - RNA, 17 nt, Human
guuacacuuuuuggaag

SEQ ID NO: 3218497 - RNA, 16 nt, Human
guuacacuaaaaggug

SEQ ID NO: 3218498 - RNA, 15 nt, Human
guuacacuaaaaggu

SEQ ID NO: 3218499 - RNA, 18 nt, Human
guuaacugagugccuuuu

SEQ ID NO: 3218500 - RNA, 21 nt, Human
guuaacuuauucaaagagaaa

SEQ ID NO: 3218501 - RNA, 17 nt, Human
guuaacaaauaacaacu

SEQ ID NO: 3218502 - RNA, 12 nt, Human
guuaacaaauaa

SEQ ID NO: 3218503 - RNA, 19 nt, Human
guuaacaaugccuauugua

SEQ ID NO: 3218504 - RNA, 23 nt, Human
guuaacaaugccuauuguaauau

SEQ ID NO: 3218505 - RNA, 23 nt, Human
guuaaauguuuuguaaacuuuga

SEQ ID NO: 3218506 - RNA, 22 nt, Human
guuaaauguuuuguaaacuuug

SEQ ID NO: 3218507 - RNA, 19 nt, Human
guuaaauguuuuguaaacu

SEQ ID NO: 3218508 - RNA, 18 nt, Human
guuaaauguuuuguaaac

SEQ ID NO: 3218509 - RNA, 17 nt, Human
guuaaauguuuuguaaa

SEQ ID NO: 3218510 - RNA, 13 nt, Human
guuaaauguuuug

SEQ ID NO: 3218511 - RNA, 11 nt, Human
guuaaauguuu

SEQ ID NO: 3218512 - RNA, 16 nt, Human
guuaaccucugcuuuu

SEQ ID NO: 3218513 - RNA, 17 nt, Human
guuaacaggcaaacauu

SEQ ID NO: 3218514 - RNA, 14 nt, Human
guguuaagauugca

SEQ ID NO: 3218515 - RNA, 16 nt, Human
guguuaauuuaaguuu

SEQ ID NO: 3218516 - RNA, 18 nt, Human
guguuaauuuaaguuuug

SEQ ID NO: 3218517 - RNA, 13 nt, Human
guguuaauuuaag

SEQ ID NO: 3218518 - RNA, 20 nt, Human
guguuaaucuuaauguauau

SEQ ID NO: 3218519 - RNA, 18 nt, Human
guguguuucauccuuccc

SEQ ID NO: 3218520 - RNA, 13 nt, Human
guguuacauguau

SEQ ID NO: 3218521 - RNA, 18 nt, Human
guguuaugacuccagaau

SEQ ID NO: 3218522 - RNA, 14 nt, Human
guguuauaugaaca

SEQ ID NO: 3218523 - RNA, 17 nt, Human
guguuuuuagcugugac

SEQ ID NO: 3218524 - RNA, 12 nt, Human
guguuuuucuca

SEQ ID NO: 3218525 - RNA, 19 nt, Human
guguuuuucucauauuuga

SEQ ID NO: 3218526 - RNA, 15 nt, Human
guguuuuuuaagaug

SEQ ID NO: 3218527 - RNA, 12 nt, Human
guguuuuggucc

SEQ ID NO: 3218528 - RNA, 20 nt, Human
guguuauuuuaaucucagaa

SEQ ID NO: 3218529 - RNA, 22 nt, Human
guguuauugagagagaugugua

SEQ ID NO: 3218530 - RNA, 24 nt, Human
guguuauugagagagauguguaau

SEQ ID NO: 3218531 - RNA, 17 nt, Human
guguuauaugaacauac

SEQ ID NO: 3218532 - RNA, 23 nt, Human
guguuauaugaacauacaaaugc

SEQ ID NO: 3218533 - RNA, 15 nt, Human
guguuaugagccagg

SEQ ID NO: 3218534 - RNA, 14 nt, Human
guguucagaaaaaa

SEQ ID NO: 3218535 - RNA, 23 nt, Human
guguucaguguuagcaguggguc

SEQ ID NO: 3218536 - RNA, 13 nt, Human
guguucucagagg

SEQ ID NO: 3218537 - RNA, 12 nt, Human
guguucucagag

SEQ ID NO: 3218538 - RNA, 22 nt, Human
guguuccuauauuccagguuua

SEQ ID NO: 3218539 - RNA, 11 nt, Human
guguuccuggc

SEQ ID NO: 3218540 - RNA, 20 nt, Human
guucugccucugauguauuu

SEQ ID NO: 3218541 - RNA, 19 nt, Human
guucugauccuaguuccac

SEQ ID NO: 3218542 - RNA, 14 nt, Human
guucugauauuaau

SEQ ID NO: 3218543 - RNA, 15 nt, Human
guucugcacacagca

SEQ ID NO: 3218544 - RNA, 16 nt, Human
guucugcacacagcac

SEQ ID NO: 3218545 - RNA, 18 nt, Human
guuccuuccucugagccu

SEQ ID NO: 3218546 - RNA, 19 nt, Human
guuccuuccucugagccuu

SEQ ID NO: 3218547 - RNA, 17 nt, Human
guuccuuccucugagcc

SEQ ID NO: 3218548 - RNA, 15 nt, Human
guuccuucugggcau

SEQ ID NO: 3218549 - RNA, 23 nt, Human
guugaaaagacuccaaagaaaug

SEQ ID NO: 3218550 - RNA, 22 nt, Human
guugaaaagacuccaaagaaau

SEQ ID NO: 3218551 - RNA, 17 nt, Human
guugaaaagacuccaaa

SEQ ID NO: 3218552 - RNA, 17 nt, Human
guugaaaaacagcugag

SEQ ID NO: 3218553 - RNA, 19 nt, Human
guucuuuucaauauauuug

SEQ ID NO: 3218554 - RNA, 12 nt, Human
guucuuugugua

SEQ ID NO: 3218555 - RNA, 12 nt, Human
guugaaaaaauu

SEQ ID NO: 3218556 - RNA, 21 nt, Human
guugaaaaaauuuaaaaguaa

SEQ ID NO: 3218557 - RNA, 19 nt, Human
guucuuucuuccucugcug

SEQ ID NO: 3218558 - RNA, 18 nt, Human
guucuuucuuccucugcu

SEQ ID NO: 3218559 - RNA, 17 nt, Human
guucuuucuuccucugc

SEQ ID NO: 3218560 - RNA, 16 nt, Human
guucuuucuuccucug

SEQ ID NO: 3218561 - RNA, 15 nt, Human
guucuuucuuccucu

SEQ ID NO: 3218562 - RNA, 14 nt, Human
guucuuucuuccuc

SEQ ID NO: 3218563 - RNA, 13 nt, Human
guucuuucucuuu

SEQ ID NO: 3218564 - RNA, 22 nt, Human
guucuuucauuugcuuuggaag

SEQ ID NO: 3218565 - RNA, 20 nt, Human
guucuuucauuugcuuugga

SEQ ID NO: 3218566 - RNA, 18 nt, Human
guucuuucacccuuuucu

SEQ ID NO: 3218567 - RNA, 16 nt, Human
guucugggacacaguu

SEQ ID NO: 3218568 - RNA, 15 nt, Human
guucugggacacagu

SEQ ID NO: 3218569 - RNA, 14 nt, Human
guucugggacacag

SEQ ID NO: 3218570 - RNA, 12 nt, Human
guucugggacac

SEQ ID NO: 3218571 - RNA, 11 nt, Human
guucugggaca

SEQ ID NO: 3218572 - RNA, 23 nt, Human
guucuggcagaguugaagacaga

SEQ ID NO: 3218573 - RNA, 19 nt, Human
guucugcuaaauuucaaau

SEQ ID NO: 3218574 - RNA, 17 nt, Human
guucugcuaaauuucaa

SEQ ID NO: 3218575 - RNA, 16 nt, Human
guucuggcucuuccag

SEQ ID NO: 3218576 - RNA, 20 nt, Human
guucuggcucuuccaggcug

SEQ ID NO: 3218577 - RNA, 12 nt, Human
guucuggcucuu

SEQ ID NO: 3218578 - RNA, 16 nt, Human
guugcaaugugaaaaa

SEQ ID NO: 3218579 - RNA, 16 nt, Human
guugauuucuaguuau

SEQ ID NO: 3218580 - RNA, 22 nt, Human
guugauuucuaguuauuuauuc

SEQ ID NO: 3218581 - RNA, 14 nt, Human
guugauucucucca

SEQ ID NO: 3218582 - RNA, 13 nt, Human
guugauucucucc

SEQ ID NO: 3218583 - RNA, 19 nt, Human
guugauuaauuucugccau

SEQ ID NO: 3218584 - RNA, 15 nt, Human
guugcaggaccucag

SEQ ID NO: 3218585 - RNA, 21 nt, Human
guugcacugaaguuugauaaa

SEQ ID NO: 3218586 - RNA, 16 nt, Human
guugcacugaaguuug

SEQ ID NO: 3218587 - RNA, 15 nt, Human
guugcacugaaguuu

SEQ ID NO: 3218588 - RNA, 13 nt, Human
guugcacugaagu

SEQ ID NO: 3218589 - RNA, 12 nt, Human
guugcacugaag

SEQ ID NO: 3218590 - RNA, 16 nt, Human
guugcauagcaguaua

SEQ ID NO: 3218591 - RNA, 18 nt, Human
guugcauagcaguauaug

SEQ ID NO: 3218592 - RNA, 23 nt, Human
guugcauagcaguauauguuaau

SEQ ID NO: 3218593 - RNA, 14 nt, Human
guugauuaaagaug

SEQ ID NO: 3218594 - RNA, 22 nt, Human
guugaugggaugauugaagaaa

SEQ ID NO: 3218595 - RNA, 13 nt, Human
guugaauguugca

SEQ ID NO: 3218596 - RNA, 19 nt, Human
guugaauguugcaauguga

SEQ ID NO: 3218597 - RNA, 13 nt, Human
guugaauaugauu

SEQ ID NO: 3218598 - RNA, 20 nt, Human
guugaagucaugcuccccug

SEQ ID NO: 3218599 - RNA, 19 nt, Human
guugaagucaugcuccccu

SEQ ID NO: 3218600 - RNA, 16 nt, Human
guugaagucaugcucc

SEQ ID NO: 3218601 - RNA, 13 nt, Human
guugaagccuuug

SEQ ID NO: 3218602 - RNA, 14 nt, Human
guugaagccuuugu

SEQ ID NO: 3218603 - RNA, 16 nt, Human
guugaagacagagcua

SEQ ID NO: 3218604 - RNA, 18 nt, Human
guugaacaaaauaaauug

SEQ ID NO: 3218605 - RNA, 17 nt, Human
guugaacaaaauaaauu

SEQ ID NO: 3218606 - RNA, 15 nt, Human
guugaacaaaauaaa

SEQ ID NO: 3218607 - RNA, 14 nt, Human
guugaacaaaauaa

SEQ ID NO: 3218608 - RNA, 21 nt, Human
guugaagaccuaaccagggcc

SEQ ID NO: 3218609 - RNA, 17 nt, Human
guugaacuguuagaaug

SEQ ID NO: 3218610 - RNA, 14 nt, Human
guugaacuguuaga

SEQ ID NO: 3218611 - RNA, 19 nt, Human
guugaagagacagagacaa

SEQ ID NO: 3218612 - RNA, 20 nt, Human
guugaagagacagagacaag

SEQ ID NO: 3218613 - RNA, 22 nt, Human
guugaagagacagagacaagua

SEQ ID NO: 3218614 - RNA, 19 nt, Human
guugaagaccuaaccaggg

SEQ ID NO: 3218615 - RNA, 19 nt, Human
guugaacuguuagaaugua

SEQ ID NO: 3218616 - RNA, 12 nt, Human
guuggcaugcau

SEQ ID NO: 3218617 - RNA, 14 nt, Human
guuggcaugcaucc

SEQ ID NO: 3218618 - RNA, 19 nt, Human
guuggccaggcugcucuca

SEQ ID NO: 3218619 - RNA, 14 nt, Human
guuggccaggcugc

SEQ ID NO: 3218620 - RNA, 13 nt, Human
guuggccaggcug

SEQ ID NO: 3218621 - RNA, 14 nt, Human
guuggccaggcugg

SEQ ID NO: 3218622 - RNA, 15 nt, Human
guuggccaggcuggu

SEQ ID NO: 3218623 - RNA, 14 nt, Human
guuggccaguguga

SEQ ID NO: 3218624 - RNA, 19 nt, Human
guuggccaggcuggucuca

SEQ ID NO: 3218625 - RNA, 17 nt, Human
guuggccaggcuggucu

SEQ ID NO: 3218626 - RNA, 19 nt, Human
guuggccaggcugcucuug

SEQ ID NO: 3218627 - RNA, 18 nt, Human
guuggccaggcuggucuc

SEQ ID NO: 3218628 - RNA, 23 nt, Human
guuggcagaugcagcucuuccug

SEQ ID NO: 3218629 - RNA, 23 nt, Human
guuggccaaagccaaagcuaggc

SEQ ID NO: 3218630 - RNA, 18 nt, Human
guuggcagaugcagcucu

SEQ ID NO: 3218631 - RNA, 14 nt, Human
guuggcaaaaaggc

SEQ ID NO: 3218632 - RNA, 18 nt, Human
guuggcaaaaaggcagga

SEQ ID NO: 3218633 - RNA, 13 nt, Human
guuggcaccuucc

SEQ ID NO: 3218634 - RNA, 18 nt, Human
guuggcaccuucccccuc

SEQ ID NO: 3218635 - RNA, 16 nt, Human
guuggcaccuuccccc

SEQ ID NO: 3218636 - RNA, 14 nt, Human
guugcccaggcagg

SEQ ID NO: 3218637 - RNA, 18 nt, Human
guugcccagccucuuucc

SEQ ID NO: 3218638 - RNA, 21 nt, Human
guugcccagccucuuucccuu

SEQ ID NO: 3218639 - RNA, 20 nt, Human
guugcccagccucuuucccu

SEQ ID NO: 3218640 - RNA, 12 nt, Human
guugcccaggca

SEQ ID NO: 3218641 - RNA, 22 nt, Human
guugcccagccucuuucccuuc

SEQ ID NO: 3218642 - RNA, 20 nt, Human
guuggaguucauucauauua

SEQ ID NO: 3218643 - RNA, 14 nt, Human
guuggaguucauuc

SEQ ID NO: 3218644 - RNA, 20 nt, Human
guuggaguagaauguaguuu

SEQ ID NO: 3218645 - RNA, 16 nt, Human
guuggaguagaaugua

SEQ ID NO: 3218646 - RNA, 16 nt, Human
guugccagucaccccg

SEQ ID NO: 3218647 - RNA, 17 nt, Human
guugccagucaccccgg

SEQ ID NO: 3218648 - RNA, 18 nt, Human
guugccagucaccccggc

SEQ ID NO: 3218649 - RNA, 23 nt, Human
guugccagucaccccggccaccu

SEQ ID NO: 3218650 - RNA, 13 nt, Human
guugccagucacc

SEQ ID NO: 3218651 - RNA, 14 nt, Human
guugccagucaccc

SEQ ID NO: 3218652 - RNA, 14 nt, Human
guuccagcaccaca

SEQ ID NO: 3218653 - RNA, 23 nt, Human
guuccagcaauucuccugccuca

SEQ ID NO: 3218654 - RNA, 14 nt, Human
guuccagccugcca

SEQ ID NO: 3218655 - RNA, 13 nt, Human
guuccagccugcc

SEQ ID NO: 3218656 - RNA, 20 nt, Human
guuccagcaauucuccugcc

SEQ ID NO: 3218657 - RNA, 21 nt, Human
guuccagcaauucuccugccu

SEQ ID NO: 3218658 - RNA, 14 nt, Human
guuccacugagacc

SEQ ID NO: 3218659 - RNA, 17 nt, Human
guuccaccaucaagcca

SEQ ID NO: 3218660 - RNA, 20 nt, Human
guuccaccaucaagccacca

SEQ ID NO: 3218661 - RNA, 13 nt, Human
guuccacugagac

SEQ ID NO: 3218662 - RNA, 12 nt, Human
guuccacugaga

SEQ ID NO: 3218663 - RNA, 14 nt, Human
guuccacagaggac

SEQ ID NO: 3218664 - RNA, 18 nt, Human
guuccaagucuuugcuau

SEQ ID NO: 3218665 - RNA, 23 nt, Human
guuccaaacaugagguucucucu

SEQ ID NO: 3218666 - RNA, 17 nt, Human
guuccaaacaugagguu

SEQ ID NO: 3218667 - RNA, 17 nt, Human
guuccaaccacugaauc

SEQ ID NO: 3218668 - RNA, 16 nt, Human
guucauucauauuaca

SEQ ID NO: 3218669 - RNA, 14 nt, Human
guucauucauauua

SEQ ID NO: 3218670 - RNA, 18 nt, Human
guucauugcaauuaaacu

SEQ ID NO: 3218671 - RNA, 17 nt, Human
guucauucauauuacaa

SEQ ID NO: 3218672 - RNA, 15 nt, Human
guuccagccugccac

SEQ ID NO: 3218673 - RNA, 14 nt, Human
guuccuaauccucu

SEQ ID NO: 3218674 - RNA, 15 nt, Human
guuccaguuucagag

SEQ ID NO: 3218675 - RNA, 17 nt, Human
guuccaggguucucuug

SEQ ID NO: 3218676 - RNA, 16 nt, Human
guuccuagccaccgcc

SEQ ID NO: 3218677 - RNA, 17 nt, Human
guuccuacacaggacag

SEQ ID NO: 3218678 - RNA, 16 nt, Human
guuccuacacaggaca

SEQ ID NO: 3218679 - RNA, 15 nt, Human
guuccuacacaggac

SEQ ID NO: 3218680 - RNA, 22 nt, Human
guuccucauuagcauuuugcua

SEQ ID NO: 3218681 - RNA, 18 nt, Human
guuccuacacaggacagg

SEQ ID NO: 3218682 - RNA, 23 nt, Human
guuccuagugauggcuuaugaua

SEQ ID NO: 3218683 - RNA, 16 nt, Human
guuccuaggggaauga

SEQ ID NO: 3218684 - RNA, 18 nt, Human
guuccuaggggaaugagg

SEQ ID NO: 3218685 - RNA, 20 nt, Human
guuccuaggggaaugagggg

SEQ ID NO: 3218686 - RNA, 22 nt, Human
guuccuaggggaaugagggggc

SEQ ID NO: 3218687 - RNA, 23 nt, Human
guuccuccccuccuccuggacuc

SEQ ID NO: 3218688 - RNA, 22 nt, Human
guuccuggggcauccauggggu

SEQ ID NO: 3218689 - RNA, 24 nt, Human
guucacucuuggagccugcagagc

SEQ ID NO: 3218690 - RNA, 20 nt, Human
guucacucuuggagccugca

SEQ ID NO: 3218691 - RNA, 19 nt, Human
guucacugcaaccuccgcc

SEQ ID NO: 3218692 - RNA, 19 nt, Human
guucacucuuggagccugc

SEQ ID NO: 3218693 - RNA, 18 nt, Human
guucacucuuggagccug

SEQ ID NO: 3218694 - RNA, 17 nt, Human
guucacucuuggagccu

SEQ ID NO: 3218695 - RNA, 15 nt, Human
guucacaccugcaga

SEQ ID NO: 3218696 - RNA, 18 nt, Human
guucacuaaacucugaau

SEQ ID NO: 3218697 - RNA, 16 nt, Human
guucacuaaacucuga

SEQ ID NO: 3218698 - RNA, 24 nt, Human
guucacucuacuuagcaugucccu

SEQ ID NO: 3218699 - RNA, 15 nt, Human
guucacuaaacucug

SEQ ID NO: 3218700 - RNA, 16 nt, Human
guucacggguggccug

SEQ ID NO: 3218701 - RNA, 20 nt, Human
guucacuaaacucugaauaa

SEQ ID NO: 3218702 - RNA, 21 nt, Human
guucagaaaaaagguucuuug

SEQ ID NO: 3218703 - RNA, 12 nt, Human
guucagaaaaaa

SEQ ID NO: 3218704 - RNA, 16 nt, Human
guucaucaaugaauga

SEQ ID NO: 3218705 - RNA, 17 nt, Human
guucaucauccuaagcu

SEQ ID NO: 3218706 - RNA, 16 nt, Human
guucaucccuucucuu

SEQ ID NO: 3218707 - RNA, 19 nt, Human
guucaucccuucucuucca

SEQ ID NO: 3218708 - RNA, 18 nt, Human
guucaucccuucucuucc

SEQ ID NO: 3218709 - RNA, 15 nt, Human
guucagauuggacau

SEQ ID NO: 3218710 - RNA, 17 nt, Human
guucagccacugaggga

SEQ ID NO: 3218711 - RNA, 12 nt, Human
guucaucuugaa

SEQ ID NO: 3218712 - RNA, 13 nt, Human
guucaucuugaau

SEQ ID NO: 3218713 - RNA, 18 nt, Human
guucaucuugaauuguaa

SEQ ID NO: 3218714 - RNA, 20 nt, Human
guucaucccuucucuuccag

SEQ ID NO: 3218715 - RNA, 23 nt, Human
guucaagugauucucaugccuca

SEQ ID NO: 3218716 - RNA, 17 nt, Human
guucaagugauucucuu

SEQ ID NO: 3218717 - RNA, 20 nt, Human
guucaagcgauucuucugcu

SEQ ID NO: 3218718 - RNA, 23 nt, Human
guuauuauagagcagaaauucug

SEQ ID NO: 3218719 - RNA, 23 nt, Human
guucaauucucauuugucacaca

SEQ ID NO: 3218720 - RNA, 17 nt, Human
guucaauuauuuccccc

SEQ ID NO: 3218721 - RNA, 18 nt, Human
guucaauuauuuccccca

SEQ ID NO: 3218722 - RNA, 19 nt, Human
guucaauuauuucccccau

SEQ ID NO: 3218723 - RNA, 16 nt, Human
guucaauucucauuug

SEQ ID NO: 3218724 - RNA, 21 nt, Human
guuauguaaauaauucuuuuu

SEQ ID NO: 3218725 - RNA, 14 nt, Human
guuauguauauggu

SEQ ID NO: 3218726 - RNA, 15 nt, Human
guuaugguagaaaaa

SEQ ID NO: 3218727 - RNA, 16 nt, Human
guuaugguagaaaaau

SEQ ID NO: 3218728 - RNA, 20 nt, Human
guuaugguagaaaaauuuca

SEQ ID NO: 3218729 - RNA, 15 nt, Human
guuauguaaauaauu

SEQ ID NO: 3218730 - RNA, 19 nt, Human
guucaagcgauucuucugc

SEQ ID NO: 3218731 - RNA, 18 nt, Human
guucaagcgauucuucug

SEQ ID NO: 3218732 - RNA, 12 nt, Human
guuauuaaaugu

SEQ ID NO: 3218733 - RNA, 13 nt, Human
guuauuaaaugua

SEQ ID NO: 3218734 - RNA, 11 nt, Human
guuaugugucu

SEQ ID NO: 3218735 - RNA, 12 nt, Human
guuauuaaaauu

SEQ ID NO: 3218736 - RNA, 13 nt, Human
guuauuaaaauug

SEQ ID NO: 3218737 - RNA, 17 nt, Human
guuaucauuuuuuccug

SEQ ID NO: 3218738 - RNA, 20 nt, Human
guuaucauuuuuuccuguuu

SEQ ID NO: 3218739 - RNA, 21 nt, Human
guuaugacuccagaauuuccc

SEQ ID NO: 3218740 - RNA, 23 nt, Human
guuauauuuuucuuaaaaaguaa

SEQ ID NO: 3218741 - RNA, 14 nt, Human
guuaucacugugca

SEQ ID NO: 3218742 - RNA, 16 nt, Human
guuaucacugugcagu

SEQ ID NO: 3218743 - RNA, 13 nt, Human
guuaucaugaauu

SEQ ID NO: 3218744 - RNA, 14 nt, Human
guuaucaugaauuu

SEQ ID NO: 3218745 - RNA, 16 nt, Human
guuaucaugaauuuua

SEQ ID NO: 3218746 - RNA, 17 nt, Human
guuaucaugaauuuuaa

SEQ ID NO: 3218747 - RNA, 18 nt, Human
guuaucaugaauuuuaaa

SEQ ID NO: 3218748 - RNA, 19 nt, Human
guuaucaugaauuuuaaag

SEQ ID NO: 3218749 - RNA, 20 nt, Human
guuaucaugaauuuuaaagu

SEQ ID NO: 3218750 - RNA, 22 nt, Human
guuaucaugaauuuuaaaguau

SEQ ID NO: 3218751 - RNA, 21 nt, Human
guuauauuuuucuuaaaaagu

SEQ ID NO: 3218752 - RNA, 17 nt, Human
guuauagugcaauauau

SEQ ID NO: 3218753 - RNA, 17 nt, Human
guuauaaugaaugacuu

SEQ ID NO: 3218754 - RNA, 18 nt, Human
guuauagguccuuuagaa

SEQ ID NO: 3218755 - RNA, 21 nt, Human
guuauagguccuuuagaaaca

SEQ ID NO: 3218756 - RNA, 16 nt, Human
guuauagugcaauaua

SEQ ID NO: 3218757 - RNA, 15 nt, Human
guuauagugcaauau

SEQ ID NO: 3218758 - RNA, 15 nt, Human
guuacuaccuccucu

SEQ ID NO: 3218759 - RNA, 11 nt, Human
guuacucucuu

SEQ ID NO: 3218760 - RNA, 21 nt, Human
guuacucucuuccacauguua

SEQ ID NO: 3218761 - RNA, 16 nt, Human
guuaguuucuccaagc

SEQ ID NO: 3218762 - RNA, 19 nt, Human
guuaguuucuccaagcagg

SEQ ID NO: 3218763 - RNA, 22 nt, Human
guuaguuucuccaagcaggaca

SEQ ID NO: 3218764 - RNA, 16 nt, Human
guuaguuccacugaga

SEQ ID NO: 3218765 - RNA, 13 nt, Human
guuauaaaggaau

SEQ ID NO: 3218766 - RNA, 18 nt, Human
guuauacaaccuucauuu

SEQ ID NO: 3218767 - RNA, 20 nt, Human
guuauacaaccuucauuuaa

SEQ ID NO: 3218768 - RNA, 17 nt, Human
guuauacaguuauaaaa

SEQ ID NO: 3218769 - RNA, 18 nt, Human
guuauacaguuauaaaau

SEQ ID NO: 3218770 - RNA, 20 nt, Human
guuauacaguuauaaaauua

SEQ ID NO: 3218771 - RNA, 22 nt, Human
guuauacaguuauaaaauuaaa

SEQ ID NO: 3218772 - RNA, 11 nt, Human
guuauaaaauu

SEQ ID NO: 3218773 - RNA, 19 nt, Human
guuacagguaccaguucuu

SEQ ID NO: 3218774 - RNA, 16 nt, Human
guuacaguaaugucau

SEQ ID NO: 3218775 - RNA, 22 nt, Human
guuacaguaaugucauaaagug

SEQ ID NO: 3218776 - RNA, 12 nt, Human
guuacagccugg

SEQ ID NO: 3218777 - RNA, 15 nt, Human
guuacagacaaagcg

SEQ ID NO: 3218778 - RNA, 17 nt, Human
guuacagacaaagcgug

SEQ ID NO: 3218779 - RNA, 20 nt, Human
guuacaugcagccacuuagg

SEQ ID NO: 3218780 - RNA, 19 nt, Human
guuacauaagauaaaugug

SEQ ID NO: 3218781 - RNA, 18 nt, Human
guuacauaagauaaaugu

SEQ ID NO: 3218782 - RNA, 12 nt, Human
guuaccuuaaau

SEQ ID NO: 3218783 - RNA, 21 nt, Human
guuaccauuggaaauuucacg

SEQ ID NO: 3218784 - RNA, 20 nt, Human
guuaccauuggaaauuucac

SEQ ID NO: 3218785 - RNA, 23 nt, Human
guuaccauuuugggguacccacu

SEQ ID NO: 3218786 - RNA, 14 nt, Human
guuaccauuggaaa

SEQ ID NO: 3218787 - RNA, 19 nt, Human
guuaccauuggaaauuuca

SEQ ID NO: 3218788 - RNA, 16 nt, Human
guuaccauuggaaauu

SEQ ID NO: 3218789 - RNA, 15 nt, Human
gucccugccaaugga

SEQ ID NO: 3218790 - RNA, 11 nt, Human
gucccugccaa

SEQ ID NO: 3218791 - RNA, 14 nt, Human
gucccugccaaugg

SEQ ID NO: 3218792 - RNA, 21 nt, Human
guccuuaccagcagagcaccu

SEQ ID NO: 3218793 - RNA, 18 nt, Human
guccuuaccagcagagca

SEQ ID NO: 3218794 - RNA, 19 nt, Human
guccuuaccagcagagcac

SEQ ID NO: 3218795 - RNA, 23 nt, Human
gucggguuuuauuguuuaaaauc

SEQ ID NO: 3218796 - RNA, 22 nt, Human
gucggcuccaguccccagaacu

SEQ ID NO: 3218797 - RNA, 16 nt, Human
gucgggcaugacacga

SEQ ID NO: 3218798 - RNA, 12 nt, Human
gucggcuccagu

SEQ ID NO: 3218799 - RNA, 11 nt, Human
gucggcuccag

SEQ ID NO: 3218800 - RNA, 19 nt, Human
gucuaagaaacauuggaag

SEQ ID NO: 3218801 - RNA, 18 nt, Human
gucuaagaaacauuggaa

SEQ ID NO: 3218802 - RNA, 15 nt, Human
gucucaccauuuccc

SEQ ID NO: 3218803 - RNA, 22 nt, Human
gucuaaccacagcuccuuuucc

SEQ ID NO: 3218804 - RNA, 15 nt, Human
gucuaagaaacauug

SEQ ID NO: 3218805 - RNA, 14 nt, Human
gucuaagaaacauu

SEQ ID NO: 3218806 - RNA, 15 nt, Human
gucuaaauuuauuau

SEQ ID NO: 3218807 - RNA, 19 nt, Human
gucucacuauguugcccag

SEQ ID NO: 3218808 - RNA, 11 nt, Human
gucucacucug

SEQ ID NO: 3218809 - RNA, 18 nt, Human
gucucacuauguugccca

SEQ ID NO: 3218810 - RNA, 23 nt, Human
gucucaccauuuccccagggcac

SEQ ID NO: 3218811 - RNA, 22 nt, Human
gucucaccauuuccccagggca

SEQ ID NO: 3218812 - RNA, 21 nt, Human
gucucaccauuuccccagggc

SEQ ID NO: 3218813 - RNA, 20 nt, Human
gucucaccauuuccccaggg

SEQ ID NO: 3218814 - RNA, 19 nt, Human
gucucaccauuuccccagg

SEQ ID NO: 3218815 - RNA, 18 nt, Human
gucucaccauuuccccag

SEQ ID NO: 3218816 - RNA, 15 nt, Human
gucguaguuacucuc

SEQ ID NO: 3218817 - RNA, 17 nt, Human
gucgucaucagaugcuu

SEQ ID NO: 3218818 - RNA, 16 nt, Human
gucucugguuccuccc

SEQ ID NO: 3218819 - RNA, 17 nt, Human
gucucuucuccacugga

SEQ ID NO: 3218820 - RNA, 13 nt, Human
gucucuucuccuu

SEQ ID NO: 3218821 - RNA, 18 nt, Human
gucucuucuccacuggau

SEQ ID NO: 3218822 - RNA, 14 nt, Human
gucucuucuccuua

SEQ ID NO: 3218823 - RNA, 13 nt, Human
gucucugagcauu

SEQ ID NO: 3218824 - RNA, 22 nt, Human
gucucacucugucgcccagucu

SEQ ID NO: 3218825 - RNA, 19 nt, Human
gucucacucugucgcccag

SEQ ID NO: 3218826 - RNA, 18 nt, Human
gucucacucugucgccca

SEQ ID NO: 3218827 - RNA, 16 nt, Human
gucucacucugucgcc

SEQ ID NO: 3218828 - RNA, 15 nt, Human
gucucacucugucgc

SEQ ID NO: 3218829 - RNA, 18 nt, Human
gucucuagugcugugaaa

SEQ ID NO: 3218830 - RNA, 17 nt, Human
gucucuagugcugugaa

SEQ ID NO: 3218831 - RNA, 16 nt, Human
gucucuagugcuguga

SEQ ID NO: 3218832 - RNA, 14 nt, Human
gucucuagugcugu

SEQ ID NO: 3218833 - RNA, 16 nt, Human
gucuugguuccagccu

SEQ ID NO: 3218834 - RNA, 19 nt, Human
gucuugguuccagccugcc

SEQ ID NO: 3218835 - RNA, 17 nt, Human
gucuugguuccagccug

SEQ ID NO: 3218836 - RNA, 16 nt, Human
gucuuuuuucacuaca

SEQ ID NO: 3218837 - RNA, 21 nt, Human
gucuuggaagcuguuuggaaa

SEQ ID NO: 3218838 - RNA, 22 nt, Human
gucuuggaagcuguuuggaaaa

SEQ ID NO: 3218839 - RNA, 15 nt, Human
gucuugccuauauuu

SEQ ID NO: 3218840 - RNA, 23 nt, Human
gucuugcaauggcagccuuggca

SEQ ID NO: 3218841 - RNA, 21 nt, Human
gucuugcaauggcagccuugg

SEQ ID NO: 3218842 - RNA, 20 nt, Human
gucuugcaauggcagccuug

SEQ ID NO: 3218843 - RNA, 19 nt, Human
gucuugcaauggcagccuu

SEQ ID NO: 3218844 - RNA, 18 nt, Human
gucuugcaauggcagccu

SEQ ID NO: 3218845 - RNA, 17 nt, Human
gucuugcaauggcagcc

SEQ ID NO: 3218846 - RNA, 16 nt, Human
gucuugcaauggcagc

SEQ ID NO: 3218847 - RNA, 20 nt, Human
gucuugaacuccuggccuca

SEQ ID NO: 3218848 - RNA, 18 nt, Human
gucuugaacuccuggccu

SEQ ID NO: 3218849 - RNA, 21 nt, Human
gucuugaacuccuggccucaa

SEQ ID NO: 3218850 - RNA, 17 nt, Human
gucuugaacuccuggcc

SEQ ID NO: 3218851 - RNA, 16 nt, Human
gucuugaacuccuggc

SEQ ID NO: 3218852 - RNA, 22 nt, Human
gucuucugcuuuguugugugcc

SEQ ID NO: 3218853 - RNA, 14 nt, Human
gucuucugcuuugu

SEQ ID NO: 3218854 - RNA, 13 nt, Human
gucuucugcuuug

SEQ ID NO: 3218855 - RNA, 12 nt, Human
gucuucugcuuu

SEQ ID NO: 3218856 - RNA, 11 nt, Human
gucugugugug

SEQ ID NO: 3218857 - RNA, 12 nt, Human
gucugugugugu

SEQ ID NO: 3218858 - RNA, 16 nt, Human
gucuguguguguguau

SEQ ID NO: 3218859 - RNA, 20 nt, Human
gucuguguguguguaugugg

SEQ ID NO: 3218860 - RNA, 11 nt, Human
gucuguguguu

SEQ ID NO: 3218861 - RNA, 21 nt, Human
gucuguguguuuaugugugug

SEQ ID NO: 3218862 - RNA, 22 nt, Human
gucuguguguuuaugugugugu

SEQ ID NO: 3218863 - RNA, 20 nt, Human
gucuguguuccaaccacuga

SEQ ID NO: 3218864 - RNA, 13 nt, Human
gucuguugauuaa

SEQ ID NO: 3218865 - RNA, 19 nt, Human
gucuguugauuaaagauga

SEQ ID NO: 3218866 - RNA, 16 nt, Human
gucuguugauuaaaga

SEQ ID NO: 3218867 - RNA, 13 nt, Human
gucugucuuccuu

SEQ ID NO: 3218868 - RNA, 14 nt, Human
gucugucuuccuuu

SEQ ID NO: 3218869 - RNA, 21 nt, Human
gucugucuuccuuugcuuccc

SEQ ID NO: 3218870 - RNA, 15 nt, Human
gucugcccccuccug

SEQ ID NO: 3218871 - RNA, 22 nt, Human
gucugccccaaguuuugugaaa

SEQ ID NO: 3218872 - RNA, 19 nt, Human
gucugccccaaguuuugug

SEQ ID NO: 3218873 - RNA, 18 nt, Human
gucugccccaaguuuugu

SEQ ID NO: 3218874 - RNA, 13 nt, Human
gucugccuggagg

SEQ ID NO: 3218875 - RNA, 15 nt, Human
gucugugagaugcua

SEQ ID NO: 3218876 - RNA, 16 nt, Human
gucugugagaugcuag

SEQ ID NO: 3218877 - RNA, 17 nt, Human
gucugugagaugcuaga

SEQ ID NO: 3218878 - RNA, 21 nt, Human
gucugugagaugcuagaacuc

SEQ ID NO: 3218879 - RNA, 22 nt, Human
gucugugagaugcuagaacucc

SEQ ID NO: 3218880 - RNA, 23 nt, Human
gucugugagaugcuagaacuccc

SEQ ID NO: 3218881 - RNA, 18 nt, Human
gucugugccauuuuguau

SEQ ID NO: 3218882 - RNA, 16 nt, Human
gugauauaaacagcuu

SEQ ID NO: 3218883 - RNA, 12 nt, Human
gugauauucccc

SEQ ID NO: 3218884 - RNA, 20 nt, Human
gugauauucuuuguuaauuu

SEQ ID NO: 3218885 - RNA, 13 nt, Human
gugauauucuuug

SEQ ID NO: 3218886 - RNA, 22 nt, Human
gugauccacccaccucagccuc

SEQ ID NO: 3218887 - RNA, 14 nt, Human
gugaucacuuucug

SEQ ID NO: 3218888 - RNA, 23 nt, Human
gugaucacuuucugaaauucaca

SEQ ID NO: 3218889 - RNA, 17 nt, Human
gugauauuucagaaaua

SEQ ID NO: 3218890 - RNA, 13 nt, Human
gugauauuucaga

SEQ ID NO: 3218891 - RNA, 23 nt, Human
gugauauucuuuguuaauuugga

SEQ ID NO: 3218892 - RNA, 22 nt, Human
gugauauucuuuguuaauuugg

SEQ ID NO: 3218893 - RNA, 18 nt, Human
gugauauuucagaaauac

SEQ ID NO: 3218894 - RNA, 17 nt, Human
gugaguugauagcacag

SEQ ID NO: 3218895 - RNA, 12 nt, Human
gugaguuuguuu

SEQ ID NO: 3218896 - RNA, 15 nt, Human
gugaguuuguuucuu

SEQ ID NO: 3218897 - RNA, 13 nt, Human
gugaguuuguuuc

SEQ ID NO: 3218898 - RNA, 13 nt, Human
gugauaaaaucau

SEQ ID NO: 3218899 - RNA, 12 nt, Human
gugauaaaauca

SEQ ID NO: 3218900 - RNA, 22 nt, Human
gugaguuuguuucuuugaauuu

SEQ ID NO: 3218901 - RNA, 17 nt, Human
gugaguuuguuucuuug

SEQ ID NO: 3218902 - RNA, 19 nt, Human
gugauaagggaaaagauaa

SEQ ID NO: 3218903 - RNA, 21 nt, Human
gugauaagggaaaagauaaag

SEQ ID NO: 3218904 - RNA, 21 nt, Human
gugauaaaaucauaaguauuu

SEQ ID NO: 3218905 - RNA, 17 nt, Human
gugaggaugaaaaaaua

SEQ ID NO: 3218906 - RNA, 16 nt, Human
gugagugguugaauau

SEQ ID NO: 3218907 - RNA, 20 nt, Human
gugagugugaauauaaaugu

SEQ ID NO: 3218908 - RNA, 19 nt, Human
gugagccgagaucacgcca

SEQ ID NO: 3218909 - RNA, 21 nt, Human
gugacuauggagcugagcagg

SEQ ID NO: 3218910 - RNA, 12 nt, Human
gugacuaggaaa

SEQ ID NO: 3218911 - RNA, 20 nt, Human
gugagccacugcaccgggcc

SEQ ID NO: 3218912 - RNA, 15 nt, Human
gugagccacugcacc

SEQ ID NO: 3218913 - RNA, 14 nt, Human
gugagccacugcac

SEQ ID NO: 3218914 - RNA, 22 nt, Human
gugaccuuccaagagccugaga

SEQ ID NO: 3218915 - RNA, 21 nt, Human
gugaccuuccaagagccugag

SEQ ID NO: 3218916 - RNA, 20 nt, Human
gugaccuuccaagagccuga

SEQ ID NO: 3218917 - RNA, 14 nt, Human
gugacgaaaacauu

SEQ ID NO: 3218918 - RNA, 15 nt, Human
gugacgaaaacauug

SEQ ID NO: 3218919 - RNA, 24 nt, Human
gugacgguuccuacacaggacagg

SEQ ID NO: 3218920 - RNA, 13 nt, Human
gugacgguuccua

SEQ ID NO: 3218921 - RNA, 14 nt, Human
gugaccucugccug

SEQ ID NO: 3218922 - RNA, 13 nt, Human
gugaccucugccu

SEQ ID NO: 3218923 - RNA, 15 nt, Human
gugacagaggcagcc

SEQ ID NO: 3218924 - RNA, 12 nt, Human
gugaccucugcc

SEQ ID NO: 3218925 - RNA, 14 nt, Human
gugacagaggcagc

SEQ ID NO: 3218926 - RNA, 13 nt, Human
gugacagaggcag

SEQ ID NO: 3218927 - RNA, 12 nt, Human
gugacagaggca

SEQ ID NO: 3218928 - RNA, 21 nt, Human
gugaaugaugauccuaggcau

SEQ ID NO: 3218929 - RNA, 20 nt, Human
gugacaaggauugcuacugu

SEQ ID NO: 3218930 - RNA, 13 nt, Human
gugaacacaucag

SEQ ID NO: 3218931 - RNA, 21 nt, Human
gugaacaaauuuacagagaca

SEQ ID NO: 3218932 - RNA, 18 nt, Human
gugaaauuuuucauauuu

SEQ ID NO: 3218933 - RNA, 23 nt, Human
gucuuuuuuuuuuaagugaaauu

SEQ ID NO: 3218934 - RNA, 21 nt, Human
gucuuuuuuuuuuaagugaaa

SEQ ID NO: 3218935 - RNA, 15 nt, Human
gugaaaaaaaaaaug

SEQ ID NO: 3218936 - RNA, 14 nt, Human
gugaaaaaaaaaau

SEQ ID NO: 3218937 - RNA, 18 nt, Human
gugaaaaauguuaggaca

SEQ ID NO: 3218938 - RNA, 18 nt, Human
gugaaaaaaaaaaugcug

SEQ ID NO: 3218939 - RNA, 14 nt, Human
gugaaauuuuucau

SEQ ID NO: 3218940 - RNA, 13 nt, Human
gugaaauuuuuca

SEQ ID NO: 3218941 - RNA, 18 nt, Human
gugcaaacccacucagag

SEQ ID NO: 3218942 - RNA, 21 nt, Human
gugcaaaaggcuugcagaacu

SEQ ID NO: 3218943 - RNA, 19 nt, Human
gugcaaacccacucagaga

SEQ ID NO: 3218944 - RNA, 18 nt, Human
gugcagacaaucuucugu

SEQ ID NO: 3218945 - RNA, 23 nt, Human
gugcagaagggagcuggcuccag

SEQ ID NO: 3218946 - RNA, 22 nt, Human
gugcagaacugcagucacugca

SEQ ID NO: 3218947 - RNA, 16 nt, Human
gugauuuuaaaugugu

SEQ ID NO: 3218948 - RNA, 13 nt, Human
gugauuuggaucu

SEQ ID NO: 3218949 - RNA, 24 nt, Human
gugauccacccaccucagccuccc

SEQ ID NO: 3218950 - RNA, 23 nt, Human
gugauccacccaccucagccucc

SEQ ID NO: 3218951 - RNA, 23 nt, Human
gugcaguggugcgaucuggguuc

SEQ ID NO: 3218952 - RNA, 20 nt, Human
gugcaguggugcgaucuggg

SEQ ID NO: 3218953 - RNA, 15 nt, Human
gugcaggagcgcucc

SEQ ID NO: 3218954 - RNA, 11 nt, Human
gugcaggcagg

SEQ ID NO: 3218955 - RNA, 17 nt, Human
gugcaggagcgcucccu

SEQ ID NO: 3218956 - RNA, 13 nt, Human
gugcaggcccacc

SEQ ID NO: 3218957 - RNA, 12 nt, Human
gugcaggcccac

SEQ ID NO: 3218958 - RNA, 18 nt, Human
gugcaggcaggcuggccu

SEQ ID NO: 3218959 - RNA, 12 nt, Human
gugcaggcaggc

SEQ ID NO: 3218960 - RNA, 14 nt, Human
gugcagcagggcag

SEQ ID NO: 3218961 - RNA, 20 nt, Human
gugcauaguuguagacaaag

SEQ ID NO: 3218962 - RNA, 22 nt, Human
gugcauaguuguagacaaagua

SEQ ID NO: 3218963 - RNA, 16 nt, Human
gugcaguugcuguuua

SEQ ID NO: 3218964 - RNA, 17 nt, Human
gugcaguugcuguuuac

SEQ ID NO: 3218965 - RNA, 19 nt, Human
gugcaggcccacccugcuu

SEQ ID NO: 3218966 - RNA, 16 nt, Human
gugcaggcccacccug

SEQ ID NO: 3218967 - RNA, 18 nt, Human
gugccagcccagaggccg

SEQ ID NO: 3218968 - RNA, 14 nt, Human
gugccagcccagag

SEQ ID NO: 3218969 - RNA, 13 nt, Human
gugcaucucagcc

SEQ ID NO: 3218970 - RNA, 14 nt, Human
gugccuuuugccau

SEQ ID NO: 3218971 - RNA, 21 nt, Human
gugcgaucuggguucacugca

SEQ ID NO: 3218972 - RNA, 15 nt, Human
gugcccgccaccaca

SEQ ID NO: 3218973 - RNA, 15 nt, Human
gugccuucagcucua

SEQ ID NO: 3218974 - RNA, 21 nt, Human
gugccaggauggaaugauggg

SEQ ID NO: 3218975 - RNA, 14 nt, Human
gugccaucagugcc

SEQ ID NO: 3218976 - RNA, 16 nt, Human
gugccaugugccaggu

SEQ ID NO: 3218977 - RNA, 14 nt, Human
gugccaugugccag

SEQ ID NO: 3218978 - RNA, 20 nt, Human
gugcccaagaauagaugcug

SEQ ID NO: 3218979 - RNA, 19 nt, Human
gugcguaugcaguguagau

SEQ ID NO: 3218980 - RNA, 20 nt, Human
gugcgucaguccaagggguc

SEQ ID NO: 3218981 - RNA, 14 nt, Human
gugcggccuuuggc

SEQ ID NO: 3218982 - RNA, 14 nt, Human
gugcgccuacagga

SEQ ID NO: 3218983 - RNA, 20 nt, Human
gugcuaaacguguauguuuu

SEQ ID NO: 3218984 - RNA, 17 nt, Human
gugcuaaacguguaugu

SEQ ID NO: 3218985 - RNA, 14 nt, Human
gugcuaaacgugua

SEQ ID NO: 3218986 - RNA, 13 nt, Human
gugcuaagugcuu

SEQ ID NO: 3218987 - RNA, 14 nt, Human
guagguugggagaa

SEQ ID NO: 3218988 - RNA, 17 nt, Human
guaguacuucuucugua

SEQ ID NO: 3218989 - RNA, 19 nt, Human
guaguacuucuucuguaau

SEQ ID NO: 3218990 - RNA, 21 nt, Human
guaguacuucuucuguaauau

SEQ ID NO: 3218991 - RNA, 22 nt, Human
guaguacuucuucuguaauauu

SEQ ID NO: 3218992 - RNA, 14 nt, Human
guagucaggugccu

SEQ ID NO: 3218993 - RNA, 22 nt, Human
guaguaugauagguuauuuuga

SEQ ID NO: 3218994 - RNA, 16 nt, Human
guaggguuauaauaau

SEQ ID NO: 3218995 - RNA, 17 nt, Human
guagggugggccuucag

SEQ ID NO: 3218996 - RNA, 22 nt, Human
guagggugggccuucagggagu

SEQ ID NO: 3218997 - RNA, 14 nt, Human
guagggugggccuu

SEQ ID NO: 3218998 - RNA, 15 nt, Human
guagggguggcccga

SEQ ID NO: 3218999 - RNA, 18 nt, Human
guagggguaccacugaau

SEQ ID NO: 3219000 - RNA, 13 nt, Human
guaggggaagaau

SEQ ID NO: 3219001 - RNA, 18 nt, Human
guaggggcuuagaggcau

SEQ ID NO: 3219002 - RNA, 14 nt, Human
guagucggcacagc

SEQ ID NO: 3219003 - RNA, 19 nt, Human
guagugucuggaucaguaa

SEQ ID NO: 3219004 - RNA, 19 nt, Human
guagugaagacuccagaaa

SEQ ID NO: 3219005 - RNA, 21 nt, Human
guaguguuauugccaggaaag

SEQ ID NO: 3219006 - RNA, 22 nt, Human
guauaauucacccaccagacuu

SEQ ID NO: 3219007 - RNA, 17 nt, Human
guaguguucagaaaaaa

SEQ ID NO: 3219008 - RNA, 12 nt, Human
guauaauugugu

SEQ ID NO: 3219009 - RNA, 21 nt, Human
guauaauugugugauauuuca

SEQ ID NO: 3219010 - RNA, 14 nt, Human
guauaauuguguga

SEQ ID NO: 3219011 - RNA, 23 nt, Human
guauaauugugugauauuucaga

SEQ ID NO: 3219012 - RNA, 14 nt, Human
guauacaaguacug

SEQ ID NO: 3219013 - RNA, 17 nt, Human
guagcaaaugagacagc

SEQ ID NO: 3219014 - RNA, 23 nt, Human
guagcaaacccugucaaacauua

SEQ ID NO: 3219015 - RNA, 20 nt, Human
guagcacaggcugagugcag

SEQ ID NO: 3219016 - RNA, 14 nt, Human
guagcacaggcuga

SEQ ID NO: 3219017 - RNA, 12 nt, Human
guagcacaggcu

SEQ ID NO: 3219018 - RNA, 15 nt, Human
guagcagaguuaaau

SEQ ID NO: 3219019 - RNA, 17 nt, Human
guagcagaguuaaaucu

SEQ ID NO: 3219020 - RNA, 22 nt, Human
guagauuccauuuacugcauuc

SEQ ID NO: 3219021 - RNA, 16 nt, Human
guagauuuauuucauc

SEQ ID NO: 3219022 - RNA, 12 nt, Human
guagauuuauuu

SEQ ID NO: 3219023 - RNA, 18 nt, Human
guagcaaacccugucaaa

SEQ ID NO: 3219024 - RNA, 21 nt, Human
guagcaaacccugucaaacau

SEQ ID NO: 3219025 - RNA, 20 nt, Human
guagcaaacccugucaaaca

SEQ ID NO: 3219026 - RNA, 12 nt, Human
guagauuugauu

SEQ ID NO: 3219027 - RNA, 16 nt, Human
guagauuugauuuuuu

SEQ ID NO: 3219028 - RNA, 21 nt, Human
guagauuuauuucaucauauu

SEQ ID NO: 3219029 - RNA, 19 nt, Human
guagauuuauuucaucaua

SEQ ID NO: 3219030 - RNA, 18 nt, Human
gcuauaggugcuacaaaa

SEQ ID NO: 3219031 - RNA, 15 nt, Human
guagagugugccuga

SEQ ID NO: 3219032 - RNA, 15 nt, Human
guagauacaaucagc

SEQ ID NO: 3219033 - RNA, 17 nt, Human
guagauacaaucagcug

SEQ ID NO: 3219034 - RNA, 20 nt, Human
guagauacaaucagcugcuu

SEQ ID NO: 3219035 - RNA, 21 nt, Human
guagaucuauauuagaucaaa

SEQ ID NO: 3219036 - RNA, 16 nt, Human
guagauaguaugcacu

SEQ ID NO: 3219037 - RNA, 23 nt, Human
guagauaguaugcacuauauaca

SEQ ID NO: 3219038 - RNA, 21 nt, Human
guagcauucuuuggaguuaaa

SEQ ID NO: 3219039 - RNA, 21 nt, Human
guagccaccugaguuccugag

SEQ ID NO: 3219040 - RNA, 15 nt, Human
guagcccccucuucc

SEQ ID NO: 3219041 - RNA, 19 nt, Human
guagcccccucuucccugg

SEQ ID NO: 3219042 - RNA, 22 nt, Human
guagggcgggaggauguucugg

SEQ ID NO: 3219043 - RNA, 21 nt, Human
guagggcgggaggauguucug

SEQ ID NO: 3219044 - RNA, 23 nt, Human
guagggcgggaggauguucuggg

SEQ ID NO: 3219045 - RNA, 18 nt, Human
guagggcucugacaaagc

SEQ ID NO: 3219046 - RNA, 16 nt, Human
guagggcgggaggaug

SEQ ID NO: 3219047 - RNA, 11 nt, Human
guaugaaauau

SEQ ID NO: 3219048 - RNA, 16 nt, Human
guaugaaauauaugug

SEQ ID NO: 3219049 - RNA, 17 nt, Human
guaugaaauauauguga

SEQ ID NO: 3219050 - RNA, 20 nt, Human
guaugaaauauaugugaaag

SEQ ID NO: 3219051 - RNA, 19 nt, Human
guaugaauaaagacaccua

SEQ ID NO: 3219052 - RNA, 18 nt, Human
guaugaauaaagacaccu

SEQ ID NO: 3219053 - RNA, 15 nt, Human
guaugaaucuauuug

SEQ ID NO: 3219054 - RNA, 12 nt, Human
guaucugagcag

SEQ ID NO: 3219055 - RNA, 12 nt, Human
guaucuggugac

SEQ ID NO: 3219056 - RNA, 19 nt, Human
guaucuggugacuuuccuc

SEQ ID NO: 3219057 - RNA, 21 nt, Human
guaucuggauucaaauuuauu

SEQ ID NO: 3219058 - RNA, 15 nt, Human
guaucugugaacuga

SEQ ID NO: 3219059 - RNA, 17 nt, Human
guaucuuacuuuccucu

SEQ ID NO: 3219060 - RNA, 12 nt, Human
guaucugugaac

SEQ ID NO: 3219061 - RNA, 23 nt, Human
guaugaaagauggcugugccucu

SEQ ID NO: 3219062 - RNA, 22 nt, Human
guaugaaagauggcugugccuc

SEQ ID NO: 3219063 - RNA, 13 nt, Human
guaugaaaacaug

SEQ ID NO: 3219064 - RNA, 17 nt, Human
guaugaaaacauggaac

SEQ ID NO: 3219065 - RNA, 20 nt, Human
guaugaaaacauggaacagu

SEQ ID NO: 3219066 - RNA, 13 nt, Human
guauguguuuaga

SEQ ID NO: 3219067 - RNA, 21 nt, Human
guaugaucacggcucacugca

SEQ ID NO: 3219068 - RNA, 20 nt, Human
guaugaucacggcucacugc

SEQ ID NO: 3219069 - RNA, 24 nt, Human
guaugauagguuauuuugauguaa

SEQ ID NO: 3219070 - RNA, 14 nt, Human
guauguuuuucagu

SEQ ID NO: 3219071 - RNA, 13 nt, Human
guauguuuuucag

SEQ ID NO: 3219072 - RNA, 17 nt, Human
guauguugaagccuuug

SEQ ID NO: 3219073 - RNA, 18 nt, Human
guauguguuuagaauuga

SEQ ID NO: 3219074 - RNA, 22 nt, Human
guauguguuuagaauugaaggu

SEQ ID NO: 3219075 - RNA, 14 nt, Human
guauguuauacaac

SEQ ID NO: 3219076 - RNA, 21 nt, Human
guauguuuuucaguucaaagu

SEQ ID NO: 3219077 - RNA, 20 nt, Human
guauguuuuucaguucaaag

SEQ ID NO: 3219078 - RNA, 18 nt, Human
guauguuuuucaguucaa

SEQ ID NO: 3219079 - RNA, 13 nt, Human
guauuaaaugcca

SEQ ID NO: 3219080 - RNA, 22 nt, Human
guauuaaauuacauuuguaauu

SEQ ID NO: 3219081 - RNA, 21 nt, Human
guauuaaauuacauuuguaau

SEQ ID NO: 3219082 - RNA, 18 nt, Human
guauuaaauuacauuugu

SEQ ID NO: 3219083 - RNA, 15 nt, Human
guauuaaauuacauu

SEQ ID NO: 3219084 - RNA, 23 nt, Human
guauagaagucuucaugaaaugc

SEQ ID NO: 3219085 - RNA, 21 nt, Human
guauagaagucuucaugaaau

SEQ ID NO: 3219086 - RNA, 21 nt, Human
guauacuuccuuacuuuuaag

SEQ ID NO: 3219087 - RNA, 18 nt, Human
guauagaagucuucauga

SEQ ID NO: 3219088 - RNA, 17 nt, Human
guauagaagucuucaug

SEQ ID NO: 3219089 - RNA, 21 nt, Human
guauagacaggagaagaaaga

SEQ ID NO: 3219090 - RNA, 16 nt, Human
guauagacaggagaag

SEQ ID NO: 3219091 - RNA, 20 nt, Human
guauagauauaaugaacaaa

SEQ ID NO: 3219092 - RNA, 14 nt, Human
guauauaaaaaugg

SEQ ID NO: 3219093 - RNA, 18 nt, Human
guauaguuauguaaauaa

SEQ ID NO: 3219094 - RNA, 14 nt, Human
guauaguuauguaa

SEQ ID NO: 3219095 - RNA, 15 nt, Human
guauaguuauguaaa

SEQ ID NO: 3219096 - RNA, 13 nt, Human
guauaguauuuga

SEQ ID NO: 3219097 - RNA, 15 nt, Human
guauaguauuugaaa

SEQ ID NO: 3219098 - RNA, 14 nt, Human
guauaguauuugaa

SEQ ID NO: 3219099 - RNA, 21 nt, Human
guauaguauuugaaaacagaa

SEQ ID NO: 3219100 - RNA, 18 nt, Human
guauaguauuugaaaaca

SEQ ID NO: 3219101 - RNA, 17 nt, Human
guauaguauuugaaaac

SEQ ID NO: 3219102 - RNA, 16 nt, Human
guauaguauuugaaaa

SEQ ID NO: 3219103 - RNA, 22 nt, Human
guauaugucaagccauaauugu

SEQ ID NO: 3219104 - RNA, 18 nt, Human
guauauggugguaauaag

SEQ ID NO: 3219105 - RNA, 15 nt, Human
guauauggugguaau

SEQ ID NO: 3219106 - RNA, 17 nt, Human
guauaucauucuaaaga

SEQ ID NO: 3219107 - RNA, 13 nt, Human
guauaucauucua

SEQ ID NO: 3219108 - RNA, 20 nt, Human
guauauccuuuucuguguuu

SEQ ID NO: 3219109 - RNA, 12 nt, Human
guauaucguuau

SEQ ID NO: 3219110 - RNA, 18 nt, Human
guauaucguuaucacugu

SEQ ID NO: 3219111 - RNA, 14 nt, Human
guauauccuuuucu

SEQ ID NO: 3219112 - RNA, 19 nt, Human
guauaucauucuaaagaua

SEQ ID NO: 3219113 - RNA, 11 nt, Human
guauauuaaac

SEQ ID NO: 3219114 - RNA, 16 nt, Human
guauauguugggugca

SEQ ID NO: 3219115 - RNA, 21 nt, Human
guauaugucucaggucccugc

SEQ ID NO: 3219116 - RNA, 15 nt, Human
guauaugucucaggu

SEQ ID NO: 3219117 - RNA, 13 nt, Human
guauaugucucag

SEQ ID NO: 3219118 - RNA, 18 nt, Human
guaucuaagaauaauaaa

SEQ ID NO: 3219119 - RNA, 21 nt, Human
guaucuaagaauaauaaaauc

SEQ ID NO: 3219120 - RNA, 17 nt, Human
guaucguauucaccuuc

SEQ ID NO: 3219121 - RNA, 22 nt, Human
guauccuuaucuaguguuugau

SEQ ID NO: 3219122 - RNA, 22 nt, Human
gucagcuguuucuagaguuccu

SEQ ID NO: 3219123 - RNA, 17 nt, Human
gucauuaaauuacuaua

SEQ ID NO: 3219124 - RNA, 24 nt, Human
gucauuaaauuacuauagcaaagu

SEQ ID NO: 3219125 - RNA, 23 nt, Human
gucagcuccccucggagaagagc

SEQ ID NO: 3219126 - RNA, 22 nt, Human
gucagcuccccucggagaagag

SEQ ID NO: 3219127 - RNA, 21 nt, Human
gucagcuccccucggagaaga

SEQ ID NO: 3219128 - RNA, 21 nt, Human
gucauucgcuacuaugauuua

SEQ ID NO: 3219129 - RNA, 23 nt, Human
gucauuguaauguugugaauaau

SEQ ID NO: 3219130 - RNA, 21 nt, Human
gucauuguaauguugugaaua

SEQ ID NO: 3219131 - RNA, 13 nt, Human
gucauuguaaugu

SEQ ID NO: 3219132 - RNA, 12 nt, Human
gucauuguaaug

SEQ ID NO: 3219133 - RNA, 22 nt, Human
gucauugcuucuucugaggccu

SEQ ID NO: 3219134 - RNA, 12 nt, Human
gucauugcuucu

SEQ ID NO: 3219135 - RNA, 16 nt, Human
gucauugcuucuucug

SEQ ID NO: 3219136 - RNA, 15 nt, Human
gucauugcuucuucu

SEQ ID NO: 3219137 - RNA, 14 nt, Human
gucauugcuucuuc

SEQ ID NO: 3219138 - RNA, 13 nt, Human
gucauugcuucuu

SEQ ID NO: 3219139 - RNA, 21 nt, Human
gucccaccuuggcugcaggga

SEQ ID NO: 3219140 - RNA, 23 nt, Human
guccaguaagaucacuguuuaga

SEQ ID NO: 3219141 - RNA, 18 nt, Human
guccaguaagaucacugu

SEQ ID NO: 3219142 - RNA, 19 nt, Human
guccaguaagaucacuguu

SEQ ID NO: 3219143 - RNA, 20 nt, Human
guccaguaagaucacuguuu

SEQ ID NO: 3219144 - RNA, 21 nt, Human
guccaguaagaucacuguuua

SEQ ID NO: 3219145 - RNA, 14 nt, Human
guccaguaagauca

SEQ ID NO: 3219146 - RNA, 22 nt, Human
guccagguggagguggcauccc

SEQ ID NO: 3219147 - RNA, 12 nt, Human
guccacccagga

SEQ ID NO: 3219148 - RNA, 23 nt, Human
guccacccaggagccccgaggcc

SEQ ID NO: 3219149 - RNA, 11 nt, Human
guccacccgcc

SEQ ID NO: 3219150 - RNA, 18 nt, Human
guccacccgccccugccc

SEQ ID NO: 3219151 - RNA, 21 nt, Human
guccacugggguggccugacu

SEQ ID NO: 3219152 - RNA, 16 nt, Human
guccagagcugcuucc

SEQ ID NO: 3219153 - RNA, 13 nt, Human
guccagagcugcu

SEQ ID NO: 3219154 - RNA, 17 nt, Human
guccagagcugcuuccc

SEQ ID NO: 3219155 - RNA, 23 nt, Human
guccacgugcguguuuucugacu

SEQ ID NO: 3219156 - RNA, 16 nt, Human
guccacgugcguguuu

SEQ ID NO: 3219157 - RNA, 13 nt, Human
guccacuggggug

SEQ ID NO: 3219158 - RNA, 20 nt, Human
guccccaccaucugcugucu

SEQ ID NO: 3219159 - RNA, 18 nt, Human
guccccaccaucugcugu

SEQ ID NO: 3219160 - RNA, 17 nt, Human
guccccaccaucugcug

SEQ ID NO: 3219161 - RNA, 22 nt, Human
gucccaugugagcugcugccau

SEQ ID NO: 3219162 - RNA, 21 nt, Human
gucccaugugagcugcugcca

SEQ ID NO: 3219163 - RNA, 17 nt, Human
gucccaugugagcugcu

SEQ ID NO: 3219164 - RNA, 20 nt, Human
gucccaugugagcugcugcc

SEQ ID NO: 3219165 - RNA, 18 nt, Human
gucccaugugagcugcug

SEQ ID NO: 3219166 - RNA, 16 nt, Human
guccccaaugaauaua

SEQ ID NO: 3219167 - RNA, 13 nt, Human
guccccaccaucu

SEQ ID NO: 3219168 - RNA, 16 nt, Human
guccccaccaucugcu

SEQ ID NO: 3219169 - RNA, 15 nt, Human
guccccaccaucugc

SEQ ID NO: 3219170 - RNA, 23 nt, Human
gucccaccuuggcugcagggagu

SEQ ID NO: 3219171 - RNA, 20 nt, Human
gucccaccuuggcugcaggg

SEQ ID NO: 3219172 - RNA, 16 nt, Human
gucccaggcugagccu

SEQ ID NO: 3219173 - RNA, 17 nt, Human
gucccaggcugagccuc

SEQ ID NO: 3219174 - RNA, 15 nt, Human
gucccaggcugagcc

SEQ ID NO: 3219175 - RNA, 18 nt, Human
gucccaggcugagccuca

SEQ ID NO: 3219176 - RNA, 19 nt, Human
gucccaggcugagccucag

SEQ ID NO: 3219177 - RNA, 22 nt, Human
gucccugaggcagguccccaga

SEQ ID NO: 3219178 - RNA, 16 nt, Human
gucccugcacuugcag

SEQ ID NO: 3219179 - RNA, 21 nt, Human
gucccugcacuugcagacucu

SEQ ID NO: 3219180 - RNA, 19 nt, Human
gucccugcacuugcagacu

SEQ ID NO: 3219181 - RNA, 18 nt, Human
gucccugaggcagguccc

SEQ ID NO: 3219182 - RNA, 16 nt, Human
gucccugaagagaagg

SEQ ID NO: 3219183 - RNA, 21 nt, Human
gucccuaccgagucucuucuc

SEQ ID NO: 3219184 - RNA, 23 nt, Human
gucccuaccgagucucuucucca

SEQ ID NO: 3219185 - RNA, 22 nt, Human
gucccuaccgagucucuucucc

SEQ ID NO: 3219186 - RNA, 19 nt, Human
gucagcuccccucggagaa

SEQ ID NO: 3219187 - RNA, 22 nt, Human
gucagaugcugugcaaauguua

SEQ ID NO: 3219188 - RNA, 15 nt, Human
gucagauguuuaaaa

SEQ ID NO: 3219189 - RNA, 17 nt, Human
gucagauguuuaaaaca

SEQ ID NO: 3219190 - RNA, 13 nt, Human
gucagauguuuaa

SEQ ID NO: 3219191 - RNA, 19 nt, Human
gucagauguuuaaaacacc

SEQ ID NO: 3219192 - RNA, 12 nt, Human
gucagauguuug

SEQ ID NO: 3219193 - RNA, 18 nt, Human
gucagauguuuaaaacac

SEQ ID NO: 3219194 - RNA, 16 nt, Human
gucagagccugcaguu

SEQ ID NO: 3219195 - RNA, 15 nt, Human
gucagagccugcagu

SEQ ID NO: 3219196 - RNA, 14 nt, Human
gucagagccugcag

SEQ ID NO: 3219197 - RNA, 12 nt, Human
gucacucuggca

SEQ ID NO: 3219198 - RNA, 13 nt, Human
gucacucuggcag

SEQ ID NO: 3219199 - RNA, 14 nt, Human
gucacucuggcagc

SEQ ID NO: 3219200 - RNA, 16 nt, Human
gucacucuggcagcuc

SEQ ID NO: 3219201 - RNA, 17 nt, Human
gucacucuggcagcuca

SEQ ID NO: 3219202 - RNA, 19 nt, Human
gucacucuggcagcucaga

SEQ ID NO: 3219203 - RNA, 17 nt, Human
gucaccccggccaccug

SEQ ID NO: 3219204 - RNA, 18 nt, Human
gucaccccggccaccugc

SEQ ID NO: 3219205 - RNA, 22 nt, Human
gucaccccggccaccugcggug

SEQ ID NO: 3219206 - RNA, 14 nt, Human
gucacuaccuggcu

SEQ ID NO: 3219207 - RNA, 17 nt, Human
gucacuaccuggcugcg

SEQ ID NO: 3219208 - RNA, 16 nt, Human
gucacuaccuggcugc

SEQ ID NO: 3219209 - RNA, 19 nt, Human
guauuuuguuuuugucuua

SEQ ID NO: 3219210 - RNA, 21 nt, Human
gucaauaauuauuugucucag

SEQ ID NO: 3219211 - RNA, 15 nt, Human
gucaagugaaaaagg

SEQ ID NO: 3219212 - RNA, 15 nt, Human
gucaaugcagccccc

SEQ ID NO: 3219213 - RNA, 18 nt, Human
gucaaugaacaagcauuc

SEQ ID NO: 3219214 - RNA, 15 nt, Human
gucaccccggccacc

SEQ ID NO: 3219215 - RNA, 15 nt, Human
guauuaauucucuuu

SEQ ID NO: 3219216 - RNA, 23 nt, Human
guauuacacaagaccagugcuua

SEQ ID NO: 3219217 - RNA, 13 nt, Human
guauuuuaaucac

SEQ ID NO: 3219218 - RNA, 19 nt, Human
guauuaagcccacaguaua

SEQ ID NO: 3219219 - RNA, 21 nt, Human
guauuaagcccacaguauauu

SEQ ID NO: 3219220 - RNA, 23 nt, Human
guauuaagauuauaauuguugca

SEQ ID NO: 3219221 - RNA, 16 nt, Human
guauuaagauuauaau

SEQ ID NO: 3219222 - RNA, 12 nt, Human
guauuaauaaaa

SEQ ID NO: 3219223 - RNA, 13 nt, Human
guauuaauaaaaa

SEQ ID NO: 3219224 - RNA, 14 nt, Human
guauuaauaaaaag

SEQ ID NO: 3219225 - RNA, 15 nt, Human
guauuaauaaaaaga

SEQ ID NO: 3219226 - RNA, 18 nt, Human
guauuaauaaaaagacaa

SEQ ID NO: 3219227 - RNA, 14 nt, Human
guauuuuacuaaua

SEQ ID NO: 3219228 - RNA, 23 nt, Human
guauuuuaguggacccugaaaug

SEQ ID NO: 3219229 - RNA, 12 nt, Human
guauuuucaguc

SEQ ID NO: 3219230 - RNA, 21 nt, Human
guauuuugugaguuuguuucu

SEQ ID NO: 3219231 - RNA, 22 nt, Human
uuugaauguaugcuucauacag

SEQ ID NO: 3219232 - RNA, 17 nt, Human
uuugaauguaugcuuca

SEQ ID NO: 3219233 - RNA, 13 nt, Human
uuugaaucuuuaa

SEQ ID NO: 3219234 - RNA, 19 nt, Human
uuugaaucuuuaauuaaaa

SEQ ID NO: 3219235 - RNA, 15 nt, Human
uuugaaucuuuaauu

SEQ ID NO: 3219236 - RNA, 11 nt, Human
uuugcauaucc

SEQ ID NO: 3219237 - RNA, 14 nt, Human
uuuggaauuuugug

SEQ ID NO: 3219238 - RNA, 21 nt, Human
uuuggaaaacgauuuaauuua

SEQ ID NO: 3219239 - RNA, 19 nt, Human
uuugcuuuuuaguuuugcu

SEQ ID NO: 3219240 - RNA, 12 nt, Human
uuuggugcuuuu

SEQ ID NO: 3219241 - RNA, 20 nt, Human
uuuggugcuuuuuauaaaaa

SEQ ID NO: 3219242 - RNA, 23 nt, Human
uuugguuuuaaaauacuguagau

SEQ ID NO: 3219243 - RNA, 22 nt, Human
uuugguuuuaaaauacuguaga

SEQ ID NO: 3219244 - RNA, 18 nt, Human
uuugguuuuaaaauacug

SEQ ID NO: 3219245 - RNA, 16 nt, Human
uuugguuugguuuuua

SEQ ID NO: 3219246 - RNA, 12 nt, Human
uuugguuuuguu

SEQ ID NO: 3219247 - RNA, 20 nt, Human
uuuggagucagacagaugug

SEQ ID NO: 3219248 - RNA, 22 nt, Human
uuuggaggcuggaguaaucaga

SEQ ID NO: 3219249 - RNA, 20 nt, Human
uuuggagcacaaaauucaaa

SEQ ID NO: 3219250 - RNA, 21 nt, Human
uuuggaauuuugugcccccau

SEQ ID NO: 3219251 - RNA, 22 nt, Human
uuuggagagaaauauuuuaauu

SEQ ID NO: 3219252 - RNA, 13 nt, Human
uuuggaauuagaa

SEQ ID NO: 3219253 - RNA, 19 nt, Human
uuuggagagaaauauuuua

SEQ ID NO: 3219254 - RNA, 17 nt, Human
uuuggucuacacugugc

SEQ ID NO: 3219255 - RNA, 14 nt, Human
uuuggauuaaauua

SEQ ID NO: 3219256 - RNA, 21 nt, Human
uuuggauaucuguuagaugcu

SEQ ID NO: 3219257 - RNA, 15 nt, Human
uuuggugcaaaguau

SEQ ID NO: 3219258 - RNA, 17 nt, Human
uuuuaaagaaugcucuu

SEQ ID NO: 3219259 - RNA, 20 nt, Human
uuuuaaaagaugcaauguag

SEQ ID NO: 3219260 - RNA, 23 nt, Human
uuuuaaaagccuuggccucagag

SEQ ID NO: 3219261 - RNA, 18 nt, Human
uuuuaaaagccuuggccu

SEQ ID NO: 3219262 - RNA, 13 nt, Human
uuuuaaaagccuu

SEQ ID NO: 3219263 - RNA, 15 nt, Human
uuuguugaacuguua

SEQ ID NO: 3219264 - RNA, 16 nt, Human
uuuguugaaagaaagu

SEQ ID NO: 3219265 - RNA, 21 nt, Human
uuuguucuggcucuuccaggc

SEQ ID NO: 3219266 - RNA, 23 nt, Human
uuuguaugcaagcaguuucaaua

SEQ ID NO: 3219267 - RNA, 23 nt, Human
uuuguaugaaaacauggaacagu

SEQ ID NO: 3219268 - RNA, 19 nt, Human
uuuguaugaaauauaugug

SEQ ID NO: 3219269 - RNA, 20 nt, Human
uuuguaugaaauauauguga

SEQ ID NO: 3219270 - RNA, 15 nt, Human
uuuguaugaaaacau

SEQ ID NO: 3219271 - RNA, 21 nt, Human
uuuguaugcaagcaguuucaa

SEQ ID NO: 3219272 - RNA, 12 nt, Human
uuuguaugcaag

SEQ ID NO: 3219273 - RNA, 14 nt, Human
uuuguaaaaaugua

SEQ ID NO: 3219274 - RNA, 14 nt, Human
uuuguauaguuaug

SEQ ID NO: 3219275 - RNA, 16 nt, Human
uuuguauaguuaugua

SEQ ID NO: 3219276 - RNA, 17 nt, Human
uuuguauaguuauguaa

SEQ ID NO: 3219277 - RNA, 19 nt, Human
uuuguauaguuauguaaau

SEQ ID NO: 3219278 - RNA, 21 nt, Human
uuuguauaguuauguaaauaa

SEQ ID NO: 3219279 - RNA, 22 nt, Human
uuuguauaguuauguaaauaau

SEQ ID NO: 3219280 - RNA, 13 nt, Human
uuuguaugaaaac

SEQ ID NO: 3219281 - RNA, 18 nt, Human
uuuguauauugguuuuau

SEQ ID NO: 3219282 - RNA, 20 nt, Human
uuuguauauugguuuuauga

SEQ ID NO: 3219283 - RNA, 16 nt, Human
uuuuaacaagaagcaa

SEQ ID NO: 3219284 - RNA, 19 nt, Human
uuuuaauguaauugauugu

SEQ ID NO: 3219285 - RNA, 21 nt, Human
uuuuaaugcuaaucuugugaa

SEQ ID NO: 3219286 - RNA, 17 nt, Human
uuuuaaugauuguuuaa

SEQ ID NO: 3219287 - RNA, 16 nt, Human
uuuuaaugauuguuua

SEQ ID NO: 3219288 - RNA, 18 nt, Human
uuuuaaucuacugcauuu

SEQ ID NO: 3219289 - RNA, 21 nt, Human
uuuuaaucucuaacaguggac

SEQ ID NO: 3219290 - RNA, 19 nt, Human
uuuuaaauuauguuuuacu

SEQ ID NO: 3219291 - RNA, 20 nt, Human
uuuuaaaugugugagugcau

SEQ ID NO: 3219292 - RNA, 20 nt, Human
uuuuaaaugcaguuacaaau

SEQ ID NO: 3219293 - RNA, 22 nt, Human
uuuuaaaugugugagugcaugu

SEQ ID NO: 3219294 - RNA, 17 nt, Human
uuuuaaauuaauaucuu

SEQ ID NO: 3219295 - RNA, 18 nt, Human
uuuuaaauuagaaaauau

SEQ ID NO: 3219296 - RNA, 19 nt, Human
uuuuaaauuagaaaauauu

SEQ ID NO: 3219297 - RNA, 14 nt, Human
uuuuaaaugcaguu

SEQ ID NO: 3219298 - RNA, 15 nt, Human
uuuuaaagacuugca

SEQ ID NO: 3219299 - RNA, 22 nt, Human
uuugaagaugccgcauuuggau

SEQ ID NO: 3219300 - RNA, 18 nt, Human
uuugaagagugaaauacc

SEQ ID NO: 3219301 - RNA, 14 nt, Human
uuugaacucuucaa

SEQ ID NO: 3219302 - RNA, 23 nt, Human
uuucuucuucaaaccuuugugug

SEQ ID NO: 3219303 - RNA, 21 nt, Human
uuucuucuuccacacaugcaa

SEQ ID NO: 3219304 - RNA, 14 nt, Human
uuucuugauaauuu

SEQ ID NO: 3219305 - RNA, 21 nt, Human
uuucuugauaauuuuccuuua

SEQ ID NO: 3219306 - RNA, 19 nt, Human
uuucuugauaauuuuccuu

SEQ ID NO: 3219307 - RNA, 17 nt, Human
uuugaagacuucaaaau

SEQ ID NO: 3219308 - RNA, 23 nt, Human
uuugaagacuucaaaauauugag

SEQ ID NO: 3219309 - RNA, 17 nt, Human
uuugaacucuucucauu

SEQ ID NO: 3219310 - RNA, 22 nt, Human
uuugaacucuucucauuacuug

SEQ ID NO: 3219311 - RNA, 17 nt, Human
uuucuuauuucauuucu

SEQ ID NO: 3219312 - RNA, 11 nt, Human
uuucuucaaaa

SEQ ID NO: 3219313 - RNA, 20 nt, Human
uuucuguuucuaauuugcug

SEQ ID NO: 3219314 - RNA, 22 nt, Human
uuucuguuucuaauuugcugcu

SEQ ID NO: 3219315 - RNA, 12 nt, Human
uuucuuaaaaag

SEQ ID NO: 3219316 - RNA, 12 nt, Human
uuucuucucccu

SEQ ID NO: 3219317 - RNA, 16 nt, Human
uuucuuccucugcuga

SEQ ID NO: 3219318 - RNA, 14 nt, Human
uuucuuccucugcu

SEQ ID NO: 3219319 - RNA, 13 nt, Human
uuucuucucccuc

SEQ ID NO: 3219320 - RNA, 13 nt, Human
uuucuuccucugc

SEQ ID NO: 3219321 - RNA, 11 nt, Human
uuucuuccucu

SEQ ID NO: 3219322 - RNA, 22 nt, Human
uuucuucaaaauauaaaaugcc

SEQ ID NO: 3219323 - RNA, 12 nt, Human
uuucuucaaaau

SEQ ID NO: 3219324 - RNA, 17 nt, Human
uuucuagaaagaauaaa

SEQ ID NO: 3219325 - RNA, 18 nt, Human
uuucuagacacuuuuucu

SEQ ID NO: 3219326 - RNA, 21 nt, Human
uuucuagacuauaaauguugc

SEQ ID NO: 3219327 - RNA, 23 nt, Human
uuucuacucgaguuacagacaaa

SEQ ID NO: 3219328 - RNA, 13 nt, Human
uuucugagaaaga

SEQ ID NO: 3219329 - RNA, 19 nt, Human
uuucugaagguagcauucu

SEQ ID NO: 3219330 - RNA, 22 nt, Human
uuuccucaaaacuucagacaua

SEQ ID NO: 3219331 - RNA, 16 nt, Human
uuuccugaggcugggc

SEQ ID NO: 3219332 - RNA, 12 nt, Human
uuuccugcccug

SEQ ID NO: 3219333 - RNA, 13 nt, Human
uuuccugcccugg

SEQ ID NO: 3219334 - RNA, 20 nt, Human
uuuccugauagcauaugaca

SEQ ID NO: 3219335 - RNA, 20 nt, Human
uuacauuuuauuaagcuuuu

SEQ ID NO: 3219336 - RNA, 19 nt, Human
uuaccaauaggcaaauuaa

SEQ ID NO: 3219337 - RNA, 20 nt, Human
uuaccaauaggcaaauuaau

SEQ ID NO: 3219338 - RNA, 20 nt, Human
uuuucuuuuguuuuuugaag

SEQ ID NO: 3219339 - RNA, 11 nt, Human
uuuucuuuucu

SEQ ID NO: 3219340 - RNA, 21 nt, Human
uuuucuuuuuuaaauuaauau

SEQ ID NO: 3219341 - RNA, 23 nt, Human
uuuucuuuuuuaaauuaauaucu

SEQ ID NO: 3219342 - RNA, 14 nt, Human
uuuugaaucuuuaa

SEQ ID NO: 3219343 - RNA, 16 nt, Human
uuuugaaucuuuaauu

SEQ ID NO: 3219344 - RNA, 16 nt, Human
uuuuggccaugaaagc

SEQ ID NO: 3219345 - RNA, 20 nt, Human
uuuuggauuuggagagaaau

SEQ ID NO: 3219346 - RNA, 22 nt, Human
uuuuggcacuugccauuccaaa

SEQ ID NO: 3219347 - RNA, 16 nt, Human
uuuugacacugaaaua

SEQ ID NO: 3219348 - RNA, 21 nt, Human
uuuugacacugaaauaaccgu

SEQ ID NO: 3219349 - RNA, 15 nt, Human
uuuuggucuguguga

SEQ ID NO: 3219350 - RNA, 18 nt, Human
uuuuggggugugaccuca

SEQ ID NO: 3219351 - RNA, 21 nt, Human
uuuugguccacuuuuccagua

SEQ ID NO: 3219352 - RNA, 20 nt, Human
uuuugguccacuuuuccagu

SEQ ID NO: 3219353 - RNA, 14 nt, Human
uuuuggcugcugaa

SEQ ID NO: 3219354 - RNA, 17 nt, Human
uuuuggcgaaucucaaa

SEQ ID NO: 3219355 - RNA, 21 nt, Human
uuuugggaaaugcugauuuaa

SEQ ID NO: 3219356 - RNA, 18 nt, Human
uuuugggaaguuaaaggg

SEQ ID NO: 3219357 - RNA, 19 nt, Human
uuuuccuuacauaaacauc

SEQ ID NO: 3219358 - RNA, 12 nt, Human
uuuucuaaagua

SEQ ID NO: 3219359 - RNA, 15 nt, Human
uuuucuuuuaauuuu

SEQ ID NO: 3219360 - RNA, 20 nt, Human
uuuucuuugccaucucugcu

SEQ ID NO: 3219361 - RNA, 12 nt, Human
uuuucuuucagu

SEQ ID NO: 3219362 - RNA, 22 nt, Human
uuuuaauuguauuuuuguuguu

SEQ ID NO: 3219363 - RNA, 12 nt, Human
uuuuccuuacau

SEQ ID NO: 3219364 - RNA, 15 nt, Human
uuuuccuuacauaaa

SEQ ID NO: 3219365 - RNA, 14 nt, Human
uuuuccuuacauaa

SEQ ID NO: 3219366 - RNA, 13 nt, Human
uuuuccuguucua

SEQ ID NO: 3219367 - RNA, 20 nt, Human
uuuuccugggacaucuucug

SEQ ID NO: 3219368 - RNA, 19 nt, Human
uuuuaauuaacuuuggauu

SEQ ID NO: 3219369 - RNA, 14 nt, Human
uuuuaauugaaaag

SEQ ID NO: 3219370 - RNA, 19 nt, Human
uuuuaauugaaaagaagua

SEQ ID NO: 3219371 - RNA, 13 nt, Human
uuuuaauuguauu

SEQ ID NO: 3219372 - RNA, 14 nt, Human
uuuuaauuguauuu

SEQ ID NO: 3219373 - RNA, 12 nt, Human
uuuuaauuguau

SEQ ID NO: 3219374 - RNA, 24 nt, Human
uuuuaauugaucaguuuucaugug

SEQ ID NO: 3219375 - RNA, 19 nt, Human
uuuuguagagccagggucu

SEQ ID NO: 3219376 - RNA, 13 nt, Human
uuuuguaugcaag

SEQ ID NO: 3219377 - RNA, 23 nt, Human
uuuuguaugcaagcaguuucaau

SEQ ID NO: 3219378 - RNA, 23 nt, Human
uuuuguaugaaauauaugugaaa

SEQ ID NO: 3219379 - RNA, 14 nt, Human
uuuuguauauuggu

SEQ ID NO: 3219380 - RNA, 15 nt, Human
uuuuguaaacuuuga

SEQ ID NO: 3219381 - RNA, 14 nt, Human
uuuuguaaacuuug

SEQ ID NO: 3219382 - RNA, 16 nt, Human
uuuuguaaagaaaaau

SEQ ID NO: 3219383 - RNA, 11 nt, Human
uuuuguaaaga

SEQ ID NO: 3219384 - RNA, 19 nt, Human
uuuuguaaacuuugaaaua

SEQ ID NO: 3219385 - RNA, 17 nt, Human
uuuuguaaacuuugaaa

SEQ ID NO: 3219386 - RNA, 14 nt, Human
uuuuguaaagauuu

SEQ ID NO: 3219387 - RNA, 13 nt, Human
uuuuguaaagauu

SEQ ID NO: 3219388 - RNA, 18 nt, Human
uuuuguaaagaaaaauau

SEQ ID NO: 3219389 - RNA, 17 nt, Human
uuuuguaaagaaaaaua

SEQ ID NO: 3219390 - RNA, 20 nt, Human
uuuuguaaagauuucuguuc

SEQ ID NO: 3219391 - RNA, 16 nt, Human
uuuuguaaagauuucu

SEQ ID NO: 3219392 - RNA, 19 nt, Human
uuuuguaauaauaaagaau

SEQ ID NO: 3219393 - RNA, 17 nt, Human
uuuuguaauaauaaaga

SEQ ID NO: 3219394 - RNA, 15 nt, Human
uuuugguugaauaaa

SEQ ID NO: 3219395 - RNA, 22 nt, Human
uuuugguucauuuucagauuca

SEQ ID NO: 3219396 - RNA, 20 nt, Human
uuuugguugaauaaacuaga

SEQ ID NO: 3219397 - RNA, 16 nt, Human
uuuuguaaaauguauu

SEQ ID NO: 3219398 - RNA, 18 nt, Human
uuuuguaaaauguauuau

SEQ ID NO: 3219399 - RNA, 16 nt, Human
uuuuuaaagcuuuuga

SEQ ID NO: 3219400 - RNA, 19 nt, Human
uuuuuaaaaucuuauuaaa

SEQ ID NO: 3219401 - RNA, 16 nt, Human
uuuuuaaacaauaaag

SEQ ID NO: 3219402 - RNA, 12 nt, Human
uuuuuaaaaucu

SEQ ID NO: 3219403 - RNA, 14 nt, Human
uuuuuaaaaucuua

SEQ ID NO: 3219404 - RNA, 13 nt, Human
uuuuuaaaaucuu

SEQ ID NO: 3219405 - RNA, 13 nt, Human
uuuuuaaaaaacu

SEQ ID NO: 3219406 - RNA, 14 nt, Human
uuuuuaaaaaacuu

SEQ ID NO: 3219407 - RNA, 15 nt, Human
uuuuuaaaaauaaag

SEQ ID NO: 3219408 - RNA, 16 nt, Human
uuuugucauauaagau

SEQ ID NO: 3219409 - RNA, 22 nt, Human
uuuuguauucaauuaaagaaau

SEQ ID NO: 3219410 - RNA, 20 nt, Human
uuuuugaaaugcugaaaauu

SEQ ID NO: 3219411 - RNA, 17 nt, Human
uuuuugaaaugcugaaa

SEQ ID NO: 3219412 - RNA, 23 nt, Human
uuuuugaaaucaguaaacacugu

SEQ ID NO: 3219413 - RNA, 12 nt, Human
uuuuugaaaacc

SEQ ID NO: 3219414 - RNA, 14 nt, Human
uuuuuuguaugaaa

SEQ ID NO: 3219415 - RNA, 13 nt, Human
uuuuuuguaugaa

SEQ ID NO: 3219416 - RNA, 19 nt, Human
uuuuugaacucuucucauu

SEQ ID NO: 3219417 - RNA, 20 nt, Human
uuuuugaacucuucucauua

SEQ ID NO: 3219418 - RNA, 17 nt, Human
uuuuuugagagagaguc

SEQ ID NO: 3219419 - RNA, 13 nt, Human
uuuuuugaagugu

SEQ ID NO: 3219420 - RNA, 15 nt, Human
uuuuucuauauuauu

SEQ ID NO: 3219421 - RNA, 11 nt, Human
uuuuuccuuuu

SEQ ID NO: 3219422 - RNA, 19 nt, Human
uuuuuccuucagugccuua

SEQ ID NO: 3219423 - RNA, 20 nt, Human
uuuuuccuuacauaaacauc

SEQ ID NO: 3219424 - RNA, 11 nt, Human
uuuuuccuuca

SEQ ID NO: 3219425 - RNA, 19 nt, Human
uuuuuccuuacauaaacau

SEQ ID NO: 3219426 - RNA, 15 nt, Human
uuuuuccuuacauaa

SEQ ID NO: 3219427 - RNA, 22 nt, Human
uuuuuccuaugaccauaaaauu

SEQ ID NO: 3219428 - RNA, 19 nt, Human
uuuuuccugugaacacaua

SEQ ID NO: 3219429 - RNA, 15 nt, Human
uuuuuaagugaaauu

SEQ ID NO: 3219430 - RNA, 14 nt, Human
uuuuuaagugaaau

SEQ ID NO: 3219431 - RNA, 20 nt, Human
uuuuuaagugaaaauauagc

SEQ ID NO: 3219432 - RNA, 13 nt, Human
uuuuuaagugaaa

SEQ ID NO: 3219433 - RNA, 23 nt, Human
uuuuuaaauaaaaauuacugugu

SEQ ID NO: 3219434 - RNA, 21 nt, Human
cuaauaaaauuuaaaagucuu

SEQ ID NO: 3219435 - RNA, 16 nt, Human
cuaaggugugcucuga

SEQ ID NO: 3219436 - RNA, 20 nt, Human
cuaauaaaauuuaaaagucu

SEQ ID NO: 3219437 - RNA, 18 nt, Human
cuaauauguaacaagcca

SEQ ID NO: 3219438 - RNA, 19 nt, Human
cuaaucagcauucucacuc

SEQ ID NO: 3219439 - RNA, 17 nt, Human
cuaaucagcauucucac

SEQ ID NO: 3219440 - RNA, 16 nt, Human
cuaauccucuuuuucu

SEQ ID NO: 3219441 - RNA, 14 nt, Human
cuaauguacugcau

SEQ ID NO: 3219442 - RNA, 16 nt, Human
cuaauguacugcauau

SEQ ID NO: 3219443 - RNA, 21 nt, Human
cuaaucuugugaaaauaauug

SEQ ID NO: 3219444 - RNA, 19 nt, Human
cuaaucuugugaaaauaau

SEQ ID NO: 3219445 - RNA, 16 nt, Human
cuaaucuugugaaaau

SEQ ID NO: 3219446 - RNA, 14 nt, Human
cuaaucuugugaaa

SEQ ID NO: 3219447 - RNA, 22 nt, Human
cuaaugaaugcauaaaauguua

SEQ ID NO: 3219448 - RNA, 19 nt, Human
cuaaugaaugcauaaaaug

SEQ ID NO: 3219449 - RNA, 22 nt, Human
cuaauguuggcagaugcagcuc

SEQ ID NO: 3219450 - RNA, 17 nt, Human
cuaauguuuaagcagaa

SEQ ID NO: 3219451 - RNA, 16 nt, Human
cuaauguuuaagcaga

SEQ ID NO: 3219452 - RNA, 13 nt, Human
cuaauuaauauau

SEQ ID NO: 3219453 - RNA, 15 nt, Human
cuaauuaauauauua

SEQ ID NO: 3219454 - RNA, 18 nt, Human
cuaauuaauauauuaaaa

SEQ ID NO: 3219455 - RNA, 21 nt, Human
cuaauuaauauauuaaaauuc

SEQ ID NO: 3219456 - RNA, 23 nt, Human
cuaauuaauauauuaaaauucca

SEQ ID NO: 3219457 - RNA, 22 nt, Human
cuaauguuuaagcagaauugga

SEQ ID NO: 3219458 - RNA, 20 nt, Human
cuaauguuuaagcagaauug

SEQ ID NO: 3219459 - RNA, 18 nt, Human
cuaauguuuaagcagaau

SEQ ID NO: 3219460 - RNA, 15 nt, Human
cuacaagacacagug

SEQ ID NO: 3219461 - RNA, 13 nt, Human
cuaauuaauuuca

SEQ ID NO: 3219462 - RNA, 22 nt, Human
cuacaauauguacauuucuaag

SEQ ID NO: 3219463 - RNA, 21 nt, Human
cuacaauauguacauuucuaa

SEQ ID NO: 3219464 - RNA, 14 nt, Human
cuacaauauguaca

SEQ ID NO: 3219465 - RNA, 24 nt, Human
cuaccccucccggcccugccugcu

SEQ ID NO: 3219466 - RNA, 16 nt, Human
cuaccccuugauuuuc

SEQ ID NO: 3219467 - RNA, 21 nt, Human
cuaccccucccggcccugccu

SEQ ID NO: 3219468 - RNA, 19 nt, Human
cuacccagcgagcccuggu

SEQ ID NO: 3219469 - RNA, 20 nt, Human
cuacccagcgagcccuggug

SEQ ID NO: 3219470 - RNA, 22 nt, Human
cuacccacccuccuuucaccac

SEQ ID NO: 3219471 - RNA, 13 nt, Human
cuacccacccucc

SEQ ID NO: 3219472 - RNA, 17 nt, Human
cuacccacccuccuuuc

SEQ ID NO: 3219473 - RNA, 16 nt, Human
cuacacuccagugaga

SEQ ID NO: 3219474 - RNA, 17 nt, Human
cuacacuccagugagac

SEQ ID NO: 3219475 - RNA, 18 nt, Human
cuacacugugcugagucu

SEQ ID NO: 3219476 - RNA, 15 nt, Human
cuacagaggccaugg

SEQ ID NO: 3219477 - RNA, 18 nt, Human
cuacagaaaagaaacucu

SEQ ID NO: 3219478 - RNA, 13 nt, Human
cuacacaaagcag

SEQ ID NO: 3219479 - RNA, 22 nt, Human
cuacagaaaaacaaugguaaca

SEQ ID NO: 3219480 - RNA, 17 nt, Human
cuacagaaaagaaacuc

SEQ ID NO: 3219481 - RNA, 15 nt, Human
cuaagcaaaauguga

SEQ ID NO: 3219482 - RNA, 18 nt, Human
cuaagcaaaaugugauau

SEQ ID NO: 3219483 - RNA, 12 nt, Human
cuaagauucuuu

SEQ ID NO: 3219484 - RNA, 14 nt, Human
cuaagauucuuuua

SEQ ID NO: 3219485 - RNA, 21 nt, Human
cuaagauucuuuuaaauuaga

SEQ ID NO: 3219486 - RNA, 23 nt, Human
cuaagauucuuuuaaauuagaaa

SEQ ID NO: 3219487 - RNA, 14 nt, Human
cuaagcauuuaaaa

SEQ ID NO: 3219488 - RNA, 17 nt, Human
cuaacauuauuacuuuu

SEQ ID NO: 3219489 - RNA, 17 nt, Human
cuaaccacgcuggaccu

SEQ ID NO: 3219490 - RNA, 16 nt, Human
cuaacaugguuuaaaa

SEQ ID NO: 3219491 - RNA, 14 nt, Human
cuaagcaaaaugug

SEQ ID NO: 3219492 - RNA, 14 nt, Human
cuaaggcugaacuu

SEQ ID NO: 3219493 - RNA, 19 nt, Human
cuaaggauuagucccuggc

SEQ ID NO: 3219494 - RNA, 15 nt, Human
cuaaggugugcucug

SEQ ID NO: 3219495 - RNA, 21 nt, Human
cuaagcuauucaguaauaacu

SEQ ID NO: 3219496 - RNA, 19 nt, Human
cuaagcuauucaguaauaa

SEQ ID NO: 3219497 - RNA, 20 nt, Human
cuacugaggauauggacacu

SEQ ID NO: 3219498 - RNA, 18 nt, Human
cuacugaccagacaagcu

SEQ ID NO: 3219499 - RNA, 14 nt, Human
cuacucuucucucu

SEQ ID NO: 3219500 - RNA, 11 nt, Human
cuacucuucuc

SEQ ID NO: 3219501 - RNA, 18 nt, Human
cuacucuucucucugcuc

SEQ ID NO: 3219502 - RNA, 17 nt, Human
cuacucuucucucugcu

SEQ ID NO: 3219503 - RNA, 19 nt, Human
cuacucuucucucugcucu

SEQ ID NO: 3219504 - RNA, 14 nt, Human
cuacccgggaaggg

SEQ ID NO: 3219505 - RNA, 15 nt, Human
cuacccgggaagggg

SEQ ID NO: 3219506 - RNA, 20 nt, Human
cuacccgggaagggggcugg

SEQ ID NO: 3219507 - RNA, 21 nt, Human
cuacccgggaagggggcuggg

SEQ ID NO: 3219508 - RNA, 21 nt, Human
cuacucugugucagguggggc

SEQ ID NO: 3219509 - RNA, 16 nt, Human
cuacucugugucaggu

SEQ ID NO: 3219510 - RNA, 13 nt, Human
cuacucuguguca

SEQ ID NO: 3219511 - RNA, 15 nt, Human
cuacuugggaggcug

SEQ ID NO: 3219512 - RNA, 18 nt, Human
cuacuugggaggcugaga

SEQ ID NO: 3219513 - RNA, 19 nt, Human
cuacuugggaggcugagau

SEQ ID NO: 3219514 - RNA, 22 nt, Human
cuacuuagcaugucccuaccga

SEQ ID NO: 3219515 - RNA, 22 nt, Human
cuacuguucagcuuuuauuccu

SEQ ID NO: 3219516 - RNA, 14 nt, Human
cuacuuccccuucc

SEQ ID NO: 3219517 - RNA, 15 nt, Human
cuacuuccccuuccu

SEQ ID NO: 3219518 - RNA, 20 nt, Human
cuacuuccccuuccuaauuc

SEQ ID NO: 3219519 - RNA, 20 nt, Human
cuacuuccugugacuucagc

SEQ ID NO: 3219520 - RNA, 13 nt, Human
cuagauuaccaug

SEQ ID NO: 3219521 - RNA, 14 nt, Human
cuagauguaaauuu

SEQ ID NO: 3219522 - RNA, 14 nt, Human
cuagaugauuuuuu

SEQ ID NO: 3219523 - RNA, 17 nt, Human
cuagaugauuuuuugaa

SEQ ID NO: 3219524 - RNA, 20 nt, Human
cuagaugauuuuuugaaagu

SEQ ID NO: 3219525 - RNA, 21 nt, Human
cuagaugauuuuuugaaaguu

SEQ ID NO: 3219526 - RNA, 17 nt, Human
cuagaucuuugugccaa

SEQ ID NO: 3219527 - RNA, 17 nt, Human
cuagcacuuugggaggc

SEQ ID NO: 3219528 - RNA, 14 nt, Human
cuagcacagcuccc

SEQ ID NO: 3219529 - RNA, 17 nt, Human
cuagcacagcucccuuc

SEQ ID NO: 3219530 - RNA, 16 nt, Human
cuagcacagcucccuu

SEQ ID NO: 3219531 - RNA, 14 nt, Human
cuagauuugggaga

SEQ ID NO: 3219532 - RNA, 17 nt, Human
cuagagugaacuugggc

SEQ ID NO: 3219533 - RNA, 21 nt, Human
cuagagugaacuugggccacu

SEQ ID NO: 3219534 - RNA, 21 nt, Human
cuagaguagagguauaauugu

SEQ ID NO: 3219535 - RNA, 20 nt, Human
cuagacgagcaggcuucuuc

SEQ ID NO: 3219536 - RNA, 21 nt, Human
cuagacgagcaggcuucuucc

SEQ ID NO: 3219537 - RNA, 21 nt, Human
cuagacccacuggacucaccu

SEQ ID NO: 3219538 - RNA, 14 nt, Human
cuagacuauaaaug

SEQ ID NO: 3219539 - RNA, 16 nt, Human
cuagacuauaaauguu

SEQ ID NO: 3219540 - RNA, 20 nt, Human
cuaucuuaucucagauauuu

SEQ ID NO: 3219541 - RNA, 14 nt, Human
cuaucuucauguaa

SEQ ID NO: 3219542 - RNA, 16 nt, Human
cuaucuucauguaaau

SEQ ID NO: 3219543 - RNA, 17 nt, Human
cuaucuucauguaaauu

SEQ ID NO: 3219544 - RNA, 20 nt, Human
cuaucuucauguaaauugac

SEQ ID NO: 3219545 - RNA, 21 nt, Human
cuaucuuggagagcuggggac

SEQ ID NO: 3219546 - RNA, 13 nt, Human
cuaucuuggagag

SEQ ID NO: 3219547 - RNA, 21 nt, Human
cuaucuguuuacaguguuccg

SEQ ID NO: 3219548 - RNA, 17 nt, Human
cuaucuguuuacagugu

SEQ ID NO: 3219549 - RNA, 20 nt, Human
cuaucuguuuacaguguucc

SEQ ID NO: 3219550 - RNA, 14 nt, Human
cuauauuuuccuga

SEQ ID NO: 3219551 - RNA, 13 nt, Human
cuauauuuuccug

SEQ ID NO: 3219552 - RNA, 22 nt, Human
cuauauuuuuuguuaaaugauu

SEQ ID NO: 3219553 - RNA, 18 nt, Human
cuauaucuauaaacacug

SEQ ID NO: 3219554 - RNA, 17 nt, Human
cuauaucuauaaacacu

SEQ ID NO: 3219555 - RNA, 19 nt, Human
cuauaucuauaaacacugu

SEQ ID NO: 3219556 - RNA, 22 nt, Human
cuauauuguuuucaguguacau

SEQ ID NO: 3219557 - RNA, 20 nt, Human
cuauauuuuuuguuaaauga

SEQ ID NO: 3219558 - RNA, 23 nt, Human
cuauauuguuuucaguguacaug

SEQ ID NO: 3219559 - RNA, 19 nt, Human
cuaguucaucccuucucuu

SEQ ID NO: 3219560 - RNA, 18 nt, Human
cuaguucaucccuucucu

SEQ ID NO: 3219561 - RNA, 17 nt, Human
cuaguucaucccuucuc

SEQ ID NO: 3219562 - RNA, 16 nt, Human
cuaguucaucccuucu

SEQ ID NO: 3219563 - RNA, 18 nt, Human
cuaguuaaagaaaggaaa

SEQ ID NO: 3219564 - RNA, 15 nt, Human
cuaguguuugauugu

SEQ ID NO: 3219565 - RNA, 18 nt, Human
cuaguguucuuucucuuu

SEQ ID NO: 3219566 - RNA, 12 nt, Human
cuaguuauuuau

SEQ ID NO: 3219567 - RNA, 20 nt, Human
cuaguuauuuauucugggaa

SEQ ID NO: 3219568 - RNA, 19 nt, Human
cuaguuauuuauucuggga

SEQ ID NO: 3219569 - RNA, 16 nt, Human
cuaguuauuuauucug

SEQ ID NO: 3219570 - RNA, 13 nt, Human
cuaguuauuuauu

SEQ ID NO: 3219571 - RNA, 23 nt, Human
cuaguucaucccuucucuuccag

SEQ ID NO: 3219572 - RNA, 20 nt, Human
cuaguucaucccuucucuuc

SEQ ID NO: 3219573 - RNA, 14 nt, Human
cuagcacuuccuug

SEQ ID NO: 3219574 - RNA, 13 nt, Human
cuagcacuuccuu

SEQ ID NO: 3219575 - RNA, 16 nt, Human
cuaggaaauccagggu

SEQ ID NO: 3219576 - RNA, 17 nt, Human
cuaggaaauccagggug

SEQ ID NO: 3219577 - RNA, 21 nt, Human
cuaggaagacuuuggaaagag

SEQ ID NO: 3219578 - RNA, 14 nt, Human
cuaggaacaaaucu

SEQ ID NO: 3219579 - RNA, 16 nt, Human
cuaggaacaaaucuuc

SEQ ID NO: 3219580 - RNA, 13 nt, Human
cuaggaacacucc

SEQ ID NO: 3219581 - RNA, 15 nt, Human
cuaggaacacuccuu

SEQ ID NO: 3219582 - RNA, 22 nt, Human
cuaggaccccuccaugugggcu

SEQ ID NO: 3219583 - RNA, 17 nt, Human
cuaggaauauagauuaa

SEQ ID NO: 3219584 - RNA, 14 nt, Human
cuaggaauauagau

SEQ ID NO: 3219585 - RNA, 22 nt, Human
cuaggaaggcacuucugccuga

SEQ ID NO: 3219586 - RNA, 23 nt, Human
cuaggauguauauuuuauauaaa

SEQ ID NO: 3219587 - RNA, 22 nt, Human
cuaggauucacaccccaccugc

SEQ ID NO: 3219588 - RNA, 21 nt, Human
cuaggauucacaccccaccug

SEQ ID NO: 3219589 - RNA, 20 nt, Human
cuaggauucacaccccaccu

SEQ ID NO: 3219590 - RNA, 19 nt, Human
cuaggauucacaccccacc

SEQ ID NO: 3219591 - RNA, 23 nt, Human
cuaggauucacaccccaccugcg

SEQ ID NO: 3219592 - RNA, 17 nt, Human
cuaggaggucucuaaga

SEQ ID NO: 3219593 - RNA, 23 nt, Human
cuaguaucaaaagaaagaaaauc

SEQ ID NO: 3219594 - RNA, 15 nt, Human
cuaguaucaaaagaa

SEQ ID NO: 3219595 - RNA, 17 nt, Human
cuaguaucaaaagaaag

SEQ ID NO: 3219596 - RNA, 21 nt, Human
cuaggcauuugcugaauacag

SEQ ID NO: 3219597 - RNA, 19 nt, Human
cuaggcagggugucugccc

SEQ ID NO: 3219598 - RNA, 18 nt, Human
cuaggcagggugucugcc

SEQ ID NO: 3219599 - RNA, 17 nt, Human
cuaggcagggugucugc

SEQ ID NO: 3219600 - RNA, 16 nt, Human
cuaggcauuuguaaau

SEQ ID NO: 3219601 - RNA, 21 nt, Human
cuaggcauuuguaaauauuaa

SEQ ID NO: 3219602 - RNA, 22 nt, Human
cuaggcauuuguaaauauuaaa

SEQ ID NO: 3219603 - RNA, 14 nt, Human
cuaguacugugaau

SEQ ID NO: 3219604 - RNA, 21 nt, Human
cuaguagggguaccacugaau

SEQ ID NO: 3219605 - RNA, 20 nt, Human
cuaguagggguaccacugaa

SEQ ID NO: 3219606 - RNA, 21 nt, Human
cuagugugguguuuccuggca

SEQ ID NO: 3219607 - RNA, 22 nt, Human
cuagugugguguuuccuggcac

SEQ ID NO: 3219608 - RNA, 23 nt, Human
cuagugugguguuuccuggcacu

SEQ ID NO: 3219609 - RNA, 19 nt, Human
cuagugugguguuuccugg

SEQ ID NO: 3219610 - RNA, 13 nt, Human
cuagucuuaagaa

SEQ ID NO: 3219611 - RNA, 19 nt, Human
cuagugcagcugaaauuga

SEQ ID NO: 3219612 - RNA, 17 nt, Human
cuagugcagcugaaauu

SEQ ID NO: 3219613 - RNA, 16 nt, Human
cuagugcagcugaaau

SEQ ID NO: 3219614 - RNA, 14 nt, Human
cuagugcagcugaa

SEQ ID NO: 3219615 - RNA, 20 nt, Human
cuagucaacaguacccuggu

SEQ ID NO: 3219616 - RNA, 16 nt, Human
cuaugacuuaacauag

SEQ ID NO: 3219617 - RNA, 13 nt, Human
cuauuuucucuga

SEQ ID NO: 3219618 - RNA, 22 nt, Human
cuauuuucucugauacuuuuuu

SEQ ID NO: 3219619 - RNA, 17 nt, Human
cuauuuucucugauacu

SEQ ID NO: 3219620 - RNA, 16 nt, Human
cuauuuucucugauac

SEQ ID NO: 3219621 - RNA, 19 nt, Human
cucaacucuccuccagagu

SEQ ID NO: 3219622 - RNA, 14 nt, Human
cucaacucugcuga

SEQ ID NO: 3219623 - RNA, 16 nt, Human
cucaacucugcugagg

SEQ ID NO: 3219624 - RNA, 17 nt, Human
cucaacucugcugaggg

SEQ ID NO: 3219625 - RNA, 18 nt, Human
cucaacucugcugagggu

SEQ ID NO: 3219626 - RNA, 19 nt, Human
cucaacucugcugaggguc

SEQ ID NO: 3219627 - RNA, 16 nt, Human
cucaacuaaauccaaa

SEQ ID NO: 3219628 - RNA, 17 nt, Human
cucaagagggcacuggu

SEQ ID NO: 3219629 - RNA, 21 nt, Human
cucaagagggcacugguggcc

SEQ ID NO: 3219630 - RNA, 19 nt, Human
cucaagagggcacuggugg

SEQ ID NO: 3219631 - RNA, 20 nt, Human
cucaacucuccuccagaguc

SEQ ID NO: 3219632 - RNA, 21 nt, Human
cucaacucuccuccagaguca

SEQ ID NO: 3219633 - RNA, 15 nt, Human
cucaacuaaauccaa

SEQ ID NO: 3219634 - RNA, 18 nt, Human
cucaaauuguaauuaaua

SEQ ID NO: 3219635 - RNA, 17 nt, Human
cucaaccuccugggcua

SEQ ID NO: 3219636 - RNA, 13 nt, Human
cucacuaggcuuc

SEQ ID NO: 3219637 - RNA, 16 nt, Human
cucacuaggcuucugg

SEQ ID NO: 3219638 - RNA, 17 nt, Human
cucacuauguugcccag

SEQ ID NO: 3219639 - RNA, 16 nt, Human
cucacuauguugccca

SEQ ID NO: 3219640 - RNA, 20 nt, Human
cucacuaucccggcugcccu

SEQ ID NO: 3219641 - RNA, 21 nt, Human
cucacuaucccggcugcccuu

SEQ ID NO: 3219642 - RNA, 20 nt, Human
cucacuaggcuucugguuga

SEQ ID NO: 3219643 - RNA, 12 nt, Human
cucaccccagcc

SEQ ID NO: 3219644 - RNA, 13 nt, Human
cucaccccagccc

SEQ ID NO: 3219645 - RNA, 19 nt, Human
cucaccagccccagugccc

SEQ ID NO: 3219646 - RNA, 16 nt, Human
cucacauggaaugagg

SEQ ID NO: 3219647 - RNA, 18 nt, Human
cucacauggaaugagggu

SEQ ID NO: 3219648 - RNA, 19 nt, Human
cucacauggaaugaggguu

SEQ ID NO: 3219649 - RNA, 20 nt, Human
cucacauggaaugaggguuu

SEQ ID NO: 3219650 - RNA, 21 nt, Human
cucaccagccccagugcccac

SEQ ID NO: 3219651 - RNA, 20 nt, Human
cucaccagccccagugccca

SEQ ID NO: 3219652 - RNA, 20 nt, Human
cucaagugauucuccugccu

SEQ ID NO: 3219653 - RNA, 19 nt, Human
cucaagugauucuccugcc

SEQ ID NO: 3219654 - RNA, 18 nt, Human
cucaagugauucuccugc

SEQ ID NO: 3219655 - RNA, 20 nt, Human
cucaaggauaccuucuuauu

SEQ ID NO: 3219656 - RNA, 23 nt, Human
cucacaguccuuaccagcagagc

SEQ ID NO: 3219657 - RNA, 16 nt, Human
cucacaguuauuacau

SEQ ID NO: 3219658 - RNA, 13 nt, Human
cucacaguuauua

SEQ ID NO: 3219659 - RNA, 21 nt, Human
cguuuaaggugagcauaaauc

SEQ ID NO: 3219660 - RNA, 14 nt, Human
cuaaaaauuggugu

SEQ ID NO: 3219661 - RNA, 11 nt, Human
cuaaaaauaua

SEQ ID NO: 3219662 - RNA, 23 nt, Human
cuaaaaaugagcuugauuaaauc

SEQ ID NO: 3219663 - RNA, 23 nt, Human
cuaaaaauauacauguuuaugua

SEQ ID NO: 3219664 - RNA, 21 nt, Human
cuaaaaauauacauguuuaug

SEQ ID NO: 3219665 - RNA, 13 nt, Human
cuaaaacuguacu

SEQ ID NO: 3219666 - RNA, 17 nt, Human
cuaaaacuguacuuuga

SEQ ID NO: 3219667 - RNA, 16 nt, Human
cuaaaacuguacuuug

SEQ ID NO: 3219668 - RNA, 20 nt, Human
cuaaaacuguacuuugauuc

SEQ ID NO: 3219669 - RNA, 18 nt, Human
cuaaaacuguacuuugau

SEQ ID NO: 3219670 - RNA, 22 nt, Human
cuaaaacuguacuuugauucac

SEQ ID NO: 3219671 - RNA, 19 nt, Human
cuaaaauugaguucuuccu

SEQ ID NO: 3219672 - RNA, 17 nt, Human
cuaaaauguuuucagcu

SEQ ID NO: 3219673 - RNA, 13 nt, Human
cuaaaauguuuuc

SEQ ID NO: 3219674 - RNA, 15 nt, Human
cuaaaauguuuucag

SEQ ID NO: 3219675 - RNA, 14 nt, Human
cuaaaauguuuuca

SEQ ID NO: 3219676 - RNA, 15 nt, Human
cuaaaauuuuuuccu

SEQ ID NO: 3219677 - RNA, 21 nt, Human
cuaaacguguauguuuuucag

SEQ ID NO: 3219678 - RNA, 20 nt, Human
cuaaacguguauguuuuuca

SEQ ID NO: 3219679 - RNA, 19 nt, Human
cuaaacguguauguuuuuc

SEQ ID NO: 3219680 - RNA, 18 nt, Human
cuaaacguguauguuuuu

SEQ ID NO: 3219681 - RNA, 17 nt, Human
cuaaacguguauguuuu

SEQ ID NO: 3219682 - RNA, 14 nt, Human
cuaaacguguaugu

SEQ ID NO: 3219683 - RNA, 22 nt, Human
cuaaacguguauguuuuucagu

SEQ ID NO: 3219684 - RNA, 15 nt, Human
cuaacauggaaguac

SEQ ID NO: 3219685 - RNA, 17 nt, Human
cuaacauggaaguacua

SEQ ID NO: 3219686 - RNA, 23 nt, Human
cuaaauugacacuuaaaaauggu

SEQ ID NO: 3219687 - RNA, 23 nt, Human
cuaaauguuaaagauguagcaaa

SEQ ID NO: 3219688 - RNA, 19 nt, Human
cuaaauguuaaagauguag

SEQ ID NO: 3219689 - RNA, 17 nt, Human
cuaaauguuaaagaugu

SEQ ID NO: 3219690 - RNA, 16 nt, Human
cuaaauguuaaagaug

SEQ ID NO: 3219691 - RNA, 15 nt, Human
cuaaauguuaaagau

SEQ ID NO: 3219692 - RNA, 14 nt, Human
cuaaauguuaaaga

SEQ ID NO: 3219693 - RNA, 17 nt, Human
cuaaauugauguugaug

SEQ ID NO: 3219694 - RNA, 18 nt, Human
cuaaauuuauuauuuaaa

SEQ ID NO: 3219695 - RNA, 14 nt, Human
cuaaauugauguug

SEQ ID NO: 3219696 - RNA, 16 nt, Human
cuaaauugauguugau

SEQ ID NO: 3219697 - RNA, 15 nt, Human
cuaaauugauguuga

SEQ ID NO: 3219698 - RNA, 16 nt, Human
cuaaauguugaaagau

SEQ ID NO: 3219699 - RNA, 13 nt, Human
cuaaauguuaaag

SEQ ID NO: 3219700 - RNA, 19 nt, Human
cguggcuucccgcucagcc

SEQ ID NO: 3219701 - RNA, 18 nt, Human
cguggcuucccgcucagc

SEQ ID NO: 3219702 - RNA, 15 nt, Human
cguggcaccuccucg

SEQ ID NO: 3219703 - RNA, 16 nt, Human
cguggcaucuuaaaag

SEQ ID NO: 3219704 - RNA, 14 nt, Human
cguggcaccuccuc

SEQ ID NO: 3219705 - RNA, 23 nt, Human
cguugcaaccacugcaauaucuu

SEQ ID NO: 3219706 - RNA, 19 nt, Human
cguugaaguugacucugcu

SEQ ID NO: 3219707 - RNA, 18 nt, Human
cguugcugacuuagaauc

SEQ ID NO: 3219708 - RNA, 17 nt, Human
cguggcugcuucaagga

SEQ ID NO: 3219709 - RNA, 21 nt, Human
cguggcuucccgcucagcccu

SEQ ID NO: 3219710 - RNA, 20 nt, Human
cguggcuucccgcucagccc

SEQ ID NO: 3219711 - RNA, 19 nt, Human
cgugcguguuuucugacug

SEQ ID NO: 3219712 - RNA, 23 nt, Human
cguggagaaucacaggcugggcu

SEQ ID NO: 3219713 - RNA, 17 nt, Human
cguggagaaucacaggc

SEQ ID NO: 3219714 - RNA, 20 nt, Human
cguggagaaucacaggcugg

SEQ ID NO: 3219715 - RNA, 18 nt, Human
cguggagaaucacaggcu

SEQ ID NO: 3219716 - RNA, 14 nt, Human
cgugcacacaccag

SEQ ID NO: 3219717 - RNA, 19 nt, Human
cgugcacacaccagagccc

SEQ ID NO: 3219718 - RNA, 18 nt, Human
cgugcacacaccagagcc

SEQ ID NO: 3219719 - RNA, 21 nt, Human
cgugcaguggugcgaucuggg

SEQ ID NO: 3219720 - RNA, 22 nt, Human
cgucugacaggcaaugcuggcu

SEQ ID NO: 3219721 - RNA, 21 nt, Human
cgucugacaggcaaugcuggc

SEQ ID NO: 3219722 - RNA, 20 nt, Human
cgucugacaggcaaugcugg

SEQ ID NO: 3219723 - RNA, 18 nt, Human
cgucuuucccaaaggcau

SEQ ID NO: 3219724 - RNA, 11 nt, Human
cgucuuuccca

SEQ ID NO: 3219725 - RNA, 16 nt, Human
cgugcacacaccagag

SEQ ID NO: 3219726 - RNA, 18 nt, Human
cggugcuaucucccccag

SEQ ID NO: 3219727 - RNA, 20 nt, Human
cggugcuaucucccccagcc

SEQ ID NO: 3219728 - RNA, 21 nt, Human
cggugcuaucucccccagccc

SEQ ID NO: 3219729 - RNA, 22 nt, Human
cggugcuaucucccccagcccc

SEQ ID NO: 3219730 - RNA, 16 nt, Human
cgucucauacucaccu

SEQ ID NO: 3219731 - RNA, 16 nt, Human
cgucuaccugaggggc

SEQ ID NO: 3219732 - RNA, 22 nt, Human
cgucuagcuaugcuguaucugu

SEQ ID NO: 3219733 - RNA, 15 nt, Human
cggcuggcuccccug

SEQ ID NO: 3219734 - RNA, 16 nt, Human
cggcuggcuccccugc

SEQ ID NO: 3219735 - RNA, 18 nt, Human
cggcuggcuccccugcag

SEQ ID NO: 3219736 - RNA, 19 nt, Human
cggcuggcuccccugcagc

SEQ ID NO: 3219737 - RNA, 21 nt, Human
cggcuggcuccccugcagccc

SEQ ID NO: 3219738 - RNA, 23 nt, Human
cggcuggccuggccccucagggu

SEQ ID NO: 3219739 - RNA, 22 nt, Human
cggcuggccuggccccucaggg

SEQ ID NO: 3219740 - RNA, 19 nt, Human
cggcuggccuggccccuca

SEQ ID NO: 3219741 - RNA, 18 nt, Human
cgggacguggcaccuccu

SEQ ID NO: 3219742 - RNA, 19 nt, Human
cgggacguggcaccuccuc

SEQ ID NO: 3219743 - RNA, 11 nt, Human
cgggacucugc

SEQ ID NO: 3219744 - RNA, 22 nt, Human
cgggaugggagccgggcaaacu

SEQ ID NO: 3219745 - RNA, 15 nt, Human
cgggcacaccuccuc

SEQ ID NO: 3219746 - RNA, 17 nt, Human
cgggauuaguacacacu

SEQ ID NO: 3219747 - RNA, 18 nt, Human
cgggaggucgaggcagga

SEQ ID NO: 3219748 - RNA, 20 nt, Human
cgggaggucgaggcaggagg

SEQ ID NO: 3219749 - RNA, 22 nt, Human
cgggcacucagaagacacugau

SEQ ID NO: 3219750 - RNA, 14 nt, Human
cgggcacucagaag

SEQ ID NO: 3219751 - RNA, 22 nt, Human
cggggacagcuccuucuguccu

SEQ ID NO: 3219752 - RNA, 12 nt, Human
cgggcagagcac

SEQ ID NO: 3219753 - RNA, 23 nt, Human
cgggggcaggggaggccaucugg

SEQ ID NO: 3219754 - RNA, 15 nt, Human
cgggggcagagaggg

SEQ ID NO: 3219755 - RNA, 23 nt, Human
cggggacagcuccuucuguccua

SEQ ID NO: 3219756 - RNA, 22 nt, Human
cggggcuucugugcaccugggc

SEQ ID NO: 3219757 - RNA, 22 nt, Human
cgggucaucuguaccucugccu

SEQ ID NO: 3219758 - RNA, 19 nt, Human
cggggugucugucuuccuu

SEQ ID NO: 3219759 - RNA, 21 nt, Human
cggggugucugucuuccuuug

SEQ ID NO: 3219760 - RNA, 12 nt, Human
cgggucuuccua

SEQ ID NO: 3219761 - RNA, 16 nt, Human
cgggucuuccuacucu

SEQ ID NO: 3219762 - RNA, 15 nt, Human
cgggucaucuguacc

SEQ ID NO: 3219763 - RNA, 19 nt, Human
cgggucacaggagggaggg

SEQ ID NO: 3219764 - RNA, 11 nt, Human
cgggucacagg

SEQ ID NO: 3219765 - RNA, 14 nt, Human
cgggugcagcaucu

SEQ ID NO: 3219766 - RNA, 22 nt, Human
cgggugcagacaaucuucuguu

SEQ ID NO: 3219767 - RNA, 17 nt, Human
cggguuauaaugaauga

SEQ ID NO: 3219768 - RNA, 21 nt, Human
cggguuuuauuguuuaaaauc

SEQ ID NO: 3219769 - RNA, 14 nt, Human
cgguaccaaugcag

SEQ ID NO: 3219770 - RNA, 13 nt, Human
cgguacccaccac

SEQ ID NO: 3219771 - RNA, 19 nt, Human
cgguaccaaugcagaacuc

SEQ ID NO: 3219772 - RNA, 20 nt, Human
cgguccacccaggagccccg

SEQ ID NO: 3219773 - RNA, 16 nt, Human
cgguccacccaggagc

SEQ ID NO: 3219774 - RNA, 15 nt, Human
cgguccacccaggag

SEQ ID NO: 3219775 - RNA, 14 nt, Human
cgguccacccagga

SEQ ID NO: 3219776 - RNA, 19 nt, Human
cggugaccucuagcccugc

SEQ ID NO: 3219777 - RNA, 21 nt, Human
cggugagaggggaacagacug

SEQ ID NO: 3219778 - RNA, 20 nt, Human
cggugagaggggaacagacu

SEQ ID NO: 3219779 - RNA, 22 nt, Human
cggucggguuuuauuguuuaaa

SEQ ID NO: 3219780 - RNA, 20 nt, Human
cgguccccacuuuauugcca

SEQ ID NO: 3219781 - RNA, 22 nt, Human
cggucucggaucaggcucccag

SEQ ID NO: 3219782 - RNA, 23 nt, Human
cggucucggaucaggcucccagg

SEQ ID NO: 3219783 - RNA, 23 nt, Human
cggucgggggggacccuccaagg

SEQ ID NO: 3219784 - RNA, 15 nt, Human
cggcuggacuuggag

SEQ ID NO: 3219785 - RNA, 11 nt, Human
cggcugcccuu

SEQ ID NO: 3219786 - RNA, 12 nt, Human
cggcugcccuuu

SEQ ID NO: 3219787 - RNA, 12 nt, Human
cggccucagagu

SEQ ID NO: 3219788 - RNA, 12 nt, Human
cggccuccaucc

SEQ ID NO: 3219789 - RNA, 24 nt, Human
cggccaggccagagggagugacag

SEQ ID NO: 3219790 - RNA, 16 nt, Human
cggccaggugccuccu

SEQ ID NO: 3219791 - RNA, 17 nt, Human
cggccaggugccuccug

SEQ ID NO: 3219792 - RNA, 18 nt, Human
cggccaggugccuccuga

SEQ ID NO: 3219793 - RNA, 19 nt, Human
cggccaggugccuccugac

SEQ ID NO: 3219794 - RNA, 19 nt, Human
cggccccugcugguucagg

SEQ ID NO: 3219795 - RNA, 18 nt, Human
cggccccugcugguucag

SEQ ID NO: 3219796 - RNA, 13 nt, Human
cggccccugcugg

SEQ ID NO: 3219797 - RNA, 13 nt, Human
cggaagagccuug

SEQ ID NO: 3219798 - RNA, 11 nt, Human
cggccaccugc

SEQ ID NO: 3219799 - RNA, 15 nt, Human
cggccaccugcggug

SEQ ID NO: 3219800 - RNA, 16 nt, Human
cggccaccugcggugc

SEQ ID NO: 3219801 - RNA, 17 nt, Human
cggccaccugcggugcu

SEQ ID NO: 3219802 - RNA, 13 nt, Human
cggcauuuguuuc

SEQ ID NO: 3219803 - RNA, 17 nt, Human
cgcccuggcccccacau

SEQ ID NO: 3219804 - RNA, 15 nt, Human
cgcccuggcccccac

SEQ ID NO: 3219805 - RNA, 14 nt, Human
cgcccuggccccca

SEQ ID NO: 3219806 - RNA, 16 nt, Human
cgcccuggcaggcagg

SEQ ID NO: 3219807 - RNA, 14 nt, Human
cgcccuggcaggca

SEQ ID NO: 3219808 - RNA, 18 nt, Human
cgccccugagcccacugu

SEQ ID NO: 3219809 - RNA, 15 nt, Human
cgccccugagcccac

SEQ ID NO: 3219810 - RNA, 14 nt, Human
cgccccugagccca

SEQ ID NO: 3219811 - RNA, 22 nt, Human
cgcccaggcuuagucacugaga

SEQ ID NO: 3219812 - RNA, 18 nt, Human
cgcccagucccagcagcc

SEQ ID NO: 3219813 - RNA, 17 nt, Human
cgcccagucccagcagc

SEQ ID NO: 3219814 - RNA, 15 nt, Human
cgcccagucccagca

SEQ ID NO: 3219815 - RNA, 14 nt, Human
cgcccagucccagc

SEQ ID NO: 3219816 - RNA, 12 nt, Human
cgcccacuuccc

SEQ ID NO: 3219817 - RNA, 13 nt, Human
cgcccacuucccu

SEQ ID NO: 3219818 - RNA, 13 nt, Human
cgccccugagccc

SEQ ID NO: 3219819 - RNA, 12 nt, Human
cgccccugagcc

SEQ ID NO: 3219820 - RNA, 21 nt, Human
cgcccagucccagcagccagc

SEQ ID NO: 3219821 - RNA, 18 nt, Human
cgccccgaaaggucaccu

SEQ ID NO: 3219822 - RNA, 23 nt, Human
cgccaggggaaaaucagccugcu

SEQ ID NO: 3219823 - RNA, 16 nt, Human
cgccaggacuuggccu

SEQ ID NO: 3219824 - RNA, 14 nt, Human
cgccaucccagccc

SEQ ID NO: 3219825 - RNA, 16 nt, Human
cgccaucccagcccca

SEQ ID NO: 3219826 - RNA, 17 nt, Human
ccucugcccacucccug

SEQ ID NO: 3219827 - RNA, 19 nt, Human
ccucugcccacucccugca

SEQ ID NO: 3219828 - RNA, 20 nt, Human
ccucugcccacucccugcaa

SEQ ID NO: 3219829 - RNA, 22 nt, Human
cgccagauucuuuccugaggcu

SEQ ID NO: 3219830 - RNA, 14 nt, Human
cgcucucuggccuu

SEQ ID NO: 3219831 - RNA, 15 nt, Human
cgcucucuggccuuc

SEQ ID NO: 3219832 - RNA, 15 nt, Human
cgcuccaacuccaac

SEQ ID NO: 3219833 - RNA, 14 nt, Human
cgcuccaacuccaa

SEQ ID NO: 3219834 - RNA, 18 nt, Human
cgcucauucagcaucuga

SEQ ID NO: 3219835 - RNA, 16 nt, Human
cgcucauucagcaucu

SEQ ID NO: 3219836 - RNA, 22 nt, Human
cgcuacauuuccgccacauccc

SEQ ID NO: 3219837 - RNA, 16 nt, Human
cgcuacccgggaaggg

SEQ ID NO: 3219838 - RNA, 12 nt, Human
cgcucagcccuc

SEQ ID NO: 3219839 - RNA, 21 nt, Human
cgcucagcccucccugccccu

SEQ ID NO: 3219840 - RNA, 16 nt, Human
cgcucagcccucccug

SEQ ID NO: 3219841 - RNA, 22 nt, Human
cgcuaagagggagggagggcuc

SEQ ID NO: 3219842 - RNA, 21 nt, Human
cgcuaagagggagggagggcu

SEQ ID NO: 3219843 - RNA, 15 nt, Human
cgcggcgggcccugc

SEQ ID NO: 3219844 - RNA, 20 nt, Human
cgcggccucuucucucagac

SEQ ID NO: 3219845 - RNA, 17 nt, Human
cgcggacauccccugcu

SEQ ID NO: 3219846 - RNA, 20 nt, Human
cgcgccccgaaaggucaccu

SEQ ID NO: 3219847 - RNA, 22 nt, Human
cgcugucagccauuccuguucc

SEQ ID NO: 3219848 - RNA, 16 nt, Human
cgcugugcugcccugc

SEQ ID NO: 3219849 - RNA, 17 nt, Human
cgcugugcugcccugcc

SEQ ID NO: 3219850 - RNA, 15 nt, Human
cgcugugcugcccug

SEQ ID NO: 3219851 - RNA, 15 nt, Human
cucuugaacuccuga

SEQ ID NO: 3219852 - RNA, 19 nt, Human
cucuuggguucaagcgauu

SEQ ID NO: 3219853 - RNA, 21 nt, Human
cucuuggguucaagcgauucu

SEQ ID NO: 3219854 - RNA, 22 nt, Human
cucuucuuuaaagggauggcaa

SEQ ID NO: 3219855 - RNA, 12 nt, Human
cucuucuguguu

SEQ ID NO: 3219856 - RNA, 18 nt, Human
cucuucuggguuccuucc

SEQ ID NO: 3219857 - RNA, 21 nt, Human
cucuuccuccugacaccccac

SEQ ID NO: 3219858 - RNA, 18 nt, Human
cucuuccuccugacaccc

SEQ ID NO: 3219859 - RNA, 16 nt, Human
cucuuccuccugacac

SEQ ID NO: 3219860 - RNA, 14 nt, Human
cucuuccuccugac

SEQ ID NO: 3219861 - RNA, 19 nt, Human
cucuuccuccaaggacaga

SEQ ID NO: 3219862 - RNA, 11 nt, Human
cucuuccucca

SEQ ID NO: 3219863 - RNA, 14 nt, Human
cucuucuucucaag

SEQ ID NO: 3219864 - RNA, 13 nt, Human
cucuucuuagccu

SEQ ID NO: 3219865 - RNA, 19 nt, Human
cucuucuuauacagauaaa

SEQ ID NO: 3219866 - RNA, 13 nt, Human
cucuucuguguuu

SEQ ID NO: 3219867 - RNA, 23 nt, Human
cucuucccugaacuuccugcuuc

SEQ ID NO: 3219868 - RNA, 21 nt, Human
cucuucccugguaagaaaaag

SEQ ID NO: 3219869 - RNA, 14 nt, Human
cucuuccaggcagc

SEQ ID NO: 3219870 - RNA, 13 nt, Human
cucuuccaggcag

SEQ ID NO: 3219871 - RNA, 22 nt, Human
cucuucccugaacuuccugcuu

SEQ ID NO: 3219872 - RNA, 15 nt, Human
cucuuccaggcagcc

SEQ ID NO: 3219873 - RNA, 20 nt, Human
cucuucccugaacuuccugc

SEQ ID NO: 3219874 - RNA, 14 nt, Human
cucuuccuagcugg

SEQ ID NO: 3219875 - RNA, 17 nt, Human
cucuuucccucccuucc

SEQ ID NO: 3219876 - RNA, 13 nt, Human
cucuuucccuccc

SEQ ID NO: 3219877 - RNA, 23 nt, Human
cucuuuaaugucacaggcagguc

SEQ ID NO: 3219878 - RNA, 22 nt, Human
cucuuuaaugucacaggcaggu

SEQ ID NO: 3219879 - RNA, 21 nt, Human
cucuuuaaugucacaggcagg

SEQ ID NO: 3219880 - RNA, 20 nt, Human
cucuuuaaugucacaggcag

SEQ ID NO: 3219881 - RNA, 13 nt, Human
cucuugguccugc

SEQ ID NO: 3219882 - RNA, 15 nt, Human
cucuugguccugcug

SEQ ID NO: 3219883 - RNA, 16 nt, Human
cucuugguccugcugc

SEQ ID NO: 3219884 - RNA, 18 nt, Human
cucuuuaaugucacaggc

SEQ ID NO: 3219885 - RNA, 19 nt, Human
cucuuuaacuuguaauaaa

SEQ ID NO: 3219886 - RNA, 17 nt, Human
cucuuuaacuuguaaua

SEQ ID NO: 3219887 - RNA, 13 nt, Human
cucuuguuucucc

SEQ ID NO: 3219888 - RNA, 20 nt, Human
cucuuguucuuacuuuccug

SEQ ID NO: 3219889 - RNA, 19 nt, Human
cucuuguucuuacuuuccu

SEQ ID NO: 3219890 - RNA, 16 nt, Human
cucuuguucuuacuuu

SEQ ID NO: 3219891 - RNA, 19 nt, Human
cugaagaauugaaaaacca

SEQ ID NO: 3219892 - RNA, 18 nt, Human
cugaacguuugguucaaa

SEQ ID NO: 3219893 - RNA, 23 nt, Human
cugaacguuugguucaaaugugu

SEQ ID NO: 3219894 - RNA, 16 nt, Human
cugaacucugacaaca

SEQ ID NO: 3219895 - RNA, 17 nt, Human
cugaacucugacaacag

SEQ ID NO: 3219896 - RNA, 22 nt, Human
cugaacacugaagucaguucuc

SEQ ID NO: 3219897 - RNA, 22 nt, Human
cugaacagaugaccccugccca

SEQ ID NO: 3219898 - RNA, 24 nt, Human
cugaacagaugaccccugcccaga

SEQ ID NO: 3219899 - RNA, 13 nt, Human
cugaaauuuuaga

SEQ ID NO: 3219900 - RNA, 18 nt, Human
cugaaauuuuagaaauau

SEQ ID NO: 3219901 - RNA, 22 nt, Human
cugaaauuuuagaaauauucac

SEQ ID NO: 3219902 - RNA, 21 nt, Human
cugaaauugaaaaguuauuuc

SEQ ID NO: 3219903 - RNA, 20 nt, Human
cugaaauugaaaaguuauuu

SEQ ID NO: 3219904 - RNA, 13 nt, Human
cugaaauccuggu

SEQ ID NO: 3219905 - RNA, 14 nt, Human
cugaaauccugguu

SEQ ID NO: 3219906 - RNA, 15 nt, Human
cugaaauccugguuc

SEQ ID NO: 3219907 - RNA, 16 nt, Human
cugaaauccugguucc

SEQ ID NO: 3219908 - RNA, 17 nt, Human
cugaaauccugguuccu

SEQ ID NO: 3219909 - RNA, 15 nt, Human
cugaaauugaaaagu

SEQ ID NO: 3219910 - RNA, 14 nt, Human
cugaaauugaaaag

SEQ ID NO: 3219911 - RNA, 15 nt, Human
cugaaagcccugagc

SEQ ID NO: 3219912 - RNA, 19 nt, Human
cucuuucuucuuccacaca

SEQ ID NO: 3219913 - RNA, 11 nt, Human
cucuuugaaac

SEQ ID NO: 3219914 - RNA, 13 nt, Human
cucuuucccuucc

SEQ ID NO: 3219915 - RNA, 23 nt, Human
cucuuucccuuccaguuuauucc

SEQ ID NO: 3219916 - RNA, 17 nt, Human
cucuuucccuuccaguu

SEQ ID NO: 3219917 - RNA, 16 nt, Human
cugaaagcccugagcu

SEQ ID NO: 3219918 - RNA, 17 nt, Human
cugaaagcccugagcuu

SEQ ID NO: 3219919 - RNA, 18 nt, Human
cugaaagcccugagcuuu

SEQ ID NO: 3219920 - RNA, 19 nt, Human
cugaaagcccugagcuuuc

SEQ ID NO: 3219921 - RNA, 23 nt, Human
cugaaagcccugagcuuucugcu

SEQ ID NO: 3219922 - RNA, 22 nt, Human
cugaaauagacccacaagaggc

SEQ ID NO: 3219923 - RNA, 14 nt, Human
cugaaauauaaagu

SEQ ID NO: 3219924 - RNA, 22 nt, Human
cucugugcccacccuccacucu

SEQ ID NO: 3219925 - RNA, 22 nt, Human
cucuggcuccagcuggccggga

SEQ ID NO: 3219926 - RNA, 15 nt, Human
cucuggcucuacaca

SEQ ID NO: 3219927 - RNA, 15 nt, Human
cucugugucaggugg

SEQ ID NO: 3219928 - RNA, 22 nt, Human
cucuguuacacuuuuuggaagu

SEQ ID NO: 3219929 - RNA, 13 nt, Human
cucuuagaaaaac

SEQ ID NO: 3219930 - RNA, 15 nt, Human
cucuuagaaaaacca

SEQ ID NO: 3219931 - RNA, 14 nt, Human
cucuuccaggcugg

SEQ ID NO: 3219932 - RNA, 15 nt, Human
cucuuccaggcuggg

SEQ ID NO: 3219933 - RNA, 13 nt, Human
cucuuccaggcug

SEQ ID NO: 3219934 - RNA, 16 nt, Human
cucuuccaaccauuua

SEQ ID NO: 3219935 - RNA, 14 nt, Human
cucuggacaggcau

SEQ ID NO: 3219936 - RNA, 16 nt, Human
cucuggacaggcaugu

SEQ ID NO: 3219937 - RNA, 12 nt, Human
cucuggcagcuc

SEQ ID NO: 3219938 - RNA, 14 nt, Human
cucuggcagcucag

SEQ ID NO: 3219939 - RNA, 12 nt, Human
cucuggccuucg

SEQ ID NO: 3219940 - RNA, 15 nt, Human
cucuggcagcucaga

SEQ ID NO: 3219941 - RNA, 15 nt, Human
cucuggcuccagcug

SEQ ID NO: 3219942 - RNA, 16 nt, Human
cucuggcuccagcugg

SEQ ID NO: 3219943 - RNA, 15 nt, Human
cucuggacaggcaug

SEQ ID NO: 3219944 - RNA, 11 nt, Human
cucugcugugg

SEQ ID NO: 3219945 - RNA, 22 nt, Human
cucugcugugggcacaggucag

SEQ ID NO: 3219946 - RNA, 21 nt, Human
cucugccugaagucacacagu

SEQ ID NO: 3219947 - RNA, 10 nt, Human
cucugccuga

SEQ ID NO: 3219948 - RNA, 22 nt, Human
cucugccugaagucacacagug

SEQ ID NO: 3219949 - RNA, 17 nt, Human
cucucugaaggaggcca

SEQ ID NO: 3219950 - RNA, 13 nt, Human
cucucuccucccu

SEQ ID NO: 3219951 - RNA, 17 nt, Human
cucucuccccugcucca

SEQ ID NO: 3219952 - RNA, 22 nt, Human
cugaagauuguuuaucuagaug

SEQ ID NO: 3219953 - RNA, 15 nt, Human
cugacagccagaacu

SEQ ID NO: 3219954 - RNA, 14 nt, Human
cugacagccagaac

SEQ ID NO: 3219955 - RNA, 16 nt, Human
cugacagccagaacuc

SEQ ID NO: 3219956 - RNA, 14 nt, Human
cugaagauuguuua

SEQ ID NO: 3219957 - RNA, 16 nt, Human
cugaagauuguuuauc

SEQ ID NO: 3219958 - RNA, 15 nt, Human
cugaagauuguuuau

SEQ ID NO: 3219959 - RNA, 21 nt, Human
cugacauuguuggccaaagcc

SEQ ID NO: 3219960 - RNA, 21 nt, Human
cugacaggcaaugcuggcugu

SEQ ID NO: 3219961 - RNA, 19 nt, Human
cugacaucagagguaucuu

SEQ ID NO: 3219962 - RNA, 13 nt, Human
cugacccaugcug

SEQ ID NO: 3219963 - RNA, 14 nt, Human
cugacccacugcuu

SEQ ID NO: 3219964 - RNA, 13 nt, Human
cugacccacugcu

SEQ ID NO: 3219965 - RNA, 14 nt, Human
cugacccaugcugc

SEQ ID NO: 3219966 - RNA, 15 nt, Human
cugacccaugcugcc

SEQ ID NO: 3219967 - RNA, 16 nt, Human
cugacccaugcugccc

SEQ ID NO: 3219968 - RNA, 12 nt, Human
cugacccacugc

SEQ ID NO: 3219969 - RNA, 22 nt, Human
cugacauuguuggccaaagcca

SEQ ID NO: 3219970 - RNA, 14 nt, Human
cugaccaaguuucu

SEQ ID NO: 3219971 - RNA, 16 nt, Human
cugacuguuuucucuu

SEQ ID NO: 3219972 - RNA, 16 nt, Human
cugacuucuaaguaaa

SEQ ID NO: 3219973 - RNA, 14 nt, Human
cugacuucuguuua

SEQ ID NO: 3219974 - RNA, 15 nt, Human
cugacuucuaaguaa

SEQ ID NO: 3219975 - RNA, 13 nt, Human
cugacuucuaagu

SEQ ID NO: 3219976 - RNA, 18 nt, Human
cugacuguuuucucuuga

SEQ ID NO: 3219977 - RNA, 12 nt, Human
cugacuuagaau

SEQ ID NO: 3219978 - RNA, 22 nt, Human
cugacuuagaaucccuguguua

SEQ ID NO: 3219979 - RNA, 23 nt, Human
cugagaaagacuauucaaacagu

SEQ ID NO: 3219980 - RNA, 22 nt, Human
cugagaaagacuauucaaacag

SEQ ID NO: 3219981 - RNA, 14 nt, Human
cugagacagcccgg

SEQ ID NO: 3219982 - RNA, 15 nt, Human
cugagacagcccggg

SEQ ID NO: 3219983 - RNA, 18 nt, Human
cugagaaugaacaaagac

SEQ ID NO: 3219984 - RNA, 17 nt, Human
cugagaaugaacaaaga

SEQ ID NO: 3219985 - RNA, 21 nt, Human
cugaggauauggacacuggug

SEQ ID NO: 3219986 - RNA, 19 nt, Human
cugaggcagguccccagac

SEQ ID NO: 3219987 - RNA, 18 nt, Human
cugaggcagguccccaga

SEQ ID NO: 3219988 - RNA, 17 nt, Human
cugaggcagguccccag

SEQ ID NO: 3219989 - RNA, 14 nt, Human
cugaggcagguccc

SEQ ID NO: 3219990 - RNA, 17 nt, Human
cugaggcaguuugagga

SEQ ID NO: 3219991 - RNA, 12 nt, Human
cugaggcccaga

SEQ ID NO: 3219992 - RNA, 13 nt, Human
cugaggcccagag

SEQ ID NO: 3219993 - RNA, 14 nt, Human
cugaggcccagagg

SEQ ID NO: 3219994 - RNA, 15 nt, Human
cugaggcccagaggg

SEQ ID NO: 3219995 - RNA, 16 nt, Human
cugaggcccagagggc

SEQ ID NO: 3219996 - RNA, 17 nt, Human
cugaggcccagagggcc

SEQ ID NO: 3219997 - RNA, 18 nt, Human
cugaggcccagagggccu

SEQ ID NO: 3219998 - RNA, 19 nt, Human
cugaggcccagagggccug

SEQ ID NO: 3219999 - RNA, 21 nt, Human
cugaggcccagagggccugca

SEQ ID NO: 3220000 - RNA, 23 nt, Human
cugaggcccagagggccugcaag

SEQ ID NO: 3220001 - RNA, 14 nt, Human
cugaggcccuucuc

SEQ ID NO: 3220002 - RNA, 15 nt, Human
cugaggcccuucucu

SEQ ID NO: 3220003 - RNA, 18 nt, Human
cugaggcccuucucucca

SEQ ID NO: 3220004 - RNA, 19 nt, Human
cugaggcccuucucuccag

SEQ ID NO: 3220005 - RNA, 20 nt, Human
cugaggcccuucucuccagc

SEQ ID NO: 3220006 - RNA, 16 nt, Human
cugagcgacagugaga

SEQ ID NO: 3220007 - RNA, 20 nt, Human
cugagcgacagugagacucu

SEQ ID NO: 3220008 - RNA, 17 nt, Human
cugagccuucugagcug

SEQ ID NO: 3220009 - RNA, 15 nt, Human
cugagccuucugagc

SEQ ID NO: 3220010 - RNA, 14 nt, Human
cugagccuucugag

SEQ ID NO: 3220011 - RNA, 13 nt, Human
cugagccuucuga

SEQ ID NO: 3220012 - RNA, 22 nt, Human
cugagccucagucucccucccu

SEQ ID NO: 3220013 - RNA, 16 nt, Human
cugagacagcccgggc

SEQ ID NO: 3220014 - RNA, 17 nt, Human
cugagacagcccgggcu

SEQ ID NO: 3220015 - RNA, 18 nt, Human
cugagacagcccgggcuc

SEQ ID NO: 3220016 - RNA, 17 nt, Human
cugagccagauuucacu

SEQ ID NO: 3220017 - RNA, 18 nt, Human
cugagccagauuucacuc

SEQ ID NO: 3220018 - RNA, 19 nt, Human
cugagccagauuucacucu

SEQ ID NO: 3220019 - RNA, 20 nt, Human
cugagccagauuucacucuc

SEQ ID NO: 3220020 - RNA, 21 nt, Human
cugagccagauuucacucucc

SEQ ID NO: 3220021 - RNA, 15 nt, Human
cugagccagauuuca

SEQ ID NO: 3220022 - RNA, 16 nt, Human
cugagccucagucucc

SEQ ID NO: 3220023 - RNA, 21 nt, Human
cugagccucagucucccuccc

SEQ ID NO: 3220024 - RNA, 16 nt, Human
cugagccgcagagaag

SEQ ID NO: 3220025 - RNA, 15 nt, Human
cugagccgcagagaa

SEQ ID NO: 3220026 - RNA, 14 nt, Human
cugagccgcagaga

SEQ ID NO: 3220027 - RNA, 11 nt, Human
cucuccacugc

SEQ ID NO: 3220028 - RNA, 14 nt, Human
cucuccagccccug

SEQ ID NO: 3220029 - RNA, 14 nt, Human
cucuccacugccuu

SEQ ID NO: 3220030 - RNA, 12 nt, Human
cucuccacugcc

SEQ ID NO: 3220031 - RNA, 15 nt, Human
cucuccagccccugg

SEQ ID NO: 3220032 - RNA, 16 nt, Human
cucuccagccccugga

SEQ ID NO: 3220033 - RNA, 17 nt, Human
cucuccagccccuggau

SEQ ID NO: 3220034 - RNA, 18 nt, Human
cucuccagccccuggaug

SEQ ID NO: 3220035 - RNA, 17 nt, Human
cucucaggccagcugcu

SEQ ID NO: 3220036 - RNA, 18 nt, Human
cucucaggccagcugcuu

SEQ ID NO: 3220037 - RNA, 19 nt, Human
cucucaggccagcugcuug

SEQ ID NO: 3220038 - RNA, 21 nt, Human
cucucaggccagcugcuuggg

SEQ ID NO: 3220039 - RNA, 14 nt, Human
cucucauuugugug

SEQ ID NO: 3220040 - RNA, 22 nt, Human
cucucaugcugccccugccuug

SEQ ID NO: 3220041 - RNA, 21 nt, Human
cucucaugcugccccugccuu

SEQ ID NO: 3220042 - RNA, 19 nt, Human
cucucaugcugccccugcc

SEQ ID NO: 3220043 - RNA, 16 nt, Human
cucucaugcugccccu

SEQ ID NO: 3220044 - RNA, 22 nt, Human
cucucaggccaaacucaccugc

SEQ ID NO: 3220045 - RNA, 23 nt, Human
cucucaggccaaacucaccugcc

SEQ ID NO: 3220046 - RNA, 13 nt, Human
cucucaggccagc

SEQ ID NO: 3220047 - RNA, 15 nt, Human
cucucaggccagcug

SEQ ID NO: 3220048 - RNA, 20 nt, Human
cucucaggccaaacucaccu

SEQ ID NO: 3220049 - RNA, 21 nt, Human
cucucaggccaaacucaccug

SEQ ID NO: 3220050 - RNA, 12 nt, Human
cucucaggccaa

SEQ ID NO: 3220051 - RNA, 22 nt, Human
cucuauaagcaaauugcuuuuu

SEQ ID NO: 3220052 - RNA, 20 nt, Human
cucuagugcugugaaaaaaa

SEQ ID NO: 3220053 - RNA, 19 nt, Human
cucuagugcugugaaaaaa

SEQ ID NO: 3220054 - RNA, 18 nt, Human
cucuagugcugugaaaaa

SEQ ID NO: 3220055 - RNA, 13 nt, Human
cucuagugcugug

SEQ ID NO: 3220056 - RNA, 12 nt, Human
cucuagugcugu

SEQ ID NO: 3220057 - RNA, 17 nt, Human
cucuagugcugugaaaa

SEQ ID NO: 3220058 - RNA, 16 nt, Human
cucuagugcugugaaa

SEQ ID NO: 3220059 - RNA, 15 nt, Human
cucuagugcugugaa

SEQ ID NO: 3220060 - RNA, 14 nt, Human
cucuagugcuguga

SEQ ID NO: 3220061 - RNA, 18 nt, Human
cucuccuuaaaugcuucu

SEQ ID NO: 3220062 - RNA, 12 nt, Human
cucucucacucc

SEQ ID NO: 3220063 - RNA, 22 nt, Human
cucucuauuucccccuuucuuc

SEQ ID NO: 3220064 - RNA, 21 nt, Human
cucucuauuucccccuuucuu

SEQ ID NO: 3220065 - RNA, 14 nt, Human
cucucuacuggucc

SEQ ID NO: 3220066 - RNA, 13 nt, Human
cucucucaggcca

SEQ ID NO: 3220067 - RNA, 21 nt, Human
cucucucaauuuuugguugaa

SEQ ID NO: 3220068 - RNA, 15 nt, Human
cucucucaaaauuau

SEQ ID NO: 3220069 - RNA, 22 nt, Human
cucuccucuugccacugccucu

SEQ ID NO: 3220070 - RNA, 19 nt, Human
cucuccucuugccacugcc

SEQ ID NO: 3220071 - RNA, 17 nt, Human
cucuccucuugccacug

SEQ ID NO: 3220072 - RNA, 16 nt, Human
cucuccucuugccacu

SEQ ID NO: 3220073 - RNA, 15 nt, Human
cucuccucuugccac

SEQ ID NO: 3220074 - RNA, 14 nt, Human
cucuccucuugcca

SEQ ID NO: 3220075 - RNA, 13 nt, Human
cucuccucugcug

SEQ ID NO: 3220076 - RNA, 14 nt, Human
cucuccucugcugc

SEQ ID NO: 3220077 - RNA, 15 nt, Human
cucuccucugcugcu

SEQ ID NO: 3220078 - RNA, 18 nt, Human
cucuccucugcugcuggc

SEQ ID NO: 3220079 - RNA, 13 nt, Human
cucuccccagcaa

SEQ ID NO: 3220080 - RNA, 19 nt, Human
cucuccagccccuggaugc

SEQ ID NO: 3220081 - RNA, 12 nt, Human
cucuccucugcu

SEQ ID NO: 3220082 - RNA, 22 nt, Human
cucuccccagcaagugagagcu

SEQ ID NO: 3220083 - RNA, 14 nt, Human
cucuccccagcaag

SEQ ID NO: 3220084 - RNA, 21 nt, Human
cucuacugggagccuacccac

SEQ ID NO: 3220085 - RNA, 18 nt, Human
cucuacugggagccuacc

SEQ ID NO: 3220086 - RNA, 16 nt, Human
cucuacuuagcauguc

SEQ ID NO: 3220087 - RNA, 20 nt, Human
cucuacuuagcaugucccua

SEQ ID NO: 3220088 - RNA, 19 nt, Human
cucuacuuagcaugucccu

SEQ ID NO: 3220089 - RNA, 17 nt, Human
cucuacuuagcaugucc

SEQ ID NO: 3220090 - RNA, 13 nt, Human
cucuacccuggca

SEQ ID NO: 3220091 - RNA, 20 nt, Human
cucuaccauccccuguagag

SEQ ID NO: 3220092 - RNA, 12 nt, Human
cucuagcugaau

SEQ ID NO: 3220093 - RNA, 11 nt, Human
cucuagcugaa

SEQ ID NO: 3220094 - RNA, 15 nt, Human
cucuagcugaauuga

SEQ ID NO: 3220095 - RNA, 13 nt, Human
cucuagcugaauu

SEQ ID NO: 3220096 - RNA, 16 nt, Human
cucuagcccugcccgg

SEQ ID NO: 3220097 - RNA, 14 nt, Human
cucuagcccugccc

SEQ ID NO: 3220098 - RNA, 23 nt, Human
cucuagagaaguggacuggagga

SEQ ID NO: 3220099 - RNA, 18 nt, Human
cucuagagaaguggacug

SEQ ID NO: 3220100 - RNA, 23 nt, Human
cucuagaguagagguauaauugu

SEQ ID NO: 3220101 - RNA, 21 nt, Human
cucuagaguagagguauaauu

SEQ ID NO: 3220102 - RNA, 20 nt, Human
cucuagaauuuuaagccuuu

SEQ ID NO: 3220103 - RNA, 15 nt, Human
cucuagaauuuuaag

SEQ ID NO: 3220104 - RNA, 22 nt, Human
cucuagaaaggggauuacaguu

SEQ ID NO: 3220105 - RNA, 16 nt, Human
cucuaggauguauauu

SEQ ID NO: 3220106 - RNA, 22 nt, Human
cucuaggauguauauuuuauau

SEQ ID NO: 3220107 - RNA, 23 nt, Human
cucuagggaaaaaccagcgugug

SEQ ID NO: 3220108 - RNA, 18 nt, Human
cucuagggaccagaacca

SEQ ID NO: 3220109 - RNA, 16 nt, Human
cucuaguacugugaau

SEQ ID NO: 3220110 - RNA, 14 nt, Human
cucuaguacuguga

SEQ ID NO: 3220111 - RNA, 23 nt, Human
cucuaagauguuauauuuuucuu

SEQ ID NO: 3220112 - RNA, 19 nt, Human
cucuaagauguuauauuuu

SEQ ID NO: 3220113 - RNA, 18 nt, Human
cucuaagauguuauauuu

SEQ ID NO: 3220114 - RNA, 13 nt, Human
cucuacaaaaagc

SEQ ID NO: 3220115 - RNA, 12 nt, Human
cucuaagauguu

SEQ ID NO: 3220116 - RNA, 17 nt, Human
cucuaagauguuauauu

SEQ ID NO: 3220117 - RNA, 15 nt, Human
cucuaagauguuaua

SEQ ID NO: 3220118 - RNA, 16 nt, Human
cucuaacuguauauuu

SEQ ID NO: 3220119 - RNA, 17 nt, Human
cucuaacuguauauuug

SEQ ID NO: 3220120 - RNA, 20 nt, Human
cucuaacuguauauuuguau

SEQ ID NO: 3220121 - RNA, 21 nt, Human
cucuaacuguauauuuguaug

SEQ ID NO: 3220122 - RNA, 13 nt, Human
cucggcuggcucc

SEQ ID NO: 3220123 - RNA, 14 nt, Human
cucggcuggcuccc

SEQ ID NO: 3220124 - RNA, 16 nt, Human
cucggcuggcuccccu

SEQ ID NO: 3220125 - RNA, 21 nt, Human
cucggcuggcuccccugcagc

SEQ ID NO: 3220126 - RNA, 22 nt, Human
cucggcuggcuccccugcagcc

SEQ ID NO: 3220127 - RNA, 23 nt, Human
cucggcuggcuccccugcagccc

SEQ ID NO: 3220128 - RNA, 16 nt, Human
cucuacagaggccaug

SEQ ID NO: 3220129 - RNA, 14 nt, Human
cucuacagaggcca

SEQ ID NO: 3220130 - RNA, 19 nt, Human
cucuacagaggccaugggc

SEQ ID NO: 3220131 - RNA, 21 nt, Human
cucuacagcuaaucagcauuc

SEQ ID NO: 3220132 - RNA, 13 nt, Human
cucuacagaggcc

SEQ ID NO: 3220133 - RNA, 11 nt, Human
cucuaauuucc

SEQ ID NO: 3220134 - RNA, 11 nt, Human
cucgcuucuuu

SEQ ID NO: 3220135 - RNA, 14 nt, Human
cucggcucacugca

SEQ ID NO: 3220136 - RNA, 15 nt, Human
cucggaguucuucuu

SEQ ID NO: 3220137 - RNA, 17 nt, Human
cucggcucacugcaucc

SEQ ID NO: 3220138 - RNA, 18 nt, Human
cucggcucacugcauccu

SEQ ID NO: 3220139 - RNA, 16 nt, Human
cucggaguucuucuug

SEQ ID NO: 3220140 - RNA, 16 nt, Human
cuccuucacagauggg

SEQ ID NO: 3220141 - RNA, 17 nt, Human
cuccuucacagaugggu

SEQ ID NO: 3220142 - RNA, 14 nt, Human
cuccugugugugcg

SEQ ID NO: 3220143 - RNA, 23 nt, Human
cuccuucaacaaggcuugcugca

SEQ ID NO: 3220144 - RNA, 19 nt, Human
cuccuucacagaugggugc

SEQ ID NO: 3220145 - RNA, 18 nt, Human
cucacuauguugcccagg

SEQ ID NO: 3220146 - RNA, 16 nt, Human
cuccauccuccuccuu

SEQ ID NO: 3220147 - RNA, 18 nt, Human
cuccauccugaggcucca

SEQ ID NO: 3220148 - RNA, 14 nt, Human
cuccaucuccacuc

SEQ ID NO: 3220149 - RNA, 14 nt, Human
cuccauccugaggc

SEQ ID NO: 3220150 - RNA, 16 nt, Human
cuccauccugaggcuc

SEQ ID NO: 3220151 - RNA, 13 nt, Human
cuccaugugggcu

SEQ ID NO: 3220152 - RNA, 17 nt, Human
cucccaaagugcuggga

SEQ ID NO: 3220153 - RNA, 13 nt, Human
cuccaugucucug

SEQ ID NO: 3220154 - RNA, 22 nt, Human
cuccaugucucugagcauuaga

SEQ ID NO: 3220155 - RNA, 19 nt, Human
cuccauccuccuccuuccu

SEQ ID NO: 3220156 - RNA, 17 nt, Human
cuccauccuccuccuuc

SEQ ID NO: 3220157 - RNA, 16 nt, Human
cuccaucuccacucca

SEQ ID NO: 3220158 - RNA, 21 nt, Human
cucccaucucacacaugagca

SEQ ID NO: 3220159 - RNA, 11 nt, Human
cucccaucugu

SEQ ID NO: 3220160 - RNA, 14 nt, Human
cucccaucugugaa

SEQ ID NO: 3220161 - RNA, 15 nt, Human
cucccaucugugaaa

SEQ ID NO: 3220162 - RNA, 18 nt, Human
cucccaucugugaaagga

SEQ ID NO: 3220163 - RNA, 23 nt, Human
cucccaucugugaaaggaaagag

SEQ ID NO: 3220164 - RNA, 16 nt, Human
cucccaacucacccca

SEQ ID NO: 3220165 - RNA, 17 nt, Human
cucccaacucaccccag

SEQ ID NO: 3220166 - RNA, 18 nt, Human
cucccaaagugcugggau

SEQ ID NO: 3220167 - RNA, 22 nt, Human
cucccaaagugcugggauuaca

SEQ ID NO: 3220168 - RNA, 22 nt, Human
cucccaacucaccccagcccca

SEQ ID NO: 3220169 - RNA, 12 nt, Human
cuccccugcugg

SEQ ID NO: 3220170 - RNA, 20 nt, Human
cuccccagccccaucccaaa

SEQ ID NO: 3220171 - RNA, 20 nt, Human
cuccccagcaagugagagcu

SEQ ID NO: 3220172 - RNA, 12 nt, Human
cuccccagcaag

SEQ ID NO: 3220173 - RNA, 23 nt, Human
cuccccaaggcccccugccugcc

SEQ ID NO: 3220174 - RNA, 17 nt, Human
cuccccaaggcccccug

SEQ ID NO: 3220175 - RNA, 22 nt, Human
cuccccaaggcccccugccugc

SEQ ID NO: 3220176 - RNA, 21 nt, Human
cuccccaaggcccccugccug

SEQ ID NO: 3220177 - RNA, 20 nt, Human
cucccaucuuuuguuacucu

SEQ ID NO: 3220178 - RNA, 17 nt, Human
cucccgaguagcuggga

SEQ ID NO: 3220179 - RNA, 16 nt, Human
cucccgaguagcuggg

SEQ ID NO: 3220180 - RNA, 18 nt, Human
cucccgaauagcugggac

SEQ ID NO: 3220181 - RNA, 15 nt, Human
cucccgaguagcugg

SEQ ID NO: 3220182 - RNA, 13 nt, Human
cuccccugcuggg

SEQ ID NO: 3220183 - RNA, 16 nt, Human
cucccgaauagcuggg

SEQ ID NO: 3220184 - RNA, 17 nt, Human
cucccgaauagcuggga

SEQ ID NO: 3220185 - RNA, 18 nt, Human
cucccggcccugccugcu

SEQ ID NO: 3220186 - RNA, 17 nt, Human
cucccggcccugccugc

SEQ ID NO: 3220187 - RNA, 16 nt, Human
cucccggcccugccug

SEQ ID NO: 3220188 - RNA, 15 nt, Human
cucccggcccugccu

SEQ ID NO: 3220189 - RNA, 15 nt, Human
cucccgcuccgggcu

SEQ ID NO: 3220190 - RNA, 17 nt, Human
cucccgcuccgggcucc

SEQ ID NO: 3220191 - RNA, 16 nt, Human
cucccuacuuucuuag

SEQ ID NO: 3220192 - RNA, 20 nt, Human
cucccggcuaugggggcacu

SEQ ID NO: 3220193 - RNA, 15 nt, Human
cucccgggacucugc

SEQ ID NO: 3220194 - RNA, 22 nt, Human
cuccucuccccagcaagugaga

SEQ ID NO: 3220195 - RNA, 14 nt, Human
cuccucccggugcc

SEQ ID NO: 3220196 - RNA, 14 nt, Human
cuccucccucccag

SEQ ID NO: 3220197 - RNA, 13 nt, Human
cuccuccuuccua

SEQ ID NO: 3220198 - RNA, 15 nt, Human
cuccuccuuccuagu

SEQ ID NO: 3220199 - RNA, 14 nt, Human
cuccuccuuccuag

SEQ ID NO: 3220200 - RNA, 17 nt, Human
cuccucccggugcccaa

SEQ ID NO: 3220201 - RNA, 15 nt, Human
cuccucccggugccc

SEQ ID NO: 3220202 - RNA, 22 nt, Human
cuccuccagccgccaugcuccu

SEQ ID NO: 3220203 - RNA, 17 nt, Human
cucccuuucuucccuac

SEQ ID NO: 3220204 - RNA, 18 nt, Human
cucccucagucuggcccu

SEQ ID NO: 3220205 - RNA, 13 nt, Human
cucccucauucca

SEQ ID NO: 3220206 - RNA, 18 nt, Human
cuccgaaaugcugucuuu

SEQ ID NO: 3220207 - RNA, 17 nt, Human
cuccgaaaugcugucuu

SEQ ID NO: 3220208 - RNA, 16 nt, Human
cuccgaaaugcugucu

SEQ ID NO: 3220209 - RNA, 15 nt, Human
cuccgaaaugcuguc

SEQ ID NO: 3220210 - RNA, 16 nt, Human
cuccgccccugagccc

SEQ ID NO: 3220211 - RNA, 15 nt, Human
cuccgccccugagcc

SEQ ID NO: 3220212 - RNA, 14 nt, Human
cuccgccccugagc

SEQ ID NO: 3220213 - RNA, 20 nt, Human
cuccgccccugagcccacug

SEQ ID NO: 3220214 - RNA, 19 nt, Human
cuccgccccugagcccacu

SEQ ID NO: 3220215 - RNA, 18 nt, Human
cuccgccccugagcccac

SEQ ID NO: 3220216 - RNA, 17 nt, Human
cuccgccccugagccca

SEQ ID NO: 3220217 - RNA, 19 nt, Human
cuccugcguguucucagag

SEQ ID NO: 3220218 - RNA, 15 nt, Human
cuccugccucagccu

SEQ ID NO: 3220219 - RNA, 22 nt, Human
cuccugccucgaacuggcugca

SEQ ID NO: 3220220 - RNA, 19 nt, Human
cuccugugugugcgccuac

SEQ ID NO: 3220221 - RNA, 16 nt, Human
cuccugugugugcgcc

SEQ ID NO: 3220222 - RNA, 20 nt, Human
cuccuguggccugccaguca

SEQ ID NO: 3220223 - RNA, 18 nt, Human
cuccuguggccugccagu

SEQ ID NO: 3220224 - RNA, 17 nt, Human
cuccuguggccugccag

SEQ ID NO: 3220225 - RNA, 15 nt, Human
cuccuguggccugcc

SEQ ID NO: 3220226 - RNA, 18 nt, Human
cuccugucuucugcuuug

SEQ ID NO: 3220227 - RNA, 17 nt, Human
cuccugucuucugcuuu

SEQ ID NO: 3220228 - RNA, 16 nt, Human
cuccugucuucugcuu

SEQ ID NO: 3220229 - RNA, 14 nt, Human
cuccugucuucugc

SEQ ID NO: 3220230 - RNA, 13 nt, Human
cuccugucuucug

SEQ ID NO: 3220231 - RNA, 22 nt, Human
cuccuguggaaggcagagaaau

SEQ ID NO: 3220232 - RNA, 11 nt, Human
cuccugcaggc

SEQ ID NO: 3220233 - RNA, 16 nt, Human
cuccugcaggcagcca

SEQ ID NO: 3220234 - RNA, 17 nt, Human
cuccugcaggcagccag

SEQ ID NO: 3220235 - RNA, 14 nt, Human
cuccugauuuuucu

SEQ ID NO: 3220236 - RNA, 22 nt, Human
cuccugaguagcugggauuaca

SEQ ID NO: 3220237 - RNA, 22 nt, Human
cuccugaguugaagucaugcuc

SEQ ID NO: 3220238 - RNA, 14 nt, Human
cuccugccucagcc

SEQ ID NO: 3220239 - RNA, 13 nt, Human
cuccugccucagc

SEQ ID NO: 3220240 - RNA, 11 nt, Human
cuccugcccuu

SEQ ID NO: 3220241 - RNA, 18 nt, Human
cuccugcaggcagccagg

SEQ ID NO: 3220242 - RNA, 20 nt, Human
cuccugcaggcagccaggcc

SEQ ID NO: 3220243 - RNA, 14 nt, Human
cuguaccucugccu

SEQ ID NO: 3220244 - RNA, 15 nt, Human
cuguaucccaugagc

SEQ ID NO: 3220245 - RNA, 14 nt, Human
cuguaucccaugag

SEQ ID NO: 3220246 - RNA, 19 nt, Human
cuguauagcucuuuuccua

SEQ ID NO: 3220247 - RNA, 18 nt, Human
cuguaucccaugagccuc

SEQ ID NO: 3220248 - RNA, 13 nt, Human
cuguauuugaaag

SEQ ID NO: 3220249 - RNA, 14 nt, Human
cuguauuugaaagu

SEQ ID NO: 3220250 - RNA, 16 nt, Human
cuguauuugaaagugc

SEQ ID NO: 3220251 - RNA, 17 nt, Human
cuguauuugaaagugcc

SEQ ID NO: 3220252 - RNA, 19 nt, Human
cuguauuugaaagugccuu

SEQ ID NO: 3220253 - RNA, 20 nt, Human
cuguauuugaaagugccuuu

SEQ ID NO: 3220254 - RNA, 21 nt, Human
cuguauuugaaagugccuuug

SEQ ID NO: 3220255 - RNA, 23 nt, Human
cugucauuugagcagggcucagc

SEQ ID NO: 3220256 - RNA, 15 nt, Human
cuguccaagcagauu

SEQ ID NO: 3220257 - RNA, 22 nt, Human
cugucccagugccgagaaggaa

SEQ ID NO: 3220258 - RNA, 21 nt, Human
cuguccauuuuuauucagggg

SEQ ID NO: 3220259 - RNA, 17 nt, Human
cuguccauuuuuauuca

SEQ ID NO: 3220260 - RNA, 17 nt, Human
cuguccaggcacugcug

SEQ ID NO: 3220261 - RNA, 22 nt, Human
cuguccaggcacugcugcccag

SEQ ID NO: 3220262 - RNA, 21 nt, Human
cuguccaggcacugcugccca

SEQ ID NO: 3220263 - RNA, 20 nt, Human
cuguccaggcacugcugccc

SEQ ID NO: 3220264 - RNA, 19 nt, Human
cuguccaggcacugcugcc

SEQ ID NO: 3220265 - RNA, 18 nt, Human
cuguccaggcacugcugc

SEQ ID NO: 3220266 - RNA, 22 nt, Human
cuguccacccgccccugccccu

SEQ ID NO: 3220267 - RNA, 18 nt, Human
cugucucuacuaaaaaua

SEQ ID NO: 3220268 - RNA, 21 nt, Human
cuguccuacucugugucaggu

SEQ ID NO: 3220269 - RNA, 12 nt, Human
cuguccuaccuu

SEQ ID NO: 3220270 - RNA, 22 nt, Human
cugucucaaaaaaagaaaaaga

SEQ ID NO: 3220271 - RNA, 21 nt, Human
cugucucaagagggcacuggu

SEQ ID NO: 3220272 - RNA, 20 nt, Human
cugucucaagagggcacugg

SEQ ID NO: 3220273 - RNA, 19 nt, Human
cugucucaagagggcacug

SEQ ID NO: 3220274 - RNA, 18 nt, Human
cugucucaagagggcacu

SEQ ID NO: 3220275 - RNA, 13 nt, Human
cugucccccugac

SEQ ID NO: 3220276 - RNA, 14 nt, Human
cugucccccugaca

SEQ ID NO: 3220277 - RNA, 20 nt, Human
cuguccuacucugugucagg

SEQ ID NO: 3220278 - RNA, 18 nt, Human
cuguccuacucuguguca

SEQ ID NO: 3220279 - RNA, 17 nt, Human
cuguccuacucuguguc

SEQ ID NO: 3220280 - RNA, 16 nt, Human
cuguccuacucugugu

SEQ ID NO: 3220281 - RNA, 22 nt, Human
cugucccuuacgugaguccugg

SEQ ID NO: 3220282 - RNA, 13 nt, Human
cuggucagcccaa

SEQ ID NO: 3220283 - RNA, 12 nt, Human
cuggucagccca

SEQ ID NO: 3220284 - RNA, 17 nt, Human
cuggucacuucuucugu

SEQ ID NO: 3220285 - RNA, 16 nt, Human
cuggucacuucuucug

SEQ ID NO: 3220286 - RNA, 21 nt, Human
cugguccauagagagcaagac

SEQ ID NO: 3220287 - RNA, 23 nt, Human
cuggucucaaacucuugaccuca

SEQ ID NO: 3220288 - RNA, 13 nt, Human
cuggucccacuca

SEQ ID NO: 3220289 - RNA, 17 nt, Human
cugguccaucugguuuu

SEQ ID NO: 3220290 - RNA, 15 nt, Human
cuggucacuucuucu

SEQ ID NO: 3220291 - RNA, 23 nt, Human
cuggucacaggacucugccuccu

SEQ ID NO: 3220292 - RNA, 22 nt, Human
cuggucacaggacucugccucc

SEQ ID NO: 3220293 - RNA, 21 nt, Human
cuggucacaggacucugccuc

SEQ ID NO: 3220294 - RNA, 20 nt, Human
cuggucacaggacucugccu

SEQ ID NO: 3220295 - RNA, 19 nt, Human
cuggucacaggacucugcc

SEQ ID NO: 3220296 - RNA, 18 nt, Human
cuggguacuuguggacac

SEQ ID NO: 3220297 - RNA, 14 nt, Human
cuggguacuugugg

SEQ ID NO: 3220298 - RNA, 16 nt, Human
cuggguacuuguggac

SEQ ID NO: 3220299 - RNA, 19 nt, Human
cugggcucccuucccaccu

SEQ ID NO: 3220300 - RNA, 20 nt, Human
cugggcucccuucccaccuc

SEQ ID NO: 3220301 - RNA, 21 nt, Human
cugggcucccuucccaccucu

SEQ ID NO: 3220302 - RNA, 22 nt, Human
cugggcucccuucccaccucuc

SEQ ID NO: 3220303 - RNA, 15 nt, Human
cuggguuggagggug

SEQ ID NO: 3220304 - RNA, 17 nt, Human
cugguuauuuaaaaugu

SEQ ID NO: 3220305 - RNA, 19 nt, Human
cugguucaagcgauucucu

SEQ ID NO: 3220306 - RNA, 20 nt, Human
cugguucaggguuggccccu

SEQ ID NO: 3220307 - RNA, 13 nt, Human
cugguggcagcuc

SEQ ID NO: 3220308 - RNA, 14 nt, Human
cugguggcagcuca

SEQ ID NO: 3220309 - RNA, 12 nt, Human
cugguggcagcu

SEQ ID NO: 3220310 - RNA, 16 nt, Human
cuggucucgaacuccu

SEQ ID NO: 3220311 - RNA, 15 nt, Human
cuguacaugggacua

SEQ ID NO: 3220312 - RNA, 23 nt, Human
cuguacagagcccacgcccccac

SEQ ID NO: 3220313 - RNA, 22 nt, Human
cuguacagagccguaaaaacug

SEQ ID NO: 3220314 - RNA, 21 nt, Human
cuguacagagccguaaaaacu

SEQ ID NO: 3220315 - RNA, 17 nt, Human
cuguaaggcaugaagga

SEQ ID NO: 3220316 - RNA, 16 nt, Human
cuguaaggcaugaagg

SEQ ID NO: 3220317 - RNA, 21 nt, Human
cuggaaucauuguccagagcu

SEQ ID NO: 3220318 - RNA, 14 nt, Human
cuggcaagaaugug

SEQ ID NO: 3220319 - RNA, 23 nt, Human
cuggcaagaaaagaguuaaggca

SEQ ID NO: 3220320 - RNA, 17 nt, Human
cuggcaagaaaagaguu

SEQ ID NO: 3220321 - RNA, 15 nt, Human
cuggcacagggcagu

SEQ ID NO: 3220322 - RNA, 22 nt, Human
cuggcacccggccccugcuggu

SEQ ID NO: 3220323 - RNA, 18 nt, Human
cuggcacccggccccugc

SEQ ID NO: 3220324 - RNA, 17 nt, Human
cuggcacccggccccug

SEQ ID NO: 3220325 - RNA, 16 nt, Human
cuggcacccggccccu

SEQ ID NO: 3220326 - RNA, 22 nt, Human
cuggccagaugcaccagcccuu

SEQ ID NO: 3220327 - RNA, 24 nt, Human
cuggcaugggaaugaaugucagug

SEQ ID NO: 3220328 - RNA, 21 nt, Human
cuggcauggugguugggaccc

SEQ ID NO: 3220329 - RNA, 16 nt, Human
cuggcaugggaaugaa

SEQ ID NO: 3220330 - RNA, 18 nt, Human
cuggcaugggaaugaaug

SEQ ID NO: 3220331 - RNA, 19 nt, Human
cuggcaugggaaugaaugu

SEQ ID NO: 3220332 - RNA, 22 nt, Human
cuggcaugggaaugaaugucag

SEQ ID NO: 3220333 - RNA, 16 nt, Human
cuggcacuauaaugua

SEQ ID NO: 3220334 - RNA, 15 nt, Human
cuggcacuauaaugu

SEQ ID NO: 3220335 - RNA, 19 nt, Human
cuggcacuaccaaaggaca

SEQ ID NO: 3220336 - RNA, 16 nt, Human
cuggccuucggccucc

SEQ ID NO: 3220337 - RNA, 17 nt, Human
cuggccuucggccucca

SEQ ID NO: 3220338 - RNA, 18 nt, Human
cuggccuucggccuccau

SEQ ID NO: 3220339 - RNA, 21 nt, Human
cuggccuucggccuccauccu

SEQ ID NO: 3220340 - RNA, 15 nt, Human
cuggccuucggccuc

SEQ ID NO: 3220341 - RNA, 14 nt, Human
cuggccugugucua

SEQ ID NO: 3220342 - RNA, 16 nt, Human
cuggccuggccccuca

SEQ ID NO: 3220343 - RNA, 17 nt, Human
cuggccuggccccucag

SEQ ID NO: 3220344 - RNA, 15 nt, Human
cuggccugagcuggg

SEQ ID NO: 3220345 - RNA, 18 nt, Human
cuggccugagcugggaug

SEQ ID NO: 3220346 - RNA, 14 nt, Human
cuggccuggccccu

SEQ ID NO: 3220347 - RNA, 13 nt, Human
cuggccuggcccc

SEQ ID NO: 3220348 - RNA, 13 nt, Human
cuggccucugcac

SEQ ID NO: 3220349 - RNA, 14 nt, Human
cuggccucugcacu

SEQ ID NO: 3220350 - RNA, 16 nt, Human
cuggccugagcuggga

SEQ ID NO: 3220351 - RNA, 22 nt, Human
cuggccucaagugauucuccug

SEQ ID NO: 3220352 - RNA, 12 nt, Human
cuggccucugca

SEQ ID NO: 3220353 - RNA, 13 nt, Human
cuggccucucacu

SEQ ID NO: 3220354 - RNA, 20 nt, Human
cuggccucucacugccuccc

SEQ ID NO: 3220355 - RNA, 23 nt, Human
cuggccucaagugauucuccugc

SEQ ID NO: 3220356 - RNA, 15 nt, Human
cuggcccccacaugg

SEQ ID NO: 3220357 - RNA, 14 nt, Human
cuggcccccacaug

SEQ ID NO: 3220358 - RNA, 13 nt, Human
cuggcccccacau

SEQ ID NO: 3220359 - RNA, 19 nt, Human
cugggaggucaaggcugca

SEQ ID NO: 3220360 - RNA, 21 nt, Human
cugggaggucaaggcugcagu

SEQ ID NO: 3220361 - RNA, 16 nt, Human
cugggagccuacccac

SEQ ID NO: 3220362 - RNA, 22 nt, Human
cugggagccuacccacccccag

SEQ ID NO: 3220363 - RNA, 19 nt, Human
cugggagccuacccacccc

SEQ ID NO: 3220364 - RNA, 19 nt, Human
cugggccccaguuguauuu

SEQ ID NO: 3220365 - RNA, 15 nt, Human
cugggccccaguugu

SEQ ID NO: 3220366 - RNA, 20 nt, Human
cugggaucacauguggacuu

SEQ ID NO: 3220367 - RNA, 18 nt, Human
cugggaugauuggagggg

SEQ ID NO: 3220368 - RNA, 20 nt, Human
cugggaucccucauccucau

SEQ ID NO: 3220369 - RNA, 20 nt, Human
cugggauuacaggugugaac

SEQ ID NO: 3220370 - RNA, 16 nt, Human
cugggauuacaggugu

SEQ ID NO: 3220371 - RNA, 18 nt, Human
cugggauuacagguguga

SEQ ID NO: 3220372 - RNA, 17 nt, Human
cugggauuacaggugug

SEQ ID NO: 3220373 - RNA, 23 nt, Human
cugggauuacaggcuccugccac

SEQ ID NO: 3220374 - RNA, 14 nt, Human
cuggcuguccaccc

SEQ ID NO: 3220375 - RNA, 17 nt, Human
cuggcuguuggcugggg

SEQ ID NO: 3220376 - RNA, 16 nt, Human
cuggcuguuggcuggg

SEQ ID NO: 3220377 - RNA, 22 nt, Human
cuggcuggguggcaccagcagc

SEQ ID NO: 3220378 - RNA, 20 nt, Human
cuggcugguuagagguuccc

SEQ ID NO: 3220379 - RNA, 20 nt, Human
cuggccuugugguccaaaua

SEQ ID NO: 3220380 - RNA, 21 nt, Human
cuggccuugugguccaaauag

SEQ ID NO: 3220381 - RNA, 19 nt, Human
cuggcuggccuuguggucc

SEQ ID NO: 3220382 - RNA, 21 nt, Human
cuggcuggccuugugguccaa

SEQ ID NO: 3220383 - RNA, 22 nt, Human
cugggagaaccaaaaagaggcu

SEQ ID NO: 3220384 - RNA, 17 nt, Human
cugggagagccuuccag

SEQ ID NO: 3220385 - RNA, 18 nt, Human
cugggagagccuuccagg

SEQ ID NO: 3220386 - RNA, 19 nt, Human
cugggagagccuuccaggg

SEQ ID NO: 3220387 - RNA, 20 nt, Human
cugggagagccuuccagggg

SEQ ID NO: 3220388 - RNA, 21 nt, Human
cugggagagccuuccaggggu

SEQ ID NO: 3220389 - RNA, 22 nt, Human
cuggcuuucaacuguuucuaga

SEQ ID NO: 3220390 - RNA, 17 nt, Human
cugggaaagcauaaagc

SEQ ID NO: 3220391 - RNA, 23 nt, Human
cuggcuuuucacugcuggcugcc

SEQ ID NO: 3220392 - RNA, 22 nt, Human
cuggcuuuucacugcuggcugc

SEQ ID NO: 3220393 - RNA, 17 nt, Human
cugccagacccccugga

SEQ ID NO: 3220394 - RNA, 19 nt, Human
cugccagacccccuggaga

SEQ ID NO: 3220395 - RNA, 22 nt, Human
cugccaccuccccuugccagcu

SEQ ID NO: 3220396 - RNA, 20 nt, Human
cugccaccuccccuugccag

SEQ ID NO: 3220397 - RNA, 19 nt, Human
cugccaccuccccuugcca

SEQ ID NO: 3220398 - RNA, 18 nt, Human
cugccaccuccccuugcc

SEQ ID NO: 3220399 - RNA, 17 nt, Human
cugccaccuccccuugc

SEQ ID NO: 3220400 - RNA, 12 nt, Human
cugccaccuccc

SEQ ID NO: 3220401 - RNA, 13 nt, Human
cugccaccucccc

SEQ ID NO: 3220402 - RNA, 12 nt, Human
cugccacccugg

SEQ ID NO: 3220403 - RNA, 21 nt, Human
cugccacccuggggagaaagu

SEQ ID NO: 3220404 - RNA, 11 nt, Human
cugccaccucc

SEQ ID NO: 3220405 - RNA, 10 nt, Human
cugccaccuc

SEQ ID NO: 3220406 - RNA, 20 nt, Human
cugcaucaagaugugacaug

SEQ ID NO: 3220407 - RNA, 14 nt, Human
cugcauaucuucau

SEQ ID NO: 3220408 - RNA, 15 nt, Human
cugcauaugaaagga

SEQ ID NO: 3220409 - RNA, 23 nt, Human
cugcauaauucugaaguuauauu

SEQ ID NO: 3220410 - RNA, 22 nt, Human
cugcauaauucugaaguuauau

SEQ ID NO: 3220411 - RNA, 22 nt, Human
cugccaggaagccagcaggcuc

SEQ ID NO: 3220412 - RNA, 15 nt, Human
cugccauccucccaa

SEQ ID NO: 3220413 - RNA, 21 nt, Human
cugccauccagguucagcuug

SEQ ID NO: 3220414 - RNA, 21 nt, Human
cugccagcucuuccuagcugg

SEQ ID NO: 3220415 - RNA, 19 nt, Human
cugccaggaagccagcagg

SEQ ID NO: 3220416 - RNA, 13 nt, Human
cugccaggaagcc

SEQ ID NO: 3220417 - RNA, 14 nt, Human
cugccaggaagcca

SEQ ID NO: 3220418 - RNA, 20 nt, Human
cugccaggaagccagcaggc

SEQ ID NO: 3220419 - RNA, 21 nt, Human
cugccaggaagccagcaggcu

SEQ ID NO: 3220420 - RNA, 12 nt, Human
cugccagcucuu

SEQ ID NO: 3220421 - RNA, 15 nt, Human
cugccagcucuuccu

SEQ ID NO: 3220422 - RNA, 14 nt, Human
cugccagcucuucc

SEQ ID NO: 3220423 - RNA, 19 nt, Human
cugccagcucuuccuagcu

SEQ ID NO: 3220424 - RNA, 17 nt, Human
cugccagcucuuccuag

SEQ ID NO: 3220425 - RNA, 13 nt, Human
cugcccggcaggg

SEQ ID NO: 3220426 - RNA, 18 nt, Human
cugccccuggcagccccu

SEQ ID NO: 3220427 - RNA, 17 nt, Human
cugccccuggcagcccc

SEQ ID NO: 3220428 - RNA, 19 nt, Human
cugccccuggcagccccug

SEQ ID NO: 3220429 - RNA, 20 nt, Human
cugcccggugggggggcaga

SEQ ID NO: 3220430 - RNA, 23 nt, Human
cugcccggugggggggcagagcc

SEQ ID NO: 3220431 - RNA, 21 nt, Human
cugcccggugggggggcagag

SEQ ID NO: 3220432 - RNA, 20 nt, Human
cugcccuaaugcgcaggcug

SEQ ID NO: 3220433 - RNA, 21 nt, Human
cugcccuaaugcgcaggcugg

SEQ ID NO: 3220434 - RNA, 22 nt, Human
cugcccuaaugcgcaggcuggc

SEQ ID NO: 3220435 - RNA, 15 nt, Human
cugccccaaguuuug

SEQ ID NO: 3220436 - RNA, 20 nt, Human
cugcccaggccccugccacc

SEQ ID NO: 3220437 - RNA, 19 nt, Human
cugcccaggccccugccac

SEQ ID NO: 3220438 - RNA, 18 nt, Human
cugcccaggccccugcca

SEQ ID NO: 3220439 - RNA, 16 nt, Human
cugcccaggccccugc

SEQ ID NO: 3220440 - RNA, 15 nt, Human
cugccauuucugaga

SEQ ID NO: 3220441 - RNA, 19 nt, Human
cugcccaaccugcucuccu

SEQ ID NO: 3220442 - RNA, 13 nt, Human
cugccauuucaug

SEQ ID NO: 3220443 - RNA, 16 nt, Human
cugcccacaccuccug

SEQ ID NO: 3220444 - RNA, 17 nt, Human
cugcccacaccuccugg

SEQ ID NO: 3220445 - RNA, 19 nt, Human
cugcccacaccuccugggg

SEQ ID NO: 3220446 - RNA, 20 nt, Human
cugcccacaccuccuggggc

SEQ ID NO: 3220447 - RNA, 15 nt, Human
cugcccaggccccug

SEQ ID NO: 3220448 - RNA, 14 nt, Human
cugcccaggccccu

SEQ ID NO: 3220449 - RNA, 12 nt, Human
cugcccaccugg

SEQ ID NO: 3220450 - RNA, 13 nt, Human
cugcccaggcccc

SEQ ID NO: 3220451 - RNA, 13 nt, Human
cugcaguugccag

SEQ ID NO: 3220452 - RNA, 16 nt, Human
cugcaguugccaguca

SEQ ID NO: 3220453 - RNA, 21 nt, Human
cugcaguuccccuggaagcag

SEQ ID NO: 3220454 - RNA, 15 nt, Human
cugcaguuccccugg

SEQ ID NO: 3220455 - RNA, 20 nt, Human
cugcaguuccccuggaagca

SEQ ID NO: 3220456 - RNA, 17 nt, Human
cugcaguuccccuggaa

SEQ ID NO: 3220457 - RNA, 23 nt, Human
cugcagagcugcgggcugggugu

SEQ ID NO: 3220458 - RNA, 10 nt, Human
cugcagaggg

SEQ ID NO: 3220459 - RNA, 13 nt, Human
cugcagagggcac

SEQ ID NO: 3220460 - RNA, 12 nt, Human
cugcacugucaa

SEQ ID NO: 3220461 - RNA, 18 nt, Human
cugcacuccccugcuggg

SEQ ID NO: 3220462 - RNA, 21 nt, Human
cugcacuccccugcugggugu

SEQ ID NO: 3220463 - RNA, 20 nt, Human
cugcacuccagccuggguga

SEQ ID NO: 3220464 - RNA, 19 nt, Human
cugcacuccagccugggug

SEQ ID NO: 3220465 - RNA, 18 nt, Human
cugcaccgggccacagag

SEQ ID NO: 3220466 - RNA, 13 nt, Human
cugcacuccccug

SEQ ID NO: 3220467 - RNA, 19 nt, Human
cugcacuccccugcugggu

SEQ ID NO: 3220468 - RNA, 20 nt, Human
cugcacuccccugcugggug

SEQ ID NO: 3220469 - RNA, 22 nt, Human
cugaggcccuucucuccagccc

SEQ ID NO: 3220470 - RNA, 23 nt, Human
cugaggcccuucucuccagcccc

SEQ ID NO: 3220471 - RNA, 14 nt, Human
cugcaccggcuggc

SEQ ID NO: 3220472 - RNA, 15 nt, Human
cugcaccggcuggcc

SEQ ID NO: 3220473 - RNA, 15 nt, Human
cugcaccgggccaca

SEQ ID NO: 3220474 - RNA, 14 nt, Human
cugcaccgggccac

SEQ ID NO: 3220475 - RNA, 22 nt, Human
cugcgggcuggguguggucucc

SEQ ID NO: 3220476 - RNA, 22 nt, Human
cugcggggcgggcacaccuccu

SEQ ID NO: 3220477 - RNA, 19 nt, Human
cugcggggcgggcacaccu

SEQ ID NO: 3220478 - RNA, 15 nt, Human
cugcgggucacagga

SEQ ID NO: 3220479 - RNA, 21 nt, Human
cugcgggucacaggagggagg

SEQ ID NO: 3220480 - RNA, 18 nt, Human
cugcggugcuaucucccc

SEQ ID NO: 3220481 - RNA, 19 nt, Human
cugcggugcuaucuccccc

SEQ ID NO: 3220482 - RNA, 23 nt, Human
cugcgguccacccaggagccccg

SEQ ID NO: 3220483 - RNA, 22 nt, Human
cugcgggucacaggagggaggg

SEQ ID NO: 3220484 - RNA, 23 nt, Human
cugcgggucacaggagggagggg

SEQ ID NO: 3220485 - RNA, 20 nt, Human
cugcccugcccaccuggccu

SEQ ID NO: 3220486 - RNA, 17 nt, Human
cugcccugcccaccugg

SEQ ID NO: 3220487 - RNA, 21 nt, Human
cugcccugcccaccuggccuc

SEQ ID NO: 3220488 - RNA, 16 nt, Human
cugccugaagucacac

SEQ ID NO: 3220489 - RNA, 18 nt, Human
cugccugaagucacacag

SEQ ID NO: 3220490 - RNA, 19 nt, Human
cugccugaagucacacagu

SEQ ID NO: 3220491 - RNA, 21 nt, Human
cugccugcaguacuuuaccuc

SEQ ID NO: 3220492 - RNA, 20 nt, Human
cugccugcaguacuuuaccu

SEQ ID NO: 3220493 - RNA, 21 nt, Human
cugccugcccugucaggaggc

SEQ ID NO: 3220494 - RNA, 17 nt, Human
cugccugcccuuugucc

SEQ ID NO: 3220495 - RNA, 18 nt, Human
cugccugccuuaagugag

SEQ ID NO: 3220496 - RNA, 20 nt, Human
cugccugccuuaagugagga

SEQ ID NO: 3220497 - RNA, 22 nt, Human
cugccugccuuaagugaggaaa

SEQ ID NO: 3220498 - RNA, 23 nt, Human
cugccugcccuuuguccuccugc

SEQ ID NO: 3220499 - RNA, 17 nt, Human
cugccugccuuaaguga

SEQ ID NO: 3220500 - RNA, 16 nt, Human
cugcugccucaggaau

SEQ ID NO: 3220501 - RNA, 14 nt, Human
cugcugcaguugcc

SEQ ID NO: 3220502 - RNA, 10 nt, Human
cugcugcagu

SEQ ID NO: 3220503 - RNA, 13 nt, Human
cugcugcaguugc

SEQ ID NO: 3220504 - RNA, 15 nt, Human
cugcucugugcccac

SEQ ID NO: 3220505 - RNA, 12 nt, Human
cugcucugguua

SEQ ID NO: 3220506 - RNA, 16 nt, Human
cugcucuugaacuccu

SEQ ID NO: 3220507 - RNA, 18 nt, Human
cugcucuugaacuccuga

SEQ ID NO: 3220508 - RNA, 19 nt, Human
cugcucuugaacuccugac

SEQ ID NO: 3220509 - RNA, 11 nt, Human
cugcucuugca

SEQ ID NO: 3220510 - RNA, 20 nt, Human
cugcucugaugaagaggagu

SEQ ID NO: 3220511 - RNA, 15 nt, Human
cugcucugccccagc

SEQ ID NO: 3220512 - RNA, 13 nt, Human
cugcucugcccca

SEQ ID NO: 3220513 - RNA, 12 nt, Human
cugcucugcuga

SEQ ID NO: 3220514 - RNA, 11 nt, Human
cugcucugcug

SEQ ID NO: 3220515 - RNA, 11 nt, Human
cugcucugcuc

SEQ ID NO: 3220516 - RNA, 15 nt, Human
cugcucugcucgccu

SEQ ID NO: 3220517 - RNA, 12 nt, Human
cugcucugcucg

SEQ ID NO: 3220518 - RNA, 22 nt, Human
cugcucugccccagcuugggca

SEQ ID NO: 3220519 - RNA, 17 nt, Human
cugcucugccccagcuu

SEQ ID NO: 3220520 - RNA, 15 nt, Human
cugcucuccgaccag

SEQ ID NO: 3220521 - RNA, 20 nt, Human
cugcucucaaaccccugacc

SEQ ID NO: 3220522 - RNA, 22 nt, Human
cugcucucaccuugguuccugg

SEQ ID NO: 3220523 - RNA, 23 nt, Human
cugcucucaaaccccugaccuca

SEQ ID NO: 3220524 - RNA, 20 nt, Human
cugcuccucuccccagcaag

SEQ ID NO: 3220525 - RNA, 19 nt, Human
cugcuccucuccccagcaa

SEQ ID NO: 3220526 - RNA, 23 nt, Human
cugcuccucuccccagcaaguga

SEQ ID NO: 3220527 - RNA, 12 nt, Human
cugcuccugagc

SEQ ID NO: 3220528 - RNA, 14 nt, Human
cugcuccugagccc

SEQ ID NO: 3220529 - RNA, 13 nt, Human
cugcuccugagcc

SEQ ID NO: 3220530 - RNA, 20 nt, Human
cugcggugcuaucuccccca

SEQ ID NO: 3220531 - RNA, 21 nt, Human
cugcggugcuaucucccccag

SEQ ID NO: 3220532 - RNA, 22 nt, Human
cugcggugcuaucucccccagc

SEQ ID NO: 3220533 - RNA, 23 nt, Human
cugcggugcuaucucccccagcc

SEQ ID NO: 3220534 - RNA, 22 nt, Human
cugcuugaggcaacucaucuua

SEQ ID NO: 3220535 - RNA, 20 nt, Human
cugcuugcuugcuuuuuaau

SEQ ID NO: 3220536 - RNA, 13 nt, Human
cugcuugggcuuc

SEQ ID NO: 3220537 - RNA, 15 nt, Human
cugcuugggcuucau

SEQ ID NO: 3220538 - RNA, 17 nt, Human
cugcuugggcuucaucc

SEQ ID NO: 3220539 - RNA, 18 nt, Human
cugcuugggcuucauccu

SEQ ID NO: 3220540 - RNA, 19 nt, Human
cugcuugggcuucauccuc

SEQ ID NO: 3220541 - RNA, 18 nt, Human
cugcuuggcccagggggc

SEQ ID NO: 3220542 - RNA, 16 nt, Human
cugcuuggcccagggg

SEQ ID NO: 3220543 - RNA, 23 nt, Human
cugcuuggcccagggggcuuccu

SEQ ID NO: 3220544 - RNA, 14 nt, Human
cugcuuggcccagg

SEQ ID NO: 3220545 - RNA, 15 nt, Human
cugcuuggcccaggg

SEQ ID NO: 3220546 - RNA, 19 nt, Human
cugcuugugaaaggaaaga

SEQ ID NO: 3220547 - RNA, 20 nt, Human
cugcuuuagacuugaaaaga

SEQ ID NO: 3220548 - RNA, 17 nt, Human
cugcuuuagacuugaaa

SEQ ID NO: 3220549 - RNA, 19 nt, Human
cugcuuuagacuugaaaag

SEQ ID NO: 3220550 - RNA, 14 nt, Human
cugcuuuagacuug

SEQ ID NO: 3220551 - RNA, 16 nt, Human
cugcuuuagacuugaa

SEQ ID NO: 3220552 - RNA, 13 nt, Human
cugcuuuaaucag

SEQ ID NO: 3220553 - RNA, 13 nt, Human
cugcuuuggaaau

SEQ ID NO: 3220554 - RNA, 16 nt, Human
cugcuuugggcugccc

SEQ ID NO: 3220555 - RNA, 15 nt, Human
cugcuuuuggucugu

SEQ ID NO: 3220556 - RNA, 17 nt, Human
cugcuuuuggucugugu

SEQ ID NO: 3220557 - RNA, 13 nt, Human
cuggaaggaggaa

SEQ ID NO: 3220558 - RNA, 14 nt, Human
cuggaaggaggaag

SEQ ID NO: 3220559 - RNA, 22 nt, Human
cuggaaggaggaagaauagggc

SEQ ID NO: 3220560 - RNA, 13 nt, Human
cugcuugaggcaa

SEQ ID NO: 3220561 - RNA, 20 nt, Human
cugcuugaggcaacucaucu

SEQ ID NO: 3220562 - RNA, 21 nt, Human
cugcuugaggcaacucaucuu

SEQ ID NO: 3220563 - RNA, 22 nt, Human
cugcuugaauaaacaccacugg

SEQ ID NO: 3220564 - RNA, 19 nt, Human
cugcuucugacauaaucca

SEQ ID NO: 3220565 - RNA, 19 nt, Human
cugcuucucugcccagcuu

SEQ ID NO: 3220566 - RNA, 23 nt, Human
cugcuggugggcuugucauagcc

SEQ ID NO: 3220567 - RNA, 18 nt, Human
cugcugucauugcuucuu

SEQ ID NO: 3220568 - RNA, 16 nt, Human
cugcugucauugcuuc

SEQ ID NO: 3220569 - RNA, 22 nt, Human
cugcugucauugcuucuucuga

SEQ ID NO: 3220570 - RNA, 20 nt, Human
cugcugucauugcuucuucu

SEQ ID NO: 3220571 - RNA, 19 nt, Human
cugcugucauugcuucuuc

SEQ ID NO: 3220572 - RNA, 17 nt, Human
cugcuuccuuucuugau

SEQ ID NO: 3220573 - RNA, 16 nt, Human
cugcuuccuuucuuga

SEQ ID NO: 3220574 - RNA, 17 nt, Human
cugcuggguguggcgca

SEQ ID NO: 3220575 - RNA, 17 nt, Human
cugcuggucacuucuuc

SEQ ID NO: 3220576 - RNA, 17 nt, Human
cugcuggucagcacucc

SEQ ID NO: 3220577 - RNA, 20 nt, Human
cugcuggucacuucuucugu

SEQ ID NO: 3220578 - RNA, 19 nt, Human
cugcuggucacuucuucug

SEQ ID NO: 3220579 - RNA, 18 nt, Human
cugcuggucacuucuucu

SEQ ID NO: 3220580 - RNA, 14 nt, Human
cugcuggguguggc

SEQ ID NO: 3220581 - RNA, 15 nt, Human
cugcuggguguggcg

SEQ ID NO: 3220582 - RNA, 12 nt, Human
cugcugcuggcu

SEQ ID NO: 3220583 - RNA, 13 nt, Human
cugcugcuggcug

SEQ ID NO: 3220584 - RNA, 20 nt, Human
cugcugggcuccacuuggcu

SEQ ID NO: 3220585 - RNA, 12 nt, Human
cugcuggcugcc

SEQ ID NO: 3220586 - RNA, 15 nt, Human
cugcuggcugccuua

SEQ ID NO: 3220587 - RNA, 14 nt, Human
cugcuggcugccuu

SEQ ID NO: 3220588 - RNA, 13 nt, Human
cugcuggcugccu

SEQ ID NO: 3220589 - RNA, 18 nt, Human
gaagcauuuacuuugugu

SEQ ID NO: 3220590 - RNA, 23 nt, Human
gaagauuguuuaucuagauguaa

SEQ ID NO: 3220591 - RNA, 16 nt, Human
gaagauuguuuaucua

SEQ ID NO: 3220592 - RNA, 13 nt, Human
gaagauuguuuau

SEQ ID NO: 3220593 - RNA, 18 nt, Human
gaagauggauaugaccag

SEQ ID NO: 3220594 - RNA, 16 nt, Human
gaagagugaaauacca

SEQ ID NO: 3220595 - RNA, 14 nt, Human
gaagaguauggauu

SEQ ID NO: 3220596 - RNA, 14 nt, Human
gaagagugaaauac

SEQ ID NO: 3220597 - RNA, 13 nt, Human
gaagagugaaaua

SEQ ID NO: 3220598 - RNA, 22 nt, Human
gaagaguggcagcuauaggaaa

SEQ ID NO: 3220599 - RNA, 21 nt, Human
gaagauagucuuggaagcugu

SEQ ID NO: 3220600 - RNA, 17 nt, Human
gaagaucuuugggcaua

SEQ ID NO: 3220601 - RNA, 13 nt, Human
gaagaaguguguc

SEQ ID NO: 3220602 - RNA, 15 nt, Human
gaagacuucaucccu

SEQ ID NO: 3220603 - RNA, 16 nt, Human
gaagacuucaucccuc

SEQ ID NO: 3220604 - RNA, 12 nt, Human
gaagagccuugc

SEQ ID NO: 3220605 - RNA, 13 nt, Human
gaagacuucaaaa

SEQ ID NO: 3220606 - RNA, 12 nt, Human
gaagaauaauuu

SEQ ID NO: 3220607 - RNA, 23 nt, Human
gaagagccccacucucagaggcc

SEQ ID NO: 3220608 - RNA, 17 nt, Human
gaagacuucaucccucu

SEQ ID NO: 3220609 - RNA, 20 nt, Human
gaagagccccacucucagag

SEQ ID NO: 3220610 - RNA, 17 nt, Human
gaagagucuauugucuc

SEQ ID NO: 3220611 - RNA, 23 nt, Human
gaagagcuguucacagccagacu

SEQ ID NO: 3220612 - RNA, 17 nt, Human
gaagagcuuagaaacug

SEQ ID NO: 3220613 - RNA, 14 nt, Human
gaagagcuuagaaa

SEQ ID NO: 3220614 - RNA, 20 nt, Human
gaagagcuguugaugggaug

SEQ ID NO: 3220615 - RNA, 15 nt, Human
gaagagcuggggaga

SEQ ID NO: 3220616 - RNA, 13 nt, Human
gaagagcuguuca

SEQ ID NO: 3220617 - RNA, 16 nt, Human
gaagagcuagagaaau

SEQ ID NO: 3220618 - RNA, 20 nt, Human
gaagagcuguucacagccag

SEQ ID NO: 3220619 - RNA, 15 nt, Human
gaagagcuguucaca

SEQ ID NO: 3220620 - RNA, 22 nt, Human
gaacuugaagccugcuccuucc

SEQ ID NO: 3220621 - RNA, 21 nt, Human
gaacuugaagccugcuccuuc

SEQ ID NO: 3220622 - RNA, 19 nt, Human
gaacuuggugccuaauguu

SEQ ID NO: 3220623 - RNA, 17 nt, Human
gaacuugggccacugug

SEQ ID NO: 3220624 - RNA, 18 nt, Human
gaacuuggcgcugccccu

SEQ ID NO: 3220625 - RNA, 17 nt, Human
gaacuuuccaggaaggc

SEQ ID NO: 3220626 - RNA, 15 nt, Human
gaacuuguuuucugg

SEQ ID NO: 3220627 - RNA, 14 nt, Human
gaacuuguuuaaua

SEQ ID NO: 3220628 - RNA, 20 nt, Human
gaagaaagaacuaucuucau

SEQ ID NO: 3220629 - RNA, 12 nt, Human
gaagaaagaugu

SEQ ID NO: 3220630 - RNA, 12 nt, Human
gaagaaagccug

SEQ ID NO: 3220631 - RNA, 14 nt, Human
gaagaagcucucuc

SEQ ID NO: 3220632 - RNA, 21 nt, Human
gaagaaauguaguuuacauuu

SEQ ID NO: 3220633 - RNA, 15 nt, Human
gaacucccuuucaac

SEQ ID NO: 3220634 - RNA, 15 nt, Human
gaacuccuaaaucaa

SEQ ID NO: 3220635 - RNA, 16 nt, Human
gaacucccuuucaaca

SEQ ID NO: 3220636 - RNA, 13 nt, Human
gaacuccugaccu

SEQ ID NO: 3220637 - RNA, 16 nt, Human
gaacuccuaaaucaag

SEQ ID NO: 3220638 - RNA, 13 nt, Human
gaacuguuguaua

SEQ ID NO: 3220639 - RNA, 18 nt, Human
gaaccacaucuugcucug

SEQ ID NO: 3220640 - RNA, 19 nt, Human
gaaccaauaaaauaauuuu

SEQ ID NO: 3220641 - RNA, 17 nt, Human
gaacuuggcgcugcccc

SEQ ID NO: 3220642 - RNA, 19 nt, Human
gaacuugaagccugcuccu

SEQ ID NO: 3220643 - RNA, 18 nt, Human
gaacuugaagccugcucc

SEQ ID NO: 3220644 - RNA, 16 nt, Human
gaacuugaagccugcu

SEQ ID NO: 3220645 - RNA, 20 nt, Human
gaacuguuguauaaauuuau

SEQ ID NO: 3220646 - RNA, 16 nt, Human
gaacuguuguauaaau

SEQ ID NO: 3220647 - RNA, 15 nt, Human
gaacuguuguauaaa

SEQ ID NO: 3220648 - RNA, 14 nt, Human
gaacuguuguauaa

SEQ ID NO: 3220649 - RNA, 15 nt, Human
gaacuguuagaaugu

SEQ ID NO: 3220650 - RNA, 23 nt, Human
gaaggaaccaaagcgaauuuuaa

SEQ ID NO: 3220651 - RNA, 19 nt, Human
gaaggaagacuucaucccu

SEQ ID NO: 3220652 - RNA, 15 nt, Human
gaaggaacguccccu

SEQ ID NO: 3220653 - RNA, 21 nt, Human
gaaggaaacccagcucugguc

SEQ ID NO: 3220654 - RNA, 22 nt, Human
gaaggaaacccagcucuggucc

SEQ ID NO: 3220655 - RNA, 21 nt, Human
gaaggacauugcggacagcca

SEQ ID NO: 3220656 - RNA, 20 nt, Human
gaaggacauugcggacagcc

SEQ ID NO: 3220657 - RNA, 19 nt, Human
gaaggacauugcggacagc

SEQ ID NO: 3220658 - RNA, 22 nt, Human
gaaggaauaaauugcuccuuga

SEQ ID NO: 3220659 - RNA, 22 nt, Human
gaaggacccggaggggccuggc

SEQ ID NO: 3220660 - RNA, 18 nt, Human
gaagccgcuggggccagu

SEQ ID NO: 3220661 - RNA, 20 nt, Human
gaagccgcuggggccaguug

SEQ ID NO: 3220662 - RNA, 14 nt, Human
gaagccgcuggggc

SEQ ID NO: 3220663 - RNA, 19 nt, Human
gaaggaaacccagcucugg

SEQ ID NO: 3220664 - RNA, 20 nt, Human
gaaggaaacccagcucuggu

SEQ ID NO: 3220665 - RNA, 15 nt, Human
gaagcuguuuggaaa

SEQ ID NO: 3220666 - RNA, 18 nt, Human
gaagcuguuuggaaaaga

SEQ ID NO: 3220667 - RNA, 15 nt, Human
gaagccugcuccuuc

SEQ ID NO: 3220668 - RNA, 16 nt, Human
gaaggaugccaagaag

SEQ ID NO: 3220669 - RNA, 23 nt, Human
gaaggagggggugaccuccggcc

SEQ ID NO: 3220670 - RNA, 12 nt, Human
gaaggaggccac

SEQ ID NO: 3220671 - RNA, 16 nt, Human
gaaggaggccaccucc

SEQ ID NO: 3220672 - RNA, 15 nt, Human
gaaggaggccaccuc

SEQ ID NO: 3220673 - RNA, 20 nt, Human
gaaggaggcuccaggcagca

SEQ ID NO: 3220674 - RNA, 19 nt, Human
gaaggaggcuccaggcagc

SEQ ID NO: 3220675 - RNA, 17 nt, Human
gaaggaggccaccuccu

SEQ ID NO: 3220676 - RNA, 18 nt, Human
gaaggaggcuccaggcag

SEQ ID NO: 3220677 - RNA, 17 nt, Human
gaaggauuauggaaaaa

SEQ ID NO: 3220678 - RNA, 18 nt, Human
gaaggcagggagggccug

SEQ ID NO: 3220679 - RNA, 20 nt, Human
gaaggcagggagggccuggg

SEQ ID NO: 3220680 - RNA, 22 nt, Human
gaaggcagggagggccugggcc

SEQ ID NO: 3220681 - RNA, 23 nt, Human
gaaggcagggagggccugggccc

SEQ ID NO: 3220682 - RNA, 13 nt, Human
gaaggauuugugu

SEQ ID NO: 3220683 - RNA, 13 nt, Human
gaagggggcuggg

SEQ ID NO: 3220684 - RNA, 19 nt, Human
gaagguagcauucuuugga

SEQ ID NO: 3220685 - RNA, 18 nt, Human
gaagguauuaagauuaua

SEQ ID NO: 3220686 - RNA, 15 nt, Human
gaaggucauuuccau

SEQ ID NO: 3220687 - RNA, 14 nt, Human
gaaggucauuucca

SEQ ID NO: 3220688 - RNA, 18 nt, Human
gaaguaacuggugauaua

SEQ ID NO: 3220689 - RNA, 17 nt, Human
gaaggugauaagggaaa

SEQ ID NO: 3220690 - RNA, 19 nt, Human
gaaggugauaagggaaaag

SEQ ID NO: 3220691 - RNA, 23 nt, Human
gaaggugauaagggaaaagauaa

SEQ ID NO: 3220692 - RNA, 13 nt, Human
gaagucacacagu

SEQ ID NO: 3220693 - RNA, 19 nt, Human
gaaguaacuggugauauau

SEQ ID NO: 3220694 - RNA, 18 nt, Human
gaagucuuagauguauau

SEQ ID NO: 3220695 - RNA, 15 nt, Human
gaagucuucaugaaa

SEQ ID NO: 3220696 - RNA, 15 nt, Human
gaagucacugcacag

SEQ ID NO: 3220697 - RNA, 15 nt, Human
gaacacuccuucaca

SEQ ID NO: 3220698 - RNA, 16 nt, Human
gaacacuccuucacag

SEQ ID NO: 3220699 - RNA, 19 nt, Human
gaacagacuggaagcacag

SEQ ID NO: 3220700 - RNA, 20 nt, Human
gaacagacuggaagcacagc

SEQ ID NO: 3220701 - RNA, 17 nt, Human
gaacacuccuucacaga

SEQ ID NO: 3220702 - RNA, 11 nt, Human
gaaccaaagcg

SEQ ID NO: 3220703 - RNA, 23 nt, Human
gaaccaaagcgaauuuuaaaaga

SEQ ID NO: 3220704 - RNA, 20 nt, Human
gaaccaaagcgaauuuuaaa

SEQ ID NO: 3220705 - RNA, 17 nt, Human
gaacaguuuaugcagug

SEQ ID NO: 3220706 - RNA, 23 nt, Human
gaacaguuuaugcagugcugcuu

SEQ ID NO: 3220707 - RNA, 21 nt, Human
gaacagguuuuuuuguuuguu

SEQ ID NO: 3220708 - RNA, 16 nt, Human
gaacagguucacguga

SEQ ID NO: 3220709 - RNA, 22 nt, Human
gaacagacuggaagcacagcuu

SEQ ID NO: 3220710 - RNA, 22 nt, Human
gaacagcuguugacucuaguac

SEQ ID NO: 3220711 - RNA, 17 nt, Human
gaacagcuguugacucu

SEQ ID NO: 3220712 - RNA, 12 nt, Human
gaacagcuguug

SEQ ID NO: 3220713 - RNA, 19 nt, Human
gaaauaucugaaaauguau

SEQ ID NO: 3220714 - RNA, 18 nt, Human
gaaauaucugaaaaugua

SEQ ID NO: 3220715 - RNA, 22 nt, Human
gaaauaaaccuuaauauuucuu

SEQ ID NO: 3220716 - RNA, 12 nt, Human
gaaauaaaagcu

SEQ ID NO: 3220717 - RNA, 15 nt, Human
gaaauaucaucacgu

SEQ ID NO: 3220718 - RNA, 21 nt, Human
gaaauaucaucacguauguua

SEQ ID NO: 3220719 - RNA, 22 nt, Human
gaaauaucaucacguauguuau

SEQ ID NO: 3220720 - RNA, 23 nt, Human
gaaauauauggucuaauguuuaa

SEQ ID NO: 3220721 - RNA, 24 nt, Human
gaaauauauggucuaauguuuaag

SEQ ID NO: 3220722 - RNA, 13 nt, Human
gaaauauauguga

SEQ ID NO: 3220723 - RNA, 14 nt, Human
gaaauauaugugaa

SEQ ID NO: 3220724 - RNA, 20 nt, Human
gaaauauauuacuuaacugu

SEQ ID NO: 3220725 - RNA, 22 nt, Human
gaaauauauggucuaauguuua

SEQ ID NO: 3220726 - RNA, 20 nt, Human
gaaauauauggucuaauguu

SEQ ID NO: 3220727 - RNA, 22 nt, Human
gaaauguaagggaaacugccag

SEQ ID NO: 3220728 - RNA, 14 nt, Human
gaaaugcugauuua

SEQ ID NO: 3220729 - RNA, 22 nt, Human
gaaaugcugauuuaaacuucuu

SEQ ID NO: 3220730 - RNA, 17 nt, Human
gaaaugggcagagcaga

SEQ ID NO: 3220731 - RNA, 19 nt, Human
gaaaugggcagagcagaga

SEQ ID NO: 3220732 - RNA, 16 nt, Human
gaaaugucccuuucuu

SEQ ID NO: 3220733 - RNA, 15 nt, Human
gaaaugucccuuucu

SEQ ID NO: 3220734 - RNA, 13 nt, Human
gaaauguguguga

SEQ ID NO: 3220735 - RNA, 20 nt, Human
gaaaugucccuuucuucucc

SEQ ID NO: 3220736 - RNA, 18 nt, Human
gaaaugucccuuucuucu

SEQ ID NO: 3220737 - RNA, 17 nt, Human
gaaaugucccuuucuuc

SEQ ID NO: 3220738 - RNA, 23 nt, Human
gaaaugugugugaugugacauuu

SEQ ID NO: 3220739 - RNA, 21 nt, Human
gaaaugugugugaugugacau

SEQ ID NO: 3220740 - RNA, 20 nt, Human
gaaaugugugugaugugaca

SEQ ID NO: 3220741 - RNA, 19 nt, Human
gaaaugugugugaugugac

SEQ ID NO: 3220742 - RNA, 18 nt, Human
gaaaugugugugauguga

SEQ ID NO: 3220743 - RNA, 16 nt, Human
gaaaugugugugaugu

SEQ ID NO: 3220744 - RNA, 16 nt, Human
gaaaugggcagagcag

SEQ ID NO: 3220745 - RNA, 15 nt, Human
gaaaugggcagagca

SEQ ID NO: 3220746 - RNA, 17 nt, Human
gaaaugcuaugucauuu

SEQ ID NO: 3220747 - RNA, 22 nt, Human
gaaaugcugacccaugggcagg

SEQ ID NO: 3220748 - RNA, 14 nt, Human
gaaaugcugaccca

SEQ ID NO: 3220749 - RNA, 14 nt, Human
gaaaugcugaaaau

SEQ ID NO: 3220750 - RNA, 22 nt, Human
gaaaugcuaugucauuucaugu

SEQ ID NO: 3220751 - RNA, 21 nt, Human
gaaaugcuaugucauuucaug

SEQ ID NO: 3220752 - RNA, 20 nt, Human
gaaaugcuaugucauuucau

SEQ ID NO: 3220753 - RNA, 19 nt, Human
gaaaugcuaugucauuuca

SEQ ID NO: 3220754 - RNA, 18 nt, Human
gaaaugcuaugucauuuc

SEQ ID NO: 3220755 - RNA, 11 nt, Human
gaaaugagcug

SEQ ID NO: 3220756 - RNA, 18 nt, Human
gaaaugaggucagagccu

SEQ ID NO: 3220757 - RNA, 13 nt, Human
gaaacuauguguu

SEQ ID NO: 3220758 - RNA, 14 nt, Human
gaaacuauguguuu

SEQ ID NO: 3220759 - RNA, 17 nt, Human
gaaacuauguguuuuuc

SEQ ID NO: 3220760 - RNA, 18 nt, Human
gaaacuauguguuuuucu

SEQ ID NO: 3220761 - RNA, 19 nt, Human
gaaacuauguguuuuucuc

SEQ ID NO: 3220762 - RNA, 20 nt, Human
gaaacuauguguuuuucuca

SEQ ID NO: 3220763 - RNA, 21 nt, Human
gaaacuauguguuuuucucau

SEQ ID NO: 3220764 - RNA, 15 nt, Human
gaaacugccagcaac

SEQ ID NO: 3220765 - RNA, 13 nt, Human
gaaacugccagca

SEQ ID NO: 3220766 - RNA, 16 nt, Human
gaaaaaugagccuggc

SEQ ID NO: 3220767 - RNA, 16 nt, Human
gaaaaagcaaaaggca

SEQ ID NO: 3220768 - RNA, 20 nt, Human
gaaaccuuuucuuguaucug

SEQ ID NO: 3220769 - RNA, 17 nt, Human
gaaaaauuauugagcca

SEQ ID NO: 3220770 - RNA, 16 nt, Human
gaaaaauguuaggaca

SEQ ID NO: 3220771 - RNA, 22 nt, Human
gaaaaauucaauaguaauauaa

SEQ ID NO: 3220772 - RNA, 20 nt, Human
gaaaaauucaauaguaauau

SEQ ID NO: 3220773 - RNA, 14 nt, Human
gaaaaauguuagga

SEQ ID NO: 3220774 - RNA, 19 nt, Human
gaaagacuauucaaacagu

SEQ ID NO: 3220775 - RNA, 16 nt, Human
gaaacugacuugcugu

SEQ ID NO: 3220776 - RNA, 17 nt, Human
gaaagacuauucaaaca

SEQ ID NO: 3220777 - RNA, 23 nt, Human
gaaagacuauucaaacagucuca

SEQ ID NO: 3220778 - RNA, 22 nt, Human
gaaagacuauucaaacagucuc

SEQ ID NO: 3220779 - RNA, 13 nt, Human
gaaagcagaacag

SEQ ID NO: 3220780 - RNA, 23 nt, Human
gaaagauggcugugccucugccu

SEQ ID NO: 3220781 - RNA, 19 nt, Human
gaaagaugguuaaacauuu

SEQ ID NO: 3220782 - RNA, 16 nt, Human
gaaagaucaaaagguu

SEQ ID NO: 3220783 - RNA, 22 nt, Human
gaaagauggcugugccucugcc

SEQ ID NO: 3220784 - RNA, 16 nt, Human
gaaagaguaggaagac

SEQ ID NO: 3220785 - RNA, 16 nt, Human
gaaagagauuuaaacu

SEQ ID NO: 3220786 - RNA, 13 nt, Human
gaaagagauuuaa

SEQ ID NO: 3220787 - RNA, 17 nt, Human
gaaaguuaacauuaaug

SEQ ID NO: 3220788 - RNA, 21 nt, Human
gaaaguguucuguuacaaaau

SEQ ID NO: 3220789 - RNA, 19 nt, Human
gaaaguguucuguuacaaa

SEQ ID NO: 3220790 - RNA, 18 nt, Human
gaaaguguucuguuacaa

SEQ ID NO: 3220791 - RNA, 17 nt, Human
gaaaguguucuguuaca

SEQ ID NO: 3220792 - RNA, 16 nt, Human
gaaaguguucuguuac

SEQ ID NO: 3220793 - RNA, 15 nt, Human
gaaaguguucuguua

SEQ ID NO: 3220794 - RNA, 14 nt, Human
gaaaguguucuguu

SEQ ID NO: 3220795 - RNA, 14 nt, Human
gaaaguuuacagga

SEQ ID NO: 3220796 - RNA, 16 nt, Human
gaaaguuuacaggaaa

SEQ ID NO: 3220797 - RNA, 14 nt, Human
gaaauaaaaagagu

SEQ ID NO: 3220798 - RNA, 13 nt, Human
gaaaguguucugu

SEQ ID NO: 3220799 - RNA, 18 nt, Human
gaaagugccuuugcagcu

SEQ ID NO: 3220800 - RNA, 20 nt, Human
gaaagugccuuugcagcuca

SEQ ID NO: 3220801 - RNA, 15 nt, Human
gaaagugccuuugca

SEQ ID NO: 3220802 - RNA, 23 nt, Human
gaaagugccuuugcagcucagaa

SEQ ID NO: 3220803 - RNA, 21 nt, Human
gaaagcuugcccuggugccuc

SEQ ID NO: 3220804 - RNA, 11 nt, Human
gaaaggaaaga

SEQ ID NO: 3220805 - RNA, 16 nt, Human
gaaaggaaagaggcuc

SEQ ID NO: 3220806 - RNA, 20 nt, Human
gaaagcacagaggccuccug

SEQ ID NO: 3220807 - RNA, 22 nt, Human
gaaaguacuucuccacccugcu

SEQ ID NO: 3220808 - RNA, 15 nt, Human
gaaaggagaguacuu

SEQ ID NO: 3220809 - RNA, 22 nt, Human
gaaaggaguuucuuuagcugac

SEQ ID NO: 3220810 - RNA, 10 nt, Human
gaaagucaga

SEQ ID NO: 3220811 - RNA, 21 nt, Human
gaaagucagaaucagaagaua

SEQ ID NO: 3220812 - RNA, 16 nt, Human
gaaaggaccugcaaac

SEQ ID NO: 3220813 - RNA, 12 nt, Human
gaaaggaaaaga

SEQ ID NO: 3220814 - RNA, 14 nt, Human
gaaaggaaaagaaa

SEQ ID NO: 3220815 - RNA, 13 nt, Human
gaaaggaaaccuu

SEQ ID NO: 3220816 - RNA, 14 nt, Human
gaaaggaaaccuuu

SEQ ID NO: 3220817 - RNA, 15 nt, Human
gaaaggaaaccuuuu

SEQ ID NO: 3220818 - RNA, 21 nt, Human
gaaagcuuuguugaaagaaag

SEQ ID NO: 3220819 - RNA, 20 nt, Human
gaaagcuuuguugaaagaaa

SEQ ID NO: 3220820 - RNA, 15 nt, Human
cuuucuucaaaauau

SEQ ID NO: 3220821 - RNA, 23 nt, Human
cuuucuuaauauuuuuacaugca

SEQ ID NO: 3220822 - RNA, 21 nt, Human
cuuucuuaauauuuuuacaug

SEQ ID NO: 3220823 - RNA, 17 nt, Human
cuuuccugaggcugggc

SEQ ID NO: 3220824 - RNA, 16 nt, Human
cuuuccugaggcuggg

SEQ ID NO: 3220825 - RNA, 20 nt, Human
cuuuccugaggcugggcucc

SEQ ID NO: 3220826 - RNA, 16 nt, Human
cuuucuuucuuucuuu

SEQ ID NO: 3220827 - RNA, 18 nt, Human
cuuugaagagugaaauac

SEQ ID NO: 3220828 - RNA, 23 nt, Human
cuuugaaauauauggucuaaugu

SEQ ID NO: 3220829 - RNA, 19 nt, Human
cuuuggaaagaguaggaag

SEQ ID NO: 3220830 - RNA, 23 nt, Human
cuuugcccccaaacccccauucu

SEQ ID NO: 3220831 - RNA, 23 nt, Human
cuuuggaaagaguaggaagacuu

SEQ ID NO: 3220832 - RNA, 19 nt, Human
cuuuggaaaguagaaaagc

SEQ ID NO: 3220833 - RNA, 21 nt, Human
cuuugcccuuuacuugucuuu

SEQ ID NO: 3220834 - RNA, 14 nt, Human
cuuugccaucucug

SEQ ID NO: 3220835 - RNA, 12 nt, Human
cuuugccaucuc

SEQ ID NO: 3220836 - RNA, 15 nt, Human
cuuugccaugugcuu

SEQ ID NO: 3220837 - RNA, 19 nt, Human
cuuugccaucucugcucca

SEQ ID NO: 3220838 - RNA, 18 nt, Human
cuuugccaucucugcucc

SEQ ID NO: 3220839 - RNA, 17 nt, Human
cuuugcacuuuuucuua

SEQ ID NO: 3220840 - RNA, 22 nt, Human
cuuugcacuuuuucuuaaucau

SEQ ID NO: 3220841 - RNA, 15 nt, Human
cuuugcagacaggca

SEQ ID NO: 3220842 - RNA, 14 nt, Human
cuuugcagacaggc

SEQ ID NO: 3220843 - RNA, 11 nt, Human
cuuugaauuuu

SEQ ID NO: 3220844 - RNA, 13 nt, Human
cuuugaauuuuca

SEQ ID NO: 3220845 - RNA, 15 nt, Human
cuuugaauuuucauu

SEQ ID NO: 3220846 - RNA, 14 nt, Human
cuuugaauuuucau

SEQ ID NO: 3220847 - RNA, 18 nt, Human
cuuugaauuuucauuuua

SEQ ID NO: 3220848 - RNA, 20 nt, Human
cuuuccaaagccaaugugaa

SEQ ID NO: 3220849 - RNA, 23 nt, Human
cuuuccaaagccaaugugaacag

SEQ ID NO: 3220850 - RNA, 15 nt, Human
cuuuccaccuucuca

SEQ ID NO: 3220851 - RNA, 18 nt, Human
cuuuccacuccuccuagc

SEQ ID NO: 3220852 - RNA, 21 nt, Human
cuuuccacuccuccuagccac

SEQ ID NO: 3220853 - RNA, 14 nt, Human
cuuuccaggaaggc

SEQ ID NO: 3220854 - RNA, 21 nt, Human
cuuuccgguguuuaagacauu

SEQ ID NO: 3220855 - RNA, 22 nt, Human
cuuuccuacuugcacucuucua

SEQ ID NO: 3220856 - RNA, 15 nt, Human
cuuuccccaugucuc

SEQ ID NO: 3220857 - RNA, 20 nt, Human
cuuuccccaugucucgacuc

SEQ ID NO: 3220858 - RNA, 21 nt, Human
cuuuccccaugucucgacuca

SEQ ID NO: 3220859 - RNA, 16 nt, Human
cuuucaagaucuaaau

SEQ ID NO: 3220860 - RNA, 17 nt, Human
cuuucaagaucuaaauc

SEQ ID NO: 3220861 - RNA, 19 nt, Human
cuuucaagggcuuuccugu

SEQ ID NO: 3220862 - RNA, 17 nt, Human
cuuuauuuuuuugaacu

SEQ ID NO: 3220863 - RNA, 20 nt, Human
cuuuauuuuuuugaacucuu

SEQ ID NO: 3220864 - RNA, 14 nt, Human
cuuucaacucauug

SEQ ID NO: 3220865 - RNA, 15 nt, Human
cuuucaagaacuugu

SEQ ID NO: 3220866 - RNA, 13 nt, Human
cuuucaagaacuu

SEQ ID NO: 3220867 - RNA, 17 nt, Human
cuuucaagaacuuguuu

SEQ ID NO: 3220868 - RNA, 16 nt, Human
cuuucaagaacuuguu

SEQ ID NO: 3220869 - RNA, 14 nt, Human
cuuuggaguuaaaa

SEQ ID NO: 3220870 - RNA, 17 nt, Human
cuuuggaguuaaaaugc

SEQ ID NO: 3220871 - RNA, 19 nt, Human
cuuuuaaaaaguauugcca

SEQ ID NO: 3220872 - RNA, 16 nt, Human
cuuuuaaaaaguauug

SEQ ID NO: 3220873 - RNA, 15 nt, Human
cuuuuaaaaaguauu

SEQ ID NO: 3220874 - RNA, 14 nt, Human
cuuuuaaaaaguau

SEQ ID NO: 3220875 - RNA, 18 nt, Human
cuuuuaaaacacuuccau

SEQ ID NO: 3220876 - RNA, 19 nt, Human
cuuuuaaaacuacuuagca

SEQ ID NO: 3220877 - RNA, 14 nt, Human
cuuuuaaaacuacu

SEQ ID NO: 3220878 - RNA, 23 nt, Human
cuuuuaaaaaguauugccaaaca

SEQ ID NO: 3220879 - RNA, 21 nt, Human
cuuuuaaaaaguauugccaaa

SEQ ID NO: 3220880 - RNA, 14 nt, Human
cuuuuaaggauaaa

SEQ ID NO: 3220881 - RNA, 18 nt, Human
cuuuuaaggauaaaucau

SEQ ID NO: 3220882 - RNA, 23 nt, Human
cuuuuaaggauaaaucauaaagu

SEQ ID NO: 3220883 - RNA, 16 nt, Human
cuuuuaaauuagaaaa

SEQ ID NO: 3220884 - RNA, 17 nt, Human
cuuuuaaauuagaaaau

SEQ ID NO: 3220885 - RNA, 19 nt, Human
cuuuuaaauuagaaaauau

SEQ ID NO: 3220886 - RNA, 21 nt, Human
cuuuucgcaggauucuuccuc

SEQ ID NO: 3220887 - RNA, 20 nt, Human
cuuuucgcaggauucuuccu

SEQ ID NO: 3220888 - RNA, 15 nt, Human
cuuuuccuugcauac

SEQ ID NO: 3220889 - RNA, 15 nt, Human
cuuuuccucuuagaa

SEQ ID NO: 3220890 - RNA, 19 nt, Human
cuuuuccucuuagaagaau

SEQ ID NO: 3220891 - RNA, 20 nt, Human
cuuuuccuugcauacaaaca

SEQ ID NO: 3220892 - RNA, 20 nt, Human
cuuuuccucgcuucuuucaa

SEQ ID NO: 3220893 - RNA, 19 nt, Human
cuuuuccucgcuucuuuca

SEQ ID NO: 3220894 - RNA, 16 nt, Human
cuuuuccucgcuucuu

SEQ ID NO: 3220895 - RNA, 18 nt, Human
cuuuuccucgcuucuuuc

SEQ ID NO: 3220896 - RNA, 17 nt, Human
cuuuuccucgcuucuuu

SEQ ID NO: 3220897 - RNA, 18 nt, Human
cuuuuccaguauuuuagu

SEQ ID NO: 3220898 - RNA, 14 nt, Human
cuuuucccuucuuu

SEQ ID NO: 3220899 - RNA, 14 nt, Human
cuuuuccagagcau

SEQ ID NO: 3220900 - RNA, 14 nt, Human
cuuuuccaguauuu

SEQ ID NO: 3220901 - RNA, 21 nt, Human
cuuuuccagagcauuccaguc

SEQ ID NO: 3220902 - RNA, 14 nt, Human
cuuuucauugcugu

SEQ ID NO: 3220903 - RNA, 19 nt, Human
cuuuuccaauaugugauuu

SEQ ID NO: 3220904 - RNA, 17 nt, Human
cuuuuccaauaugugau

SEQ ID NO: 3220905 - RNA, 13 nt, Human
cuuuuccaacccu

SEQ ID NO: 3220906 - RNA, 23 nt, Human
cuuuuccaacccucaucaccaac

SEQ ID NO: 3220907 - RNA, 22 nt, Human
cuuuucauuuaggugaggaagc

SEQ ID NO: 3220908 - RNA, 18 nt, Human
cuuuucacccuucuacuc

SEQ ID NO: 3220909 - RNA, 12 nt, Human
cuuuucacugcu

SEQ ID NO: 3220910 - RNA, 18 nt, Human
cuuuucaauauauuugua

SEQ ID NO: 3220911 - RNA, 15 nt, Human
cuuuucaccauucgu

SEQ ID NO: 3220912 - RNA, 14 nt, Human
cuuuucacccuucu

SEQ ID NO: 3220913 - RNA, 17 nt, Human
cuuuucacccuucuacu

SEQ ID NO: 3220914 - RNA, 16 nt, Human
cuuuucacccuucuac

SEQ ID NO: 3220915 - RNA, 16 nt, Human
cuuuucuuucuaccaa

SEQ ID NO: 3220916 - RNA, 17 nt, Human
cuuuucuuugccaucuc

SEQ ID NO: 3220917 - RNA, 22 nt, Human
cuuuucuuugccaucucugcuc

SEQ ID NO: 3220918 - RNA, 21 nt, Human
cuuuucuuugccaucucugcu

SEQ ID NO: 3220919 - RNA, 17 nt, Human
cuuuucuuucagccaag

SEQ ID NO: 3220920 - RNA, 23 nt, Human
cuuuucuaaacuaggcuccuuca

SEQ ID NO: 3220921 - RNA, 16 nt, Human
cuuuucuuucagccaa

SEQ ID NO: 3220922 - RNA, 22 nt, Human
cuuuucuaaacuaggcuccuuc

SEQ ID NO: 3220923 - RNA, 15 nt, Human
cuuuugauguggugu

SEQ ID NO: 3220924 - RNA, 22 nt, Human
cuuuuuaauauugauaugcuua

SEQ ID NO: 3220925 - RNA, 16 nt, Human
cuuuuuaaucaugaau

SEQ ID NO: 3220926 - RNA, 18 nt, Human
cuuuuuaaucaugaauau

SEQ ID NO: 3220927 - RNA, 21 nt, Human
cuuuuuaaucaugaauaugau

SEQ ID NO: 3220928 - RNA, 11 nt, Human
cuuuuuauaaa

SEQ ID NO: 3220929 - RNA, 13 nt, Human
cuuuuuauaaaaa

SEQ ID NO: 3220930 - RNA, 14 nt, Human
cuuuuuauaaaaag

SEQ ID NO: 3220931 - RNA, 15 nt, Human
cuuuuuauaaaaaga

SEQ ID NO: 3220932 - RNA, 18 nt, Human
cuuuuuauaaaaagauaa

SEQ ID NO: 3220933 - RNA, 19 nt, Human
cuuuuuauaaaaagauaau

SEQ ID NO: 3220934 - RNA, 15 nt, Human
cuuuuuaaccucugu

SEQ ID NO: 3220935 - RNA, 16 nt, Human
cuuuuuaaccucuguu

SEQ ID NO: 3220936 - RNA, 13 nt, Human
cuuuuuuauuaau

SEQ ID NO: 3220937 - RNA, 15 nt, Human
cuuuuuuauaucuug

SEQ ID NO: 3220938 - RNA, 14 nt, Human
cuuuuuuauuaauc

SEQ ID NO: 3220939 - RNA, 15 nt, Human
cuuuuuuauuaauca

SEQ ID NO: 3220940 - RNA, 14 nt, Human
cuuuuuuauaucuu

SEQ ID NO: 3220941 - RNA, 11 nt, Human
gaaaaagaaaa

SEQ ID NO: 3220942 - RNA, 16 nt, Human
gaaaaagaaaaaauau

SEQ ID NO: 3220943 - RNA, 17 nt, Human
cuuuuuuauuaaucacu

SEQ ID NO: 3220944 - RNA, 19 nt, Human
cuuuuuuauuaaucacugu

SEQ ID NO: 3220945 - RNA, 20 nt, Human
cuuuuuuauuaaucacugug

SEQ ID NO: 3220946 - RNA, 21 nt, Human
cuuuuuuauuaaucacugugu

SEQ ID NO: 3220947 - RNA, 21 nt, Human
cuuuuuagaugugcugcuuug

SEQ ID NO: 3220948 - RNA, 21 nt, Human
cuuguaaauagcucagguguc

SEQ ID NO: 3220949 - RNA, 18 nt, Human
cuuguaaaaauuaaaagu

SEQ ID NO: 3220950 - RNA, 16 nt, Human
cuuggcuuggcccugg

SEQ ID NO: 3220951 - RNA, 17 nt, Human
cuuggcuugccauuuuu

SEQ ID NO: 3220952 - RNA, 18 nt, Human
cuuggcuuggcccuggca

SEQ ID NO: 3220953 - RNA, 18 nt, Human
cuuggggaccagagcugc

SEQ ID NO: 3220954 - RNA, 19 nt, Human
cuuggggaccagagcugcc

SEQ ID NO: 3220955 - RNA, 17 nt, Human
cuuggggaccagagcug

SEQ ID NO: 3220956 - RNA, 16 nt, Human
cuuggggaccagagcu

SEQ ID NO: 3220957 - RNA, 13 nt, Human
cuuggcucugagg

SEQ ID NO: 3220958 - RNA, 22 nt, Human
cuuggcucucaaugcuguuugg

SEQ ID NO: 3220959 - RNA, 19 nt, Human
cuuguaucuggauucaaau

SEQ ID NO: 3220960 - RNA, 22 nt, Human
cuuguaacuaaaauaauuuugu

SEQ ID NO: 3220961 - RNA, 17 nt, Human
cuuguaacuaaaauaau

SEQ ID NO: 3220962 - RNA, 16 nt, Human
cuuguaacuaaaauaa

SEQ ID NO: 3220963 - RNA, 14 nt, Human
cuuguaacuaaaau

SEQ ID NO: 3220964 - RNA, 21 nt, Human
cuuguaugaaagauggcugug

SEQ ID NO: 3220965 - RNA, 16 nt, Human
cuuguauuuuuuaaug

SEQ ID NO: 3220966 - RNA, 18 nt, Human
cuuguggacacagcucuu

SEQ ID NO: 3220967 - RNA, 17 nt, Human
cuuguggacacagcucu

SEQ ID NO: 3220968 - RNA, 16 nt, Human
cuuguggacacagcuc

SEQ ID NO: 3220969 - RNA, 16 nt, Human
cuugucauagccagug

SEQ ID NO: 3220970 - RNA, 13 nt, Human
cuuggagccugca

SEQ ID NO: 3220971 - RNA, 21 nt, Human
cuuggacacuuaauucuguuc

SEQ ID NO: 3220972 - RNA, 18 nt, Human
cuuggagccugcagagcu

SEQ ID NO: 3220973 - RNA, 17 nt, Human
cuuggagccugcagagc

SEQ ID NO: 3220974 - RNA, 16 nt, Human
cuuggagccugcagag

SEQ ID NO: 3220975 - RNA, 15 nt, Human
cuuggagccugcaga

SEQ ID NO: 3220976 - RNA, 20 nt, Human
cuuggagccugcagagcugc

SEQ ID NO: 3220977 - RNA, 19 nt, Human
cuuggagccugcagagcug

SEQ ID NO: 3220978 - RNA, 14 nt, Human
cuuggagcucugag

SEQ ID NO: 3220979 - RNA, 21 nt, Human
cuuggaugaguuuugggaagu

SEQ ID NO: 3220980 - RNA, 13 nt, Human
cuuggauuguccc

SEQ ID NO: 3220981 - RNA, 23 nt, Human
cuuggcucaaguccucuuuucug

SEQ ID NO: 3220982 - RNA, 13 nt, Human
cuuggcugcaggg

SEQ ID NO: 3220983 - RNA, 12 nt, Human
cuuggcugcagg

SEQ ID NO: 3220984 - RNA, 13 nt, Human
cuugcuugcuuuu

SEQ ID NO: 3220985 - RNA, 20 nt, Human
cuugcugcccugugcuccuc

SEQ ID NO: 3220986 - RNA, 10 nt, Human
cuugcugccu

SEQ ID NO: 3220987 - RNA, 13 nt, Human
cuugcugccucgg

SEQ ID NO: 3220988 - RNA, 11 nt, Human
cuugcugccuc

SEQ ID NO: 3220989 - RNA, 21 nt, Human
cuugcauuuuugcaggagcag

SEQ ID NO: 3220990 - RNA, 20 nt, Human
cuugccaaaguacagaauuu

SEQ ID NO: 3220991 - RNA, 21 nt, Human
cuugccaaaguacagaauuug

SEQ ID NO: 3220992 - RNA, 20 nt, Human
cuugcauuuuugcaggagca

SEQ ID NO: 3220993 - RNA, 14 nt, Human
cuugcauuuuugca

SEQ ID NO: 3220994 - RNA, 13 nt, Human
cuugcauuuuugc

SEQ ID NO: 3220995 - RNA, 22 nt, Human
cuugcauuucacuugaguggag

SEQ ID NO: 3220996 - RNA, 18 nt, Human
cuugcauuuaaaagacag

SEQ ID NO: 3220997 - RNA, 12 nt, Human
cuugcauuuuug

SEQ ID NO: 3220998 - RNA, 20 nt, Human
cuugcauuuuagcuaauuua

SEQ ID NO: 3220999 - RNA, 16 nt, Human
cuugcauuuuagcuaa

SEQ ID NO: 3221000 - RNA, 19 nt, Human
cuugaacugagcuuggaag

SEQ ID NO: 3221001 - RNA, 17 nt, Human
cuugaacugagcuugga

SEQ ID NO: 3221002 - RNA, 16 nt, Human
cuugaacuggguacuu

SEQ ID NO: 3221003 - RNA, 19 nt, Human
cuugaacuccuggccucaa

SEQ ID NO: 3221004 - RNA, 20 nt, Human
cuugaacuggguacuugugg

SEQ ID NO: 3221005 - RNA, 18 nt, Human
cuugaacuggguacuugu

SEQ ID NO: 3221006 - RNA, 19 nt, Human
cuugaacccgggaggcaga

SEQ ID NO: 3221007 - RNA, 14 nt, Human
cuugaacccgggag

SEQ ID NO: 3221008 - RNA, 18 nt, Human
cuugaacuccuggccuca

SEQ ID NO: 3221009 - RNA, 17 nt, Human
cuugaacuccuggccuc

SEQ ID NO: 3221010 - RNA, 15 nt, Human
cuugaacuccuggcc

SEQ ID NO: 3221011 - RNA, 14 nt, Human
cuugaacuccuggc

SEQ ID NO: 3221012 - RNA, 12 nt, Human
cuucuuugcccu

SEQ ID NO: 3221013 - RNA, 14 nt, Human
cuucuuucccuucc

SEQ ID NO: 3221014 - RNA, 13 nt, Human
cuucuuucccuuc

SEQ ID NO: 3221015 - RNA, 23 nt, Human
cuucuuucccuuccuccauccuc

SEQ ID NO: 3221016 - RNA, 19 nt, Human
cuucuuucccuuccuccau

SEQ ID NO: 3221017 - RNA, 18 nt, Human
cuucuuucccuuccucca

SEQ ID NO: 3221018 - RNA, 16 nt, Human
cuucuuucccuuccuc

SEQ ID NO: 3221019 - RNA, 22 nt, Human
cuucuuuauaauucuacuuuga

SEQ ID NO: 3221020 - RNA, 22 nt, Human
cuugaguaaaauacucuuuuua

SEQ ID NO: 3221021 - RNA, 14 nt, Human
cuugcaauggcagc

SEQ ID NO: 3221022 - RNA, 22 nt, Human
cuugcaagggcggccuuuccca

SEQ ID NO: 3221023 - RNA, 12 nt, Human
cuugcagaacuu

SEQ ID NO: 3221024 - RNA, 18 nt, Human
cuugcacucucuuggcug

SEQ ID NO: 3221025 - RNA, 17 nt, Human
cuugcacucuucuacca

SEQ ID NO: 3221026 - RNA, 18 nt, Human
cuugcacuggccuucuga

SEQ ID NO: 3221027 - RNA, 19 nt, Human
cuugcacuggccuucugau

SEQ ID NO: 3221028 - RNA, 17 nt, Human
cuugcacucucuuggcu

SEQ ID NO: 3221029 - RNA, 18 nt, Human
cuugcagacucuacagag

SEQ ID NO: 3221030 - RNA, 15 nt, Human
cuugcauacaaacaa

SEQ ID NO: 3221031 - RNA, 14 nt, Human
cuugcauacaaaca

SEQ ID NO: 3221032 - RNA, 21 nt, Human
cuugcaugguuuagaaagcuu

SEQ ID NO: 3221033 - RNA, 21 nt, Human
cuugcauaguaaauguaguuc

SEQ ID NO: 3221034 - RNA, 21 nt, Human
cuugcauacaaacaagcauau

SEQ ID NO: 3221035 - RNA, 20 nt, Human
cuugcauacaaacaagcaua

SEQ ID NO: 3221036 - RNA, 21 nt, Human
cuugcaugaggcuaguguggu

SEQ ID NO: 3221037 - RNA, 17 nt, Human
cuugcaugaggcuagug

SEQ ID NO: 3221038 - RNA, 21 nt, Human
cuugaguaaaauacucuuuuu

SEQ ID NO: 3221039 - RNA, 14 nt, Human
cuugagagggugga

SEQ ID NO: 3221040 - RNA, 21 nt, Human
cuugaccauucuccaccugcc

SEQ ID NO: 3221041 - RNA, 17 nt, Human
cuugaccauucuccacc

SEQ ID NO: 3221042 - RNA, 20 nt, Human
cuugaccauucuccaccugc

SEQ ID NO: 3221043 - RNA, 17 nt, Human
gaccuuuccugaggaag

SEQ ID NO: 3221044 - RNA, 14 nt, Human
gaccuuuugcugcc

SEQ ID NO: 3221045 - RNA, 21 nt, Human
gaccuuucaauaggaaaaacu

SEQ ID NO: 3221046 - RNA, 20 nt, Human
gaccuuguaauguaacugcu

SEQ ID NO: 3221047 - RNA, 18 nt, Human
gaccuuguaauguaacug

SEQ ID NO: 3221048 - RNA, 17 nt, Human
gaccuuguaauguaacu

SEQ ID NO: 3221049 - RNA, 16 nt, Human
gaccuuguaauguaac

SEQ ID NO: 3221050 - RNA, 15 nt, Human
gaccuuguaauguaa

SEQ ID NO: 3221051 - RNA, 23 nt, Human
gaccuugaacuggguacuugugg

SEQ ID NO: 3221052 - RNA, 20 nt, Human
gaccugcugaaguccggaac

SEQ ID NO: 3221053 - RNA, 13 nt, Human
gaccugcugaagu

SEQ ID NO: 3221054 - RNA, 19 nt, Human
gaccugccucggccuccca

SEQ ID NO: 3221055 - RNA, 15 nt, Human
gacguguuaugacuc

SEQ ID NO: 3221056 - RNA, 21 nt, Human
gacgucagauguuuaaaacac

SEQ ID NO: 3221057 - RNA, 17 nt, Human
gacguguuaugacucca

SEQ ID NO: 3221058 - RNA, 20 nt, Human
gacguguuaugacuccagaa

SEQ ID NO: 3221059 - RNA, 16 nt, Human
gacguacaaguaguuc

SEQ ID NO: 3221060 - RNA, 22 nt, Human
gacgguuccuacacaggacagg

SEQ ID NO: 3221061 - RNA, 18 nt, Human
gacguacaaguaguucug

SEQ ID NO: 3221062 - RNA, 19 nt, Human
gacguacaaguaguucugu

SEQ ID NO: 3221063 - RNA, 22 nt, Human
gacguacaaguaguucuguauu

SEQ ID NO: 3221064 - RNA, 11 nt, Human
gacgguuccua

SEQ ID NO: 3221065 - RNA, 21 nt, Human
gacgguuccuacacaggacag

SEQ ID NO: 3221066 - RNA, 19 nt, Human
gacgguuccuacacaggac

SEQ ID NO: 3221067 - RNA, 18 nt, Human
gacgguuccuacacagga

SEQ ID NO: 3221068 - RNA, 16 nt, Human
gacgguuccuacacag

SEQ ID NO: 3221069 - RNA, 21 nt, Human
gacggagucccaccuuggcug

SEQ ID NO: 3221070 - RNA, 17 nt, Human
gacgggguuucaccaug

SEQ ID NO: 3221071 - RNA, 18 nt, Human
gacggagucccaccuugg

SEQ ID NO: 3221072 - RNA, 14 nt, Human
gacggagucccacc

SEQ ID NO: 3221073 - RNA, 20 nt, Human
gacgacuguuuucccaacac

SEQ ID NO: 3221074 - RNA, 14 nt, Human
gacgcaccagccca

SEQ ID NO: 3221075 - RNA, 14 nt, Human
gacuagacacacaa

SEQ ID NO: 3221076 - RNA, 19 nt, Human
gacuagacacacaaagcag

SEQ ID NO: 3221077 - RNA, 16 nt, Human
gacuagacacacaaag

SEQ ID NO: 3221078 - RNA, 17 nt, Human
gacuacucccccaggug

SEQ ID NO: 3221079 - RNA, 12 nt, Human
gacuacaggcac

SEQ ID NO: 3221080 - RNA, 14 nt, Human
gacuacuguucagc

SEQ ID NO: 3221081 - RNA, 22 nt, Human
gacguguuaugacuccagaauu

SEQ ID NO: 3221082 - RNA, 18 nt, Human
gacuccaaagaaauguaa

SEQ ID NO: 3221083 - RNA, 11 nt, Human
gacuccagaaa

SEQ ID NO: 3221084 - RNA, 22 nt, Human
gacuccagaaaugucccuuucu

SEQ ID NO: 3221085 - RNA, 15 nt, Human
gacucaguggggagg

SEQ ID NO: 3221086 - RNA, 21 nt, Human
gacucauauccccuauuuaac

SEQ ID NO: 3221087 - RNA, 15 nt, Human
gacucagguugucug

SEQ ID NO: 3221088 - RNA, 15 nt, Human
gacuccugcaggcag

SEQ ID NO: 3221089 - RNA, 16 nt, Human
gacuccugcaggcagc

SEQ ID NO: 3221090 - RNA, 14 nt, Human
gacuccugcaggca

SEQ ID NO: 3221091 - RNA, 22 nt, Human
gacucccccaguccccuucccg

SEQ ID NO: 3221092 - RNA, 15 nt, Human
gaccugccucggccu

SEQ ID NO: 3221093 - RNA, 21 nt, Human
gaccugccccuccucucugcc

SEQ ID NO: 3221094 - RNA, 11 nt, Human
gaccucaggcc

SEQ ID NO: 3221095 - RNA, 12 nt, Human
gaccucaggccu

SEQ ID NO: 3221096 - RNA, 14 nt, Human
gaccugaggcccuu

SEQ ID NO: 3221097 - RNA, 15 nt, Human
gaccugaggcccuuc

SEQ ID NO: 3221098 - RNA, 18 nt, Human
gaccugaggcccuucucu

SEQ ID NO: 3221099 - RNA, 21 nt, Human
gaccugaggcccuucucucca

SEQ ID NO: 3221100 - RNA, 17 nt, Human
gaccucaccuaggaagu

SEQ ID NO: 3221101 - RNA, 16 nt, Human
gaccucaccuaggaag

SEQ ID NO: 3221102 - RNA, 17 nt, Human
gaccuaaaaauuggugu

SEQ ID NO: 3221103 - RNA, 22 nt, Human
gaccuaaccagggccagaagua

SEQ ID NO: 3221104 - RNA, 19 nt, Human
gaccuaaccagggccagaa

SEQ ID NO: 3221105 - RNA, 18 nt, Human
gaccuaaccagggccaga

SEQ ID NO: 3221106 - RNA, 15 nt, Human
gaccuaaccagggcc

SEQ ID NO: 3221107 - RNA, 14 nt, Human
gaccgugaggccag

SEQ ID NO: 3221108 - RNA, 19 nt, Human
gaccgugaggccagagaca

SEQ ID NO: 3221109 - RNA, 12 nt, Human
gaccgucuuccu

SEQ ID NO: 3221110 - RNA, 19 nt, Human
gaccgugaagauacuuugu

SEQ ID NO: 3221111 - RNA, 22 nt, Human
gacccacaagaaaugaaagcag

SEQ ID NO: 3221112 - RNA, 11 nt, Human
gacccacugcu

SEQ ID NO: 3221113 - RNA, 16 nt, Human
gacccaugcugcccug

SEQ ID NO: 3221114 - RNA, 14 nt, Human
gacccaugcugccc

SEQ ID NO: 3221115 - RNA, 15 nt, Human
gacccaugcugcccu

SEQ ID NO: 3221116 - RNA, 13 nt, Human
gacccaugcugcc

SEQ ID NO: 3221117 - RNA, 23 nt, Human
gacccugucucaaaaaaagaaaa

SEQ ID NO: 3221118 - RNA, 16 nt, Human
gacccugcccuguggg

SEQ ID NO: 3221119 - RNA, 13 nt, Human
gacccugcccugu

SEQ ID NO: 3221120 - RNA, 15 nt, Human
gacccugcccugugg

SEQ ID NO: 3221121 - RNA, 19 nt, Human
gacccugaggcccagaggg

SEQ ID NO: 3221122 - RNA, 20 nt, Human
gacccugaggcccagagggc

SEQ ID NO: 3221123 - RNA, 12 nt, Human
gacccugcccug

SEQ ID NO: 3221124 - RNA, 21 nt, Human
gacccugaggcccagagggcc

SEQ ID NO: 3221125 - RNA, 18 nt, Human
gacccugaggcccagagg

SEQ ID NO: 3221126 - RNA, 23 nt, Human
gaccccucauagcccucacccug

SEQ ID NO: 3221127 - RNA, 22 nt, Human
gaccccucauagcccucacccu

SEQ ID NO: 3221128 - RNA, 19 nt, Human
gaccccaucugugaauaag

SEQ ID NO: 3221129 - RNA, 16 nt, Human
gaccccaucugugaau

SEQ ID NO: 3221130 - RNA, 22 nt, Human
gacacccugugauggggcccug

SEQ ID NO: 3221131 - RNA, 23 nt, Human
gacacccugugauggggcccugc

SEQ ID NO: 3221132 - RNA, 17 nt, Human
gacaccuacugaguggc

SEQ ID NO: 3221133 - RNA, 18 nt, Human
gacacaggcccggcucca

SEQ ID NO: 3221134 - RNA, 17 nt, Human
gacacagugaccauacu

SEQ ID NO: 3221135 - RNA, 22 nt, Human
gacacaggggacacccagaaac

SEQ ID NO: 3221136 - RNA, 12 nt, Human
gacacccuguga

SEQ ID NO: 3221137 - RNA, 13 nt, Human
gacacccugugau

SEQ ID NO: 3221138 - RNA, 14 nt, Human
gacaccccacuuag

SEQ ID NO: 3221139 - RNA, 15 nt, Human
gacaccccacuuagc

SEQ ID NO: 3221140 - RNA, 18 nt, Human
gacacuaaccacgcugga

SEQ ID NO: 3221141 - RNA, 17 nt, Human
gacacuaaccacgcugg

SEQ ID NO: 3221142 - RNA, 16 nt, Human
gacacuaaccacgcug

SEQ ID NO: 3221143 - RNA, 15 nt, Human
gacacuaaccacgcu

SEQ ID NO: 3221144 - RNA, 17 nt, Human
gacacgaauauugcuga

SEQ ID NO: 3221145 - RNA, 18 nt, Human
gacacgaauauugcugau

SEQ ID NO: 3221146 - RNA, 19 nt, Human
gacacgaauauugcugaug

SEQ ID NO: 3221147 - RNA, 17 nt, Human
gacaccuugacagggca

SEQ ID NO: 3221148 - RNA, 15 nt, Human
gacaccuugacaggg

SEQ ID NO: 3221149 - RNA, 20 nt, Human
gacaccuugacagggcacac

SEQ ID NO: 3221150 - RNA, 18 nt, Human
gacaccuugacagggcac

SEQ ID NO: 3221151 - RNA, 15 nt, Human
gacacgaauauugcu

SEQ ID NO: 3221152 - RNA, 12 nt, Human
gacaaugcaaac

SEQ ID NO: 3221153 - RNA, 16 nt, Human
gacaaugcaaaccauc

SEQ ID NO: 3221154 - RNA, 18 nt, Human
gacaaugcaaaccaucau

SEQ ID NO: 3221155 - RNA, 13 nt, Human
gacaaucuucugu

SEQ ID NO: 3221156 - RNA, 22 nt, Human
gacacaagccuucggcgccuua

SEQ ID NO: 3221157 - RNA, 14 nt, Human
gacacacaaagcag

SEQ ID NO: 3221158 - RNA, 13 nt, Human
gacacacaaagca

SEQ ID NO: 3221159 - RNA, 17 nt, Human
gacacaggcccggcucc

SEQ ID NO: 3221160 - RNA, 15 nt, Human
gacacaggcccggcu

SEQ ID NO: 3221161 - RNA, 12 nt, Human
gacacaggcccg

SEQ ID NO: 3221162 - RNA, 16 nt, Human
gacaaugacccagugg

SEQ ID NO: 3221163 - RNA, 19 nt, Human
gacaauacuguaugucguc

SEQ ID NO: 3221164 - RNA, 17 nt, Human
gacaauagcauuagaaa

SEQ ID NO: 3221165 - RNA, 15 nt, Human
gacaaguaauuucag

SEQ ID NO: 3221166 - RNA, 16 nt, Human
gacaaggugcaggcag

SEQ ID NO: 3221167 - RNA, 18 nt, Human
gacaaggugcaggcaggc

SEQ ID NO: 3221168 - RNA, 17 nt, Human
gacaaggugcaggcagg

SEQ ID NO: 3221169 - RNA, 22 nt, Human
gacaagggaaaauaaaaaaaga

SEQ ID NO: 3221170 - RNA, 22 nt, Human
gacaaggauugcuacuguccua

SEQ ID NO: 3221171 - RNA, 21 nt, Human
gacaaggauugcuacuguccu

SEQ ID NO: 3221172 - RNA, 15 nt, Human
gacaagcacagucag

SEQ ID NO: 3221173 - RNA, 12 nt, Human
gacaagcacagu

SEQ ID NO: 3221174 - RNA, 16 nt, Human
gaagucuuuguacaga

SEQ ID NO: 3221175 - RNA, 22 nt, Human
gacaagaguuggggacagaacu

SEQ ID NO: 3221176 - RNA, 14 nt, Human
gaagucuuuguaca

SEQ ID NO: 3221177 - RNA, 18 nt, Human
gaagucuucaugaaaugc

SEQ ID NO: 3221178 - RNA, 17 nt, Human
gaagucuucaugaaaug

SEQ ID NO: 3221179 - RNA, 12 nt, Human
gacagcaugaga

SEQ ID NO: 3221180 - RNA, 23 nt, Human
gacagcagucuuaugcuuccaga

SEQ ID NO: 3221181 - RNA, 12 nt, Human
gacagcugccug

SEQ ID NO: 3221182 - RNA, 13 nt, Human
gacagcugccugg

SEQ ID NO: 3221183 - RNA, 16 nt, Human
gacagacacaggcccg

SEQ ID NO: 3221184 - RNA, 15 nt, Human
gacagacacaggccc

SEQ ID NO: 3221185 - RNA, 23 nt, Human
gacagaucucugcuuuggaaauc

SEQ ID NO: 3221186 - RNA, 21 nt, Human
gacagaucucugcuuuggaaa

SEQ ID NO: 3221187 - RNA, 19 nt, Human
gacagaucucugcuuugga

SEQ ID NO: 3221188 - RNA, 20 nt, Human
gacacuaaccacgcuggacc

SEQ ID NO: 3221189 - RNA, 14 nt, Human
gacagacacaggcc

SEQ ID NO: 3221190 - RNA, 12 nt, Human
gacagacacagg

SEQ ID NO: 3221191 - RNA, 23 nt, Human
gacagcuuagaauuauuugcacu

SEQ ID NO: 3221192 - RNA, 17 nt, Human
gacagcuuagaauuauu

SEQ ID NO: 3221193 - RNA, 22 nt, Human
gacaggagagauuauuuacaag

SEQ ID NO: 3221194 - RNA, 21 nt, Human
gacagcugccugggaucccuc

SEQ ID NO: 3221195 - RNA, 14 nt, Human
gacagcugccuggg

SEQ ID NO: 3221196 - RNA, 15 nt, Human
gacagcugccuggga

SEQ ID NO: 3221197 - RNA, 19 nt, Human
gacaggcauguucucugag

SEQ ID NO: 3221198 - RNA, 18 nt, Human
gacaggcauguucucuga

SEQ ID NO: 3221199 - RNA, 17 nt, Human
gacaggcaaugcuggcu

SEQ ID NO: 3221200 - RNA, 24 nt, Human
gacaggcaaugcuggcuguuggcu

SEQ ID NO: 3221201 - RNA, 16 nt, Human
gacaggcaaugcuggc

SEQ ID NO: 3221202 - RNA, 14 nt, Human
gacaggcaaugcug

SEQ ID NO: 3221203 - RNA, 21 nt, Human
gacaggcaagcaccuccugcc

SEQ ID NO: 3221204 - RNA, 22 nt, Human
gacaggagaugcugugccccug

SEQ ID NO: 3221205 - RNA, 19 nt, Human
gacaggagaugcugugccc

SEQ ID NO: 3221206 - RNA, 17 nt, Human
gacaggagaugcugugc

SEQ ID NO: 3221207 - RNA, 21 nt, Human
gacaugggucgcccaugagag

SEQ ID NO: 3221208 - RNA, 23 nt, Human
gacaugggucgcccaugagagcg

SEQ ID NO: 3221209 - RNA, 18 nt, Human
gacauggcuucugaaccu

SEQ ID NO: 3221210 - RNA, 23 nt, Human
gacaugaaaauagcaauauucuu

SEQ ID NO: 3221211 - RNA, 14 nt, Human
gacauggaaaugaa

SEQ ID NO: 3221212 - RNA, 15 nt, Human
gacauggaaaugaag

SEQ ID NO: 3221213 - RNA, 21 nt, Human
gaccaaauggaaacagaggac

SEQ ID NO: 3221214 - RNA, 13 nt, Human
gaccaaauggaaa

SEQ ID NO: 3221215 - RNA, 17 nt, Human
gacaugucuuuucuugc

SEQ ID NO: 3221216 - RNA, 12 nt, Human
gacauggugggg

SEQ ID NO: 3221217 - RNA, 21 nt, Human
gacaugucuuuucuugcauga

SEQ ID NO: 3221218 - RNA, 19 nt, Human
gacauaacugacuuaguuc

SEQ ID NO: 3221219 - RNA, 16 nt, Human
gacaggcgaaagaaaa

SEQ ID NO: 3221220 - RNA, 17 nt, Human
gacaggcgaaagaaaac

SEQ ID NO: 3221221 - RNA, 19 nt, Human
gagagaggcuaaaauguuu

SEQ ID NO: 3221222 - RNA, 18 nt, Human
gagagaggcuaaaauguu

SEQ ID NO: 3221223 - RNA, 20 nt, Human
gagagaggcuaaaauguuuu

SEQ ID NO: 3221224 - RNA, 14 nt, Human
gagagauacucugg

SEQ ID NO: 3221225 - RNA, 15 nt, Human
gagagauacucuggg

SEQ ID NO: 3221226 - RNA, 22 nt, Human
gagagcauuauaaucaccaggg

SEQ ID NO: 3221227 - RNA, 20 nt, Human
gagagcccagagucccccca

SEQ ID NO: 3221228 - RNA, 19 nt, Human
gagagcccagagucccccc

SEQ ID NO: 3221229 - RNA, 17 nt, Human
gagagaagagaaugcac

SEQ ID NO: 3221230 - RNA, 10 nt, Human
gagacuuuga

SEQ ID NO: 3221231 - RNA, 11 nt, Human
gagacuuugau

SEQ ID NO: 3221232 - RNA, 13 nt, Human
gagacuuugaugu

SEQ ID NO: 3221233 - RNA, 19 nt, Human
gagacuuugaugucagcag

SEQ ID NO: 3221234 - RNA, 14 nt, Human
gagacuuugauguc

SEQ ID NO: 3221235 - RNA, 15 nt, Human
gagacuuugauguca

SEQ ID NO: 3221236 - RNA, 14 nt, Human
gagagaagagcccc

SEQ ID NO: 3221237 - RNA, 16 nt, Human
gagagaagagccccac

SEQ ID NO: 3221238 - RNA, 15 nt, Human
gagagaagagcccca

SEQ ID NO: 3221239 - RNA, 22 nt, Human
gagagagcuucuguugcugccu

SEQ ID NO: 3221240 - RNA, 15 nt, Human
gagagugagguggaa

SEQ ID NO: 3221241 - RNA, 16 nt, Human
gagaguuuagcuguaa

SEQ ID NO: 3221242 - RNA, 19 nt, Human
gagagugaacaaauuuaca

SEQ ID NO: 3221243 - RNA, 15 nt, Human
gagagugaacaaauu

SEQ ID NO: 3221244 - RNA, 20 nt, Human
gagagggugggagugggccc

SEQ ID NO: 3221245 - RNA, 21 nt, Human
gagagggugggagugggccca

SEQ ID NO: 3221246 - RNA, 13 nt, Human
gagaggggaacag

SEQ ID NO: 3221247 - RNA, 13 nt, Human
gagagccuuccag

SEQ ID NO: 3221248 - RNA, 15 nt, Human
gagacagcucugcau

SEQ ID NO: 3221249 - RNA, 13 nt, Human
gagacagcucugc

SEQ ID NO: 3221250 - RNA, 24 nt, Human
gagacagcccgggcucugccuccc

SEQ ID NO: 3221251 - RNA, 14 nt, Human
gagacagcccgggc

SEQ ID NO: 3221252 - RNA, 17 nt, Human
gagacagcccgggcucu

SEQ ID NO: 3221253 - RNA, 18 nt, Human
gagacagcccgggcucug

SEQ ID NO: 3221254 - RNA, 19 nt, Human
gagacagcccgggcucugc

SEQ ID NO: 3221255 - RNA, 20 nt, Human
gagacagcccgggcucugcc

SEQ ID NO: 3221256 - RNA, 21 nt, Human
gagacagcccgggcucugccu

SEQ ID NO: 3221257 - RNA, 22 nt, Human
gagacagcccgggcucugccuc

SEQ ID NO: 3221258 - RNA, 23 nt, Human
gagacagcccgggcucugccucc

SEQ ID NO: 3221259 - RNA, 22 nt, Human
gagacuccugcaggcagccagg

SEQ ID NO: 3221260 - RNA, 16 nt, Human
gagacucgcgacaaug

SEQ ID NO: 3221261 - RNA, 13 nt, Human
gagacucugucuc

SEQ ID NO: 3221262 - RNA, 18 nt, Human
gagaccacccauaucaug

SEQ ID NO: 3221263 - RNA, 14 nt, Human
gagacucugucuca

SEQ ID NO: 3221264 - RNA, 17 nt, Human
gagacugcuccugagcc

SEQ ID NO: 3221265 - RNA, 19 nt, Human
gagacugcuccugagcccc

SEQ ID NO: 3221266 - RNA, 18 nt, Human
gagacugcuccugagccc

SEQ ID NO: 3221267 - RNA, 22 nt, Human
gagacugucucaagagggcacu

SEQ ID NO: 3221268 - RNA, 23 nt, Human
gagacugucucaagagggcacug

SEQ ID NO: 3221269 - RNA, 21 nt, Human
gagacuguggagacugcuccu

SEQ ID NO: 3221270 - RNA, 20 nt, Human
gagacuguggagacugcucc

SEQ ID NO: 3221271 - RNA, 13 nt, Human
gagacuuguauga

SEQ ID NO: 3221272 - RNA, 14 nt, Human
gagacuuguaguuu

SEQ ID NO: 3221273 - RNA, 22 nt, Human
gagaagccagcuuuccucauca

SEQ ID NO: 3221274 - RNA, 20 nt, Human
gagaaugcacaaacagaggc

SEQ ID NO: 3221275 - RNA, 21 nt, Human
gagaaugcacaaacagaggcc

SEQ ID NO: 3221276 - RNA, 13 nt, Human
gagaagagcuguu

SEQ ID NO: 3221277 - RNA, 20 nt, Human
gagaagauggauaugaccag

SEQ ID NO: 3221278 - RNA, 22 nt, Human
gagaagagcuguucacagccag

SEQ ID NO: 3221279 - RNA, 15 nt, Human
gagaagagcuguuca

SEQ ID NO: 3221280 - RNA, 12 nt, Human
gagacagcccgg

SEQ ID NO: 3221281 - RNA, 19 nt, Human
gagacagaguuuucacucu

SEQ ID NO: 3221282 - RNA, 19 nt, Human
gagacagagcaaccccugg

SEQ ID NO: 3221283 - RNA, 17 nt, Human
gagacagacuagaaguu

SEQ ID NO: 3221284 - RNA, 20 nt, Human
gagacagagcgacagagcag

SEQ ID NO: 3221285 - RNA, 15 nt, Human
gagacagacuagaag

SEQ ID NO: 3221286 - RNA, 15 nt, Human
gagacacaagccuuc

SEQ ID NO: 3221287 - RNA, 17 nt, Human
gagacacaagccuucgg

SEQ ID NO: 3221288 - RNA, 18 nt, Human
gacuugugcacaggcaga

SEQ ID NO: 3221289 - RNA, 17 nt, Human
gacuugugcacaggcag

SEQ ID NO: 3221290 - RNA, 13 nt, Human
gacuuggaagcuc

SEQ ID NO: 3221291 - RNA, 19 nt, Human
gacuugugcacaggcagag

SEQ ID NO: 3221292 - RNA, 21 nt, Human
gagaaaauggacguguuauga

SEQ ID NO: 3221293 - RNA, 16 nt, Human
gacuuguucuugauag

SEQ ID NO: 3221294 - RNA, 19 nt, Human
gagaaacacugaaaagaag

SEQ ID NO: 3221295 - RNA, 17 nt, Human
gacuccugcaggcagcc

SEQ ID NO: 3221296 - RNA, 18 nt, Human
gacucgcgacaaugcaaa

SEQ ID NO: 3221297 - RNA, 19 nt, Human
gacucgcgacaaugcaaac

SEQ ID NO: 3221298 - RNA, 16 nt, Human
gacuuggaagcuccgc

SEQ ID NO: 3221299 - RNA, 15 nt, Human
gacuuggaagcuccg

SEQ ID NO: 3221300 - RNA, 14 nt, Human
gacuuggaagcucc

SEQ ID NO: 3221301 - RNA, 17 nt, Human
gagaaauauuuuaauuu

SEQ ID NO: 3221302 - RNA, 14 nt, Human
gagaaauauuuuaa

SEQ ID NO: 3221303 - RNA, 12 nt, Human
gagaaccaccua

SEQ ID NO: 3221304 - RNA, 17 nt, Human
gagaacagauaaagauu

SEQ ID NO: 3221305 - RNA, 22 nt, Human
gagaaaguacuucuccacccug

SEQ ID NO: 3221306 - RNA, 23 nt, Human
gagaaaguacuucuccacccugc

SEQ ID NO: 3221307 - RNA, 18 nt, Human
gagaaagacuauucaaac

SEQ ID NO: 3221308 - RNA, 17 nt, Human
gagaaagacuauucaaa

SEQ ID NO: 3221309 - RNA, 15 nt, Human
gagaaagacuauuca

SEQ ID NO: 3221310 - RNA, 13 nt, Human
gagaaagacuauu

SEQ ID NO: 3221311 - RNA, 18 nt, Human
gagcccacgcccccacug

SEQ ID NO: 3221312 - RNA, 20 nt, Human
gagccgagaucacgccacug

SEQ ID NO: 3221313 - RNA, 19 nt, Human
gagccgagaucacgccacu

SEQ ID NO: 3221314 - RNA, 18 nt, Human
gagcccuugcccaugcug

SEQ ID NO: 3221315 - RNA, 22 nt, Human
gagccgagaucacgccacugca

SEQ ID NO: 3221316 - RNA, 21 nt, Human
gagccgagaucacgccacugc

SEQ ID NO: 3221317 - RNA, 13 nt, Human
gagccgcagagaa

SEQ ID NO: 3221318 - RNA, 20 nt, Human
gagccgggcaaacuggccgc

SEQ ID NO: 3221319 - RNA, 17 nt, Human
gagccuacccaccccca

SEQ ID NO: 3221320 - RNA, 15 nt, Human
gagccuacccacccc

SEQ ID NO: 3221321 - RNA, 19 nt, Human
gagccuaaaaauaaagcac

SEQ ID NO: 3221322 - RNA, 17 nt, Human
gagccuaaaaauaaagc

SEQ ID NO: 3221323 - RNA, 15 nt, Human
gagccuaaaaauaaa

SEQ ID NO: 3221324 - RNA, 13 nt, Human
gagccucagcauc

SEQ ID NO: 3221325 - RNA, 15 nt, Human
gagccucagcauccu

SEQ ID NO: 3221326 - RNA, 14 nt, Human
gagccucagcaucc

SEQ ID NO: 3221327 - RNA, 17 nt, Human
gagccucagcauccugg

SEQ ID NO: 3221328 - RNA, 18 nt, Human
gagccucagucucccucc

SEQ ID NO: 3221329 - RNA, 19 nt, Human
gagccucagucucccuccc

SEQ ID NO: 3221330 - RNA, 12 nt, Human
gagccugcaguu

SEQ ID NO: 3221331 - RNA, 16 nt, Human
gagccugacagccaga

SEQ ID NO: 3221332 - RNA, 15 nt, Human
gagccugacagccag

SEQ ID NO: 3221333 - RNA, 13 nt, Human
gagccuccugccc

SEQ ID NO: 3221334 - RNA, 18 nt, Human
gagccagauuucacucuc

SEQ ID NO: 3221335 - RNA, 19 nt, Human
gagccagauuucacucucc

SEQ ID NO: 3221336 - RNA, 15 nt, Human
gagccagauuucacu

SEQ ID NO: 3221337 - RNA, 13 nt, Human
gagccacugcacc

SEQ ID NO: 3221338 - RNA, 19 nt, Human
gagccacugcaccgggcca

SEQ ID NO: 3221339 - RNA, 18 nt, Human
gagccacugcaccgggcc

SEQ ID NO: 3221340 - RNA, 17 nt, Human
gagcccaccuuggcuca

SEQ ID NO: 3221341 - RNA, 15 nt, Human
gagcccaccuuggcu

SEQ ID NO: 3221342 - RNA, 13 nt, Human
gagcccaccuugg

SEQ ID NO: 3221343 - RNA, 13 nt, Human
gagccagauuuca

SEQ ID NO: 3221344 - RNA, 12 nt, Human
gagccaggaggg

SEQ ID NO: 3221345 - RNA, 22 nt, Human
gagcagccacauuccugaugcu

SEQ ID NO: 3221346 - RNA, 14 nt, Human
gagcagccaggaga

SEQ ID NO: 3221347 - RNA, 21 nt, Human
gagcagccacauuccugaugc

SEQ ID NO: 3221348 - RNA, 19 nt, Human
gagcagagaccaucccuga

SEQ ID NO: 3221349 - RNA, 21 nt, Human
gagcagagaccaucccugaag

SEQ ID NO: 3221350 - RNA, 23 nt, Human
gagcagagaccaucccugaaggc

SEQ ID NO: 3221351 - RNA, 17 nt, Human
gagcagagaccaucccu

SEQ ID NO: 3221352 - RNA, 18 nt, Human
gagcagagaccaucccug

SEQ ID NO: 3221353 - RNA, 16 nt, Human
gagcagagaccauccc

SEQ ID NO: 3221354 - RNA, 19 nt, Human
gagauagccaaggccaaag

SEQ ID NO: 3221355 - RNA, 22 nt, Human
gagauaggaaggucauuuccau

SEQ ID NO: 3221356 - RNA, 21 nt, Human
gagauaggaaggucauuucca

SEQ ID NO: 3221357 - RNA, 20 nt, Human
gagauagccaaggccaaagg

SEQ ID NO: 3221358 - RNA, 21 nt, Human
gagauagccaaggccaaagga

SEQ ID NO: 3221359 - RNA, 19 nt, Human
gagcucacuguggugucug

SEQ ID NO: 3221360 - RNA, 16 nt, Human
gagcuauuuuaaacca

SEQ ID NO: 3221361 - RNA, 13 nt, Human
gagcuaugacuua

SEQ ID NO: 3221362 - RNA, 13 nt, Human
gagcuaggcaggg

SEQ ID NO: 3221363 - RNA, 15 nt, Human
gagcuagcagcaggg

SEQ ID NO: 3221364 - RNA, 17 nt, Human
gagcuagcagcagggag

SEQ ID NO: 3221365 - RNA, 13 nt, Human
gagcuagagaaau

SEQ ID NO: 3221366 - RNA, 15 nt, Human
gagccugcaguuauu

SEQ ID NO: 3221367 - RNA, 13 nt, Human
gagccugcccagc

SEQ ID NO: 3221368 - RNA, 13 nt, Human
gagccugccccag

SEQ ID NO: 3221369 - RNA, 19 nt, Human
gagccugacagccagaacu

SEQ ID NO: 3221370 - RNA, 18 nt, Human
gagccugccccagcgcug

SEQ ID NO: 3221371 - RNA, 17 nt, Human
gagccugccccagcgcu

SEQ ID NO: 3221372 - RNA, 20 nt, Human
gagcucccacuucugccaga

SEQ ID NO: 3221373 - RNA, 19 nt, Human
gagcucccacuucugccag

SEQ ID NO: 3221374 - RNA, 23 nt, Human
gagcuccauacacacgcugccuu

SEQ ID NO: 3221375 - RNA, 22 nt, Human
gagcuccauacacacgcugccu

SEQ ID NO: 3221376 - RNA, 21 nt, Human
gagcuccauacacacgcugcc

SEQ ID NO: 3221377 - RNA, 20 nt, Human
gagcuccauacacacgcugc

SEQ ID NO: 3221378 - RNA, 18 nt, Human
gagcuccauacacacgcu

SEQ ID NO: 3221379 - RNA, 23 nt, Human
gagcucgcggcgaggacgacuuc

SEQ ID NO: 3221380 - RNA, 15 nt, Human
gagcugaguggggga

SEQ ID NO: 3221381 - RNA, 12 nt, Human
gagcugagaaga

SEQ ID NO: 3221382 - RNA, 14 nt, Human
gagcugagaagacu

SEQ ID NO: 3221383 - RNA, 20 nt, Human
gagcuuugaaaauucagugg

SEQ ID NO: 3221384 - RNA, 22 nt, Human
gagcuuucugcuaucaaagagg

SEQ ID NO: 3221385 - RNA, 16 nt, Human
gaggaaagcaaaggag

SEQ ID NO: 3221386 - RNA, 17 nt, Human
gaggaaagcaaaggaga

SEQ ID NO: 3221387 - RNA, 17 nt, Human
gaggaaaaauaugugaa

SEQ ID NO: 3221388 - RNA, 14 nt, Human
gaggaaaaauaugu

SEQ ID NO: 3221389 - RNA, 23 nt, Human
gagcuuugucuacuucaaaaguu

SEQ ID NO: 3221390 - RNA, 23 nt, Human
gaggaaaaccaagccguggcuuc

SEQ ID NO: 3221391 - RNA, 21 nt, Human
gaggaaaaccaagccguggcu

SEQ ID NO: 3221392 - RNA, 20 nt, Human
gaggaaaaccaagccguggc

SEQ ID NO: 3221393 - RNA, 13 nt, Human
gaggaaaaauaug

SEQ ID NO: 3221394 - RNA, 18 nt, Human
gaggaagccgcuggggcc

SEQ ID NO: 3221395 - RNA, 14 nt, Human
gaggaagccgcugg

SEQ ID NO: 3221396 - RNA, 17 nt, Human
gaggaagccgcuggggc

SEQ ID NO: 3221397 - RNA, 13 nt, Human
gaggaagccgcug

SEQ ID NO: 3221398 - RNA, 17 nt, Human
gaggaagagaaaaaaua

SEQ ID NO: 3221399 - RNA, 14 nt, Human
gaggaagaauaggg

SEQ ID NO: 3221400 - RNA, 16 nt, Human
gaggaacaaggcaagg

SEQ ID NO: 3221401 - RNA, 15 nt, Human
gagcuugauuaaauc

SEQ ID NO: 3221402 - RNA, 18 nt, Human
gaggaaccucugauuuau

SEQ ID NO: 3221403 - RNA, 14 nt, Human
gaggaacaaggcaa

SEQ ID NO: 3221404 - RNA, 12 nt, Human
gaggaaaucaaa

SEQ ID NO: 3221405 - RNA, 20 nt, Human
gaggaaaucaaagugcuauu

SEQ ID NO: 3221406 - RNA, 20 nt, Human
gaggaaaguacauuuuuuga

SEQ ID NO: 3221407 - RNA, 16 nt, Human
gaggaaauccuaccuu

SEQ ID NO: 3221408 - RNA, 20 nt, Human
gaggaaagcacagaggccuc

SEQ ID NO: 3221409 - RNA, 19 nt, Human
gaggaaagcacagaggccu

SEQ ID NO: 3221410 - RNA, 22 nt, Human
gaggaaagcacagaggccuccu

SEQ ID NO: 3221411 - RNA, 13 nt, Human
gauagugggacca

SEQ ID NO: 3221412 - RNA, 13 nt, Human
gaucaaguauuac

SEQ ID NO: 3221413 - RNA, 23 nt, Human
gauagucuuggaagcuguuugga

SEQ ID NO: 3221414 - RNA, 18 nt, Human
gaucacgccacugcacua

SEQ ID NO: 3221415 - RNA, 16 nt, Human
gaucacgccacugcac

SEQ ID NO: 3221416 - RNA, 14 nt, Human
gaucagccagaagc

SEQ ID NO: 3221417 - RNA, 15 nt, Human
gaucagccagaagcc

SEQ ID NO: 3221418 - RNA, 12 nt, Human
gaucagccuggg

SEQ ID NO: 3221419 - RNA, 15 nt, Human
gaucagccugggcaa

SEQ ID NO: 3221420 - RNA, 22 nt, Human
gaucagucugauucccaagcuc

SEQ ID NO: 3221421 - RNA, 14 nt, Human
gaucaguaaaauua

SEQ ID NO: 3221422 - RNA, 23 nt, Human
gaucaguaaaauuauacugugug

SEQ ID NO: 3221423 - RNA, 16 nt, Human
gaucaguaguuugcau

SEQ ID NO: 3221424 - RNA, 15 nt, Human
gaucauuugaguuca

SEQ ID NO: 3221425 - RNA, 14 nt, Human
gaucauuaucagcc

SEQ ID NO: 3221426 - RNA, 20 nt, Human
gauccccaagccuggcaagg

SEQ ID NO: 3221427 - RNA, 21 nt, Human
gaucauccacugugccaugug

SEQ ID NO: 3221428 - RNA, 16 nt, Human
gaucauccacugugcc

SEQ ID NO: 3221429 - RNA, 12 nt, Human
gaucaugaauaa

SEQ ID NO: 3221430 - RNA, 19 nt, Human
gaucauccacugugccaug

SEQ ID NO: 3221431 - RNA, 17 nt, Human
gaucauccacugugcca

SEQ ID NO: 3221432 - RNA, 22 nt, Human
gaucaguaguuugcauuucaga

SEQ ID NO: 3221433 - RNA, 17 nt, Human
gaucaguaguuugcauu

SEQ ID NO: 3221434 - RNA, 13 nt, Human
gauagaugugugg

SEQ ID NO: 3221435 - RNA, 18 nt, Human
gauacaggaaaagcugcu

SEQ ID NO: 3221436 - RNA, 20 nt, Human
gauagcacagacccugcccu

SEQ ID NO: 3221437 - RNA, 15 nt, Human
gauagcagccuggcu

SEQ ID NO: 3221438 - RNA, 22 nt, Human
gauagcagccuggcuccccugg

SEQ ID NO: 3221439 - RNA, 21 nt, Human
gauagcacagacccugcccug

SEQ ID NO: 3221440 - RNA, 22 nt, Human
gauagcacagacccugcccugu

SEQ ID NO: 3221441 - RNA, 19 nt, Human
gauacaccgggccuggaga

SEQ ID NO: 3221442 - RNA, 18 nt, Human
gauacacucaagcaugaa

SEQ ID NO: 3221443 - RNA, 23 nt, Human
gauacacucaagcaugaagauaa

SEQ ID NO: 3221444 - RNA, 16 nt, Human
gauaaagauugugugg

SEQ ID NO: 3221445 - RNA, 13 nt, Human
gauaaagauugug

SEQ ID NO: 3221446 - RNA, 21 nt, Human
gauaaagauugugugguguuu

SEQ ID NO: 3221447 - RNA, 13 nt, Human
gaggaaggaaacc

SEQ ID NO: 3221448 - RNA, 19 nt, Human
gaggaaggaaacccagcuc

SEQ ID NO: 3221449 - RNA, 20 nt, Human
gaggaaggaaacccagcucu

SEQ ID NO: 3221450 - RNA, 18 nt, Human
gauaagggacugauguuu

SEQ ID NO: 3221451 - RNA, 21 nt, Human
gauaaauauugagcagaucua

SEQ ID NO: 3221452 - RNA, 20 nt, Human
gauaagcaguuaugugaccu

SEQ ID NO: 3221453 - RNA, 14 nt, Human
gauaagggaaaaga

SEQ ID NO: 3221454 - RNA, 16 nt, Human
gauaagggaaaagaua

SEQ ID NO: 3221455 - RNA, 15 nt, Human
gauaaauauuauauu

SEQ ID NO: 3221456 - RNA, 22 nt, Human
gauaaauauuauauuauauaua

SEQ ID NO: 3221457 - RNA, 17 nt, Human
gauaaauaguguuauug

SEQ ID NO: 3221458 - RNA, 20 nt, Human
gauaaauauucacacuugaa

SEQ ID NO: 3221459 - RNA, 12 nt, Human
gauaaauauuca

SEQ ID NO: 3221460 - RNA, 22 nt, Human
gauaaauaguuuaugauuccac

SEQ ID NO: 3221461 - RNA, 21 nt, Human
gaucugugaggggcucucuca

SEQ ID NO: 3221462 - RNA, 21 nt, Human
gaucucaggggucuuaccuug

SEQ ID NO: 3221463 - RNA, 22 nt, Human
gaucugugccuuuuuuauaucu

SEQ ID NO: 3221464 - RNA, 17 nt, Human
gaucuuugcagacaggc

SEQ ID NO: 3221465 - RNA, 18 nt, Human
gaucuuugcagacaggca

SEQ ID NO: 3221466 - RNA, 14 nt, Human
gaugaaaauauuua

SEQ ID NO: 3221467 - RNA, 16 nt, Human
gaugaaaauauuuaaa

SEQ ID NO: 3221468 - RNA, 15 nt, Human
gaugaaaauauuuaa

SEQ ID NO: 3221469 - RNA, 17 nt, Human
gaugaaaauauuuaaag

SEQ ID NO: 3221470 - RNA, 14 nt, Human
gaugaaaauauuug

SEQ ID NO: 3221471 - RNA, 14 nt, Human
gaugaagacagccc

SEQ ID NO: 3221472 - RNA, 21 nt, Human
gauccugagccagauuucacu

SEQ ID NO: 3221473 - RNA, 22 nt, Human
gauccugagccagauuucacuc

SEQ ID NO: 3221474 - RNA, 18 nt, Human
gauccugcacugacucug

SEQ ID NO: 3221475 - RNA, 15 nt, Human
gaucccucauccuca

SEQ ID NO: 3221476 - RNA, 16 nt, Human
gaucccucauccucau

SEQ ID NO: 3221477 - RNA, 18 nt, Human
gauccccuuccuaccacc

SEQ ID NO: 3221478 - RNA, 16 nt, Human
gauccccuuccuacca

SEQ ID NO: 3221479 - RNA, 21 nt, Human
gaucuaaaaauaacuguaauu

SEQ ID NO: 3221480 - RNA, 20 nt, Human
gaucgucugguuagaaaaca

SEQ ID NO: 3221481 - RNA, 17 nt, Human
gaucgguuaacaaauaa

SEQ ID NO: 3221482 - RNA, 16 nt, Human
gaucgguuaacaaaua

SEQ ID NO: 3221483 - RNA, 21 nt, Human
gauccugcacugacucuggaa

SEQ ID NO: 3221484 - RNA, 13 nt, Human
gaugcaccagccc

SEQ ID NO: 3221485 - RNA, 23 nt, Human
gaugcagacagggggccagaaca

SEQ ID NO: 3221486 - RNA, 14 nt, Human
gaugcagccucaca

SEQ ID NO: 3221487 - RNA, 12 nt, Human
gaugcagccuca

SEQ ID NO: 3221488 - RNA, 17 nt, Human
gaugccugguggcagcu

SEQ ID NO: 3221489 - RNA, 22 nt, Human
gaugccacuaccccuugauuuu

SEQ ID NO: 3221490 - RNA, 21 nt, Human
gaugccaagaaguuuaaggaa

SEQ ID NO: 3221491 - RNA, 22 nt, Human
gauggccgggcgcgguggcuca

SEQ ID NO: 3221492 - RNA, 22 nt, Human
gauggauuuccagccaaagccu

SEQ ID NO: 3221493 - RNA, 19 nt, Human
gaugccugguggcagcugc

SEQ ID NO: 3221494 - RNA, 18 nt, Human
gaugccugguggcagcug

SEQ ID NO: 3221495 - RNA, 20 nt, Human
gaugccugguggcagcugcg

SEQ ID NO: 3221496 - RNA, 19 nt, Human
gauggauauauguuuuuga

SEQ ID NO: 3221497 - RNA, 21 nt, Human
gauggcuaguaucaaaagaaa

SEQ ID NO: 3221498 - RNA, 19 nt, Human
gauggcugugccucugccu

SEQ ID NO: 3221499 - RNA, 18 nt, Human
gauggcugugccucugcc

SEQ ID NO: 3221500 - RNA, 17 nt, Human
gauggcugugccucugc

SEQ ID NO: 3221501 - RNA, 13 nt, Human
gauggcugugccu

SEQ ID NO: 3221502 - RNA, 14 nt, Human
gauggggcccugcc

SEQ ID NO: 3221503 - RNA, 22 nt, Human
gauggggcccugccuccuuugu

SEQ ID NO: 3221504 - RNA, 13 nt, Human
gauggggcccugc

SEQ ID NO: 3221505 - RNA, 20 nt, Human
gauggcugugccucugccug

SEQ ID NO: 3221506 - RNA, 16 nt, Human
gauggcuuacaaaaag

SEQ ID NO: 3221507 - RNA, 17 nt, Human
gauuccagguggcauca

SEQ ID NO: 3221508 - RNA, 18 nt, Human
gauucccaagcucugcuc

SEQ ID NO: 3221509 - RNA, 20 nt, Human
gauuccagagaguggcuccu

SEQ ID NO: 3221510 - RNA, 19 nt, Human
gauuccagagaguggcucc

SEQ ID NO: 3221511 - RNA, 22 nt, Human
gauuccagagaguggcuccucc

SEQ ID NO: 3221512 - RNA, 20 nt, Human
gauucagauuucucuuugaa

SEQ ID NO: 3221513 - RNA, 15 nt, Human
gauuccagcacaacc

SEQ ID NO: 3221514 - RNA, 19 nt, Human
gauucauauuuacuucuua

SEQ ID NO: 3221515 - RNA, 18 nt, Human
gauucauauuuacuucuu

SEQ ID NO: 3221516 - RNA, 17 nt, Human
gauucauauuuacuucu

SEQ ID NO: 3221517 - RNA, 14 nt, Human
gauucagauuucuc

SEQ ID NO: 3221518 - RNA, 23 nt, Human
gauggggcugcaccggcuggccu

SEQ ID NO: 3221519 - RNA, 19 nt, Human
gauggggcugcaccggcug

SEQ ID NO: 3221520 - RNA, 12 nt, Human
gauggggcuggg

SEQ ID NO: 3221521 - RNA, 13 nt, Human
gauucagcucugc

SEQ ID NO: 3221522 - RNA, 15 nt, Human
gauucagcucugcaa

SEQ ID NO: 3221523 - RNA, 19 nt, Human
gauucagacagcugccugg

SEQ ID NO: 3221524 - RNA, 18 nt, Human
gauucagacagcugccug

SEQ ID NO: 3221525 - RNA, 20 nt, Human
gauucccaagcucugcuccu

SEQ ID NO: 3221526 - RNA, 19 nt, Human
gauucccaagcucugcucc

SEQ ID NO: 3221527 - RNA, 17 nt, Human
gauuccauuuacugcau

SEQ ID NO: 3221528 - RNA, 12 nt, Human
gauucuuuccug

SEQ ID NO: 3221529 - RNA, 23 nt, Human
gauucguggucuuuuccucgcuu

SEQ ID NO: 3221530 - RNA, 18 nt, Human
gauucguggucuuuuccu

SEQ ID NO: 3221531 - RNA, 16 nt, Human
gauucuuuccugaggc

SEQ ID NO: 3221532 - RNA, 17 nt, Human
gauucuuuccugaggcu

SEQ ID NO: 3221533 - RNA, 18 nt, Human
gauucuuuccugaggcug

SEQ ID NO: 3221534 - RNA, 20 nt, Human
gauugcaacaggcugggcuu

SEQ ID NO: 3221535 - RNA, 16 nt, Human
gauugcaccacugcac

SEQ ID NO: 3221536 - RNA, 23 nt, Human
gauugcaccacugcacuccagcc

SEQ ID NO: 3221537 - RNA, 21 nt, Human
gauugcaacaggcugggcuuc

SEQ ID NO: 3221538 - RNA, 18 nt, Human
gauugcaacaggcugggc

SEQ ID NO: 3221539 - RNA, 23 nt, Human
gauuugcucagugucuggcugca

SEQ ID NO: 3221540 - RNA, 17 nt, Human
gauuugccauagaguac

SEQ ID NO: 3221541 - RNA, 20 nt, Human
gauuuggggcucagaguggg

SEQ ID NO: 3221542 - RNA, 15 nt, Human
gauuugggagaaggg

SEQ ID NO: 3221543 - RNA, 17 nt, Human
gauuugggcugaaugua

SEQ ID NO: 3221544 - RNA, 19 nt, Human
gauuugggcugaauguaug

SEQ ID NO: 3221545 - RNA, 13 nt, Human
gauuugccauaga

SEQ ID NO: 3221546 - RNA, 14 nt, Human
gauuucuguucagc

SEQ ID NO: 3221547 - RNA, 21 nt, Human
gauuucucacacucuaacugu

SEQ ID NO: 3221548 - RNA, 22 nt, Human
gauuucucuuugaaacaugcuu

SEQ ID NO: 3221549 - RNA, 13 nt, Human
gauuucucuuuga

SEQ ID NO: 3221550 - RNA, 13 nt, Human
gauugcagaauug

SEQ ID NO: 3221551 - RNA, 15 nt, Human
gauugcagaauuguu

SEQ ID NO: 3221552 - RNA, 19 nt, Human
gauugcagaauuguuuaga

SEQ ID NO: 3221553 - RNA, 16 nt, Human
gauugcagaauuguuu

SEQ ID NO: 3221554 - RNA, 21 nt, Human
gauuuuccaucuaaaaauaua

SEQ ID NO: 3221555 - RNA, 16 nt, Human
gauuuuccaucuaaaa

SEQ ID NO: 3221556 - RNA, 11 nt, Human
gauuuuccauc

SEQ ID NO: 3221557 - RNA, 21 nt, Human
gauuuuugagcccuuguuuca

SEQ ID NO: 3221558 - RNA, 15 nt, Human
gauuuuauucuugau

SEQ ID NO: 3221559 - RNA, 13 nt, Human
gauuuuauucuug

SEQ ID NO: 3221560 - RNA, 20 nt, Human
gauuuuauguugacauuugu

SEQ ID NO: 3221561 - RNA, 17 nt, Human
gauuugucacugcuuca

SEQ ID NO: 3221562 - RNA, 18 nt, Human
gauuuuauguugacauuu

SEQ ID NO: 3221563 - RNA, 16 nt, Human
gauuuuauguugacau

SEQ ID NO: 3221564 - RNA, 14 nt, Human
gauuuuauguugac

SEQ ID NO: 3221565 - RNA, 13 nt, Human
gauuuuauguuga

SEQ ID NO: 3221566 - RNA, 22 nt, Human
gcaaauccuugugggaaaagaa

SEQ ID NO: 3221567 - RNA, 17 nt, Human
gcaagaauugaagcagg

SEQ ID NO: 3221568 - RNA, 13 nt, Human
gcaagaaaagagu

SEQ ID NO: 3221569 - RNA, 14 nt, Human
gcaagacgcugugc

SEQ ID NO: 3221570 - RNA, 20 nt, Human
gcaagacgcugugcugcccu

SEQ ID NO: 3221571 - RNA, 21 nt, Human
gcaagacgcugugcugcccug

SEQ ID NO: 3221572 - RNA, 22 nt, Human
gcaagacgcugugcugcccugc

SEQ ID NO: 3221573 - RNA, 23 nt, Human
gcaagacgcugugcugcccugcc

SEQ ID NO: 3221574 - RNA, 18 nt, Human
gcaagaggcaagcugaaa

SEQ ID NO: 3221575 - RNA, 19 nt, Human
gcaagaggcaagcugaaau

SEQ ID NO: 3221576 - RNA, 20 nt, Human
gcaaauccuugugggaaaag

SEQ ID NO: 3221577 - RNA, 16 nt, Human
gcaaauccgaaaucag

SEQ ID NO: 3221578 - RNA, 20 nt, Human
gcaaaguacagguacuuugu

SEQ ID NO: 3221579 - RNA, 13 nt, Human
gcaaaguaguacu

SEQ ID NO: 3221580 - RNA, 14 nt, Human
gcaaaguaguacuu

SEQ ID NO: 3221581 - RNA, 23 nt, Human
gcaaaguaguacuucuucuguaa

SEQ ID NO: 3221582 - RNA, 19 nt, Human
gcaaaguacagguacuuug

SEQ ID NO: 3221583 - RNA, 23 nt, Human
gcaaagggggaggagaagaaaau

SEQ ID NO: 3221584 - RNA, 23 nt, Human
gcaaagcacugacuucuaaguaa

SEQ ID NO: 3221585 - RNA, 21 nt, Human
gcaaagcccagcuugaaaccu

SEQ ID NO: 3221586 - RNA, 13 nt, Human
gcaaagcccagcu

SEQ ID NO: 3221587 - RNA, 20 nt, Human
gcaaagcauguuuugcaugu

SEQ ID NO: 3221588 - RNA, 21 nt, Human
gcaaagcaugccaauuucucu

SEQ ID NO: 3221589 - RNA, 21 nt, Human
gcaauauucucuguacauauu

SEQ ID NO: 3221590 - RNA, 15 nt, Human
gcaaucaaaucugcu

SEQ ID NO: 3221591 - RNA, 17 nt, Human
gcaaucaaaucugcuuu

SEQ ID NO: 3221592 - RNA, 22 nt, Human
gcaauauucucuguacauauua

SEQ ID NO: 3221593 - RNA, 22 nt, Human
gcaauauuguauauuuuuaucu

SEQ ID NO: 3221594 - RNA, 15 nt, Human
gcaaugaccuuucaa

SEQ ID NO: 3221595 - RNA, 17 nt, Human
gcaaugaccuuucaaua

SEQ ID NO: 3221596 - RNA, 20 nt, Human
gcaaugaccuuucaauagga

SEQ ID NO: 3221597 - RNA, 22 nt, Human
gcaaugaccuuucaauaggaaa

SEQ ID NO: 3221598 - RNA, 23 nt, Human
gcaaugcuggcuguuggcugggg

SEQ ID NO: 3221599 - RNA, 22 nt, Human
gcaaugcuggcuguuggcuggg

SEQ ID NO: 3221600 - RNA, 14 nt, Human
gcaaugcuggcugu

SEQ ID NO: 3221601 - RNA, 13 nt, Human
gcaaugcuggcug

SEQ ID NO: 3221602 - RNA, 23 nt, Human
gcaaugaccuuucaauaggaaaa

SEQ ID NO: 3221603 - RNA, 14 nt, Human
gcaagggugauggg

SEQ ID NO: 3221604 - RNA, 14 nt, Human
gcaagguaaaauuu

SEQ ID NO: 3221605 - RNA, 20 nt, Human
gcaaggcgcuaacuugcuua

SEQ ID NO: 3221606 - RNA, 17 nt, Human
gcaagggaggcccagcg

SEQ ID NO: 3221607 - RNA, 21 nt, Human
gcaagggcggccuuucccacu

SEQ ID NO: 3221608 - RNA, 19 nt, Human
gcaagggcggccuuuccca

SEQ ID NO: 3221609 - RNA, 21 nt, Human
gcaagggcagggacagggccg

SEQ ID NO: 3221610 - RNA, 16 nt, Human
gcaagggcagggacag

SEQ ID NO: 3221611 - RNA, 11 nt, Human
gcaaggcuguc

SEQ ID NO: 3221612 - RNA, 18 nt, Human
gcaaggcgcuaacuugcu

SEQ ID NO: 3221613 - RNA, 16 nt, Human
gcaaggcgcuaacuug

SEQ ID NO: 3221614 - RNA, 22 nt, Human
gcaaggccaccucuuccuggcc

SEQ ID NO: 3221615 - RNA, 20 nt, Human
gcaaggccaccucuuccugg

SEQ ID NO: 3221616 - RNA, 14 nt, Human
gcaaggccaccucu

SEQ ID NO: 3221617 - RNA, 13 nt, Human
gcaaggccaccuc

SEQ ID NO: 3221618 - RNA, 18 nt, Human
gcauuauauuuguaaauu

SEQ ID NO: 3221619 - RNA, 14 nt, Human
gcauuauuaaauug

SEQ ID NO: 3221620 - RNA, 18 nt, Human
gcauuauuaaauuguaaa

SEQ ID NO: 3221621 - RNA, 20 nt, Human
gcauuauaaucaccagggcc

SEQ ID NO: 3221622 - RNA, 19 nt, Human
gcauucacauuuagaaaag

SEQ ID NO: 3221623 - RNA, 21 nt, Human
gcauucuucugaucacugaaa

SEQ ID NO: 3221624 - RNA, 14 nt, Human
gcauucuucugauc

SEQ ID NO: 3221625 - RNA, 15 nt, Human
gcauuuguguguuac

SEQ ID NO: 3221626 - RNA, 14 nt, Human
gcauuugcugaaua

SEQ ID NO: 3221627 - RNA, 12 nt, Human
gcauuugugaaa

SEQ ID NO: 3221628 - RNA, 13 nt, Human
gcauuuguguguu

SEQ ID NO: 3221629 - RNA, 13 nt, Human
gcauuugcugaau

SEQ ID NO: 3221630 - RNA, 14 nt, Human
gccaaacucaccug

SEQ ID NO: 3221631 - RNA, 16 nt, Human
gccaaacucaccugcc

SEQ ID NO: 3221632 - RNA, 22 nt, Human
gcauuuguuucuuucucugagg

SEQ ID NO: 3221633 - RNA, 17 nt, Human
gcauuuuugcaggagca

SEQ ID NO: 3221634 - RNA, 16 nt, Human
gcauuuuugcaggagc

SEQ ID NO: 3221635 - RNA, 22 nt, Human
gccaaagcuaggccuggccaga

SEQ ID NO: 3221636 - RNA, 16 nt, Human
gccaaagcuaggccug

SEQ ID NO: 3221637 - RNA, 16 nt, Human
gccaaagccuccucca

SEQ ID NO: 3221638 - RNA, 19 nt, Human
gccaaagccuccuccagcc

SEQ ID NO: 3221639 - RNA, 20 nt, Human
gccaaagccaaagcuaggcc

SEQ ID NO: 3221640 - RNA, 13 nt, Human
gccaaagccaaag

SEQ ID NO: 3221641 - RNA, 20 nt, Human
gcaucugaccucuaccuuca

SEQ ID NO: 3221642 - RNA, 20 nt, Human
gcaucacuuaaaacacguuu

SEQ ID NO: 3221643 - RNA, 16 nt, Human
gcaucacuuaaaacac

SEQ ID NO: 3221644 - RNA, 15 nt, Human
gcaugaacagugcac

SEQ ID NO: 3221645 - RNA, 21 nt, Human
gcaugaacagcuaauuguacc

SEQ ID NO: 3221646 - RNA, 16 nt, Human
gcaugaaaauuguguu

SEQ ID NO: 3221647 - RNA, 19 nt, Human
gcaugaaaugaacacaaau

SEQ ID NO: 3221648 - RNA, 18 nt, Human
gcaugaaaugaacacaaa

SEQ ID NO: 3221649 - RNA, 16 nt, Human
gcaugaaaugaacaca

SEQ ID NO: 3221650 - RNA, 13 nt, Human
gcaucuuugaugu

SEQ ID NO: 3221651 - RNA, 11 nt, Human
gcaucuuugau

SEQ ID NO: 3221652 - RNA, 15 nt, Human
gcaucuuugaugugu

SEQ ID NO: 3221653 - RNA, 17 nt, Human
gcaucuuugauguguug

SEQ ID NO: 3221654 - RNA, 18 nt, Human
gcauggagauagccccac

SEQ ID NO: 3221655 - RNA, 18 nt, Human
gcaugcgggcuuccuccu

SEQ ID NO: 3221656 - RNA, 18 nt, Human
gcaugauugcagaauugu

SEQ ID NO: 3221657 - RNA, 21 nt, Human
gcauguucucugaggacacua

SEQ ID NO: 3221658 - RNA, 15 nt, Human
gcauguucucugagg

SEQ ID NO: 3221659 - RNA, 14 nt, Human
gcauguucucugag

SEQ ID NO: 3221660 - RNA, 20 nt, Human
gcauggcaaggacugcaggg

SEQ ID NO: 3221661 - RNA, 19 nt, Human
gcaggggcccugcagcucu

SEQ ID NO: 3221662 - RNA, 20 nt, Human
gcaggggcccugcagcucuc

SEQ ID NO: 3221663 - RNA, 14 nt, Human
gcagggcucagcgg

SEQ ID NO: 3221664 - RNA, 22 nt, Human
gcaggggaggguagagcggaga

SEQ ID NO: 3221665 - RNA, 18 nt, Human
gcagggucucacucuguc

SEQ ID NO: 3221666 - RNA, 17 nt, Human
gcagggucucacucugu

SEQ ID NO: 3221667 - RNA, 15 nt, Human
gcaggcagccaggcc

SEQ ID NO: 3221668 - RNA, 16 nt, Human
gcaggcagccaggcca

SEQ ID NO: 3221669 - RNA, 21 nt, Human
gcagggcaggaccagcccacg

SEQ ID NO: 3221670 - RNA, 21 nt, Human
gcagggcucagcggggacagc

SEQ ID NO: 3221671 - RNA, 19 nt, Human
gcagggcucagcggggaca

SEQ ID NO: 3221672 - RNA, 13 nt, Human
gcagguccccaga

SEQ ID NO: 3221673 - RNA, 20 nt, Human
gcaggucuugaacuccuggc

SEQ ID NO: 3221674 - RNA, 19 nt, Human
gcaggucuugaacuccugg

SEQ ID NO: 3221675 - RNA, 22 nt, Human
gcagguccaggguuugaguuca

SEQ ID NO: 3221676 - RNA, 20 nt, Human
gcagguaggaauauuauauu

SEQ ID NO: 3221677 - RNA, 16 nt, Human
gcagguaggaauauua

SEQ ID NO: 3221678 - RNA, 14 nt, Human
gcaggguuucuuuu

SEQ ID NO: 3221679 - RNA, 23 nt, Human
gcagggugucugcccccuccuga

SEQ ID NO: 3221680 - RNA, 19 nt, Human
gcagggugucugcccccuc

SEQ ID NO: 3221681 - RNA, 17 nt, Human
gcaguggagcccaggag

SEQ ID NO: 3221682 - RNA, 16 nt, Human
gcaguggagcccagga

SEQ ID NO: 3221683 - RNA, 20 nt, Human
gcaguggcgaaaucccugcu

SEQ ID NO: 3221684 - RNA, 15 nt, Human
gcagugcaugcuguc

SEQ ID NO: 3221685 - RNA, 23 nt, Human
gcaggugaucugcugcagagcag

SEQ ID NO: 3221686 - RNA, 16 nt, Human
gcagugcaugcugucc

SEQ ID NO: 3221687 - RNA, 16 nt, Human
gcagugcaaggaggga

SEQ ID NO: 3221688 - RNA, 15 nt, Human
gcagugcccaggugg

SEQ ID NO: 3221689 - RNA, 14 nt, Human
gcagugcccaggug

SEQ ID NO: 3221690 - RNA, 22 nt, Human
gcauaugcuucuuuaaaaaagc

SEQ ID NO: 3221691 - RNA, 17 nt, Human
gcauaugacaaauguuu

SEQ ID NO: 3221692 - RNA, 16 nt, Human
gcauaugacaaauguu

SEQ ID NO: 3221693 - RNA, 15 nt, Human
gcauaugacaaaugu

SEQ ID NO: 3221694 - RNA, 14 nt, Human
gcauaugacaaaug

SEQ ID NO: 3221695 - RNA, 19 nt, Human
gcauaugacaaauguuucu

SEQ ID NO: 3221696 - RNA, 18 nt, Human
gcauaugacaaauguuuc

SEQ ID NO: 3221697 - RNA, 20 nt, Human
gcauaugacaaauguuucua

SEQ ID NO: 3221698 - RNA, 16 nt, Human
gcaguucuuaacccag

SEQ ID NO: 3221699 - RNA, 22 nt, Human
gcauauaaaauggcaacaaacu

SEQ ID NO: 3221700 - RNA, 15 nt, Human
gcauauaaaauggca

SEQ ID NO: 3221701 - RNA, 22 nt, Human
gcauagucuacuuguuauaaau

SEQ ID NO: 3221702 - RNA, 14 nt, Human
gcauauccuuuuag

SEQ ID NO: 3221703 - RNA, 17 nt, Human
gcauaguaaauguaguu

SEQ ID NO: 3221704 - RNA, 18 nt, Human
gcauaguuguagacaaag

SEQ ID NO: 3221705 - RNA, 21 nt, Human
gcauaguuguagacaaaguac

SEQ ID NO: 3221706 - RNA, 23 nt, Human
gcaguuaugugaccucacgugca

SEQ ID NO: 3221707 - RNA, 13 nt, Human
gcaguucaccaug

SEQ ID NO: 3221708 - RNA, 17 nt, Human
gcaguuauuaacacuaa

SEQ ID NO: 3221709 - RNA, 15 nt, Human
gcagugggagcugcc

SEQ ID NO: 3221710 - RNA, 14 nt, Human
gcagugggagcugc

SEQ ID NO: 3221711 - RNA, 12 nt, Human
gcagugggagcu

SEQ ID NO: 3221712 - RNA, 13 nt, Human
gcagugggagcug

SEQ ID NO: 3221713 - RNA, 22 nt, Human
gcaguuaugugaccucacgugc

SEQ ID NO: 3221714 - RNA, 14 nt, Human
gcaguguagauuuu

SEQ ID NO: 3221715 - RNA, 18 nt, Human
gcagauaaacaguaguga

SEQ ID NO: 3221716 - RNA, 20 nt, Human
gcagaguugaagacagagcu

SEQ ID NO: 3221717 - RNA, 21 nt, Human
gcagaguugaagacagagcua

SEQ ID NO: 3221718 - RNA, 17 nt, Human
gcagacaguuaagagaa

SEQ ID NO: 3221719 - RNA, 20 nt, Human
gcagacaugguggggucucc

SEQ ID NO: 3221720 - RNA, 20 nt, Human
gcagacagggggccagaaca

SEQ ID NO: 3221721 - RNA, 21 nt, Human
gcagauucuaggaccuguguc

SEQ ID NO: 3221722 - RNA, 17 nt, Human
gcagauacuacugacca

SEQ ID NO: 3221723 - RNA, 24 nt, Human
gcagauacuacugaccagacaagc

SEQ ID NO: 3221724 - RNA, 22 nt, Human
gcagauacuacugaccagacaa

SEQ ID NO: 3221725 - RNA, 22 nt, Human
gcagauacaggaaaagcugcug

SEQ ID NO: 3221726 - RNA, 20 nt, Human
gcagccccgugggguuccuc

SEQ ID NO: 3221727 - RNA, 20 nt, Human
gcagccccuguucuggcaga

SEQ ID NO: 3221728 - RNA, 21 nt, Human
gcagccccuguucuggcagag

SEQ ID NO: 3221729 - RNA, 22 nt, Human
gcagcccgcaucagcugcucag

SEQ ID NO: 3221730 - RNA, 19 nt, Human
gcagcccgcaucagcugcu

SEQ ID NO: 3221731 - RNA, 13 nt, Human
gcagcccugcaga

SEQ ID NO: 3221732 - RNA, 24 nt, Human
gcagccccauucugccugcccagg

SEQ ID NO: 3221733 - RNA, 21 nt, Human
gcagccccauucugccugccc

SEQ ID NO: 3221734 - RNA, 19 nt, Human
gcagccccauucugccugc

SEQ ID NO: 3221735 - RNA, 18 nt, Human
gcagccccauucugccug

SEQ ID NO: 3221736 - RNA, 17 nt, Human
gcagccccauucugccu

SEQ ID NO: 3221737 - RNA, 17 nt, Human
gcagcaauaauuucugu

SEQ ID NO: 3221738 - RNA, 17 nt, Human
gcagauuuuaguuuuau

SEQ ID NO: 3221739 - RNA, 13 nt, Human
gcagcccugcuuu

SEQ ID NO: 3221740 - RNA, 15 nt, Human
gcagccuggcucccc

SEQ ID NO: 3221741 - RNA, 17 nt, Human
gcagccuggcuccccug

SEQ ID NO: 3221742 - RNA, 19 nt, Human
gcagccuggcuccccuggg

SEQ ID NO: 3221743 - RNA, 20 nt, Human
gcagccuggcuccccugggg

SEQ ID NO: 3221744 - RNA, 21 nt, Human
gcagccuggcuccccuggggu

SEQ ID NO: 3221745 - RNA, 14 nt, Human
gcagcccugcagag

SEQ ID NO: 3221746 - RNA, 15 nt, Human
gcagcccugcagagg

SEQ ID NO: 3221747 - RNA, 16 nt, Human
gcagcccugcagaggg

SEQ ID NO: 3221748 - RNA, 17 nt, Human
gcagcccugcagagggc

SEQ ID NO: 3221749 - RNA, 15 nt, Human
gcagcucaccucucc

SEQ ID NO: 3221750 - RNA, 15 nt, Human
gcagccuuggcaaac

SEQ ID NO: 3221751 - RNA, 14 nt, Human
gcagcucaccucuc

SEQ ID NO: 3221752 - RNA, 23 nt, Human
gcaggaggaucacuugaguccag

SEQ ID NO: 3221753 - RNA, 19 nt, Human
gcaggacacugcagaacag

SEQ ID NO: 3221754 - RNA, 14 nt, Human
gcaggacacugcag

SEQ ID NO: 3221755 - RNA, 20 nt, Human
gcaggaggaucacuugaguc

SEQ ID NO: 3221756 - RNA, 20 nt, Human
gcaggaaggcugagaggaga

SEQ ID NO: 3221757 - RNA, 13 nt, Human
gcaggcagccagg

SEQ ID NO: 3221758 - RNA, 14 nt, Human
gcaggcagccaggc

SEQ ID NO: 3221759 - RNA, 12 nt, Human
gcaggcagccag

SEQ ID NO: 3221760 - RNA, 9 nt, Human
gcaggcagc

SEQ ID NO: 3221761 - RNA, 21 nt, Human
gcaggagggacagucucacca

SEQ ID NO: 3221762 - RNA, 18 nt, Human
gcaccuuagacagucccu

SEQ ID NO: 3221763 - RNA, 15 nt, Human
gcacccucaggcagg

SEQ ID NO: 3221764 - RNA, 23 nt, Human
gcacccguguuuguaaaaaugua

SEQ ID NO: 3221765 - RNA, 14 nt, Human
gcaccuuagacagu

SEQ ID NO: 3221766 - RNA, 17 nt, Human
gcaccuuagacaguccc

SEQ ID NO: 3221767 - RNA, 19 nt, Human
gcacccggccccugcuggu

SEQ ID NO: 3221768 - RNA, 18 nt, Human
gcacccggccccugcugg

SEQ ID NO: 3221769 - RNA, 22 nt, Human
gcacccaccaucaugucuggcu

SEQ ID NO: 3221770 - RNA, 16 nt, Human
gcaccagcagccugga

SEQ ID NO: 3221771 - RNA, 19 nt, Human
gcaccagcccagaagugca

SEQ ID NO: 3221772 - RNA, 21 nt, Human
gcaccacugcacuccagccug

SEQ ID NO: 3221773 - RNA, 22 nt, Human
gcaccacugcacuccagccugg

SEQ ID NO: 3221774 - RNA, 15 nt, Human
gcaccagcagccugg

SEQ ID NO: 3221775 - RNA, 14 nt, Human
gcaccagcagccug

SEQ ID NO: 3221776 - RNA, 13 nt, Human
gcaauggcagccu

SEQ ID NO: 3221777 - RNA, 12 nt, Human
gcaauggcagcc

SEQ ID NO: 3221778 - RNA, 20 nt, Human
gcaccacugcacuccagccu

SEQ ID NO: 3221779 - RNA, 14 nt, Human
gcaauggcagccuu

SEQ ID NO: 3221780 - RNA, 13 nt, Human
gcacgugcacaaa

SEQ ID NO: 3221781 - RNA, 16 nt, Human
gcacugcuuccaguga

SEQ ID NO: 3221782 - RNA, 18 nt, Human
gcacugcuuccagugagg

SEQ ID NO: 3221783 - RNA, 15 nt, Human
gcacugcucucaccu

SEQ ID NO: 3221784 - RNA, 13 nt, Human
gcacugcucucac

SEQ ID NO: 3221785 - RNA, 20 nt, Human
gcacugcuuccagugaggcu

SEQ ID NO: 3221786 - RNA, 15 nt, Human
gcacugcuuccagug

SEQ ID NO: 3221787 - RNA, 19 nt, Human
gcacugguggcccgacagc

SEQ ID NO: 3221788 - RNA, 24 nt, Human
gcacugguggcccgacagccuggc

SEQ ID NO: 3221789 - RNA, 23 nt, Human
gcacugguggcccgacagccugg

SEQ ID NO: 3221790 - RNA, 22 nt, Human
gcacugguggcccgacagccug

SEQ ID NO: 3221791 - RNA, 12 nt, Human
gcagacaggacc

SEQ ID NO: 3221792 - RNA, 21 nt, Human
gcagaauuguuuagauuuugu

SEQ ID NO: 3221793 - RNA, 20 nt, Human
gcagaauuggaaaagacuaa

SEQ ID NO: 3221794 - RNA, 15 nt, Human
gcagacaaucuucug

SEQ ID NO: 3221795 - RNA, 23 nt, Human
gcagaauuguuuagauuuugugu

SEQ ID NO: 3221796 - RNA, 13 nt, Human
gcagacaggacca

SEQ ID NO: 3221797 - RNA, 15 nt, Human
gcagacaggaccagg

SEQ ID NO: 3221798 - RNA, 14 nt, Human
gcagacaggcaagc

SEQ ID NO: 3221799 - RNA, 19 nt, Human
gcagacaggcaagcaccuc

SEQ ID NO: 3221800 - RNA, 23 nt, Human
gcagacaggcaagcaccuccugc

SEQ ID NO: 3221801 - RNA, 14 nt, Human
gcacuucaggaggc

SEQ ID NO: 3221802 - RNA, 13 nt, Human
gcagaauucauuc

SEQ ID NO: 3221803 - RNA, 14 nt, Human
gcagaauucauuca

SEQ ID NO: 3221804 - RNA, 21 nt, Human
gcagaauucauucauacuuaa

SEQ ID NO: 3221805 - RNA, 14 nt, Human
gcagaauuggaaaa

SEQ ID NO: 3221806 - RNA, 13 nt, Human
gcagaauuggaaa

SEQ ID NO: 3221807 - RNA, 19 nt, Human
gcacuucagggcagauuuu

SEQ ID NO: 3221808 - RNA, 18 nt, Human
gccuuugcucuggucuau

SEQ ID NO: 3221809 - RNA, 22 nt, Human
gccuuuggaaacagcucgacuu

SEQ ID NO: 3221810 - RNA, 16 nt, Human
gccuuugcagcucaga

SEQ ID NO: 3221811 - RNA, 21 nt, Human
gccuuugcagcucagaaccac

SEQ ID NO: 3221812 - RNA, 15 nt, Human
gccuuggccucagag

SEQ ID NO: 3221813 - RNA, 17 nt, Human
gccuuucuuuucuuucu

SEQ ID NO: 3221814 - RNA, 20 nt, Human
gccuuugaagagugaaauac

SEQ ID NO: 3221815 - RNA, 23 nt, Human
gcgacaaugcaaaccaucauuga

SEQ ID NO: 3221816 - RNA, 14 nt, Human
gcgaaagaaaacuc

SEQ ID NO: 3221817 - RNA, 17 nt, Human
gcgaaaucccugcucac

SEQ ID NO: 3221818 - RNA, 23 nt, Human
gcgaaaaacucaaccaaauggua

SEQ ID NO: 3221819 - RNA, 16 nt, Human
gccuuauggaacacuc

SEQ ID NO: 3221820 - RNA, 18 nt, Human
gccuuauggaacacucug

SEQ ID NO: 3221821 - RNA, 19 nt, Human
gccuuauggaacacucuga

SEQ ID NO: 3221822 - RNA, 12 nt, Human
gccuuccagggg

SEQ ID NO: 3221823 - RNA, 13 nt, Human
gccuuccaccucu

SEQ ID NO: 3221824 - RNA, 13 nt, Human
gccuucagggagu

SEQ ID NO: 3221825 - RNA, 21 nt, Human
gccuucagggagugagggauu

SEQ ID NO: 3221826 - RNA, 16 nt, Human
gccuucagcucuacag

SEQ ID NO: 3221827 - RNA, 13 nt, Human
gccuucaucuccc

SEQ ID NO: 3221828 - RNA, 15 nt, Human
gccuuccaggggugg

SEQ ID NO: 3221829 - RNA, 16 nt, Human
gccuuccagggguggg

SEQ ID NO: 3221830 - RNA, 22 nt, Human
gccuucgauacaccgggccugg

SEQ ID NO: 3221831 - RNA, 18 nt, Human
gccuucgauacaccgggc

SEQ ID NO: 3221832 - RNA, 23 nt, Human
gccuucgauacaccgggccugga

SEQ ID NO: 3221833 - RNA, 17 nt, Human
gccugguccucacacuc

SEQ ID NO: 3221834 - RNA, 17 nt, Human
gccuggucgccuuccac

SEQ ID NO: 3221835 - RNA, 14 nt, Human
gccuggggucaggc

SEQ ID NO: 3221836 - RNA, 18 nt, Human
gccuggucgccuuccacc

SEQ ID NO: 3221837 - RNA, 13 nt, Human
gccugguggcagc

SEQ ID NO: 3221838 - RNA, 21 nt, Human
gccugguggcagcugcggucc

SEQ ID NO: 3221839 - RNA, 19 nt, Human
gccugguggcagcugcggu

SEQ ID NO: 3221840 - RNA, 18 nt, Human
gccugguggcagcugcgg

SEQ ID NO: 3221841 - RNA, 23 nt, Human
gccugccacucaggcccaaagcc

SEQ ID NO: 3221842 - RNA, 15 nt, Human
gccugccacucaggc

SEQ ID NO: 3221843 - RNA, 21 nt, Human
gccugggggcugggcagagga

SEQ ID NO: 3221844 - RNA, 22 nt, Human
gccugggggcugggcagaggaa

SEQ ID NO: 3221845 - RNA, 16 nt, Human
gccuuaaaacaucauu

SEQ ID NO: 3221846 - RNA, 22 nt, Human
gccuggugaugcgcaguugcug

SEQ ID NO: 3221847 - RNA, 21 nt, Human
gccuguugggccaggagccuc

SEQ ID NO: 3221848 - RNA, 16 nt, Human
gccuuacacaaugguu

SEQ ID NO: 3221849 - RNA, 19 nt, Human
gccuuaaaacaucauuccu

SEQ ID NO: 3221850 - RNA, 20 nt, Human
gccuuacacaaugguuuucu

SEQ ID NO: 3221851 - RNA, 21 nt, Human
gccuuacacaaugguuuucuu

SEQ ID NO: 3221852 - RNA, 18 nt, Human
gccuuagaagucacacag

SEQ ID NO: 3221853 - RNA, 17 nt, Human
gccuuagaagucacaca

SEQ ID NO: 3221854 - RNA, 19 nt, Human
gccuuagaagucacacagu

SEQ ID NO: 3221855 - RNA, 17 nt, Human
gccuuagaaccuuucuu

SEQ ID NO: 3221856 - RNA, 10 nt, Human
gccuuaugga

SEQ ID NO: 3221857 - RNA, 14 nt, Human
gccuuauggaacac

SEQ ID NO: 3221858 - RNA, 21 nt, Human
gcgcggacauccccugcuggc

SEQ ID NO: 3221859 - RNA, 22 nt, Human
gcgcuaacuugcuuaaauguga

SEQ ID NO: 3221860 - RNA, 21 nt, Human
gcgcuaacuugcuuaaaugug

SEQ ID NO: 3221861 - RNA, 14 nt, Human
gcgcgugaggcccg

SEQ ID NO: 3221862 - RNA, 20 nt, Human
gcgcuaacuugcuuaaaugu

SEQ ID NO: 3221863 - RNA, 15 nt, Human
gcgcuaacuugcuua

SEQ ID NO: 3221864 - RNA, 13 nt, Human
gcggacagccacg

SEQ ID NO: 3221865 - RNA, 11 nt, Human
gcggacagcca

SEQ ID NO: 3221866 - RNA, 18 nt, Human
gcgcuagcacagcucccu

SEQ ID NO: 3221867 - RNA, 13 nt, Human
gcgcuagaggcca

SEQ ID NO: 3221868 - RNA, 21 nt, Human
gcgcuagcacagcucccuucu

SEQ ID NO: 3221869 - RNA, 12 nt, Human
gcgacagugaga

SEQ ID NO: 3221870 - RNA, 13 nt, Human
gcgacagagcagu

SEQ ID NO: 3221871 - RNA, 12 nt, Human
gcgacagagcag

SEQ ID NO: 3221872 - RNA, 15 nt, Human
gcgccuacaggagug

SEQ ID NO: 3221873 - RNA, 19 nt, Human
gcgucucauacucaccuca

SEQ ID NO: 3221874 - RNA, 18 nt, Human
gcgguuuaucgcccuggc

SEQ ID NO: 3221875 - RNA, 19 nt, Human
gcgggucacaggagggagg

SEQ ID NO: 3221876 - RNA, 20 nt, Human
gcgggucacaggagggaggg

SEQ ID NO: 3221877 - RNA, 15 nt, Human
gcggacagccacggc

SEQ ID NO: 3221878 - RNA, 19 nt, Human
gcggaaugaaccacaucuu

SEQ ID NO: 3221879 - RNA, 22 nt, Human
gcgggcacaccuccucccacug

SEQ ID NO: 3221880 - RNA, 19 nt, Human
gcgggcacaccuccuccca

SEQ ID NO: 3221881 - RNA, 17 nt, Human
gcgggcacaccuccucc

SEQ ID NO: 3221882 - RNA, 16 nt, Human
gcgggcccugcccaca

SEQ ID NO: 3221883 - RNA, 13 nt, Human
gcgggucacagga

SEQ ID NO: 3221884 - RNA, 15 nt, Human
gcgggucacaggagg

SEQ ID NO: 3221885 - RNA, 16 nt, Human
gcuaagaauauuugaa

SEQ ID NO: 3221886 - RNA, 17 nt, Human
gcuaagaauauuugaau

SEQ ID NO: 3221887 - RNA, 13 nt, Human
gcuaagagggagg

SEQ ID NO: 3221888 - RNA, 20 nt, Human
gcuaaagacugaucucaggg

SEQ ID NO: 3221889 - RNA, 23 nt, Human
gcuaaacguguauguuuuucagu

SEQ ID NO: 3221890 - RNA, 22 nt, Human
gcuaaacguguauguuuuucag

SEQ ID NO: 3221891 - RNA, 14 nt, Human
gcuacacaggggaa

SEQ ID NO: 3221892 - RNA, 14 nt, Human
gcuaagaauuuuuu

SEQ ID NO: 3221893 - RNA, 20 nt, Human
gcuaagagggagggagggcu

SEQ ID NO: 3221894 - RNA, 13 nt, Human
gcuaccuugcccc

SEQ ID NO: 3221895 - RNA, 14 nt, Human
gcuaccuugcccca

SEQ ID NO: 3221896 - RNA, 15 nt, Human
gcuaccuugccccaa

SEQ ID NO: 3221897 - RNA, 20 nt, Human
gcuaccuugccccaacccuu

SEQ ID NO: 3221898 - RNA, 22 nt, Human
gcuaccuugccccaacccuucu

SEQ ID NO: 3221899 - RNA, 23 nt, Human
gcuaccuugccccaacccuucuu

SEQ ID NO: 3221900 - RNA, 19 nt, Human
gcuagaacucccuuucaac

SEQ ID NO: 3221901 - RNA, 18 nt, Human
gcuagaacucccuuucaa

SEQ ID NO: 3221902 - RNA, 13 nt, Human
gcuauaggugcua

SEQ ID NO: 3221903 - RNA, 23 nt, Human
gcuauagcuuuagccgugucacg

SEQ ID NO: 3221904 - RNA, 22 nt, Human
gcuaggaaauccaggguggugg

SEQ ID NO: 3221905 - RNA, 14 nt, Human
gcuaggaacaaauc

SEQ ID NO: 3221906 - RNA, 15 nt, Human
gcuaggaacacuccu

SEQ ID NO: 3221907 - RNA, 19 nt, Human
gcuaggaaauccagggugg

SEQ ID NO: 3221908 - RNA, 20 nt, Human
gccucucauuccagaggaag

SEQ ID NO: 3221909 - RNA, 13 nt, Human
gccucucucaggc

SEQ ID NO: 3221910 - RNA, 14 nt, Human
gccucucucaggcc

SEQ ID NO: 3221911 - RNA, 16 nt, Human
gccucucucaggccaa

SEQ ID NO: 3221912 - RNA, 16 nt, Human
gccucugacacacagc

SEQ ID NO: 3221913 - RNA, 18 nt, Human
gccucugacacacagcuc

SEQ ID NO: 3221914 - RNA, 17 nt, Human
gccucugacacacagcu

SEQ ID NO: 3221915 - RNA, 14 nt, Human
gccucugcacuccc

SEQ ID NO: 3221916 - RNA, 21 nt, Human
gccucugacacacagcucugu

SEQ ID NO: 3221917 - RNA, 20 nt, Human
gccucugacacacagcucug

SEQ ID NO: 3221918 - RNA, 19 nt, Human
gccucugacacacagcucu

SEQ ID NO: 3221919 - RNA, 14 nt, Human
gccugacuccccca

SEQ ID NO: 3221920 - RNA, 15 nt, Human
gccugacucccccag

SEQ ID NO: 3221921 - RNA, 23 nt, Human
gccugacucccccaguccccuuc

SEQ ID NO: 3221922 - RNA, 21 nt, Human
gccugacucccccaguccccu

SEQ ID NO: 3221923 - RNA, 13 nt, Human
gccucugccucug

SEQ ID NO: 3221924 - RNA, 12 nt, Human
gccucugccucu

SEQ ID NO: 3221925 - RNA, 15 nt, Human
gccucugcauucagg

SEQ ID NO: 3221926 - RNA, 17 nt, Human
gccucugcaaaggaaau

SEQ ID NO: 3221927 - RNA, 13 nt, Human
gccugcaagggag

SEQ ID NO: 3221928 - RNA, 15 nt, Human
gccugcaagggagug

SEQ ID NO: 3221929 - RNA, 20 nt, Human
gccugaggggcagccugccu

SEQ ID NO: 3221930 - RNA, 19 nt, Human
gccugaggggcagccugcc

SEQ ID NO: 3221931 - RNA, 16 nt, Human
gccugaggggcagccu

SEQ ID NO: 3221932 - RNA, 13 nt, Human
gccugaggggcag

SEQ ID NO: 3221933 - RNA, 20 nt, Human
gccuccuacagcccaccugg

SEQ ID NO: 3221934 - RNA, 21 nt, Human
gccuccgucacuaccuggcug

SEQ ID NO: 3221935 - RNA, 20 nt, Human
gccuccgucacuaccuggcu

SEQ ID NO: 3221936 - RNA, 19 nt, Human
gccucucauuccagaggaa

SEQ ID NO: 3221937 - RNA, 16 nt, Human
gccuccgcuucccugg

SEQ ID NO: 3221938 - RNA, 19 nt, Human
gccuccgucacuaccuggc

SEQ ID NO: 3221939 - RNA, 15 nt, Human
gccuccgcuucccug

SEQ ID NO: 3221940 - RNA, 17 nt, Human
gccucccgaguagcugg

SEQ ID NO: 3221941 - RNA, 19 nt, Human
gccucccgaguagcuggga

SEQ ID NO: 3221942 - RNA, 18 nt, Human
gccucccgaguagcuggg

SEQ ID NO: 3221943 - RNA, 16 nt, Human
gccucccaacucaccc

SEQ ID NO: 3221944 - RNA, 17 nt, Human
gccucccaacucacccc

SEQ ID NO: 3221945 - RNA, 18 nt, Human
gccucccaacucacccca

SEQ ID NO: 3221946 - RNA, 19 nt, Human
gccucccaacucaccccag

SEQ ID NO: 3221947 - RNA, 14 nt, Human
gccucccaucaccc

SEQ ID NO: 3221948 - RNA, 16 nt, Human
gccucccaucacccgc

SEQ ID NO: 3221949 - RNA, 13 nt, Human
gccucccaacuca

SEQ ID NO: 3221950 - RNA, 19 nt, Human
gccucccaaagugcuggga

SEQ ID NO: 3221951 - RNA, 18 nt, Human
gccucccaaagugcuggg

SEQ ID NO: 3221952 - RNA, 16 nt, Human
gccucagcauccuggc

SEQ ID NO: 3221953 - RNA, 15 nt, Human
gccucagcauccugg

SEQ ID NO: 3221954 - RNA, 18 nt, Human
gccucacaguccuuacca

SEQ ID NO: 3221955 - RNA, 20 nt, Human
gccucaacucugcugagggu

SEQ ID NO: 3221956 - RNA, 22 nt, Human
gccucaacucugcugagggucc

SEQ ID NO: 3221957 - RNA, 23 nt, Human
gccucaacucugcugagggucca

SEQ ID NO: 3221958 - RNA, 17 nt, Human
gccucaaccuccugggc

SEQ ID NO: 3221959 - RNA, 13 nt, Human
gccucacaguccu

SEQ ID NO: 3221960 - RNA, 17 nt, Human
gccucacaguccuuacc

SEQ ID NO: 3221961 - RNA, 19 nt, Human
gccucaaccuccugggcua

SEQ ID NO: 3221962 - RNA, 18 nt, Human
gccucaaccuccugggcu

SEQ ID NO: 3221963 - RNA, 22 nt, Human
gccuaugugcaugcagcaucua

SEQ ID NO: 3221964 - RNA, 20 nt, Human
gccguguaaccauggaccca

SEQ ID NO: 3221965 - RNA, 22 nt, Human
gccguggcuucccgcucagccc

SEQ ID NO: 3221966 - RNA, 21 nt, Human
gccguggcuucccgcucagcc

SEQ ID NO: 3221967 - RNA, 19 nt, Human
gccguggcuucccgcucag

SEQ ID NO: 3221968 - RNA, 15 nt, Human
gccguggcuucccgc

SEQ ID NO: 3221969 - RNA, 19 nt, Human
gccgugccuucagcucuac

SEQ ID NO: 3221970 - RNA, 17 nt, Human
gccgugccuucagcucu

SEQ ID NO: 3221971 - RNA, 15 nt, Human
gccgugccuucagcu

SEQ ID NO: 3221972 - RNA, 14 nt, Human
gccgugccuucagc

SEQ ID NO: 3221973 - RNA, 15 nt, Human
gccgucuaccugagg

SEQ ID NO: 3221974 - RNA, 16 nt, Human
gccgucuaccugaggg

SEQ ID NO: 3221975 - RNA, 17 nt, Human
gccgucuaccugagggg

SEQ ID NO: 3221976 - RNA, 16 nt, Human
gccggugugggggccc

SEQ ID NO: 3221977 - RNA, 12 nt, Human
gccguacaguuc

SEQ ID NO: 3221978 - RNA, 19 nt, Human
gccgagaucacgccacugc

SEQ ID NO: 3221979 - RNA, 22 nt, Human
gccgagaucacgccacugcacu

SEQ ID NO: 3221980 - RNA, 21 nt, Human
gccgagaucacgccacugcac

SEQ ID NO: 3221981 - RNA, 20 nt, Human
gccgagaucacgccacugca

SEQ ID NO: 3221982 - RNA, 11 nt, Human
gccgcagcccu

SEQ ID NO: 3221983 - RNA, 12 nt, Human
gccgcagcccug

SEQ ID NO: 3221984 - RNA, 20 nt, Human
gccgggcgugguggugagug

SEQ ID NO: 3221985 - RNA, 21 nt, Human
gccgggcuacccgugagcccu

SEQ ID NO: 3221986 - RNA, 21 nt, Human
gccgggcgcgguggcucacgc

SEQ ID NO: 3221987 - RNA, 16 nt, Human
gccggcuuucaggagc

SEQ ID NO: 3221988 - RNA, 15 nt, Human
gccgaauagcugaug

SEQ ID NO: 3221989 - RNA, 18 nt, Human
gcccugcuuugggcugcc

SEQ ID NO: 3221990 - RNA, 16 nt, Human
gcccugcuuugggcug

SEQ ID NO: 3221991 - RNA, 12 nt, Human
gcccugcuguuu

SEQ ID NO: 3221992 - RNA, 14 nt, Human
gcccuucucuccag

SEQ ID NO: 3221993 - RNA, 16 nt, Human
gcccuucucuccagcc

SEQ ID NO: 3221994 - RNA, 17 nt, Human
gcccuucucuccagccc

SEQ ID NO: 3221995 - RNA, 13 nt, Human
gccaggcuggucu

SEQ ID NO: 3221996 - RNA, 22 nt, Human
gccaguaacacaggccacccug

SEQ ID NO: 3221997 - RNA, 22 nt, Human
gccagucccugaggcagguccc

SEQ ID NO: 3221998 - RNA, 16 nt, Human
gccagucccugaggca

SEQ ID NO: 3221999 - RNA, 21 nt, Human
gccagucaccccggccaccug

SEQ ID NO: 3222000 - RNA, 17 nt, Human
gccaucauguuuacaga

SEQ ID NO: 3222001 - RNA, 21 nt, Human
gccaucauguuuacagaggac

SEQ ID NO: 3222002 - RNA, 13 nt, Human
gccaucauuucug

SEQ ID NO: 3222003 - RNA, 19 nt, Human
gccaucuggagagcccaga

SEQ ID NO: 3222004 - RNA, 14 nt, Human
gccaucuggagagc

SEQ ID NO: 3222005 - RNA, 13 nt, Human
gccaucuggagag

SEQ ID NO: 3222006 - RNA, 20 nt, Human
gccaucuggagagcccagag

SEQ ID NO: 3222007 - RNA, 14 nt, Human
gccaugcuccuggc

SEQ ID NO: 3222008 - RNA, 20 nt, Human
gccaugaggaacaaggcaag

SEQ ID NO: 3222009 - RNA, 11 nt, Human
gccaugaauua

SEQ ID NO: 3222010 - RNA, 12 nt, Human
gccaugaacugu

SEQ ID NO: 3222011 - RNA, 16 nt, Human
gcccagaaugaggcug

SEQ ID NO: 3222012 - RNA, 17 nt, Human
gcccagaaugaggcugc

SEQ ID NO: 3222013 - RNA, 13 nt, Human
gcccagaauacug

SEQ ID NO: 3222014 - RNA, 14 nt, Human
gcccacuucugcca

SEQ ID NO: 3222015 - RNA, 16 nt, Human
gcccaccuuggcucaa

SEQ ID NO: 3222016 - RNA, 15 nt, Human
gcccaccuuggcuca

SEQ ID NO: 3222017 - RNA, 13 nt, Human
gcccaccuuggcu

SEQ ID NO: 3222018 - RNA, 17 nt, Human
gcccaccuggccucugc

SEQ ID NO: 3222019 - RNA, 20 nt, Human
gcccaccuggccucugcacu

SEQ ID NO: 3222020 - RNA, 21 nt, Human
gcccaccuggccucugcacuc

SEQ ID NO: 3222021 - RNA, 24 nt, Human
gcccaccuggccucugcacucccc

SEQ ID NO: 3222022 - RNA, 15 nt, Human
gcccaccuggccucu

SEQ ID NO: 3222023 - RNA, 16 nt, Human
gcccaccuggccucug

SEQ ID NO: 3222024 - RNA, 16 nt, Human
gcccaccccauggccg

SEQ ID NO: 3222025 - RNA, 16 nt, Human
gccaugggccuccugu

SEQ ID NO: 3222026 - RNA, 15 nt, Human
gccaugggccuccug

SEQ ID NO: 3222027 - RNA, 14 nt, Human
gcccaaccugcucu

SEQ ID NO: 3222028 - RNA, 24 nt, Human
gcccaaccugcucuccucuugcca

SEQ ID NO: 3222029 - RNA, 14 nt, Human
gccaugggugcuug

SEQ ID NO: 3222030 - RNA, 22 nt, Human
gcccaagaauagaugcugacug

SEQ ID NO: 3222031 - RNA, 21 nt, Human
gcccaagaauagaugcugacu

SEQ ID NO: 3222032 - RNA, 23 nt, Human
gcccacauccggggccagcuccg

SEQ ID NO: 3222033 - RNA, 22 nt, Human
gcccacauccggggccagcucc

SEQ ID NO: 3222034 - RNA, 21 nt, Human
gcccaccaggccccccuguca

SEQ ID NO: 3222035 - RNA, 19 nt, Human
gcccacccaagcaggaggc

SEQ ID NO: 3222036 - RNA, 20 nt, Human
gcccacauagugaugguucc

SEQ ID NO: 3222037 - RNA, 21 nt, Human
gcccacauccggggccagcuc

SEQ ID NO: 3222038 - RNA, 15 nt, Human
gcccacaguauauuu

SEQ ID NO: 3222039 - RNA, 17 nt, Human
gcccacaguauauuuua

SEQ ID NO: 3222040 - RNA, 13 nt, Human
gccaggagagcuu

SEQ ID NO: 3222041 - RNA, 17 nt, Human
gccaggagagcuuaggg

SEQ ID NO: 3222042 - RNA, 20 nt, Human
gccaggagagcuuagggucu

SEQ ID NO: 3222043 - RNA, 21 nt, Human
gccaggagagcuuagggucuc

SEQ ID NO: 3222044 - RNA, 14 nt, Human
gccaggagccuccu

SEQ ID NO: 3222045 - RNA, 16 nt, Human
gccaggagccuccugc

SEQ ID NO: 3222046 - RNA, 19 nt, Human
gccaggagccuccugcccu

SEQ ID NO: 3222047 - RNA, 20 nt, Human
gccaggagccuccugcccuu

SEQ ID NO: 3222048 - RNA, 22 nt, Human
gccaggcgcuagcacagcuccc

SEQ ID NO: 3222049 - RNA, 20 nt, Human
gccaggaagccagcaggcuc

SEQ ID NO: 3222050 - RNA, 11 nt, Human
gccaggaagcc

SEQ ID NO: 3222051 - RNA, 18 nt, Human
gccaggaaguagcacagg

SEQ ID NO: 3222052 - RNA, 17 nt, Human
gccaggaaguagcacag

SEQ ID NO: 3222053 - RNA, 22 nt, Human
gccaggaaguagcacaggcuga

SEQ ID NO: 3222054 - RNA, 21 nt, Human
gccaggaaguagcacaggcug

SEQ ID NO: 3222055 - RNA, 20 nt, Human
gccaggaaguagcacaggcu

SEQ ID NO: 3222056 - RNA, 19 nt, Human
gccaggaaguagcacaggc

SEQ ID NO: 3222057 - RNA, 20 nt, Human
gccagcugcuugggcuucau

SEQ ID NO: 3222058 - RNA, 12 nt, Human
gccaggaagcca

SEQ ID NO: 3222059 - RNA, 13 nt, Human
gccaggaagccag

SEQ ID NO: 3222060 - RNA, 14 nt, Human
gccaggaagccagc

SEQ ID NO: 3222061 - RNA, 17 nt, Human
gccagcugcuugggcuu

SEQ ID NO: 3222062 - RNA, 18 nt, Human
gccagcugcuugggcuuc

SEQ ID NO: 3222063 - RNA, 16 nt, Human
gccagcugcuugggcu

SEQ ID NO: 3222064 - RNA, 14 nt, Human
gccagcugccuagg

SEQ ID NO: 3222065 - RNA, 21 nt, Human
gccagcucuuccuagcuggag

SEQ ID NO: 3222066 - RNA, 19 nt, Human
gccagcucuuccuagcugg

SEQ ID NO: 3222067 - RNA, 17 nt, Human
gccagcucuuccuagcu

SEQ ID NO: 3222068 - RNA, 13 nt, Human
gccagcucuuccu

SEQ ID NO: 3222069 - RNA, 12 nt, Human
gccagccuggcu

SEQ ID NO: 3222070 - RNA, 17 nt, Human
gccagccuggcugggac

SEQ ID NO: 3222071 - RNA, 14 nt, Human
gccagccuggcugg

SEQ ID NO: 3222072 - RNA, 13 nt, Human
gccagccuggcug

SEQ ID NO: 3222073 - RNA, 24 nt, Human
gccaaggccaaaggaagcacaugc

SEQ ID NO: 3222074 - RNA, 19 nt, Human
gccaaggccaaaggaagca

SEQ ID NO: 3222075 - RNA, 20 nt, Human
gccacuccagaccccuggcu

SEQ ID NO: 3222076 - RNA, 21 nt, Human
gccacuccagaccccuggcuu

SEQ ID NO: 3222077 - RNA, 20 nt, Human
gccaaggccaaaggaagcac

SEQ ID NO: 3222078 - RNA, 21 nt, Human
gccagagacacaagccuucgg

SEQ ID NO: 3222079 - RNA, 20 nt, Human
gccagagacacaagccuucg

SEQ ID NO: 3222080 - RNA, 22 nt, Human
gccagagacacaagccuucggc

SEQ ID NO: 3222081 - RNA, 19 nt, Human
gccacugcaccgggccaca

SEQ ID NO: 3222082 - RNA, 21 nt, Human
gccacugcaccgggccacaga

SEQ ID NO: 3222083 - RNA, 20 nt, Human
gccacugcaccgggccacag

SEQ ID NO: 3222084 - RNA, 22 nt, Human
gccacuccagaccccuggcuuu

SEQ ID NO: 3222085 - RNA, 13 nt, Human
gccacuccccagc

SEQ ID NO: 3222086 - RNA, 14 nt, Human
gccagaugcaccag

SEQ ID NO: 3222087 - RNA, 24 nt, Human
gccagauucuuuccugaggcuggg

SEQ ID NO: 3222088 - RNA, 13 nt, Human
gccagauuucacu

SEQ ID NO: 3222089 - RNA, 20 nt, Human
gccagauucuuuccugaggc

SEQ ID NO: 3222090 - RNA, 22 nt, Human
gccagccgagauagccaaggcc

SEQ ID NO: 3222091 - RNA, 21 nt, Human
gccagccgagauagccaaggc

SEQ ID NO: 3222092 - RNA, 19 nt, Human
gccagauucuuuccugagg

SEQ ID NO: 3222093 - RNA, 16 nt, Human
gccccugagaucucug

SEQ ID NO: 3222094 - RNA, 20 nt, Human
gccccuucugacccaugcug

SEQ ID NO: 3222095 - RNA, 14 nt, Human
gcccgauccucccc

SEQ ID NO: 3222096 - RNA, 20 nt, Human
gcccgauccuccccuggacu

SEQ ID NO: 3222097 - RNA, 17 nt, Human
gcccgauccuccccugg

SEQ ID NO: 3222098 - RNA, 15 nt, Human
gcccgacagccuggc

SEQ ID NO: 3222099 - RNA, 24 nt, Human
gcccgaagcaugaacagugcaccu

SEQ ID NO: 3222100 - RNA, 14 nt, Human
gcccgacagccugg

SEQ ID NO: 3222101 - RNA, 12 nt, Human
gcccgacagccu

SEQ ID NO: 3222102 - RNA, 15 nt, Human
gccccgaggccuucu

SEQ ID NO: 3222103 - RNA, 22 nt, Human
gccccgaaaggucaccucacuc

SEQ ID NO: 3222104 - RNA, 14 nt, Human
gccccucagggucc

SEQ ID NO: 3222105 - RNA, 18 nt, Human
gccccgaggccuucucug

SEQ ID NO: 3222106 - RNA, 23 nt, Human
gccccucaacucuccuccagagu

SEQ ID NO: 3222107 - RNA, 16 nt, Human
gccccucagggucccu

SEQ ID NO: 3222108 - RNA, 20 nt, Human
gccccucccucuccagcagg

SEQ ID NO: 3222109 - RNA, 15 nt, Human
gccccucccucucca

SEQ ID NO: 3222110 - RNA, 17 nt, Human
gccccucccuccucuga

SEQ ID NO: 3222111 - RNA, 15 nt, Human
gccccucccuccucu

SEQ ID NO: 3222112 - RNA, 13 nt, Human
gccccucccuccu

SEQ ID NO: 3222113 - RNA, 21 nt, Human
gcccgauccuccccuggacuc

SEQ ID NO: 3222114 - RNA, 13 nt, Human
gcccgcaucagcu

SEQ ID NO: 3222115 - RNA, 20 nt, Human
gcccgcaucagcugcucaga

SEQ ID NO: 3222116 - RNA, 19 nt, Human
gcccgcaucagcugcucag

SEQ ID NO: 3222117 - RNA, 15 nt, Human
gcccgcaucagcugc

SEQ ID NO: 3222118 - RNA, 19 nt, Human
gcccuccaagaccuucucc

SEQ ID NO: 3222119 - RNA, 21 nt, Human
gcccuccaagaccuucuccuu

SEQ ID NO: 3222120 - RNA, 22 nt, Human
gcccuccaagaccuucuccuuc

SEQ ID NO: 3222121 - RNA, 23 nt, Human
gcccuccaagaccuucuccuuca

SEQ ID NO: 3222122 - RNA, 15 nt, Human
gcccuccacacccgc

SEQ ID NO: 3222123 - RNA, 20 nt, Human
gcccuccaucuaaacugccc

SEQ ID NO: 3222124 - RNA, 21 nt, Human
gcccuccaucuaaacugcccc

SEQ ID NO: 3222125 - RNA, 17 nt, Human
gcccucuucuucucaag

SEQ ID NO: 3222126 - RNA, 15 nt, Human
gcccugcagagggca

SEQ ID NO: 3222127 - RNA, 14 nt, Human
gcccugcagagggc

SEQ ID NO: 3222128 - RNA, 13 nt, Human
gcccugcagaggg

SEQ ID NO: 3222129 - RNA, 21 nt, Human
gcccucccugccccucccuuc

SEQ ID NO: 3222130 - RNA, 13 nt, Human
gcccucugcccac

SEQ ID NO: 3222131 - RNA, 16 nt, Human
gcccucugcccacucc

SEQ ID NO: 3222132 - RNA, 18 nt, Human
gcccucugcccacucccu

SEQ ID NO: 3222133 - RNA, 12 nt, Human
gcccaggcuggc

SEQ ID NO: 3222134 - RNA, 19 nt, Human
gcccaggcuggagugcagu

SEQ ID NO: 3222135 - RNA, 20 nt, Human
gcccaggcuggagugcagug

SEQ ID NO: 3222136 - RNA, 22 nt, Human
gcccaggccccugccacccugg

SEQ ID NO: 3222137 - RNA, 20 nt, Human
gcccaggcuggagugcaaug

SEQ ID NO: 3222138 - RNA, 15 nt, Human
gcccaggcuggagug

SEQ ID NO: 3222139 - RNA, 23 nt, Human
gcccaggccccugccacccuggg

SEQ ID NO: 3222140 - RNA, 21 nt, Human
gcccagagaggguggugaccu

SEQ ID NO: 3222141 - RNA, 15 nt, Human
gcccagagagggugg

SEQ ID NO: 3222142 - RNA, 17 nt, Human
gcccagaauacugaugg

SEQ ID NO: 3222143 - RNA, 22 nt, Human
gcccaguuggguggaugccugg

SEQ ID NO: 3222144 - RNA, 20 nt, Human
gcccagggggcuuccugagg

SEQ ID NO: 3222145 - RNA, 21 nt, Human
gcccagggugagguggcaugg

SEQ ID NO: 3222146 - RNA, 15 nt, Human
gcccauauuuuacuu

SEQ ID NO: 3222147 - RNA, 20 nt, Human
gcccauauuuuacuuggaaa

SEQ ID NO: 3222148 - RNA, 22 nt, Human
gcccauauuuuacuuggaaaua

SEQ ID NO: 3222149 - RNA, 22 nt, Human
gccccacucucagaggccccaa

SEQ ID NO: 3222150 - RNA, 17 nt, Human
gccccaccugcagcucc

SEQ ID NO: 3222151 - RNA, 16 nt, Human
gccccaccugcagcuc

SEQ ID NO: 3222152 - RNA, 18 nt, Human
gccccaccuggcccucuc

SEQ ID NO: 3222153 - RNA, 15 nt, Human
gccccaccuggcccu

SEQ ID NO: 3222154 - RNA, 14 nt, Human
gccccaccuggccc

SEQ ID NO: 3222155 - RNA, 18 nt, Human
gccccaccugcagcuccc

SEQ ID NO: 3222156 - RNA, 21 nt, Human
gccccacucucagaggcccca

SEQ ID NO: 3222157 - RNA, 19 nt, Human
gccccacucucagaggccc

SEQ ID NO: 3222158 - RNA, 18 nt, Human
gccccacucucagaggcc

SEQ ID NO: 3222159 - RNA, 17 nt, Human
gccccacucucagaggc

SEQ ID NO: 3222160 - RNA, 16 nt, Human
gccccacucucagagg

SEQ ID NO: 3222161 - RNA, 14 nt, Human
gccccacucucaga

SEQ ID NO: 3222162 - RNA, 13 nt, Human
gccccacucucag

SEQ ID NO: 3222163 - RNA, 12 nt, Human
gccccacucuca

SEQ ID NO: 3222164 - RNA, 12 nt, Human
gccccagugccc

SEQ ID NO: 3222165 - RNA, 18 nt, Human
gccccaucccaaacccuu

SEQ ID NO: 3222166 - RNA, 19 nt, Human
gccccaguuguauuuauuu

SEQ ID NO: 3222167 - RNA, 21 nt, Human
gccccauaauuuuuuuuuucc

SEQ ID NO: 3222168 - RNA, 14 nt, Human
gccccagugcccac

SEQ ID NO: 3222169 - RNA, 13 nt, Human
gccccagugccca

SEQ ID NO: 3222170 - RNA, 21 nt, Human
gccccagugcccacaggauca

SEQ ID NO: 3222171 - RNA, 13 nt, Human
gccccauccucug

SEQ ID NO: 3222172 - RNA, 14 nt, Human
gccccauccucugu

SEQ ID NO: 3222173 - RNA, 22 nt, Human
gccccauccucuguacagagcc

SEQ ID NO: 3222174 - RNA, 14 nt, Human
gccccauucugccu

SEQ ID NO: 3222175 - RNA, 13 nt, Human
gccccauuaacug

SEQ ID NO: 3222176 - RNA, 16 nt, Human
gcccccaaacccccau

SEQ ID NO: 3222177 - RNA, 13 nt, Human
gcccccugccugc

SEQ ID NO: 3222178 - RNA, 16 nt, Human
gcccccugccugcccu

SEQ ID NO: 3222179 - RNA, 16 nt, Human
cauccuacaagacaca

SEQ ID NO: 3222180 - RNA, 15 nt, Human
cauccucauacccac

SEQ ID NO: 3222181 - RNA, 16 nt, Human
cauccucauacccacc

SEQ ID NO: 3222182 - RNA, 13 nt, Human
cauccucccaagg

SEQ ID NO: 3222183 - RNA, 17 nt, Human
cauccucauacccaccc

SEQ ID NO: 3222184 - RNA, 18 nt, Human
cauccucauacccacccc

SEQ ID NO: 3222185 - RNA, 21 nt, Human
cauccucauacccacccccac

SEQ ID NO: 3222186 - RNA, 22 nt, Human
cauccucauacccacccccacc

SEQ ID NO: 3222187 - RNA, 15 nt, Human
cauccuccucagauc

SEQ ID NO: 3222188 - RNA, 16 nt, Human
cauccuccucagaucu

SEQ ID NO: 3222189 - RNA, 18 nt, Human
cauccuccucagaucuuc

SEQ ID NO: 3222190 - RNA, 19 nt, Human
cauccuccucagaucuucu

SEQ ID NO: 3222191 - RNA, 11 nt, Human
cauccuccuca

SEQ ID NO: 3222192 - RNA, 12 nt, Human
cauccuccucag

SEQ ID NO: 3222193 - RNA, 20 nt, Human
cauccuccgccucccggguu

SEQ ID NO: 3222194 - RNA, 13 nt, Human
cauccuccagggc

SEQ ID NO: 3222195 - RNA, 15 nt, Human
caucuacccuccgau

SEQ ID NO: 3222196 - RNA, 23 nt, Human
caucuaauuuuauuuugugaagu

SEQ ID NO: 3222197 - RNA, 18 nt, Human
caucuaggggagccuuga

SEQ ID NO: 3222198 - RNA, 15 nt, Human
cauccucuguacaga

SEQ ID NO: 3222199 - RNA, 18 nt, Human
cauccucuguacagagcc

SEQ ID NO: 3222200 - RNA, 17 nt, Human
cauccuccuccuuccua

SEQ ID NO: 3222201 - RNA, 16 nt, Human
cauccuccuccuuccu

SEQ ID NO: 3222202 - RNA, 15 nt, Human
cauccuccuccuucc

SEQ ID NO: 3222203 - RNA, 20 nt, Human
cauccuccuccgauuucuaa

SEQ ID NO: 3222204 - RNA, 19 nt, Human
cauccucuguacagagccc

SEQ ID NO: 3222205 - RNA, 18 nt, Human
cauccuccuccuuccuag

SEQ ID NO: 3222206 - RNA, 19 nt, Human
caucuaggggagccuugau

SEQ ID NO: 3222207 - RNA, 20 nt, Human
caucuaggggagccuugauu

SEQ ID NO: 3222208 - RNA, 19 nt, Human
caucuaucuggugauuucu

SEQ ID NO: 3222209 - RNA, 16 nt, Human
caucucacacaugagc

SEQ ID NO: 3222210 - RNA, 17 nt, Human
caucucacacaugagca

SEQ ID NO: 3222211 - RNA, 20 nt, Human
caucucacacaugagcauca

SEQ ID NO: 3222212 - RNA, 13 nt, Human
caucucacagcua

SEQ ID NO: 3222213 - RNA, 13 nt, Human
caucucagcccac

SEQ ID NO: 3222214 - RNA, 16 nt, Human
caucucaguccucaaa

SEQ ID NO: 3222215 - RNA, 17 nt, Human
caucucaguccucaaag

SEQ ID NO: 3222216 - RNA, 22 nt, Human
caucucaguccucaaagcuuuu

SEQ ID NO: 3222217 - RNA, 12 nt, Human
caucucaucaug

SEQ ID NO: 3222218 - RNA, 18 nt, Human
caucucaucaugucuauu

SEQ ID NO: 3222219 - RNA, 21 nt, Human
caucucaucaugucuauuguc

SEQ ID NO: 3222220 - RNA, 20 nt, Human
caucuugacagagccugccc

SEQ ID NO: 3222221 - RNA, 15 nt, Human
caucuugacagagcc

SEQ ID NO: 3222222 - RNA, 22 nt, Human
caucuugacagagccugcccca

SEQ ID NO: 3222223 - RNA, 20 nt, Human
caucuugcucugcugacaga

SEQ ID NO: 3222224 - RNA, 23 nt, Human
caucuugguuauuucugaaggua

SEQ ID NO: 3222225 - RNA, 19 nt, Human
caucuugcucugcugacag

SEQ ID NO: 3222226 - RNA, 14 nt, Human
caucuugcucugcu

SEQ ID NO: 3222227 - RNA, 13 nt, Human
caucuugcucugc

SEQ ID NO: 3222228 - RNA, 22 nt, Human
caucucuucuggguuccuuccu

SEQ ID NO: 3222229 - RNA, 14 nt, Human
caucuccacuccag

SEQ ID NO: 3222230 - RNA, 22 nt, Human
caucuuccaaggguacuaagga

SEQ ID NO: 3222231 - RNA, 23 nt, Human
caucugagagaggcuaaaauguu

SEQ ID NO: 3222232 - RNA, 22 nt, Human
caucugagagaggcuaaaaugu

SEQ ID NO: 3222233 - RNA, 20 nt, Human
caucugagagaggcuaaaau

SEQ ID NO: 3222234 - RNA, 16 nt, Human
caucugagaaugaaca

SEQ ID NO: 3222235 - RNA, 14 nt, Human
caucugagaaugaa

SEQ ID NO: 3222236 - RNA, 14 nt, Human
caucugauuccagc

SEQ ID NO: 3222237 - RNA, 20 nt, Human
cauccaccguccccucccag

SEQ ID NO: 3222238 - RNA, 23 nt, Human
cauccacaaaugcaguuuuagaa

SEQ ID NO: 3222239 - RNA, 14 nt, Human
cauccaaguggccu

SEQ ID NO: 3222240 - RNA, 17 nt, Human
cauccaccguccccucc

SEQ ID NO: 3222241 - RNA, 14 nt, Human
cauccacagucucc

SEQ ID NO: 3222242 - RNA, 15 nt, Human
cauccagguucagcu

SEQ ID NO: 3222243 - RNA, 15 nt, Human
caucccucuggggcu

SEQ ID NO: 3222244 - RNA, 19 nt, Human
caucccucuggggcuguuc

SEQ ID NO: 3222245 - RNA, 11 nt, Human
caucccugaag

SEQ ID NO: 3222246 - RNA, 13 nt, Human
caucccugaaggc

SEQ ID NO: 3222247 - RNA, 14 nt, Human
caucauugaaaucu

SEQ ID NO: 3222248 - RNA, 15 nt, Human
caucauugaaaucuu

SEQ ID NO: 3222249 - RNA, 20 nt, Human
caucauugaaaucuuuuugc

SEQ ID NO: 3222250 - RNA, 21 nt, Human
caucauugaaaucuuuuugcu

SEQ ID NO: 3222251 - RNA, 13 nt, Human
caucauugaaauc

SEQ ID NO: 3222252 - RNA, 15 nt, Human
caucaccaacgucug

SEQ ID NO: 3222253 - RNA, 12 nt, Human
caucauuucugg

SEQ ID NO: 3222254 - RNA, 22 nt, Human
cauccaaggaagggauguauuu

SEQ ID NO: 3222255 - RNA, 17 nt, Human
caucccugaaggccccg

SEQ ID NO: 3222256 - RNA, 18 nt, Human
caucccugaaggccccgc

SEQ ID NO: 3222257 - RNA, 19 nt, Human
caucccugaaggccccgcc

SEQ ID NO: 3222258 - RNA, 21 nt, Human
caucccugaaggccccgccca

SEQ ID NO: 3222259 - RNA, 21 nt, Human
cauccuaacuccaugucucug

SEQ ID NO: 3222260 - RNA, 14 nt, Human
cauccuaacuccau

SEQ ID NO: 3222261 - RNA, 17 nt, Human
cauccggggccagcucc

SEQ ID NO: 3222262 - RNA, 18 nt, Human
cauccggggccagcuccg

SEQ ID NO: 3222263 - RNA, 22 nt, Human
cauagaauugcaaucuauaaua

SEQ ID NO: 3222264 - RNA, 20 nt, Human
cauagaauugcaaucuauaa

SEQ ID NO: 3222265 - RNA, 14 nt, Human
cauagaauagcaug

SEQ ID NO: 3222266 - RNA, 15 nt, Human
cauagaauagcaugu

SEQ ID NO: 3222267 - RNA, 16 nt, Human
cauagaauagcauguu

SEQ ID NO: 3222268 - RNA, 18 nt, Human
cauagaauagcauguugu

SEQ ID NO: 3222269 - RNA, 21 nt, Human
cauagaauagcauguuguaga

SEQ ID NO: 3222270 - RNA, 23 nt, Human
cauagagagcaagacgcugugcu

SEQ ID NO: 3222271 - RNA, 19 nt, Human
cauagagagcaagacgcug

SEQ ID NO: 3222272 - RNA, 21 nt, Human
cauagagagcaagacgcugug

SEQ ID NO: 3222273 - RNA, 23 nt, Human
cauagaaaguaaauaaaaggacu

SEQ ID NO: 3222274 - RNA, 20 nt, Human
cauagaaacugucuagcacu

SEQ ID NO: 3222275 - RNA, 12 nt, Human
cauacuuuauca

SEQ ID NO: 3222276 - RNA, 17 nt, Human
cauacuuuaucaaugug

SEQ ID NO: 3222277 - RNA, 16 nt, Human
cauacucccaucugug

SEQ ID NO: 3222278 - RNA, 15 nt, Human
cauacucccaucugu

SEQ ID NO: 3222279 - RNA, 18 nt, Human
cauacucccaucugugaa

SEQ ID NO: 3222280 - RNA, 20 nt, Human
cauacucccaucugugaaag

SEQ ID NO: 3222281 - RNA, 11 nt, Human
cauacucugcu

SEQ ID NO: 3222282 - RNA, 14 nt, Human
cauacucaugcaug

SEQ ID NO: 3222283 - RNA, 17 nt, Human
cauacuccuaugcuuua

SEQ ID NO: 3222284 - RNA, 16 nt, Human
cauacucgagucugag

SEQ ID NO: 3222285 - RNA, 17 nt, Human
cauacucgagucugagg

SEQ ID NO: 3222286 - RNA, 18 nt, Human
cauacucgagucugaggc

SEQ ID NO: 3222287 - RNA, 19 nt, Human
cauacucgagucugaggcc

SEQ ID NO: 3222288 - RNA, 15 nt, Human
cauacucgagucuga

SEQ ID NO: 3222289 - RNA, 18 nt, Human
cauacuccuaugcuuuag

SEQ ID NO: 3222290 - RNA, 18 nt, Human
cauauccccuauuuaaca

SEQ ID NO: 3222291 - RNA, 19 nt, Human
cauauccauagugacuuuu

SEQ ID NO: 3222292 - RNA, 18 nt, Human
cauauccauagugacuuu

SEQ ID NO: 3222293 - RNA, 14 nt, Human
cauaucauuucuua

SEQ ID NO: 3222294 - RNA, 15 nt, Human
cauaucauuucuuaa

SEQ ID NO: 3222295 - RNA, 18 nt, Human
cauauacaacaccaaaaa

SEQ ID NO: 3222296 - RNA, 23 nt, Human
cauauacaacaccaaaaaauauc

SEQ ID NO: 3222297 - RNA, 22 nt, Human
cauauacaacaccaaaaaauau

SEQ ID NO: 3222298 - RNA, 20 nt, Human
cauauacaacaccaaaaaau

SEQ ID NO: 3222299 - RNA, 17 nt, Human
cauauauauaugugugu

SEQ ID NO: 3222300 - RNA, 22 nt, Human
cauauauauguuuuaagaggca

SEQ ID NO: 3222301 - RNA, 15 nt, Human
cauauauauaugugu

SEQ ID NO: 3222302 - RNA, 14 nt, Human
cauauauauaugug

SEQ ID NO: 3222303 - RNA, 13 nt, Human
cauauauauaugu

SEQ ID NO: 3222304 - RNA, 14 nt, Human
cauagaguacacug

SEQ ID NO: 3222305 - RNA, 17 nt, Human
cauaguaugguggcugg

SEQ ID NO: 3222306 - RNA, 15 nt, Human
cauagaguacacugc

SEQ ID NO: 3222307 - RNA, 17 nt, Human
cauagaguacacugccu

SEQ ID NO: 3222308 - RNA, 18 nt, Human
cauagaguacacugccug

SEQ ID NO: 3222309 - RNA, 19 nt, Human
cauagaguacacugccugc

SEQ ID NO: 3222310 - RNA, 19 nt, Human
cauaguaugguggcugggu

SEQ ID NO: 3222311 - RNA, 18 nt, Human
cauaguaugguggcuggg

SEQ ID NO: 3222312 - RNA, 20 nt, Human
cauaguaugguggcuggguu

SEQ ID NO: 3222313 - RNA, 22 nt, Human
cauagugaugguuccccuguuc

SEQ ID NO: 3222314 - RNA, 22 nt, Human
cauaguggcuuaaaacaacacu

SEQ ID NO: 3222315 - RNA, 20 nt, Human
cauaguuaaagaagacauuu

SEQ ID NO: 3222316 - RNA, 15 nt, Human
cauaguuacuguaaa

SEQ ID NO: 3222317 - RNA, 13 nt, Human
cauaguuacugua

SEQ ID NO: 3222318 - RNA, 19 nt, Human
cauaguuacuguaaaaugc

SEQ ID NO: 3222319 - RNA, 17 nt, Human
cauaguuacuguaaaau

SEQ ID NO: 3222320 - RNA, 19 nt, Human
cauaguucguuuaccuuca

SEQ ID NO: 3222321 - RNA, 21 nt, Human
cauaguuacuguaaaaugcaa

SEQ ID NO: 3222322 - RNA, 22 nt, Human
cauaguucuagugcagcugaaa

SEQ ID NO: 3222323 - RNA, 20 nt, Human
cauaguuguagacaaaguac

SEQ ID NO: 3222324 - RNA, 21 nt, Human
cauaguuguagacaaaguaca

SEQ ID NO: 3222325 - RNA, 15 nt, Human
cauaguuuuauuuau

SEQ ID NO: 3222326 - RNA, 16 nt, Human
cauaguuuuauuuaua

SEQ ID NO: 3222327 - RNA, 18 nt, Human
cauauaaaauggcaacaa

SEQ ID NO: 3222328 - RNA, 17 nt, Human
cauauaaaauggcaaca

SEQ ID NO: 3222329 - RNA, 19 nt, Human
cauaguuuuauuuauauuu

SEQ ID NO: 3222330 - RNA, 21 nt, Human
cauauaaaauggcaacaaacu

SEQ ID NO: 3222331 - RNA, 18 nt, Human
cauauuuuaaacagagga

SEQ ID NO: 3222332 - RNA, 10 nt, Human
cauauuugag

SEQ ID NO: 3222333 - RNA, 24 nt, Human
cauauuucuaauuggcuuuacuau

SEQ ID NO: 3222334 - RNA, 16 nt, Human
cauauuuuaauuucaa

SEQ ID NO: 3222335 - RNA, 23 nt, Human
cauauuuuaauuucaagcuuauu

SEQ ID NO: 3222336 - RNA, 18 nt, Human
cauauuuuacuuggaaau

SEQ ID NO: 3222337 - RNA, 22 nt, Human
cauauuuuacuuggaaauauua

SEQ ID NO: 3222338 - RNA, 23 nt, Human
cauauuuuacuuggaaauauuaa

SEQ ID NO: 3222339 - RNA, 15 nt, Human
cauauuuuaauuuca

SEQ ID NO: 3222340 - RNA, 14 nt, Human
cauauuuuaauuuc

SEQ ID NO: 3222341 - RNA, 20 nt, Human
cauauuuacuucuuauacau

SEQ ID NO: 3222342 - RNA, 17 nt, Human
cauauuuacuucuuaua

SEQ ID NO: 3222343 - RNA, 16 nt, Human
cauauuuacuucuuau

SEQ ID NO: 3222344 - RNA, 14 nt, Human
cauauuuacuucuu

SEQ ID NO: 3222345 - RNA, 13 nt, Human
cauaugcagaaau

SEQ ID NO: 3222346 - RNA, 14 nt, Human
cauaugcagaaaua

SEQ ID NO: 3222347 - RNA, 20 nt, Human
cauaugcagaaauagacaaa

SEQ ID NO: 3222348 - RNA, 13 nt, Human
cauauuuuuacaa

SEQ ID NO: 3222349 - RNA, 14 nt, Human
cauauuuuucaaaa

SEQ ID NO: 3222350 - RNA, 15 nt, Human
cauauuuuuuuccuu

SEQ ID NO: 3222351 - RNA, 22 nt, Human
cauauuuuuuuccuuacauaaa

SEQ ID NO: 3222352 - RNA, 18 nt, Human
cauauuuuuuuccuuaca

SEQ ID NO: 3222353 - RNA, 14 nt, Human
caucaagaugugac

SEQ ID NO: 3222354 - RNA, 21 nt, Human
caucaaaugaauaaugccuuu

SEQ ID NO: 3222355 - RNA, 18 nt, Human
caucaaugaaugaaugaa

SEQ ID NO: 3222356 - RNA, 13 nt, Human
caucacagcuugu

SEQ ID NO: 3222357 - RNA, 14 nt, Human
caucacagcuuguu

SEQ ID NO: 3222358 - RNA, 15 nt, Human
caucacagcuuguuu

SEQ ID NO: 3222359 - RNA, 11 nt, Human
cagugguuaag

SEQ ID NO: 3222360 - RNA, 11 nt, Human
cagugggaacu

SEQ ID NO: 3222361 - RNA, 22 nt, Human
cagugguuccuaauccucuagg

SEQ ID NO: 3222362 - RNA, 15 nt, Human
caguguaaagugugu

SEQ ID NO: 3222363 - RNA, 18 nt, Human
caguggcuggaucuguga

SEQ ID NO: 3222364 - RNA, 20 nt, Human
caguggcuggaucugugagg

SEQ ID NO: 3222365 - RNA, 16 nt, Human
caguggcuggaucugu

SEQ ID NO: 3222366 - RNA, 14 nt, Human
caguggccuacaaa

SEQ ID NO: 3222367 - RNA, 18 nt, Human
caguggccuacaaaucag

SEQ ID NO: 3222368 - RNA, 22 nt, Human
caguggccuacaaaucaguaau

SEQ ID NO: 3222369 - RNA, 23 nt, Human
caguggccuacaaaucaguaauu

SEQ ID NO: 3222370 - RNA, 20 nt, Human
caguggcagggcacagggcc

SEQ ID NO: 3222371 - RNA, 19 nt, Human
caguggcagggcacagggc

SEQ ID NO: 3222372 - RNA, 17 nt, Human
caguggcagggcacagg

SEQ ID NO: 3222373 - RNA, 16 nt, Human
caguggcagggcacag

SEQ ID NO: 3222374 - RNA, 15 nt, Human
caguggcagggcaca

SEQ ID NO: 3222375 - RNA, 14 nt, Human
caguggcagggcac

SEQ ID NO: 3222376 - RNA, 13 nt, Human
caguggcagggca

SEQ ID NO: 3222377 - RNA, 12 nt, Human
caguggcagggc

SEQ ID NO: 3222378 - RNA, 23 nt, Human
caguggcugaguagcucugccuu

SEQ ID NO: 3222379 - RNA, 23 nt, Human
caguggcgaaaucccugcucacu

SEQ ID NO: 3222380 - RNA, 20 nt, Human
caguggcgaaaucccugcuc

SEQ ID NO: 3222381 - RNA, 22 nt, Human
caguggcgaaaucccugcucac

SEQ ID NO: 3222382 - RNA, 21 nt, Human
caguggcgaaaucccugcuca

SEQ ID NO: 3222383 - RNA, 19 nt, Human
caguggcgaaaucccugcu

SEQ ID NO: 3222384 - RNA, 16 nt, Human
caguggcagcugcuuu

SEQ ID NO: 3222385 - RNA, 15 nt, Human
caguggcagcugcuu

SEQ ID NO: 3222386 - RNA, 14 nt, Human
caguggcagcugcu

SEQ ID NO: 3222387 - RNA, 13 nt, Human
caguggcagcugc

SEQ ID NO: 3222388 - RNA, 12 nt, Human
caguggcagcug

SEQ ID NO: 3222389 - RNA, 19 nt, Human
caguggagugcaaaaggcu

SEQ ID NO: 3222390 - RNA, 21 nt, Human
caguggagugcaaaaggcuug

SEQ ID NO: 3222391 - RNA, 14 nt, Human
caguggauacgugu

SEQ ID NO: 3222392 - RNA, 13 nt, Human
caguggagcccag

SEQ ID NO: 3222393 - RNA, 17 nt, Human
caguggagcccaggagu

SEQ ID NO: 3222394 - RNA, 16 nt, Human
caguggagcccaggag

SEQ ID NO: 3222395 - RNA, 19 nt, Human
cagugucuggcugcagagc

SEQ ID NO: 3222396 - RNA, 17 nt, Human
cagugucuggcugcaga

SEQ ID NO: 3222397 - RNA, 12 nt, Human
cagugugacuga

SEQ ID NO: 3222398 - RNA, 14 nt, Human
cagugugacaagga

SEQ ID NO: 3222399 - RNA, 19 nt, Human
caguguggccucuucugag

SEQ ID NO: 3222400 - RNA, 19 nt, Human
cagugugagggaaagagcu

SEQ ID NO: 3222401 - RNA, 17 nt, Human
cagugugagggaaagag

SEQ ID NO: 3222402 - RNA, 12 nt, Human
cagugugauuuu

SEQ ID NO: 3222403 - RNA, 14 nt, Human
cagugucaaugcag

SEQ ID NO: 3222404 - RNA, 20 nt, Human
caguguccauggacucagaa

SEQ ID NO: 3222405 - RNA, 22 nt, Human
caguguccauggacucagaaac

SEQ ID NO: 3222406 - RNA, 23 nt, Human
caguguacauggaauaacaugua

SEQ ID NO: 3222407 - RNA, 20 nt, Human
caguguacauggaauaacau

SEQ ID NO: 3222408 - RNA, 22 nt, Human
caguguaccauuaaaauaugca

SEQ ID NO: 3222409 - RNA, 21 nt, Human
caguguaccauuaaaauaugc

SEQ ID NO: 3222410 - RNA, 18 nt, Human
caguguaccauuaaaaua

SEQ ID NO: 3222411 - RNA, 17 nt, Human
caguguaccauuaaaau

SEQ ID NO: 3222412 - RNA, 15 nt, Human
caguguaccauuaaa

SEQ ID NO: 3222413 - RNA, 13 nt, Human
caguguagauuuu

SEQ ID NO: 3222414 - RNA, 16 nt, Human
caguguagauuuuaua

SEQ ID NO: 3222415 - RNA, 20 nt, Human
caguguagauuuuauagugu

SEQ ID NO: 3222416 - RNA, 16 nt, Human
caguguacauggaaua

SEQ ID NO: 3222417 - RNA, 18 nt, Human
caguguuccgugguuaaa

SEQ ID NO: 3222418 - RNA, 21 nt, Human
caguguuuugaccuuugauac

SEQ ID NO: 3222419 - RNA, 13 nt, Human
caguguuugugug

SEQ ID NO: 3222420 - RNA, 13 nt, Human
caguguuuucaga

SEQ ID NO: 3222421 - RNA, 19 nt, Human
caguguuuucagaagaaau

SEQ ID NO: 3222422 - RNA, 23 nt, Human
caguguuuucagaagaaauaaau

SEQ ID NO: 3222423 - RNA, 13 nt, Human
caguguuuggugc

SEQ ID NO: 3222424 - RNA, 14 nt, Human
caguguuucugggg

SEQ ID NO: 3222425 - RNA, 11 nt, Human
caguguuuaug

SEQ ID NO: 3222426 - RNA, 23 nt, Human
caguguuuaugugcuauuaauau

SEQ ID NO: 3222427 - RNA, 21 nt, Human
caguuccccuggaagcagugc

SEQ ID NO: 3222428 - RNA, 17 nt, Human
caguuccccuggaagca

SEQ ID NO: 3222429 - RNA, 22 nt, Human
caguuacaaauuauaauguauu

SEQ ID NO: 3222430 - RNA, 19 nt, Human
caguuacaaauuauaaugu

SEQ ID NO: 3222431 - RNA, 18 nt, Human
caguuacaaauuauaaug

SEQ ID NO: 3222432 - RNA, 14 nt, Human
caguuacaaauuau

SEQ ID NO: 3222433 - RNA, 20 nt, Human
caguuaagccuuuggaaaca

SEQ ID NO: 3222434 - RNA, 13 nt, Human
caguuaagagaaa

SEQ ID NO: 3222435 - RNA, 14 nt, Human
caguuaagagaaau

SEQ ID NO: 3222436 - RNA, 15 nt, Human
caguuaagccuuugg

SEQ ID NO: 3222437 - RNA, 17 nt, Human
caguuaagccuuuggaa

SEQ ID NO: 3222438 - RNA, 14 nt, Human
caguuaagccuuug

SEQ ID NO: 3222439 - RNA, 17 nt, Human
caguucuacagaaaaac

SEQ ID NO: 3222440 - RNA, 14 nt, Human
caguucucuccuuc

SEQ ID NO: 3222441 - RNA, 15 nt, Human
caguucucuccuucu

SEQ ID NO: 3222442 - RNA, 13 nt, Human
caguucucuccuu

SEQ ID NO: 3222443 - RNA, 16 nt, Human
caguucucuucacuca

SEQ ID NO: 3222444 - RNA, 22 nt, Human
caguucucuccuucuucccccc

SEQ ID NO: 3222445 - RNA, 12 nt, Human
caguugaaaaac

SEQ ID NO: 3222446 - RNA, 18 nt, Human
caguugaaaaacagcuga

SEQ ID NO: 3222447 - RNA, 19 nt, Human
caguugaaaaacagcugag

SEQ ID NO: 3222448 - RNA, 15 nt, Human
cauaccuggcccugu

SEQ ID NO: 3222449 - RNA, 14 nt, Human
cauacccaccccca

SEQ ID NO: 3222450 - RNA, 17 nt, Human
cauacccacccccaccc

SEQ ID NO: 3222451 - RNA, 18 nt, Human
cauacccacccccaccca

SEQ ID NO: 3222452 - RNA, 21 nt, Human
cauacccacccccacccaagg

SEQ ID NO: 3222453 - RNA, 15 nt, Human
cauacguaaaaaucu

SEQ ID NO: 3222454 - RNA, 14 nt, Human
cauacguaaaaauc

SEQ ID NO: 3222455 - RNA, 17 nt, Human
cauaccuuggccagcaa

SEQ ID NO: 3222456 - RNA, 20 nt, Human
cauacuaauuauacccccug

SEQ ID NO: 3222457 - RNA, 16 nt, Human
cauacgugugcaugug

SEQ ID NO: 3222458 - RNA, 17 nt, Human
cauaaguauuuggaauu

SEQ ID NO: 3222459 - RNA, 22 nt, Human
cauaaguauuuggaauuagaac

SEQ ID NO: 3222460 - RNA, 18 nt, Human
cauaaggucagcucagag

SEQ ID NO: 3222461 - RNA, 16 nt, Human
cauaagcuuuuucucu

SEQ ID NO: 3222462 - RNA, 18 nt, Human
cauaagcuuaugcuuaaa

SEQ ID NO: 3222463 - RNA, 14 nt, Human
cauaagauaaaugu

SEQ ID NO: 3222464 - RNA, 21 nt, Human
cauaagcaacaauuuucagau

SEQ ID NO: 3222465 - RNA, 17 nt, Human
cauaagcaacaauuuuc

SEQ ID NO: 3222466 - RNA, 15 nt, Human
cauaagcaacaauuu

SEQ ID NO: 3222467 - RNA, 15 nt, Human
cauaagauauuuuau

SEQ ID NO: 3222468 - RNA, 19 nt, Human
cauaacugacuuaguucuu

SEQ ID NO: 3222469 - RNA, 18 nt, Human
cauaauaauccugcaaag

SEQ ID NO: 3222470 - RNA, 15 nt, Human
cauaauacugaacca

SEQ ID NO: 3222471 - RNA, 16 nt, Human
cauaauacugaaccac

SEQ ID NO: 3222472 - RNA, 17 nt, Human
cauaauacugaaccacu

SEQ ID NO: 3222473 - RNA, 18 nt, Human
cauaauacugaaccacuu

SEQ ID NO: 3222474 - RNA, 18 nt, Human
cauaauccaguaaaauaa

SEQ ID NO: 3222475 - RNA, 18 nt, Human
cauaaucacaacccuuca

SEQ ID NO: 3222476 - RNA, 17 nt, Human
cauaauccaguaaaaua

SEQ ID NO: 3222477 - RNA, 17 nt, Human
cauaccaacacgagcag

SEQ ID NO: 3222478 - RNA, 11 nt, Human
cauacccaccc

SEQ ID NO: 3222479 - RNA, 12 nt, Human
cauacccacccc

SEQ ID NO: 3222480 - RNA, 20 nt, Human
cauaccaacucaacuuuuuu

SEQ ID NO: 3222481 - RNA, 22 nt, Human
cauaaagaauuugucacaggaa

SEQ ID NO: 3222482 - RNA, 13 nt, Human
cauaaagaauuug

SEQ ID NO: 3222483 - RNA, 11 nt, Human
cauaaacauca

SEQ ID NO: 3222484 - RNA, 20 nt, Human
cauaaaccauuuuuguuacu

SEQ ID NO: 3222485 - RNA, 21 nt, Human
cauaaaccauuuuuguuacuc

SEQ ID NO: 3222486 - RNA, 22 nt, Human
cauaaacaucagguuaggcagu

SEQ ID NO: 3222487 - RNA, 21 nt, Human
cauaaaaauuagccaagugug

SEQ ID NO: 3222488 - RNA, 19 nt, Human
cauaaaauaaggagcauau

SEQ ID NO: 3222489 - RNA, 22 nt, Human
cauaaaauguccaguaagauca

SEQ ID NO: 3222490 - RNA, 16 nt, Human
cauaaccuagccuuag

SEQ ID NO: 3222491 - RNA, 16 nt, Human
cauaaaucuuccaaag

SEQ ID NO: 3222492 - RNA, 11 nt, Human
cauaaaucaac

SEQ ID NO: 3222493 - RNA, 14 nt, Human
cauaaagugagaaa

SEQ ID NO: 3222494 - RNA, 17 nt, Human
cauaaagugagaaaacu

SEQ ID NO: 3222495 - RNA, 11 nt, Human
cauaaagucag

SEQ ID NO: 3222496 - RNA, 17 nt, Human
cauaaagcucaaaugaa

SEQ ID NO: 3222497 - RNA, 20 nt, Human
cauaaagcucaaaugaaaug

SEQ ID NO: 3222498 - RNA, 21 nt, Human
cauaaagcucaaaugaaaugu

SEQ ID NO: 3222499 - RNA, 13 nt, Human
caguuuuuguguu

SEQ ID NO: 3222500 - RNA, 19 nt, Human
caguuuuucuuaauauaua

SEQ ID NO: 3222501 - RNA, 16 nt, Human
caguuuuucuuaauau

SEQ ID NO: 3222502 - RNA, 15 nt, Human
caguuuuucuuaaua

SEQ ID NO: 3222503 - RNA, 13 nt, Human
caguuuuucuuaa

SEQ ID NO: 3222504 - RNA, 21 nt, Human
caguuuuucauaagauauuuu

SEQ ID NO: 3222505 - RNA, 23 nt, Human
caguuuuucauaagauauuuuau

SEQ ID NO: 3222506 - RNA, 12 nt, Human
caguuuuucauu

SEQ ID NO: 3222507 - RNA, 20 nt, Human
caguuuuucauuuuaaaaag

SEQ ID NO: 3222508 - RNA, 20 nt, Human
caguuuucugagaaagacua

SEQ ID NO: 3222509 - RNA, 19 nt, Human
caguuuucugagaaagacu

SEQ ID NO: 3222510 - RNA, 22 nt, Human
caguuguaacauucuauuucaa

SEQ ID NO: 3222511 - RNA, 15 nt, Human
caguuuucugagaaa

SEQ ID NO: 3222512 - RNA, 14 nt, Human
caguuuucugagaa

SEQ ID NO: 3222513 - RNA, 17 nt, Human
caguuguuagugugucu

SEQ ID NO: 3222514 - RNA, 21 nt, Human
caguuguuaaguccuuggcuu

SEQ ID NO: 3222515 - RNA, 23 nt, Human
caguugccagucaccccggccac

SEQ ID NO: 3222516 - RNA, 18 nt, Human
caguugcccagccucuuu

SEQ ID NO: 3222517 - RNA, 17 nt, Human
caguugcccagccucuu

SEQ ID NO: 3222518 - RNA, 16 nt, Human
caguugcccagccucu

SEQ ID NO: 3222519 - RNA, 14 nt, Human
caguugcccagccu

SEQ ID NO: 3222520 - RNA, 17 nt, Human
caguugcucaaaaagaa

SEQ ID NO: 3222521 - RNA, 19 nt, Human
caguugcucaaaaagaaau

SEQ ID NO: 3222522 - RNA, 23 nt, Human
caguugcucaaaaagaaaucaau

SEQ ID NO: 3222523 - RNA, 21 nt, Human
caguugcccagccucuuuccc

SEQ ID NO: 3222524 - RNA, 19 nt, Human
caguugcccagccucuuuc

SEQ ID NO: 3222525 - RNA, 14 nt, Human
caguugcugguaaa

SEQ ID NO: 3222526 - RNA, 13 nt, Human
caguugcugguaa

SEQ ID NO: 3222527 - RNA, 17 nt, Human
caguugcugguaaaaug

SEQ ID NO: 3222528 - RNA, 18 nt, Human
caguugcugguaaaauga

SEQ ID NO: 3222529 - RNA, 19 nt, Human
caguugcugguaaaaugaa

SEQ ID NO: 3222530 - RNA, 20 nt, Human
caguugcugguaaaaugaag

SEQ ID NO: 3222531 - RNA, 16 nt, Human
caguuggguggaugcc

SEQ ID NO: 3222532 - RNA, 21 nt, Human
caguugcugguaaaaugaaga

SEQ ID NO: 3222533 - RNA, 22 nt, Human
caguugcugguaaaaugaagaa

SEQ ID NO: 3222534 - RNA, 23 nt, Human
caguugcugguaaaaugaagaau

SEQ ID NO: 3222535 - RNA, 22 nt, Human
caguugcugucagucuugaccu

SEQ ID NO: 3222536 - RNA, 19 nt, Human
caguuggucccccuuccau

SEQ ID NO: 3222537 - RNA, 20 nt, Human
caguuggucccccuuccaug

SEQ ID NO: 3222538 - RNA, 21 nt, Human
caguuggucccccuuccaugg

SEQ ID NO: 3222539 - RNA, 22 nt, Human
caguuggucccccuuccaugga

SEQ ID NO: 3222540 - RNA, 19 nt, Human
caguuggguggaugccugg

SEQ ID NO: 3222541 - RNA, 18 nt, Human
caguuggguggaugccug

SEQ ID NO: 3222542 - RNA, 18 nt, Human
caguuggucccccuucca

SEQ ID NO: 3222543 - RNA, 18 nt, Human
caguugaaaagacuccaa

SEQ ID NO: 3222544 - RNA, 21 nt, Human
caguucuuuaagaagaucuuu

SEQ ID NO: 3222545 - RNA, 14 nt, Human
caguugaaaagacu

SEQ ID NO: 3222546 - RNA, 22 nt, Human
caguugaaaagacuccaaagaa

SEQ ID NO: 3222547 - RNA, 21 nt, Human
caguugaaaagacuccaaaga

SEQ ID NO: 3222548 - RNA, 23 nt, Human
caguugaaaagacuccaaagaaa

SEQ ID NO: 3222549 - RNA, 19 nt, Human
caguugagaggacacuccc

SEQ ID NO: 3222550 - RNA, 20 nt, Human
caguugagaggacacucccg

SEQ ID NO: 3222551 - RNA, 19 nt, Human
caugccagcuuaucucagg

SEQ ID NO: 3222552 - RNA, 20 nt, Human
caugccagcuuaucucaggg

SEQ ID NO: 3222553 - RNA, 17 nt, Human
caugcccauauuuuacu

SEQ ID NO: 3222554 - RNA, 14 nt, Human
caugccaggggccu

SEQ ID NO: 3222555 - RNA, 13 nt, Human
caugccaggggcc

SEQ ID NO: 3222556 - RNA, 14 nt, Human
caugccaguauuuu

SEQ ID NO: 3222557 - RNA, 19 nt, Human
caugccaguauuuuuaaag

SEQ ID NO: 3222558 - RNA, 21 nt, Human
cauggagauagccccacagga

SEQ ID NO: 3222559 - RNA, 17 nt, Human
cauggagguuugaagau

SEQ ID NO: 3222560 - RNA, 20 nt, Human
cauggagaaccaccuacccc

SEQ ID NO: 3222561 - RNA, 11 nt, Human
cauggacuuug

SEQ ID NO: 3222562 - RNA, 13 nt, Human
cauggacuuuguu

SEQ ID NO: 3222563 - RNA, 16 nt, Human
cauggaguauauguca

SEQ ID NO: 3222564 - RNA, 18 nt, Human
caugggaaugaaugucag

SEQ ID NO: 3222565 - RNA, 19 nt, Human
cauggggcugauuguauuu

SEQ ID NO: 3222566 - RNA, 17 nt, Human
caugggccuccugugug

SEQ ID NO: 3222567 - RNA, 16 nt, Human
caugggccuccugugu

SEQ ID NO: 3222568 - RNA, 17 nt, Human
caugggacagggaggac

SEQ ID NO: 3222569 - RNA, 22 nt, Human
caugggaaugaaugucagugug

SEQ ID NO: 3222570 - RNA, 15 nt, Human
caugggccuccugug

SEQ ID NO: 3222571 - RNA, 14 nt, Human
caugguccauucuc

SEQ ID NO: 3222572 - RNA, 20 nt, Human
cauggggggagcacccugag

SEQ ID NO: 3222573 - RNA, 21 nt, Human
cauggggggagcacccugagg

SEQ ID NO: 3222574 - RNA, 23 nt, Human
cauggggggagcacccugagggc

SEQ ID NO: 3222575 - RNA, 15 nt, Human
cauggggucucucac

SEQ ID NO: 3222576 - RNA, 19 nt, Human
cauggggucucucacagac

SEQ ID NO: 3222577 - RNA, 16 nt, Human
cauggggucucucaca

SEQ ID NO: 3222578 - RNA, 23 nt, Human
cauggggucucucacagacagga

SEQ ID NO: 3222579 - RNA, 18 nt, Human
cauggacaugaucuucuu

SEQ ID NO: 3222580 - RNA, 16 nt, Human
cauggaauaacaugua

SEQ ID NO: 3222581 - RNA, 14 nt, Human
cauggaaugagggu

SEQ ID NO: 3222582 - RNA, 15 nt, Human
cauggaaugaggguu

SEQ ID NO: 3222583 - RNA, 13 nt, Human
caugcuuaaauuu

SEQ ID NO: 3222584 - RNA, 14 nt, Human
caugcuuaaauuuu

SEQ ID NO: 3222585 - RNA, 20 nt, Human
cauggaaguacuauaauuua

SEQ ID NO: 3222586 - RNA, 22 nt, Human
cauggaaguacuauaauuuacc

SEQ ID NO: 3222587 - RNA, 22 nt, Human
caugcugucccuuacgugaguc

SEQ ID NO: 3222588 - RNA, 17 nt, Human
caugcugucccuuacgu

SEQ ID NO: 3222589 - RNA, 18 nt, Human
caugcugucuggcacagc

SEQ ID NO: 3222590 - RNA, 17 nt, Human
caugcugucuggcacag

SEQ ID NO: 3222591 - RNA, 12 nt, Human
caugcugucugg

SEQ ID NO: 3222592 - RNA, 23 nt, Human
caugcugucuggcacagccugca

SEQ ID NO: 3222593 - RNA, 21 nt, Human
caugcugucuggcacagccug

SEQ ID NO: 3222594 - RNA, 20 nt, Human
caugcugucuggcacagccu

SEQ ID NO: 3222595 - RNA, 19 nt, Human
caugcugucuggcacagcc

SEQ ID NO: 3222596 - RNA, 17 nt, Human
caugcgggcuuccuccu

SEQ ID NO: 3222597 - RNA, 18 nt, Human
caugccuggauggggcug

SEQ ID NO: 3222598 - RNA, 21 nt, Human
caugccuggauggggcugcac

SEQ ID NO: 3222599 - RNA, 23 nt, Human
caugccuggauggggcugcaccg

SEQ ID NO: 3222600 - RNA, 14 nt, Human
caugccucucucag

SEQ ID NO: 3222601 - RNA, 15 nt, Human
caugccucucucagg

SEQ ID NO: 3222602 - RNA, 15 nt, Human
caugccgggugcagc

SEQ ID NO: 3222603 - RNA, 16 nt, Human
caugccucucucaggc

SEQ ID NO: 3222604 - RNA, 17 nt, Human
caugccucucucaggcc

SEQ ID NO: 3222605 - RNA, 18 nt, Human
caugccucucucaggcca

SEQ ID NO: 3222606 - RNA, 19 nt, Human
caugccucucucaggccaa

SEQ ID NO: 3222607 - RNA, 13 nt, Human
caugccuggaugg

SEQ ID NO: 3222608 - RNA, 21 nt, Human
cauuaccucagugagaagcca

SEQ ID NO: 3222609 - RNA, 22 nt, Human
cauuaccucagugagaagccag

SEQ ID NO: 3222610 - RNA, 13 nt, Human
cauuaauguugau

SEQ ID NO: 3222611 - RNA, 21 nt, Human
cauuaauucaggcauauuuua

SEQ ID NO: 3222612 - RNA, 20 nt, Human
cauuaauguugauuucuagu

SEQ ID NO: 3222613 - RNA, 17 nt, Human
cauuaauguugauuucu

SEQ ID NO: 3222614 - RNA, 16 nt, Human
cauuaauguugauuuc

SEQ ID NO: 3222615 - RNA, 14 nt, Human
cauuaauguugauu

SEQ ID NO: 3222616 - RNA, 17 nt, Human
cauuaauccacauguuu

SEQ ID NO: 3222617 - RNA, 19 nt, Human
cauuaauccacauguuuca

SEQ ID NO: 3222618 - RNA, 21 nt, Human
cauuaauccacauguuucaga

SEQ ID NO: 3222619 - RNA, 22 nt, Human
cauuaauccacauguuucagag

SEQ ID NO: 3222620 - RNA, 17 nt, Human
cauuaaugccugcuuuu

SEQ ID NO: 3222621 - RNA, 19 nt, Human
cauuaaugccugcuuuuug

SEQ ID NO: 3222622 - RNA, 21 nt, Human
cauuaaugccugcuuuuugga

SEQ ID NO: 3222623 - RNA, 22 nt, Human
cauuaaugccugcuuuuuggaa

SEQ ID NO: 3222624 - RNA, 23 nt, Human
cauuaaugccugcuuuuuggaaa

SEQ ID NO: 3222625 - RNA, 17 nt, Human
cauuagcaguuugcuuu

SEQ ID NO: 3222626 - RNA, 22 nt, Human
cauuagcaaaaaaaguuguaug

SEQ ID NO: 3222627 - RNA, 20 nt, Human
cauuagcaaaaaaaguugua

SEQ ID NO: 3222628 - RNA, 19 nt, Human
cauuagcaaaaaaaguugu

SEQ ID NO: 3222629 - RNA, 18 nt, Human
cauuagcaaaaaaaguug

SEQ ID NO: 3222630 - RNA, 23 nt, Human
cauuaccucuuuggaaaaggaag

SEQ ID NO: 3222631 - RNA, 17 nt, Human
cauuaccucuuuggaaa

SEQ ID NO: 3222632 - RNA, 15 nt, Human
cauuaccucuuugga

SEQ ID NO: 3222633 - RNA, 17 nt, Human
cauuagagucaacuaca

SEQ ID NO: 3222634 - RNA, 17 nt, Human
cauuagcaaaaaaaguu

SEQ ID NO: 3222635 - RNA, 16 nt, Human
cauuagcaaaaaaagu

SEQ ID NO: 3222636 - RNA, 15 nt, Human
cauguuuuguuuacg

SEQ ID NO: 3222637 - RNA, 22 nt, Human
cauuaaauuacuauagcaaagu

SEQ ID NO: 3222638 - RNA, 13 nt, Human
cauuaaagucaga

SEQ ID NO: 3222639 - RNA, 15 nt, Human
cauuaaagucagaag

SEQ ID NO: 3222640 - RNA, 17 nt, Human
cauuaaagucagaaguu

SEQ ID NO: 3222641 - RNA, 18 nt, Human
cauuaaagucagaaguuu

SEQ ID NO: 3222642 - RNA, 14 nt, Human
caugucuuuucuug

SEQ ID NO: 3222643 - RNA, 19 nt, Human
caugucuuuucuugcauga

SEQ ID NO: 3222644 - RNA, 21 nt, Human
caugucuuuucuugcaugagg

SEQ ID NO: 3222645 - RNA, 23 nt, Human
caugucuuuucuugcaugaggcu

SEQ ID NO: 3222646 - RNA, 21 nt, Human
cauguaauuaaguacuaugua

SEQ ID NO: 3222647 - RNA, 18 nt, Human
cauguaauuaaguacuau

SEQ ID NO: 3222648 - RNA, 18 nt, Human
cauguaauuuguguaaau

SEQ ID NO: 3222649 - RNA, 19 nt, Human
cauguaauuuuauuuuaaa

SEQ ID NO: 3222650 - RNA, 14 nt, Human
cauguaauuugugu

SEQ ID NO: 3222651 - RNA, 15 nt, Human
caugucgccucugca

SEQ ID NO: 3222652 - RNA, 14 nt, Human
caugucgccucugc

SEQ ID NO: 3222653 - RNA, 20 nt, Human
cauguccugugucaguuuau

SEQ ID NO: 3222654 - RNA, 19 nt, Human
cauguccugugucaguuua

SEQ ID NO: 3222655 - RNA, 14 nt, Human
cauguccuguguca

SEQ ID NO: 3222656 - RNA, 18 nt, Human
cauguccugugucaguuu

SEQ ID NO: 3222657 - RNA, 15 nt, Human
cauguccugugucag

SEQ ID NO: 3222658 - RNA, 20 nt, Human
caugucgccucugcauucag

SEQ ID NO: 3222659 - RNA, 18 nt, Human
caugucgccucugcauuc

SEQ ID NO: 3222660 - RNA, 20 nt, Human
cauggugacuuuugaaaaga

SEQ ID NO: 3222661 - RNA, 17 nt, Human
cauguaaauugacugua

SEQ ID NO: 3222662 - RNA, 18 nt, Human
caugguuuaaaagaaaaa

SEQ ID NO: 3222663 - RNA, 19 nt, Human
caugguuuaaaagaaaaaa

SEQ ID NO: 3222664 - RNA, 20 nt, Human
caugguuuaaaagaaaaaau

SEQ ID NO: 3222665 - RNA, 14 nt, Human
cauguaacaauguu

SEQ ID NO: 3222666 - RNA, 14 nt, Human
cauguuuauguaaa

SEQ ID NO: 3222667 - RNA, 13 nt, Human
cauguuuucaaau

SEQ ID NO: 3222668 - RNA, 20 nt, Human
cauguuuucaaauggaguug

SEQ ID NO: 3222669 - RNA, 16 nt, Human
cauguuuucaaaugga

SEQ ID NO: 3222670 - RNA, 22 nt, Human
cauguuuucaaauggaguugga

SEQ ID NO: 3222671 - RNA, 16 nt, Human
cauguuuugcauguaa

SEQ ID NO: 3222672 - RNA, 15 nt, Human
cauguuuugcaugua

SEQ ID NO: 3222673 - RNA, 22 nt, Human
cauguggggagguuaaucuagg

SEQ ID NO: 3222674 - RNA, 23 nt, Human
caugugggccacacaagugcagu

SEQ ID NO: 3222675 - RNA, 18 nt, Human
cauguggagucagccucg

SEQ ID NO: 3222676 - RNA, 15 nt, Human
cauguggagucagcc

SEQ ID NO: 3222677 - RNA, 15 nt, Human
caugugcacaugcac

SEQ ID NO: 3222678 - RNA, 21 nt, Human
caugugccagguuuuuggucu

SEQ ID NO: 3222679 - RNA, 15 nt, Human
caugugcuucugcca

SEQ ID NO: 3222680 - RNA, 14 nt, Human
ccaagguucugggu

SEQ ID NO: 3222681 - RNA, 19 nt, Human
ccaaggcugauuaaaccaa

SEQ ID NO: 3222682 - RNA, 16 nt, Human
ccaaggcucugagcaa

SEQ ID NO: 3222683 - RNA, 14 nt, Human
ccaaggcuggggga

SEQ ID NO: 3222684 - RNA, 18 nt, Human
ccaaggugggaggauugc

SEQ ID NO: 3222685 - RNA, 20 nt, Human
ccaauauucauagcagcuua

SEQ ID NO: 3222686 - RNA, 12 nt, Human
ccaagugugcua

SEQ ID NO: 3222687 - RNA, 16 nt, Human
ccaaguggcucccaca

SEQ ID NO: 3222688 - RNA, 22 nt, Human
ccaaguggagccugacagccag

SEQ ID NO: 3222689 - RNA, 18 nt, Human
ccaaguggagccugacag

SEQ ID NO: 3222690 - RNA, 23 nt, Human
ccaaguggagccugacagccaga

SEQ ID NO: 3222691 - RNA, 13 nt, Human
ccaaguggcuccc

SEQ ID NO: 3222692 - RNA, 16 nt, Human
ccacaagaaaugaaag

SEQ ID NO: 3222693 - RNA, 22 nt, Human
ccacaagaaaugaaagcaggga

SEQ ID NO: 3222694 - RNA, 16 nt, Human
ccacaagacccuugug

SEQ ID NO: 3222695 - RNA, 13 nt, Human
ccacaagagccca

SEQ ID NO: 3222696 - RNA, 18 nt, Human
ccacaaaggagagcuagc

SEQ ID NO: 3222697 - RNA, 13 nt, Human
ccacaacacacag

SEQ ID NO: 3222698 - RNA, 10 nt, Human
ccaauuucuc

SEQ ID NO: 3222699 - RNA, 12 nt, Human
ccaauuuuccuu

SEQ ID NO: 3222700 - RNA, 21 nt, Human
ccaauuuuaacuuagagcuuu

SEQ ID NO: 3222701 - RNA, 12 nt, Human
ccacaaaauaua

SEQ ID NO: 3222702 - RNA, 23 nt, Human
ccaauuuuuuaagugaaaauaua

SEQ ID NO: 3222703 - RNA, 12 nt, Human
ccaauauuuaaa

SEQ ID NO: 3222704 - RNA, 16 nt, Human
ccaagagccugagagu

SEQ ID NO: 3222705 - RNA, 13 nt, Human
ccaagaggcugca

SEQ ID NO: 3222706 - RNA, 12 nt, Human
ccaagaggcugc

SEQ ID NO: 3222707 - RNA, 23 nt, Human
ccaagcagagguugggaggccau

SEQ ID NO: 3222708 - RNA, 14 nt, Human
ccaagcaggacaug

SEQ ID NO: 3222709 - RNA, 14 nt, Human
ccaagccguggcuu

SEQ ID NO: 3222710 - RNA, 21 nt, Human
ccaagccguggcuucccgcuc

SEQ ID NO: 3222711 - RNA, 17 nt, Human
ccaagccguggcuuccc

SEQ ID NO: 3222712 - RNA, 16 nt, Human
ccaagccguggcuucc

SEQ ID NO: 3222713 - RNA, 15 nt, Human
ccaagccguggcuuc

SEQ ID NO: 3222714 - RNA, 18 nt, Human
ccaaggcuagaaccaccu

SEQ ID NO: 3222715 - RNA, 21 nt, Human
ccaaggcccccugccugcccu

SEQ ID NO: 3222716 - RNA, 20 nt, Human
ccaaggcccccugccugccc

SEQ ID NO: 3222717 - RNA, 19 nt, Human
ccaaggcccccugccugcc

SEQ ID NO: 3222718 - RNA, 17 nt, Human
ccaaggcccccugccug

SEQ ID NO: 3222719 - RNA, 14 nt, Human
ccaagcuccaucuc

SEQ ID NO: 3222720 - RNA, 16 nt, Human
ccaaggccaggccuug

SEQ ID NO: 3222721 - RNA, 12 nt, Human
ccaagcucccag

SEQ ID NO: 3222722 - RNA, 13 nt, Human
ccaagcucccagg

SEQ ID NO: 3222723 - RNA, 23 nt, Human
ccaagccguggcuucccgcucag

SEQ ID NO: 3222724 - RNA, 14 nt, Human
ccaagcaggaggcu

SEQ ID NO: 3222725 - RNA, 13 nt, Human
ccaagcaggaggc

SEQ ID NO: 3222726 - RNA, 20 nt, Human
ccacaaguuaaauaaaucau

SEQ ID NO: 3222727 - RNA, 15 nt, Human
ccacaaguuaaauaa

SEQ ID NO: 3222728 - RNA, 20 nt, Human
ccacaagggugcccaccucu

SEQ ID NO: 3222729 - RNA, 16 nt, Human
ccacaaggaagaaauu

SEQ ID NO: 3222730 - RNA, 13 nt, Human
ccacaaggaagaa

SEQ ID NO: 3222731 - RNA, 13 nt, Human
ccacacacacaaa

SEQ ID NO: 3222732 - RNA, 12 nt, Human
ccacacacacaa

SEQ ID NO: 3222733 - RNA, 15 nt, Human
ccacacaagugcagu

SEQ ID NO: 3222734 - RNA, 21 nt, Human
ccacacaacauccaaguggcc

SEQ ID NO: 3222735 - RNA, 15 nt, Human
ccacaaucaccgaug

SEQ ID NO: 3222736 - RNA, 16 nt, Human
ccacaagagcccaggc

SEQ ID NO: 3222737 - RNA, 17 nt, Human
ccacaagagcccaggcc

SEQ ID NO: 3222738 - RNA, 18 nt, Human
ccacaagagcccaggccu

SEQ ID NO: 3222739 - RNA, 19 nt, Human
ccacaagagcccaggccuc

SEQ ID NO: 3222740 - RNA, 20 nt, Human
ccacaagagcccaggccucc

SEQ ID NO: 3222741 - RNA, 21 nt, Human
ccacaagagcccaggccuccu

SEQ ID NO: 3222742 - RNA, 12 nt, Human
ccaagagccuga

SEQ ID NO: 3222743 - RNA, 20 nt, Human
ccaagagcaaggaagguaaa

SEQ ID NO: 3222744 - RNA, 22 nt, Human
ccaagagcaaggaagguaaaaa

SEQ ID NO: 3222745 - RNA, 21 nt, Human
ccaacacgagcaggcuacugu

SEQ ID NO: 3222746 - RNA, 16 nt, Human
ccaacaucaacaucuu

SEQ ID NO: 3222747 - RNA, 17 nt, Human
ccaacauccacucucuc

SEQ ID NO: 3222748 - RNA, 15 nt, Human
ccaacauccacucuc

SEQ ID NO: 3222749 - RNA, 14 nt, Human
ccaacauccacucu

SEQ ID NO: 3222750 - RNA, 13 nt, Human
ccaacauccacuc

SEQ ID NO: 3222751 - RNA, 14 nt, Human
ccaacauacuccca

SEQ ID NO: 3222752 - RNA, 13 nt, Human
ccaacaucaacau

SEQ ID NO: 3222753 - RNA, 14 nt, Human
ccaacacgagcagg

SEQ ID NO: 3222754 - RNA, 16 nt, Human
ccaacaccaucacagc

SEQ ID NO: 3222755 - RNA, 18 nt, Human
ccaacaccaucacagcuu

SEQ ID NO: 3222756 - RNA, 20 nt, Human
ccaacaccaucacagcuugu

SEQ ID NO: 3222757 - RNA, 21 nt, Human
ccaacaccaucacagcuuguu

SEQ ID NO: 3222758 - RNA, 22 nt, Human
ccaacaccaucacagcuuguuu

SEQ ID NO: 3222759 - RNA, 14 nt, Human
ccaaauugucaccu

SEQ ID NO: 3222760 - RNA, 22 nt, Human
ccaaauugucaccugcuucucu

SEQ ID NO: 3222761 - RNA, 21 nt, Human
ccaaauugucaccugcuucuc

SEQ ID NO: 3222762 - RNA, 22 nt, Human
ccaaauucuuucaguggcuacc

SEQ ID NO: 3222763 - RNA, 15 nt, Human
ccaaauucuuucagu

SEQ ID NO: 3222764 - RNA, 13 nt, Human
ccaacccucauca

SEQ ID NO: 3222765 - RNA, 15 nt, Human
ccaacccucaucacc

SEQ ID NO: 3222766 - RNA, 18 nt, Human
ccaacccuggcacccagg

SEQ ID NO: 3222767 - RNA, 14 nt, Human
ccaacccuucuuca

SEQ ID NO: 3222768 - RNA, 15 nt, Human
ccaacccuucuucau

SEQ ID NO: 3222769 - RNA, 16 nt, Human
ccaacccuucuucaug

SEQ ID NO: 3222770 - RNA, 15 nt, Human
ccaagaccuucuccu

SEQ ID NO: 3222771 - RNA, 17 nt, Human
ccaaccucuuccuccug

SEQ ID NO: 3222772 - RNA, 15 nt, Human
ccaaccucuuccucc

SEQ ID NO: 3222773 - RNA, 14 nt, Human
ccaaccucuuccuc

SEQ ID NO: 3222774 - RNA, 13 nt, Human
ccaaccucuuccu

SEQ ID NO: 3222775 - RNA, 14 nt, Human
ccaaccucgcucca

SEQ ID NO: 3222776 - RNA, 14 nt, Human
ccaaagaugcagcc

SEQ ID NO: 3222777 - RNA, 13 nt, Human
ccaaagaugcagc

SEQ ID NO: 3222778 - RNA, 17 nt, Human
ccaaagaaauguaaggg

SEQ ID NO: 3222779 - RNA, 12 nt, Human
ccaaagaaaguu

SEQ ID NO: 3222780 - RNA, 16 nt, Human
ccaaacuacugaauga

SEQ ID NO: 3222781 - RNA, 13 nt, Human
ccaaagacaaaua

SEQ ID NO: 3222782 - RNA, 14 nt, Human
ccaaagaaugaauu

SEQ ID NO: 3222783 - RNA, 16 nt, Human
ccaaagacaaauagua

SEQ ID NO: 3222784 - RNA, 15 nt, Human
ccaaagacaaauagu

SEQ ID NO: 3222785 - RNA, 14 nt, Human
ccaaagacaaauag

SEQ ID NO: 3222786 - RNA, 16 nt, Human
ccaaacccuucagugc

SEQ ID NO: 3222787 - RNA, 18 nt, Human
ccaaaauaagaaaagaug

SEQ ID NO: 3222788 - RNA, 14 nt, Human
ccaaaauaagaaaa

SEQ ID NO: 3222789 - RNA, 17 nt, Human
ccaaaauaagaaaagau

SEQ ID NO: 3222790 - RNA, 16 nt, Human
ccaaaauaagaaaaga

SEQ ID NO: 3222791 - RNA, 20 nt, Human
cauuuuuaguagagacaggg

SEQ ID NO: 3222792 - RNA, 14 nt, Human
ccaaaaguuauuaa

SEQ ID NO: 3222793 - RNA, 22 nt, Human
cauuuuuaucaggauuuccucu

SEQ ID NO: 3222794 - RNA, 21 nt, Human
cauuuuuauaccuguuuaaau

SEQ ID NO: 3222795 - RNA, 20 nt, Human
cauuuuuauaccuguuuaaa

SEQ ID NO: 3222796 - RNA, 21 nt, Human
cauuuuauuaagcuuuuugga

SEQ ID NO: 3222797 - RNA, 22 nt, Human
cauuuuauuaagcuuuuuggaa

SEQ ID NO: 3222798 - RNA, 23 nt, Human
cauuuuauuaagcuuuuuggaau

SEQ ID NO: 3222799 - RNA, 16 nt, Human
cauuuucuuaauccag

SEQ ID NO: 3222800 - RNA, 23 nt, Human
cauuuugggguacccacugcucu

SEQ ID NO: 3222801 - RNA, 19 nt, Human
cauuuuggcgcucgaaguu

SEQ ID NO: 3222802 - RNA, 22 nt, Human
cauuuuggugucuuucucuuuu

SEQ ID NO: 3222803 - RNA, 18 nt, Human
cauuuuuaguagagacag

SEQ ID NO: 3222804 - RNA, 19 nt, Human
cauuuuuaguagagacagg

SEQ ID NO: 3222805 - RNA, 18 nt, Human
cauuuugcuaaaugugaa

SEQ ID NO: 3222806 - RNA, 21 nt, Human
cauuuugcuaaaugugaauga

SEQ ID NO: 3222807 - RNA, 24 nt, Human
cauuuugcuaaaugugaaugauga

SEQ ID NO: 3222808 - RNA, 18 nt, Human
cauuuugcuuuaauuuua

SEQ ID NO: 3222809 - RNA, 14 nt, Human
cauuuugcuuuaau

SEQ ID NO: 3222810 - RNA, 13 nt, Human
cauuuugcuuuaa

SEQ ID NO: 3222811 - RNA, 12 nt, Human
cauuuugcuuua

SEQ ID NO: 3222812 - RNA, 22 nt, Human
cauuuugggguacccacugcuc

SEQ ID NO: 3222813 - RNA, 21 nt, Human
cauuuugggguacccacugcu

SEQ ID NO: 3222814 - RNA, 20 nt, Human
cauuuugggguacccacugc

SEQ ID NO: 3222815 - RNA, 12 nt, Human
cauuuuggcgcu

SEQ ID NO: 3222816 - RNA, 23 nt, Human
cauuucuuccacaagagcccagg

SEQ ID NO: 3222817 - RNA, 14 nt, Human
cauuugagcagggc

SEQ ID NO: 3222818 - RNA, 24 nt, Human
cauuucugccuuuuguucauuuca

SEQ ID NO: 3222819 - RNA, 18 nt, Human
cauuucugccuuuuguuc

SEQ ID NO: 3222820 - RNA, 12 nt, Human
cauuucugauuu

SEQ ID NO: 3222821 - RNA, 23 nt, Human
cauuucugcaucagcugcugaaa

SEQ ID NO: 3222822 - RNA, 21 nt, Human
cauuucuuccacaagagccca

SEQ ID NO: 3222823 - RNA, 11 nt, Human
cauuucugauu

SEQ ID NO: 3222824 - RNA, 19 nt, Human
cauuucugauacuuucugu

SEQ ID NO: 3222825 - RNA, 22 nt, Human
cauuuccguaauucuuauucca

SEQ ID NO: 3222826 - RNA, 19 nt, Human
cauuuccguaauucuuauu

SEQ ID NO: 3222827 - RNA, 17 nt, Human
cauuuccccagggcacg

SEQ ID NO: 3222828 - RNA, 16 nt, Human
cauuuccccagggcac

SEQ ID NO: 3222829 - RNA, 15 nt, Human
cauuuccccagggca

SEQ ID NO: 3222830 - RNA, 14 nt, Human
cauuuccccagggc

SEQ ID NO: 3222831 - RNA, 16 nt, Human
cauuuccguaauucuu

SEQ ID NO: 3222832 - RNA, 19 nt, Human
cauuuagaauggugauuuu

SEQ ID NO: 3222833 - RNA, 12 nt, Human
cauuuagaaugg

SEQ ID NO: 3222834 - RNA, 10 nt, Human
cauuuagaau

SEQ ID NO: 3222835 - RNA, 12 nt, Human
cauuuagaaaag

SEQ ID NO: 3222836 - RNA, 15 nt, Human
cauuuagaaaaguga

SEQ ID NO: 3222837 - RNA, 13 nt, Human
cauuuagaagaaa

SEQ ID NO: 3222838 - RNA, 16 nt, Human
cauuuagaagaaagau

SEQ ID NO: 3222839 - RNA, 17 nt, Human
cauuuagaagaaagaug

SEQ ID NO: 3222840 - RNA, 20 nt, Human
cauuuagaagaaagauguuu

SEQ ID NO: 3222841 - RNA, 21 nt, Human
cauuuagaauggugauuuuaa

SEQ ID NO: 3222842 - RNA, 20 nt, Human
cauuuagaauggugauuuua

SEQ ID NO: 3222843 - RNA, 16 nt, Human
cauuuccauguaugca

SEQ ID NO: 3222844 - RNA, 15 nt, Human
cauuuccauguaugc

SEQ ID NO: 3222845 - RNA, 14 nt, Human
cauuuccauguaug

SEQ ID NO: 3222846 - RNA, 12 nt, Human
cauuuccaugua

SEQ ID NO: 3222847 - RNA, 17 nt, Human
cauuuccauguaugcau

SEQ ID NO: 3222848 - RNA, 18 nt, Human
cauuucccaacacaaaga

SEQ ID NO: 3222849 - RNA, 19 nt, Human
cauuuaaagcuuauuaaaa

SEQ ID NO: 3222850 - RNA, 21 nt, Human
cauuuacuuuguguucaccuu

SEQ ID NO: 3222851 - RNA, 17 nt, Human
cauuuacuuuguguuca

SEQ ID NO: 3222852 - RNA, 21 nt, Human
cauugcaugccgggugcagca

SEQ ID NO: 3222853 - RNA, 16 nt, Human
cauugcauauaacuua

SEQ ID NO: 3222854 - RNA, 18 nt, Human
cauugagaccgugaagau

SEQ ID NO: 3222855 - RNA, 16 nt, Human
cauugauuugauuuuu

SEQ ID NO: 3222856 - RNA, 13 nt, Human
cauugauuugauu

SEQ ID NO: 3222857 - RNA, 21 nt, Human
cauugcaacaaaauacauucu

SEQ ID NO: 3222858 - RNA, 15 nt, Human
cauugcaacaaaaua

SEQ ID NO: 3222859 - RNA, 14 nt, Human
cauugcaacaaaau

SEQ ID NO: 3222860 - RNA, 22 nt, Human
cauugauuugauuuuuauuauu

SEQ ID NO: 3222861 - RNA, 13 nt, Human
cauugaccugagg

SEQ ID NO: 3222862 - RNA, 22 nt, Human
cauugaccugaggcccuucucu

SEQ ID NO: 3222863 - RNA, 19 nt, Human
cauugaaaucuuuuugcuu

SEQ ID NO: 3222864 - RNA, 22 nt, Human
cauugaaaauuauuaaucagaa

SEQ ID NO: 3222865 - RNA, 20 nt, Human
ccaucauguuuacagaggac

SEQ ID NO: 3222866 - RNA, 22 nt, Human
ccaucauguuuacagaggacag

SEQ ID NO: 3222867 - RNA, 16 nt, Human
ccaucaugucuggcua

SEQ ID NO: 3222868 - RNA, 14 nt, Human
ccaucaugucuggc

SEQ ID NO: 3222869 - RNA, 15 nt, Human
ccauccugaggcucc

SEQ ID NO: 3222870 - RNA, 21 nt, Human
ccauccucuguacagagccca

SEQ ID NO: 3222871 - RNA, 16 nt, Human
ccaucuuuuauucuuu

SEQ ID NO: 3222872 - RNA, 20 nt, Human
ccaucuuuuuaaccucuguu

SEQ ID NO: 3222873 - RNA, 22 nt, Human
ccaucuuuuguuacucuuggga

SEQ ID NO: 3222874 - RNA, 16 nt, Human
ccaucgcugucaucuc

SEQ ID NO: 3222875 - RNA, 22 nt, Human
ccaucaacuaaaguuguacuuu

SEQ ID NO: 3222876 - RNA, 13 nt, Human
ccaucaccagaca

SEQ ID NO: 3222877 - RNA, 12 nt, Human
ccaucacccgcu

SEQ ID NO: 3222878 - RNA, 18 nt, Human
ccauauuuuacuuggaaa

SEQ ID NO: 3222879 - RNA, 19 nt, Human
ccauauuuuacuuggaaau

SEQ ID NO: 3222880 - RNA, 22 nt, Human
ccauauuuuuuuccuuacauaa

SEQ ID NO: 3222881 - RNA, 17 nt, Human
ccauauuuuuuuccuua

SEQ ID NO: 3222882 - RNA, 16 nt, Human
ccauauuuuuuuccuu

SEQ ID NO: 3222883 - RNA, 15 nt, Human
ccauauuuuuuuccu

SEQ ID NO: 3222884 - RNA, 18 nt, Human
ccauauucuguuggccag

SEQ ID NO: 3222885 - RNA, 19 nt, Human
ccauauuagaaaacuuugu

SEQ ID NO: 3222886 - RNA, 22 nt, Human
ccauauuagaaaacuuuguuag

SEQ ID NO: 3222887 - RNA, 20 nt, Human
ccauauuagaaaacuuuguu

SEQ ID NO: 3222888 - RNA, 15 nt, Human
ccauauucuguuggc

SEQ ID NO: 3222889 - RNA, 23 nt, Human
ccauagagagcaagacgcugugc

SEQ ID NO: 3222890 - RNA, 21 nt, Human
ccaguggggccugaggcuccu

SEQ ID NO: 3222891 - RNA, 16 nt, Human
ccauagaguacacugc

SEQ ID NO: 3222892 - RNA, 22 nt, Human
ccauagaguacacugccugccu

SEQ ID NO: 3222893 - RNA, 19 nt, Human
ccauagaguacacugccug

SEQ ID NO: 3222894 - RNA, 20 nt, Human
ccauagaguacacugccugc

SEQ ID NO: 3222895 - RNA, 23 nt, Human
ccagggacagaggggguggccuc

SEQ ID NO: 3222896 - RNA, 19 nt, Human
ccagggacagauccagcag

SEQ ID NO: 3222897 - RNA, 19 nt, Human
ccagugcuuagcaaaaaau

SEQ ID NO: 3222898 - RNA, 22 nt, Human
ccaguggauucuuguuuugcuu

SEQ ID NO: 3222899 - RNA, 13 nt, Human
ccaguggcagggc

SEQ ID NO: 3222900 - RNA, 12 nt, Human
ccaggccugccu

SEQ ID NO: 3222901 - RNA, 12 nt, Human
ccagggaagggg

SEQ ID NO: 3222902 - RNA, 19 nt, Human
ccagcugcaccccuuccug

SEQ ID NO: 3222903 - RNA, 17 nt, Human
ccagcugcaccccuucc

SEQ ID NO: 3222904 - RNA, 14 nt, Human
ccagcugcaccccu

SEQ ID NO: 3222905 - RNA, 13 nt, Human
ccagcugcacccc

SEQ ID NO: 3222906 - RNA, 20 nt, Human
ccagcucuuccuagcuggag

SEQ ID NO: 3222907 - RNA, 16 nt, Human
ccagcucuuccuagcu

SEQ ID NO: 3222908 - RNA, 13 nt, Human
ccagccucuuucc

SEQ ID NO: 3222909 - RNA, 15 nt, Human
ccagccucuuucccu

SEQ ID NO: 3222910 - RNA, 14 nt, Human
ccagccucuuuccc

SEQ ID NO: 3222911 - RNA, 16 nt, Human
ccagcugcuugggcuu

SEQ ID NO: 3222912 - RNA, 18 nt, Human
ccagcugcuugggcuuca

SEQ ID NO: 3222913 - RNA, 12 nt, Human
ccagcuggccgg

SEQ ID NO: 3222914 - RNA, 14 nt, Human
ccagcuggccggga

SEQ ID NO: 3222915 - RNA, 20 nt, Human
ccagcuggccgggagccuga

SEQ ID NO: 3222916 - RNA, 13 nt, Human
ccagcugcuuggg

SEQ ID NO: 3222917 - RNA, 15 nt, Human
ccagcugcuugggcu

SEQ ID NO: 3222918 - RNA, 23 nt, Human
ccagcugcaccccuuccugggca

SEQ ID NO: 3222919 - RNA, 22 nt, Human
ccagcugcaccccuuccugggc

SEQ ID NO: 3222920 - RNA, 21 nt, Human
ccagcugcaccccuuccuggg

SEQ ID NO: 3222921 - RNA, 20 nt, Human
ccagcugcaccccuuccugg

SEQ ID NO: 3222922 - RNA, 21 nt, Human
ccagcugugcucuggacaggc

SEQ ID NO: 3222923 - RNA, 20 nt, Human
ccagcugugcucuggacagg

SEQ ID NO: 3222924 - RNA, 18 nt, Human
ccagcugugcucuggaca

SEQ ID NO: 3222925 - RNA, 17 nt, Human
ccagcuggguuggaaaa

SEQ ID NO: 3222926 - RNA, 16 nt, Human
ccagcuggguuggaaa

SEQ ID NO: 3222927 - RNA, 14 nt, Human
ccacacacacaaaa

SEQ ID NO: 3222928 - RNA, 12 nt, Human
ccaggagcagcc

SEQ ID NO: 3222929 - RNA, 13 nt, Human
ccaggagcagcca

SEQ ID NO: 3222930 - RNA, 14 nt, Human
ccaggaagccagca

SEQ ID NO: 3222931 - RNA, 15 nt, Human
ccaggaagccagcag

SEQ ID NO: 3222932 - RNA, 17 nt, Human
ccaggaagccagcaggc

SEQ ID NO: 3222933 - RNA, 19 nt, Human
ccaggaagccagcaggcuc

SEQ ID NO: 3222934 - RNA, 23 nt, Human
ccagcugugcucuggacaggcau

SEQ ID NO: 3222935 - RNA, 22 nt, Human
ccagcugugcucuggacaggca

SEQ ID NO: 3222936 - RNA, 23 nt, Human
ccaggacccugccaggcacaggc

SEQ ID NO: 3222937 - RNA, 22 nt, Human
ccaggacccugccaggcacagg

SEQ ID NO: 3222938 - RNA, 13 nt, Human
ccaggacccugcc

SEQ ID NO: 3222939 - RNA, 21 nt, Human
ccaggacccugccaggcacag

SEQ ID NO: 3222940 - RNA, 20 nt, Human
ccaggacccugccaggcaca

SEQ ID NO: 3222941 - RNA, 19 nt, Human
ccaggacccugccaggcac

SEQ ID NO: 3222942 - RNA, 18 nt, Human
ccaggacccugccaggca

SEQ ID NO: 3222943 - RNA, 17 nt, Human
ccaggacccugccaggc

SEQ ID NO: 3222944 - RNA, 16 nt, Human
ccaggacccugccagg

SEQ ID NO: 3222945 - RNA, 15 nt, Human
ccaggacccugccag

SEQ ID NO: 3222946 - RNA, 14 nt, Human
ccaggacccugcca

SEQ ID NO: 3222947 - RNA, 16 nt, Human
ccaggcccucugccca

SEQ ID NO: 3222948 - RNA, 17 nt, Human
ccaggcccucugcccac

SEQ ID NO: 3222949 - RNA, 18 nt, Human
ccaggcccucugcccacu

SEQ ID NO: 3222950 - RNA, 19 nt, Human
ccaggcccucugcccacuc

SEQ ID NO: 3222951 - RNA, 13 nt, Human
ccaggccuccuac

SEQ ID NO: 3222952 - RNA, 17 nt, Human
ccaggccuacuccuguc

SEQ ID NO: 3222953 - RNA, 23 nt, Human
ccaggccuacuccugucuucugc

SEQ ID NO: 3222954 - RNA, 21 nt, Human
ccaggccuacuccugucuucu

SEQ ID NO: 3222955 - RNA, 18 nt, Human
ccaggccuacuccugucu

SEQ ID NO: 3222956 - RNA, 18 nt, Human
ccaggccuccuacagcuu

SEQ ID NO: 3222957 - RNA, 19 nt, Human
ccaggccuccuacagcuug

SEQ ID NO: 3222958 - RNA, 12 nt, Human
ccaggccagagg

SEQ ID NO: 3222959 - RNA, 14 nt, Human
ccaggagcagccac

SEQ ID NO: 3222960 - RNA, 21 nt, Human
ccaggccagagggagugacag

SEQ ID NO: 3222961 - RNA, 14 nt, Human
ccaggccagaggga

SEQ ID NO: 3222962 - RNA, 23 nt, Human
ccaggccccugccacccugggga

SEQ ID NO: 3222963 - RNA, 21 nt, Human
ccaggccccugccacccuggg

SEQ ID NO: 3222964 - RNA, 19 nt, Human
ccaggccccugccacccug

SEQ ID NO: 3222965 - RNA, 16 nt, Human
cccaggaccccugagu

SEQ ID NO: 3222966 - RNA, 14 nt, Human
cccaggaggccagc

SEQ ID NO: 3222967 - RNA, 13 nt, Human
cccaggagcccau

SEQ ID NO: 3222968 - RNA, 12 nt, Human
cccaggagccca

SEQ ID NO: 3222969 - RNA, 14 nt, Human
cccaggagccccga

SEQ ID NO: 3222970 - RNA, 13 nt, Human
cccaggagccccg

SEQ ID NO: 3222971 - RNA, 21 nt, Human
cccagcuaugguucucucgca

SEQ ID NO: 3222972 - RNA, 23 nt, Human
cccagccugggauaggggcagag

SEQ ID NO: 3222973 - RNA, 14 nt, Human
cccagcgagcccug

SEQ ID NO: 3222974 - RNA, 13 nt, Human
cccagcucugguc

SEQ ID NO: 3222975 - RNA, 14 nt, Human
cccagcucuggucc

SEQ ID NO: 3222976 - RNA, 12 nt, Human
cccagcucuggu

SEQ ID NO: 3222977 - RNA, 15 nt, Human
cccagcucuggucca

SEQ ID NO: 3222978 - RNA, 16 nt, Human
cccagcucugguccau

SEQ ID NO: 3222979 - RNA, 18 nt, Human
cccagcucugguccauag

SEQ ID NO: 3222980 - RNA, 23 nt, Human
cccagauugcaacaggcugggcu

SEQ ID NO: 3222981 - RNA, 17 nt, Human
cccagccccaaugaaca

SEQ ID NO: 3222982 - RNA, 11 nt, Human
cccagccccau

SEQ ID NO: 3222983 - RNA, 12 nt, Human
cccagccccauc

SEQ ID NO: 3222984 - RNA, 13 nt, Human
cccagccccaaug

SEQ ID NO: 3222985 - RNA, 20 nt, Human
cccagaggccgagagcuaug

SEQ ID NO: 3222986 - RNA, 18 nt, Human
cccagccccauccucugu

SEQ ID NO: 3222987 - RNA, 19 nt, Human
cccagccccauccucugua

SEQ ID NO: 3222988 - RNA, 18 nt, Human
cccagccccuucugaccc

SEQ ID NO: 3222989 - RNA, 13 nt, Human
cccagccccaucc

SEQ ID NO: 3222990 - RNA, 14 nt, Human
cccagccccauccc

SEQ ID NO: 3222991 - RNA, 14 nt, Human
cccagccccauccu

SEQ ID NO: 3222992 - RNA, 15 nt, Human
cccagccccauccuc

SEQ ID NO: 3222993 - RNA, 20 nt, Human
cccagccuccaagcuccauc

SEQ ID NO: 3222994 - RNA, 18 nt, Human
cccagccuccaagcucca

SEQ ID NO: 3222995 - RNA, 23 nt, Human
cccagcccuccuuaucaaaggac

SEQ ID NO: 3222996 - RNA, 23 nt, Human
cccagccucaaauccaggacccu

SEQ ID NO: 3222997 - RNA, 18 nt, Human
cccagaaugccuccugca

SEQ ID NO: 3222998 - RNA, 13 nt, Human
cccagaccccgac

SEQ ID NO: 3222999 - RNA, 13 nt, Human
cccacgcccccac

SEQ ID NO: 3223000 - RNA, 14 nt, Human
cccacgcccccacu

SEQ ID NO: 3223001 - RNA, 13 nt, Human
cccaccuggcccu

SEQ ID NO: 3223002 - RNA, 12 nt, Human
cccaccuggccc

SEQ ID NO: 3223003 - RNA, 18 nt, Human
cccaccuggcccucucug

SEQ ID NO: 3223004 - RNA, 20 nt, Human
cccagacgccugauauugaa

SEQ ID NO: 3223005 - RNA, 17 nt, Human
cccagacccuggaggaa

SEQ ID NO: 3223006 - RNA, 22 nt, Human
cccagagagaagagccccacuc

SEQ ID NO: 3223007 - RNA, 18 nt, Human
cccagagagaagagcccc

SEQ ID NO: 3223008 - RNA, 21 nt, Human
cccagagagaagagccccacu

SEQ ID NO: 3223009 - RNA, 19 nt, Human
cccagagagaagagcccca

SEQ ID NO: 3223010 - RNA, 12 nt, Human
ccauguggacuu

SEQ ID NO: 3223011 - RNA, 11 nt, Human
ccauuccaaaa

SEQ ID NO: 3223012 - RNA, 13 nt, Human
ccauuccaaaaua

SEQ ID NO: 3223013 - RNA, 15 nt, Human
ccauuccaaaauauu

SEQ ID NO: 3223014 - RNA, 21 nt, Human
ccauuccaaaauauuaugccc

SEQ ID NO: 3223015 - RNA, 15 nt, Human
ccauguuggccaggc

SEQ ID NO: 3223016 - RNA, 18 nt, Human
ccauguuggccaggcugg

SEQ ID NO: 3223017 - RNA, 21 nt, Human
ccauguuggccaggcuggucu

SEQ ID NO: 3223018 - RNA, 19 nt, Human
ccauguuggccaggcuggu

SEQ ID NO: 3223019 - RNA, 19 nt, Human
cccaccuuggcugcaggga

SEQ ID NO: 3223020 - RNA, 17 nt, Human
cccaccuuggcugcagg

SEQ ID NO: 3223021 - RNA, 16 nt, Human
cccaccuuggcugcag

SEQ ID NO: 3223022 - RNA, 12 nt, Human
cccaccuggccu

SEQ ID NO: 3223023 - RNA, 15 nt, Human
cccaccuggccucug

SEQ ID NO: 3223024 - RNA, 12 nt, Human
cccaccugcgcu

SEQ ID NO: 3223025 - RNA, 23 nt, Human
ccauggcacucuauguucuaaga

SEQ ID NO: 3223026 - RNA, 22 nt, Human
ccauggagugggucuggaggac

SEQ ID NO: 3223027 - RNA, 13 nt, Human
ccaugugccaggu

SEQ ID NO: 3223028 - RNA, 16 nt, Human
ccaugugagcugcugc

SEQ ID NO: 3223029 - RNA, 19 nt, Human
ccaugugagcugcugccau

SEQ ID NO: 3223030 - RNA, 14 nt, Human
ccauguuggccagg

SEQ ID NO: 3223031 - RNA, 13 nt, Human
ccauguuggccag

SEQ ID NO: 3223032 - RNA, 22 nt, Human
ccaugugagcugcugccaugaa

SEQ ID NO: 3223033 - RNA, 21 nt, Human
ccaugugagcugcugccauga

SEQ ID NO: 3223034 - RNA, 20 nt, Human
ccaugugagcugcugccaug

SEQ ID NO: 3223035 - RNA, 13 nt, Human
ccaugcuccuggc

SEQ ID NO: 3223036 - RNA, 14 nt, Human
ccaugaaagaaaac

SEQ ID NO: 3223037 - RNA, 23 nt, Human
ccaucuuuuuaaccucuguucag

SEQ ID NO: 3223038 - RNA, 16 nt, Human
ccaugcugcccuguga

SEQ ID NO: 3223039 - RNA, 17 nt, Human
ccaugcugcccugugag

SEQ ID NO: 3223040 - RNA, 14 nt, Human
ccaugcugccucca

SEQ ID NO: 3223041 - RNA, 16 nt, Human
ccauggaaaaaugcca

SEQ ID NO: 3223042 - RNA, 15 nt, Human
ccaugcuccuggccc

SEQ ID NO: 3223043 - RNA, 18 nt, Human
ccaugcuccuggcccacu

SEQ ID NO: 3223044 - RNA, 15 nt, Human
ccaugcugcccugug

SEQ ID NO: 3223045 - RNA, 14 nt, Human
cccaguuagcucuc

SEQ ID NO: 3223046 - RNA, 20 nt, Human
cccagugguuccuaauccuc

SEQ ID NO: 3223047 - RNA, 19 nt, Human
cccagucuggaaugcagug

SEQ ID NO: 3223048 - RNA, 18 nt, Human
cccagucuggaaugcagu

SEQ ID NO: 3223049 - RNA, 10 nt, Human
cccagucugg

SEQ ID NO: 3223050 - RNA, 21 nt, Human
cccagugcccacaggaucagu

SEQ ID NO: 3223051 - RNA, 15 nt, Human
cccagugccgagaag

SEQ ID NO: 3223052 - RNA, 13 nt, Human
cccagguuucuau

SEQ ID NO: 3223053 - RNA, 15 nt, Human
cccaggaggccagcc

SEQ ID NO: 3223054 - RNA, 16 nt, Human
cccaggaggccagccu

SEQ ID NO: 3223055 - RNA, 15 nt, Human
cccaggcauucccca

SEQ ID NO: 3223056 - RNA, 23 nt, Human
cccaggcaggucuugaacuccug

SEQ ID NO: 3223057 - RNA, 17 nt, Human
cccaggcauuccccagg

SEQ ID NO: 3223058 - RNA, 22 nt, Human
cccaggagcccauuuggagggc

SEQ ID NO: 3223059 - RNA, 16 nt, Human
cccaggagcccauuug

SEQ ID NO: 3223060 - RNA, 19 nt, Human
cccagggugggaagggcua

SEQ ID NO: 3223061 - RNA, 13 nt, Human
ccccaacccuucu

SEQ ID NO: 3223062 - RNA, 21 nt, Human
ccccaacccuucuucauguuc

SEQ ID NO: 3223063 - RNA, 22 nt, Human
cccaugugagcugcugccauga

SEQ ID NO: 3223064 - RNA, 19 nt, Human
cccauguggagucagccuc

SEQ ID NO: 3223065 - RNA, 16 nt, Human
cccaugucucgacuca

SEQ ID NO: 3223066 - RNA, 17 nt, Human
cccaugucucgacucau

SEQ ID NO: 3223067 - RNA, 14 nt, Human
cccaugugagcugc

SEQ ID NO: 3223068 - RNA, 18 nt, Human
cccaugugagcugcugcc

SEQ ID NO: 3223069 - RNA, 16 nt, Human
cccaugugagcugcug

SEQ ID NO: 3223070 - RNA, 20 nt, Human
cccauguauggccaggaagu

SEQ ID NO: 3223071 - RNA, 19 nt, Human
cccauguauggccaggaag

SEQ ID NO: 3223072 - RNA, 16 nt, Human
cccaugagccucagca

SEQ ID NO: 3223073 - RNA, 15 nt, Human
cccaugagccucagc

SEQ ID NO: 3223074 - RNA, 20 nt, Human
cccaugagccucagcauccu

SEQ ID NO: 3223075 - RNA, 12 nt, Human
cccaugcugccc

SEQ ID NO: 3223076 - RNA, 13 nt, Human
cccaugcugcccu

SEQ ID NO: 3223077 - RNA, 14 nt, Human
cccaugcugcccug

SEQ ID NO: 3223078 - RNA, 12 nt, Human
cccaucugugaa

SEQ ID NO: 3223079 - RNA, 18 nt, Human
cccaucucacacaugagc

SEQ ID NO: 3223080 - RNA, 13 nt, Human
cccaucucacaca

SEQ ID NO: 3223081 - RNA, 20 nt, Human
cccaucugugaaaggaaaga

SEQ ID NO: 3223082 - RNA, 16 nt, Human
cccaucugugaauaag

SEQ ID NO: 3223083 - RNA, 13 nt, Human
cccaucugugaau

SEQ ID NO: 3223084 - RNA, 19 nt, Human
cccucauuggcucuugaac

SEQ ID NO: 3223085 - RNA, 21 nt, Human
cccuccaagaccuucuccuuc

SEQ ID NO: 3223086 - RNA, 23 nt, Human
cccucauuaaaauauugaaaucu

SEQ ID NO: 3223087 - RNA, 22 nt, Human
cccucauuccaccuucccaugc

SEQ ID NO: 3223088 - RNA, 22 nt, Human
cccucauccucauacccacccc

SEQ ID NO: 3223089 - RNA, 17 nt, Human
cccucauccucauaccc

SEQ ID NO: 3223090 - RNA, 20 nt, Human
cccucauccucauacccacc

SEQ ID NO: 3223091 - RNA, 22 nt, Human
cccucaucaccaacgucugugc

SEQ ID NO: 3223092 - RNA, 19 nt, Human
cccucauagcccucacccu

SEQ ID NO: 3223093 - RNA, 20 nt, Human
cccucagucuggcccuuccu

SEQ ID NO: 3223094 - RNA, 21 nt, Human
cccucagggucccugguggca

SEQ ID NO: 3223095 - RNA, 13 nt, Human
cccucauagcccu

SEQ ID NO: 3223096 - RNA, 15 nt, Human
cccucauagcccuca

SEQ ID NO: 3223097 - RNA, 23 nt, Human
cccucccucuacugggagccuac

SEQ ID NO: 3223098 - RNA, 13 nt, Human
cccucccucuuuc

SEQ ID NO: 3223099 - RNA, 14 nt, Human
cccucccuucaacc

SEQ ID NO: 3223100 - RNA, 14 nt, Human
cccucccucuccag

SEQ ID NO: 3223101 - RNA, 17 nt, Human
cccuccaugugggcuag

SEQ ID NO: 3223102 - RNA, 12 nt, Human
cccuccaggagu

SEQ ID NO: 3223103 - RNA, 10 nt, Human
cccuccaagg

SEQ ID NO: 3223104 - RNA, 16 nt, Human
cccuccaaggccaggc

SEQ ID NO: 3223105 - RNA, 19 nt, Human
cccuccaucuaaacugccc

SEQ ID NO: 3223106 - RNA, 16 nt, Human
cccucagggucccugg

SEQ ID NO: 3223107 - RNA, 17 nt, Human
cccucagggucccuggu

SEQ ID NO: 3223108 - RNA, 18 nt, Human
cccucagggucccuggug

SEQ ID NO: 3223109 - RNA, 19 nt, Human
cccucagggucccuggugg

SEQ ID NO: 3223110 - RNA, 15 nt, Human
cccucagggucccug

SEQ ID NO: 3223111 - RNA, 13 nt, Human
cccuaaagccuca

SEQ ID NO: 3223112 - RNA, 13 nt, Human
cccgugaccuggu

SEQ ID NO: 3223113 - RNA, 16 nt, Human
cccgugaccuggucag

SEQ ID NO: 3223114 - RNA, 15 nt, Human
cccgugaccugguca

SEQ ID NO: 3223115 - RNA, 16 nt, Human
cccggcaggguccuag

SEQ ID NO: 3223116 - RNA, 18 nt, Human
cccggaggggccuggcag

SEQ ID NO: 3223117 - RNA, 17 nt, Human
cccggaggggccuggca

SEQ ID NO: 3223118 - RNA, 23 nt, Human
ccccuggugguucacucuuggag

SEQ ID NO: 3223119 - RNA, 15 nt, Human
ccccuguaggccuca

SEQ ID NO: 3223120 - RNA, 22 nt, Human
ccccuguccccgcacugggcuu

SEQ ID NO: 3223121 - RNA, 22 nt, Human
ccccuggcuuuucacugcuggc

SEQ ID NO: 3223122 - RNA, 23 nt, Human
ccccuggcuuuucacugcuggcu

SEQ ID NO: 3223123 - RNA, 20 nt, Human
ccccuguucuggcagaguug

SEQ ID NO: 3223124 - RNA, 14 nt, Human
ccccuuaccacugc

SEQ ID NO: 3223125 - RNA, 18 nt, Human
ccccuucccgugaccugg

SEQ ID NO: 3223126 - RNA, 12 nt, Human
ccccuucccccu

SEQ ID NO: 3223127 - RNA, 20 nt, Human
ccccuuccuaauuccacagc

SEQ ID NO: 3223128 - RNA, 21 nt, Human
ccccuuccuaauuccacagcu

SEQ ID NO: 3223129 - RNA, 22 nt, Human
ccccuuccuaauuccacagcug

SEQ ID NO: 3223130 - RNA, 14 nt, Human
ccccuuccuaccac

SEQ ID NO: 3223131 - RNA, 15 nt, Human
cccgaggccuucucu

SEQ ID NO: 3223132 - RNA, 20 nt, Human
cccgaggccuucucugaagg

SEQ ID NO: 3223133 - RNA, 16 nt, Human
cccgcaagcaccaucc

SEQ ID NO: 3223134 - RNA, 15 nt, Human
cccgaucgccagcaa

SEQ ID NO: 3223135 - RNA, 19 nt, Human
cccgauccuccccuggacu

SEQ ID NO: 3223136 - RNA, 19 nt, Human
cccgcucagcccucccugc

SEQ ID NO: 3223137 - RNA, 15 nt, Human
cccgcucagcccucc

SEQ ID NO: 3223138 - RNA, 23 nt, Human
cccgcucagcccucccugccccu

SEQ ID NO: 3223139 - RNA, 23 nt, Human
ccccacaggagguggucugggac

SEQ ID NO: 3223140 - RNA, 16 nt, Human
ccccagccccauccca

SEQ ID NO: 3223141 - RNA, 15 nt, Human
ccccagccccauccu

SEQ ID NO: 3223142 - RNA, 13 nt, Human
ccccagccugcua

SEQ ID NO: 3223143 - RNA, 14 nt, Human
ccccaggugccagu

SEQ ID NO: 3223144 - RNA, 12 nt, Human
ccccuggcagcc

SEQ ID NO: 3223145 - RNA, 14 nt, Human
ccccuggcagcccc

SEQ ID NO: 3223146 - RNA, 15 nt, Human
ccccuggcagccccu

SEQ ID NO: 3223147 - RNA, 12 nt, Human
ccccaggaggcc

SEQ ID NO: 3223148 - RNA, 12 nt, Human
ccccagggcacg

SEQ ID NO: 3223149 - RNA, 21 nt, Human
cccugguggcagugggagcug

SEQ ID NO: 3223150 - RNA, 22 nt, Human
cccugguggcagugggagcugc

SEQ ID NO: 3223151 - RNA, 16 nt, Human
cccuggugcugccaca

SEQ ID NO: 3223152 - RNA, 21 nt, Human
cccuggguuagacugccagcu

SEQ ID NO: 3223153 - RNA, 20 nt, Human
cccuggguuagacugccagc

SEQ ID NO: 3223154 - RNA, 21 nt, Human
cccuggugcugccacacuuca

SEQ ID NO: 3223155 - RNA, 17 nt, Human
cccuggugcugccacac

SEQ ID NO: 3223156 - RNA, 16 nt, Human
cccuggguuagacugc

SEQ ID NO: 3223157 - RNA, 19 nt, Human
cccuggguuagacugccag

SEQ ID NO: 3223158 - RNA, 18 nt, Human
cccuggguuagacugcca

SEQ ID NO: 3223159 - RNA, 21 nt, Human
cccuggggugcaggcgccuca

SEQ ID NO: 3223160 - RNA, 16 nt, Human
cccuggaagcagugcc

SEQ ID NO: 3223161 - RNA, 15 nt, Human
cccuggaagcagugc

SEQ ID NO: 3223162 - RNA, 18 nt, Human
cccuggaagcagugccca

SEQ ID NO: 3223163 - RNA, 17 nt, Human
cccuggaagcagugccc

SEQ ID NO: 3223164 - RNA, 21 nt, Human
cccuggaagcagugcccaggu

SEQ ID NO: 3223165 - RNA, 20 nt, Human
cccugcugguucaggguugg

SEQ ID NO: 3223166 - RNA, 19 nt, Human
cccugcugguucaggguug

SEQ ID NO: 3223167 - RNA, 22 nt, Human
cccugcuggguguggcgcagca

SEQ ID NO: 3223168 - RNA, 22 nt, Human
cccugcuuugggcugcccuggu

SEQ ID NO: 3223169 - RNA, 23 nt, Human
cccugcuuugggcugcccuggug

SEQ ID NO: 3223170 - RNA, 23 nt, Human
cccugccugcccugucaggaggc

SEQ ID NO: 3223171 - RNA, 13 nt, Human
cccugccugcccu

SEQ ID NO: 3223172 - RNA, 13 nt, Human
cccugcugguuca

SEQ ID NO: 3223173 - RNA, 16 nt, Human
cccugccuccuuugug

SEQ ID NO: 3223174 - RNA, 23 nt, Human
cccugccuccuuugugaggaagc

SEQ ID NO: 3223175 - RNA, 20 nt, Human
cccugccaucauguuuacag

SEQ ID NO: 3223176 - RNA, 23 nt, Human
cccugccaggcacaggcagggca

SEQ ID NO: 3223177 - RNA, 22 nt, Human
cccugccaggcacaggcagggc

SEQ ID NO: 3223178 - RNA, 21 nt, Human
cccugccaggcacaggcaggg

SEQ ID NO: 3223179 - RNA, 20 nt, Human
cccugccaggcacaggcagg

SEQ ID NO: 3223180 - RNA, 19 nt, Human
cccugccaggcacaggcag

SEQ ID NO: 3223181 - RNA, 18 nt, Human
cccugccaggcacaggca

SEQ ID NO: 3223182 - RNA, 14 nt, Human
cccugccuccuuug

SEQ ID NO: 3223183 - RNA, 17 nt, Human
cccugcccacaccuccu

SEQ ID NO: 3223184 - RNA, 18 nt, Human
cccugcccacaccuccug

SEQ ID NO: 3223185 - RNA, 19 nt, Human
cccugcccacaccuccugg

SEQ ID NO: 3223186 - RNA, 20 nt, Human
cccugcccacaccuccuggg

SEQ ID NO: 3223187 - RNA, 18 nt, Human
cccugccacccuggggag

SEQ ID NO: 3223188 - RNA, 17 nt, Human
cccugccacccugggga

SEQ ID NO: 3223189 - RNA, 17 nt, Human
cccugccaggcacaggc

SEQ ID NO: 3223190 - RNA, 15 nt, Human
cccugccaggcacag

SEQ ID NO: 3223191 - RNA, 14 nt, Human
cccugccaggcaca

SEQ ID NO: 3223192 - RNA, 13 nt, Human
cccugccaggcac

SEQ ID NO: 3223193 - RNA, 15 nt, Human
cccugccacccuggg

SEQ ID NO: 3223194 - RNA, 14 nt, Human
cccugccacccugg

SEQ ID NO: 3223195 - RNA, 12 nt, Human
cccugccacccu

SEQ ID NO: 3223196 - RNA, 20 nt, Human
cccucuacugggagccuacc

SEQ ID NO: 3223197 - RNA, 17 nt, Human
cccucuacugggagccu

SEQ ID NO: 3223198 - RNA, 23 nt, Human
cccugaucccuuccaccugcucu

SEQ ID NO: 3223199 - RNA, 16 nt, Human
cccugaucccuuccac

SEQ ID NO: 3223200 - RNA, 15 nt, Human
cccugaucccuucca

SEQ ID NO: 3223201 - RNA, 22 nt, Human
cccugcaaccugauugugucuc

SEQ ID NO: 3223202 - RNA, 16 nt, Human
cccugcaaccugauug

SEQ ID NO: 3223203 - RNA, 18 nt, Human
cccugcagagggcacaga

SEQ ID NO: 3223204 - RNA, 12 nt, Human
cccugcagaggg

SEQ ID NO: 3223205 - RNA, 22 nt, Human
cccugcacuugcagacucuaca

SEQ ID NO: 3223206 - RNA, 14 nt, Human
cccugguggcagcu

SEQ ID NO: 3223207 - RNA, 14 nt, Human
ccucuacugggagc

SEQ ID NO: 3223208 - RNA, 19 nt, Human
ccucuccacugccuucgau

SEQ ID NO: 3223209 - RNA, 22 nt, Human
ccucuccagcaggcccauggga

SEQ ID NO: 3223210 - RNA, 15 nt, Human
ccucuccccagcaag

SEQ ID NO: 3223211 - RNA, 20 nt, Human
ccucuccccagcaagugaga

SEQ ID NO: 3223212 - RNA, 13 nt, Human
ccucucccuugga

SEQ ID NO: 3223213 - RNA, 22 nt, Human
ccucucccuuggauuguccccg

SEQ ID NO: 3223214 - RNA, 15 nt, Human
ccuccuccuuccuag

SEQ ID NO: 3223215 - RNA, 21 nt, Human
ccuccucggcuggcuguccac

SEQ ID NO: 3223216 - RNA, 17 nt, Human
ccuccucggcuggcugu

SEQ ID NO: 3223217 - RNA, 14 nt, Human
ccuccuccuuccua

SEQ ID NO: 3223218 - RNA, 13 nt, Human
ccuccuccuuccu

SEQ ID NO: 3223219 - RNA, 21 nt, Human
ccuccuccagccgccaugcuc

SEQ ID NO: 3223220 - RNA, 13 nt, Human
ccuccucucugcc

SEQ ID NO: 3223221 - RNA, 15 nt, Human
ccuccucucugcccu

SEQ ID NO: 3223222 - RNA, 16 nt, Human
ccuccucucugcccua

SEQ ID NO: 3223223 - RNA, 18 nt, Human
ccucgguguggagaagcg

SEQ ID NO: 3223224 - RNA, 14 nt, Human
ccucgucuuuccca

SEQ ID NO: 3223225 - RNA, 20 nt, Human
ccucuccgccccugagccca

SEQ ID NO: 3223226 - RNA, 19 nt, Human
ccucuccgccccugagccc

SEQ ID NO: 3223227 - RNA, 18 nt, Human
ccucuccgccccugagcc

SEQ ID NO: 3223228 - RNA, 15 nt, Human
ccucuccgccccuga

SEQ ID NO: 3223229 - RNA, 13 nt, Human
ccucugacacaca

SEQ ID NO: 3223230 - RNA, 22 nt, Human
ccucuccgccccugagcccacu

SEQ ID NO: 3223231 - RNA, 20 nt, Human
ccucugacacacagcucugu

SEQ ID NO: 3223232 - RNA, 19 nt, Human
ccucugacacacagcucug

SEQ ID NO: 3223233 - RNA, 14 nt, Human
ccucugacacacag

SEQ ID NO: 3223234 - RNA, 18 nt, Human
ccucugacacacagcucu

SEQ ID NO: 3223235 - RNA, 21 nt, Human
ccucugacacacagcucuguc

SEQ ID NO: 3223236 - RNA, 13 nt, Human
ccucugagaggcg

SEQ ID NO: 3223237 - RNA, 13 nt, Human
ccucugcccacuc

SEQ ID NO: 3223238 - RNA, 16 nt, Human
ccucugcccacucccu

SEQ ID NO: 3223239 - RNA, 21 nt, Human
ccucugauguauuuugugagu

SEQ ID NO: 3223240 - RNA, 23 nt, Human
ccucugcacuccccugcugggug

SEQ ID NO: 3223241 - RNA, 18 nt, Human
ccucugcacuccccugcu

SEQ ID NO: 3223242 - RNA, 16 nt, Human
ccucugcacuccccug

SEQ ID NO: 3223243 - RNA, 17 nt, Human
ccucugcacuccccugc

SEQ ID NO: 3223244 - RNA, 15 nt, Human
ccucugcacuccccu

SEQ ID NO: 3223245 - RNA, 17 nt, Human
ccucugauguauuuugu

SEQ ID NO: 3223246 - RNA, 13 nt, Human
ccucugaggcuga

SEQ ID NO: 3223247 - RNA, 11 nt, Human
ccucugagccu

SEQ ID NO: 3223248 - RNA, 12 nt, Human
ccucugagccuu

SEQ ID NO: 3223249 - RNA, 13 nt, Human
ccuccacucuccu

SEQ ID NO: 3223250 - RNA, 12 nt, Human
ccuccagaacuc

SEQ ID NO: 3223251 - RNA, 20 nt, Human
ccuccagaacucuuccucca

SEQ ID NO: 3223252 - RNA, 18 nt, Human
ccuccagaacucuuccuc

SEQ ID NO: 3223253 - RNA, 17 nt, Human
ccuccagaacucuuccu

SEQ ID NO: 3223254 - RNA, 17 nt, Human
ccucaggugagaagcag

SEQ ID NO: 3223255 - RNA, 18 nt, Human
ccucaggugagaagcaga

SEQ ID NO: 3223256 - RNA, 20 nt, Human
ccucaggugagaagcagagg

SEQ ID NO: 3223257 - RNA, 15 nt, Human
ccucagggucccugg

SEQ ID NO: 3223258 - RNA, 21 nt, Human
ccuccauccuccuccuuccua

SEQ ID NO: 3223259 - RNA, 20 nt, Human
ccuccauccuccuccuuccu

SEQ ID NO: 3223260 - RNA, 19 nt, Human
ccuccauccuccuccuucc

SEQ ID NO: 3223261 - RNA, 18 nt, Human
ccuccauccuccuccuuc

SEQ ID NO: 3223262 - RNA, 17 nt, Human
ccuccaggugcacaagc

SEQ ID NO: 3223263 - RNA, 11 nt, Human
ccuccaggugc

SEQ ID NO: 3223264 - RNA, 12 nt, Human
ccuccaggugca

SEQ ID NO: 3223265 - RNA, 12 nt, Human
ccuccauccuga

SEQ ID NO: 3223266 - RNA, 13 nt, Human
ccuccauccugag

SEQ ID NO: 3223267 - RNA, 16 nt, Human
ccuccaugcugccucc

SEQ ID NO: 3223268 - RNA, 19 nt, Human
ccuccaugcugccuccaga

SEQ ID NO: 3223269 - RNA, 14 nt, Human
ccucccaacucacc

SEQ ID NO: 3223270 - RNA, 17 nt, Human
ccucccaaagugcuggg

SEQ ID NO: 3223271 - RNA, 15 nt, Human
ccuccaugugggcua

SEQ ID NO: 3223272 - RNA, 12 nt, Human
ccuccauguggg

SEQ ID NO: 3223273 - RNA, 15 nt, Human
ccuccccuccuccug

SEQ ID NO: 3223274 - RNA, 18 nt, Human
ccucccgaauagcuggga

SEQ ID NO: 3223275 - RNA, 15 nt, Human
ccucccaacucaccc

SEQ ID NO: 3223276 - RNA, 16 nt, Human
ccucccaaagugcugg

SEQ ID NO: 3223277 - RNA, 20 nt, Human
ccucccgaauagcugggacu

SEQ ID NO: 3223278 - RNA, 19 nt, Human
ccucccgaauagcugggac

SEQ ID NO: 3223279 - RNA, 21 nt, Human
ccucccgaauagcugggacua

SEQ ID NO: 3223280 - RNA, 18 nt, Human
ccucccgaguagcuggga

SEQ ID NO: 3223281 - RNA, 17 nt, Human
ccucccgaguagcuggg

SEQ ID NO: 3223282 - RNA, 18 nt, Human
ccucccucuccagcaggc

SEQ ID NO: 3223283 - RNA, 13 nt, Human
ccucccucuccag

SEQ ID NO: 3223284 - RNA, 12 nt, Human
ccuccuccagcc

SEQ ID NO: 3223285 - RNA, 11 nt, Human
ccuccucagau

SEQ ID NO: 3223286 - RNA, 13 nt, Human
ccucccucuuucc

SEQ ID NO: 3223287 - RNA, 16 nt, Human
ccucagaucuucugug

SEQ ID NO: 3223288 - RNA, 16 nt, Human
ccucagggucccuggu

SEQ ID NO: 3223289 - RNA, 17 nt, Human
ccucagggucccuggug

SEQ ID NO: 3223290 - RNA, 20 nt, Human
ccucagggucccugguggca

SEQ ID NO: 3223291 - RNA, 23 nt, Human
ccucaggccugggggcugggcag

SEQ ID NO: 3223292 - RNA, 16 nt, Human
ccucagagccaccccu

SEQ ID NO: 3223293 - RNA, 14 nt, Human
ccucacccuggggc

SEQ ID NO: 3223294 - RNA, 23 nt, Human
ccucacccggugaccucuagccc

SEQ ID NO: 3223295 - RNA, 22 nt, Human
ccucacuaucccggcugcccuu

SEQ ID NO: 3223296 - RNA, 18 nt, Human
ccucacucagcaccacuc

SEQ ID NO: 3223297 - RNA, 17 nt, Human
ccucacucagcaccacu

SEQ ID NO: 3223298 - RNA, 20 nt, Human
ccucacucugcuaccuugcc

SEQ ID NO: 3223299 - RNA, 22 nt, Human
ccucacucugcuaccuugcccc

SEQ ID NO: 3223300 - RNA, 23 nt, Human
ccucacucugcuaccuugcccca

SEQ ID NO: 3223301 - RNA, 14 nt, Human
ccucacucucagga

SEQ ID NO: 3223302 - RNA, 13 nt, Human
ccucacucucagg

SEQ ID NO: 3223303 - RNA, 14 nt, Human
ccucacacucaccc

SEQ ID NO: 3223304 - RNA, 13 nt, Human
ccuauuguaauau

SEQ ID NO: 3223305 - RNA, 24 nt, Human
ccucacaguccuuaccagcagagc

SEQ ID NO: 3223306 - RNA, 23 nt, Human
ccucacaguccuuaccagcagag

SEQ ID NO: 3223307 - RNA, 15 nt, Human
ccucacacuccuuua

SEQ ID NO: 3223308 - RNA, 22 nt, Human
ccuaucuguuuacaguguuccg

SEQ ID NO: 3223309 - RNA, 16 nt, Human
ccuauuagagaagaga

SEQ ID NO: 3223310 - RNA, 17 nt, Human
ccuauuagagaagagau

SEQ ID NO: 3223311 - RNA, 16 nt, Human
ccuauuaguguuauau

SEQ ID NO: 3223312 - RNA, 19 nt, Human
ccuauuaguguuauaugaa

SEQ ID NO: 3223313 - RNA, 11 nt, Human
ccuauuagugu

SEQ ID NO: 3223314 - RNA, 15 nt, Human
ccuauuaguguuaua

SEQ ID NO: 3223315 - RNA, 15 nt, Human
ccuaggugacagagu

SEQ ID NO: 3223316 - RNA, 13 nt, Human
ccuaggucuauuu

SEQ ID NO: 3223317 - RNA, 23 nt, Human
ccuagguagcccccucuucccug

SEQ ID NO: 3223318 - RNA, 21 nt, Human
ccuagguagcccccucuuccc

SEQ ID NO: 3223319 - RNA, 20 nt, Human
ccuagguagcccccucuucc

SEQ ID NO: 3223320 - RNA, 16 nt, Human
ccuagguagcccccuc

SEQ ID NO: 3223321 - RNA, 16 nt, Human
ccgggagccugaucac

SEQ ID NO: 3223322 - RNA, 23 nt, Human
ccgggagccugaucaccugcccu

SEQ ID NO: 3223323 - RNA, 14 nt, Human
ccgggaagcaaaug

SEQ ID NO: 3223324 - RNA, 21 nt, Human
ccgggacguggcaccuccucg

SEQ ID NO: 3223325 - RNA, 12 nt, Human
ccgggacucugc

SEQ ID NO: 3223326 - RNA, 17 nt, Human
ccggugggggggcagag

SEQ ID NO: 3223327 - RNA, 16 nt, Human
ccggugggggggcaga

SEQ ID NO: 3223328 - RNA, 21 nt, Human
ccgugcuuuuaaggaaaggca

SEQ ID NO: 3223329 - RNA, 17 nt, Human
ccggugugggggccccg

SEQ ID NO: 3223330 - RNA, 21 nt, Human
ccggugggggggcagagcccu

SEQ ID NO: 3223331 - RNA, 18 nt, Human
ccggugaccucuagcccu

SEQ ID NO: 3223332 - RNA, 21 nt, Human
ccggucgggggggacccucca

SEQ ID NO: 3223333 - RNA, 16 nt, Human
ccggcaauaaaagccc

SEQ ID NO: 3223334 - RNA, 17 nt, Human
ccgggaagggggcuggg

SEQ ID NO: 3223335 - RNA, 18 nt, Human
ccggcaauaaaagcccag

SEQ ID NO: 3223336 - RNA, 17 nt, Human
ccggcaauaaaagccca

SEQ ID NO: 3223337 - RNA, 21 nt, Human
ccggaggggccuggcagccgu

SEQ ID NO: 3223338 - RNA, 17 nt, Human
ccggaggggccuggcag

SEQ ID NO: 3223339 - RNA, 13 nt, Human
cccuggugguuca

SEQ ID NO: 3223340 - RNA, 16 nt, Human
cccuguguuaauuuaa

SEQ ID NO: 3223341 - RNA, 13 nt, Human
cccuguucacucu

SEQ ID NO: 3223342 - RNA, 22 nt, Human
cccuguucacucuacuuagcau

SEQ ID NO: 3223343 - RNA, 14 nt, Human
cccuguucacucua

SEQ ID NO: 3223344 - RNA, 13 nt, Human
cccuucccaccuc

SEQ ID NO: 3223345 - RNA, 12 nt, Human
cccuucccaccu

SEQ ID NO: 3223346 - RNA, 11 nt, Human
cccuucauuug

SEQ ID NO: 3223347 - RNA, 13 nt, Human
cccuuccuaauuc

SEQ ID NO: 3223348 - RNA, 14 nt, Human
cccuuccuaauucc

SEQ ID NO: 3223349 - RNA, 19 nt, Human
cccuuccuaauuccacagc

SEQ ID NO: 3223350 - RNA, 20 nt, Human
cccuuccuaauuccacagcu

SEQ ID NO: 3223351 - RNA, 14 nt, Human
cccuucccagggca

SEQ ID NO: 3223352 - RNA, 11 nt, Human
cccuucuuuuu

SEQ ID NO: 3223353 - RNA, 19 nt, Human
cccuucuuuuucuucuuuu

SEQ ID NO: 3223354 - RNA, 15 nt, Human
cccuugaccugcuga

SEQ ID NO: 3223355 - RNA, 12 nt, Human
cccuugaccugc

SEQ ID NO: 3223356 - RNA, 17 nt, Human
cccuuggauuguccccg

SEQ ID NO: 3223357 - RNA, 22 nt, Human
cccuugguuaggcauuguggga

SEQ ID NO: 3223358 - RNA, 23 nt, Human
cccuugguuaggcauugugggaa

SEQ ID NO: 3223359 - RNA, 22 nt, Human
cccuuguggucccaccccacac

SEQ ID NO: 3223360 - RNA, 20 nt, Human
cccuuguggucccaccccac

SEQ ID NO: 3223361 - RNA, 12 nt, Human
cccuuguuccag

SEQ ID NO: 3223362 - RNA, 17 nt, Human
cccuuuagcuguguuau

SEQ ID NO: 3223363 - RNA, 23 nt, Human
cccuuuacuugucuuucuggggu

SEQ ID NO: 3223364 - RNA, 13 nt, Human
ccuaggugacaga

SEQ ID NO: 3223365 - RNA, 18 nt, Human
ccuagaauguuucauuug

SEQ ID NO: 3223366 - RNA, 19 nt, Human
ccuagaauguuucauuugc

SEQ ID NO: 3223367 - RNA, 21 nt, Human
ccuagaaauuccccacccuga

SEQ ID NO: 3223368 - RNA, 16 nt, Human
ccuacuuccccuuccu

SEQ ID NO: 3223369 - RNA, 13 nt, Human
ccuacuuccccuu

SEQ ID NO: 3223370 - RNA, 18 nt, Human
ccuacccacccuccuuuc

SEQ ID NO: 3223371 - RNA, 13 nt, Human
ccuacccacccuc

SEQ ID NO: 3223372 - RNA, 18 nt, Human
ccuacaugcuuugugaac

SEQ ID NO: 3223373 - RNA, 21 nt, Human
ccuacaguugaaaaacagcug

SEQ ID NO: 3223374 - RNA, 17 nt, Human
ccuacaugcuuugugaa

SEQ ID NO: 3223375 - RNA, 15 nt, Human
ccuacagcccaccug

SEQ ID NO: 3223376 - RNA, 19 nt, Human
ccuacagcuugaccgugag

SEQ ID NO: 3223377 - RNA, 22 nt, Human
ccuacaguugaaaaacagcuga

SEQ ID NO: 3223378 - RNA, 23 nt, Human
ccuaacaugguuuaaaagaaaaa

SEQ ID NO: 3223379 - RNA, 22 nt, Human
ccuaacaacauuguagccucaa

SEQ ID NO: 3223380 - RNA, 21 nt, Human
ccuaacaacauuguagccuca

SEQ ID NO: 3223381 - RNA, 15 nt, Human
ccuaaaauucagugg

SEQ ID NO: 3223382 - RNA, 19 nt, Human
ccguguuugucucuucugg

SEQ ID NO: 3223383 - RNA, 14 nt, Human
ccguguuugucucu

SEQ ID NO: 3223384 - RNA, 18 nt, Human
ccguguuugucucuucug

SEQ ID NO: 3223385 - RNA, 16 nt, Human
ccuaaaauucagugga

SEQ ID NO: 3223386 - RNA, 20 nt, Human
cuugaaugaugccaugagga

SEQ ID NO: 3223387 - RNA, 23 nt, Human
cuugaauaaacaccacuggauua

SEQ ID NO: 3223388 - RNA, 13 nt, Human
cuugaauaguauu

SEQ ID NO: 3223389 - RNA, 15 nt, Human
cuugaauaguauugu

SEQ ID NO: 3223390 - RNA, 17 nt, Human
cuugaauaguauugugu

SEQ ID NO: 3223391 - RNA, 18 nt, Human
cuugaauaguauuguguu

SEQ ID NO: 3223392 - RNA, 13 nt, Human
cuugaauauaaaa

SEQ ID NO: 3223393 - RNA, 15 nt, Human
cuugaauauaaaaaa

SEQ ID NO: 3223394 - RNA, 16 nt, Human
cuugaauauaaaaaau

SEQ ID NO: 3223395 - RNA, 20 nt, Human
cuugaauauaaaaaaucaug

SEQ ID NO: 3223396 - RNA, 22 nt, Human
cuucuucagagacuccugcagg

SEQ ID NO: 3223397 - RNA, 18 nt, Human
cuucuucagagacuccug

SEQ ID NO: 3223398 - RNA, 23 nt, Human
cuucugacccaugcugcccugug

SEQ ID NO: 3223399 - RNA, 15 nt, Human
cuucugacucuuccc

SEQ ID NO: 3223400 - RNA, 17 nt, Human
cuucugacucuucccca

SEQ ID NO: 3223401 - RNA, 16 nt, Human
cuucugacucuucccc

SEQ ID NO: 3223402 - RNA, 23 nt, Human
cuucugacucuuccccaggaagg

SEQ ID NO: 3223403 - RNA, 20 nt, Human
cuucuucagagacuccugca

SEQ ID NO: 3223404 - RNA, 21 nt, Human
cuucuucagagacuccugcag

SEQ ID NO: 3223405 - RNA, 19 nt, Human
cuucuguuuucaaucucgu

SEQ ID NO: 3223406 - RNA, 16 nt, Human
cuucuguuuucaaucu

SEQ ID NO: 3223407 - RNA, 13 nt, Human
cuucuguuuucaa

SEQ ID NO: 3223408 - RNA, 11 nt, Human
cuuggcccagg

SEQ ID NO: 3223409 - RNA, 18 nt, Human
cuugcucucuuuuauucu

SEQ ID NO: 3223410 - RNA, 21 nt, Human
cuuggccagcaaguuagagaa

SEQ ID NO: 3223411 - RNA, 22 nt, Human
cuugacaaagucaagccacaug

SEQ ID NO: 3223412 - RNA, 20 nt, Human
cuugccgucuaccugagggg

SEQ ID NO: 3223413 - RNA, 12 nt, Human
cuugacagggca

SEQ ID NO: 3223414 - RNA, 19 nt, Human
cuugccgucuaccugaggg

SEQ ID NO: 3223415 - RNA, 19 nt, Human
cuugacagagccugcccca

SEQ ID NO: 3223416 - RNA, 16 nt, Human
cuugacagagccugcc

SEQ ID NO: 3223417 - RNA, 12 nt, Human
cuugacagcuca

SEQ ID NO: 3223418 - RNA, 23 nt, Human
cuugccgucuaccugaggggccu

SEQ ID NO: 3223419 - RNA, 12 nt, Human
cuugcucugcug

SEQ ID NO: 3223420 - RNA, 22 nt, Human
cuuucagacucucucugggagg

SEQ ID NO: 3223421 - RNA, 20 nt, Human
cuuuaaagggauggcaagau

SEQ ID NO: 3223422 - RNA, 12 nt, Human
cuuuaaauuaug

SEQ ID NO: 3223423 - RNA, 12 nt, Human
cuuuaacaugcc

SEQ ID NO: 3223424 - RNA, 15 nt, Human
cuuguggacacagcu

SEQ ID NO: 3223425 - RNA, 14 nt, Human
cuuguggacacagc

SEQ ID NO: 3223426 - RNA, 13 nt, Human
cuuguggacacag

SEQ ID NO: 3223427 - RNA, 16 nt, Human
cuugugcacaggcaga

SEQ ID NO: 3223428 - RNA, 15 nt, Human
cuugugcacaggcag

SEQ ID NO: 3223429 - RNA, 22 nt, Human
cuugugcacaggcagagcccag

SEQ ID NO: 3223430 - RNA, 18 nt, Human
cuugugcacaggcagagc

SEQ ID NO: 3223431 - RNA, 16 nt, Human
cuugugacuuuugcuu

SEQ ID NO: 3223432 - RNA, 12 nt, Human
cuugugacuuuu

SEQ ID NO: 3223433 - RNA, 22 nt, Human
cuugugacuuuugcuuuaauuc

SEQ ID NO: 3223434 - RNA, 21 nt, Human
cuugugacuuuugcuuuaauu

SEQ ID NO: 3223435 - RNA, 19 nt, Human
cuugugacuuuugcuuuaa

SEQ ID NO: 3223436 - RNA, 17 nt, Human
cuugugacuuuugcuuu

SEQ ID NO: 3223437 - RNA, 13 nt, Human
cuuuaauuuuagc

SEQ ID NO: 3223438 - RNA, 18 nt, Human
cuuuacaaacaaaagcau

SEQ ID NO: 3223439 - RNA, 19 nt, Human
cuuuaaucagguccugcuc

SEQ ID NO: 3223440 - RNA, 17 nt, Human
cuuuaauaugaaauuuu

SEQ ID NO: 3223441 - RNA, 14 nt, Human
cuuuaauaugaaau

SEQ ID NO: 3223442 - RNA, 18 nt, Human
cuuucaauaggaaaaacu

SEQ ID NO: 3223443 - RNA, 23 nt, Human
cuuuacacggagcggauugcaaa

SEQ ID NO: 3223444 - RNA, 20 nt, Human
cuuucaauaggaaaaacuga

SEQ ID NO: 3223445 - RNA, 21 nt, Human
cuuucaauaggaaaaacugau

SEQ ID NO: 3223446 - RNA, 22 nt, Human
cuuucaauaggaaaaacugauu

SEQ ID NO: 3223447 - RNA, 12 nt, Human
cuuucacuucuu

SEQ ID NO: 3223448 - RNA, 21 nt, Human
cuuucacuucuuucccuuccu

SEQ ID NO: 3223449 - RNA, 20 nt, Human
cuuucacuucuuucccuucc

SEQ ID NO: 3223450 - RNA, 18 nt, Human
cuuucacuucuuucccuu

SEQ ID NO: 3223451 - RNA, 16 nt, Human
cuuucacuucuuuccc

SEQ ID NO: 3223452 - RNA, 15 nt, Human
cuuucacuucuuucc

SEQ ID NO: 3223453 - RNA, 14 nt, Human
cuuucacuucuuuc

SEQ ID NO: 3223454 - RNA, 13 nt, Human
cuuucacuucuuu

SEQ ID NO: 3223455 - RNA, 19 nt, Human
cuuucagacucucucuggg

SEQ ID NO: 3223456 - RNA, 14 nt, Human
cuuugagguggaag

SEQ ID NO: 3223457 - RNA, 17 nt, Human
cuuugagguggaagagg

SEQ ID NO: 3223458 - RNA, 16 nt, Human
cuuugagguggaagag

SEQ ID NO: 3223459 - RNA, 16 nt, Human
cuuugagcuuaagaau

SEQ ID NO: 3223460 - RNA, 14 nt, Human
cuuugagcucccac

SEQ ID NO: 3223461 - RNA, 23 nt, Human
cuuugagcucccacuucugccag

SEQ ID NO: 3223462 - RNA, 23 nt, Human
cuuugagaucuaaaaauaacugu

SEQ ID NO: 3223463 - RNA, 22 nt, Human
cuuugagaucuaaaaauaacug

SEQ ID NO: 3223464 - RNA, 19 nt, Human
cuuugagaucuaaaaauaa

SEQ ID NO: 3223465 - RNA, 17 nt, Human
cuuugagaucuaaaaau

SEQ ID NO: 3223466 - RNA, 16 nt, Human
cuuugagaucuaaaaa

SEQ ID NO: 3223467 - RNA, 18 nt, Human
cuuugacgccaucccagc

SEQ ID NO: 3223468 - RNA, 19 nt, Human
cuuugacgccaucccagcc

SEQ ID NO: 3223469 - RNA, 21 nt, Human
cuuugacgccaucccagcccc

SEQ ID NO: 3223470 - RNA, 22 nt, Human
cuuugacgccaucccagcccca

SEQ ID NO: 3223471 - RNA, 22 nt, Human
cuuugagguggaagagggcugc

SEQ ID NO: 3223472 - RNA, 21 nt, Human
cuuugagugucuuaauuaaaa

SEQ ID NO: 3223473 - RNA, 19 nt, Human
cuuugaguuaagucuaucu

SEQ ID NO: 3223474 - RNA, 22 nt, Human
cuuugauucacauguuuucaaa

SEQ ID NO: 3223475 - RNA, 21 nt, Human
cuuugauucacauguuuucaa

SEQ ID NO: 3223476 - RNA, 20 nt, Human
cuuugauucacauguuuuca

SEQ ID NO: 3223477 - RNA, 17 nt, Human
cuuugauucacauguuu

SEQ ID NO: 3223478 - RNA, 16 nt, Human
cuuugauucacauguu

SEQ ID NO: 3223479 - RNA, 15 nt, Human
cuuugauucacaugu

SEQ ID NO: 3223480 - RNA, 20 nt, Human
cuuucgacuugcauuuuugc

SEQ ID NO: 3223481 - RNA, 21 nt, Human
cuuucgacuugcauuuuugca

SEQ ID NO: 3223482 - RNA, 22 nt, Human
cuuucggggagaggcugaggac

SEQ ID NO: 3223483 - RNA, 13 nt, Human
cuuucuccuuuuu

SEQ ID NO: 3223484 - RNA, 19 nt, Human
cuuucguuuguuuguuuca

SEQ ID NO: 3223485 - RNA, 13 nt, Human
cuuucuaagaaau

SEQ ID NO: 3223486 - RNA, 14 nt, Human
cuuucuaagaaauc

SEQ ID NO: 3223487 - RNA, 16 nt, Human
cuuucuaagaaaucaa

SEQ ID NO: 3223488 - RNA, 18 nt, Human
cuuucuauaauuuuacaa

SEQ ID NO: 3223489 - RNA, 17 nt, Human
cuuucuauaauuuuaca

SEQ ID NO: 3223490 - RNA, 14 nt, Human
cuuucuauaauuuu

SEQ ID NO: 3223491 - RNA, 12 nt, Human
cuuuucaaaauc

SEQ ID NO: 3223492 - RNA, 15 nt, Human
cuuuucaaaacauuu

SEQ ID NO: 3223493 - RNA, 17 nt, Human
cuuuucaaguauuuaag

SEQ ID NO: 3223494 - RNA, 14 nt, Human
cuuuucaaguauuu

SEQ ID NO: 3223495 - RNA, 20 nt, Human
cuuuggucuacacugugcug

SEQ ID NO: 3223496 - RNA, 18 nt, Human
cuuuggucacuuuuagau

SEQ ID NO: 3223497 - RNA, 15 nt, Human
cuuuggucacuuuua

SEQ ID NO: 3223498 - RNA, 16 nt, Human
cuuuggucuacacugu

SEQ ID NO: 3223499 - RNA, 14 nt, Human
cuuugggugcuguu

SEQ ID NO: 3223500 - RNA, 23 nt, Human
cuuuuagaaaagggaguuuaaaa

SEQ ID NO: 3223501 - RNA, 19 nt, Human
cuuuuauuuagcaccaggg

SEQ ID NO: 3223502 - RNA, 19 nt, Human
cugugucuugcaauggcag

SEQ ID NO: 3223503 - RNA, 16 nt, Human
cugugucuugcaaugg

SEQ ID NO: 3223504 - RNA, 15 nt, Human
cuguucacucuacuu

SEQ ID NO: 3223505 - RNA, 13 nt, Human
cuguucacucuac

SEQ ID NO: 3223506 - RNA, 16 nt, Human
cuguucagauuggaca

SEQ ID NO: 3223507 - RNA, 22 nt, Human
cugugucugcccaaugaauaau

SEQ ID NO: 3223508 - RNA, 13 nt, Human
cuguucagcucca

SEQ ID NO: 3223509 - RNA, 14 nt, Human
cuguucagcguuuu

SEQ ID NO: 3223510 - RNA, 17 nt, Human
cuguucagcguuuugca

SEQ ID NO: 3223511 - RNA, 14 nt, Human
cuguguaagcugug

SEQ ID NO: 3223512 - RNA, 19 nt, Human
cugugcugagucugaaggc

SEQ ID NO: 3223513 - RNA, 11 nt, Human
cugugcugccc

SEQ ID NO: 3223514 - RNA, 20 nt, Human
cugugcugagucugaaggcu

SEQ ID NO: 3223515 - RNA, 22 nt, Human
cugugcugagucugaaggcugg

SEQ ID NO: 3223516 - RNA, 14 nt, Human
cugugucucccuuc

SEQ ID NO: 3223517 - RNA, 19 nt, Human
cugugucucccuucauccu

SEQ ID NO: 3223518 - RNA, 14 nt, Human
cugugucuugcaau

SEQ ID NO: 3223519 - RNA, 21 nt, Human
cugugucagguggggcagcuu

SEQ ID NO: 3223520 - RNA, 20 nt, Human
cugugucagcauagaaguaa

SEQ ID NO: 3223521 - RNA, 19 nt, Human
cugugucagguggggcagc

SEQ ID NO: 3223522 - RNA, 21 nt, Human
cugugacaucucuauucccca

SEQ ID NO: 3223523 - RNA, 17 nt, Human
cugugacuucagcucug

SEQ ID NO: 3223524 - RNA, 17 nt, Human
cugugacuaggaaaaaa

SEQ ID NO: 3223525 - RNA, 22 nt, Human
cugugacuucagcucuguuuua

SEQ ID NO: 3223526 - RNA, 22 nt, Human
cugugcguggggcucccgccuc

SEQ ID NO: 3223527 - RNA, 15 nt, Human
cugugcguggggcuc

SEQ ID NO: 3223528 - RNA, 14 nt, Human
cugugcguggggcu

SEQ ID NO: 3223529 - RNA, 14 nt, Human
cuguugcugccuca

SEQ ID NO: 3223530 - RNA, 17 nt, Human
cuguugcugccucaugc

SEQ ID NO: 3223531 - RNA, 15 nt, Human
cuguugcugccucau

SEQ ID NO: 3223532 - RNA, 16 nt, Human
cuguugcugccucaug

SEQ ID NO: 3223533 - RNA, 13 nt, Human
cuuacacaauggu

SEQ ID NO: 3223534 - RNA, 21 nt, Human
cuuacacuggcaaugguaguu

SEQ ID NO: 3223535 - RNA, 23 nt, Human
cuuaaaauuugaaacauugcuuu

SEQ ID NO: 3223536 - RNA, 20 nt, Human
cuuaaaauuugaaacauugc

SEQ ID NO: 3223537 - RNA, 22 nt, Human
cuuaaagggcccaaugaauuau

SEQ ID NO: 3223538 - RNA, 17 nt, Human
cuguugggccaggagcc

SEQ ID NO: 3223539 - RNA, 20 nt, Human
cuguugggccaggagccucc

SEQ ID NO: 3223540 - RNA, 16 nt, Human
cuguugggccaggagc

SEQ ID NO: 3223541 - RNA, 20 nt, Human
cuuaaaauauuccugcauuu

SEQ ID NO: 3223542 - RNA, 18 nt, Human
cuuaaaauauuccugcau

SEQ ID NO: 3223543 - RNA, 13 nt, Human
cuuaaaauuugaa

SEQ ID NO: 3223544 - RNA, 19 nt, Human
cuuaaaauuugaaacauug

SEQ ID NO: 3223545 - RNA, 16 nt, Human
cuuaaaauuugaaaca

SEQ ID NO: 3223546 - RNA, 15 nt, Human
cuuaaaauuugaaac

SEQ ID NO: 3223547 - RNA, 14 nt, Human
cuuaaaauuugaaa

SEQ ID NO: 3223548 - RNA, 13 nt, Human
cuuaccucggugc

SEQ ID NO: 3223549 - RNA, 16 nt, Human
cuuaccuacuuucuuc

SEQ ID NO: 3223550 - RNA, 18 nt, Human
cuuaccuacuuucuucag

SEQ ID NO: 3223551 - RNA, 14 nt, Human
cuuaccgacaagca

SEQ ID NO: 3223552 - RNA, 19 nt, Human
cuuaccucggugccuuccu

SEQ ID NO: 3223553 - RNA, 21 nt, Human
cuuaccucggugccuuccucu

SEQ ID NO: 3223554 - RNA, 19 nt, Human
cuuagauguauauauuucc

SEQ ID NO: 3223555 - RNA, 17 nt, Human
cuuaccugaguugaaga

SEQ ID NO: 3223556 - RNA, 21 nt, Human
cuuauggaacacucugagacu

SEQ ID NO: 3223557 - RNA, 14 nt, Human
cuuaugggcugggu

SEQ ID NO: 3223558 - RNA, 21 nt, Human
cuuaugggcuggguucuaccc

SEQ ID NO: 3223559 - RNA, 13 nt, Human
cuuauugcccacg

SEQ ID NO: 3223560 - RNA, 12 nt, Human
cuuauugcccac

SEQ ID NO: 3223561 - RNA, 16 nt, Human
cuuauuacauuuuauu

SEQ ID NO: 3223562 - RNA, 23 nt, Human
cuuauuaaaguuucaaaaaucug

SEQ ID NO: 3223563 - RNA, 22 nt, Human
cuuauuaaaguuucaaaaaucu

SEQ ID NO: 3223564 - RNA, 20 nt, Human
cuuauuaaaguuucaaaaau

SEQ ID NO: 3223565 - RNA, 19 nt, Human
cuuauuaaaguuucaaaaa

SEQ ID NO: 3223566 - RNA, 18 nt, Human
cuuauuaaaguuucaaaa

SEQ ID NO: 3223567 - RNA, 17 nt, Human
cuuauuaaaguuucaaa

SEQ ID NO: 3223568 - RNA, 16 nt, Human
cuuauuaaaguuucaa

SEQ ID NO: 3223569 - RNA, 15 nt, Human
cuuauuaaaguuuca

SEQ ID NO: 3223570 - RNA, 14 nt, Human
cuuauuaaaguuuc

SEQ ID NO: 3223571 - RNA, 13 nt, Human
cuuauuaaaguuu

SEQ ID NO: 3223572 - RNA, 22 nt, Human
cuuaugggcuggguucuaccca

SEQ ID NO: 3223573 - RNA, 23 nt, Human
cuuaugggcuggguucuacccag

SEQ ID NO: 3223574 - RNA, 21 nt, Human
cuuauggguagggcucugaca

SEQ ID NO: 3223575 - RNA, 18 nt, Human
cuuauuaaaacacuucau

SEQ ID NO: 3223576 - RNA, 14 nt, Human
cuuauguugaaaaa

SEQ ID NO: 3223577 - RNA, 16 nt, Human
cuuauguugaaaaaau

SEQ ID NO: 3223578 - RNA, 17 nt, Human
cuuauguugaaaaaauu

SEQ ID NO: 3223579 - RNA, 18 nt, Human
cuuauguugaaaaaauuu

SEQ ID NO: 3223580 - RNA, 18 nt, Human
cuuagcagggaaacagcu

SEQ ID NO: 3223581 - RNA, 18 nt, Human
cuuccagugaggcucugc

SEQ ID NO: 3223582 - RNA, 17 nt, Human
cuuccagugaggcucug

SEQ ID NO: 3223583 - RNA, 19 nt, Human
cuuccagugaggcucugcc

SEQ ID NO: 3223584 - RNA, 20 nt, Human
cuuccagugaggcucugccc

SEQ ID NO: 3223585 - RNA, 16 nt, Human
cuuccauggacuuugu

SEQ ID NO: 3223586 - RNA, 17 nt, Human
cuuccauggacuuuguu

SEQ ID NO: 3223587 - RNA, 16 nt, Human
cuuccaugucgccucu

SEQ ID NO: 3223588 - RNA, 15 nt, Human
cuuccaugucgccuc

SEQ ID NO: 3223589 - RNA, 20 nt, Human
cuuccaugucgccucugcau

SEQ ID NO: 3223590 - RNA, 19 nt, Human
cuuccaugucgccucugca

SEQ ID NO: 3223591 - RNA, 18 nt, Human
cuuccaugucgccucugc

SEQ ID NO: 3223592 - RNA, 17 nt, Human
cuuccaugucgccucug

SEQ ID NO: 3223593 - RNA, 22 nt, Human
cuucaucucccaaagugcuggg

SEQ ID NO: 3223594 - RNA, 16 nt, Human
cuucauccuccucaga

SEQ ID NO: 3223595 - RNA, 23 nt, Human
cuucagagacuccugcaggcagc

SEQ ID NO: 3223596 - RNA, 17 nt, Human
cuucaguggcagcugcu

SEQ ID NO: 3223597 - RNA, 18 nt, Human
cuucaguggcagcugcuu

SEQ ID NO: 3223598 - RNA, 17 nt, Human
cuucaguuaagccuuug

SEQ ID NO: 3223599 - RNA, 13 nt, Human
cuucaucccucug

SEQ ID NO: 3223600 - RNA, 18 nt, Human
cuucaguuaagccuuugg

SEQ ID NO: 3223601 - RNA, 15 nt, Human
cuucauccuccucag

SEQ ID NO: 3223602 - RNA, 16 nt, Human
cuucauccccucagaa

SEQ ID NO: 3223603 - RNA, 11 nt, Human
cuucagacaua

SEQ ID NO: 3223604 - RNA, 21 nt, Human
cuucacuucugacucuucccc

SEQ ID NO: 3223605 - RNA, 20 nt, Human
cuucacuucugacucuuccc

SEQ ID NO: 3223606 - RNA, 14 nt, Human
cuucacuucugacu

SEQ ID NO: 3223607 - RNA, 13 nt, Human
cuucacuucugac

SEQ ID NO: 3223608 - RNA, 16 nt, Human
cuucagagacuccugc

SEQ ID NO: 3223609 - RNA, 21 nt, Human
cuucagagacuccugcaggca

SEQ ID NO: 3223610 - RNA, 22 nt, Human
cuucagagacuccugcaggcag

SEQ ID NO: 3223611 - RNA, 17 nt, Human
cuucaccuuugucccca

SEQ ID NO: 3223612 - RNA, 18 nt, Human
cuuauugcccacgcugga

SEQ ID NO: 3223613 - RNA, 14 nt, Human
cuucaccuuugucc

SEQ ID NO: 3223614 - RNA, 13 nt, Human
cugcauuggcuuu

SEQ ID NO: 3223615 - RNA, 18 nt, Human
cugcauugggugaucauu

SEQ ID NO: 3223616 - RNA, 16 nt, Human
cugcccuuaccugcca

SEQ ID NO: 3223617 - RNA, 12 nt, Human
cugcccuuaccu

SEQ ID NO: 3223618 - RNA, 19 nt, Human
cugccccuccucucugccc

SEQ ID NO: 3223619 - RNA, 19 nt, Human
cugcccugugggcccccaa

SEQ ID NO: 3223620 - RNA, 17 nt, Human
cugccccuccucucugc

SEQ ID NO: 3223621 - RNA, 18 nt, Human
cugccccuccucucugcc

SEQ ID NO: 3223622 - RNA, 17 nt, Human
cugccccucccuucaac

SEQ ID NO: 3223623 - RNA, 14 nt, Human
cugccccucccuuc

SEQ ID NO: 3223624 - RNA, 13 nt, Human
cugccccucccuu

SEQ ID NO: 3223625 - RNA, 20 nt, Human
cugccagggacagagggggu

SEQ ID NO: 3223626 - RNA, 22 nt, Human
cugccagggacagagggggugg

SEQ ID NO: 3223627 - RNA, 23 nt, Human
cugccagggacagaggggguggc

SEQ ID NO: 3223628 - RNA, 13 nt, Human
cugccaguuuugu

SEQ ID NO: 3223629 - RNA, 12 nt, Human
cugccaguuuug

SEQ ID NO: 3223630 - RNA, 22 nt, Human
cugccaguggggccugaggcuc

SEQ ID NO: 3223631 - RNA, 20 nt, Human
cugccaguggggccugaggc

SEQ ID NO: 3223632 - RNA, 17 nt, Human
cugccagucccccugcc

SEQ ID NO: 3223633 - RNA, 21 nt, Human
cugccagucccccugccccag

SEQ ID NO: 3223634 - RNA, 20 nt, Human
cugccagucccccugcccca

SEQ ID NO: 3223635 - RNA, 22 nt, Human
cugccagucccccugccccagg

SEQ ID NO: 3223636 - RNA, 19 nt, Human
cugccauccagguucagcu

SEQ ID NO: 3223637 - RNA, 18 nt, Human
cugccauccagguucagc

SEQ ID NO: 3223638 - RNA, 16 nt, Human
cugccauccagguuca

SEQ ID NO: 3223639 - RNA, 16 nt, Human
cugccauauucuguug

SEQ ID NO: 3223640 - RNA, 12 nt, Human
cugccauccagg

SEQ ID NO: 3223641 - RNA, 13 nt, Human
cugccccccagcc

SEQ ID NO: 3223642 - RNA, 19 nt, Human
cugcaaauccuugugggaa

SEQ ID NO: 3223643 - RNA, 16 nt, Human
cugcaaauccuugugg

SEQ ID NO: 3223644 - RNA, 22 nt, Human
cugcaaaguacagguacuuugu

SEQ ID NO: 3223645 - RNA, 21 nt, Human
cugcaaaguacagguacuuug

SEQ ID NO: 3223646 - RNA, 23 nt, Human
cugcaaaguacagguacuuuguc

SEQ ID NO: 3223647 - RNA, 20 nt, Human
cugcaaccuccgccucuugg

SEQ ID NO: 3223648 - RNA, 21 nt, Human
cugcaaccaaacucccaucag

SEQ ID NO: 3223649 - RNA, 19 nt, Human
cugcaaccugauugugucu

SEQ ID NO: 3223650 - RNA, 21 nt, Human
cugcaaccugauugugucucu

SEQ ID NO: 3223651 - RNA, 14 nt, Human
cugcaaccugauug

SEQ ID NO: 3223652 - RNA, 22 nt, Human
cugcaaccuccgccucuugggu

SEQ ID NO: 3223653 - RNA, 18 nt, Human
cugcaagaauugaagcag

SEQ ID NO: 3223654 - RNA, 19 nt, Human
cugcaacuuguaaaugugg

SEQ ID NO: 3223655 - RNA, 18 nt, Human
cugcaacuuguaaaugug

SEQ ID NO: 3223656 - RNA, 22 nt, Human
cugcaaccugauugugucucuu

SEQ ID NO: 3223657 - RNA, 17 nt, Human
cugcaaccuucgccacc

SEQ ID NO: 3223658 - RNA, 19 nt, Human
cugcaaccuucgccaccug

SEQ ID NO: 3223659 - RNA, 20 nt, Human
cugcaaccuucgccaccugg

SEQ ID NO: 3223660 - RNA, 22 nt, Human
cugcaaccuucgccaccugggu

SEQ ID NO: 3223661 - RNA, 20 nt, Human
cugcaaccuuguuuauuaaa

SEQ ID NO: 3223662 - RNA, 23 nt, Human
cugcaccgggccacagagaaagu

SEQ ID NO: 3223663 - RNA, 20 nt, Human
cugcaccgggccacagagaa

SEQ ID NO: 3223664 - RNA, 12 nt, Human
cugcaagggagu

SEQ ID NO: 3223665 - RNA, 20 nt, Human
cugcaagaauugaagcagga

SEQ ID NO: 3223666 - RNA, 16 nt, Human
cugaugcuucuucaga

SEQ ID NO: 3223667 - RNA, 17 nt, Human
cugaugcuucuucagag

SEQ ID NO: 3223668 - RNA, 14 nt, Human
cucuuaugggcugg

SEQ ID NO: 3223669 - RNA, 22 nt, Human
cucuuauaucuaaaucugucca

SEQ ID NO: 3223670 - RNA, 15 nt, Human
cucuuaugggcuggg

SEQ ID NO: 3223671 - RNA, 17 nt, Human
cugaugaccaauuuuaa

SEQ ID NO: 3223672 - RNA, 22 nt, Human
cugaugacccccccagcuucac

SEQ ID NO: 3223673 - RNA, 21 nt, Human
cugaugacccccccagcuuca

SEQ ID NO: 3223674 - RNA, 21 nt, Human
cugaugggcaacccccagccu

SEQ ID NO: 3223675 - RNA, 18 nt, Human
cugaugggcaacccccag

SEQ ID NO: 3223676 - RNA, 18 nt, Human
cugaugcuucuucagaga

SEQ ID NO: 3223677 - RNA, 19 nt, Human
cugaugcuucuucagagac

SEQ ID NO: 3223678 - RNA, 20 nt, Human
cugaugcuucuucagagacu

SEQ ID NO: 3223679 - RNA, 18 nt, Human
cugauggaauuuuuuugu

SEQ ID NO: 3223680 - RNA, 22 nt, Human
cugcaaaggguaucaggugcug

SEQ ID NO: 3223681 - RNA, 15 nt, Human
cugcaaaggaaauac

SEQ ID NO: 3223682 - RNA, 21 nt, Human
cugcaaaggguaucaggugcu

SEQ ID NO: 3223683 - RNA, 17 nt, Human
cugcaaagcccagcuug

SEQ ID NO: 3223684 - RNA, 18 nt, Human
cugcaaagcccagcuuga

SEQ ID NO: 3223685 - RNA, 23 nt, Human
cugaugggcaacccccagccugc

SEQ ID NO: 3223686 - RNA, 22 nt, Human
cugaugggcaacccccagccug

SEQ ID NO: 3223687 - RNA, 24 nt, Human
cugaugggcaacccccagccugcu

SEQ ID NO: 3223688 - RNA, 17 nt, Human
cugcaggaaauggcugu

SEQ ID NO: 3223689 - RNA, 12 nt, Human
cugcagcuuugu

SEQ ID NO: 3223690 - RNA, 20 nt, Human
cugcaggauucucaccagcu

SEQ ID NO: 3223691 - RNA, 19 nt, Human
cugcaggauucucaccagc

SEQ ID NO: 3223692 - RNA, 13 nt, Human
cugcaggcagcca

SEQ ID NO: 3223693 - RNA, 14 nt, Human
cugcaggcagccag

SEQ ID NO: 3223694 - RNA, 15 nt, Human
cugcaggcagccagg

SEQ ID NO: 3223695 - RNA, 16 nt, Human
cugcaggcagccaggc

SEQ ID NO: 3223696 - RNA, 17 nt, Human
cugcaggcagccaggcc

SEQ ID NO: 3223697 - RNA, 18 nt, Human
cugcaggcagccaggcca

SEQ ID NO: 3223698 - RNA, 19 nt, Human
cugcaggcagccaggccac

SEQ ID NO: 3223699 - RNA, 20 nt, Human
cugcaggcagccaggccaca

SEQ ID NO: 3223700 - RNA, 17 nt, Human
cugcacuccagccugag

SEQ ID NO: 3223701 - RNA, 20 nt, Human
cugcacuccagccugagcga

SEQ ID NO: 3223702 - RNA, 16 nt, Human
cugcacuccagccuga

SEQ ID NO: 3223703 - RNA, 15 nt, Human
cugcacuccagccug

SEQ ID NO: 3223704 - RNA, 13 nt, Human
cugcacuccagcc

SEQ ID NO: 3223705 - RNA, 23 nt, Human
cugcacuauagccuaggugacag

SEQ ID NO: 3223706 - RNA, 22 nt, Human
cugcacuauagccuaggugaca

SEQ ID NO: 3223707 - RNA, 20 nt, Human
cugcacuauagccuagguga

SEQ ID NO: 3223708 - RNA, 18 nt, Human
cugcacuauagccuaggu

SEQ ID NO: 3223709 - RNA, 17 nt, Human
cugcacuauagccuagg

SEQ ID NO: 3223710 - RNA, 16 nt, Human
cugcacuauagccuag

SEQ ID NO: 3223711 - RNA, 17 nt, Human
cugcacuccagccuggg

SEQ ID NO: 3223712 - RNA, 16 nt, Human
cugcacuccagccugg

SEQ ID NO: 3223713 - RNA, 18 nt, Human
cugcacuccagccugggu

SEQ ID NO: 3223714 - RNA, 24 nt, Human
cugcagccucaaccuccugggcua

SEQ ID NO: 3223715 - RNA, 23 nt, Human
cugcagccucaaccuccugggcu

SEQ ID NO: 3223716 - RNA, 18 nt, Human
cugcagcucucaugcugc

SEQ ID NO: 3223717 - RNA, 23 nt, Human
cugcagcucccucaaagaggcag

SEQ ID NO: 3223718 - RNA, 19 nt, Human
cugcagcucccucaaagag

SEQ ID NO: 3223719 - RNA, 11 nt, Human
cugcagcuccc

SEQ ID NO: 3223720 - RNA, 14 nt, Human
cugcagcucccuca

SEQ ID NO: 3223721 - RNA, 13 nt, Human
cugcagcucccuc

SEQ ID NO: 3223722 - RNA, 17 nt, Human
cugcagcucucaugcug

SEQ ID NO: 3223723 - RNA, 21 nt, Human
cugcagccuccgcuucccugg

SEQ ID NO: 3223724 - RNA, 20 nt, Human
cugcagccuccgcuucccug

SEQ ID NO: 3223725 - RNA, 19 nt, Human
cugcagccuccgcuucccu

SEQ ID NO: 3223726 - RNA, 13 nt, Human
cugcagccucccu

SEQ ID NO: 3223727 - RNA, 22 nt, Human
cugcugugggcacaggucaggc

SEQ ID NO: 3223728 - RNA, 19 nt, Human
cugcugugggcacagguca

SEQ ID NO: 3223729 - RNA, 19 nt, Human
cugcugugaagcuggaacu

SEQ ID NO: 3223730 - RNA, 19 nt, Human
cugcugucuuuucuuugcc

SEQ ID NO: 3223731 - RNA, 17 nt, Human
cugcugagucuguucug

SEQ ID NO: 3223732 - RNA, 22 nt, Human
cugcugagucuguucugguaau

SEQ ID NO: 3223733 - RNA, 20 nt, Human
cugcugauaauguauaugaa

SEQ ID NO: 3223734 - RNA, 19 nt, Human
cugcugaguccgaccuggc

SEQ ID NO: 3223735 - RNA, 22 nt, Human
cugcugaguccgaccuggccug

SEQ ID NO: 3223736 - RNA, 21 nt, Human
cugcugaguccgaccuggccu

SEQ ID NO: 3223737 - RNA, 22 nt, Human
cugcugaugacccccccagcuu

SEQ ID NO: 3223738 - RNA, 13 nt, Human
cugcugaaggcuc

SEQ ID NO: 3223739 - RNA, 14 nt, Human
cugcugaaggcucg

SEQ ID NO: 3223740 - RNA, 15 nt, Human
cugcugaaggcucga

SEQ ID NO: 3223741 - RNA, 12 nt, Human
cugcugacagug

SEQ ID NO: 3223742 - RNA, 11 nt, Human
cugcugacagu

SEQ ID NO: 3223743 - RNA, 12 nt, Human
cugcugaggguc

SEQ ID NO: 3223744 - RNA, 13 nt, Human
cugcugagggucc

SEQ ID NO: 3223745 - RNA, 14 nt, Human
cugcugagggucca

SEQ ID NO: 3223746 - RNA, 16 nt, Human
cugcugaggguccaga

SEQ ID NO: 3223747 - RNA, 19 nt, Human
cugcugagucccaggcuga

SEQ ID NO: 3223748 - RNA, 23 nt, Human
cugcugagucccaggcugagccu

SEQ ID NO: 3223749 - RNA, 15 nt, Human
cugcugacaguguug

SEQ ID NO: 3223750 - RNA, 13 nt, Human
cugcugacagugu

SEQ ID NO: 3223751 - RNA, 14 nt, Human
cugcucacauaucu

SEQ ID NO: 3223752 - RNA, 19 nt, Human
cugcucacauaucugucau

SEQ ID NO: 3223753 - RNA, 16 nt, Human
cugcucacauaucugu

SEQ ID NO: 3223754 - RNA, 12 nt, Human
cugcugaaggcu

SEQ ID NO: 3223755 - RNA, 14 nt, Human
cuggaucugugagg

SEQ ID NO: 3223756 - RNA, 20 nt, Human
cuggaucucuuaagacagca

SEQ ID NO: 3223757 - RNA, 16 nt, Human
cuggaguucugguucc

SEQ ID NO: 3223758 - RNA, 17 nt, Human
cuggaguucugguuccu

SEQ ID NO: 3223759 - RNA, 15 nt, Human
cuggaguucugguuc

SEQ ID NO: 3223760 - RNA, 21 nt, Human
cugcuuaccuacuuucuucag

SEQ ID NO: 3223761 - RNA, 12 nt, Human
cugcuuaauuca

SEQ ID NO: 3223762 - RNA, 13 nt, Human
cugcuuaauucaa

SEQ ID NO: 3223763 - RNA, 22 nt, Human
cuggaugcagccucacaguccu

SEQ ID NO: 3223764 - RNA, 22 nt, Human
cuggaugaguagcgcuauaguu

SEQ ID NO: 3223765 - RNA, 22 nt, Human
cuggaugccucauuaugucaac

SEQ ID NO: 3223766 - RNA, 13 nt, Human
cuggcccugugcc

SEQ ID NO: 3223767 - RNA, 12 nt, Human
cuggcccuuccu

SEQ ID NO: 3223768 - RNA, 23 nt, Human
cuggcucacacuuggcucugagg

SEQ ID NO: 3223769 - RNA, 15 nt, Human
cugggacuacaggca

SEQ ID NO: 3223770 - RNA, 13 nt, Human
cugggacuacagg

SEQ ID NO: 3223771 - RNA, 21 nt, Human
cugggaccacaggugcccgcc

SEQ ID NO: 3223772 - RNA, 14 nt, Human
cuggcucuacacau

SEQ ID NO: 3223773 - RNA, 13 nt, Human
cuggcucuacaca

SEQ ID NO: 3223774 - RNA, 18 nt, Human
cugggacaugggaaaggg

SEQ ID NO: 3223775 - RNA, 22 nt, Human
cugggacaugggaaaggggaag

SEQ ID NO: 3223776 - RNA, 14 nt, Human
cugggacaugggaa

SEQ ID NO: 3223777 - RNA, 17 nt, Human
cugggacagggagcagc

SEQ ID NO: 3223778 - RNA, 16 nt, Human
cuggcucuacacauau

SEQ ID NO: 3223779 - RNA, 20 nt, Human
cugggcagguuggugggggc

SEQ ID NO: 3223780 - RNA, 20 nt, Human
cugggcagaggaaagcaaag

SEQ ID NO: 3223781 - RNA, 13 nt, Human
cugggcagaggaa

SEQ ID NO: 3223782 - RNA, 16 nt, Human
cugggcagaggaaagc

SEQ ID NO: 3223783 - RNA, 12 nt, Human
cugggcagagga

SEQ ID NO: 3223784 - RNA, 13 nt, Human
cuggggagaaagu

SEQ ID NO: 3223785 - RNA, 22 nt, Human
cuggggaccagcuuggcucagg

SEQ ID NO: 3223786 - RNA, 23 nt, Human
cugggcccacccaagcaggaggc

SEQ ID NO: 3223787 - RNA, 21 nt, Human
cugggcccacccaagcaggag

SEQ ID NO: 3223788 - RNA, 18 nt, Human
cugggcccacccaagcag

SEQ ID NO: 3223789 - RNA, 15 nt, Human
cugggcccacauccg

SEQ ID NO: 3223790 - RNA, 18 nt, Human
cuggguggcaccagcagc

SEQ ID NO: 3223791 - RNA, 20 nt, Human
cuggguggcaccagcagccu

SEQ ID NO: 3223792 - RNA, 17 nt, Human
cuggggcgcgugaggcc

SEQ ID NO: 3223793 - RNA, 13 nt, Human
cugggugcaggag

SEQ ID NO: 3223794 - RNA, 22 nt, Human
cugggugcaggagcgcucccuu

SEQ ID NO: 3223795 - RNA, 14 nt, Human
cugggugcaggagc

SEQ ID NO: 3223796 - RNA, 15 nt, Human
cuggguguggcgcag

SEQ ID NO: 3223797 - RNA, 14 nt, Human
cuggguguggcgca

SEQ ID NO: 3223798 - RNA, 21 nt, Human
cuggguggcaccagcagccug

SEQ ID NO: 3223799 - RNA, 12 nt, Human
cuggugccucac

SEQ ID NO: 3223800 - RNA, 21 nt, Human
cuggugccucaccccuugcca

SEQ ID NO: 3223801 - RNA, 16 nt, Human
gacacagcucuucucc

SEQ ID NO: 3223802 - RNA, 14 nt, Human
gacacagcucuucu

SEQ ID NO: 3223803 - RNA, 13 nt, Human
gacacagcucuuc

SEQ ID NO: 3223804 - RNA, 23 nt, Human
gacacagcucuucuccaggcugu

SEQ ID NO: 3223805 - RNA, 22 nt, Human
gacacagcucuucuccaggcug

SEQ ID NO: 3223806 - RNA, 21 nt, Human
gacagaaagcagaacagugau

SEQ ID NO: 3223807 - RNA, 17 nt, Human
gacagcccgggcucugc

SEQ ID NO: 3223808 - RNA, 15 nt, Human
gacagugaauuuggg

SEQ ID NO: 3223809 - RNA, 18 nt, Human
gacagcccgggcucugcc

SEQ ID NO: 3223810 - RNA, 19 nt, Human
gacagcccgggcucugccu

SEQ ID NO: 3223811 - RNA, 21 nt, Human
gacagugagacucugucucag

SEQ ID NO: 3223812 - RNA, 18 nt, Human
gacauugauuugauuuuu

SEQ ID NO: 3223813 - RNA, 19 nt, Human
gacauuguagagcuucugg

SEQ ID NO: 3223814 - RNA, 15 nt, Human
gacauugcggacagc

SEQ ID NO: 3223815 - RNA, 14 nt, Human
gacauugcggacag

SEQ ID NO: 3223816 - RNA, 19 nt, Human
gacauuguuggccaaagcc

SEQ ID NO: 3223817 - RNA, 14 nt, Human
gacauuuagaagaa

SEQ ID NO: 3223818 - RNA, 15 nt, Human
gacauuuagaagaaa

SEQ ID NO: 3223819 - RNA, 17 nt, Human
gacauuucuaauuccug

SEQ ID NO: 3223820 - RNA, 18 nt, Human
gaccagggauuuccauga

SEQ ID NO: 3223821 - RNA, 17 nt, Human
gaccagcuuggcucagg

SEQ ID NO: 3223822 - RNA, 12 nt, Human
gaccaucccuga

SEQ ID NO: 3223823 - RNA, 13 nt, Human
gaccaucccugaa

SEQ ID NO: 3223824 - RNA, 18 nt, Human
gaccaucccugaaggccc

SEQ ID NO: 3223825 - RNA, 19 nt, Human
gaccaucccugaaggcccc

SEQ ID NO: 3223826 - RNA, 20 nt, Human
gaccagggauuuccaugaug

SEQ ID NO: 3223827 - RNA, 23 nt, Human
gaccagggacagauccagcaggc

SEQ ID NO: 3223828 - RNA, 13 nt, Human
gaccauacuaauu

SEQ ID NO: 3223829 - RNA, 23 nt, Human
gaccaucauuucaccugcugcuu

SEQ ID NO: 3223830 - RNA, 19 nt, Human
gacuguggguuuguggggg

SEQ ID NO: 3223831 - RNA, 21 nt, Human
gacuguggguuugugggggga

SEQ ID NO: 3223832 - RNA, 19 nt, Human
gacugugauuugaauccag

SEQ ID NO: 3223833 - RNA, 16 nt, Human
gacuguggagacugcu

SEQ ID NO: 3223834 - RNA, 19 nt, Human
gacuguggagacugcuccu

SEQ ID NO: 3223835 - RNA, 18 nt, Human
gacuguggagacugcucc

SEQ ID NO: 3223836 - RNA, 14 nt, Human
gacuuguuuuuguu

SEQ ID NO: 3223837 - RNA, 23 nt, Human
gacuguacuccucccaggcgccc

SEQ ID NO: 3223838 - RNA, 18 nt, Human
gacuguacuccucccagg

SEQ ID NO: 3223839 - RNA, 13 nt, Human
gacugaauuccaa

SEQ ID NO: 3223840 - RNA, 12 nt, Human
gacugaauucca

SEQ ID NO: 3223841 - RNA, 16 nt, Human
gacucagaaacuccau

SEQ ID NO: 3223842 - RNA, 15 nt, Human
gacucagaaacucca

SEQ ID NO: 3223843 - RNA, 15 nt, Human
gacucaccuccccca

SEQ ID NO: 3223844 - RNA, 22 nt, Human
gacucaccucccccaucucuuc

SEQ ID NO: 3223845 - RNA, 12 nt, Human
gacucugccucc

SEQ ID NO: 3223846 - RNA, 16 nt, Human
gacucuugaguuguuu

SEQ ID NO: 3223847 - RNA, 18 nt, Human
gacucuugacucuugccu

SEQ ID NO: 3223848 - RNA, 10 nt, Human
gacucuuccc

SEQ ID NO: 3223849 - RNA, 19 nt, Human
gacucugucucaaaaaaac

SEQ ID NO: 3223850 - RNA, 15 nt, Human
gacuuuagcuuucug

SEQ ID NO: 3223851 - RNA, 22 nt, Human
gacuuuagccuaccuaacccag

SEQ ID NO: 3223852 - RNA, 11 nt, Human
gacuuuauaaa

SEQ ID NO: 3223853 - RNA, 15 nt, Human
gacuuuauuauuuau

SEQ ID NO: 3223854 - RNA, 21 nt, Human
gacuuucaaaguggaugcaau

SEQ ID NO: 3223855 - RNA, 13 nt, Human
gacuuuauuauuu

SEQ ID NO: 3223856 - RNA, 14 nt, Human
gacuuuauuauuua

SEQ ID NO: 3223857 - RNA, 11 nt, Human
gacuuuauuag

SEQ ID NO: 3223858 - RNA, 11 nt, Human
gaccugaggcc

SEQ ID NO: 3223859 - RNA, 13 nt, Human
gaccugaggcccu

SEQ ID NO: 3223860 - RNA, 16 nt, Human
gacgccaucccagccc

SEQ ID NO: 3223861 - RNA, 18 nt, Human
gaccucuagcccugcccg

SEQ ID NO: 3223862 - RNA, 13 nt, Human
gaccucugccuga

SEQ ID NO: 3223863 - RNA, 20 nt, Human
gaccaucccugaaggccccg

SEQ ID NO: 3223864 - RNA, 19 nt, Human
gaccaucuggaauugguuu

SEQ ID NO: 3223865 - RNA, 15 nt, Human
gacgcucucuggccu

SEQ ID NO: 3223866 - RNA, 16 nt, Human
gacgcuacccgggaag

SEQ ID NO: 3223867 - RNA, 18 nt, Human
gacgcuacccgggaaggg

SEQ ID NO: 3223868 - RNA, 17 nt, Human
gacgccaucccagcccc

SEQ ID NO: 3223869 - RNA, 18 nt, Human
gacgccaucccagcccca

SEQ ID NO: 3223870 - RNA, 15 nt, Human
gacgccaucccagcc

SEQ ID NO: 3223871 - RNA, 22 nt, Human
gaccugaggacauggcuucuga

SEQ ID NO: 3223872 - RNA, 19 nt, Human
gaccugaggacauggcuuc

SEQ ID NO: 3223873 - RNA, 16 nt, Human
gacgcucucuggccuu

SEQ ID NO: 3223874 - RNA, 17 nt, Human
gacgcucucuggccuuc

SEQ ID NO: 3223875 - RNA, 22 nt, Human
gaagcaagaggcaagcugaaau

SEQ ID NO: 3223876 - RNA, 23 nt, Human
gaagcaagaggcaagcugaaauu

SEQ ID NO: 3223877 - RNA, 23 nt, Human
gaagcaacccaaauguucaucaa

SEQ ID NO: 3223878 - RNA, 17 nt, Human
gaagcacaugccucucu

SEQ ID NO: 3223879 - RNA, 20 nt, Human
gaagcacaugccucucucag

SEQ ID NO: 3223880 - RNA, 15 nt, Human
gaagcacaugccucu

SEQ ID NO: 3223881 - RNA, 22 nt, Human
gaagcacaccaaucuuacuuug

SEQ ID NO: 3223882 - RNA, 23 nt, Human
gaagauuuugaaauuuuuauuaa

SEQ ID NO: 3223883 - RNA, 23 nt, Human
gaagacaaugugaaaagaaaaau

SEQ ID NO: 3223884 - RNA, 14 nt, Human
gaagcacaugccuc

SEQ ID NO: 3223885 - RNA, 15 nt, Human
gaagcagaggaagga

SEQ ID NO: 3223886 - RNA, 17 nt, Human
gaacugcugggcuuggc

SEQ ID NO: 3223887 - RNA, 20 nt, Human
gaacugcugggcuuggcagc

SEQ ID NO: 3223888 - RNA, 16 nt, Human
gaacugcuuucuuucg

SEQ ID NO: 3223889 - RNA, 18 nt, Human
gaacugacauuaaaauaa

SEQ ID NO: 3223890 - RNA, 16 nt, Human
gaacucugccugcccu

SEQ ID NO: 3223891 - RNA, 20 nt, Human
gaacucgguguccccaccau

SEQ ID NO: 3223892 - RNA, 12 nt, Human
gaacuggcugca

SEQ ID NO: 3223893 - RNA, 11 nt, Human
gaacuggcugc

SEQ ID NO: 3223894 - RNA, 14 nt, Human
gaagaauauuguau

SEQ ID NO: 3223895 - RNA, 15 nt, Human
gaagaauauuguauu

SEQ ID NO: 3223896 - RNA, 15 nt, Human
gaagaauagggccca

SEQ ID NO: 3223897 - RNA, 23 nt, Human
gaagaauagggcccaugggaggg

SEQ ID NO: 3223898 - RNA, 19 nt, Human
gaacugggcauauuucuaa

SEQ ID NO: 3223899 - RNA, 16 nt, Human
gaacugggcauauuuc

SEQ ID NO: 3223900 - RNA, 13 nt, Human
gaagaauuuaaag

SEQ ID NO: 3223901 - RNA, 13 nt, Human
gaagaauuugaag

SEQ ID NO: 3223902 - RNA, 14 nt, Human
gaagaauuugaaga

SEQ ID NO: 3223903 - RNA, 12 nt, Human
gaagaauuuaaa

SEQ ID NO: 3223904 - RNA, 14 nt, Human
gaagaaugaagccc

SEQ ID NO: 3223905 - RNA, 14 nt, Human
gaagaaugcaugcu

SEQ ID NO: 3223906 - RNA, 20 nt, Human
gaagaaugcaugcuuuccau

SEQ ID NO: 3223907 - RNA, 15 nt, Human
gaacuccuggccuca

SEQ ID NO: 3223908 - RNA, 20 nt, Human
gaacucugacaacagacuuc

SEQ ID NO: 3223909 - RNA, 17 nt, Human
gaacucgguguccccac

SEQ ID NO: 3223910 - RNA, 19 nt, Human
gaacccgggaggcagaggu

SEQ ID NO: 3223911 - RNA, 21 nt, Human
gaagugugggucugugugugu

SEQ ID NO: 3223912 - RNA, 24 nt, Human
gaagugugggucugugugugugua

SEQ ID NO: 3223913 - RNA, 18 nt, Human
gaaggggacugccaccuc

SEQ ID NO: 3223914 - RNA, 19 nt, Human
gaaggggacugccaccucc

SEQ ID NO: 3223915 - RNA, 22 nt, Human
gaaggggagauaaggguaucug

SEQ ID NO: 3223916 - RNA, 15 nt, Human
gaaggggacugccac

SEQ ID NO: 3223917 - RNA, 22 nt, Human
gaaguuagccuuuaucuaccaa

SEQ ID NO: 3223918 - RNA, 21 nt, Human
gaaguuagccuuuaucuacca

SEQ ID NO: 3223919 - RNA, 18 nt, Human
gaaguuagccuuuaucua

SEQ ID NO: 3223920 - RNA, 11 nt, Human
gaaguuagccu

SEQ ID NO: 3223921 - RNA, 21 nt, Human
gaaguuacuguuacuugauaa

SEQ ID NO: 3223922 - RNA, 12 nt, Human
gaaguuaaaggg

SEQ ID NO: 3223923 - RNA, 20 nt, Human
gaaguuaaaagcacaaagga

SEQ ID NO: 3223924 - RNA, 21 nt, Human
gaaguuaaagggaagaaaaca

SEQ ID NO: 3223925 - RNA, 15 nt, Human
gaaguuaaagggaag

SEQ ID NO: 3223926 - RNA, 17 nt, Human
gaaguucugccucugau

SEQ ID NO: 3223927 - RNA, 21 nt, Human
gaaguugacucugcucuugca

SEQ ID NO: 3223928 - RNA, 14 nt, Human
gaaguucuuugauu

SEQ ID NO: 3223929 - RNA, 18 nt, Human
gaaguucugccucugaug

SEQ ID NO: 3223930 - RNA, 15 nt, Human
gaaguucaagaucaa

SEQ ID NO: 3223931 - RNA, 20 nt, Human
gaaguuauguguaugugagu

SEQ ID NO: 3223932 - RNA, 16 nt, Human
gaaguuauguguaugu

SEQ ID NO: 3223933 - RNA, 15 nt, Human
gaaguuaguggaaau

SEQ ID NO: 3223934 - RNA, 21 nt, Human
gaaguuauauuuccuauacca

SEQ ID NO: 3223935 - RNA, 13 nt, Human
gaaguuauauuuc

SEQ ID NO: 3223936 - RNA, 16 nt, Human
gaaguugaucucccca

SEQ ID NO: 3223937 - RNA, 14 nt, Human
gaaguuuaaauauu

SEQ ID NO: 3223938 - RNA, 19 nt, Human
gaauagggcuaggaauaua

SEQ ID NO: 3223939 - RNA, 13 nt, Human
gaauauaaaaaau

SEQ ID NO: 3223940 - RNA, 14 nt, Human
gaauaguauugugu

SEQ ID NO: 3223941 - RNA, 13 nt, Human
gaauauuaaaaaa

SEQ ID NO: 3223942 - RNA, 14 nt, Human
gaauauuaaaaaac

SEQ ID NO: 3223943 - RNA, 16 nt, Human
gaauauuauauuugga

SEQ ID NO: 3223944 - RNA, 13 nt, Human
gaauauuauauuu

SEQ ID NO: 3223945 - RNA, 20 nt, Human
gaauauuagugaccucagcu

SEQ ID NO: 3223946 - RNA, 14 nt, Human
gaauauugcugaug

SEQ ID NO: 3223947 - RNA, 15 nt, Human
gaauauugcugaugg

SEQ ID NO: 3223948 - RNA, 21 nt, Human
gaauaugggagaaauagugug

SEQ ID NO: 3223949 - RNA, 18 nt, Human
gaauaugggagaaauagu

SEQ ID NO: 3223950 - RNA, 13 nt, Human
gaauauaaaugug

SEQ ID NO: 3223951 - RNA, 14 nt, Human
gaauauaaaugugu

SEQ ID NO: 3223952 - RNA, 17 nt, Human
gaauauaaaugugugua

SEQ ID NO: 3223953 - RNA, 19 nt, Human
gaauauugcugauggugca

SEQ ID NO: 3223954 - RNA, 23 nt, Human
gaauauuguauuguuagauguuu

SEQ ID NO: 3223955 - RNA, 24 nt, Human
gaauauuauauuuggaugcagagu

SEQ ID NO: 3223956 - RNA, 19 nt, Human
gaauauuauauuuggaugc

SEQ ID NO: 3223957 - RNA, 19 nt, Human
gaagcuccgcuuucuaccc

SEQ ID NO: 3223958 - RNA, 17 nt, Human
gaaggccccgcccaggc

SEQ ID NO: 3223959 - RNA, 22 nt, Human
gaagcuccgcuuucuacccagc

SEQ ID NO: 3223960 - RNA, 15 nt, Human
gaaggcuggguucug

SEQ ID NO: 3223961 - RNA, 19 nt, Human
gaaggcuggguucugaucc

SEQ ID NO: 3223962 - RNA, 19 nt, Human
gaaggcucgagcaugccug

SEQ ID NO: 3223963 - RNA, 18 nt, Human
gaaggccccgcccaggcu

SEQ ID NO: 3223964 - RNA, 19 nt, Human
gaaggccccgcccaggcuu

SEQ ID NO: 3223965 - RNA, 21 nt, Human
gaaggcucgagcaugccugga

SEQ ID NO: 3223966 - RNA, 20 nt, Human
gaaggcuggguucugauccu

SEQ ID NO: 3223967 - RNA, 22 nt, Human
gaaggcuggguucugauccuag

SEQ ID NO: 3223968 - RNA, 17 nt, Human
gauuauggaaaaauaaa

SEQ ID NO: 3223969 - RNA, 18 nt, Human
gauuauggaaaaauaaaa

SEQ ID NO: 3223970 - RNA, 20 nt, Human
gauuauggaaaaauaaaacu

SEQ ID NO: 3223971 - RNA, 20 nt, Human
gauuauaggcaccuaccacc

SEQ ID NO: 3223972 - RNA, 18 nt, Human
gauuauauaucccugaua

SEQ ID NO: 3223973 - RNA, 20 nt, Human
gauguauguugaagccuuug

SEQ ID NO: 3223974 - RNA, 21 nt, Human
gauguauguugaagccuuugu

SEQ ID NO: 3223975 - RNA, 16 nt, Human
gauguauuuugugagu

SEQ ID NO: 3223976 - RNA, 15 nt, Human
gauguauuuugugag

SEQ ID NO: 3223977 - RNA, 21 nt, Human
gauguauuuugugaguuuguu

SEQ ID NO: 3223978 - RNA, 12 nt, Human
gauuauuggaaa

SEQ ID NO: 3223979 - RNA, 21 nt, Human
gauuauugaguuccaguugaa

SEQ ID NO: 3223980 - RNA, 14 nt, Human
gauucugagagcug

SEQ ID NO: 3223981 - RNA, 14 nt, Human
gauucuccugccuc

SEQ ID NO: 3223982 - RNA, 18 nt, Human
gauucuccugccucagcc

SEQ ID NO: 3223983 - RNA, 17 nt, Human
gauucuccugccucagc

SEQ ID NO: 3223984 - RNA, 15 nt, Human
gauucuccugccuca

SEQ ID NO: 3223985 - RNA, 15 nt, Human
gauuuauacucauuu

SEQ ID NO: 3223986 - RNA, 20 nt, Human
gauuuuuuacagcugccugc

SEQ ID NO: 3223987 - RNA, 12 nt, Human
gauuuauuaacu

SEQ ID NO: 3223988 - RNA, 18 nt, Human
gauucuuccucccucccu

SEQ ID NO: 3223989 - RNA, 17 nt, Human
gauucuuccucccuccc

SEQ ID NO: 3223990 - RNA, 17 nt, Human
gauguagaggagaaacu

SEQ ID NO: 3223991 - RNA, 18 nt, Human
gauguagaggagaaacug

SEQ ID NO: 3223992 - RNA, 21 nt, Human
gauguagcaaacccugucaaa

SEQ ID NO: 3223993 - RNA, 17 nt, Human
gauguagauuuauuuca

SEQ ID NO: 3223994 - RNA, 15 nt, Human
gauguagauuuauuu

SEQ ID NO: 3223995 - RNA, 14 nt, Human
gauguagauuuauu

SEQ ID NO: 3223996 - RNA, 12 nt, Human
gauguaaagaug

SEQ ID NO: 3223997 - RNA, 14 nt, Human
gaugauccuaggca

SEQ ID NO: 3223998 - RNA, 20 nt, Human
gauggaauuuuuuuguacga

SEQ ID NO: 3223999 - RNA, 16 nt, Human
gaugaucuuuaaaaua

SEQ ID NO: 3224000 - RNA, 21 nt, Human
gaugaucuaggaagacuuugg

SEQ ID NO: 3224001 - RNA, 15 nt, Human
gaugaucuaggaaga

SEQ ID NO: 3224002 - RNA, 19 nt, Human
gaugaguuuugggaaguua

SEQ ID NO: 3224003 - RNA, 19 nt, Human
gaugaggucaguuguguuu

SEQ ID NO: 3224004 - RNA, 12 nt, Human
gaucugcugcag

SEQ ID NO: 3224005 - RNA, 23 nt, Human
gauuuuuuuucccauuuagaaug

SEQ ID NO: 3224006 - RNA, 17 nt, Human
gcaauauauuuuguaug

SEQ ID NO: 3224007 - RNA, 15 nt, Human
gcaauauauuuugua

SEQ ID NO: 3224008 - RNA, 14 nt, Human
gcaauauauuuugu

SEQ ID NO: 3224009 - RNA, 12 nt, Human
gcaauauauuuu

SEQ ID NO: 3224010 - RNA, 19 nt, Human
gcaagugagagcugggugu

SEQ ID NO: 3224011 - RNA, 19 nt, Human
gcaagugugaauacugcuu

SEQ ID NO: 3224012 - RNA, 13 nt, Human
gcaagugugaaua

SEQ ID NO: 3224013 - RNA, 16 nt, Human
gcaagugugaauacug

SEQ ID NO: 3224014 - RNA, 23 nt, Human
gcacaguuuucugagaaagacua

SEQ ID NO: 3224015 - RNA, 23 nt, Human
gcacauagaaaguaaauaaaagg

SEQ ID NO: 3224016 - RNA, 22 nt, Human
gcacaguuuucugagaaagacu

SEQ ID NO: 3224017 - RNA, 20 nt, Human
gcacaguuuucugagaaaga

SEQ ID NO: 3224018 - RNA, 21 nt, Human
gcacagugcaucucagcccac

SEQ ID NO: 3224019 - RNA, 20 nt, Human
gcacagugcaucucagccca

SEQ ID NO: 3224020 - RNA, 19 nt, Human
gcacagugcaucucagccc

SEQ ID NO: 3224021 - RNA, 22 nt, Human
gcacaagcugcacccucaggca

SEQ ID NO: 3224022 - RNA, 14 nt, Human
gcaauauucucugu

SEQ ID NO: 3224023 - RNA, 20 nt, Human
gcaauauauuuuguaugcaa

SEQ ID NO: 3224024 - RNA, 19 nt, Human
gcaauaucuucguuaguaa

SEQ ID NO: 3224025 - RNA, 20 nt, Human
gcaauaucuucguuaguaau

SEQ ID NO: 3224026 - RNA, 19 nt, Human
gcaauauauuuuguaugca

SEQ ID NO: 3224027 - RNA, 18 nt, Human
gcaauauauuuuguaugc

SEQ ID NO: 3224028 - RNA, 19 nt, Human
gcaauauucucuguacaua

SEQ ID NO: 3224029 - RNA, 17 nt, Human
gcaauauucucuguaca

SEQ ID NO: 3224030 - RNA, 14 nt, Human
gcacaccgggcacu

SEQ ID NO: 3224031 - RNA, 20 nt, Human
gcacaccaaucuuacuuugu

SEQ ID NO: 3224032 - RNA, 21 nt, Human
gcacaccaaucuuacuuugua

SEQ ID NO: 3224033 - RNA, 22 nt, Human
gcacaccaaucuuacuuuguaa

SEQ ID NO: 3224034 - RNA, 16 nt, Human
gcacaccaaucuuacu

SEQ ID NO: 3224035 - RNA, 17 nt, Human
gcacaccaaucuuacuu

SEQ ID NO: 3224036 - RNA, 17 nt, Human
gcacuccccugcugggu

SEQ ID NO: 3224037 - RNA, 16 nt, Human
gcacucagaagacacu

SEQ ID NO: 3224038 - RNA, 13 nt, Human
gcacucagaagac

SEQ ID NO: 3224039 - RNA, 22 nt, Human
gcacuccccugcuggguguggc

SEQ ID NO: 3224040 - RNA, 16 nt, Human
gcacuccccugcuggg

SEQ ID NO: 3224041 - RNA, 16 nt, Human
gcacuugcagacucua

SEQ ID NO: 3224042 - RNA, 23 nt, Human
gcaccgggccacagagaaaguac

SEQ ID NO: 3224043 - RNA, 21 nt, Human
gcaccuaccaccacgcccggc

SEQ ID NO: 3224044 - RNA, 18 nt, Human
gcaccuaccaccacgccc

SEQ ID NO: 3224045 - RNA, 22 nt, Human
gcaccuaccaccacgcccggcu

SEQ ID NO: 3224046 - RNA, 14 nt, Human
gcaccgggccacag

SEQ ID NO: 3224047 - RNA, 20 nt, Human
gaguuggaguagaauguagu

SEQ ID NO: 3224048 - RNA, 17 nt, Human
gaguuggaguagaaugu

SEQ ID NO: 3224049 - RNA, 18 nt, Human
gaguugauucagcucugc

SEQ ID NO: 3224050 - RNA, 21 nt, Human
gaguuuaaaaaugguaucaaa

SEQ ID NO: 3224051 - RNA, 13 nt, Human
gaguuguuuuugu

SEQ ID NO: 3224052 - RNA, 14 nt, Human
gaguuguuuuugua

SEQ ID NO: 3224053 - RNA, 16 nt, Human
gaguuguuuuuguaua

SEQ ID NO: 3224054 - RNA, 18 nt, Human
gaguuguuuuuguauauu

SEQ ID NO: 3224055 - RNA, 23 nt, Human
gaggugaccccagguuucuaugu

SEQ ID NO: 3224056 - RNA, 17 nt, Human
gaggugaaaaggccaag

SEQ ID NO: 3224057 - RNA, 16 nt, Human
gaggugaaaaggccaa

SEQ ID NO: 3224058 - RNA, 15 nt, Human
gaggugaaaaggcca

SEQ ID NO: 3224059 - RNA, 15 nt, Human
gaggucgaggcagga

SEQ ID NO: 3224060 - RNA, 20 nt, Human
gagguggaagagggcugcaa

SEQ ID NO: 3224061 - RNA, 17 nt, Human
gagguggaagagggcug

SEQ ID NO: 3224062 - RNA, 17 nt, Human
gagucaccaagcccagu

SEQ ID NO: 3224063 - RNA, 16 nt, Human
gagucaccaagcccag

SEQ ID NO: 3224064 - RNA, 15 nt, Human
gagucaccaagccca

SEQ ID NO: 3224065 - RNA, 18 nt, Human
gagucagggagagcugaa

SEQ ID NO: 3224066 - RNA, 16 nt, Human
gagucagcuguuucua

SEQ ID NO: 3224067 - RNA, 20 nt, Human
gagucagccucgcaggccuc

SEQ ID NO: 3224068 - RNA, 22 nt, Human
gagucagaaguuucugccgcag

SEQ ID NO: 3224069 - RNA, 15 nt, Human
gagucagcuguuucu

SEQ ID NO: 3224070 - RNA, 18 nt, Human
gagugacagaggcagccc

SEQ ID NO: 3224071 - RNA, 17 nt, Human
gagugacagaggcagcc

SEQ ID NO: 3224072 - RNA, 12 nt, Human
gagucccaccuu

SEQ ID NO: 3224073 - RNA, 20 nt, Human
gagugacagaggcagcccca

SEQ ID NO: 3224074 - RNA, 15 nt, Human
gagugcaggcccacc

SEQ ID NO: 3224075 - RNA, 19 nt, Human
gaguggacuguucccugag

SEQ ID NO: 3224076 - RNA, 14 nt, Human
gagugcaggcccac

SEQ ID NO: 3224077 - RNA, 13 nt, Human
gagugcaggccca

SEQ ID NO: 3224078 - RNA, 23 nt, Human
gagugcaaaaggcuugcagaacu

SEQ ID NO: 3224079 - RNA, 15 nt, Human
gaguugauucagcuc

SEQ ID NO: 3224080 - RNA, 16 nt, Human
gaguugauucagcucu

SEQ ID NO: 3224081 - RNA, 17 nt, Human
gaguugauucagcucug

SEQ ID NO: 3224082 - RNA, 22 nt, Human
gaguugauagcacagacccugc

SEQ ID NO: 3224083 - RNA, 20 nt, Human
gaguggagguuuauaguuaa

SEQ ID NO: 3224084 - RNA, 16 nt, Human
gagcuggacucccuca

SEQ ID NO: 3224085 - RNA, 21 nt, Human
gagcuggacaguggagugcaa

SEQ ID NO: 3224086 - RNA, 18 nt, Human
gagcugcuuuuuuugaaa

SEQ ID NO: 3224087 - RNA, 16 nt, Human
gagcugcuuuuuuuga

SEQ ID NO: 3224088 - RNA, 13 nt, Human
gagcugcuucccc

SEQ ID NO: 3224089 - RNA, 15 nt, Human
gagcugcugccauga

SEQ ID NO: 3224090 - RNA, 23 nt, Human
gagccuuccaggggugggacacc

SEQ ID NO: 3224091 - RNA, 21 nt, Human
gagcgcccacuagacccacug

SEQ ID NO: 3224092 - RNA, 12 nt, Human
gagcgcagcccg

SEQ ID NO: 3224093 - RNA, 22 nt, Human
gagcgcagccgccuucacagca

SEQ ID NO: 3224094 - RNA, 14 nt, Human
gagcgcagccgccu

SEQ ID NO: 3224095 - RNA, 20 nt, Human
gagccuuccaggggugggac

SEQ ID NO: 3224096 - RNA, 18 nt, Human
gaggcugcagccaggcca

SEQ ID NO: 3224097 - RNA, 16 nt, Human
gaggcucaaauuuuga

SEQ ID NO: 3224098 - RNA, 15 nt, Human
gaggcucaaauuuug

SEQ ID NO: 3224099 - RNA, 14 nt, Human
gaggcucagauugu

SEQ ID NO: 3224100 - RNA, 19 nt, Human
gaggcuccacuuggucugu

SEQ ID NO: 3224101 - RNA, 18 nt, Human
gaggcuccacuuggucug

SEQ ID NO: 3224102 - RNA, 23 nt, Human
gaggcuccacuuggucugugaga

SEQ ID NO: 3224103 - RNA, 13 nt, Human
gaggccagagaca

SEQ ID NO: 3224104 - RNA, 14 nt, Human
gaggccagagacac

SEQ ID NO: 3224105 - RNA, 22 nt, Human
gaggcuagugugguguuuccug

SEQ ID NO: 3224106 - RNA, 16 nt, Human
gaggcaguuugaggau

SEQ ID NO: 3224107 - RNA, 13 nt, Human
gaggccaccuccu

SEQ ID NO: 3224108 - RNA, 12 nt, Human
gaggccaccucc

SEQ ID NO: 3224109 - RNA, 11 nt, Human
gaggccaccuc

SEQ ID NO: 3224110 - RNA, 15 nt, Human
gaggccacugaagag

SEQ ID NO: 3224111 - RNA, 16 nt, Human
gaggccacugaagagg

SEQ ID NO: 3224112 - RNA, 17 nt, Human
gaggccacugaagagga

SEQ ID NO: 3224113 - RNA, 19 nt, Human
gaggccacugaagaggagg

SEQ ID NO: 3224114 - RNA, 12 nt, Human
gaggcagguccc

SEQ ID NO: 3224115 - RNA, 16 nt, Human
gaggcagguccccaga

SEQ ID NO: 3224116 - RNA, 13 nt, Human
gaggcaggucccc

SEQ ID NO: 3224117 - RNA, 22 nt, Human
gaggcagggucucacucugucg

SEQ ID NO: 3224118 - RNA, 15 nt, Human
gaggcagggucucac

SEQ ID NO: 3224119 - RNA, 15 nt, Human
gaggcaguuugagga

SEQ ID NO: 3224120 - RNA, 21 nt, Human
gaggcaguugcccagccucuu

SEQ ID NO: 3224121 - RNA, 20 nt, Human
gaggcaguugcccagccucu

SEQ ID NO: 3224122 - RNA, 18 nt, Human
gaggcaguugcccagccu

SEQ ID NO: 3224123 - RNA, 15 nt, Human
gaggcaguugcccag

SEQ ID NO: 3224124 - RNA, 21 nt, Human
gaggcaguucgaccagccagg

SEQ ID NO: 3224125 - RNA, 17 nt, Human
gaggccaaggugggagg

SEQ ID NO: 3224126 - RNA, 22 nt, Human
gaggccaaggugggaggauugc

SEQ ID NO: 3224127 - RNA, 15 nt, Human
gaggacgcucucugg

SEQ ID NO: 3224128 - RNA, 14 nt, Human
gaggcagggucuca

SEQ ID NO: 3224129 - RNA, 13 nt, Human
gaggaccugcccg

SEQ ID NO: 3224130 - RNA, 14 nt, Human
ggaggcugacuccu

SEQ ID NO: 3224131 - RNA, 17 nt, Human
ggaggcugacuccuggu

SEQ ID NO: 3224132 - RNA, 15 nt, Human
ggaggcugagauggg

SEQ ID NO: 3224133 - RNA, 19 nt, Human
ggaggcugagaugggagaa

SEQ ID NO: 3224134 - RNA, 15 nt, Human
ggaggucgaggcagg

SEQ ID NO: 3224135 - RNA, 16 nt, Human
ggaggucgaggcagga

SEQ ID NO: 3224136 - RNA, 14 nt, Human
ggaggucgaggcag

SEQ ID NO: 3224137 - RNA, 18 nt, Human
ggaggucgaggcaggagg

SEQ ID NO: 3224138 - RNA, 17 nt, Human
ggaggugugaggcagga

SEQ ID NO: 3224139 - RNA, 15 nt, Human
ggaggugugaggcag

SEQ ID NO: 3224140 - RNA, 23 nt, Human
ggagcccauuuggagggccuggg

SEQ ID NO: 3224141 - RNA, 18 nt, Human
ggagcccauuuggagggc

SEQ ID NO: 3224142 - RNA, 22 nt, Human
ggagcccauuuggagggccugg

SEQ ID NO: 3224143 - RNA, 21 nt, Human
ggagcccauuuggagggccug

SEQ ID NO: 3224144 - RNA, 22 nt, Human
ggagcugccuguucagcuccag

SEQ ID NO: 3224145 - RNA, 17 nt, Human
ggagcuggaguccacug

SEQ ID NO: 3224146 - RNA, 13 nt, Human
ggaggccaucugg

SEQ ID NO: 3224147 - RNA, 12 nt, Human
ggaggccaucug

SEQ ID NO: 3224148 - RNA, 22 nt, Human
ggaggcccagcgcggacauccc

SEQ ID NO: 3224149 - RNA, 17 nt, Human
ggaggccaucuggagag

SEQ ID NO: 3224150 - RNA, 21 nt, Human
ggaggcccagcgcggacaucc

SEQ ID NO: 3224151 - RNA, 12 nt, Human
ggaggccagccu

SEQ ID NO: 3224152 - RNA, 18 nt, Human
ggaggccaaggugggagg

SEQ ID NO: 3224153 - RNA, 13 nt, Human
ggaggccagccuu

SEQ ID NO: 3224154 - RNA, 11 nt, Human
ggaggccaaga

SEQ ID NO: 3224155 - RNA, 23 nt, Human
ggaggccaagaguggccccaccu

SEQ ID NO: 3224156 - RNA, 22 nt, Human
ggaggccaagaguggccccacc

SEQ ID NO: 3224157 - RNA, 21 nt, Human
ggaggcaugugaugagaggaa

SEQ ID NO: 3224158 - RNA, 21 nt, Human
ggaggaagaacugaaaggcuu

SEQ ID NO: 3224159 - RNA, 14 nt, Human
ggaggaagaauagg

SEQ ID NO: 3224160 - RNA, 12 nt, Human
ggaggaagagaa

SEQ ID NO: 3224161 - RNA, 22 nt, Human
ggaggaaaaccaagccguggcu

SEQ ID NO: 3224162 - RNA, 21 nt, Human
ggaggaaaaccaagccguggc

SEQ ID NO: 3224163 - RNA, 20 nt, Human
ggaggaaaaccaagccgugg

SEQ ID NO: 3224164 - RNA, 18 nt, Human
ggagcaguaucaugaagc

SEQ ID NO: 3224165 - RNA, 13 nt, Human
ggagcagccacau

SEQ ID NO: 3224166 - RNA, 21 nt, Human
ggagcagccacauuccugaug

SEQ ID NO: 3224167 - RNA, 18 nt, Human
ggaccccuggugguucac

SEQ ID NO: 3224168 - RNA, 20 nt, Human
ggaccccaucugugaauaag

SEQ ID NO: 3224169 - RNA, 14 nt, Human
ggaccccaucugug

SEQ ID NO: 3224170 - RNA, 18 nt, Human
ggaccccaucugugaaua

SEQ ID NO: 3224171 - RNA, 17 nt, Human
ggaccccaucugugaau

SEQ ID NO: 3224172 - RNA, 13 nt, Human
ggaccccagccuc

SEQ ID NO: 3224173 - RNA, 12 nt, Human
ggaccccagccu

SEQ ID NO: 3224174 - RNA, 15 nt, Human
ggaccccagccucaa

SEQ ID NO: 3224175 - RNA, 14 nt, Human
ggaccccagccuca

SEQ ID NO: 3224176 - RNA, 15 nt, Human
ggacccugaggccca

SEQ ID NO: 3224177 - RNA, 18 nt, Human
ggacccugaggcccagag

SEQ ID NO: 3224178 - RNA, 14 nt, Human
ggacccugaggccc

SEQ ID NO: 3224179 - RNA, 21 nt, Human
ggacccggaggggccuggcag

SEQ ID NO: 3224180 - RNA, 20 nt, Human
ggacccggaggggccuggca

SEQ ID NO: 3224181 - RNA, 16 nt, Human
ggacccuccaaggcca

SEQ ID NO: 3224182 - RNA, 16 nt, Human
ggacuuggagguagcu

SEQ ID NO: 3224183 - RNA, 17 nt, Human
ggacuuggaagcuccgc

SEQ ID NO: 3224184 - RNA, 15 nt, Human
ggacuuggaagcucc

SEQ ID NO: 3224185 - RNA, 11 nt, Human
ggacuuccuga

SEQ ID NO: 3224186 - RNA, 19 nt, Human
ggagaaaauggacguguua

SEQ ID NO: 3224187 - RNA, 9 nt, Human
ggacuuugu

SEQ ID NO: 3224188 - RNA, 18 nt, Human
ggacuuuuauuuccagug

SEQ ID NO: 3224189 - RNA, 12 nt, Human
ggacuuuguuac

SEQ ID NO: 3224190 - RNA, 13 nt, Human
ggacuuuguuaca

SEQ ID NO: 3224191 - RNA, 22 nt, Human
ggagaaccaaaaagaggcuaug

SEQ ID NO: 3224192 - RNA, 13 nt, Human
ggagaaccaccua

SEQ ID NO: 3224193 - RNA, 16 nt, Human
ggagaaccaccuaccc

SEQ ID NO: 3224194 - RNA, 16 nt, Human
ggagacugucucaaga

SEQ ID NO: 3224195 - RNA, 22 nt, Human
ggagacugcugagucaacccaa

SEQ ID NO: 3224196 - RNA, 17 nt, Human
ggacuuagcugggagaa

SEQ ID NO: 3224197 - RNA, 12 nt, Human
ggacuuaggaag

SEQ ID NO: 3224198 - RNA, 20 nt, Human
ggacuacaggugugagucac

SEQ ID NO: 3224199 - RNA, 22 nt, Human
ggacucaaugcacugacauugu

SEQ ID NO: 3224200 - RNA, 16 nt, Human
ggacuaggguccuggg

SEQ ID NO: 3224201 - RNA, 18 nt, Human
ggacucaaugcacugaca

SEQ ID NO: 3224202 - RNA, 17 nt, Human
ggacucagaaacuccau

SEQ ID NO: 3224203 - RNA, 14 nt, Human
ggagagagacucca

SEQ ID NO: 3224204 - RNA, 22 nt, Human
ggagagccuuccagggguggga

SEQ ID NO: 3224205 - RNA, 17 nt, Human
ggagagccuuccagggg

SEQ ID NO: 3224206 - RNA, 18 nt, Human
ggagagccuuccaggggu

SEQ ID NO: 3224207 - RNA, 13 nt, Human
ggagagccuucca

SEQ ID NO: 3224208 - RNA, 16 nt, Human
ggagagccuuccaggg

SEQ ID NO: 3224209 - RNA, 15 nt, Human
ggagagcuagcagca

SEQ ID NO: 3224210 - RNA, 17 nt, Human
ggcagaaagcaaaauua

SEQ ID NO: 3224211 - RNA, 12 nt, Human
ggcagaaggaag

SEQ ID NO: 3224212 - RNA, 21 nt, Human
ggcagaaguaggggaagaaua

SEQ ID NO: 3224213 - RNA, 10 nt, Human
ggcaggcagg

SEQ ID NO: 3224214 - RNA, 11 nt, Human
ggcaggcaggg

SEQ ID NO: 3224215 - RNA, 23 nt, Human
ggcaggagacuguggagacugcu

SEQ ID NO: 3224216 - RNA, 22 nt, Human
ggcagccgugccuucagcucua

SEQ ID NO: 3224217 - RNA, 15 nt, Human
ggcaggaccagccca

SEQ ID NO: 3224218 - RNA, 14 nt, Human
ggcaggaccagccc

SEQ ID NO: 3224219 - RNA, 13 nt, Human
ggcaggaccagcc

SEQ ID NO: 3224220 - RNA, 19 nt, Human
ggcaggacacugcagaaca

SEQ ID NO: 3224221 - RNA, 19 nt, Human
ggcaggaccagcccacgcu

SEQ ID NO: 3224222 - RNA, 18 nt, Human
ggcaggaccagcccacgc

SEQ ID NO: 3224223 - RNA, 17 nt, Human
ggcaggaccagcccacg

SEQ ID NO: 3224224 - RNA, 16 nt, Human
ggcaggaccagcccac

SEQ ID NO: 3224225 - RNA, 14 nt, Human
ggcagccaggccac

SEQ ID NO: 3224226 - RNA, 10 nt, Human
ggcagagcag

SEQ ID NO: 3224227 - RNA, 15 nt, Human
ggcagccaggccaca

SEQ ID NO: 3224228 - RNA, 17 nt, Human
ggcagccaggccacaag

SEQ ID NO: 3224229 - RNA, 16 nt, Human
ggcagagaggcugugg

SEQ ID NO: 3224230 - RNA, 13 nt, Human
ggcagagcacagc

SEQ ID NO: 3224231 - RNA, 18 nt, Human
ggcagccgugccuucagc

SEQ ID NO: 3224232 - RNA, 21 nt, Human
ggcagccgugccuucagcucu

SEQ ID NO: 3224233 - RNA, 19 nt, Human
ggcagccgugccuucagcu

SEQ ID NO: 3224234 - RNA, 15 nt, Human
ggaugguguucaaaa

SEQ ID NO: 3224235 - RNA, 13 nt, Human
ggaugucugggcc

SEQ ID NO: 3224236 - RNA, 22 nt, Human
ggauguugaaaaaguucugcag

SEQ ID NO: 3224237 - RNA, 16 nt, Human
ggaugugcugcagugc

SEQ ID NO: 3224238 - RNA, 21 nt, Human
ggaugaauuccaaauucugcu

SEQ ID NO: 3224239 - RNA, 22 nt, Human
ggaugagaaagguugaagcacc

SEQ ID NO: 3224240 - RNA, 12 nt, Human
ggaugagaaagg

SEQ ID NO: 3224241 - RNA, 17 nt, Human
ggaugaauuguaaaagc

SEQ ID NO: 3224242 - RNA, 20 nt, Human
ggaugaauuguaaaagcaac

SEQ ID NO: 3224243 - RNA, 21 nt, Human
ggauuuuauguugacauuugu

SEQ ID NO: 3224244 - RNA, 16 nt, Human
ggauuuuauguugaca

SEQ ID NO: 3224245 - RNA, 18 nt, Human
ggauuuggagagaaauau

SEQ ID NO: 3224246 - RNA, 17 nt, Human
ggauuuggagagaaaua

SEQ ID NO: 3224247 - RNA, 15 nt, Human
ggauuuuauguugac

SEQ ID NO: 3224248 - RNA, 21 nt, Human
ggauuuugauccaagcugguc

SEQ ID NO: 3224249 - RNA, 20 nt, Human
ggcaaauccgaaaucagcag

SEQ ID NO: 3224250 - RNA, 17 nt, Human
ggcaaauccgaaaucag

SEQ ID NO: 3224251 - RNA, 13 nt, Human
ggcaaauaaaauu

SEQ ID NO: 3224252 - RNA, 17 nt, Human
ggcaaauaaaauucccu

SEQ ID NO: 3224253 - RNA, 16 nt, Human
ggcaaagggggaggag

SEQ ID NO: 3224254 - RNA, 16 nt, Human
ggcaacaaacugcaca

SEQ ID NO: 3224255 - RNA, 18 nt, Human
ggcaacaaacugcacaug

SEQ ID NO: 3224256 - RNA, 17 nt, Human
ggcaaacauuugaagga

SEQ ID NO: 3224257 - RNA, 22 nt, Human
ggcaaacauuuucucuuagaaa

SEQ ID NO: 3224258 - RNA, 21 nt, Human
ggcaaacauuuucucuuagaa

SEQ ID NO: 3224259 - RNA, 20 nt, Human
ggcaaagcagcaacacacau

SEQ ID NO: 3224260 - RNA, 20 nt, Human
ggcaaagagacccagucaau

SEQ ID NO: 3224261 - RNA, 13 nt, Human
ggcaaagcuguuc

SEQ ID NO: 3224262 - RNA, 16 nt, Human
ggccuccauccugagg

SEQ ID NO: 3224263 - RNA, 13 nt, Human
ggccucccaacuc

SEQ ID NO: 3224264 - RNA, 14 nt, Human
ggccucccaacuca

SEQ ID NO: 3224265 - RNA, 23 nt, Human
ggcccuuccucuccacugccuuc

SEQ ID NO: 3224266 - RNA, 22 nt, Human
ggcccuuccucuccacugccuu

SEQ ID NO: 3224267 - RNA, 19 nt, Human
ggcccuuccucuccacugc

SEQ ID NO: 3224268 - RNA, 18 nt, Human
ggcccuuccucuccacug

SEQ ID NO: 3224269 - RNA, 21 nt, Human
ggccuccgucacuaccuggcu

SEQ ID NO: 3224270 - RNA, 19 nt, Human
ggccucccugccaguaggg

SEQ ID NO: 3224271 - RNA, 12 nt, Human
ggccucccugcc

SEQ ID NO: 3224272 - RNA, 15 nt, Human
ggccucccugccagu

SEQ ID NO: 3224273 - RNA, 13 nt, Human
ggccucccugcca

SEQ ID NO: 3224274 - RNA, 22 nt, Human
ggcccagcgcggacauccccug

SEQ ID NO: 3224275 - RNA, 21 nt, Human
ggcccauguauggccaggaag

SEQ ID NO: 3224276 - RNA, 20 nt, Human
ggcccauguauggccaggaa

SEQ ID NO: 3224277 - RNA, 19 nt, Human
ggcccauguauggccagga

SEQ ID NO: 3224278 - RNA, 17 nt, Human
ggcccauguauggccag

SEQ ID NO: 3224279 - RNA, 16 nt, Human
ggcccaugggagggag

SEQ ID NO: 3224280 - RNA, 17 nt, Human
ggcccaugggagggagc

SEQ ID NO: 3224281 - RNA, 20 nt, Human
ggcccaugggagggagcuga

SEQ ID NO: 3224282 - RNA, 14 nt, Human
ggcccaucaugggg

SEQ ID NO: 3224283 - RNA, 19 nt, Human
ggcccaucauggggggagc

SEQ ID NO: 3224284 - RNA, 13 nt, Human
ggccccacaccag

SEQ ID NO: 3224285 - RNA, 19 nt, Human
ggccccagcuucucagcuc

SEQ ID NO: 3224286 - RNA, 15 nt, Human
ggcccgacagccugg

SEQ ID NO: 3224287 - RNA, 17 nt, Human
ggcccgacagccuggca

SEQ ID NO: 3224288 - RNA, 16 nt, Human
ggcccgacagccuggc

SEQ ID NO: 3224289 - RNA, 18 nt, Human
ggccagcaccaucucuuu

SEQ ID NO: 3224290 - RNA, 20 nt, Human
ggccagaugcaccagcccuu

SEQ ID NO: 3224291 - RNA, 19 nt, Human
ggccagaugcaccagcccu

SEQ ID NO: 3224292 - RNA, 17 nt, Human
ggccagaugcaccagcc

SEQ ID NO: 3224293 - RNA, 23 nt, Human
ggccagagggagugacagaggca

SEQ ID NO: 3224294 - RNA, 22 nt, Human
ggccagagggagugacagaggc

SEQ ID NO: 3224295 - RNA, 13 nt, Human
ggccaagguggga

SEQ ID NO: 3224296 - RNA, 21 nt, Human
ggccaaggaugccccgucccc

SEQ ID NO: 3224297 - RNA, 12 nt, Human
ggcauucucucu

SEQ ID NO: 3224298 - RNA, 19 nt, Human
ggcauugccucggcuggcu

SEQ ID NO: 3224299 - RNA, 12 nt, Human
ggcauuguggga

SEQ ID NO: 3224300 - RNA, 21 nt, Human
ggccaaacucaccugccccuc

SEQ ID NO: 3224301 - RNA, 16 nt, Human
ggcauuucccacccug

SEQ ID NO: 3224302 - RNA, 16 nt, Human
ggccaaagacaaauag

SEQ ID NO: 3224303 - RNA, 15 nt, Human
ggccaaagacaaaua

SEQ ID NO: 3224304 - RNA, 13 nt, Human
ggccaaagacaaa

SEQ ID NO: 3224305 - RNA, 12 nt, Human
ggccaaaggaag

SEQ ID NO: 3224306 - RNA, 15 nt, Human
ggccaaagccaaagc

SEQ ID NO: 3224307 - RNA, 21 nt, Human
ggccaaaggaagcacaugccu

SEQ ID NO: 3224308 - RNA, 14 nt, Human
ggccaggugccucc

SEQ ID NO: 3224309 - RNA, 16 nt, Human
ggccaggugccuccug

SEQ ID NO: 3224310 - RNA, 19 nt, Human
ggccagguggccacuccag

SEQ ID NO: 3224311 - RNA, 13 nt, Human
aaaaaaaaagaaa

SEQ ID NO: 3224312 - RNA, 13 nt, Human
aaaaaaaaaguca

SEQ ID NO: 3224313 - RNA, 10 nt, Human
aaaaaaaaga

SEQ ID NO: 3224314 - RNA, 19 nt, Human
aaaaagcuagucaacagua

SEQ ID NO: 3224315 - RNA, 12 nt, Human
aaaaaauaauua

SEQ ID NO: 3224316 - RNA, 10 nt, Human
aaaaaauaca

SEQ ID NO: 3224317 - RNA, 16 nt, Human
aaaaaagucaccaaau

SEQ ID NO: 3224318 - RNA, 18 nt, Human
aaaaaaggaugcaacaau

SEQ ID NO: 3224319 - RNA, 12 nt, Human
aaaaaaguugua

SEQ ID NO: 3224320 - RNA, 13 nt, Human
aaaaaagcugaau

SEQ ID NO: 3224321 - RNA, 12 nt, Human
aaaaaagaaaga

SEQ ID NO: 3224322 - RNA, 13 nt, Human
aaaaaaaauugua

SEQ ID NO: 3224323 - RNA, 11 nt, Human
aaaaaaaagaa

SEQ ID NO: 3224324 - RNA, 13 nt, Human
aaaaaaaacucuu

SEQ ID NO: 3224325 - RNA, 20 nt, Human
aaaaaggcuuauaaaacaga

SEQ ID NO: 3224326 - RNA, 20 nt, Human
aaaaagcuccaaaugcagcu

SEQ ID NO: 3224327 - RNA, 19 nt, Human
aaaaagcuauaaauuauau

SEQ ID NO: 3224328 - RNA, 16 nt, Human
aaaaagggaguuuuug

SEQ ID NO: 3224329 - RNA, 15 nt, Human
aaaaaguauugccaa

SEQ ID NO: 3224330 - RNA, 12 nt, Human
aaaaaguauugc

SEQ ID NO: 3224331 - RNA, 15 nt, Human
aaaaagucuuuuaaa

SEQ ID NO: 3224332 - RNA, 14 nt, Human
aaaaagucuuuuaa

SEQ ID NO: 3224333 - RNA, 20 nt, Human
aaaaaguauugccaaacauu

SEQ ID NO: 3224334 - RNA, 16 nt, Human
aaaaaguauugccaaa

SEQ ID NO: 3224335 - RNA, 21 nt, Human
aaaaaguauugccaaacauua

SEQ ID NO: 3224336 - RNA, 14 nt, Human
aaaaagucagaugu

SEQ ID NO: 3224337 - RNA, 16 nt, Human
aaaaagucagauguuu

SEQ ID NO: 3224338 - RNA, 23 nt, Human
gggaaaaucagccugcuccagcu

SEQ ID NO: 3224339 - RNA, 20 nt, Human
gggaaaaaguugaugucaau

SEQ ID NO: 3224340 - RNA, 22 nt, Human
gggaaaauaaaaaaagaaaaaa

SEQ ID NO: 3224341 - RNA, 18 nt, Human
gggaaacuaagauucuuu

SEQ ID NO: 3224342 - RNA, 13 nt, Human
gggaaaaucagcc

SEQ ID NO: 3224343 - RNA, 17 nt, Human
ggcuuuuguuuugcuuu

SEQ ID NO: 3224344 - RNA, 16 nt, Human
ggcuucaguggcagcu

SEQ ID NO: 3224345 - RNA, 22 nt, Human
ggcuucagggugggaguaguug

SEQ ID NO: 3224346 - RNA, 23 nt, Human
ggcuucccaaaugugugcccagc

SEQ ID NO: 3224347 - RNA, 20 nt, Human
ggcuuccugaggggagacag

SEQ ID NO: 3224348 - RNA, 17 nt, Human
ggcuuccugaggggaga

SEQ ID NO: 3224349 - RNA, 17 nt, Human
ggcuucggacaaaauau

SEQ ID NO: 3224350 - RNA, 16 nt, Human
ggcuggugucaccuga

SEQ ID NO: 3224351 - RNA, 19 nt, Human
ggcuguaucccaugagccu

SEQ ID NO: 3224352 - RNA, 15 nt, Human
ggcugucaauuacag

SEQ ID NO: 3224353 - RNA, 23 nt, Human
ggcuguaucccaugagccucagc

SEQ ID NO: 3224354 - RNA, 22 nt, Human
ggcuguaucccaugagccucag

SEQ ID NO: 3224355 - RNA, 20 nt, Human
ggcuguaucccaugagccuc

SEQ ID NO: 3224356 - RNA, 15 nt, Human
ggcuucaguggcagc

SEQ ID NO: 3224357 - RNA, 14 nt, Human
ggcuguccacccgc

SEQ ID NO: 3224358 - RNA, 22 nt, Human
ggcugucaguguuuggugcacg

SEQ ID NO: 3224359 - RNA, 17 nt, Human
ggcuccucccggugccc

SEQ ID NO: 3224360 - RNA, 13 nt, Human
ggcuccugccacc

SEQ ID NO: 3224361 - RNA, 12 nt, Human
ggcuccugccca

SEQ ID NO: 3224362 - RNA, 15 nt, Human
ggcuccugcccccau

SEQ ID NO: 3224363 - RNA, 12 nt, Human
ggcuccugcccc

SEQ ID NO: 3224364 - RNA, 12 nt, Human
ggcuccugccac

SEQ ID NO: 3224365 - RNA, 20 nt, Human
ggcucccuucccaccucucu

SEQ ID NO: 3224366 - RNA, 22 nt, Human
ggcucccuucccaccucucuca

SEQ ID NO: 3224367 - RNA, 17 nt, Human
ggcucccuucccaccuc

SEQ ID NO: 3224368 - RNA, 18 nt, Human
ggcucccuucccaccucu

SEQ ID NO: 3224369 - RNA, 16 nt, Human
ggcucccuucccaccu

SEQ ID NO: 3224370 - RNA, 20 nt, Human
ggcucuuccaggcugggaga

SEQ ID NO: 3224371 - RNA, 23 nt, Human
ggcucuuccaggcugggagagcc

SEQ ID NO: 3224372 - RNA, 24 nt, Human
ggcucuuccaggcugggagagccu

SEQ ID NO: 3224373 - RNA, 18 nt, Human
ggcucgagcaugccugga

SEQ ID NO: 3224374 - RNA, 17 nt, Human
ggcugcagggaguccga

SEQ ID NO: 3224375 - RNA, 20 nt, Human
ggcugcaugcgggcuuccuc

SEQ ID NO: 3224376 - RNA, 21 nt, Human
ggcugccaaugggagcucaug

SEQ ID NO: 3224377 - RNA, 17 nt, Human
ggcuggaucugugaggg

SEQ ID NO: 3224378 - RNA, 22 nt, Human
ggcuggaguuggggcagaggag

SEQ ID NO: 3224379 - RNA, 17 nt, Human
ggcuggaguuggggcag

SEQ ID NO: 3224380 - RNA, 17 nt, Human
ggcuggccuggccccuc

SEQ ID NO: 3224381 - RNA, 22 nt, Human
ggcuggccuggccccucagggu

SEQ ID NO: 3224382 - RNA, 13 nt, Human
ggcuggcccugcc

SEQ ID NO: 3224383 - RNA, 14 nt, Human
ggcuggcccugccc

SEQ ID NO: 3224384 - RNA, 15 nt, Human
ggcuggcccugcccu

SEQ ID NO: 3224385 - RNA, 20 nt, Human
ggcuggcgugcaguggugcg

SEQ ID NO: 3224386 - RNA, 16 nt, Human
ggcuggcgugcagugg

SEQ ID NO: 3224387 - RNA, 14 nt, Human
ggcuggcgugcagu

SEQ ID NO: 3224388 - RNA, 16 nt, Human
ggcuggcccugcccug

SEQ ID NO: 3224389 - RNA, 11 nt, Human
ggcugggaaau

SEQ ID NO: 3224390 - RNA, 14 nt, Human
ggcuggcuccccug

SEQ ID NO: 3224391 - RNA, 15 nt, Human
ggcuggcuccccugc

SEQ ID NO: 3224392 - RNA, 16 nt, Human
ggcuggcuccccugca

SEQ ID NO: 3224393 - RNA, 18 nt, Human
ggcuggcuccccugcagc

SEQ ID NO: 3224394 - RNA, 20 nt, Human
ggcuggcuccccugcagccc

SEQ ID NO: 3224395 - RNA, 21 nt, Human
ggcuggcuccccugcagcccu

SEQ ID NO: 3224396 - RNA, 18 nt, Human
gggagggcuccagacaca

SEQ ID NO: 3224397 - RNA, 16 nt, Human
gggaggggagacuuug

SEQ ID NO: 3224398 - RNA, 23 nt, Human
gggauuuguugauucucuccauu

SEQ ID NO: 3224399 - RNA, 23 nt, Human
gggcagagcagagaccaucccug

SEQ ID NO: 3224400 - RNA, 15 nt, Human
gggauuuccaugaug

SEQ ID NO: 3224401 - RNA, 15 nt, Human
aaaagguugaauaau

SEQ ID NO: 3224402 - RNA, 17 nt, Human
aaaaggcuuauaaaaca

SEQ ID NO: 3224403 - RNA, 19 nt, Human
aaaaggcuuauaaaacaga

SEQ ID NO: 3224404 - RNA, 20 nt, Human
aaaaggcuuauaaaacagag

SEQ ID NO: 3224405 - RNA, 22 nt, Human
gggcaggacagguccucccugc

SEQ ID NO: 3224406 - RNA, 14 nt, Human
gggcaggaccagcc

SEQ ID NO: 3224407 - RNA, 13 nt, Human
gggcaggaccagc

SEQ ID NO: 3224408 - RNA, 21 nt, Human
gggcaggaccagcccacgcug

SEQ ID NO: 3224409 - RNA, 18 nt, Human
gggcaggaccagcccacg

SEQ ID NO: 3224410 - RNA, 17 nt, Human
gggcaggaccagcccac

SEQ ID NO: 3224411 - RNA, 16 nt, Human
gggcaggaccagccca

SEQ ID NO: 3224412 - RNA, 15 nt, Human
gggcaggaccagccc

SEQ ID NO: 3224413 - RNA, 13 nt, Human
aaaauauguauua

SEQ ID NO: 3224414 - RNA, 13 nt, Human
aaaauauagcuaa

SEQ ID NO: 3224415 - RNA, 14 nt, Human
aaaauauacauguu

SEQ ID NO: 3224416 - RNA, 11 nt, Human
aaaauauacau

SEQ ID NO: 3224417 - RNA, 13 nt, Human
aaaauauacaaaa

SEQ ID NO: 3224418 - RNA, 12 nt, Human
aaaauagccugc

SEQ ID NO: 3224419 - RNA, 15 nt, Human
aaaauaggcuuuuua

SEQ ID NO: 3224420 - RNA, 16 nt, Human
aaaauaggcuuuuuaa

SEQ ID NO: 3224421 - RNA, 17 nt, Human
aaaauaggcuuuuuaau

SEQ ID NO: 3224422 - RNA, 21 nt, Human
aaaauaggcuuuuuaaucaug

SEQ ID NO: 3224423 - RNA, 13 nt, Human
aaaauaguuuauu

SEQ ID NO: 3224424 - RNA, 14 nt, Human
aaaauaguuuauuu

SEQ ID NO: 3224425 - RNA, 13 nt, Human
aaaauaaagcaag

SEQ ID NO: 3224426 - RNA, 11 nt, Human
aaaauaaagca

SEQ ID NO: 3224427 - RNA, 12 nt, Human
aaaauaaauuau

SEQ ID NO: 3224428 - RNA, 12 nt, Human
aaaaguaaaaug

SEQ ID NO: 3224429 - RNA, 13 nt, Human
aaaaguaaaaugu

SEQ ID NO: 3224430 - RNA, 13 nt, Human
aaaaguaauauuu

SEQ ID NO: 3224431 - RNA, 15 nt, Human
aaaaguaauauuuau

SEQ ID NO: 3224432 - RNA, 15 nt, Human
aaaaguagaacuuug

SEQ ID NO: 3224433 - RNA, 13 nt, Human
aaaaguagaacuu

SEQ ID NO: 3224434 - RNA, 13 nt, Human
aaaauaaauugga

SEQ ID NO: 3224435 - RNA, 14 nt, Human
aaaagccuuggccu

SEQ ID NO: 3224436 - RNA, 11 nt, Human
aaaagccuugg

SEQ ID NO: 3224437 - RNA, 21 nt, Human
aaaacuuuaugcuaagugaaa

SEQ ID NO: 3224438 - RNA, 22 nt, Human
aaaacuugauguguuaucucuu

SEQ ID NO: 3224439 - RNA, 17 nt, Human
aaaacuacuuagcacuu

SEQ ID NO: 3224440 - RNA, 15 nt, Human
aaaacuuuaaaccug

SEQ ID NO: 3224441 - RNA, 17 nt, Human
aaaagcuagaacacugc

SEQ ID NO: 3224442 - RNA, 16 nt, Human
aaaagcuauaaauuau

SEQ ID NO: 3224443 - RNA, 16 nt, Human
aaaagcuaucuucaug

SEQ ID NO: 3224444 - RNA, 19 nt, Human
aaaagcuaucuucauguaa

SEQ ID NO: 3224445 - RNA, 14 nt, Human
aaaagcugggcagg

SEQ ID NO: 3224446 - RNA, 23 nt, Human
gggacugccagucccccugcccc

SEQ ID NO: 3224447 - RNA, 20 nt, Human
aaaagcugaacacauuucuu

SEQ ID NO: 3224448 - RNA, 19 nt, Human
aaaagcugaacacauuucu

SEQ ID NO: 3224449 - RNA, 18 nt, Human
aaaagcugaacacauuuc

SEQ ID NO: 3224450 - RNA, 16 nt, Human
aaaagcugaacacauu

SEQ ID NO: 3224451 - RNA, 20 nt, Human
gggaggcagagguugcagug

SEQ ID NO: 3224452 - RNA, 19 nt, Human
gggaggccaagaguggccc

SEQ ID NO: 3224453 - RNA, 23 nt, Human
gggaggccaagaguggccccacc

SEQ ID NO: 3224454 - RNA, 22 nt, Human
gggaggccaagaguggccccac

SEQ ID NO: 3224455 - RNA, 11 nt, Human
gggagggcucc

SEQ ID NO: 3224456 - RNA, 13 nt, Human
gggagggcuccag

SEQ ID NO: 3224457 - RNA, 13 nt, Human
gggagggccuggg

SEQ ID NO: 3224458 - RNA, 11 nt, Human
gggaggcagag

SEQ ID NO: 3224459 - RNA, 14 nt, Human
gggagacuuugaug

SEQ ID NO: 3224460 - RNA, 18 nt, Human
aaaacugauuuuuuuuuc

SEQ ID NO: 3224461 - RNA, 22 nt, Human
aaaacugauuuuuuuuuccuuc

SEQ ID NO: 3224462 - RNA, 21 nt, Human
aaaacguggcugcuucaagga

SEQ ID NO: 3224463 - RNA, 19 nt, Human
aaaaccaagccguggcuuc

SEQ ID NO: 3224464 - RNA, 14 nt, Human
aaaacuacuuagca

SEQ ID NO: 3224465 - RNA, 13 nt, Human
aaaacuaaguucu

SEQ ID NO: 3224466 - RNA, 14 nt, Human
aaaacguggcugcu

SEQ ID NO: 3224467 - RNA, 16 nt, Human
aaaacguggcugcuuc

SEQ ID NO: 3224468 - RNA, 17 nt, Human
aaaacguggcugcuuca

SEQ ID NO: 3224469 - RNA, 18 nt, Human
aaaacguggcugcuucaa

SEQ ID NO: 3224470 - RNA, 15 nt, Human
aaaaccaauguucuc

SEQ ID NO: 3224471 - RNA, 23 nt, Human
aaaaccaaaaguuauuaaaauug

SEQ ID NO: 3224472 - RNA, 20 nt, Human
aaaaccaaaaguuauuaaaa

SEQ ID NO: 3224473 - RNA, 19 nt, Human
aaaaauuauugauugcuuu

SEQ ID NO: 3224474 - RNA, 18 nt, Human
aaaacauuuggcagaaaa

SEQ ID NO: 3224475 - RNA, 21 nt, Human
aaaaaucugaagauuguuuau

SEQ ID NO: 3224476 - RNA, 20 nt, Human
aaaaaucugaagauuguuua

SEQ ID NO: 3224477 - RNA, 13 nt, Human
aaaaaucugaaga

SEQ ID NO: 3224478 - RNA, 17 nt, Human
aaaaaucugaagauugu

SEQ ID NO: 3224479 - RNA, 14 nt, Human
aaaaaucugaagau

SEQ ID NO: 3224480 - RNA, 18 nt, Human
aaaaaucuuaauacuguu

SEQ ID NO: 3224481 - RNA, 15 nt, Human
aaaaaucuuaauacu

SEQ ID NO: 3224482 - RNA, 18 nt, Human
aaaaaucugcuguuaacu

SEQ ID NO: 3224483 - RNA, 23 nt, Human
aaaaaucugaagauuguuuaucu

SEQ ID NO: 3224484 - RNA, 19 nt, Human
aaaaaucuuaauacuguua

SEQ ID NO: 3224485 - RNA, 22 nt, Human
aaaaaugagcuugauuaaauca

SEQ ID NO: 3224486 - RNA, 23 nt, Human
aaaaaugucaaaaguagaacuuu

SEQ ID NO: 3224487 - RNA, 18 nt, Human
aaaaaugucaaaaguaga

SEQ ID NO: 3224488 - RNA, 18 nt, Human
aaaaaugccaucaaauga

SEQ ID NO: 3224489 - RNA, 13 nt, Human
aaaaauuacaguu

SEQ ID NO: 3224490 - RNA, 22 nt, Human
aaaaauguuaagcaucuaagga

SEQ ID NO: 3224491 - RNA, 18 nt, Human
aaaaauguuaagcaucua

SEQ ID NO: 3224492 - RNA, 22 nt, Human
gggaacagacuggaagcacagc

SEQ ID NO: 3224493 - RNA, 14 nt, Human
gggaacagacugga

SEQ ID NO: 3224494 - RNA, 18 nt, Human
gggaaaugcugauuuaaa

SEQ ID NO: 3224495 - RNA, 21 nt, Human
gggaaaguauucucuuuucaa

SEQ ID NO: 3224496 - RNA, 23 nt, Human
gggaaaucgagugccgcaucuca

SEQ ID NO: 3224497 - RNA, 21 nt, Human
gggaaagccuuaagcugcagg

SEQ ID NO: 3224498 - RNA, 12 nt, Human
aaaauaugugaa

SEQ ID NO: 3224499 - RNA, 20 nt, Human
aaaauaugucccagaaaugu

SEQ ID NO: 3224500 - RNA, 14 nt, Human
aaaauauguauuaa

SEQ ID NO: 3224501 - RNA, 18 nt, Human
aaaauaugugaaggaccu

SEQ ID NO: 3224502 - RNA, 13 nt, Human
aaaauaugugaag

SEQ ID NO: 3224503 - RNA, 20 nt, Human
aaaauggaagacagcucuua

SEQ ID NO: 3224504 - RNA, 21 nt, Human
aaaauguaggguuauaauaau

SEQ ID NO: 3224505 - RNA, 22 nt, Human
aaaauguacauguauuaaauua

SEQ ID NO: 3224506 - RNA, 21 nt, Human
aaaauguacauguauuaaauu

SEQ ID NO: 3224507 - RNA, 18 nt, Human
aaaauguacauguauuaa

SEQ ID NO: 3224508 - RNA, 16 nt, Human
aaaauguacauguauu

SEQ ID NO: 3224509 - RNA, 15 nt, Human
aaaauguacauguau

SEQ ID NO: 3224510 - RNA, 21 nt, Human
aaaauggacguguuaugacuc

SEQ ID NO: 3224511 - RNA, 19 nt, Human
aaaauggcaacaaacugca

SEQ ID NO: 3224512 - RNA, 14 nt, Human
aaaauguacaugua

SEQ ID NO: 3224513 - RNA, 18 nt, Human
aaaauuuaaaaagcccaa

SEQ ID NO: 3224514 - RNA, 16 nt, Human
aaaauugugauguguc

SEQ ID NO: 3224515 - RNA, 13 nt, Human
aaaauguaucuaa

SEQ ID NO: 3224516 - RNA, 23 nt, Human
aaacaaaagcugaacacauuucu

SEQ ID NO: 3224517 - RNA, 19 nt, Human
aaacaaaagcugaacacau

SEQ ID NO: 3224518 - RNA, 13 nt, Human
aaacaaaaccaaa

SEQ ID NO: 3224519 - RNA, 12 nt, Human
aaacaaaaccaa

SEQ ID NO: 3224520 - RNA, 19 nt, Human
aaaauuuaaaaagcccaac

SEQ ID NO: 3224521 - RNA, 17 nt, Human
aaaauuuaaaaguaaaa

SEQ ID NO: 3224522 - RNA, 19 nt, Human
aaaauuuaaaaguaaaaug

SEQ ID NO: 3224523 - RNA, 12 nt, Human
aaacaaaaggca

SEQ ID NO: 3224524 - RNA, 19 nt, Human
aaacaacagucuucauuuu

SEQ ID NO: 3224525 - RNA, 12 nt, Human
aaacaacauuua

SEQ ID NO: 3224526 - RNA, 17 nt, Human
aaacaacauuuauaugu

SEQ ID NO: 3224527 - RNA, 18 nt, Human
aaacaacauuuauaugua

SEQ ID NO: 3224528 - RNA, 12 nt, Human
aaacaagaauga

SEQ ID NO: 3224529 - RNA, 17 nt, Human
ggggccaguuggucccc

SEQ ID NO: 3224530 - RNA, 16 nt, Human
ggggcccugccuccuu

SEQ ID NO: 3224531 - RNA, 15 nt, Human
ggggcccugccuccu

SEQ ID NO: 3224532 - RNA, 19 nt, Human
ggggcccugccuccuuugu

SEQ ID NO: 3224533 - RNA, 23 nt, Human
ggggcccugccuccuuugugagg

SEQ ID NO: 3224534 - RNA, 13 nt, Human
ggggaccucaggc

SEQ ID NO: 3224535 - RNA, 15 nt, Human
ggggaccucaggccu

SEQ ID NO: 3224536 - RNA, 16 nt, Human
ggggaccucaggccug

SEQ ID NO: 3224537 - RNA, 17 nt, Human
ggggaccucaggccugg

SEQ ID NO: 3224538 - RNA, 24 nt, Human
ggggaaaaucagccugcuccagcu

SEQ ID NO: 3224539 - RNA, 16 nt, Human
ggggaacguucucuuu

SEQ ID NO: 3224540 - RNA, 15 nt, Human
aaacaauaaagcaau

SEQ ID NO: 3224541 - RNA, 19 nt, Human
aaacacaaacgggcucagc

SEQ ID NO: 3224542 - RNA, 20 nt, Human
aaacaagcauauaaaauggc

SEQ ID NO: 3224543 - RNA, 18 nt, Human
aaacaagcauauaaaaug

SEQ ID NO: 3224544 - RNA, 15 nt, Human
aaacaagcauauaaa

SEQ ID NO: 3224545 - RNA, 12 nt, Human
aaacaagcauau

SEQ ID NO: 3224546 - RNA, 23 nt, Human
aaacaagaaugaagguuuuugua

SEQ ID NO: 3224547 - RNA, 15 nt, Human
aaacaagaaugaagg

SEQ ID NO: 3224548 - RNA, 16 nt, Human
aaacauacgugugcau

SEQ ID NO: 3224549 - RNA, 22 nt, Human
aaacauguugccaaaauggugg

SEQ ID NO: 3224550 - RNA, 20 nt, Human
aaacauguugccaaaauggu

SEQ ID NO: 3224551 - RNA, 23 nt, Human
gggucucacuauguugcccaggc

SEQ ID NO: 3224552 - RNA, 22 nt, Human
gggucucacuauguugcccagg

SEQ ID NO: 3224553 - RNA, 17 nt, Human
gggucaggccgggcaga

SEQ ID NO: 3224554 - RNA, 21 nt, Human
gggucaggccgggcagagcac

SEQ ID NO: 3224555 - RNA, 18 nt, Human
gggucaggccgggcagag

SEQ ID NO: 3224556 - RNA, 14 nt, Human
aaacauuaaaauau

SEQ ID NO: 3224557 - RNA, 22 nt, Human
aaacauuggaagcagguuaaau

SEQ ID NO: 3224558 - RNA, 19 nt, Human
aaacauuggaagcagguua

SEQ ID NO: 3224559 - RNA, 17 nt, Human
aaacauuggaagcaggu

SEQ ID NO: 3224560 - RNA, 13 nt, Human
aaacauuggaagc

SEQ ID NO: 3224561 - RNA, 16 nt, Human
aaacauugcuuuuaaa

SEQ ID NO: 3224562 - RNA, 13 nt, Human
aaacauugcuuuu

SEQ ID NO: 3224563 - RNA, 13 nt, Human
aaaccaacaccau

SEQ ID NO: 3224564 - RNA, 14 nt, Human
aaaccaagccgugg

SEQ ID NO: 3224565 - RNA, 14 nt, Human
aaacauuucauaau

SEQ ID NO: 3224566 - RNA, 16 nt, Human
aaacauuucauaauuu

SEQ ID NO: 3224567 - RNA, 22 nt, Human
aaaccaaaaguuauuaaaauug

SEQ ID NO: 3224568 - RNA, 20 nt, Human
aaaccaaaaguuauuaaaau

SEQ ID NO: 3224569 - RNA, 19 nt, Human
aaaccaaaaguuauuaaaa

SEQ ID NO: 3224570 - RNA, 15 nt, Human
ggggaagaauaauuu

SEQ ID NO: 3224571 - RNA, 20 nt, Human
ggggccuuugggugcuguuu

SEQ ID NO: 3224572 - RNA, 23 nt, Human
ggggucucucacagacaggaccc

SEQ ID NO: 3224573 - RNA, 19 nt, Human
ggggucucucacagacagg

SEQ ID NO: 3224574 - RNA, 17 nt, Human
ggggucucucacagaca

SEQ ID NO: 3224575 - RNA, 15 nt, Human
ggggucucucacaga

SEQ ID NO: 3224576 - RNA, 23 nt, Human
ggggucuguguguuuaugugugu

SEQ ID NO: 3224577 - RNA, 23 nt, Human
ggguagcuguaaggcaugaagga

SEQ ID NO: 3224578 - RNA, 20 nt, Human
ggguaucaggugcugccauc

SEQ ID NO: 3224579 - RNA, 14 nt, Human
gggucagaagagag

SEQ ID NO: 3224580 - RNA, 22 nt, Human
gggucacucuggcagcucagag

SEQ ID NO: 3224581 - RNA, 15 nt, Human
aaaccacagcaguug

SEQ ID NO: 3224582 - RNA, 16 nt, Human
aaaccacagcaguuga

SEQ ID NO: 3224583 - RNA, 16 nt, Human
aaacgcuucaguuguu

SEQ ID NO: 3224584 - RNA, 16 nt, Human
aaacguggcugcuuca

SEQ ID NO: 3224585 - RNA, 12 nt, Human
aaacgugaaaau

SEQ ID NO: 3224586 - RNA, 17 nt, Human
aaacguggcugcuucaa

SEQ ID NO: 3224587 - RNA, 12 nt, Human
aaacuaauaaaa

SEQ ID NO: 3224588 - RNA, 13 nt, Human
aaacuaauaaaau

SEQ ID NO: 3224589 - RNA, 14 nt, Human
aaacuaauaaaaua

SEQ ID NO: 3224590 - RNA, 18 nt, Human
aaacuaauaaaauauuuu

SEQ ID NO: 3224591 - RNA, 19 nt, Human
aaacuaauaaaauauuuuc

SEQ ID NO: 3224592 - RNA, 20 nt, Human
aaacuaauaaaauauuuucu

SEQ ID NO: 3224593 - RNA, 21 nt, Human
aaacuaauaaaauauuuucug

SEQ ID NO: 3224594 - RNA, 22 nt, Human
aaacuaauaaaauauuuucugu

SEQ ID NO: 3224595 - RNA, 23 nt, Human
aaacuaauaaaauauuuucugug

SEQ ID NO: 3224596 - RNA, 15 nt, Human
aaacuaagauucuuu

SEQ ID NO: 3224597 - RNA, 16 nt, Human
aaacuaagauucuuuu

SEQ ID NO: 3224598 - RNA, 16 nt, Human
aaacuacugaaugaag

SEQ ID NO: 3224599 - RNA, 20 nt, Human
aaacuacugaaugaagcagu

SEQ ID NO: 3224600 - RNA, 21 nt, Human
aaacuacugaaugaagcagua

SEQ ID NO: 3224601 - RNA, 15 nt, Human
aaacucauuuugcuu

SEQ ID NO: 3224602 - RNA, 22 nt, Human
aaacuccagaugccacaaugga

SEQ ID NO: 3224603 - RNA, 15 nt, Human
aaacuccagaugcca

SEQ ID NO: 3224604 - RNA, 12 nt, Human
aaacugcccccu

SEQ ID NO: 3224605 - RNA, 11 nt, Human
aaacugccccc

SEQ ID NO: 3224606 - RNA, 15 nt, Human
aaacuggaaugagca

SEQ ID NO: 3224607 - RNA, 13 nt, Human
aaacugcccccuc

SEQ ID NO: 3224608 - RNA, 17 nt, Human
aaacugcccccucugcc

SEQ ID NO: 3224609 - RNA, 19 nt, Human
aaacugcccccucugcccu

SEQ ID NO: 3224610 - RNA, 20 nt, Human
aaacugcccccucugcccug

SEQ ID NO: 3224611 - RNA, 20 nt, Human
aaacugggcuggaagauauu

SEQ ID NO: 3224612 - RNA, 21 nt, Human
ggucuugguuccagccugcca

SEQ ID NO: 3224613 - RNA, 20 nt, Human
ggucuugguuccagccugcc

SEQ ID NO: 3224614 - RNA, 10 nt, Human
ggucuuugag

SEQ ID NO: 3224615 - RNA, 16 nt, Human
ggucuugcauuuaaaa

SEQ ID NO: 3224616 - RNA, 19 nt, Human
ggucuugcaaaauuccuga

SEQ ID NO: 3224617 - RNA, 21 nt, Human
ggugauccacucgccuucauc

SEQ ID NO: 3224618 - RNA, 22 nt, Human
ggucuuuuccucgcuucuuuca

SEQ ID NO: 3224619 - RNA, 17 nt, Human
ggucuuugagcucccac

SEQ ID NO: 3224620 - RNA, 15 nt, Human
ggugccaguuauggc

SEQ ID NO: 3224621 - RNA, 19 nt, Human
ggugcagacaaucuucugu

SEQ ID NO: 3224622 - RNA, 23 nt, Human
ggugcacuuggggcacagggaga

SEQ ID NO: 3224623 - RNA, 22 nt, Human
ggugcacgcuggggaagaauuu

SEQ ID NO: 3224624 - RNA, 17 nt, Human
ggugcaaaguauuguaa

SEQ ID NO: 3224625 - RNA, 16 nt, Human
ggugauguccuguaaa

SEQ ID NO: 3224626 - RNA, 22 nt, Human
ggugauguugacaucacuggca

SEQ ID NO: 3224627 - RNA, 16 nt, Human
ggugcacaagcuccaa

SEQ ID NO: 3224628 - RNA, 22 nt, Human
ggugcacaagcuccaagcuccc

SEQ ID NO: 3224629 - RNA, 22 nt, Human
aaagauuuugaucucacauuuu

SEQ ID NO: 3224630 - RNA, 16 nt, Human
aaagauuuugaucuca

SEQ ID NO: 3224631 - RNA, 19 nt, Human
ggucuggaggaccugcccg

SEQ ID NO: 3224632 - RNA, 14 nt, Human
ggucuggaggaccu

SEQ ID NO: 3224633 - RNA, 19 nt, Human
ggucugcugccucaggaau

SEQ ID NO: 3224634 - RNA, 14 nt, Human
ggucugugagaugc

SEQ ID NO: 3224635 - RNA, 22 nt, Human
ggucuugaacuccuggccucaa

SEQ ID NO: 3224636 - RNA, 21 nt, Human
ggucuugaacuccuggccuca

SEQ ID NO: 3224637 - RNA, 14 nt, Human
aaagcgaauuuuaa

SEQ ID NO: 3224638 - RNA, 16 nt, Human
aaagcagugcaugcug

SEQ ID NO: 3224639 - RNA, 22 nt, Human
aaagcaccaaaauaagaaaaga

SEQ ID NO: 3224640 - RNA, 18 nt, Human
aaagcggguuauaaugaa

SEQ ID NO: 3224641 - RNA, 21 nt, Human
aaagcagugcaugcugucccu

SEQ ID NO: 3224642 - RNA, 22 nt, Human
aaagcagugcaugcugucccuu

SEQ ID NO: 3224643 - RNA, 18 nt, Human
aaagcuaggccuggccag

SEQ ID NO: 3224644 - RNA, 17 nt, Human
aaagcuaggccuggcca

SEQ ID NO: 3224645 - RNA, 17 nt, Human
aaagcagugcaugcugu

SEQ ID NO: 3224646 - RNA, 21 nt, Human
aaagcaccaaaauaagaaaag

SEQ ID NO: 3224647 - RNA, 20 nt, Human
aaagcaccaaaauaagaaaa

SEQ ID NO: 3224648 - RNA, 19 nt, Human
aaagcaccaaaauaagaaa

SEQ ID NO: 3224649 - RNA, 18 nt, Human
aaagcaccaaaauaagaa

SEQ ID NO: 3224650 - RNA, 13 nt, Human
aaagcacaaagga

SEQ ID NO: 3224651 - RNA, 17 nt, Human
aaagcaccaaaauaaga

SEQ ID NO: 3224652 - RNA, 16 nt, Human
aaagcaccaaaauaag

SEQ ID NO: 3224653 - RNA, 22 nt, Human
ggugccaugucagcgcucuggu

SEQ ID NO: 3224654 - RNA, 16 nt, Human
ggugccaucagugccc

SEQ ID NO: 3224655 - RNA, 11 nt, Human
aaaggaaagag

SEQ ID NO: 3224656 - RNA, 12 nt, Human
aaaggaaaccuu

SEQ ID NO: 3224657 - RNA, 13 nt, Human
aaaggaaaccuuu

SEQ ID NO: 3224658 - RNA, 14 nt, Human
aaaggaaaccuuuu

SEQ ID NO: 3224659 - RNA, 13 nt, Human
aaagcuuauuaaa

SEQ ID NO: 3224660 - RNA, 19 nt, Human
aaagcuagucaacaguacc

SEQ ID NO: 3224661 - RNA, 18 nt, Human
aaagcuaucuucauguaa

SEQ ID NO: 3224662 - RNA, 13 nt, Human
aaagcuuuuugaa

SEQ ID NO: 3224663 - RNA, 13 nt, Human
aaaggaaaagaaa

SEQ ID NO: 3224664 - RNA, 12 nt, Human
aaagcuucugug

SEQ ID NO: 3224665 - RNA, 20 nt, Human
aaagcuucccucccugcugu

SEQ ID NO: 3224666 - RNA, 16 nt, Human
aaagcuucccucccug

SEQ ID NO: 3224667 - RNA, 13 nt, Human
aaagcuucccucc

SEQ ID NO: 3224668 - RNA, 13 nt, Human
aaagcuucugugg

SEQ ID NO: 3224669 - RNA, 18 nt, Human
gguauuaagauuauaauu

SEQ ID NO: 3224670 - RNA, 16 nt, Human
gguauuaauaaaaaga

SEQ ID NO: 3224671 - RNA, 19 nt, Human
gguccacccaggagccccg

SEQ ID NO: 3224672 - RNA, 20 nt, Human
ggucauuaaggccacaucca

SEQ ID NO: 3224673 - RNA, 21 nt, Human
ggucauuuccauguaugcaua

SEQ ID NO: 3224674 - RNA, 20 nt, Human
ggucauuuccauguaugcau

SEQ ID NO: 3224675 - RNA, 19 nt, Human
ggucaugaugcucuuuccc

SEQ ID NO: 3224676 - RNA, 18 nt, Human
ggucaugaugcucuuucc

SEQ ID NO: 3224677 - RNA, 20 nt, Human
ggucaugaugcucuuuccca

SEQ ID NO: 3224678 - RNA, 14 nt, Human
gguagucaaaggca

SEQ ID NO: 3224679 - RNA, 22 nt, Human
aaacuguacuuugauucacaug

SEQ ID NO: 3224680 - RNA, 14 nt, Human
aaacugucacuguu

SEQ ID NO: 3224681 - RNA, 15 nt, Human
aaacugucacuguug

SEQ ID NO: 3224682 - RNA, 18 nt, Human
aaacuguacuuugauuca

SEQ ID NO: 3224683 - RNA, 15 nt, Human
aaacuguacuuugau

SEQ ID NO: 3224684 - RNA, 14 nt, Human
aaacuguacuuuga

SEQ ID NO: 3224685 - RNA, 12 nt, Human
aaacuguacuuu

SEQ ID NO: 3224686 - RNA, 21 nt, Human
aaacuguacuuugauucacau

SEQ ID NO: 3224687 - RNA, 20 nt, Human
aaacuguacuuugauucaca

SEQ ID NO: 3224688 - RNA, 18 nt, Human
gguauaaguggugugugu

SEQ ID NO: 3224689 - RNA, 13 nt, Human
gguaguuucugug

SEQ ID NO: 3224690 - RNA, 22 nt, Human
gguaguucaagaaaugaagagc

SEQ ID NO: 3224691 - RNA, 19 nt, Human
gguaguucaagaaaugaag

SEQ ID NO: 3224692 - RNA, 14 nt, Human
gguaguucaagaaa

SEQ ID NO: 3224693 - RNA, 13 nt, Human
gguaguucaagaa

SEQ ID NO: 3224694 - RNA, 15 nt, Human
aaacuuguugaauuu

SEQ ID NO: 3224695 - RNA, 16 nt, Human
aaacuuguucuuccaa

SEQ ID NO: 3224696 - RNA, 14 nt, Human
aaacuuuaaaccug

SEQ ID NO: 3224697 - RNA, 22 nt, Human
aaacuuuaaaccuguagaauca

SEQ ID NO: 3224698 - RNA, 12 nt, Human
ggucccacccca

SEQ ID NO: 3224699 - RNA, 22 nt, Human
gguccacccaggagccccgagg

SEQ ID NO: 3224700 - RNA, 20 nt, Human
gguccacccaggagccccga

SEQ ID NO: 3224701 - RNA, 20 nt, Human
gguccacuuuuccaguauuu

SEQ ID NO: 3224702 - RNA, 14 nt, Human
aaagaugcaaugua

SEQ ID NO: 3224703 - RNA, 20 nt, Human
aaagaugagcuuugucuacu

SEQ ID NO: 3224704 - RNA, 17 nt, Human
aaagaugguuaaacauu

SEQ ID NO: 3224705 - RNA, 19 nt, Human
aaagaugguuaaacauuuu

SEQ ID NO: 3224706 - RNA, 20 nt, Human
aaagaugguuaaacauuuuc

SEQ ID NO: 3224707 - RNA, 12 nt, Human
aaagauguagca

SEQ ID NO: 3224708 - RNA, 15 nt, Human
aaagauguagcaaac

SEQ ID NO: 3224709 - RNA, 14 nt, Human
aaagauguagcaaa

SEQ ID NO: 3224710 - RNA, 16 nt, Human
aaagauguucuggaua

SEQ ID NO: 3224711 - RNA, 20 nt, Human
aaagaggcagcuugaaacug

SEQ ID NO: 3224712 - RNA, 18 nt, Human
aaagagagaaacacugaa

SEQ ID NO: 3224713 - RNA, 13 nt, Human
aaagaggcuaugu

SEQ ID NO: 3224714 - RNA, 18 nt, Human
aaagaggcuaugugagca

SEQ ID NO: 3224715 - RNA, 21 nt, Human
aaagaggccaaacaggcccuc

SEQ ID NO: 3224716 - RNA, 15 nt, Human
aaagaggcagcuuga

SEQ ID NO: 3224717 - RNA, 20 nt, Human
aaagaggcaguugcccagcc

SEQ ID NO: 3224718 - RNA, 22 nt, Human
aaagacuauucaaacagucuca

SEQ ID NO: 3224719 - RNA, 12 nt, Human
aaagacaaauag

SEQ ID NO: 3224720 - RNA, 11 nt, Human
aaagacaaaua

SEQ ID NO: 3224721 - RNA, 16 nt, Human
aaagaauuuuuggugu

SEQ ID NO: 3224722 - RNA, 13 nt, Human
aaagaauuuguca

SEQ ID NO: 3224723 - RNA, 13 nt, Human
aaagaauguaaag

SEQ ID NO: 3224724 - RNA, 17 nt, Human
aaagaauggaaggugga

SEQ ID NO: 3224725 - RNA, 23 nt, Human
aaagacuauucaaacagucucag

SEQ ID NO: 3224726 - RNA, 13 nt, Human
aaagacuccaaag

SEQ ID NO: 3224727 - RNA, 14 nt, Human
aaagacuguacaaa

SEQ ID NO: 3224728 - RNA, 14 nt, Human
aaagacaaauagua

SEQ ID NO: 3224729 - RNA, 15 nt, Human
aaagacuguacaaag

SEQ ID NO: 3224730 - RNA, 20 nt, Human
aaagagaccacccauaucau

SEQ ID NO: 3224731 - RNA, 14 nt, Human
aaagagacaggcag

SEQ ID NO: 3224732 - RNA, 14 nt, Human
aaagagaaaagaaa

SEQ ID NO: 3224733 - RNA, 18 nt, Human
aaagagaaaacaucucau

SEQ ID NO: 3224734 - RNA, 13 nt, Human
aaagagaaaagaa

SEQ ID NO: 3224735 - RNA, 12 nt, Human
aaagagaaaaga

SEQ ID NO: 3224736 - RNA, 19 nt, Human
aaagacuuuuccaacccuc

SEQ ID NO: 3224737 - RNA, 13 nt, Human
aaagacuuaaagg

SEQ ID NO: 3224738 - RNA, 17 nt, Human
gccuacccacccccagg

SEQ ID NO: 3224739 - RNA, 16 nt, Human
gccuacccacccccag

SEQ ID NO: 3224740 - RNA, 19 nt, Human
gccuacaugcuuugugaac

SEQ ID NO: 3224741 - RNA, 23 nt, Human
gccuacuccugucuucugcuuug

SEQ ID NO: 3224742 - RNA, 22 nt, Human
gccuacuccugucuucugcuuu

SEQ ID NO: 3224743 - RNA, 16 nt, Human
gccuacuccugucuuc

SEQ ID NO: 3224744 - RNA, 15 nt, Human
gccuacuccugucuu

SEQ ID NO: 3224745 - RNA, 13 nt, Human
gccuacuccuguc

SEQ ID NO: 3224746 - RNA, 13 nt, Human
gccuccuccagcc

SEQ ID NO: 3224747 - RNA, 18 nt, Human
gccuccugcccuuaccug

SEQ ID NO: 3224748 - RNA, 12 nt, Human
gccucugggacu

SEQ ID NO: 3224749 - RNA, 19 nt, Human
gccucuggcucuacacaua

SEQ ID NO: 3224750 - RNA, 18 nt, Human
gccuccuguggccugcca

SEQ ID NO: 3224751 - RNA, 14 nt, Human
gccuccuguggccu

SEQ ID NO: 3224752 - RNA, 20 nt, Human
gccuccuguggccugccagu

SEQ ID NO: 3224753 - RNA, 12 nt, Human
gccucuucucua

SEQ ID NO: 3224754 - RNA, 23 nt, Human
gccucuucucuacucuagggaaa

SEQ ID NO: 3224755 - RNA, 15 nt, Human
gccucuucugagcuu

SEQ ID NO: 3224756 - RNA, 15 nt, Human
gccucuucucucaga

SEQ ID NO: 3224757 - RNA, 16 nt, Human
gccucuucucucagac

SEQ ID NO: 3224758 - RNA, 12 nt, Human
gccucuuccucc

SEQ ID NO: 3224759 - RNA, 22 nt, Human
gccucuuccucccucauuccac

SEQ ID NO: 3224760 - RNA, 19 nt, Human
gccugcccaggccccugcc

SEQ ID NO: 3224761 - RNA, 18 nt, Human
gccugcccaggccccugc

SEQ ID NO: 3224762 - RNA, 17 nt, Human
gccugcccaggccccug

SEQ ID NO: 3224763 - RNA, 16 nt, Human
gccuggccccucaggg

SEQ ID NO: 3224764 - RNA, 17 nt, Human
gccuggccccucagggu

SEQ ID NO: 3224765 - RNA, 15 nt, Human
gccuggccccucagg

SEQ ID NO: 3224766 - RNA, 18 nt, Human
gccugggaucccucaucc

SEQ ID NO: 3224767 - RNA, 17 nt, Human
gccugggauaggggcag

SEQ ID NO: 3224768 - RNA, 22 nt, Human
gccugggaggucaaggcugcag

SEQ ID NO: 3224769 - RNA, 14 nt, Human
gccugggaucccuc

SEQ ID NO: 3224770 - RNA, 21 nt, Human
gccugggaggucaaggcugca

SEQ ID NO: 3224771 - RNA, 10 nt, Human
gccuggccug

SEQ ID NO: 3224772 - RNA, 20 nt, Human
gccuggccccucaggguccc

SEQ ID NO: 3224773 - RNA, 22 nt, Human
gccuggccccucagggucccug

SEQ ID NO: 3224774 - RNA, 16 nt, Human
gccugccucuucucua

SEQ ID NO: 3224775 - RNA, 17 nt, Human
gccugccuguucccauu

SEQ ID NO: 3224776 - RNA, 22 nt, Human
gccugccuugcccacuccugcu

SEQ ID NO: 3224777 - RNA, 20 nt, Human
gccugccuuaagugaggaaa

SEQ ID NO: 3224778 - RNA, 21 nt, Human
gccugccuuaagugaggaaau

SEQ ID NO: 3224779 - RNA, 20 nt, Human
gccugccuuuggcacucuga

SEQ ID NO: 3224780 - RNA, 14 nt, Human
gcccaugggaggga

SEQ ID NO: 3224781 - RNA, 15 nt, Human
gcccaugggagggag

SEQ ID NO: 3224782 - RNA, 16 nt, Human
gcccaugggagggagc

SEQ ID NO: 3224783 - RNA, 15 nt, Human
gcccauguauggcca

SEQ ID NO: 3224784 - RNA, 21 nt, Human
gcccauguauggccaggaagu

SEQ ID NO: 3224785 - RNA, 20 nt, Human
gcccauguauggccaggaag

SEQ ID NO: 3224786 - RNA, 18 nt, Human
gcccauguauggccagga

SEQ ID NO: 3224787 - RNA, 17 nt, Human
gcccauguauggccagg

SEQ ID NO: 3224788 - RNA, 16 nt, Human
gcccauguauggccag

SEQ ID NO: 3224789 - RNA, 19 nt, Human
gcccacuccugcucugcuc

SEQ ID NO: 3224790 - RNA, 14 nt, Human
gcccacucccugca

SEQ ID NO: 3224791 - RNA, 15 nt, Human
gcccacucccugcaa

SEQ ID NO: 3224792 - RNA, 19 nt, Human
gcccacucccugcaaccug

SEQ ID NO: 3224793 - RNA, 18 nt, Human
gcccacuccugcucugcu

SEQ ID NO: 3224794 - RNA, 17 nt, Human
gcccacuccugcucugc

SEQ ID NO: 3224795 - RNA, 16 nt, Human
gcccacuccugcucug

SEQ ID NO: 3224796 - RNA, 15 nt, Human
gcccacuccugcucu

SEQ ID NO: 3224797 - RNA, 13 nt, Human
gcccacuccugcu

SEQ ID NO: 3224798 - RNA, 13 nt, Human
gcccacucccugc

SEQ ID NO: 3224799 - RNA, 23 nt, Human
gcccacuagacccacuggacuca

SEQ ID NO: 3224800 - RNA, 22 nt, Human
gcccacgcugacuacagggccg

SEQ ID NO: 3224801 - RNA, 19 nt, Human
gcccacgcugacuacaggg

SEQ ID NO: 3224802 - RNA, 18 nt, Human
gcccacgcugacuacagg

SEQ ID NO: 3224803 - RNA, 17 nt, Human
gcccacuagacccacug

SEQ ID NO: 3224804 - RNA, 23 nt, Human
gcccuaaugcgcaggcuggcccu

SEQ ID NO: 3224805 - RNA, 15 nt, Human
gccccuggaugcagc

SEQ ID NO: 3224806 - RNA, 16 nt, Human
gccccuggaugcagcc

SEQ ID NO: 3224807 - RNA, 18 nt, Human
gccccuggaugcagccuc

SEQ ID NO: 3224808 - RNA, 22 nt, Human
gccccuggaugcagccucacag

SEQ ID NO: 3224809 - RNA, 15 nt, Human
gccccugccccugcc

SEQ ID NO: 3224810 - RNA, 15 nt, Human
gcccguggggccggg

SEQ ID NO: 3224811 - RNA, 19 nt, Human
gcccguggggccggggcuu

SEQ ID NO: 3224812 - RNA, 22 nt, Human
gcccguggggccggggcuucug

SEQ ID NO: 3224813 - RNA, 16 nt, Human
gcccccaggugccagu

SEQ ID NO: 3224814 - RNA, 18 nt, Human
gccccaaaacucuccucu

SEQ ID NO: 3224815 - RNA, 20 nt, Human
gcccauuugggcagagaggc

SEQ ID NO: 3224816 - RNA, 19 nt, Human
gcccauuugggcagagagg

SEQ ID NO: 3224817 - RNA, 19 nt, Human
gcccauguggagucagccu

SEQ ID NO: 3224818 - RNA, 17 nt, Human
gcccauuuggagggccu

SEQ ID NO: 3224819 - RNA, 16 nt, Human
gcccauuuggagggcc

SEQ ID NO: 3224820 - RNA, 18 nt, Human
gcccauuugggcagagag

SEQ ID NO: 3224821 - RNA, 15 nt, Human
gcccauuugggcaga

SEQ ID NO: 3224822 - RNA, 20 nt, Human
gcccauuuggagggccuggg

SEQ ID NO: 3224823 - RNA, 18 nt, Human
gcccauuuggagggccug

SEQ ID NO: 3224824 - RNA, 14 nt, Human
gccccugcccggcu

SEQ ID NO: 3224825 - RNA, 13 nt, Human
gccccugcccggc

SEQ ID NO: 3224826 - RNA, 13 nt, Human
gcccuguuaaaag

SEQ ID NO: 3224827 - RNA, 23 nt, Human
gcccugcugagucccaggcugag

SEQ ID NO: 3224828 - RNA, 21 nt, Human
gcccugcugagucccaggcug

SEQ ID NO: 3224829 - RNA, 22 nt, Human
gcccugcugagucccaggcuga

SEQ ID NO: 3224830 - RNA, 17 nt, Human
gcccuguuaaaagauga

SEQ ID NO: 3224831 - RNA, 14 nt, Human
gcccuguuaaaaga

SEQ ID NO: 3224832 - RNA, 21 nt, Human
gcccugugggcccccaaaugg

SEQ ID NO: 3224833 - RNA, 16 nt, Human
gcccugccuccuuugu

SEQ ID NO: 3224834 - RNA, 22 nt, Human
gcccugccuccuuugugaggaa

SEQ ID NO: 3224835 - RNA, 16 nt, Human
gcccugcugaguccca

SEQ ID NO: 3224836 - RNA, 21 nt, Human
gcccugccucuccgccccuga

SEQ ID NO: 3224837 - RNA, 18 nt, Human
gcccugccucuccgcccc

SEQ ID NO: 3224838 - RNA, 17 nt, Human
gcccugccucuccgccc

SEQ ID NO: 3224839 - RNA, 15 nt, Human
gcccugccucuccgc

SEQ ID NO: 3224840 - RNA, 13 nt, Human
gcccugccucucc

SEQ ID NO: 3224841 - RNA, 14 nt, Human
gcccugccuccuuu

SEQ ID NO: 3224842 - RNA, 15 nt, Human
gccgccuucacagca

SEQ ID NO: 3224843 - RNA, 15 nt, Human
gccgccaugcuccug

SEQ ID NO: 3224844 - RNA, 16 nt, Human
gcccuuaccugccagg

SEQ ID NO: 3224845 - RNA, 20 nt, Human
gcccuuaccugccaggaagc

SEQ ID NO: 3224846 - RNA, 16 nt, Human
gccgccaugcuccugg

SEQ ID NO: 3224847 - RNA, 20 nt, Human
gccauauucuguuggccagu

SEQ ID NO: 3224848 - RNA, 19 nt, Human
gccauauucuguuggccag

SEQ ID NO: 3224849 - RNA, 14 nt, Human
gccauguuggccag

SEQ ID NO: 3224850 - RNA, 18 nt, Human
gccauguuggccaggcug

SEQ ID NO: 3224851 - RNA, 17 nt, Human
gccauguuggccaggcu

SEQ ID NO: 3224852 - RNA, 16 nt, Human
gccauguuggccaggc

SEQ ID NO: 3224853 - RNA, 15 nt, Human
gccauguuggccagg

SEQ ID NO: 3224854 - RNA, 24 nt, Human
gccauguuggccaggcuggucuca

SEQ ID NO: 3224855 - RNA, 22 nt, Human
gccauguuggccaggcuggucu

SEQ ID NO: 3224856 - RNA, 20 nt, Human
gccauguuggccaggcuggu

SEQ ID NO: 3224857 - RNA, 19 nt, Human
gccauguuggccaggcugg

SEQ ID NO: 3224858 - RNA, 17 nt, Human
gccauuccccgucucug

SEQ ID NO: 3224859 - RNA, 18 nt, Human
gccauuccccgucucugg

SEQ ID NO: 3224860 - RNA, 16 nt, Human
gccauuccaaaauauu

SEQ ID NO: 3224861 - RNA, 13 nt, Human
gcccacgccccca

SEQ ID NO: 3224862 - RNA, 14 nt, Human
gcccacgcccccac

SEQ ID NO: 3224863 - RNA, 18 nt, Human
gcccaccuuggcucaagu

SEQ ID NO: 3224864 - RNA, 17 nt, Human
gcccaccuuggcucaag

SEQ ID NO: 3224865 - RNA, 17 nt, Human
gcccacgcuggagugca

SEQ ID NO: 3224866 - RNA, 16 nt, Human
gcccacgcuggagugc

SEQ ID NO: 3224867 - RNA, 15 nt, Human
gcccacgcuggagug

SEQ ID NO: 3224868 - RNA, 17 nt, Human
gccauucugacucauau

SEQ ID NO: 3224869 - RNA, 15 nt, Human
gccauucugauuauu

SEQ ID NO: 3224870 - RNA, 15 nt, Human
gcccacgcugacuac

SEQ ID NO: 3224871 - RNA, 19 nt, Human
gccaggccacuggccccug

SEQ ID NO: 3224872 - RNA, 15 nt, Human
gccaggcccucugcc

SEQ ID NO: 3224873 - RNA, 13 nt, Human
gccaggccagagg

SEQ ID NO: 3224874 - RNA, 16 nt, Human
gccaggcccucugccc

SEQ ID NO: 3224875 - RNA, 17 nt, Human
gccaggcccucugccca

SEQ ID NO: 3224876 - RNA, 19 nt, Human
gccaggcccucugcccacu

SEQ ID NO: 3224877 - RNA, 20 nt, Human
gccaggcccucugcccacuc

SEQ ID NO: 3224878 - RNA, 21 nt, Human
gccaggcccucugcccacucc

SEQ ID NO: 3224879 - RNA, 22 nt, Human
gccagccaagcuuuaaauuaug

SEQ ID NO: 3224880 - RNA, 12 nt, Human
gccaggccagag

SEQ ID NO: 3224881 - RNA, 23 nt, Human
gccaggccacaagacccuugugg

SEQ ID NO: 3224882 - RNA, 17 nt, Human
gccagacccccuggaga

SEQ ID NO: 3224883 - RNA, 22 nt, Human
gccagacgcucauucagcaucu

SEQ ID NO: 3224884 - RNA, 20 nt, Human
gccagcaaaacuuagaugug

SEQ ID NO: 3224885 - RNA, 16 nt, Human
gccagaaguagcuuug

SEQ ID NO: 3224886 - RNA, 16 nt, Human
gccagaacucuguguc

SEQ ID NO: 3224887 - RNA, 18 nt, Human
gccagaaguagcuuugca

SEQ ID NO: 3224888 - RNA, 15 nt, Human
gccagaauuucaaac

SEQ ID NO: 3224889 - RNA, 22 nt, Human
gccagacaucaacagauaaaua

SEQ ID NO: 3224890 - RNA, 13 nt, Human
gccagcaggcucu

SEQ ID NO: 3224891 - RNA, 16 nt, Human
gccagcaggcucucag

SEQ ID NO: 3224892 - RNA, 19 nt, Human
gccagccaaacacacagaa

SEQ ID NO: 3224893 - RNA, 22 nt, Human
gccagccaaacacacagaaggg

SEQ ID NO: 3224894 - RNA, 21 nt, Human
gccagccaaacacacagaagg

SEQ ID NO: 3224895 - RNA, 20 nt, Human
gccagccaaacacacagaag

SEQ ID NO: 3224896 - RNA, 21 nt, Human
gccagcaggcucucaggccag

SEQ ID NO: 3224897 - RNA, 17 nt, Human
gccagcaggcucucagg

SEQ ID NO: 3224898 - RNA, 18 nt, Human
gccagcaggcucucaggc

SEQ ID NO: 3224899 - RNA, 19 nt, Human
gccagcaggcucucaggcc

SEQ ID NO: 3224900 - RNA, 20 nt, Human
gccagcaggcucucaggcca

SEQ ID NO: 3224901 - RNA, 18 nt, Human
gcacuuggagacuuguau

SEQ ID NO: 3224902 - RNA, 23 nt, Human
gcacuugggggcucagcaaggcc

SEQ ID NO: 3224903 - RNA, 22 nt, Human
gcacuugggggcucagcaaggc

SEQ ID NO: 3224904 - RNA, 21 nt, Human
gcacuugggggcucagcaagg

SEQ ID NO: 3224905 - RNA, 19 nt, Human
gcacuugggggcucagcaa

SEQ ID NO: 3224906 - RNA, 18 nt, Human
gcacuugggggcucagca

SEQ ID NO: 3224907 - RNA, 16 nt, Human
gccacauuccugaugc

SEQ ID NO: 3224908 - RNA, 20 nt, Human
gccacauuccugaugcuucu

SEQ ID NO: 3224909 - RNA, 21 nt, Human
gccacauugaaaaauguccac

SEQ ID NO: 3224910 - RNA, 24 nt, Human
gccaccacgccuagccucacgcuc

SEQ ID NO: 3224911 - RNA, 21 nt, Human
gccaccagaugugacaguguu

SEQ ID NO: 3224912 - RNA, 20 nt, Human
gccaccaacauacucccauc

SEQ ID NO: 3224913 - RNA, 21 nt, Human
gccaccaacauacucccaucu

SEQ ID NO: 3224914 - RNA, 19 nt, Human
gccaccaacauacucccau

SEQ ID NO: 3224915 - RNA, 21 nt, Human
gccaccaacagccacucagaa

SEQ ID NO: 3224916 - RNA, 22 nt, Human
gccaccaacauacucccaucug

SEQ ID NO: 3224917 - RNA, 13 nt, Human
gccaccacgcccg

SEQ ID NO: 3224918 - RNA, 23 nt, Human
gccaccaagugaaaaauguuagg

SEQ ID NO: 3224919 - RNA, 14 nt, Human
gccaccacgcccgg

SEQ ID NO: 3224920 - RNA, 17 nt, Human
gccaccacgccuagccu

SEQ ID NO: 3224921 - RNA, 16 nt, Human
gccaccgccuccuaca

SEQ ID NO: 3224922 - RNA, 23 nt, Human
gccacugcaccgggccacagaga

SEQ ID NO: 3224923 - RNA, 19 nt, Human
gccacccuggggagaaagu

SEQ ID NO: 3224924 - RNA, 13 nt, Human
gccacccugggga

SEQ ID NO: 3224925 - RNA, 21 nt, Human
gccacugcacuauagccuagg

SEQ ID NO: 3224926 - RNA, 22 nt, Human
gccacugcaccgggccacagag

SEQ ID NO: 3224927 - RNA, 13 nt, Human
gccacccugugca

SEQ ID NO: 3224928 - RNA, 12 nt, Human
gccacccugugc

SEQ ID NO: 3224929 - RNA, 14 nt, Human
gccacccaaagcag

SEQ ID NO: 3224930 - RNA, 19 nt, Human
gccacugugaagagaacca

SEQ ID NO: 3224931 - RNA, 18 nt, Human
gccacugugaagagaacc

SEQ ID NO: 3224932 - RNA, 12 nt, Human
gccacugccucu

SEQ ID NO: 3224933 - RNA, 13 nt, Human
gccacugccucuu

SEQ ID NO: 3224934 - RNA, 17 nt, Human
gccacugccucuuccuc

SEQ ID NO: 3224935 - RNA, 16 nt, Human
gccacugccucuuccu

SEQ ID NO: 3224936 - RNA, 21 nt, Human
gccacuugaugacccccaacc

SEQ ID NO: 3224937 - RNA, 18 nt, Human
gccacuuuccaagucacu

SEQ ID NO: 3224938 - RNA, 19 nt, Human
gccacuuugcaaaggagcu

SEQ ID NO: 3224939 - RNA, 13 nt, Human
gccacuuuccaag

SEQ ID NO: 3224940 - RNA, 14 nt, Human
gcugcaccggcugg

SEQ ID NO: 3224941 - RNA, 16 nt, Human
gcugcaccggcuggcc

SEQ ID NO: 3224942 - RNA, 17 nt, Human
gcugcaccggcuggccu

SEQ ID NO: 3224943 - RNA, 18 nt, Human
gcugcaccggcuggccug

SEQ ID NO: 3224944 - RNA, 19 nt, Human
gcugcaccggcuggccugg

SEQ ID NO: 3224945 - RNA, 22 nt, Human
gcugcaccggcuggccuggccc

SEQ ID NO: 3224946 - RNA, 13 nt, Human
gcugccaccugcc

SEQ ID NO: 3224947 - RNA, 19 nt, Human
gcugccagccgagauagcc

SEQ ID NO: 3224948 - RNA, 21 nt, Human
gcugccagccgagauagccaa

SEQ ID NO: 3224949 - RNA, 23 nt, Human
gcugccauccagguucagcuugu

SEQ ID NO: 3224950 - RNA, 21 nt, Human
gcugccauccagguucagcuu

SEQ ID NO: 3224951 - RNA, 10 nt, Human
gcugccagua

SEQ ID NO: 3224952 - RNA, 15 nt, Human
gcugaggguccagaa

SEQ ID NO: 3224953 - RNA, 18 nt, Human
gcugaauguauguaaaua

SEQ ID NO: 3224954 - RNA, 19 nt, Human
gcugccugggaucccucau

SEQ ID NO: 3224955 - RNA, 16 nt, Human
gcugccugggaucccu

SEQ ID NO: 3224956 - RNA, 18 nt, Human
gcugccugggaucccuca

SEQ ID NO: 3224957 - RNA, 23 nt, Human
gcugcucugccccagcuugggca

SEQ ID NO: 3224958 - RNA, 20 nt, Human
gcugcugagccgcagagaag

SEQ ID NO: 3224959 - RNA, 17 nt, Human
gcugcucugccccagcu

SEQ ID NO: 3224960 - RNA, 14 nt, Human
gcugcucugcccca

SEQ ID NO: 3224961 - RNA, 13 nt, Human
gcugcucugcccc

SEQ ID NO: 3224962 - RNA, 12 nt, Human
gcugcucugccc

SEQ ID NO: 3224963 - RNA, 20 nt, Human
gcugcucucaaaccccugac

SEQ ID NO: 3224964 - RNA, 13 nt, Human
gcugccugggauc

SEQ ID NO: 3224965 - RNA, 14 nt, Human
gcugccuaaaucca

SEQ ID NO: 3224966 - RNA, 22 nt, Human
gcugccuaaauccacucugcag

SEQ ID NO: 3224967 - RNA, 15 nt, Human
gcuggguguggcgca

SEQ ID NO: 3224968 - RNA, 20 nt, Human
gcugggcacugcucucaccu

SEQ ID NO: 3224969 - RNA, 19 nt, Human
gcugggcagaggaaagcaa

SEQ ID NO: 3224970 - RNA, 16 nt, Human
gcugggcagaggaaag

SEQ ID NO: 3224971 - RNA, 17 nt, Human
gcugggcagaggaaagc

SEQ ID NO: 3224972 - RNA, 12 nt, Human
gcugggcucccu

SEQ ID NO: 3224973 - RNA, 16 nt, Human
gcugggcucccuuccc

SEQ ID NO: 3224974 - RNA, 17 nt, Human
gcugggcucccuuccca

SEQ ID NO: 3224975 - RNA, 20 nt, Human
gcugggcucccuucccaccu

SEQ ID NO: 3224976 - RNA, 18 nt, Human
gcuggccuggccccucag

SEQ ID NO: 3224977 - RNA, 19 nt, Human
gcuggccuggccccucagg

SEQ ID NO: 3224978 - RNA, 16 nt, Human
gcugggauuacaggug

SEQ ID NO: 3224979 - RNA, 22 nt, Human
gcugggauuacaggcuccugcc

SEQ ID NO: 3224980 - RNA, 23 nt, Human
gcugggauuacaggcuccugcca

SEQ ID NO: 3224981 - RNA, 16 nt, Human
gcuggccuggccccuc

SEQ ID NO: 3224982 - RNA, 17 nt, Human
gcuggccuggccccuca

SEQ ID NO: 3224983 - RNA, 15 nt, Human
gcuggagugcaguga

SEQ ID NO: 3224984 - RNA, 14 nt, Human
gcuggagugcagug

SEQ ID NO: 3224985 - RNA, 14 nt, Human
gcugggcagaggaa

SEQ ID NO: 3224986 - RNA, 15 nt, Human
gcugggcagaggaaa

SEQ ID NO: 3224987 - RNA, 13 nt, Human
gcugggcagagga

SEQ ID NO: 3224988 - RNA, 19 nt, Human
gcugggcacugcucucacc

SEQ ID NO: 3224989 - RNA, 15 nt, Human
gcugggcacugcucu

SEQ ID NO: 3224990 - RNA, 18 nt, Human
gcugggauuacaggugug

SEQ ID NO: 3224991 - RNA, 17 nt, Human
gcugggauuacaggugu

SEQ ID NO: 3224992 - RNA, 19 nt, Human
gcugggauuacagguguga

SEQ ID NO: 3224993 - RNA, 21 nt, Human
gcugggauuacaggcuccugc

SEQ ID NO: 3224994 - RNA, 14 nt, Human
gcuggagcucugcc

SEQ ID NO: 3224995 - RNA, 16 nt, Human
gcuggacucccucaag

SEQ ID NO: 3224996 - RNA, 17 nt, Human
gcuggagcucugcccau

SEQ ID NO: 3224997 - RNA, 12 nt, Human
gcuggagugcag

SEQ ID NO: 3224998 - RNA, 22 nt, Human
gcuggaccuugaacuggguacu

SEQ ID NO: 3224999 - RNA, 19 nt, Human
gcuucccugguucaagcga

SEQ ID NO: 3225000 - RNA, 16 nt, Human
gcuucccuuuuuuccu

SEQ ID NO: 3225001 - RNA, 19 nt, Human
gcuucccuuuuuuccuuuc

SEQ ID NO: 3225002 - RNA, 18 nt, Human
gcuucccgcucagcccuc

SEQ ID NO: 3225003 - RNA, 17 nt, Human
gcuucccgcucagcccu

SEQ ID NO: 3225004 - RNA, 16 nt, Human
gcuucccgcucagccc

SEQ ID NO: 3225005 - RNA, 15 nt, Human
gcuucccgcucagcc

SEQ ID NO: 3225006 - RNA, 23 nt, Human
gcuucccgcucagcccucccugc

SEQ ID NO: 3225007 - RNA, 14 nt, Human
gcuucccucccugc

SEQ ID NO: 3225008 - RNA, 23 nt, Human
gcuucccaaaugugugcccagcu

SEQ ID NO: 3225009 - RNA, 12 nt, Human
gcuuccccuccc

SEQ ID NO: 3225010 - RNA, 16 nt, Human
gcuuccccaguagcug

SEQ ID NO: 3225011 - RNA, 14 nt, Human
gcuuccccaguagc

SEQ ID NO: 3225012 - RNA, 23 nt, Human
gcuucuuucaagggcuuuccugu

SEQ ID NO: 3225013 - RNA, 22 nt, Human
gcuucuuucaagggcuuuccug

SEQ ID NO: 3225014 - RNA, 21 nt, Human
gcuucuuucaagggcuuuccu

SEQ ID NO: 3225015 - RNA, 20 nt, Human
gcuucuuuaaaaaagcuaua

SEQ ID NO: 3225016 - RNA, 14 nt, Human
gcuucggcauuuga

SEQ ID NO: 3225017 - RNA, 15 nt, Human
gcuugggaauuuuau

SEQ ID NO: 3225018 - RNA, 16 nt, Human
gcuugggcagaucucc

SEQ ID NO: 3225019 - RNA, 20 nt, Human
gcuguaaaagcaaguccugc

SEQ ID NO: 3225020 - RNA, 12 nt, Human
gcuguaaaagca

SEQ ID NO: 3225021 - RNA, 19 nt, Human
gcuguaucccaugagccuc

SEQ ID NO: 3225022 - RNA, 14 nt, Human
gcuguaucugugcu

SEQ ID NO: 3225023 - RNA, 23 nt, Human
gcuguaucccaugagccucagca

SEQ ID NO: 3225024 - RNA, 20 nt, Human
gcuguaucccaugagccuca

SEQ ID NO: 3225025 - RNA, 17 nt, Human
gcuguaaggcaugaagg

SEQ ID NO: 3225026 - RNA, 19 nt, Human
gcuguaaggcaugaaggau

SEQ ID NO: 3225027 - RNA, 18 nt, Human
gcuguaaggcaugaagga

SEQ ID NO: 3225028 - RNA, 15 nt, Human
gcuggguucuaccca

SEQ ID NO: 3225029 - RNA, 15 nt, Human
gcuggguucugaucc

SEQ ID NO: 3225030 - RNA, 21 nt, Human
gcuggguuggaggguguccca

SEQ ID NO: 3225031 - RNA, 14 nt, Human
gcuggguuggaggg

SEQ ID NO: 3225032 - RNA, 19 nt, Human
gcugugcugcccugcccac

SEQ ID NO: 3225033 - RNA, 22 nt, Human
gcugugcugcccugcccaccug

SEQ ID NO: 3225034 - RNA, 22 nt, Human
gcuguuggcugggggccucagu

SEQ ID NO: 3225035 - RNA, 21 nt, Human
gcuguuggcugggggccucag

SEQ ID NO: 3225036 - RNA, 15 nt, Human
gcuguugucucuucu

SEQ ID NO: 3225037 - RNA, 14 nt, Human
gcuguugucucuuc

SEQ ID NO: 3225038 - RNA, 12 nt, Human
gcugugcugccc

SEQ ID NO: 3225039 - RNA, 21 nt, Human
gcugugcucuggacaggcaug

SEQ ID NO: 3225040 - RNA, 13 nt, Human
gcugugcugcccu

SEQ ID NO: 3225041 - RNA, 18 nt, Human
gcugugcucuggacaggc

SEQ ID NO: 3225042 - RNA, 17 nt, Human
gcugugcugcccugccc

SEQ ID NO: 3225043 - RNA, 13 nt, Human
gcugugaaaaaaa

SEQ ID NO: 3225044 - RNA, 22 nt, Human
gcugucuuuucuuugccaucuc

SEQ ID NO: 3225045 - RNA, 18 nt, Human
gcugucuuuucuuugcca

SEQ ID NO: 3225046 - RNA, 23 nt, Human
gcugucuuucuugcucccugacu

SEQ ID NO: 3225047 - RNA, 20 nt, Human
gcugucuuucuugcucccug

SEQ ID NO: 3225048 - RNA, 22 nt, Human
gcuucaaggauccugagccaga

SEQ ID NO: 3225049 - RNA, 21 nt, Human
gcuuaaaguugguauuaauaa

SEQ ID NO: 3225050 - RNA, 13 nt, Human
gcuuaaaugugaa

SEQ ID NO: 3225051 - RNA, 12 nt, Human
gcuuaaauguga

SEQ ID NO: 3225052 - RNA, 13 nt, Human
gcuuaaauuuuaa

SEQ ID NO: 3225053 - RNA, 14 nt, Human
gcuuaaauuuuaac

SEQ ID NO: 3225054 - RNA, 17 nt, Human
gcuuaaaugugaauuac

SEQ ID NO: 3225055 - RNA, 14 nt, Human
gcuuaaaugugaau

SEQ ID NO: 3225056 - RNA, 20 nt, Human
gcuuaaaagaaaauguucac

SEQ ID NO: 3225057 - RNA, 19 nt, Human
gcuucacggaagagccuug

SEQ ID NO: 3225058 - RNA, 22 nt, Human
gcuucacaggacaggaaagugg

SEQ ID NO: 3225059 - RNA, 14 nt, Human
gcuucacaggacag

SEQ ID NO: 3225060 - RNA, 23 nt, Human
gcuuaaaugugaauuacuaacuu

SEQ ID NO: 3225061 - RNA, 20 nt, Human
gcuucacggaagagccuugc

SEQ ID NO: 3225062 - RNA, 12 nt, Human
gcuucacuucug

SEQ ID NO: 3225063 - RNA, 21 nt, Human
gcuucacuucugacucuuccc

SEQ ID NO: 3225064 - RNA, 19 nt, Human
gccuguucagcuccagcuc

SEQ ID NO: 3225065 - RNA, 17 nt, Human
gccuguucagcuccagc

SEQ ID NO: 3225066 - RNA, 20 nt, Human
gccuguucagcuccagcuca

SEQ ID NO: 3225067 - RNA, 21 nt, Human
gcuauggggauagaugugugg

SEQ ID NO: 3225068 - RNA, 19 nt, Human
gcuauggggauagaugugu

SEQ ID NO: 3225069 - RNA, 16 nt, Human
gcuauugucaccaggg

SEQ ID NO: 3225070 - RNA, 17 nt, Human
gcuaugucauuucaugu

SEQ ID NO: 3225071 - RNA, 16 nt, Human
gcuaugucauuucaug

SEQ ID NO: 3225072 - RNA, 12 nt, Human
gcuaugucauuu

SEQ ID NO: 3225073 - RNA, 20 nt, Human
gcuauugucaccagggcugg

SEQ ID NO: 3225074 - RNA, 21 nt, Human
gcuauugucaccagggcugga

SEQ ID NO: 3225075 - RNA, 16 nt, Human
gcuaguaucaaaagaa

SEQ ID NO: 3225076 - RNA, 22 nt, Human
gcuagucaacaguacccugguu

SEQ ID NO: 3225077 - RNA, 13 nt, Human
gcuagucaacagu

SEQ ID NO: 3225078 - RNA, 22 nt, Human
gcuaggcagggugucugccccc

SEQ ID NO: 3225079 - RNA, 15 nt, Human
gcuaggccuggccag

SEQ ID NO: 3225080 - RNA, 14 nt, Human
gcuaggccuggcca

SEQ ID NO: 3225081 - RNA, 22 nt, Human
gcuaggaccccuccaugugggc

SEQ ID NO: 3225082 - RNA, 20 nt, Human
gcuaggcagggugucugccc

SEQ ID NO: 3225083 - RNA, 19 nt, Human
gcuaggcagggugucugcc

SEQ ID NO: 3225084 - RNA, 19 nt, Human
gcuaggaacacuccuucac

SEQ ID NO: 3225085 - RNA, 21 nt, Human
gcuaggaacacuccuucacag

SEQ ID NO: 3225086 - RNA, 18 nt, Human
gcuaggaacacuccuuca

SEQ ID NO: 3225087 - RNA, 16 nt, Human
gcuaggaacacuccuu

SEQ ID NO: 3225088 - RNA, 18 nt, Human
gcucagagagggugggag

SEQ ID NO: 3225089 - RNA, 20 nt, Human
gcucagagagggugggagug

SEQ ID NO: 3225090 - RNA, 15 nt, Human
gcucagagagggugg

SEQ ID NO: 3225091 - RNA, 12 nt, Human
gcucagggccug

SEQ ID NO: 3225092 - RNA, 13 nt, Human
gcucagggccugg

SEQ ID NO: 3225093 - RNA, 16 nt, Human
gcucagggccuggcuc

SEQ ID NO: 3225094 - RNA, 22 nt, Human
gcucagggugcuagaggauuag

SEQ ID NO: 3225095 - RNA, 21 nt, Human
gcucagguggggucacucugg

SEQ ID NO: 3225096 - RNA, 22 nt, Human
gcucagguggggucacucuggc

SEQ ID NO: 3225097 - RNA, 22 nt, Human
gcucuacagcuaaucagcauuc

SEQ ID NO: 3225098 - RNA, 20 nt, Human
gcucuacagcuaaucagcau

SEQ ID NO: 3225099 - RNA, 13 nt, Human
gcucucaggccag

SEQ ID NO: 3225100 - RNA, 14 nt, Human
gcucucaggccagc

SEQ ID NO: 3225101 - RNA, 15 nt, Human
gcucucaggccagcu

SEQ ID NO: 3225102 - RNA, 15 nt, Human
gcuccccucggagaa

SEQ ID NO: 3225103 - RNA, 21 nt, Human
gcuccugccaccacgcccggc

SEQ ID NO: 3225104 - RNA, 22 nt, Human
gcuccugccaccacgcccggcu

SEQ ID NO: 3225105 - RNA, 11 nt, Human
gcuccugcccc

SEQ ID NO: 3225106 - RNA, 11 nt, Human
gcuccugccca

SEQ ID NO: 3225107 - RNA, 14 nt, Human
gcuccugcccccau

SEQ ID NO: 3225108 - RNA, 22 nt, Human
gcucccaggcauuccccaggag

SEQ ID NO: 3225109 - RNA, 17 nt, Human
gcucccaggcauucccc

SEQ ID NO: 3225110 - RNA, 14 nt, Human
gcuccccagcccca

SEQ ID NO: 3225111 - RNA, 18 nt, Human
gcucccccuccaccugcu

SEQ ID NO: 3225112 - RNA, 17 nt, Human
gcucccccuuuucccuc

SEQ ID NO: 3225113 - RNA, 13 nt, Human
gcucccccuuuuc

SEQ ID NO: 3225114 - RNA, 19 nt, Human
gcuccccuaaagccucaaa

SEQ ID NO: 3225115 - RNA, 20 nt, Human
gcucccaggcauuccccagg

SEQ ID NO: 3225116 - RNA, 21 nt, Human
gcucccaggcauuccccagga

SEQ ID NO: 3225117 - RNA, 21 nt, Human
gcucugagcaaauguggcucc

SEQ ID NO: 3225118 - RNA, 20 nt, Human
gcucugagcaaauguggcuc

SEQ ID NO: 3225119 - RNA, 22 nt, Human
gcucugagagcaaacuggcuug

SEQ ID NO: 3225120 - RNA, 16 nt, Human
gcucuguccugggagu

SEQ ID NO: 3225121 - RNA, 19 nt, Human
gcucugucgcccaggcugg

SEQ ID NO: 3225122 - RNA, 23 nt, Human
gcucuguugcccaggcuggagug

SEQ ID NO: 3225123 - RNA, 22 nt, Human
gcucuguugcccaggcuggagu

SEQ ID NO: 3225124 - RNA, 18 nt, Human
gcucuguugcccaggcug

SEQ ID NO: 3225125 - RNA, 16 nt, Human
gcucuguugcccaggc

SEQ ID NO: 3225126 - RNA, 15 nt, Human
gcucuguugcccagg

SEQ ID NO: 3225127 - RNA, 14 nt, Human
gcucuguccuggga

SEQ ID NO: 3225128 - RNA, 15 nt, Human
gcucuguccugggag

SEQ ID NO: 3225129 - RNA, 15 nt, Human
gcucuuccaggcugg

SEQ ID NO: 3225130 - RNA, 16 nt, Human
gcucuuccaggcuggg

SEQ ID NO: 3225131 - RNA, 12 nt, Human
gcucuuccaggc

SEQ ID NO: 3225132 - RNA, 22 nt, Human
gcugaauacagaggcaacugca

SEQ ID NO: 3225133 - RNA, 17 nt, Human
gcugaaugguuuucaaa

SEQ ID NO: 3225134 - RNA, 12 nt, Human
gcugaaggcucg

SEQ ID NO: 3225135 - RNA, 20 nt, Human
gcugaaggcucgagcaugcc

SEQ ID NO: 3225136 - RNA, 11 nt, Human
gcugaaauuga

SEQ ID NO: 3225137 - RNA, 19 nt, Human
gcugaaauugaaaaguuau

SEQ ID NO: 3225138 - RNA, 16 nt, Human
gcugaaauuuuagaaa

SEQ ID NO: 3225139 - RNA, 17 nt, Human
gcugaaauuuuagaaau

SEQ ID NO: 3225140 - RNA, 19 nt, Human
gcugaaauuuuagaaauau

SEQ ID NO: 3225141 - RNA, 19 nt, Human
gcugaacacauuucuuuuu

SEQ ID NO: 3225142 - RNA, 18 nt, Human
gcugaacacauuucuuuu

SEQ ID NO: 3225143 - RNA, 16 nt, Human
gcugaacacauuucuu

SEQ ID NO: 3225144 - RNA, 17 nt, Human
gcugaaauugaaaaguu

SEQ ID NO: 3225145 - RNA, 16 nt, Human
gcugacagacacaggc

SEQ ID NO: 3225146 - RNA, 21 nt, Human
gcugaauugagccuaaaaaua

SEQ ID NO: 3225147 - RNA, 13 nt, Human
gcugacagacaca

SEQ ID NO: 3225148 - RNA, 13 nt, Human
gcugaauugagcc

SEQ ID NO: 3225149 - RNA, 15 nt, Human
gcugacagacacagg

SEQ ID NO: 3225150 - RNA, 14 nt, Human
gcugacagacacag

SEQ ID NO: 3225151 - RNA, 17 nt, Human
cacccuggggagaaagu

SEQ ID NO: 3225152 - RNA, 16 nt, Human
caccugccccucaacu

SEQ ID NO: 3225153 - RNA, 18 nt, Human
caccugccccucaacucu

SEQ ID NO: 3225154 - RNA, 21 nt, Human
caccugccccucaacucuccu

SEQ ID NO: 3225155 - RNA, 11 nt, Human
caccugccagg

SEQ ID NO: 3225156 - RNA, 12 nt, Human
caccugccaggg

SEQ ID NO: 3225157 - RNA, 12 nt, Human
cacccuccuuuc

SEQ ID NO: 3225158 - RNA, 22 nt, Human
cacccuccuucccacucuucuc

SEQ ID NO: 3225159 - RNA, 20 nt, Human
cacccuccuucccacucuuc

SEQ ID NO: 3225160 - RNA, 12 nt, Human
cacccuccuucc

SEQ ID NO: 3225161 - RNA, 14 nt, Human
cacccuccuuccca

SEQ ID NO: 3225162 - RNA, 13 nt, Human
cacccuccuuccc

SEQ ID NO: 3225163 - RNA, 23 nt, Human
cacccuccuucccacucuucuca

SEQ ID NO: 3225164 - RNA, 12 nt, Human
cacccugcucuc

SEQ ID NO: 3225165 - RNA, 16 nt, Human
cacccugcugagucug

SEQ ID NO: 3225166 - RNA, 17 nt, Human
cacccugcuuggcccag

SEQ ID NO: 3225167 - RNA, 16 nt, Human
cacccugcuuggccca

SEQ ID NO: 3225168 - RNA, 18 nt, Human
cacccugcuuggcccagg

SEQ ID NO: 3225169 - RNA, 11 nt, Human
cacccugaggg

SEQ ID NO: 3225170 - RNA, 12 nt, Human
cacccugagggc

SEQ ID NO: 3225171 - RNA, 17 nt, Human
caccugcggugcuaucu

SEQ ID NO: 3225172 - RNA, 19 nt, Human
caccugcggugcuaucucc

SEQ ID NO: 3225173 - RNA, 16 nt, Human
caccugcggugcuauc

SEQ ID NO: 3225174 - RNA, 24 nt, Human
caccugccuguugggccaggagcc

SEQ ID NO: 3225175 - RNA, 15 nt, Human
caccugcgcuucacu

SEQ ID NO: 3225176 - RNA, 14 nt, Human
cacugaagaguaug

SEQ ID NO: 3225177 - RNA, 11 nt, Human
cacugaagagg

SEQ ID NO: 3225178 - RNA, 12 nt, Human
cacugaagagga

SEQ ID NO: 3225179 - RNA, 13 nt, Human
cacugaagaggag

SEQ ID NO: 3225180 - RNA, 15 nt, Human
cacugaagaggagga

SEQ ID NO: 3225181 - RNA, 16 nt, Human
cacugaagaggaggag

SEQ ID NO: 3225182 - RNA, 16 nt, Human
cacuccagugagacag

SEQ ID NO: 3225183 - RNA, 21 nt, Human
cacuccagugagacagcucug

SEQ ID NO: 3225184 - RNA, 17 nt, Human
cacuccagaccccuggc

SEQ ID NO: 3225185 - RNA, 17 nt, Human
cacugaagucaguucuc

SEQ ID NO: 3225186 - RNA, 15 nt, Human
cacgcuggagugcag

SEQ ID NO: 3225187 - RNA, 20 nt, Human
cacgcuggagugcagugagc

SEQ ID NO: 3225188 - RNA, 18 nt, Human
cacgcuggagugcaguga

SEQ ID NO: 3225189 - RNA, 17 nt, Human
cacgcuggagugcagug

SEQ ID NO: 3225190 - RNA, 16 nt, Human
cacgcuggagugcagu

SEQ ID NO: 3225191 - RNA, 21 nt, Human
cacgcuggagugcagugagcc

SEQ ID NO: 3225192 - RNA, 19 nt, Human
cacgcuggggaagaauuua

SEQ ID NO: 3225193 - RNA, 14 nt, Human
cacgcuggggaaga

SEQ ID NO: 3225194 - RNA, 21 nt, Human
cacuacauuauaaaugucucu

SEQ ID NO: 3225195 - RNA, 16 nt, Human
cacggaagagccuugc

SEQ ID NO: 3225196 - RNA, 22 nt, Human
cacggaagagccuugcggaagg

SEQ ID NO: 3225197 - RNA, 16 nt, Human
cacuagacccacugga

SEQ ID NO: 3225198 - RNA, 16 nt, Human
cacuccagaccccugg

SEQ ID NO: 3225199 - RNA, 14 nt, Human
cacuccagaccccu

SEQ ID NO: 3225200 - RNA, 19 nt, Human
caccagcccuuagcaggga

SEQ ID NO: 3225201 - RNA, 16 nt, Human
caccagccccagugcc

SEQ ID NO: 3225202 - RNA, 16 nt, Human
cacauuucacugucug

SEQ ID NO: 3225203 - RNA, 17 nt, Human
cacauuucacugucugu

SEQ ID NO: 3225204 - RNA, 22 nt, Human
caccagccccagugcccacagg

SEQ ID NO: 3225205 - RNA, 21 nt, Human
caccagccccagugcccacag

SEQ ID NO: 3225206 - RNA, 18 nt, Human
caccagccccagugccca

SEQ ID NO: 3225207 - RNA, 17 nt, Human
caccagccccagugccc

SEQ ID NO: 3225208 - RNA, 18 nt, Human
cacauuuauucugcucac

SEQ ID NO: 3225209 - RNA, 17 nt, Human
cacauuuauucugcuca

SEQ ID NO: 3225210 - RNA, 19 nt, Human
cacaucuugcucugcugac

SEQ ID NO: 3225211 - RNA, 23 nt, Human
cacaucuugcucugcugacagac

SEQ ID NO: 3225212 - RNA, 12 nt, Human
cacccagcccac

SEQ ID NO: 3225213 - RNA, 21 nt, Human
cacccagggaacuaggaaggc

SEQ ID NO: 3225214 - RNA, 11 nt, Human
cacccagggaa

SEQ ID NO: 3225215 - RNA, 11 nt, Human
cacccagaaac

SEQ ID NO: 3225216 - RNA, 13 nt, Human
cacccauaucaug

SEQ ID NO: 3225217 - RNA, 14 nt, Human
cacccauaucaugc

SEQ ID NO: 3225218 - RNA, 18 nt, Human
cacccaugaaagaaaacu

SEQ ID NO: 3225219 - RNA, 23 nt, Human
cacaucagcuugcccuguuaaaa

SEQ ID NO: 3225220 - RNA, 15 nt, Human
cacaucaucuguaag

SEQ ID NO: 3225221 - RNA, 14 nt, Human
cacaucaucuguaa

SEQ ID NO: 3225222 - RNA, 13 nt, Human
cacaucagcuugc

SEQ ID NO: 3225223 - RNA, 22 nt, Human
cacaucuugcucugcugacaga

SEQ ID NO: 3225224 - RNA, 21 nt, Human
cacaucuugcucugcugacag

SEQ ID NO: 3225225 - RNA, 20 nt, Human
cacaucuugcucugcugaca

SEQ ID NO: 3225226 - RNA, 15 nt, Human
cacaucuugcucugc

SEQ ID NO: 3225227 - RNA, 14 nt, Human
cacaucuugcucug

SEQ ID NO: 3225228 - RNA, 13 nt, Human
cacaucuugcucu

SEQ ID NO: 3225229 - RNA, 21 nt, Human
cacaucccaccccauccucca

SEQ ID NO: 3225230 - RNA, 18 nt, Human
cacauccacagucucccc

SEQ ID NO: 3225231 - RNA, 13 nt, Human
cacaucccacccc

SEQ ID NO: 3225232 - RNA, 19 nt, Human
cacaucaucuguaagcugu

SEQ ID NO: 3225233 - RNA, 14 nt, Human
caagaagcccagga

SEQ ID NO: 3225234 - RNA, 21 nt, Human
caacucccugccccccagccc

SEQ ID NO: 3225235 - RNA, 15 nt, Human
caagaagcccaggaa

SEQ ID NO: 3225236 - RNA, 19 nt, Human
caacucccugccccccagc

SEQ ID NO: 3225237 - RNA, 20 nt, Human
caacucccugccccccagcc

SEQ ID NO: 3225238 - RNA, 20 nt, Human
caacuccaacauccacucuc

SEQ ID NO: 3225239 - RNA, 18 nt, Human
caagaagcccaggaaagg

SEQ ID NO: 3225240 - RNA, 17 nt, Human
caagaaggaugauucaa

SEQ ID NO: 3225241 - RNA, 18 nt, Human
caagaauagaugcugacu

SEQ ID NO: 3225242 - RNA, 13 nt, Human
caagaaugaaggu

SEQ ID NO: 3225243 - RNA, 19 nt, Human
caagaauagcauuguaaaa

SEQ ID NO: 3225244 - RNA, 22 nt, Human
caacuaugauuuggaaaauaaa

SEQ ID NO: 3225245 - RNA, 16 nt, Human
caaccccuucgcuccu

SEQ ID NO: 3225246 - RNA, 14 nt, Human
caaccccuucgcuc

SEQ ID NO: 3225247 - RNA, 17 nt, Human
caaccccuucgcuccug

SEQ ID NO: 3225248 - RNA, 13 nt, Human
caagcaagaaaca

SEQ ID NO: 3225249 - RNA, 18 nt, Human
caagcaagaaacacuggg

SEQ ID NO: 3225250 - RNA, 15 nt, Human
caagaccaaauggaa

SEQ ID NO: 3225251 - RNA, 17 nt, Human
caagaucaaaaaggcuu

SEQ ID NO: 3225252 - RNA, 21 nt, Human
caagaucaaaaaggcuuauaa

SEQ ID NO: 3225253 - RNA, 16 nt, Human
caagaucaaaaaggcu

SEQ ID NO: 3225254 - RNA, 13 nt, Human
caagcacagucag

SEQ ID NO: 3225255 - RNA, 14 nt, Human
caagcacagucagg

SEQ ID NO: 3225256 - RNA, 13 nt, Human
caagcaccuccug

SEQ ID NO: 3225257 - RNA, 18 nt, Human
caagcaccuagccucgcu

SEQ ID NO: 3225258 - RNA, 13 nt, Human
caagcaccauccc

SEQ ID NO: 3225259 - RNA, 17 nt, Human
caagcaccauccccucc

SEQ ID NO: 3225260 - RNA, 12 nt, Human
caauauuguaua

SEQ ID NO: 3225261 - RNA, 14 nt, Human
caauauuguauauu

SEQ ID NO: 3225262 - RNA, 19 nt, Human
caauauuguauauuuuuau

SEQ ID NO: 3225263 - RNA, 22 nt, Human
caauauuugugugcuaaacgug

SEQ ID NO: 3225264 - RNA, 19 nt, Human
caauauuugugugcuaaac

SEQ ID NO: 3225265 - RNA, 23 nt, Human
caauauuugugugcuaaacgugu

SEQ ID NO: 3225266 - RNA, 11 nt, Human
caaucagcugc

SEQ ID NO: 3225267 - RNA, 13 nt, Human
caaucagcugcuu

SEQ ID NO: 3225268 - RNA, 17 nt, Human
caaucagcugcuuuguu

SEQ ID NO: 3225269 - RNA, 18 nt, Human
caaucagcugcuuuguua

SEQ ID NO: 3225270 - RNA, 20 nt, Human
caaugcucuuuucacagcua

SEQ ID NO: 3225271 - RNA, 20 nt, Human
caaugccucuugucuuccua

SEQ ID NO: 3225272 - RNA, 20 nt, Human
caaugccuauuguaauauag

SEQ ID NO: 3225273 - RNA, 23 nt, Human
caaugccuauuguaauauagaaa

SEQ ID NO: 3225274 - RNA, 16 nt, Human
caaugccucuugucuu

SEQ ID NO: 3225275 - RNA, 14 nt, Human
caaucaaaucugcu

SEQ ID NO: 3225276 - RNA, 21 nt, Human
caaucaauaacagccgcucca

SEQ ID NO: 3225277 - RNA, 21 nt, Human
caaucaauaaacagcagguga

SEQ ID NO: 3225278 - RNA, 15 nt, Human
caauggcagccuugg

SEQ ID NO: 3225279 - RNA, 14 nt, Human
caauggcagccuug

SEQ ID NO: 3225280 - RNA, 13 nt, Human
caauggcagccuu

SEQ ID NO: 3225281 - RNA, 16 nt, Human
caaugcuggagaaaaa

SEQ ID NO: 3225282 - RNA, 18 nt, Human
caauuggaagucuaagaa

SEQ ID NO: 3225283 - RNA, 14 nt, Human
cacaaggaagaaau

SEQ ID NO: 3225284 - RNA, 19 nt, Human
caauuucaauuuugucugu

SEQ ID NO: 3225285 - RNA, 15 nt, Human
cacaaggaagaaauu

SEQ ID NO: 3225286 - RNA, 23 nt, Human
caaguucacaccugcagauucua

SEQ ID NO: 3225287 - RNA, 22 nt, Human
caaguucacaccugcagauucu

SEQ ID NO: 3225288 - RNA, 22 nt, Human
caaguauuuaagccuaaagauu

SEQ ID NO: 3225289 - RNA, 15 nt, Human
caaguauuuaagccu

SEQ ID NO: 3225290 - RNA, 20 nt, Human
caaggauugcuacuguccua

SEQ ID NO: 3225291 - RNA, 14 nt, Human
caaggcaaaaacaa

SEQ ID NO: 3225292 - RNA, 19 nt, Human
caaggauugcuacuguccu

SEQ ID NO: 3225293 - RNA, 14 nt, Human
caaggcaaggcugu

SEQ ID NO: 3225294 - RNA, 15 nt, Human
caaggcaaaaacaaa

SEQ ID NO: 3225295 - RNA, 17 nt, Human
caagcuccaagcuccca

SEQ ID NO: 3225296 - RNA, 18 nt, Human
caagcuccaagcucccag

SEQ ID NO: 3225297 - RNA, 19 nt, Human
caagcuccaagcucccagg

SEQ ID NO: 3225298 - RNA, 21 nt, Human
caagcuccaagcucccaggca

SEQ ID NO: 3225299 - RNA, 17 nt, Human
caagcuccaucuccacu

SEQ ID NO: 3225300 - RNA, 21 nt, Human
caagcuccaucuccacuccag

SEQ ID NO: 3225301 - RNA, 12 nt, Human
caagcucccagg

SEQ ID NO: 3225302 - RNA, 14 nt, Human
caagcucccaggca

SEQ ID NO: 3225303 - RNA, 15 nt, Human
caagcucccaggcau

SEQ ID NO: 3225304 - RNA, 17 nt, Human
caagcucccaggcauuc

SEQ ID NO: 3225305 - RNA, 16 nt, Human
caagcucugcuccucu

SEQ ID NO: 3225306 - RNA, 13 nt, Human
caagcugaaauuu

SEQ ID NO: 3225307 - RNA, 14 nt, Human
caagcugaaauuuu

SEQ ID NO: 3225308 - RNA, 20 nt, Human
caagcugaaauuuuagaaau

SEQ ID NO: 3225309 - RNA, 21 nt, Human
caagcugaaauuuuagaaaua

SEQ ID NO: 3225310 - RNA, 15 nt, Human
caagcucugcuccuc

SEQ ID NO: 3225311 - RNA, 22 nt, Human
auuuuuuuccuuacauaaacau

SEQ ID NO: 3225312 - RNA, 12 nt, Human
auuuuuuucuac

SEQ ID NO: 3225313 - RNA, 15 nt, Human
auuuuuuucuaccua

SEQ ID NO: 3225314 - RNA, 16 nt, Human
auuuuuuucuaccuau

SEQ ID NO: 3225315 - RNA, 21 nt, Human
auuuuuuuccuuacauaaaca

SEQ ID NO: 3225316 - RNA, 19 nt, Human
auuuuuuuccuuacauaaa

SEQ ID NO: 3225317 - RNA, 15 nt, Human
auuuuuuuccuuaca

SEQ ID NO: 3225318 - RNA, 12 nt, Human
auuuuuuuccuu

SEQ ID NO: 3225319 - RNA, 16 nt, Human
auuuuuauuaaauuau

SEQ ID NO: 3225320 - RNA, 13 nt, Human
auuuuuauuauua

SEQ ID NO: 3225321 - RNA, 12 nt, Human
auuuuuauuucu

SEQ ID NO: 3225322 - RNA, 14 nt, Human
auuuuuauuucuuu

SEQ ID NO: 3225323 - RNA, 15 nt, Human
auuuuuaugugugau

SEQ ID NO: 3225324 - RNA, 15 nt, Human
auuuuuaucuauaua

SEQ ID NO: 3225325 - RNA, 16 nt, Human
auuuuuaucuauauaa

SEQ ID NO: 3225326 - RNA, 19 nt, Human
auuuuuaucuauauaaaau

SEQ ID NO: 3225327 - RNA, 15 nt, Human
auuuuuaucaggauu

SEQ ID NO: 3225328 - RNA, 22 nt, Human
auuuuguuuuugucuuaaaaag

SEQ ID NO: 3225329 - RNA, 21 nt, Human
auuuuguuuuugucuuaaaaa

SEQ ID NO: 3225330 - RNA, 20 nt, Human
caaaagguuaauaaaguaau

SEQ ID NO: 3225331 - RNA, 21 nt, Human
caaaagguauuuuaaucacca

SEQ ID NO: 3225332 - RNA, 19 nt, Human
caaaagcaucuaugugaga

SEQ ID NO: 3225333 - RNA, 22 nt, Human
auuuuuuuuaauugaaaagaag

SEQ ID NO: 3225334 - RNA, 17 nt, Human
auuuuuuuuaauuguau

SEQ ID NO: 3225335 - RNA, 18 nt, Human
auuuuuuuuaauuguauu

SEQ ID NO: 3225336 - RNA, 20 nt, Human
auuuuuuuuaauuguauuuu

SEQ ID NO: 3225337 - RNA, 22 nt, Human
auuuuuuuucaugcuuuaucaa

SEQ ID NO: 3225338 - RNA, 22 nt, Human
auuuuuuuuaauuguauuuuug

SEQ ID NO: 3225339 - RNA, 23 nt, Human
auuuuuuuucccauuuagaaugg

SEQ ID NO: 3225340 - RNA, 17 nt, Human
caaaccaucauugaaau

SEQ ID NO: 3225341 - RNA, 14 nt, Human
caaaccaucauuga

SEQ ID NO: 3225342 - RNA, 16 nt, Human
caaaccaucauugaaa

SEQ ID NO: 3225343 - RNA, 19 nt, Human
caaacaugagguucucucu

SEQ ID NO: 3225344 - RNA, 23 nt, Human
auuuuaguggacccugaaaugug

SEQ ID NO: 3225345 - RNA, 20 nt, Human
auuuuaguggacccugaaau

SEQ ID NO: 3225346 - RNA, 22 nt, Human
auuuuaguggacccugaaaugu

SEQ ID NO: 3225347 - RNA, 21 nt, Human
auuuuaguggacccugaaaug

SEQ ID NO: 3225348 - RNA, 20 nt, Human
auuuguguggagucauuucu

SEQ ID NO: 3225349 - RNA, 20 nt, Human
auuugugugcuaaacgugua

SEQ ID NO: 3225350 - RNA, 23 nt, Human
auuuguguggagucauuucugau

SEQ ID NO: 3225351 - RNA, 21 nt, Human
auuuguguggagucauuucug

SEQ ID NO: 3225352 - RNA, 17 nt, Human
auuuguguguuacaaug

SEQ ID NO: 3225353 - RNA, 13 nt, Human
auuuguguguuac

SEQ ID NO: 3225354 - RNA, 14 nt, Human
auuuguuauaauga

SEQ ID NO: 3225355 - RNA, 18 nt, Human
auuuguguguucacuaaa

SEQ ID NO: 3225356 - RNA, 22 nt, Human
auuuguguguucacuaaacucu

SEQ ID NO: 3225357 - RNA, 22 nt, Human
auuuguguguuuuuagcuguga

SEQ ID NO: 3225358 - RNA, 19 nt, Human
auuuucucugauacuuuuu

SEQ ID NO: 3225359 - RNA, 18 nt, Human
auuuucucugauacuuuu

SEQ ID NO: 3225360 - RNA, 17 nt, Human
auuuucucugauacuuu

SEQ ID NO: 3225361 - RNA, 13 nt, Human
auuuucucuuaga

SEQ ID NO: 3225362 - RNA, 16 nt, Human
auuuucucuuagaaaa

SEQ ID NO: 3225363 - RNA, 14 nt, Human
auuuucucuuagaa

SEQ ID NO: 3225364 - RNA, 22 nt, Human
auuuuaguuuuauuuucuaaag

SEQ ID NO: 3225365 - RNA, 14 nt, Human
auuuuaguuuuauu

SEQ ID NO: 3225366 - RNA, 21 nt, Human
auuuuaguuuuauuuucuaaa

SEQ ID NO: 3225367 - RNA, 20 nt, Human
auuuuaguuuuauuuucuaa

SEQ ID NO: 3225368 - RNA, 12 nt, Human
auuuugaaaagu

SEQ ID NO: 3225369 - RNA, 14 nt, Human
auuuugaaaaguaa

SEQ ID NO: 3225370 - RNA, 16 nt, Human
auuuugaaaaguaaua

SEQ ID NO: 3225371 - RNA, 17 nt, Human
auuuugaaaaguaauau

SEQ ID NO: 3225372 - RNA, 21 nt, Human
auuuugaaaaguaauauuuau

SEQ ID NO: 3225373 - RNA, 22 nt, Human
auuuaagaauugccagucuuuu

SEQ ID NO: 3225374 - RNA, 19 nt, Human
auuucacgucauaggaagu

SEQ ID NO: 3225375 - RNA, 18 nt, Human
auuucacgucauaggaag

SEQ ID NO: 3225376 - RNA, 12 nt, Human
auuucacucucc

SEQ ID NO: 3225377 - RNA, 16 nt, Human
auuucacgauucauuu

SEQ ID NO: 3225378 - RNA, 15 nt, Human
auuucacauuauucu

SEQ ID NO: 3225379 - RNA, 17 nt, Human
auuucacauuauucugg

SEQ ID NO: 3225380 - RNA, 23 nt, Human
auuucaccccaucccuccuuaag

SEQ ID NO: 3225381 - RNA, 13 nt, Human
auuucacaaauau

SEQ ID NO: 3225382 - RNA, 23 nt, Human
auuucacaaauauuaaaaagucu

SEQ ID NO: 3225383 - RNA, 20 nt, Human
auuucacaaauauuaaaaag

SEQ ID NO: 3225384 - RNA, 18 nt, Human
auuucacaaauauuaaaa

SEQ ID NO: 3225385 - RNA, 15 nt, Human
auuucacaaauauua

SEQ ID NO: 3225386 - RNA, 14 nt, Human
auuucacaaauauu

SEQ ID NO: 3225387 - RNA, 18 nt, Human
auuuaaguguuggaaaaa

SEQ ID NO: 3225388 - RNA, 22 nt, Human
auuuaaguguuggaaaaaauuu

SEQ ID NO: 3225389 - RNA, 12 nt, Human
auuuaaguuuug

SEQ ID NO: 3225390 - RNA, 20 nt, Human
auuuaaguuuugacaagcug

SEQ ID NO: 3225391 - RNA, 22 nt, Human
auuuaaggucuguuugcuguug

SEQ ID NO: 3225392 - RNA, 20 nt, Human
auuuaaggucuguuugcugu

SEQ ID NO: 3225393 - RNA, 22 nt, Human
auuuaagccuaaagauuuugau

SEQ ID NO: 3225394 - RNA, 17 nt, Human
auuuaagccuaaagauu

SEQ ID NO: 3225395 - RNA, 16 nt, Human
auuuaagccuaaagau

SEQ ID NO: 3225396 - RNA, 15 nt, Human
auuuaagccuaaaga

SEQ ID NO: 3225397 - RNA, 18 nt, Human
auuuaauuugaaauaugg

SEQ ID NO: 3225398 - RNA, 13 nt, Human
auuucucuuugaa

SEQ ID NO: 3225399 - RNA, 20 nt, Human
auuucugaagguagcauucu

SEQ ID NO: 3225400 - RNA, 16 nt, Human
auuucucuuugaaaca

SEQ ID NO: 3225401 - RNA, 17 nt, Human
auuucuccuuuuguguu

SEQ ID NO: 3225402 - RNA, 12 nt, Human
auuucuccuuuu

SEQ ID NO: 3225403 - RNA, 20 nt, Human
auuucuccuuuuguguucca

SEQ ID NO: 3225404 - RNA, 15 nt, Human
auuucucuuaaguac

SEQ ID NO: 3225405 - RNA, 23 nt, Human
auuucucuguuccauaguuaaag

SEQ ID NO: 3225406 - RNA, 15 nt, Human
auuucucuguuccau

SEQ ID NO: 3225407 - RNA, 17 nt, Human
auuucaguguaaagugu

SEQ ID NO: 3225408 - RNA, 19 nt, Human
auuucaguguaaagugugu

SEQ ID NO: 3225409 - RNA, 21 nt, Human
auuucaguaagaucaagcucc

SEQ ID NO: 3225410 - RNA, 14 nt, Human
auuucaguaagucu

SEQ ID NO: 3225411 - RNA, 18 nt, Human
auuucaguaagucucaua

SEQ ID NO: 3225412 - RNA, 20 nt, Human
auuucaguaaaccugucuga

SEQ ID NO: 3225413 - RNA, 19 nt, Human
auuucaguaaaccugucug

SEQ ID NO: 3225414 - RNA, 18 nt, Human
auuugcacaaaaagauac

SEQ ID NO: 3225415 - RNA, 15 nt, Human
auuaaauuuuuuugu

SEQ ID NO: 3225416 - RNA, 16 nt, Human
auuaaauuuuuuugua

SEQ ID NO: 3225417 - RNA, 17 nt, Human
auuaaauuuuuuuguau

SEQ ID NO: 3225418 - RNA, 18 nt, Human
auuaaauuuuuuuguaug

SEQ ID NO: 3225419 - RNA, 19 nt, Human
auuaaauuuuuuuguauga

SEQ ID NO: 3225420 - RNA, 20 nt, Human
auuaaauuuuuuuguaugaa

SEQ ID NO: 3225421 - RNA, 21 nt, Human
auuaaauuuuuuuguaugaaa

SEQ ID NO: 3225422 - RNA, 22 nt, Human
auuaaauuuuuuuguaugaaaa

SEQ ID NO: 3225423 - RNA, 23 nt, Human
auuaaauuuuuuuguaugaaaac

SEQ ID NO: 3225424 - RNA, 16 nt, Human
auuaacaauuaauugu

SEQ ID NO: 3225425 - RNA, 18 nt, Human
auuaacaauuaauugucu

SEQ ID NO: 3225426 - RNA, 19 nt, Human
auuaacacuacucaaagca

SEQ ID NO: 3225427 - RNA, 21 nt, Human
auuaacacuacucaaagcaaa

SEQ ID NO: 3225428 - RNA, 22 nt, Human
auuacaagcgugagccacugca

SEQ ID NO: 3225429 - RNA, 14 nt, Human
auuacaauauuucu

SEQ ID NO: 3225430 - RNA, 14 nt, Human
auuacaauauuugu

SEQ ID NO: 3225431 - RNA, 13 nt, Human
auuacaauauuug

SEQ ID NO: 3225432 - RNA, 15 nt, Human
auuacaggcuccugc

SEQ ID NO: 3225433 - RNA, 16 nt, Human
auuacaggcuccugcc

SEQ ID NO: 3225434 - RNA, 17 nt, Human
auuacaggcuccugcca

SEQ ID NO: 3225435 - RNA, 19 nt, Human
auuacaggcuccugccacc

SEQ ID NO: 3225436 - RNA, 13 nt, Human
auuacagguguga

SEQ ID NO: 3225437 - RNA, 21 nt, Human
auuaauguauccaaugaaaua

SEQ ID NO: 3225438 - RNA, 13 nt, Human
auuaaugcuuugg

SEQ ID NO: 3225439 - RNA, 12 nt, Human
auuaaugcuuug

SEQ ID NO: 3225440 - RNA, 11 nt, Human
auuaauugugu

SEQ ID NO: 3225441 - RNA, 12 nt, Human
auuaauugucuu

SEQ ID NO: 3225442 - RNA, 14 nt, Human
auuaauugugugaa

SEQ ID NO: 3225443 - RNA, 16 nt, Human
auuaauugugugaacu

SEQ ID NO: 3225444 - RNA, 14 nt, Human
auuaauuuaaauga

SEQ ID NO: 3225445 - RNA, 15 nt, Human
auuaauuuaucagau

SEQ ID NO: 3225446 - RNA, 16 nt, Human
auuaauuuaucagauu

SEQ ID NO: 3225447 - RNA, 19 nt, Human
auuaauuuaucagauugcu

SEQ ID NO: 3225448 - RNA, 21 nt, Human
auuaauugugugaacuuggaa

SEQ ID NO: 3225449 - RNA, 18 nt, Human
auuaauugugugaacuug

SEQ ID NO: 3225450 - RNA, 20 nt, Human
auuaauugugugaacuugga

SEQ ID NO: 3225451 - RNA, 21 nt, Human
auuaauuuggagcacaaaauu

SEQ ID NO: 3225452 - RNA, 13 nt, Human
auuaauuucugcc

SEQ ID NO: 3225453 - RNA, 20 nt, Human
auuaauuucugccauuucau

SEQ ID NO: 3225454 - RNA, 21 nt, Human
auuaauuucugccauuucaug

SEQ ID NO: 3225455 - RNA, 22 nt, Human
auuaauuucugccauuucaugu

SEQ ID NO: 3225456 - RNA, 15 nt, Human
auuaaugccugcuuu

SEQ ID NO: 3225457 - RNA, 17 nt, Human
auuaaugccugcuuuuu

SEQ ID NO: 3225458 - RNA, 22 nt, Human
auuaaugccugcuuuuuggaaa

SEQ ID NO: 3225459 - RNA, 15 nt, Human
auuaauggaaauguu

SEQ ID NO: 3225460 - RNA, 17 nt, Human
auucauggccuggggga

SEQ ID NO: 3225461 - RNA, 14 nt, Human
auucauauuuacuu

SEQ ID NO: 3225462 - RNA, 20 nt, Human
auucauauuacaauauuugu

SEQ ID NO: 3225463 - RNA, 19 nt, Human
auucauauuacaauauuug

SEQ ID NO: 3225464 - RNA, 18 nt, Human
auucauauuacaauauuu

SEQ ID NO: 3225465 - RNA, 17 nt, Human
auucauauuacaauauu

SEQ ID NO: 3225466 - RNA, 15 nt, Human
auucauauuacaaua

SEQ ID NO: 3225467 - RNA, 16 nt, Human
auucauaguagaacuu

SEQ ID NO: 3225468 - RNA, 13 nt, Human
auucauauuacaa

SEQ ID NO: 3225469 - RNA, 14 nt, Human
auucauauuacaau

SEQ ID NO: 3225470 - RNA, 16 nt, Human
auucauucauacuuaa

SEQ ID NO: 3225471 - RNA, 23 nt, Human
auucauauauuuuaugaaucaga

SEQ ID NO: 3225472 - RNA, 22 nt, Human
auuauguccugugagaugugua

SEQ ID NO: 3225473 - RNA, 15 nt, Human
auuaugucaaccagg

SEQ ID NO: 3225474 - RNA, 20 nt, Human
auuaugugaccauaauguac

SEQ ID NO: 3225475 - RNA, 16 nt, Human
auuagaucaaauaguu

SEQ ID NO: 3225476 - RNA, 19 nt, Human
auuagaucaaauaguugca

SEQ ID NO: 3225477 - RNA, 21 nt, Human
auuagaucaaauaguugcaua

SEQ ID NO: 3225478 - RNA, 18 nt, Human
auuagauccauuaauuua

SEQ ID NO: 3225479 - RNA, 19 nt, Human
auuagauccuaagaugugu

SEQ ID NO: 3225480 - RNA, 16 nt, Human
auuagaggggaaaagc

SEQ ID NO: 3225481 - RNA, 23 nt, Human
auuagagucaacuacacaaagca

SEQ ID NO: 3225482 - RNA, 21 nt, Human
auugaggaaaaauaugugaag

SEQ ID NO: 3225483 - RNA, 20 nt, Human
auugaggaaaaauaugugaa

SEQ ID NO: 3225484 - RNA, 17 nt, Human
auugaggaaaaauaugu

SEQ ID NO: 3225485 - RNA, 22 nt, Human
auugagcugcuuuuuuugaaac

SEQ ID NO: 3225486 - RNA, 15 nt, Human
auugaggaaaaauau

SEQ ID NO: 3225487 - RNA, 15 nt, Human
auucucuuauccaac

SEQ ID NO: 3225488 - RNA, 21 nt, Human
auucucuccauuucacuggcu

SEQ ID NO: 3225489 - RNA, 15 nt, Human
auucucuugccucag

SEQ ID NO: 3225490 - RNA, 15 nt, Human
auucuuuagagaaga

SEQ ID NO: 3225491 - RNA, 17 nt, Human
auucucuugccucagcu

SEQ ID NO: 3225492 - RNA, 16 nt, Human
auucuuguuuugcuuc

SEQ ID NO: 3225493 - RNA, 15 nt, Human
auucuuguuuugcuu

SEQ ID NO: 3225494 - RNA, 14 nt, Human
auucucuuauccaa

SEQ ID NO: 3225495 - RNA, 12 nt, Human
auucucuuaucc

SEQ ID NO: 3225496 - RNA, 17 nt, Human
auucucuauuugaauua

SEQ ID NO: 3225497 - RNA, 20 nt, Human
auucucuauuugaauuauuu

SEQ ID NO: 3225498 - RNA, 22 nt, Human
auucucuauuugaauuauuucu

SEQ ID NO: 3225499 - RNA, 22 nt, Human
auucguacauaauacugaacca

SEQ ID NO: 3225500 - RNA, 23 nt, Human
auucguacauaauacugaaccac

SEQ ID NO: 3225501 - RNA, 16 nt, Human
auucguacauaauacu

SEQ ID NO: 3225502 - RNA, 18 nt, Human
auucguacauaauacuga

SEQ ID NO: 3225503 - RNA, 17 nt, Human
auucgggccccaccugc

SEQ ID NO: 3225504 - RNA, 21 nt, Human
auucgcuacuaugauuuaauu

SEQ ID NO: 3225505 - RNA, 15 nt, Human
auucgggccccaccu

SEQ ID NO: 3225506 - RNA, 15 nt, Human
auuccuuuuuauuua

SEQ ID NO: 3225507 - RNA, 16 nt, Human
auuccuuuuuauuuau

SEQ ID NO: 3225508 - RNA, 18 nt, Human
auuccuuuuuauuuauau

SEQ ID NO: 3225509 - RNA, 20 nt, Human
auuccuuuuuauuuauaugu

SEQ ID NO: 3225510 - RNA, 21 nt, Human
auuccuuuuuauuuauaugua

SEQ ID NO: 3225511 - RNA, 17 nt, Human
caucuguaccucugccu

SEQ ID NO: 3225512 - RNA, 15 nt, Human
caucugguuuucucu

SEQ ID NO: 3225513 - RNA, 14 nt, Human
caucugguuuucuc

SEQ ID NO: 3225514 - RNA, 15 nt, Human
caucuguaagcuguu

SEQ ID NO: 3225515 - RNA, 19 nt, Human
caucugguuuucucuccag

SEQ ID NO: 3225516 - RNA, 16 nt, Human
caucuggaguucucaa

SEQ ID NO: 3225517 - RNA, 15 nt, Human
caucuggaguucuca

SEQ ID NO: 3225518 - RNA, 20 nt, Human
caucuggagagcccagaguc

SEQ ID NO: 3225519 - RNA, 12 nt, Human
caucuggagagc

SEQ ID NO: 3225520 - RNA, 18 nt, Human
cauccugaggcuccacuu

SEQ ID NO: 3225521 - RNA, 19 nt, Human
cauccugaggcuccacuug

SEQ ID NO: 3225522 - RNA, 15 nt, Human
caucuaaacugcccc

SEQ ID NO: 3225523 - RNA, 21 nt, Human
caucuaaacugcccccucugc

SEQ ID NO: 3225524 - RNA, 23 nt, Human
caucguugcaaccacugcaauau

SEQ ID NO: 3225525 - RNA, 13 nt, Human
caucuaaaaauau

SEQ ID NO: 3225526 - RNA, 17 nt, Human
caucuaaaaauauacau

SEQ ID NO: 3225527 - RNA, 14 nt, Human
caucuaaaaauaua

SEQ ID NO: 3225528 - RNA, 23 nt, Human
caucuaaaaauauacauguuuau

SEQ ID NO: 3225529 - RNA, 21 nt, Human
caucuaaaaauauacauguuu

SEQ ID NO: 3225530 - RNA, 19 nt, Human
caucuaaaaauauacaugu

SEQ ID NO: 3225531 - RNA, 18 nt, Human
caucuaaaaauauacaug

SEQ ID NO: 3225532 - RNA, 11 nt, Human
caucccagccc

SEQ ID NO: 3225533 - RNA, 19 nt, Human
caucccaccccauccucca

SEQ ID NO: 3225534 - RNA, 16 nt, Human
caucccaccccauccu

SEQ ID NO: 3225535 - RNA, 16 nt, Human
caucccacugcugacu

SEQ ID NO: 3225536 - RNA, 20 nt, Human
caucccaaacccuucagugc

SEQ ID NO: 3225537 - RNA, 21 nt, Human
cauccucuguacagagcccac

SEQ ID NO: 3225538 - RNA, 22 nt, Human
cauccucuguacagagcccacg

SEQ ID NO: 3225539 - RNA, 19 nt, Human
caucccaaacccuucagug

SEQ ID NO: 3225540 - RNA, 19 nt, Human
caucagcugcucagauccc

SEQ ID NO: 3225541 - RNA, 18 nt, Human
caucagcugcucagaucc

SEQ ID NO: 3225542 - RNA, 16 nt, Human
caucagcugcucagau

SEQ ID NO: 3225543 - RNA, 15 nt, Human
caucagcugcucaga

SEQ ID NO: 3225544 - RNA, 17 nt, Human
caucagaacagcuguug

SEQ ID NO: 3225545 - RNA, 14 nt, Human
caucagaacagcug

SEQ ID NO: 3225546 - RNA, 12 nt, Human
caucagaacagc

SEQ ID NO: 3225547 - RNA, 19 nt, Human
caucagaaauaauaaaaaa

SEQ ID NO: 3225548 - RNA, 11 nt, Human
caucagaaaua

SEQ ID NO: 3225549 - RNA, 20 nt, Human
caucagcccaaucccugauc

SEQ ID NO: 3225550 - RNA, 18 nt, Human
caucagcccaaucccuga

SEQ ID NO: 3225551 - RNA, 12 nt, Human
caguuucaauaa

SEQ ID NO: 3225552 - RNA, 23 nt, Human
caguuuauuccagagcugccagu

SEQ ID NO: 3225553 - RNA, 19 nt, Human
caguuuauuugaaccaaua

SEQ ID NO: 3225554 - RNA, 18 nt, Human
caguuuauuugaaccaau

SEQ ID NO: 3225555 - RNA, 20 nt, Human
caguuuaugcagugcugcuu

SEQ ID NO: 3225556 - RNA, 14 nt, Human
caguuuauguuuug

SEQ ID NO: 3225557 - RNA, 13 nt, Human
caguuuauguuuu

SEQ ID NO: 3225558 - RNA, 22 nt, Human
caguuuauuccagagcugccag

SEQ ID NO: 3225559 - RNA, 18 nt, Human
caguuuauuccagagcug

SEQ ID NO: 3225560 - RNA, 14 nt, Human
caguuuauuccaga

SEQ ID NO: 3225561 - RNA, 19 nt, Human
caguuuauguuuuggucca

SEQ ID NO: 3225562 - RNA, 18 nt, Human
caguuguuagugugucuu

SEQ ID NO: 3225563 - RNA, 22 nt, Human
caguuguuagugugucuuagug

SEQ ID NO: 3225564 - RNA, 21 nt, Human
caguuguuaguuacuaccucc

SEQ ID NO: 3225565 - RNA, 21 nt, Human
caguuugaggauuaguuuaga

SEQ ID NO: 3225566 - RNA, 14 nt, Human
caguuucuaaaauu

SEQ ID NO: 3225567 - RNA, 20 nt, Human
caguuucaauaaaguuugau

SEQ ID NO: 3225568 - RNA, 18 nt, Human
caguuucaauaaaguuug

SEQ ID NO: 3225569 - RNA, 17 nt, Human
caguuucaauaaaguuu

SEQ ID NO: 3225570 - RNA, 16 nt, Human
caguuucaauaaaguu

SEQ ID NO: 3225571 - RNA, 13 nt, Human
caguuucaauaaa

SEQ ID NO: 3225572 - RNA, 15 nt, Human
cauaauguucugcua

SEQ ID NO: 3225573 - RNA, 13 nt, Human
cauaauuaacacu

SEQ ID NO: 3225574 - RNA, 16 nt, Human
cauaauuagauccauu

SEQ ID NO: 3225575 - RNA, 18 nt, Human
cauaauuagauccauuaa

SEQ ID NO: 3225576 - RNA, 19 nt, Human
cauaauuagauccauuaau

SEQ ID NO: 3225577 - RNA, 22 nt, Human
cauaauuagauccauuaauuua

SEQ ID NO: 3225578 - RNA, 16 nt, Human
cauacagggauggugu

SEQ ID NO: 3225579 - RNA, 23 nt, Human
cauacaggaagguagaaauaucu

SEQ ID NO: 3225580 - RNA, 19 nt, Human
cauacagggaugguguuca

SEQ ID NO: 3225581 - RNA, 20 nt, Human
cauaauguacugauuucagu

SEQ ID NO: 3225582 - RNA, 18 nt, Human
caguuuuauagcuuuauu

SEQ ID NO: 3225583 - RNA, 19 nt, Human
cauagcagcuuauucacaa

SEQ ID NO: 3225584 - RNA, 23 nt, Human
cauagcagagaaugaaagggccc

SEQ ID NO: 3225585 - RNA, 14 nt, Human
cauagcagaucugu

SEQ ID NO: 3225586 - RNA, 16 nt, Human
cauagcagaucuguuu

SEQ ID NO: 3225587 - RNA, 17 nt, Human
cauagcagaucuguuuu

SEQ ID NO: 3225588 - RNA, 16 nt, Human
cauagguuagauauag

SEQ ID NO: 3225589 - RNA, 15 nt, Human
cauagguuaaaaaaa

SEQ ID NO: 3225590 - RNA, 22 nt, Human
cauagguuaaaaaaaaaaguca

SEQ ID NO: 3225591 - RNA, 23 nt, Human
cauagguuaaaaaaaaaagucac

SEQ ID NO: 3225592 - RNA, 16 nt, Human
cauauguauacaugug

SEQ ID NO: 3225593 - RNA, 15 nt, Human
cauauguauacaugu

SEQ ID NO: 3225594 - RNA, 23 nt, Human
cauauuauaucagacugcuuuga

SEQ ID NO: 3225595 - RNA, 16 nt, Human
cauauuauaucagacu

SEQ ID NO: 3225596 - RNA, 14 nt, Human
cauauuauaucaga

SEQ ID NO: 3225597 - RNA, 23 nt, Human
cauauuagcgacaacagauugga

SEQ ID NO: 3225598 - RNA, 20 nt, Human
cauauuagcgacaacagauu

SEQ ID NO: 3225599 - RNA, 19 nt, Human
cauauuagcgacaacagau

SEQ ID NO: 3225600 - RNA, 19 nt, Human
cauauuacuguacauggga

SEQ ID NO: 3225601 - RNA, 12 nt, Human
cauauuagaaaa

SEQ ID NO: 3225602 - RNA, 22 nt, Human
cauauuacuguacaugggacua

SEQ ID NO: 3225603 - RNA, 17 nt, Human
cauauuagaaaacuuug

SEQ ID NO: 3225604 - RNA, 16 nt, Human
cauauuagaaaacuuu

SEQ ID NO: 3225605 - RNA, 15 nt, Human
cauauuagaaaacuu

SEQ ID NO: 3225606 - RNA, 13 nt, Human
cauauuagaaaac

SEQ ID NO: 3225607 - RNA, 20 nt, Human
cauauuagaggggaaaagcu

SEQ ID NO: 3225608 - RNA, 22 nt, Human
cauauuagacuucuguuuucaa

SEQ ID NO: 3225609 - RNA, 21 nt, Human
cauauuagacuucuguuuuca

SEQ ID NO: 3225610 - RNA, 18 nt, Human
cauauuagacuucuguuu

SEQ ID NO: 3225611 - RNA, 21 nt, Human
cauauuagaaaacuuuguuag

SEQ ID NO: 3225612 - RNA, 20 nt, Human
cauauuagaaaacuuuguua

SEQ ID NO: 3225613 - RNA, 19 nt, Human
cauauuagaaaacuuuguu

SEQ ID NO: 3225614 - RNA, 18 nt, Human
cauauuagaaaacuuugu

SEQ ID NO: 3225615 - RNA, 13 nt, Human
caguuauggcuau

SEQ ID NO: 3225616 - RNA, 19 nt, Human
caguuauacaguuauaaaa

SEQ ID NO: 3225617 - RNA, 20 nt, Human
caguuauacaguuauaaaau

SEQ ID NO: 3225618 - RNA, 20 nt, Human
caguuauggcuauaggugcu

SEQ ID NO: 3225619 - RNA, 19 nt, Human
caguuauggcuauaggugc

SEQ ID NO: 3225620 - RNA, 19 nt, Human
caguggugcgaucuggguu

SEQ ID NO: 3225621 - RNA, 21 nt, Human
cagugguaugaucacggcuca

SEQ ID NO: 3225622 - RNA, 23 nt, Human
caguuacuuuccaauucuccuuu

SEQ ID NO: 3225623 - RNA, 15 nt, Human
caguuacuuuuccuu

SEQ ID NO: 3225624 - RNA, 14 nt, Human
caguuacuuuuccu

SEQ ID NO: 3225625 - RNA, 19 nt, Human
caguuacuuuuccuugcau

SEQ ID NO: 3225626 - RNA, 16 nt, Human
caguuacuuuuccuug

SEQ ID NO: 3225627 - RNA, 17 nt, Human
caguuauaaaauuaaaa

SEQ ID NO: 3225628 - RNA, 19 nt, Human
caguuauaaaauuaaaagu

SEQ ID NO: 3225629 - RNA, 20 nt, Human
cagugguaugaucacggcuc

SEQ ID NO: 3225630 - RNA, 22 nt, Human
cagugcccagguggcuguggaa

SEQ ID NO: 3225631 - RNA, 15 nt, Human
cagugcccagguggc

SEQ ID NO: 3225632 - RNA, 18 nt, Human
cagugggagcugccuguu

SEQ ID NO: 3225633 - RNA, 17 nt, Human
cagugggagcugccugu

SEQ ID NO: 3225634 - RNA, 15 nt, Human
cagugggagcugccu

SEQ ID NO: 3225635 - RNA, 11 nt, Human
cagugcccagg

SEQ ID NO: 3225636 - RNA, 14 nt, Human
cagugcccaggugg

SEQ ID NO: 3225637 - RNA, 13 nt, Human
cagugcccaggug

SEQ ID NO: 3225638 - RNA, 16 nt, Human
cagugggagcugccug

SEQ ID NO: 3225639 - RNA, 22 nt, Human
cagugauuaccagggacugagg

SEQ ID NO: 3225640 - RNA, 23 nt, Human
cagucugauucccaagcucugcu

SEQ ID NO: 3225641 - RNA, 22 nt, Human
cagugcccacaggaucagucug

SEQ ID NO: 3225642 - RNA, 18 nt, Human
cagugcccacaggaucag

SEQ ID NO: 3225643 - RNA, 21 nt, Human
cagugcccacaggaucagucu

SEQ ID NO: 3225644 - RNA, 22 nt, Human
cagucugauucccaagcucugc

SEQ ID NO: 3225645 - RNA, 21 nt, Human
cagucugauucccaagcucug

SEQ ID NO: 3225646 - RNA, 15 nt, Human
cagucuaucauuguu

SEQ ID NO: 3225647 - RNA, 10 nt, Human
cagucucaca

SEQ ID NO: 3225648 - RNA, 17 nt, Human
cagucucaccauuuccc

SEQ ID NO: 3225649 - RNA, 20 nt, Human
cagucucacauuucucaaca

SEQ ID NO: 3225650 - RNA, 12 nt, Human
cagucucacauu

SEQ ID NO: 3225651 - RNA, 21 nt, Human
cagucuaaauuuauuauuuaa

SEQ ID NO: 3225652 - RNA, 21 nt, Human
cagucgugguugggaacacag

SEQ ID NO: 3225653 - RNA, 16 nt, Human
caguuaugugaccuca

SEQ ID NO: 3225654 - RNA, 13 nt, Human
caguuaugugacc

SEQ ID NO: 3225655 - RNA, 21 nt, Human
caguuaugugaccucacgugc

SEQ ID NO: 3225656 - RNA, 17 nt, Human
caguuauugucccuggc

SEQ ID NO: 3225657 - RNA, 23 nt, Human
caguuauugucccuggcuuccuu

SEQ ID NO: 3225658 - RNA, 20 nt, Human
caguuauugucccuggcuuc

SEQ ID NO: 3225659 - RNA, 15 nt, Human
caguucaaagucaug

SEQ ID NO: 3225660 - RNA, 13 nt, Human
caguucaaaguca

SEQ ID NO: 3225661 - RNA, 23 nt, Human
caguucaaagucaugauguuuuu

SEQ ID NO: 3225662 - RNA, 22 nt, Human
caguucaaagucaugauguuuu

SEQ ID NO: 3225663 - RNA, 15 nt, Human
caguucagcuugggg

SEQ ID NO: 3225664 - RNA, 14 nt, Human
caguucagcuuggg

SEQ ID NO: 3225665 - RNA, 23 nt, Human
caguuccaaucaguagcuuaaga

SEQ ID NO: 3225666 - RNA, 13 nt, Human
caugaaugcuuuu

SEQ ID NO: 3225667 - RNA, 14 nt, Human
caugaauuuuaaag

SEQ ID NO: 3225668 - RNA, 15 nt, Human
caugaauuuuaaagu

SEQ ID NO: 3225669 - RNA, 16 nt, Human
caugaauuuuaaagua

SEQ ID NO: 3225670 - RNA, 17 nt, Human
caugaauuuuaaaguau

SEQ ID NO: 3225671 - RNA, 21 nt, Human
caugaauuuuaaaguaugcau

SEQ ID NO: 3225672 - RNA, 23 nt, Human
caugcaagggaugaauuguaaaa

SEQ ID NO: 3225673 - RNA, 17 nt, Human
caugaugcucuuuccca

SEQ ID NO: 3225674 - RNA, 16 nt, Human
caugaugcucuuuccc

SEQ ID NO: 3225675 - RNA, 22 nt, Human
cauggccggcuuucaggagcuc

SEQ ID NO: 3225676 - RNA, 20 nt, Human
cauggccggcuuucaggagc

SEQ ID NO: 3225677 - RNA, 14 nt, Human
cauggccgugaacu

SEQ ID NO: 3225678 - RNA, 19 nt, Human
cauggcuucugaaccuguc

SEQ ID NO: 3225679 - RNA, 13 nt, Human
cauggcuucugaa

SEQ ID NO: 3225680 - RNA, 18 nt, Human
caugggaaaggggaaguu

SEQ ID NO: 3225681 - RNA, 18 nt, Human
caugggaaaguauucucu

SEQ ID NO: 3225682 - RNA, 22 nt, Human
cauggcuucugaaccugucuuu

SEQ ID NO: 3225683 - RNA, 20 nt, Human
caugggaaaugucaacaagu

SEQ ID NO: 3225684 - RNA, 21 nt, Human
caugggaaaguauucucuuuu

SEQ ID NO: 3225685 - RNA, 20 nt, Human
caugggaaaguauucucuuu

SEQ ID NO: 3225686 - RNA, 14 nt, Human
caugcuccuggccc

SEQ ID NO: 3225687 - RNA, 16 nt, Human
caugcuccuggcccac

SEQ ID NO: 3225688 - RNA, 17 nt, Human
caugcuccuggcccacu

SEQ ID NO: 3225689 - RNA, 14 nt, Human
cauggccagguggc

SEQ ID NO: 3225690 - RNA, 15 nt, Human
cauggccagguggcc

SEQ ID NO: 3225691 - RNA, 19 nt, Human
cauggccggcuuucaggag

SEQ ID NO: 3225692 - RNA, 18 nt, Human
cauggccggcuuucagga

SEQ ID NO: 3225693 - RNA, 17 nt, Human
cauggccggcuuucagg

SEQ ID NO: 3225694 - RNA, 16 nt, Human
cauggccggcuuucag

SEQ ID NO: 3225695 - RNA, 20 nt, Human
cauguuggccaggcugcucu

SEQ ID NO: 3225696 - RNA, 23 nt, Human
cauguuggccaggcugcucucaa

SEQ ID NO: 3225697 - RNA, 22 nt, Human
cauguuggccaggcugcucuca

SEQ ID NO: 3225698 - RNA, 17 nt, Human
cauguuggccaggcugg

SEQ ID NO: 3225699 - RNA, 18 nt, Human
cauguuggccaggcuggu

SEQ ID NO: 3225700 - RNA, 17 nt, Human
cauguuacauaagauaa

SEQ ID NO: 3225701 - RNA, 16 nt, Human
cauguuacauaagaua

SEQ ID NO: 3225702 - RNA, 15 nt, Human
cauguccaagaagcc

SEQ ID NO: 3225703 - RNA, 21 nt, Human
cauguuacauaagauaaaugu

SEQ ID NO: 3225704 - RNA, 18 nt, Human
cauguuaauugauagaau

SEQ ID NO: 3225705 - RNA, 15 nt, Human
cauguauggccagga

SEQ ID NO: 3225706 - RNA, 14 nt, Human
cauguauggccagg

SEQ ID NO: 3225707 - RNA, 12 nt, Human
cauguauggcca

SEQ ID NO: 3225708 - RNA, 12 nt, Human
cauguauuaaau

SEQ ID NO: 3225709 - RNA, 22 nt, Human
cauguauuaaauuacauuugua

SEQ ID NO: 3225710 - RNA, 20 nt, Human
cauguauuaaauuacauuug

SEQ ID NO: 3225711 - RNA, 11 nt, Human
cauuauuauua

SEQ ID NO: 3225712 - RNA, 13 nt, Human
cauuauuaaauug

SEQ ID NO: 3225713 - RNA, 17 nt, Human
cauuauuaaauuguaaa

SEQ ID NO: 3225714 - RNA, 17 nt, Human
cauuaucuacuugugua

SEQ ID NO: 3225715 - RNA, 23 nt, Human
cauuauuacuuuuccucuuagaa

SEQ ID NO: 3225716 - RNA, 17 nt, Human
cauucuccaccugccag

SEQ ID NO: 3225717 - RNA, 18 nt, Human
cauucuccaccugccagg

SEQ ID NO: 3225718 - RNA, 19 nt, Human
cauucuccaccugccaggg

SEQ ID NO: 3225719 - RNA, 12 nt, Human
cauucucucucc

SEQ ID NO: 3225720 - RNA, 22 nt, Human
cauucucuccauuucacuggcu

SEQ ID NO: 3225721 - RNA, 20 nt, Human
cauucucuaauauccacuug

SEQ ID NO: 3225722 - RNA, 23 nt, Human
cauuggaagcagguuaaauguuu

SEQ ID NO: 3225723 - RNA, 22 nt, Human
cauuggaagcagguuaaauguu

SEQ ID NO: 3225724 - RNA, 15 nt, Human
cauuggauucugaga

SEQ ID NO: 3225725 - RNA, 21 nt, Human
cauuggaagcagguuaaaugu

SEQ ID NO: 3225726 - RNA, 16 nt, Human
cauuuaggugaggaag

SEQ ID NO: 3225727 - RNA, 18 nt, Human
cauuuaggugaggaagca

SEQ ID NO: 3225728 - RNA, 14 nt, Human
ccaaaaggcagaag

SEQ ID NO: 3225729 - RNA, 23 nt, Human
ccaaaaaauaucuaguaauauau

SEQ ID NO: 3225730 - RNA, 19 nt, Human
ccaaaaaauaucuaguaau

SEQ ID NO: 3225731 - RNA, 17 nt, Human
ccaaaaaaauccagaaa

SEQ ID NO: 3225732 - RNA, 12 nt, Human
ccaaaaaauauc

SEQ ID NO: 3225733 - RNA, 12 nt, Human
cauuuaucuuga

SEQ ID NO: 3225734 - RNA, 15 nt, Human
cauuuaucuugaagg

SEQ ID NO: 3225735 - RNA, 14 nt, Human
cauuuaucuugaag

SEQ ID NO: 3225736 - RNA, 23 nt, Human
cauuuaucuugaaggaaaaauuc

SEQ ID NO: 3225737 - RNA, 17 nt, Human
cauuuaucuugaaggaa

SEQ ID NO: 3225738 - RNA, 16 nt, Human
cauuuaucuugaagga

SEQ ID NO: 3225739 - RNA, 12 nt, Human
cauuuguaauuu

SEQ ID NO: 3225740 - RNA, 13 nt, Human
cauuuggugcuug

SEQ ID NO: 3225741 - RNA, 20 nt, Human
cauuuggguugguuccaagu

SEQ ID NO: 3225742 - RNA, 16 nt, Human
cauuugggcagagagg

SEQ ID NO: 3225743 - RNA, 12 nt, Human
cauuugggcaga

SEQ ID NO: 3225744 - RNA, 14 nt, Human
cauuuguaauuuaa

SEQ ID NO: 3225745 - RNA, 13 nt, Human
cauuuguuaauau

SEQ ID NO: 3225746 - RNA, 16 nt, Human
cauuuguuaauaucac

SEQ ID NO: 3225747 - RNA, 22 nt, Human
cauuuguuaauaucacucauua

SEQ ID NO: 3225748 - RNA, 23 nt, Human
cauuuguuucuuucucugaggac

SEQ ID NO: 3225749 - RNA, 19 nt, Human
cauuuguugccagauuuca

SEQ ID NO: 3225750 - RNA, 22 nt, Human
cauuuguuucuuucucugagga

SEQ ID NO: 3225751 - RNA, 21 nt, Human
cauuuguuucuuucucugagg

SEQ ID NO: 3225752 - RNA, 23 nt, Human
ccaauggacuaacuugucuuugg

SEQ ID NO: 3225753 - RNA, 21 nt, Human
ccaauggagacugucucaaga

SEQ ID NO: 3225754 - RNA, 19 nt, Human
ccaauucgaacuuuuucca

SEQ ID NO: 3225755 - RNA, 14 nt, Human
ccaauucuccuuua

SEQ ID NO: 3225756 - RNA, 22 nt, Human
ccaaggacagaaggcuccugcc

SEQ ID NO: 3225757 - RNA, 13 nt, Human
ccaacucacccca

SEQ ID NO: 3225758 - RNA, 23 nt, Human
ccaaaucagcugcuacuacuccu

SEQ ID NO: 3225759 - RNA, 15 nt, Human
ccaaaucagcugcua

SEQ ID NO: 3225760 - RNA, 18 nt, Human
ccaacuccaacauccacu

SEQ ID NO: 3225761 - RNA, 17 nt, Human
ccaacuccaacauccac

SEQ ID NO: 3225762 - RNA, 16 nt, Human
ccaacuccaacaucca

SEQ ID NO: 3225763 - RNA, 21 nt, Human
ccaacucaccccagccccaaa

SEQ ID NO: 3225764 - RNA, 15 nt, Human
ccaagcucugcuccu

SEQ ID NO: 3225765 - RNA, 14 nt, Human
ccaagcucugcucc

SEQ ID NO: 3225766 - RNA, 16 nt, Human
ccaagcucugcuccuc

SEQ ID NO: 3225767 - RNA, 13 nt, Human
ccaagcucugcuc

SEQ ID NO: 3225768 - RNA, 22 nt, Human
ccaaaguacagaauuugaauua

SEQ ID NO: 3225769 - RNA, 14 nt, Human
ccaaaguauuguac

SEQ ID NO: 3225770 - RNA, 20 nt, Human
cagauuucacucuccuuggu

SEQ ID NO: 3225771 - RNA, 20 nt, Human
cagauugcaacaggcugggc

SEQ ID NO: 3225772 - RNA, 19 nt, Human
cagauugcaacaggcuggg

SEQ ID NO: 3225773 - RNA, 17 nt, Human
cagauugcaacaggcug

SEQ ID NO: 3225774 - RNA, 19 nt, Human
cagcaccaucucuccuccu

SEQ ID NO: 3225775 - RNA, 22 nt, Human
cagcaccacucaagaccaaaug

SEQ ID NO: 3225776 - RNA, 21 nt, Human
cagcaccacucaagaccaaau

SEQ ID NO: 3225777 - RNA, 14 nt, Human
cagcaccacucaag

SEQ ID NO: 3225778 - RNA, 19 nt, Human
cagcaccacccuccuuccc

SEQ ID NO: 3225779 - RNA, 17 nt, Human
cagcaccaucucuccuc

SEQ ID NO: 3225780 - RNA, 17 nt, Human
cagcaccacccuccuuc

SEQ ID NO: 3225781 - RNA, 16 nt, Human
cagauuucucuuugaa

SEQ ID NO: 3225782 - RNA, 19 nt, Human
cagauuucacucuccuugg

SEQ ID NO: 3225783 - RNA, 18 nt, Human
cagauugcaacaggcugg

SEQ ID NO: 3225784 - RNA, 17 nt, Human
cagcacguguggccugu

SEQ ID NO: 3225785 - RNA, 18 nt, Human
cagcacgggggccaagga

SEQ ID NO: 3225786 - RNA, 14 nt, Human
cagccagacuggca

SEQ ID NO: 3225787 - RNA, 14 nt, Human
cagcacuaaacuug

SEQ ID NO: 3225788 - RNA, 23 nt, Human
cagccagaagccacccaaagcag

SEQ ID NO: 3225789 - RNA, 18 nt, Human
cagccaggccacuggccc

SEQ ID NO: 3225790 - RNA, 22 nt, Human
cagccaggccacaagacccuug

SEQ ID NO: 3225791 - RNA, 18 nt, Human
cagccagacuggcacagu

SEQ ID NO: 3225792 - RNA, 15 nt, Human
cagccagacuggcac

SEQ ID NO: 3225793 - RNA, 13 nt, Human
cagagcugccacc

SEQ ID NO: 3225794 - RNA, 12 nt, Human
cagagcugaaga

SEQ ID NO: 3225795 - RNA, 20 nt, Human
cagagagguuaaggugggua

SEQ ID NO: 3225796 - RNA, 23 nt, Human
cagagaggguggugaccucugcc

SEQ ID NO: 3225797 - RNA, 23 nt, Human
cagagagggugggagugggccca

SEQ ID NO: 3225798 - RNA, 17 nt, Human
cagaggaaagcaaagga

SEQ ID NO: 3225799 - RNA, 19 nt, Human
cagaggaaagcaaaggaga

SEQ ID NO: 3225800 - RNA, 13 nt, Human
cagaggggguggc

SEQ ID NO: 3225801 - RNA, 12 nt, Human
cagagagggugg

SEQ ID NO: 3225802 - RNA, 15 nt, Human
cagagaggcuguggu

SEQ ID NO: 3225803 - RNA, 16 nt, Human
cagagaggcugugguu

SEQ ID NO: 3225804 - RNA, 23 nt, Human
cagagagaagagccccacucuca

SEQ ID NO: 3225805 - RNA, 22 nt, Human
cagagagaagagccccacucuc

SEQ ID NO: 3225806 - RNA, 17 nt, Human
cagagaggguggugacc

SEQ ID NO: 3225807 - RNA, 22 nt, Human
cagagaggguggugaccucugc

SEQ ID NO: 3225808 - RNA, 20 nt, Human
cagagaggguggugaccucu

SEQ ID NO: 3225809 - RNA, 23 nt, Human
cagagacuccugcaggcagccag

SEQ ID NO: 3225810 - RNA, 16 nt, Human
cagagagaagagcccc

SEQ ID NO: 3225811 - RNA, 15 nt, Human
cagagagaagagccc

SEQ ID NO: 3225812 - RNA, 21 nt, Human
cagagagaagagccccacucu

SEQ ID NO: 3225813 - RNA, 19 nt, Human
cagagagaagagccccacu

SEQ ID NO: 3225814 - RNA, 18 nt, Human
cagagagaagagccccac

SEQ ID NO: 3225815 - RNA, 17 nt, Human
cagagagaagagcccca

SEQ ID NO: 3225816 - RNA, 19 nt, Human
cagauagauauaugcucug

SEQ ID NO: 3225817 - RNA, 19 nt, Human
cagauacuuggggggcuga

SEQ ID NO: 3225818 - RNA, 14 nt, Human
cagaggggguggcc

SEQ ID NO: 3225819 - RNA, 16 nt, Human
cagaggggguggccuc

SEQ ID NO: 3225820 - RNA, 14 nt, Human
cagauccccaagcc

SEQ ID NO: 3225821 - RNA, 20 nt, Human
cagaucccacuuuugccaga

SEQ ID NO: 3225822 - RNA, 22 nt, Human
cagaucccagcuucggcauuug

SEQ ID NO: 3225823 - RNA, 23 nt, Human
cagacuggcacaguuuucugaga

SEQ ID NO: 3225824 - RNA, 22 nt, Human
cagacuggcacaguuuucugag

SEQ ID NO: 3225825 - RNA, 18 nt, Human
cagacuggcacaguuuuc

SEQ ID NO: 3225826 - RNA, 17 nt, Human
cagacuggcacaguuuu

SEQ ID NO: 3225827 - RNA, 21 nt, Human
cagacuggaagcacagcuuca

SEQ ID NO: 3225828 - RNA, 20 nt, Human
cagacuggaagcacagcuuc

SEQ ID NO: 3225829 - RNA, 18 nt, Human
cagacuggaagcacagcu

SEQ ID NO: 3225830 - RNA, 17 nt, Human
cagacuggaagcacagc

SEQ ID NO: 3225831 - RNA, 16 nt, Human
cagacuggaagcacag

SEQ ID NO: 3225832 - RNA, 14 nt, Human
cagacuggaagcac

SEQ ID NO: 3225833 - RNA, 13 nt, Human
cagacuggaagca

SEQ ID NO: 3225834 - RNA, 23 nt, Human
cagacaggcaagcaccuccugcc

SEQ ID NO: 3225835 - RNA, 22 nt, Human
cagacaggcaagcaccuccugc

SEQ ID NO: 3225836 - RNA, 18 nt, Human
cagacagggggccagaac

SEQ ID NO: 3225837 - RNA, 17 nt, Human
cagacucuacagaggcc

SEQ ID NO: 3225838 - RNA, 17 nt, Human
cagacagucacaaauuu

SEQ ID NO: 3225839 - RNA, 20 nt, Human
cagacagucacaaauuucuc

SEQ ID NO: 3225840 - RNA, 18 nt, Human
cagacaguggaugagaca

SEQ ID NO: 3225841 - RNA, 21 nt, Human
cagacucuacagaggccaugg

SEQ ID NO: 3225842 - RNA, 20 nt, Human
cagacucuacagaggccaug

SEQ ID NO: 3225843 - RNA, 19 nt, Human
cagacucuacagaggccau

SEQ ID NO: 3225844 - RNA, 18 nt, Human
cagacucuacagaggcca

SEQ ID NO: 3225845 - RNA, 23 nt, Human
cagacucuacagaggccaugggc

SEQ ID NO: 3225846 - RNA, 14 nt, Human
cagacagcccucca

SEQ ID NO: 3225847 - RNA, 13 nt, Human
cagacagcugccu

SEQ ID NO: 3225848 - RNA, 14 nt, Human
cagacagcugccug

SEQ ID NO: 3225849 - RNA, 13 nt, Human
cagacaggaccag

SEQ ID NO: 3225850 - RNA, 15 nt, Human
cagacaggaccaggg

SEQ ID NO: 3225851 - RNA, 16 nt, Human
cagacaggaccaggga

SEQ ID NO: 3225852 - RNA, 15 nt, Human
cagacagcugccugg

SEQ ID NO: 3225853 - RNA, 16 nt, Human
cagacagcugccuggg

SEQ ID NO: 3225854 - RNA, 17 nt, Human
cagacagcugccuggga

SEQ ID NO: 3225855 - RNA, 18 nt, Human
cagacagcugccugggau

SEQ ID NO: 3225856 - RNA, 21 nt, Human
cagacaggcaagcaccuccug

SEQ ID NO: 3225857 - RNA, 20 nt, Human
cagacaggcaagcaccuccu

SEQ ID NO: 3225858 - RNA, 18 nt, Human
cagacaggcaagcaccuc

SEQ ID NO: 3225859 - RNA, 13 nt, Human
cagacaggcaagc

SEQ ID NO: 3225860 - RNA, 17 nt, Human
cagacaggaccagggau

SEQ ID NO: 3225861 - RNA, 24 nt, Human
cagacaggaccagggauuuccaug

SEQ ID NO: 3225862 - RNA, 11 nt, Human
cagacaggcaa

SEQ ID NO: 3225863 - RNA, 23 nt, Human
cagacaggaccccugcaguuccc

SEQ ID NO: 3225864 - RNA, 15 nt, Human
cagacaggaccccug

SEQ ID NO: 3225865 - RNA, 18 nt, Human
cagacaggaccccugcag

SEQ ID NO: 3225866 - RNA, 16 nt, Human
cagacaggaccccugc

SEQ ID NO: 3225867 - RNA, 18 nt, Human
cagcugagccuucugagc

SEQ ID NO: 3225868 - RNA, 17 nt, Human
cagcugagccuucugag

SEQ ID NO: 3225869 - RNA, 16 nt, Human
cagcugagccuucuga

SEQ ID NO: 3225870 - RNA, 23 nt, Human
cagcugccuaggauucacacccc

SEQ ID NO: 3225871 - RNA, 21 nt, Human
cagcugacuuuucuguccgag

SEQ ID NO: 3225872 - RNA, 14 nt, Human
cagcugagaggcug

SEQ ID NO: 3225873 - RNA, 15 nt, Human
cagcugagccuucug

SEQ ID NO: 3225874 - RNA, 17 nt, Human
cagcuuauucacaagac

SEQ ID NO: 3225875 - RNA, 14 nt, Human
cagcuucacuucug

SEQ ID NO: 3225876 - RNA, 15 nt, Human
cagcuucacuucuga

SEQ ID NO: 3225877 - RNA, 16 nt, Human
caggaaagaagcauuu

SEQ ID NO: 3225878 - RNA, 16 nt, Human
cagcugucaaggcuca

SEQ ID NO: 3225879 - RNA, 16 nt, Human
caggaaaggcuccagg

SEQ ID NO: 3225880 - RNA, 17 nt, Human
caggaaaggcuccagga

SEQ ID NO: 3225881 - RNA, 19 nt, Human
caggaaaggcuccaggagc

SEQ ID NO: 3225882 - RNA, 15 nt, Human
cagcuaacauggaag

SEQ ID NO: 3225883 - RNA, 19 nt, Human
cagcguuuugcaagguaaa

SEQ ID NO: 3225884 - RNA, 15 nt, Human
cagcguuuugcaagg

SEQ ID NO: 3225885 - RNA, 16 nt, Human
cagccugcuccagcug

SEQ ID NO: 3225886 - RNA, 17 nt, Human
cagccugcuccagcugu

SEQ ID NO: 3225887 - RNA, 19 nt, Human
cagccugcuccagcuguuc

SEQ ID NO: 3225888 - RNA, 15 nt, Human
cagccugcuccagcu

SEQ ID NO: 3225889 - RNA, 12 nt, Human
cagcgcugacgu

SEQ ID NO: 3225890 - RNA, 18 nt, Human
cagcgcucuggugcugca

SEQ ID NO: 3225891 - RNA, 23 nt, Human
cagcgcggacauccccugcuggc

SEQ ID NO: 3225892 - RNA, 22 nt, Human
cagcgcggacauccccugcugg

SEQ ID NO: 3225893 - RNA, 20 nt, Human
cagcgcggacauccccugcu

SEQ ID NO: 3225894 - RNA, 22 nt, Human
caggcugggagagccuuccagg

SEQ ID NO: 3225895 - RNA, 23 nt, Human
caggcugggagagccuuccaggg

SEQ ID NO: 3225896 - RNA, 14 nt, Human
cagggcuuuaaaau

SEQ ID NO: 3225897 - RNA, 13 nt, Human
cagggcuuuaaaa

SEQ ID NO: 3225898 - RNA, 15 nt, Human
cagggcuuuaaaauu

SEQ ID NO: 3225899 - RNA, 14 nt, Human
caggggaaaagagg

SEQ ID NO: 3225900 - RNA, 16 nt, Human
caggggaaaagaggag

SEQ ID NO: 3225901 - RNA, 11 nt, Human
caggcuacugu

SEQ ID NO: 3225902 - RNA, 23 nt, Human
caggcuaauguuggcagaugcag

SEQ ID NO: 3225903 - RNA, 21 nt, Human
caggcugggagagccuuccag

SEQ ID NO: 3225904 - RNA, 20 nt, Human
caggcugggagagccuucca

SEQ ID NO: 3225905 - RNA, 21 nt, Human
caggcgugagccaccgugccu

SEQ ID NO: 3225906 - RNA, 12 nt, Human
caggccuccuac

SEQ ID NO: 3225907 - RNA, 18 nt, Human
caggccuacuccugucuu

SEQ ID NO: 3225908 - RNA, 17 nt, Human
caggccuacuccugucu

SEQ ID NO: 3225909 - RNA, 16 nt, Human
caggccuacuccuguc

SEQ ID NO: 3225910 - RNA, 15 nt, Human
caggccuacuccugu

SEQ ID NO: 3225911 - RNA, 17 nt, Human
caggccgggcagagcac

SEQ ID NO: 3225912 - RNA, 14 nt, Human
caggccuccuacag

SEQ ID NO: 3225913 - RNA, 19 nt, Human
caggccuacuccugucuuc

SEQ ID NO: 3225914 - RNA, 15 nt, Human
caggccuguccaaca

SEQ ID NO: 3225915 - RNA, 14 nt, Human
caggccgggcagag

SEQ ID NO: 3225916 - RNA, 13 nt, Human
caggccgggcaga

SEQ ID NO: 3225917 - RNA, 21 nt, Human
caggaccagggauuuccauga

SEQ ID NO: 3225918 - RNA, 21 nt, Human
caggaccagcccacgcugacu

SEQ ID NO: 3225919 - RNA, 17 nt, Human
caggaccagcccacgcu

SEQ ID NO: 3225920 - RNA, 23 nt, Human
caggaccaggguuggcaccuucc

SEQ ID NO: 3225921 - RNA, 22 nt, Human
caggaccaggguuggcaccuuc

SEQ ID NO: 3225922 - RNA, 19 nt, Human
caggaccaggguuggcacc

SEQ ID NO: 3225923 - RNA, 16 nt, Human
caggaccucaggugag

SEQ ID NO: 3225924 - RNA, 23 nt, Human
caggaccucaggugagaagcaga

SEQ ID NO: 3225925 - RNA, 13 nt, Human
caggaccucaggu

SEQ ID NO: 3225926 - RNA, 16 nt, Human
caggaccagcccacgc

SEQ ID NO: 3225927 - RNA, 15 nt, Human
caggaccagcccacg

SEQ ID NO: 3225928 - RNA, 14 nt, Human
caggaccagcccac

SEQ ID NO: 3225929 - RNA, 13 nt, Human
caggaccagccca

SEQ ID NO: 3225930 - RNA, 16 nt, Human
caggcaaugcuggcug

SEQ ID NO: 3225931 - RNA, 15 nt, Human
caggcaaugcuggcu

SEQ ID NO: 3225932 - RNA, 14 nt, Human
caggcaaugcuggc

SEQ ID NO: 3225933 - RNA, 18 nt, Human
caggaggccagccuugac

SEQ ID NO: 3225934 - RNA, 19 nt, Human
caggaggccagccuugacc

SEQ ID NO: 3225935 - RNA, 22 nt, Human
caggaggccagccuugaccauu

SEQ ID NO: 3225936 - RNA, 19 nt, Human
caggaggaucacuugaguc

SEQ ID NO: 3225937 - RNA, 11 nt, Human
caggccaggcc

SEQ ID NO: 3225938 - RNA, 12 nt, Human
caggccaggccc

SEQ ID NO: 3225939 - RNA, 23 nt, Human
caggccagcugcuugggcuucau

SEQ ID NO: 3225940 - RNA, 22 nt, Human
caggaggcugggacgcucugcu

SEQ ID NO: 3225941 - RNA, 21 nt, Human
caggaggcugggacgcucugc

SEQ ID NO: 3225942 - RNA, 23 nt, Human
caggaggcugggacgcucugcug

SEQ ID NO: 3225943 - RNA, 12 nt, Human
ccagagaacaag

SEQ ID NO: 3225944 - RNA, 23 nt, Human
ccagagaaaugaaagucaguuua

SEQ ID NO: 3225945 - RNA, 22 nt, Human
ccagagaaaugaaagucaguuu

SEQ ID NO: 3225946 - RNA, 16 nt, Human
ccagagacacaagccu

SEQ ID NO: 3225947 - RNA, 18 nt, Human
ccagagacacaagccuuc

SEQ ID NO: 3225948 - RNA, 16 nt, Human
ccagagagaagagccc

SEQ ID NO: 3225949 - RNA, 18 nt, Human
ccagagagaagagcccca

SEQ ID NO: 3225950 - RNA, 17 nt, Human
ccagagagaagagcccc

SEQ ID NO: 3225951 - RNA, 23 nt, Human
ccagagagaagagccccacucuc

SEQ ID NO: 3225952 - RNA, 22 nt, Human
ccagagagaagagccccacucu

SEQ ID NO: 3225953 - RNA, 20 nt, Human
ccagagagaagagccccacu

SEQ ID NO: 3225954 - RNA, 19 nt, Human
ccagagagaagagccccac

SEQ ID NO: 3225955 - RNA, 14 nt, Human
ccagaugcaccagc

SEQ ID NO: 3225956 - RNA, 13 nt, Human
ccagaugcaccag

SEQ ID NO: 3225957 - RNA, 19 nt, Human
ccagaucaccaaucuagau

SEQ ID NO: 3225958 - RNA, 15 nt, Human
ccagaucagccagaa

SEQ ID NO: 3225959 - RNA, 13 nt, Human
ccagaucagccag

SEQ ID NO: 3225960 - RNA, 20 nt, Human
ccagagggccugcaagggag

SEQ ID NO: 3225961 - RNA, 19 nt, Human
ccagaggucuagauuaaua

SEQ ID NO: 3225962 - RNA, 19 nt, Human
ccagaguccccccacuccc

SEQ ID NO: 3225963 - RNA, 18 nt, Human
ccagacuccaccaagccu

SEQ ID NO: 3225964 - RNA, 14 nt, Human
ccagacuccaccaa

SEQ ID NO: 3225965 - RNA, 22 nt, Human
ccagacgcucauucagcaucug

SEQ ID NO: 3225966 - RNA, 20 nt, Human
ccagacgcucauucagcauc

SEQ ID NO: 3225967 - RNA, 19 nt, Human
ccagacgccugauauugaa

SEQ ID NO: 3225968 - RNA, 19 nt, Human
ccagacgcucauucagcau

SEQ ID NO: 3225969 - RNA, 16 nt, Human
ccagacccggcugcgu

SEQ ID NO: 3225970 - RNA, 17 nt, Human
ccacuuuuccaguauuu

SEQ ID NO: 3225971 - RNA, 17 nt, Human
ccagacccggcugcgug

SEQ ID NO: 3225972 - RNA, 20 nt, Human
ccacuuggucugugagaugc

SEQ ID NO: 3225973 - RNA, 22 nt, Human
ccacuuggucugugagaugcua

SEQ ID NO: 3225974 - RNA, 20 nt, Human
ccacuuguagauuugauuuu

SEQ ID NO: 3225975 - RNA, 17 nt, Human
ccacuuguccaugugaa

SEQ ID NO: 3225976 - RNA, 17 nt, Human
ccacuuguagauuugau

SEQ ID NO: 3225977 - RNA, 18 nt, Human
ccacuuguagauuugauu

SEQ ID NO: 3225978 - RNA, 12 nt, Human
ccacuuguagau

SEQ ID NO: 3225979 - RNA, 15 nt, Human
ccacuuggucuguga

SEQ ID NO: 3225980 - RNA, 16 nt, Human
ccacuuggucugugag

SEQ ID NO: 3225981 - RNA, 17 nt, Human
ccacuuggucugugaga

SEQ ID NO: 3225982 - RNA, 19 nt, Human
ccacuuggucugugagaug

SEQ ID NO: 3225983 - RNA, 20 nt, Human
ccacuuucuagccagaggag

SEQ ID NO: 3225984 - RNA, 20 nt, Human
ccacuuuccaagucacugca

SEQ ID NO: 3225985 - RNA, 12 nt, Human
ccacuuuuccag

SEQ ID NO: 3225986 - RNA, 18 nt, Human
ccacuuucuagccagagg

SEQ ID NO: 3225987 - RNA, 19 nt, Human
ccacuuucuagccagagga

SEQ ID NO: 3225988 - RNA, 13 nt, Human
ccacuuucuagcc

SEQ ID NO: 3225989 - RNA, 14 nt, Human
ccacuuuauugcca

SEQ ID NO: 3225990 - RNA, 12 nt, Human
ccacuuggucug

SEQ ID NO: 3225991 - RNA, 19 nt, Human
ccacuucugccagaugucc

SEQ ID NO: 3225992 - RNA, 21 nt, Human
ccacuugcugcacucuugcac

SEQ ID NO: 3225993 - RNA, 14 nt, Human
ccacuucugccaga

SEQ ID NO: 3225994 - RNA, 13 nt, Human
ccacuucugccag

SEQ ID NO: 3225995 - RNA, 23 nt, Human
ccacuucccuggguuagacugcc

SEQ ID NO: 3225996 - RNA, 13 nt, Human
ccacuucccuggg

SEQ ID NO: 3225997 - RNA, 19 nt, Human
ccacugcaccgggccacag

SEQ ID NO: 3225998 - RNA, 17 nt, Human
ccacugcaccgggccac

SEQ ID NO: 3225999 - RNA, 14 nt, Human
ccacugcaccgggc

SEQ ID NO: 3226000 - RNA, 13 nt, Human
ccacugcaccggg

SEQ ID NO: 3226001 - RNA, 20 nt, Human
ccacugcacuauagccuagg

SEQ ID NO: 3226002 - RNA, 19 nt, Human
ccacugcacuauagccuag

SEQ ID NO: 3226003 - RNA, 10 nt, Human
ccacugaaga

SEQ ID NO: 3226004 - RNA, 11 nt, Human
ccacugaagag

SEQ ID NO: 3226005 - RNA, 12 nt, Human
ccacugaagagg

SEQ ID NO: 3226006 - RNA, 14 nt, Human
ccacugaagaggag

SEQ ID NO: 3226007 - RNA, 11 nt, Human
ccacucuucuc

SEQ ID NO: 3226008 - RNA, 16 nt, Human
ccacugaaucuguaca

SEQ ID NO: 3226009 - RNA, 11 nt, Human
ccagcagccug

SEQ ID NO: 3226010 - RNA, 12 nt, Human
ccagcagccugg

SEQ ID NO: 3226011 - RNA, 13 nt, Human
ccagccccuggau

SEQ ID NO: 3226012 - RNA, 14 nt, Human
ccagccccuggaug

SEQ ID NO: 3226013 - RNA, 15 nt, Human
ccagccccuggaugc

SEQ ID NO: 3226014 - RNA, 13 nt, Human
ccagcagccugga

SEQ ID NO: 3226015 - RNA, 23 nt, Human
ccagccccauccucuguacagag

SEQ ID NO: 3226016 - RNA, 18 nt, Human
ccagccccauccucugua

SEQ ID NO: 3226017 - RNA, 15 nt, Human
ccagccccuucugac

SEQ ID NO: 3226018 - RNA, 16 nt, Human
ccagccccuucugacc

SEQ ID NO: 3226019 - RNA, 17 nt, Human
ccagccccuucugaccc

SEQ ID NO: 3226020 - RNA, 21 nt, Human
ccagcgagcccugguggcagu

SEQ ID NO: 3226021 - RNA, 12 nt, Human
ccagccccugga

SEQ ID NO: 3226022 - RNA, 18 nt, Human
ccaggaaaggcuccagga

SEQ ID NO: 3226023 - RNA, 19 nt, Human
ccaggaaaggcuccaggag

SEQ ID NO: 3226024 - RNA, 17 nt, Human
ccaggaaaggcuccagg

SEQ ID NO: 3226025 - RNA, 15 nt, Human
ccagcgcugacgugu

SEQ ID NO: 3226026 - RNA, 15 nt, Human
ccagcgcggacaucc

SEQ ID NO: 3226027 - RNA, 21 nt, Human
ccagcgcggacauccccugcu

SEQ ID NO: 3226028 - RNA, 20 nt, Human
ccagcgcggacauccccugc

SEQ ID NO: 3226029 - RNA, 20 nt, Human
ccagcuugaaaccuucacuu

SEQ ID NO: 3226030 - RNA, 17 nt, Human
ccagcuugggcagaucu

SEQ ID NO: 3226031 - RNA, 14 nt, Human
ccagcuugggcaga

SEQ ID NO: 3226032 - RNA, 13 nt, Human
ccagcuugggcag

SEQ ID NO: 3226033 - RNA, 14 nt, Human
ccagcuuggcucag

SEQ ID NO: 3226034 - RNA, 15 nt, Human
ccaggcagcacccag

SEQ ID NO: 3226035 - RNA, 20 nt, Human
ccaggcagcugucacugcug

SEQ ID NO: 3226036 - RNA, 19 nt, Human
ccaggggugggacacccug

SEQ ID NO: 3226037 - RNA, 13 nt, Human
ccaggcugagccu

SEQ ID NO: 3226038 - RNA, 14 nt, Human
ccaggcugagccuc

SEQ ID NO: 3226039 - RNA, 16 nt, Human
ccaggcugagccucag

SEQ ID NO: 3226040 - RNA, 17 nt, Human
ccaggcugagccucagu

SEQ ID NO: 3226041 - RNA, 19 nt, Human
ccaggcugagccucagucu

SEQ ID NO: 3226042 - RNA, 22 nt, Human
ccaggcugagccucagucuccc

SEQ ID NO: 3226043 - RNA, 16 nt, Human
ccagucaccccggcca

SEQ ID NO: 3226044 - RNA, 19 nt, Human
ccaguaucuugaagacuuu

SEQ ID NO: 3226045 - RNA, 22 nt, Human
ccaguaucuugaagacuuuucu

SEQ ID NO: 3226046 - RNA, 20 nt, Human
ccaggggugggacacccugu

SEQ ID NO: 3226047 - RNA, 21 nt, Human
ccaggggugggacacccugug

SEQ ID NO: 3226048 - RNA, 22 nt, Human
ccaggggugggacacccuguga

SEQ ID NO: 3226049 - RNA, 13 nt, Human
ccaguaucuugaa

SEQ ID NO: 3226050 - RNA, 17 nt, Human
ccagucaccccggccac

SEQ ID NO: 3226051 - RNA, 18 nt, Human
ccagucaccccggccacc

SEQ ID NO: 3226052 - RNA, 13 nt, Human
ccagucaccccgg

SEQ ID NO: 3226053 - RNA, 18 nt, Human
cccaggcuggcgugcagu

SEQ ID NO: 3226054 - RNA, 20 nt, Human
cccaggcuggcgugcagugg

SEQ ID NO: 3226055 - RNA, 19 nt, Human
cccaggcuggcgugcagug

SEQ ID NO: 3226056 - RNA, 14 nt, Human
cccauccucuguac

SEQ ID NO: 3226057 - RNA, 22 nt, Human
cccauccaccguccccucccag

SEQ ID NO: 3226058 - RNA, 21 nt, Human
cccauccaccguccccuccca

SEQ ID NO: 3226059 - RNA, 14 nt, Human
cccagggcacgugg

SEQ ID NO: 3226060 - RNA, 13 nt, Human
cccagggcacgug

SEQ ID NO: 3226061 - RNA, 15 nt, Human
cccauccucuguaca

SEQ ID NO: 3226062 - RNA, 19 nt, Human
cccauccucuguacagagc

SEQ ID NO: 3226063 - RNA, 23 nt, Human
cccagccccaaaacucuccucug

SEQ ID NO: 3226064 - RNA, 21 nt, Human
cccagccccaaaacucuccuc

SEQ ID NO: 3226065 - RNA, 19 nt, Human
cccagcccacuucugccau

SEQ ID NO: 3226066 - RNA, 17 nt, Human
cccagcccacuucugcc

SEQ ID NO: 3226067 - RNA, 21 nt, Human
cccagcaucgcacucuggcag

SEQ ID NO: 3226068 - RNA, 17 nt, Human
cccagcaucgcacucug

SEQ ID NO: 3226069 - RNA, 13 nt, Human
ccccggccaccug

SEQ ID NO: 3226070 - RNA, 14 nt, Human
ccccggccaccugc

SEQ ID NO: 3226071 - RNA, 18 nt, Human
ccccggccaccugcggug

SEQ ID NO: 3226072 - RNA, 14 nt, Human
ccccgcccaggcuu

SEQ ID NO: 3226073 - RNA, 15 nt, Human
ccccauuguggucac

SEQ ID NO: 3226074 - RNA, 14 nt, Human
cccccuuccaugga

SEQ ID NO: 3226075 - RNA, 12 nt, Human
ccccgcccaggc

SEQ ID NO: 3226076 - RNA, 18 nt, Human
ccccgcaguguuugugug

SEQ ID NO: 3226077 - RNA, 18 nt, Human
ccccaaaacucuccucug

SEQ ID NO: 3226078 - RNA, 20 nt, Human
ccccaaaacucuccucugcu

SEQ ID NO: 3226079 - RNA, 12 nt, Human
ccccagccacuc

SEQ ID NO: 3226080 - RNA, 14 nt, Human
ccccagccccaucc

SEQ ID NO: 3226081 - RNA, 14 nt, Human
ccccagccccaaaa

SEQ ID NO: 3226082 - RNA, 21 nt, Human
ccccauucugccugcccaggc

SEQ ID NO: 3226083 - RNA, 10 nt, Human
ccccagcccc

SEQ ID NO: 3226084 - RNA, 12 nt, Human
ccccagccccaa

SEQ ID NO: 3226085 - RNA, 21 nt, Human
ccccagccacuccccagccag

SEQ ID NO: 3226086 - RNA, 14 nt, Human
ccccagccacuccc

SEQ ID NO: 3226087 - RNA, 18 nt, Human
ccccagccagccuggcug

SEQ ID NO: 3226088 - RNA, 16 nt, Human
ccccagccagccuggc

SEQ ID NO: 3226089 - RNA, 22 nt, Human
ccccagccagccuggcugggac

SEQ ID NO: 3226090 - RNA, 23 nt, Human
cccauucugccugcccaggcccc

SEQ ID NO: 3226091 - RNA, 12 nt, Human
cccauucugucc

SEQ ID NO: 3226092 - RNA, 15 nt, Human
cccaccgcagacagg

SEQ ID NO: 3226093 - RNA, 18 nt, Human
cccaccgcagacaggacc

SEQ ID NO: 3226094 - RNA, 13 nt, Human
ccauugguguuga

SEQ ID NO: 3226095 - RNA, 22 nt, Human
ccauuguggucacaggaaguag

SEQ ID NO: 3226096 - RNA, 12 nt, Human
ccauuguucuga

SEQ ID NO: 3226097 - RNA, 21 nt, Human
ccauuguucaggauucuaaua

SEQ ID NO: 3226098 - RNA, 21 nt, Human
cccaaccugcucuccucuugc

SEQ ID NO: 3226099 - RNA, 14 nt, Human
cccaaccugcucuc

SEQ ID NO: 3226100 - RNA, 13 nt, Human
cccaaccugcucu

SEQ ID NO: 3226101 - RNA, 17 nt, Human
cccaacuucaucuggaa

SEQ ID NO: 3226102 - RNA, 18 nt, Human
cccaacuugccuuugaag

SEQ ID NO: 3226103 - RNA, 23 nt, Human
cccaaccugcucuccucuugcca

SEQ ID NO: 3226104 - RNA, 17 nt, Human
cccaagcucugcuccuc

SEQ ID NO: 3226105 - RNA, 20 nt, Human
cccaagcgcccuggccccca

SEQ ID NO: 3226106 - RNA, 18 nt, Human
cccaagcgcccuggcccc

SEQ ID NO: 3226107 - RNA, 15 nt, Human
cccaagcucugcucc

SEQ ID NO: 3226108 - RNA, 21 nt, Human
cccaagaauagaugcugacug

SEQ ID NO: 3226109 - RNA, 20 nt, Human
cccaagaauagaugcugacu

SEQ ID NO: 3226110 - RNA, 19 nt, Human
cccaagaaaggaaaccuuu

SEQ ID NO: 3226111 - RNA, 14 nt, Human
cccaagcaggaggc

SEQ ID NO: 3226112 - RNA, 23 nt, Human
cccaagccuacuuuugccauuga

SEQ ID NO: 3226113 - RNA, 16 nt, Human
cccaagccuggcaagg

SEQ ID NO: 3226114 - RNA, 17 nt, Human
cccaagcgcccuggccc

SEQ ID NO: 3226115 - RNA, 15 nt, Human
cccacccaagggccu

SEQ ID NO: 3226116 - RNA, 21 nt, Human
cccaccaucugcugucuuuuc

SEQ ID NO: 3226117 - RNA, 19 nt, Human
cccaccaucugcugucuuu

SEQ ID NO: 3226118 - RNA, 17 nt, Human
cccaccaucugcugucu

SEQ ID NO: 3226119 - RNA, 16 nt, Human
cccaccaucugcuguc

SEQ ID NO: 3226120 - RNA, 18 nt, Human
cccaccaucaugucuggc

SEQ ID NO: 3226121 - RNA, 15 nt, Human
cccaccaucugcugu

SEQ ID NO: 3226122 - RNA, 14 nt, Human
cccaccaucugcug

SEQ ID NO: 3226123 - RNA, 13 nt, Human
cccaccaucugcu

SEQ ID NO: 3226124 - RNA, 12 nt, Human
cccaccaucugc

SEQ ID NO: 3226125 - RNA, 16 nt, Human
ccaugaggaacaaggc

SEQ ID NO: 3226126 - RNA, 17 nt, Human
ccaugaggaacaaggca

SEQ ID NO: 3226127 - RNA, 18 nt, Human
ccaugaggaacaaggcaa

SEQ ID NO: 3226128 - RNA, 15 nt, Human
ccaugagagcgcagc

SEQ ID NO: 3226129 - RNA, 18 nt, Human
ccaugagagcgcagcccg

SEQ ID NO: 3226130 - RNA, 22 nt, Human
ccaugagaauguuuuagcacag

SEQ ID NO: 3226131 - RNA, 23 nt, Human
ccaugagaauguuuuagcacagc

SEQ ID NO: 3226132 - RNA, 17 nt, Human
ccaugggccuccugugu

SEQ ID NO: 3226133 - RNA, 12 nt, Human
ccaugggcagga

SEQ ID NO: 3226134 - RNA, 23 nt, Human
ccauggggucucucacagacagg

SEQ ID NO: 3226135 - RNA, 17 nt, Human
ccauggggucucucaca

SEQ ID NO: 3226136 - RNA, 19 nt, Human
ccaugucgccucugcauuc

SEQ ID NO: 3226137 - RNA, 14 nt, Human
ccaugucucgacuc

SEQ ID NO: 3226138 - RNA, 15 nt, Human
ccaugucucgacuca

SEQ ID NO: 3226139 - RNA, 20 nt, Human
ccaugucucugagcauuaga

SEQ ID NO: 3226140 - RNA, 23 nt, Human
ccugccuccuuugugaggaagcc

SEQ ID NO: 3226141 - RNA, 21 nt, Human
ccugccuccuuugugaggaag

SEQ ID NO: 3226142 - RNA, 22 nt, Human
ccugccuccuuugugaggaagc

SEQ ID NO: 3226143 - RNA, 13 nt, Human
ccugccuccuuug

SEQ ID NO: 3226144 - RNA, 15 nt, Human
ccugccuccuuugug

SEQ ID NO: 3226145 - RNA, 19 nt, Human
ccugccuccuuugugagga

SEQ ID NO: 3226146 - RNA, 20 nt, Human
ccugccuccuuugugaggaa

SEQ ID NO: 3226147 - RNA, 15 nt, Human
ccugccucuucucua

SEQ ID NO: 3226148 - RNA, 17 nt, Human
ccugccuccuugauauu

SEQ ID NO: 3226149 - RNA, 19 nt, Human
ccugccugcccugucagga

SEQ ID NO: 3226150 - RNA, 12 nt, Human
ccugccugcugg

SEQ ID NO: 3226151 - RNA, 18 nt, Human
ccugccugcccugucagg

SEQ ID NO: 3226152 - RNA, 16 nt, Human
ccugccugcccuguca

SEQ ID NO: 3226153 - RNA, 14 nt, Human
ccugccugcccugu

SEQ ID NO: 3226154 - RNA, 12 nt, Human
ccugcugcaguu

SEQ ID NO: 3226155 - RNA, 16 nt, Human
ccugcugcaguugcca

SEQ ID NO: 3226156 - RNA, 11 nt, Human
ccugcugcagu

SEQ ID NO: 3226157 - RNA, 22 nt, Human
ccugcugcaguugccagucacc

SEQ ID NO: 3226158 - RNA, 21 nt, Human
ccugcugcaguugccagucac

SEQ ID NO: 3226159 - RNA, 19 nt, Human
ccugcugccaguaccagcc

SEQ ID NO: 3226160 - RNA, 21 nt, Human
ccugcugccaguaccagcccc

SEQ ID NO: 3226161 - RNA, 14 nt, Human
ccugaguuccuagc

SEQ ID NO: 3226162 - RNA, 18 nt, Human
ccugaguuaggcuuucuc

SEQ ID NO: 3226163 - RNA, 22 nt, Human
ccugaguuaggcuuucucuuca

SEQ ID NO: 3226164 - RNA, 19 nt, Human
ccugaguuaggcuuucucu

SEQ ID NO: 3226165 - RNA, 17 nt, Human
ccugcagagcugcgggc

SEQ ID NO: 3226166 - RNA, 14 nt, Human
ccugcagagcugcg

SEQ ID NO: 3226167 - RNA, 13 nt, Human
ccugcagagcugc

SEQ ID NO: 3226168 - RNA, 12 nt, Human
ccugcagagcug

SEQ ID NO: 3226169 - RNA, 15 nt, Human
ccugcaggcagccag

SEQ ID NO: 3226170 - RNA, 12 nt, Human
ccugcagagggc

SEQ ID NO: 3226171 - RNA, 16 nt, Human
ccugcaggcagccagg

SEQ ID NO: 3226172 - RNA, 17 nt, Human
ccugcaggcagccaggc

SEQ ID NO: 3226173 - RNA, 18 nt, Human
ccugcaggcagccaggcc

SEQ ID NO: 3226174 - RNA, 19 nt, Human
ccugcaggcagccaggcca

SEQ ID NO: 3226175 - RNA, 20 nt, Human
ccugcaggcagccaggccac

SEQ ID NO: 3226176 - RNA, 21 nt, Human
ccugcaggcagccaggccaca

SEQ ID NO: 3226177 - RNA, 16 nt, Human
ccugaggcugggcucc

SEQ ID NO: 3226178 - RNA, 19 nt, Human
ccugacucccccagucccc

SEQ ID NO: 3226179 - RNA, 13 nt, Human
ccugacuccccca

SEQ ID NO: 3226180 - RNA, 17 nt, Human
ccugaggcugggcuccc

SEQ ID NO: 3226181 - RNA, 19 nt, Human
ccugaggcugggcucccuu

SEQ ID NO: 3226182 - RNA, 21 nt, Human
ccugaggcugggcucccuucc

SEQ ID NO: 3226183 - RNA, 19 nt, Human
ccugacgagauaagcaguu

SEQ ID NO: 3226184 - RNA, 16 nt, Human
ccugaggggccucuua

SEQ ID NO: 3226185 - RNA, 21 nt, Human
ccugagugagaggggaggcca

SEQ ID NO: 3226186 - RNA, 18 nt, Human
ccugagugagaggggagg

SEQ ID NO: 3226187 - RNA, 16 nt, Human
ccugagugagagggga

SEQ ID NO: 3226188 - RNA, 15 nt, Human
ccugagugagagggg

SEQ ID NO: 3226189 - RNA, 23 nt, Human
ccugagugagaggggaggccaag

SEQ ID NO: 3226190 - RNA, 22 nt, Human
ccugagugagaggggaggccaa

SEQ ID NO: 3226191 - RNA, 12 nt, Human
ccugaggggccu

SEQ ID NO: 3226192 - RNA, 21 nt, Human
ccugaggggcagccugccuug

SEQ ID NO: 3226193 - RNA, 20 nt, Human
ccugaggggcagccugccuu

SEQ ID NO: 3226194 - RNA, 17 nt, Human
ccugaggggcagccugc

SEQ ID NO: 3226195 - RNA, 15 nt, Human
ccugaggggcagccu

SEQ ID NO: 3226196 - RNA, 22 nt, Human
ccugaggggagacagagcaacc

SEQ ID NO: 3226197 - RNA, 20 nt, Human
ccugaggggagacagagcaa

SEQ ID NO: 3226198 - RNA, 18 nt, Human
ccugagggcggggugucu

SEQ ID NO: 3226199 - RNA, 22 nt, Human
ccugagggcggggugucugucu

SEQ ID NO: 3226200 - RNA, 15 nt, Human
ccugaggggagacag

SEQ ID NO: 3226201 - RNA, 19 nt, Human
ccugaggggagacagagca

SEQ ID NO: 3226202 - RNA, 18 nt, Human
ccugaggggagacagagc

SEQ ID NO: 3226203 - RNA, 16 nt, Human
ccucuuugagugaagc

SEQ ID NO: 3226204 - RNA, 15 nt, Human
ccucuuggcugccuu

SEQ ID NO: 3226205 - RNA, 15 nt, Human
ccucuucuucucaag

SEQ ID NO: 3226206 - RNA, 14 nt, Human
ccucuucugagcuu

SEQ ID NO: 3226207 - RNA, 13 nt, Human
ccucuucucucag

SEQ ID NO: 3226208 - RNA, 14 nt, Human
ccucuucucucaga

SEQ ID NO: 3226209 - RNA, 15 nt, Human
ccucuucucucagac

SEQ ID NO: 3226210 - RNA, 22 nt, Human
ccucugcuaaauugauguugau

SEQ ID NO: 3226211 - RNA, 15 nt, Human
ccucugcuaaauuga

SEQ ID NO: 3226212 - RNA, 14 nt, Human
ccucugcuaaauug

SEQ ID NO: 3226213 - RNA, 12 nt, Human
ccucugcuaaau

SEQ ID NO: 3226214 - RNA, 19 nt, Human
ccucugccugucuccccca

SEQ ID NO: 3226215 - RNA, 15 nt, Human
ccucugccugucucc

SEQ ID NO: 3226216 - RNA, 20 nt, Human
ccucugccugaagucacaca

SEQ ID NO: 3226217 - RNA, 11 nt, Human
ccucugccuga

SEQ ID NO: 3226218 - RNA, 23 nt, Human
ccucugccucugacacacagcuc

SEQ ID NO: 3226219 - RNA, 21 nt, Human
ccucugccucugacacacagc

SEQ ID NO: 3226220 - RNA, 20 nt, Human
ccucugccucugacacacag

SEQ ID NO: 3226221 - RNA, 11 nt, Human
ccucugcccug

SEQ ID NO: 3226222 - RNA, 12 nt, Human
ccucugcccugc

SEQ ID NO: 3226223 - RNA, 13 nt, Human
ccucugcccugcg

SEQ ID NO: 3226224 - RNA, 14 nt, Human
ccucugcccugcgg

SEQ ID NO: 3226225 - RNA, 14 nt, Human
ccucggcuggcucc

SEQ ID NO: 3226226 - RNA, 15 nt, Human
ccucggcuggcuccc

SEQ ID NO: 3226227 - RNA, 16 nt, Human
ccucggcuggcucccc

SEQ ID NO: 3226228 - RNA, 17 nt, Human
ccucggcuggcuccccu

SEQ ID NO: 3226229 - RNA, 18 nt, Human
ccucggcuggcuccccug

SEQ ID NO: 3226230 - RNA, 19 nt, Human
ccucggcuggcuccccugc

SEQ ID NO: 3226231 - RNA, 21 nt, Human
ccucggcuggcuccccugcag

SEQ ID NO: 3226232 - RNA, 22 nt, Human
ccucggcuggcuccccugcagc

SEQ ID NO: 3226233 - RNA, 17 nt, Human
ccucggcuggcugucca

SEQ ID NO: 3226234 - RNA, 14 nt, Human
ccucgcuccaacuc

SEQ ID NO: 3226235 - RNA, 19 nt, Human
ccuccuuugugaggaagcc

SEQ ID NO: 3226236 - RNA, 18 nt, Human
ccuccuuugugaggaagc

SEQ ID NO: 3226237 - RNA, 15 nt, Human
ccucgaacuggcugc

SEQ ID NO: 3226238 - RNA, 16 nt, Human
ccucgaacuggcugca

SEQ ID NO: 3226239 - RNA, 20 nt, Human
ccuccgucacuaccuggcug

SEQ ID NO: 3226240 - RNA, 16 nt, Human
ccuccgggucuuccua

SEQ ID NO: 3226241 - RNA, 15 nt, Human
ccuccgggucuuccu

SEQ ID NO: 3226242 - RNA, 14 nt, Human
ccuccggcuaagca

SEQ ID NO: 3226243 - RNA, 14 nt, Human
ccuccgucacuacc

SEQ ID NO: 3226244 - RNA, 19 nt, Human
ccuccgucacuaccuggcu

SEQ ID NO: 3226245 - RNA, 16 nt, Human
ccuccgucacuaccug

SEQ ID NO: 3226246 - RNA, 21 nt, Human
ccuccuaaaaggcccagagag

SEQ ID NO: 3226247 - RNA, 19 nt, Human
ccuccuaaaaggcccagag

SEQ ID NO: 3226248 - RNA, 18 nt, Human
ccuccuaaaaggcccaga

SEQ ID NO: 3226249 - RNA, 17 nt, Human
ccuccuaaaaggcccag

SEQ ID NO: 3226250 - RNA, 16 nt, Human
ccuccuaaaaggccca

SEQ ID NO: 3226251 - RNA, 15 nt, Human
ccuccuaaaaggccc

SEQ ID NO: 3226252 - RNA, 13 nt, Human
ccuccgccucccg

SEQ ID NO: 3226253 - RNA, 16 nt, Human
ccuccgccucccgggu

SEQ ID NO: 3226254 - RNA, 22 nt, Human
ccucccugcugucauugcuucu

SEQ ID NO: 3226255 - RNA, 23 nt, Human
ccuccccaaggcccccugccugc

SEQ ID NO: 3226256 - RNA, 15 nt, Human
ccucccacugcccac

SEQ ID NO: 3226257 - RNA, 14 nt, Human
ccucccacugccca

SEQ ID NO: 3226258 - RNA, 23 nt, Human
ccucccacugcccacuggccggc

SEQ ID NO: 3226259 - RNA, 19 nt, Human
ccucccacugcccacuggc

SEQ ID NO: 3226260 - RNA, 11 nt, Human
ccucaggcagg

SEQ ID NO: 3226261 - RNA, 17 nt, Human
ccucccaacucacccca

SEQ ID NO: 3226262 - RNA, 20 nt, Human
ccucccaacucaccccagcc

SEQ ID NO: 3226263 - RNA, 21 nt, Human
ccucccaacucaccccagccc

SEQ ID NO: 3226264 - RNA, 17 nt, Human
ccucccaccucagccuc

SEQ ID NO: 3226265 - RNA, 16 nt, Human
ccuagcuggagaggag

SEQ ID NO: 3226266 - RNA, 12 nt, Human
ccuagcuggaga

SEQ ID NO: 3226267 - RNA, 23 nt, Human
ccuagccucacgcuccuuucuga

SEQ ID NO: 3226268 - RNA, 17 nt, Human
ccuagccuugcacuuuc

SEQ ID NO: 3226269 - RNA, 22 nt, Human
ccuagcuggagaggagcccugc

SEQ ID NO: 3226270 - RNA, 21 nt, Human
ccuagcuggagaggagcccug

SEQ ID NO: 3226271 - RNA, 20 nt, Human
ccuagcuggagaggagcccu

SEQ ID NO: 3226272 - RNA, 19 nt, Human
ccuagcuggagaggagccc

SEQ ID NO: 3226273 - RNA, 14 nt, Human
ccuaggaagugauu

SEQ ID NO: 3226274 - RNA, 18 nt, Human
ccucagccuccugaguag

SEQ ID NO: 3226275 - RNA, 16 nt, Human
ccgaauagcugggacu

SEQ ID NO: 3226276 - RNA, 17 nt, Human
ccgaccagacaccuuga

SEQ ID NO: 3226277 - RNA, 13 nt, Human
ccgaccagacacc

SEQ ID NO: 3226278 - RNA, 15 nt, Human
ccgcagacaggacca

SEQ ID NO: 3226279 - RNA, 15 nt, Human
ccgaccaccugccca

SEQ ID NO: 3226280 - RNA, 16 nt, Human
ccgaaaacguggcugc

SEQ ID NO: 3226281 - RNA, 17 nt, Human
ccgaaaacguggcugcu

SEQ ID NO: 3226282 - RNA, 19 nt, Human
ccgaaagggacuuggaagc

SEQ ID NO: 3226283 - RNA, 18 nt, Human
ccgaaaggucaccucacu

SEQ ID NO: 3226284 - RNA, 19 nt, Human
ccgaaagaggcacccuucc

SEQ ID NO: 3226285 - RNA, 15 nt, Human
cccuuccucuuucca

SEQ ID NO: 3226286 - RNA, 16 nt, Human
cccuuccucugcuccc

SEQ ID NO: 3226287 - RNA, 14 nt, Human
cccuuccucugcuc

SEQ ID NO: 3226288 - RNA, 13 nt, Human
cccuuccucugcu

SEQ ID NO: 3226289 - RNA, 23 nt, Human
cccuuccugggcacacgcugcuc

SEQ ID NO: 3226290 - RNA, 12 nt, Human
cccuuccuucuu

SEQ ID NO: 3226291 - RNA, 11 nt, Human
cccuuccugug

SEQ ID NO: 3226292 - RNA, 22 nt, Human
cccuuccugggcacacgcugcu

SEQ ID NO: 3226293 - RNA, 18 nt, Human
cccuuccugggcacacgc

SEQ ID NO: 3226294 - RNA, 14 nt, Human
cccuuccugggcac

SEQ ID NO: 3226295 - RNA, 16 nt, Human
ccgcagacaggaccag

SEQ ID NO: 3226296 - RNA, 17 nt, Human
ccgcagacaggaccagg

SEQ ID NO: 3226297 - RNA, 18 nt, Human
ccgcccaaaccuuucccc

SEQ ID NO: 3226298 - RNA, 14 nt, Human
ccgcccagcccacc

SEQ ID NO: 3226299 - RNA, 21 nt, Human
cccugugauggggcccugccu

SEQ ID NO: 3226300 - RNA, 22 nt, Human
cccugugauggggcccugccuc

SEQ ID NO: 3226301 - RNA, 23 nt, Human
cccugugauggggcccugccucc

SEQ ID NO: 3226302 - RNA, 21 nt, Human
cccugugcagaagggagcugg

SEQ ID NO: 3226303 - RNA, 21 nt, Human
cccuuccucuccacugccuuc

SEQ ID NO: 3226304 - RNA, 20 nt, Human
cccugugauggggcccugcc

SEQ ID NO: 3226305 - RNA, 15 nt, Human
ccuaacgaaguaucc

SEQ ID NO: 3226306 - RNA, 20 nt, Human
ccuaacgaaguauccuucag

SEQ ID NO: 3226307 - RNA, 17 nt, Human
ccgucuaccugaggggc

SEQ ID NO: 3226308 - RNA, 12 nt, Human
ccgugaggccag

SEQ ID NO: 3226309 - RNA, 13 nt, Human
ccgugaggccaga

SEQ ID NO: 3226310 - RNA, 14 nt, Human
ccgugaggccagag

SEQ ID NO: 3226311 - RNA, 14 nt, Human
ccgucuaccugagg

SEQ ID NO: 3226312 - RNA, 15 nt, Human
ccgucuaccugaggg

SEQ ID NO: 3226313 - RNA, 15 nt, Human
ccgucuacagcuccc

SEQ ID NO: 3226314 - RNA, 22 nt, Human
ccgucuacagcucccccagcuc

SEQ ID NO: 3226315 - RNA, 11 nt, Human
ccgucuacauu

SEQ ID NO: 3226316 - RNA, 14 nt, Human
ccgucuacauuuca

SEQ ID NO: 3226317 - RNA, 14 nt, Human
ccggcuccaggcuc

SEQ ID NO: 3226318 - RNA, 13 nt, Human
ccggcuccaggcu

SEQ ID NO: 3226319 - RNA, 12 nt, Human
ccggcuccaggc

SEQ ID NO: 3226320 - RNA, 17 nt, Human
ccuagcacuuugggagg

SEQ ID NO: 3226321 - RNA, 14 nt, Human
ccuaaucuucugaa

SEQ ID NO: 3226322 - RNA, 16 nt, Human
ccggccaccugcggug

SEQ ID NO: 3226323 - RNA, 15 nt, Human
ccggccccugcuggu

SEQ ID NO: 3226324 - RNA, 18 nt, Human
ccggcaggguccuagaaa

SEQ ID NO: 3226325 - RNA, 18 nt, Human
cccugagaucucugcagg

SEQ ID NO: 3226326 - RNA, 20 nt, Human
cccugacugggggcagacau

SEQ ID NO: 3226327 - RNA, 12 nt, Human
cccugacugggg

SEQ ID NO: 3226328 - RNA, 17 nt, Human
cccugagcccacugugc

SEQ ID NO: 3226329 - RNA, 16 nt, Human
cccugagcccacugug

SEQ ID NO: 3226330 - RNA, 14 nt, Human
cccugagcccacug

SEQ ID NO: 3226331 - RNA, 13 nt, Human
cccugagcccacu

SEQ ID NO: 3226332 - RNA, 12 nt, Human
cccugagcccac

SEQ ID NO: 3226333 - RNA, 14 nt, Human
cccugagcaggauu

SEQ ID NO: 3226334 - RNA, 16 nt, Human
cccugagcuuucugcu

SEQ ID NO: 3226335 - RNA, 20 nt, Human
cccugcccaccuggccucug

SEQ ID NO: 3226336 - RNA, 22 nt, Human
cccugcccagaucagccagaag

SEQ ID NO: 3226337 - RNA, 22 nt, Human
cccugcccaccuggccucugca

SEQ ID NO: 3226338 - RNA, 21 nt, Human
cccugcccagaucagccagaa

SEQ ID NO: 3226339 - RNA, 20 nt, Human
cccugcccagaucagccaga

SEQ ID NO: 3226340 - RNA, 14 nt, Human
cccugcccagauca

SEQ ID NO: 3226341 - RNA, 14 nt, Human
cccugccccccagc

SEQ ID NO: 3226342 - RNA, 20 nt, Human
cccugccccccagcccuccu

SEQ ID NO: 3226343 - RNA, 15 nt, Human
cccugccccccagcc

SEQ ID NO: 3226344 - RNA, 17 nt, Human
cccugcccggcugcgga

SEQ ID NO: 3226345 - RNA, 14 nt, Human
cccugcccggcugc

SEQ ID NO: 3226346 - RNA, 17 nt, Human
cccugccccucccuuca

SEQ ID NO: 3226347 - RNA, 23 nt, Human
cccugccccucccuucaaccauu

SEQ ID NO: 3226348 - RNA, 19 nt, Human
cccugccccucccuucaac

SEQ ID NO: 3226349 - RNA, 18 nt, Human
cccugccccucccuucaa

SEQ ID NO: 3226350 - RNA, 19 nt, Human
cccuggauccaucaggcca

SEQ ID NO: 3226351 - RNA, 17 nt, Human
cccuggaugcagccuca

SEQ ID NO: 3226352 - RNA, 21 nt, Human
cccuggaugcagccucacagu

SEQ ID NO: 3226353 - RNA, 13 nt, Human
cccuggaugcagc

SEQ ID NO: 3226354 - RNA, 11 nt, Human
cccugcccugg

SEQ ID NO: 3226355 - RNA, 12 nt, Human
cccugcccuggu

SEQ ID NO: 3226356 - RNA, 23 nt, Human
cccugcccugguuuccugcccug

SEQ ID NO: 3226357 - RNA, 22 nt, Human
cccugcccugguuuccugcccu

SEQ ID NO: 3226358 - RNA, 20 nt, Human
cccuggcucccacaggcccu

SEQ ID NO: 3226359 - RNA, 19 nt, Human
cccuggcucccacaggccc

SEQ ID NO: 3226360 - RNA, 14 nt, Human
cccugaaggaacca

SEQ ID NO: 3226361 - RNA, 12 nt, Human
cccugaaggccc

SEQ ID NO: 3226362 - RNA, 16 nt, Human
cccugaaagcccugag

SEQ ID NO: 3226363 - RNA, 13 nt, Human
cccugaaaugugu

SEQ ID NO: 3226364 - RNA, 11 nt, Human
cccugaaaugu

SEQ ID NO: 3226365 - RNA, 15 nt, Human
cccucgucuuuccca

SEQ ID NO: 3226366 - RNA, 14 nt, Human
cccucgucuuuccc

SEQ ID NO: 3226367 - RNA, 22 nt, Human
cccugaacaacgagccuuuuca

SEQ ID NO: 3226368 - RNA, 13 nt, Human
cccugaaggcccc

SEQ ID NO: 3226369 - RNA, 14 nt, Human
cccugaaggccccg

SEQ ID NO: 3226370 - RNA, 16 nt, Human
cccugaaggccccgcc

SEQ ID NO: 3226371 - RNA, 19 nt, Human
cccugaaggccccgcccag

SEQ ID NO: 3226372 - RNA, 16 nt, Human
cccugacaacacucau

SEQ ID NO: 3226373 - RNA, 22 nt, Human
cccugacaacacucauugaccu

SEQ ID NO: 3226374 - RNA, 20 nt, Human
cccugaaggccccgcccagg

SEQ ID NO: 3226375 - RNA, 22 nt, Human
cccugaaggccccgcccaggcu

SEQ ID NO: 3226376 - RNA, 14 nt, Human
cccugacaacacuc

SEQ ID NO: 3226377 - RNA, 13 nt, Human
cccucggagaaga

SEQ ID NO: 3226378 - RNA, 22 nt, Human
cccucgcccagucccagcagcc

SEQ ID NO: 3226379 - RNA, 20 nt, Human
cccucgcccagucccagcag

SEQ ID NO: 3226380 - RNA, 18 nt, Human
cccucgcccagucccagc

SEQ ID NO: 3226381 - RNA, 16 nt, Human
cccucgcccaguccca

SEQ ID NO: 3226382 - RNA, 13 nt, Human
cccucgcccaguc

SEQ ID NO: 3226383 - RNA, 12 nt, Human
cccucgcccagu

SEQ ID NO: 3226384 - RNA, 18 nt, Human
cccugaaagcccugagcu

SEQ ID NO: 3226385 - RNA, 13 nt, Human
cccucgucuuucc

SEQ ID NO: 3226386 - RNA, 18 nt, Human
cccucggaguucuucuug

SEQ ID NO: 3226387 - RNA, 19 nt, Human
cccucggaguucuucuuga

SEQ ID NO: 3226388 - RNA, 14 nt, Human
cccuccucucugcc

SEQ ID NO: 3226389 - RNA, 18 nt, Human
cccuccgcggcgggcccu

SEQ ID NO: 3226390 - RNA, 19 nt, Human
cccuccgcggcgggcccug

SEQ ID NO: 3226391 - RNA, 21 nt, Human
cccuccgcggcgggcccugcc

SEQ ID NO: 3226392 - RNA, 17 nt, Human
cccuccgggucuuccua

SEQ ID NO: 3226393 - RNA, 16 nt, Human
cccuccuccuggacuc

SEQ ID NO: 3226394 - RNA, 18 nt, Human
cccuccuccuggacuccu

SEQ ID NO: 3226395 - RNA, 11 nt, Human
cccuccuccug

SEQ ID NO: 3226396 - RNA, 20 nt, Human
cucaggccugacucucagca

SEQ ID NO: 3226397 - RNA, 22 nt, Human
cucaggccugggggcugggcag

SEQ ID NO: 3226398 - RNA, 11 nt, Human
cucaggccugg

SEQ ID NO: 3226399 - RNA, 23 nt, Human
cucaggccgaaggaggagucagg

SEQ ID NO: 3226400 - RNA, 18 nt, Human
cucaggccagcugcuugg

SEQ ID NO: 3226401 - RNA, 16 nt, Human
cucaggccagcugcuu

SEQ ID NO: 3226402 - RNA, 17 nt, Human
cucaggccagcugcuug

SEQ ID NO: 3226403 - RNA, 19 nt, Human
cucaggccaaacucaccug

SEQ ID NO: 3226404 - RNA, 20 nt, Human
cucaggccaaacucaccugc

SEQ ID NO: 3226405 - RNA, 21 nt, Human
cucaggccaaacucaccugcc

SEQ ID NO: 3226406 - RNA, 15 nt, Human
cucaggccagcugcu

SEQ ID NO: 3226407 - RNA, 22 nt, Human
cucaggcauggaugaauaaaug

SEQ ID NO: 3226408 - RNA, 22 nt, Human
cucagccucccgaauagcuggg

SEQ ID NO: 3226409 - RNA, 21 nt, Human
cucagccucccgaauagcugg

SEQ ID NO: 3226410 - RNA, 19 nt, Human
cucagccucccgaauagcu

SEQ ID NO: 3226411 - RNA, 13 nt, Human
cucagacuguaua

SEQ ID NO: 3226412 - RNA, 23 nt, Human
cucagaagacacugaugggcaac

SEQ ID NO: 3226413 - RNA, 15 nt, Human
cucagaccgucuucc

SEQ ID NO: 3226414 - RNA, 16 nt, Human
cucagaccgucuuccu

SEQ ID NO: 3226415 - RNA, 17 nt, Human
cucagaccgucuuccuc

SEQ ID NO: 3226416 - RNA, 21 nt, Human
cucagaccgucuuccuccaac

SEQ ID NO: 3226417 - RNA, 22 nt, Human
cucagaccgucuuccuccaacc

SEQ ID NO: 3226418 - RNA, 23 nt, Human
cucagaccgucuuccuccaaccc

SEQ ID NO: 3226419 - RNA, 17 nt, Human
cucaccuuucccaucuu

SEQ ID NO: 3226420 - RNA, 18 nt, Human
cucacgagucauccagaa

SEQ ID NO: 3226421 - RNA, 17 nt, Human
cucacgcuccuuucuga

SEQ ID NO: 3226422 - RNA, 15 nt, Human
cucacgcauucucug

SEQ ID NO: 3226423 - RNA, 22 nt, Human
cucagaagacacugaugggcaa

SEQ ID NO: 3226424 - RNA, 20 nt, Human
cucagaagacacugaugggc

SEQ ID NO: 3226425 - RNA, 17 nt, Human
cucagaagacacugaug

SEQ ID NO: 3226426 - RNA, 15 nt, Human
cucagaagacacuga

SEQ ID NO: 3226427 - RNA, 13 nt, Human
cucagaagacacu

SEQ ID NO: 3226428 - RNA, 14 nt, Human
cucagaaccacagc

SEQ ID NO: 3226429 - RNA, 23 nt, Human
cucaugauagaaggcuaugggga

SEQ ID NO: 3226430 - RNA, 22 nt, Human
cucagucuggcccuuccuuuuc

SEQ ID NO: 3226431 - RNA, 16 nt, Human
cucagugagcuggaga

SEQ ID NO: 3226432 - RNA, 16 nt, Human
cucaguccaugaagau

SEQ ID NO: 3226433 - RNA, 20 nt, Human
cucagucuggcccuuccuuu

SEQ ID NO: 3226434 - RNA, 12 nt, Human
cucaguccucaa

SEQ ID NO: 3226435 - RNA, 19 nt, Human
cucaguccucaaagcuuuu

SEQ ID NO: 3226436 - RNA, 17 nt, Human
cucaguccauagcagag

SEQ ID NO: 3226437 - RNA, 15 nt, Human
cucaguccauagcag

SEQ ID NO: 3226438 - RNA, 14 nt, Human
cucagguugucuga

SEQ ID NO: 3226439 - RNA, 23 nt, Human
cucaggugucccugcacuugcag

SEQ ID NO: 3226440 - RNA, 18 nt, Human
cuauguucuaagaaguga

SEQ ID NO: 3226441 - RNA, 17 nt, Human
cuauguugcccaggcag

SEQ ID NO: 3226442 - RNA, 22 nt, Human
cuauguugcccaggcaggucuu

SEQ ID NO: 3226443 - RNA, 21 nt, Human
cuauguugcccaggcaggucu

SEQ ID NO: 3226444 - RNA, 19 nt, Human
cuauguugcccaggcaggu

SEQ ID NO: 3226445 - RNA, 18 nt, Human
cuauguugcccaggcagg

SEQ ID NO: 3226446 - RNA, 23 nt, Human
cuaugucauuugcuggagcucug

SEQ ID NO: 3226447 - RNA, 17 nt, Human
cuauccugggcuuuugu

SEQ ID NO: 3226448 - RNA, 14 nt, Human
cuaugugagaccau

SEQ ID NO: 3226449 - RNA, 13 nt, Human
cuaucucccccag

SEQ ID NO: 3226450 - RNA, 17 nt, Human
cuauccuacuuccccuu

SEQ ID NO: 3226451 - RNA, 23 nt, Human
cuaucaguuuuauagcuuuauuu

SEQ ID NO: 3226452 - RNA, 23 nt, Human
cucaauuauuuugcauuuuuucu

SEQ ID NO: 3226453 - RNA, 21 nt, Human
cucaaugugugccgagcccuu

SEQ ID NO: 3226454 - RNA, 21 nt, Human
cucaagugauucuccugccuc

SEQ ID NO: 3226455 - RNA, 13 nt, Human
cuauuaaaaaagu

SEQ ID NO: 3226456 - RNA, 23 nt, Human
cuauuaaaaaagucuacaacaua

SEQ ID NO: 3226457 - RNA, 18 nt, Human
cucaaguuuaugucucag

SEQ ID NO: 3226458 - RNA, 12 nt, Human
cuccuacugagg

SEQ ID NO: 3226459 - RNA, 13 nt, Human
cuccuaccuggua

SEQ ID NO: 3226460 - RNA, 23 nt, Human
cuccgcuuucuacccagcgagcc

SEQ ID NO: 3226461 - RNA, 18 nt, Human
cuccggccaggugccucc

SEQ ID NO: 3226462 - RNA, 19 nt, Human
cuccggccaggugccuccu

SEQ ID NO: 3226463 - RNA, 20 nt, Human
cuccggccaggugccuccug

SEQ ID NO: 3226464 - RNA, 23 nt, Human
cuccggccaggugccuccugaca

SEQ ID NO: 3226465 - RNA, 15 nt, Human
cuccuuucaccacau

SEQ ID NO: 3226466 - RNA, 17 nt, Human
cuccuuucacaaccuuc

SEQ ID NO: 3226467 - RNA, 16 nt, Human
cuccuuucacaaccuu

SEQ ID NO: 3226468 - RNA, 13 nt, Human
cuccuuucacaac

SEQ ID NO: 3226469 - RNA, 13 nt, Human
cuccuggggcgcg

SEQ ID NO: 3226470 - RNA, 19 nt, Human
cuccuggggcgcgugaggc

SEQ ID NO: 3226471 - RNA, 22 nt, Human
cuccuggggcgcgugaggcccg

SEQ ID NO: 3226472 - RNA, 23 nt, Human
cuccuggggcgcgugaggcccgu

SEQ ID NO: 3226473 - RNA, 13 nt, Human
cuccugguccuag

SEQ ID NO: 3226474 - RNA, 15 nt, Human
cuccugguccuaggc

SEQ ID NO: 3226475 - RNA, 14 nt, Human
cuccucuuccaggc

SEQ ID NO: 3226476 - RNA, 15 nt, Human
cuccucuguccaggc

SEQ ID NO: 3226477 - RNA, 12 nt, Human
cuccucugucca

SEQ ID NO: 3226478 - RNA, 13 nt, Human
cuccucugcugcu

SEQ ID NO: 3226479 - RNA, 14 nt, Human
cuccucugcugcug

SEQ ID NO: 3226480 - RNA, 19 nt, Human
cuccuggcccacugcaucg

SEQ ID NO: 3226481 - RNA, 16 nt, Human
cuccucuugccacugc

SEQ ID NO: 3226482 - RNA, 15 nt, Human
cuccucuugccacug

SEQ ID NO: 3226483 - RNA, 12 nt, Human
cuccucuugcca

SEQ ID NO: 3226484 - RNA, 18 nt, Human
cuccugggcuaagugauc

SEQ ID NO: 3226485 - RNA, 19 nt, Human
cuccuggccucaagugauu

SEQ ID NO: 3226486 - RNA, 20 nt, Human
cucccucuacugggagccua

SEQ ID NO: 3226487 - RNA, 16 nt, Human
cucccucccagcucca

SEQ ID NO: 3226488 - RNA, 20 nt, Human
cucccucuuucccucccuuc

SEQ ID NO: 3226489 - RNA, 21 nt, Human
cucccucuccagcaggcccau

SEQ ID NO: 3226490 - RNA, 16 nt, Human
cucccucuccagcagg

SEQ ID NO: 3226491 - RNA, 20 nt, Human
cucccugaaguaagcaaaga

SEQ ID NO: 3226492 - RNA, 19 nt, Human
cucccucuacugggagccu

SEQ ID NO: 3226493 - RNA, 13 nt, Human
cucccucuacugg

SEQ ID NO: 3226494 - RNA, 14 nt, Human
cucccucccagcuc

SEQ ID NO: 3226495 - RNA, 11 nt, Human
cucccucccag

SEQ ID NO: 3226496 - RNA, 23 nt, Human
cuccccuaaagccucaaaacaaa

SEQ ID NO: 3226497 - RNA, 16 nt, Human
cuccccuaaagccuca

SEQ ID NO: 3226498 - RNA, 18 nt, Human
cucccaggagccugccca

SEQ ID NO: 3226499 - RNA, 21 nt, Human
cucccaggagccugcccagcc

SEQ ID NO: 3226500 - RNA, 19 nt, Human
cucccaggagccugcccag

SEQ ID NO: 3226501 - RNA, 20 nt, Human
cucccaggagccugcccagc

SEQ ID NO: 3226502 - RNA, 15 nt, Human
cucccacugcccacu

SEQ ID NO: 3226503 - RNA, 12 nt, Human
cucccacugccc

SEQ ID NO: 3226504 - RNA, 15 nt, Human
cucccacuucugcca

SEQ ID NO: 3226505 - RNA, 17 nt, Human
cucccacugcccacugg

SEQ ID NO: 3226506 - RNA, 16 nt, Human
cucccacuucugccag

SEQ ID NO: 3226507 - RNA, 17 nt, Human
cucccacuucugccaga

SEQ ID NO: 3226508 - RNA, 21 nt, Human
cucccacaggcccuuccucuc

SEQ ID NO: 3226509 - RNA, 20 nt, Human
cucccacaggcccuuccucu

SEQ ID NO: 3226510 - RNA, 16 nt, Human
cucccacaggcccuuc

SEQ ID NO: 3226511 - RNA, 14 nt, Human
cucccacaggcccu

SEQ ID NO: 3226512 - RNA, 15 nt, Human
cucccacaggcccuu

SEQ ID NO: 3226513 - RNA, 22 nt, Human
cuccaggugcacaagcuccaag

SEQ ID NO: 3226514 - RNA, 20 nt, Human
cuccaggcuguaucccauga

SEQ ID NO: 3226515 - RNA, 23 nt, Human
cuccaggcuccuuuagcgcccag

SEQ ID NO: 3226516 - RNA, 15 nt, Human
cuccaggcuccuuua

SEQ ID NO: 3226517 - RNA, 23 nt, Human
cuccaggugcacaagcuccaagc

SEQ ID NO: 3226518 - RNA, 20 nt, Human
cucugcaggaaauggcugug

SEQ ID NO: 3226519 - RNA, 17 nt, Human
cucugcacuccccugcu

SEQ ID NO: 3226520 - RNA, 21 nt, Human
cucugcuccucuccccagcaa

SEQ ID NO: 3226521 - RNA, 20 nt, Human
cucugcuccucuccccagca

SEQ ID NO: 3226522 - RNA, 23 nt, Human
cucugcugacagacacaggcccg

SEQ ID NO: 3226523 - RNA, 13 nt, Human
cucugcugcuggc

SEQ ID NO: 3226524 - RNA, 21 nt, Human
cucugcugaugacccccccag

SEQ ID NO: 3226525 - RNA, 13 nt, Human
cucugcugagggu

SEQ ID NO: 3226526 - RNA, 14 nt, Human
cucugcugaggguc

SEQ ID NO: 3226527 - RNA, 17 nt, Human
cucugcugaggguccag

SEQ ID NO: 3226528 - RNA, 20 nt, Human
cucugcugacagacacaggc

SEQ ID NO: 3226529 - RNA, 11 nt, Human
cucugcucuga

SEQ ID NO: 3226530 - RNA, 22 nt, Human
cucugcugacagacacaggccc

SEQ ID NO: 3226531 - RNA, 21 nt, Human
cucugcugacagacacaggcc

SEQ ID NO: 3226532 - RNA, 16 nt, Human
cucuguacagagccca

SEQ ID NO: 3226533 - RNA, 14 nt, Human
cucugcugcuggcu

SEQ ID NO: 3226534 - RNA, 15 nt, Human
cucugcugcuggcug

SEQ ID NO: 3226535 - RNA, 16 nt, Human
cucugcugcuggcugg

SEQ ID NO: 3226536 - RNA, 14 nt, Human
cucuguacagagcc

SEQ ID NO: 3226537 - RNA, 15 nt, Human
cucuguacagagccc

SEQ ID NO: 3226538 - RNA, 13 nt, Human
cucuguacagagc

SEQ ID NO: 3226539 - RNA, 18 nt, Human
cucugcuggacguccagg

SEQ ID NO: 3226540 - RNA, 15 nt, Human
cucugcacuccccug

SEQ ID NO: 3226541 - RNA, 16 nt, Human
cucugcacuccccugc

SEQ ID NO: 3226542 - RNA, 14 nt, Human
cucugcacuccccu

SEQ ID NO: 3226543 - RNA, 20 nt, Human
cucugcacaagcugcacccu

SEQ ID NO: 3226544 - RNA, 21 nt, Human
cucugcacaagcugcacccuc

SEQ ID NO: 3226545 - RNA, 19 nt, Human
cucugcacaagcugcaccc

SEQ ID NO: 3226546 - RNA, 16 nt, Human
cucgguguggagaagc

SEQ ID NO: 3226547 - RNA, 23 nt, Human
cucgguguccccaccaucugcug

SEQ ID NO: 3226548 - RNA, 22 nt, Human
cucgguguccccaccaucugcu

SEQ ID NO: 3226549 - RNA, 21 nt, Human
cucgguguccccaccaucugc

SEQ ID NO: 3226550 - RNA, 17 nt, Human
cucgguguggagaagcg

SEQ ID NO: 3226551 - RNA, 20 nt, Human
cucgguguccccaccaucug

SEQ ID NO: 3226552 - RNA, 16 nt, Human
cucgguguccccacca

SEQ ID NO: 3226553 - RNA, 15 nt, Human
cucgguguccccacc

SEQ ID NO: 3226554 - RNA, 13 nt, Human
cucggugucccca

SEQ ID NO: 3226555 - RNA, 13 nt, Human
cucgucuuuccca

SEQ ID NO: 3226556 - RNA, 17 nt, Human
cuccuuugugaggaagc

SEQ ID NO: 3226557 - RNA, 18 nt, Human
cuccuuugugaggaagcc

SEQ ID NO: 3226558 - RNA, 20 nt, Human
cuccuuucacaaccuucugu

SEQ ID NO: 3226559 - RNA, 17 nt, Human
cuccuuuagggacagcu

SEQ ID NO: 3226560 - RNA, 19 nt, Human
cuccuuuguauucugucuu

SEQ ID NO: 3226561 - RNA, 18 nt, Human
cuccuuuguauucugucu

SEQ ID NO: 3226562 - RNA, 17 nt, Human
cuccuuuguauucuguc

SEQ ID NO: 3226563 - RNA, 22 nt, Human
cucucuggccuucggccuccau

SEQ ID NO: 3226564 - RNA, 21 nt, Human
cucucugggcugacugggcca

SEQ ID NO: 3226565 - RNA, 17 nt, Human
cucucugggcugacugg

SEQ ID NO: 3226566 - RNA, 14 nt, Human
cucucuggccuucg

SEQ ID NO: 3226567 - RNA, 16 nt, Human
cucucuggccuucggc

SEQ ID NO: 3226568 - RNA, 13 nt, Human
cucucuggccuuc

SEQ ID NO: 3226569 - RNA, 16 nt, Human
cucuccuccagaguca

SEQ ID NO: 3226570 - RNA, 13 nt, Human
cucuccuccagag

SEQ ID NO: 3226571 - RNA, 15 nt, Human
cucuccuccagaguc

SEQ ID NO: 3226572 - RNA, 12 nt, Human
cucuccuccaga

SEQ ID NO: 3226573 - RNA, 22 nt, Human
cucuauggucuuauauuuacaa

SEQ ID NO: 3226574 - RNA, 22 nt, Human
cucuccccgcaguguuugugug

SEQ ID NO: 3226575 - RNA, 16 nt, Human
cuaaagccucaaaaca

SEQ ID NO: 3226576 - RNA, 23 nt, Human
cuaaaguccuuugagcuccuggg

SEQ ID NO: 3226577 - RNA, 23 nt, Human
cuaaaguacugagcagugauauu

SEQ ID NO: 3226578 - RNA, 22 nt, Human
cuaaaguacugagcagugauau

SEQ ID NO: 3226579 - RNA, 20 nt, Human
cuaaaguacugagcagugau

SEQ ID NO: 3226580 - RNA, 14 nt, Human
cuaaaguaauuggu

SEQ ID NO: 3226581 - RNA, 20 nt, Human
cuaacgaaguauccuucagc

SEQ ID NO: 3226582 - RNA, 14 nt, Human
cuaacuugucuuug

SEQ ID NO: 3226583 - RNA, 22 nt, Human
cuaacuugucuuuggacccuga

SEQ ID NO: 3226584 - RNA, 20 nt, Human
cuaacuugcuuaaaugugaa

SEQ ID NO: 3226585 - RNA, 21 nt, Human
cuaagaaaucaaguaaugaau

SEQ ID NO: 3226586 - RNA, 22 nt, Human
cuaagaaaucaaguaaugaauc

SEQ ID NO: 3226587 - RNA, 20 nt, Human
cuaagaacaaaagaagcagc

SEQ ID NO: 3226588 - RNA, 17 nt, Human
cuaagaacccauggaaa

SEQ ID NO: 3226589 - RNA, 19 nt, Human
cuaagaaauaucugugaaa

SEQ ID NO: 3226590 - RNA, 20 nt, Human
cuaagaaauaucugugaaau

SEQ ID NO: 3226591 - RNA, 21 nt, Human
cuaagaaauaucugugaaaua

SEQ ID NO: 3226592 - RNA, 22 nt, Human
cuaagaaauaucugugaaauau

SEQ ID NO: 3226593 - RNA, 17 nt, Human
cuaaagauuuugaucuc

SEQ ID NO: 3226594 - RNA, 13 nt, Human
cuaaagauuuuga

SEQ ID NO: 3226595 - RNA, 11 nt, Human
cuaaagcugcc

SEQ ID NO: 3226596 - RNA, 16 nt, Human
cguuaguaaucuguau

SEQ ID NO: 3226597 - RNA, 18 nt, Human
cguuaggauacugccucc

SEQ ID NO: 3226598 - RNA, 13 nt, Human
cguguucucagag

SEQ ID NO: 3226599 - RNA, 21 nt, Human
cguguuauuuuaaucucagaa

SEQ ID NO: 3226600 - RNA, 19 nt, Human
cguguuaugacuccagaau

SEQ ID NO: 3226601 - RNA, 15 nt, Human
cguguuaugacucca

SEQ ID NO: 3226602 - RNA, 19 nt, Human
cgugaguccuggcauggga

SEQ ID NO: 3226603 - RNA, 18 nt, Human
cgugaguccuggcauggg

SEQ ID NO: 3226604 - RNA, 12 nt, Human
cgugacaacacu

SEQ ID NO: 3226605 - RNA, 15 nt, Human
cgugacaacacuugu

SEQ ID NO: 3226606 - RNA, 14 nt, Human
cgugacaacacuug

SEQ ID NO: 3226607 - RNA, 20 nt, Human
cgugagccacugcaccgggc

SEQ ID NO: 3226608 - RNA, 15 nt, Human
cgugagccacugcac

SEQ ID NO: 3226609 - RNA, 14 nt, Human
cgugagccacugca

SEQ ID NO: 3226610 - RNA, 16 nt, Human
cgugacaauguuuaca

SEQ ID NO: 3226611 - RNA, 14 nt, Human
cgugaggccagaga

SEQ ID NO: 3226612 - RNA, 22 nt, Human
cgugagccacugcaccgggcca

SEQ ID NO: 3226613 - RNA, 17 nt, Human
cgugacaauguuuacaa

SEQ ID NO: 3226614 - RNA, 20 nt, Human
cuacaaaaacacagcaaggg

SEQ ID NO: 3226615 - RNA, 19 nt, Human
cuacaaaaagcauaaaaau

SEQ ID NO: 3226616 - RNA, 14 nt, Human
cuaauuugcugcug

SEQ ID NO: 3226617 - RNA, 11 nt, Human
cuaauaaaaua

SEQ ID NO: 3226618 - RNA, 12 nt, Human
cuaauaaaauau

SEQ ID NO: 3226619 - RNA, 13 nt, Human
cuaauaaaauauu

SEQ ID NO: 3226620 - RNA, 14 nt, Human
cuaauaaaauauuu

SEQ ID NO: 3226621 - RNA, 15 nt, Human
cuaauaaaauauuuu

SEQ ID NO: 3226622 - RNA, 16 nt, Human
cuaauaaaauauuuuc

SEQ ID NO: 3226623 - RNA, 17 nt, Human
cuaauaaaauauuuucu

SEQ ID NO: 3226624 - RNA, 18 nt, Human
cuaauaaaauauuuucug

SEQ ID NO: 3226625 - RNA, 19 nt, Human
cuaauaaaauauuuucugu

SEQ ID NO: 3226626 - RNA, 20 nt, Human
cuaauaaaauauuuucugug

SEQ ID NO: 3226627 - RNA, 21 nt, Human
cuaauaaaauauuuucugugu

SEQ ID NO: 3226628 - RNA, 22 nt, Human
cuaauaaaauauuuucugugug

SEQ ID NO: 3226629 - RNA, 23 nt, Human
cuaauaaaauauuuucugugugu

SEQ ID NO: 3226630 - RNA, 21 nt, Human
cuaaguuuuaggguacaugug

SEQ ID NO: 3226631 - RNA, 20 nt, Human
cuaaguuuuaggguacaugu

SEQ ID NO: 3226632 - RNA, 11 nt, Human
cuaauaaaacu

SEQ ID NO: 3226633 - RNA, 12 nt, Human
cuaauaaaacug

SEQ ID NO: 3226634 - RNA, 13 nt, Human
cuaauaaaacuga

SEQ ID NO: 3226635 - RNA, 14 nt, Human
cuaauaaaacugau

SEQ ID NO: 3226636 - RNA, 15 nt, Human
cuaauaaaacugaug

SEQ ID NO: 3226637 - RNA, 16 nt, Human
cuaauaaaacugaugu

SEQ ID NO: 3226638 - RNA, 18 nt, Human
cuaauaaaacugauguga

SEQ ID NO: 3226639 - RNA, 20 nt, Human
cuaauaaaacugaugugaaa

SEQ ID NO: 3226640 - RNA, 22 nt, Human
cuaaguugaguauauuauaaua

SEQ ID NO: 3226641 - RNA, 21 nt, Human
cuaaguugaguauauuauaau

SEQ ID NO: 3226642 - RNA, 19 nt, Human
cuaaguugaguauauuaua

SEQ ID NO: 3226643 - RNA, 18 nt, Human
cuaagucucuuuuuuaca

SEQ ID NO: 3226644 - RNA, 17 nt, Human
cuaagucucuuuuuuac

SEQ ID NO: 3226645 - RNA, 23 nt, Human
cuaaguaaaucucuucuguguuu

SEQ ID NO: 3226646 - RNA, 19 nt, Human
cuaaguaaaucucuucugu

SEQ ID NO: 3226647 - RNA, 18 nt, Human
cuaaguaaaucucuucug

SEQ ID NO: 3226648 - RNA, 17 nt, Human
cuaagaauuuuuuauuu

SEQ ID NO: 3226649 - RNA, 15 nt, Human
cuaagaauaauaaaa

SEQ ID NO: 3226650 - RNA, 18 nt, Human
cuaagaauaauaaaauca

SEQ ID NO: 3226651 - RNA, 15 nt, Human
ccuuuuccagagcau

SEQ ID NO: 3226652 - RNA, 20 nt, Human
ccuuuuccagagcauuccag

SEQ ID NO: 3226653 - RNA, 23 nt, Human
cgccaaggcugggggaagaagcu

SEQ ID NO: 3226654 - RNA, 15 nt, Human
cgcaguguuugugug

SEQ ID NO: 3226655 - RNA, 13 nt, Human
cgagucugaggcc

SEQ ID NO: 3226656 - RNA, 20 nt, Human
cgagugccgcaucucacagc

SEQ ID NO: 3226657 - RNA, 21 nt, Human
cgagucucuucuccacuggau

SEQ ID NO: 3226658 - RNA, 20 nt, Human
cgagucucuucuccacugga

SEQ ID NO: 3226659 - RNA, 21 nt, Human
cgcaggcuggcccugcccugg

SEQ ID NO: 3226660 - RNA, 22 nt, Human
cgcaggcuggcccugcccuggu

SEQ ID NO: 3226661 - RNA, 16 nt, Human
cgagucucuucuccac

SEQ ID NO: 3226662 - RNA, 18 nt, Human
cgagucucuucuccacug

SEQ ID NO: 3226663 - RNA, 17 nt, Human
cgagucucuucuccacu

SEQ ID NO: 3226664 - RNA, 18 nt, Human
cgcuggagugcagugagc

SEQ ID NO: 3226665 - RNA, 17 nt, Human
cgcuggagugcagugag

SEQ ID NO: 3226666 - RNA, 19 nt, Human
cgcugccccuggcagcccc

SEQ ID NO: 3226667 - RNA, 20 nt, Human
cgcugccccuggcagccccu

SEQ ID NO: 3226668 - RNA, 17 nt, Human
cgcugacuacagggccg

SEQ ID NO: 3226669 - RNA, 16 nt, Human
cgcugacuacagggcc

SEQ ID NO: 3226670 - RNA, 15 nt, Human
cgcugacuacagggc

SEQ ID NO: 3226671 - RNA, 21 nt, Human
cgcucuuggcagguacucagc

SEQ ID NO: 3226672 - RNA, 20 nt, Human
cgcucugucgcccaggcugg

SEQ ID NO: 3226673 - RNA, 13 nt, Human
cgcucugcugugg

SEQ ID NO: 3226674 - RNA, 15 nt, Human
cgccaccacacccaa

SEQ ID NO: 3226675 - RNA, 11 nt, Human
cgccacauccc

SEQ ID NO: 3226676 - RNA, 19 nt, Human
cgccugccuuuggcacucu

SEQ ID NO: 3226677 - RNA, 18 nt, Human
cgcucucuggccuucggc

SEQ ID NO: 3226678 - RNA, 21 nt, Human
cgggccccaccugcagcuccc

SEQ ID NO: 3226679 - RNA, 15 nt, Human
cgggccccaccugca

SEQ ID NO: 3226680 - RNA, 19 nt, Human
cgggccccaccugcagcuc

SEQ ID NO: 3226681 - RNA, 17 nt, Human
cgggccccaccugcagc

SEQ ID NO: 3226682 - RNA, 17 nt, Human
cgggccacagagaaagu

SEQ ID NO: 3226683 - RNA, 16 nt, Human
cggcucaagcccagga

SEQ ID NO: 3226684 - RNA, 17 nt, Human
cggcucaagcccaggag

SEQ ID NO: 3226685 - RNA, 12 nt, Human
cgggcucugccu

SEQ ID NO: 3226686 - RNA, 20 nt, Human
cgggcugggagcucugcaga

SEQ ID NO: 3226687 - RNA, 16 nt, Human
cgggcugggagcucug

SEQ ID NO: 3226688 - RNA, 19 nt, Human
cgggcucagcaaaagaugc

SEQ ID NO: 3226689 - RNA, 20 nt, Human
cgggccuggagaacuagaga

SEQ ID NO: 3226690 - RNA, 16 nt, Human
cgggccuggagaacua

SEQ ID NO: 3226691 - RNA, 22 nt, Human
cgggcuccgacuugugcacagg

SEQ ID NO: 3226692 - RNA, 20 nt, Human
cgguggcucacgccuguaau

SEQ ID NO: 3226693 - RNA, 13 nt, Human
cguaagcaguaua

SEQ ID NO: 3226694 - RNA, 23 nt, Human
cguaagcaguauauuaguauuau

SEQ ID NO: 3226695 - RNA, 23 nt, Human
cguaaagguuuauuuuucuguua

SEQ ID NO: 3226696 - RNA, 14 nt, Human
cguacuaaggauac

SEQ ID NO: 3226697 - RNA, 15 nt, Human
cguacauaauacuga

SEQ ID NO: 3226698 - RNA, 16 nt, Human
cguacauaauacugaa

SEQ ID NO: 3226699 - RNA, 20 nt, Human
cguacauaauacugaaccac

SEQ ID NO: 3226700 - RNA, 17 nt, Human
cggagacggagucccac

SEQ ID NO: 3226701 - RNA, 20 nt, Human
cggagacggagucccaccuu

SEQ ID NO: 3226702 - RNA, 15 nt, Human
cggagacggaguccc

SEQ ID NO: 3226703 - RNA, 22 nt, Human
cggagucccaccuuggcugcag

SEQ ID NO: 3226704 - RNA, 21 nt, Human
cggagucccaccuuggcugca

SEQ ID NO: 3226705 - RNA, 23 nt, Human
cggagucccaccuuggcugcagg

SEQ ID NO: 3226706 - RNA, 15 nt, Human
cggaggggccuggca

SEQ ID NO: 3226707 - RNA, 18 nt, Human
cggcuaauuuuuguauuu

SEQ ID NO: 3226708 - RNA, 13 nt, Human
cggcuaagcaggc

SEQ ID NO: 3226709 - RNA, 21 nt, Human
ccuugcauuuuagcuaauuua

SEQ ID NO: 3226710 - RNA, 15 nt, Human
ccuugcauacaaaca

SEQ ID NO: 3226711 - RNA, 13 nt, Human
ccuugcacuuuca

SEQ ID NO: 3226712 - RNA, 17 nt, Human
ccuugcacacaucaucu

SEQ ID NO: 3226713 - RNA, 24 nt, Human
ccuugcacacaucaucuguaagcu

SEQ ID NO: 3226714 - RNA, 13 nt, Human
ccuugccagcugc

SEQ ID NO: 3226715 - RNA, 20 nt, Human
ccuugccagcugcugagccg

SEQ ID NO: 3226716 - RNA, 19 nt, Human
ccuugccagcugcugagcc

SEQ ID NO: 3226717 - RNA, 15 nt, Human
ccuugccagcugcug

SEQ ID NO: 3226718 - RNA, 14 nt, Human
ccuugccagcugcu

SEQ ID NO: 3226719 - RNA, 19 nt, Human
ccuugccaggucccuuuca

SEQ ID NO: 3226720 - RNA, 24 nt, Human
ccuugccagcugcugagccgcaga

SEQ ID NO: 3226721 - RNA, 23 nt, Human
ccuugccagcugcugagccgcag

SEQ ID NO: 3226722 - RNA, 22 nt, Human
ccuugccagcugcugagccgca

SEQ ID NO: 3226723 - RNA, 18 nt, Human
ccuugcuaccacggccuc

SEQ ID NO: 3226724 - RNA, 23 nt, Human
ccuugcuaccacggccuccuuuc

SEQ ID NO: 3226725 - RNA, 20 nt, Human
ccuuuaucuaccaacuuuca

SEQ ID NO: 3226726 - RNA, 15 nt, Human
ccuuuaguuauaaag

SEQ ID NO: 3226727 - RNA, 15 nt, Human
ccuuucaauaggaaa

SEQ ID NO: 3226728 - RNA, 14 nt, Human
ccuuuauucuggca

SEQ ID NO: 3226729 - RNA, 17 nt, Human
ccuuucaauaggaaaaa

SEQ ID NO: 3226730 - RNA, 17 nt, Human
ccuucucuucacaguca

SEQ ID NO: 3226731 - RNA, 21 nt, Human
ccuucuguccuacucuguguc

SEQ ID NO: 3226732 - RNA, 20 nt, Human
ccuucuguccuacucugugu

SEQ ID NO: 3226733 - RNA, 22 nt, Human
ccuucuguccuacucuguguca

SEQ ID NO: 3226734 - RNA, 12 nt, Human
ccuucucuucca

SEQ ID NO: 3226735 - RNA, 16 nt, Human
ccuuccccuuccuucu

SEQ ID NO: 3226736 - RNA, 15 nt, Human
ccuuccccuuccuuc

SEQ ID NO: 3226737 - RNA, 14 nt, Human
ccuuccccuuccuu

SEQ ID NO: 3226738 - RNA, 17 nt, Human
ccuuccccuuccuucuu

SEQ ID NO: 3226739 - RNA, 13 nt, Human
ccuuccccuuccu

SEQ ID NO: 3226740 - RNA, 22 nt, Human
ccuucccccucccccagccacu

SEQ ID NO: 3226741 - RNA, 19 nt, Human
ccuucccccuccaauccca

SEQ ID NO: 3226742 - RNA, 19 nt, Human
ccuuccuaauuccacagcu

SEQ ID NO: 3226743 - RNA, 20 nt, Human
ccuuccuaauuccacagcug

SEQ ID NO: 3226744 - RNA, 18 nt, Human
ccuuccuaauuccacagc

SEQ ID NO: 3226745 - RNA, 12 nt, Human
ccuucccuugcu

SEQ ID NO: 3226746 - RNA, 20 nt, Human
ccuucucuccagccccugga

SEQ ID NO: 3226747 - RNA, 17 nt, Human
ccuuccucuccacugcc

SEQ ID NO: 3226748 - RNA, 16 nt, Human
ccuuccucuccacugc

SEQ ID NO: 3226749 - RNA, 15 nt, Human
ccuuccucuccacug

SEQ ID NO: 3226750 - RNA, 14 nt, Human
ccuuccucuccacu

SEQ ID NO: 3226751 - RNA, 21 nt, Human
ccuuccuaauuccacagcugc

SEQ ID NO: 3226752 - RNA, 14 nt, Human
ccuuccuaccaccc

SEQ ID NO: 3226753 - RNA, 21 nt, Human
ccuuccuaguucaucccuucu

SEQ ID NO: 3226754 - RNA, 23 nt, Human
ccuuccuccauccuccuccuucc

SEQ ID NO: 3226755 - RNA, 21 nt, Human
ccuuccuccauccuccuccuu

SEQ ID NO: 3226756 - RNA, 16 nt, Human
ccuucucugaaggaca

SEQ ID NO: 3226757 - RNA, 14 nt, Human
ccuucucugaagga

SEQ ID NO: 3226758 - RNA, 21 nt, Human
ccuucucuccagccccuggau

SEQ ID NO: 3226759 - RNA, 23 nt, Human
ccuucucuccagccccuggaugc

SEQ ID NO: 3226760 - RNA, 20 nt, Human
ccuuccucuccacugccuuc

SEQ ID NO: 3226761 - RNA, 20 nt, Human
ccuucucucucaauuuuugg

SEQ ID NO: 3226762 - RNA, 14 nt, Human
ccuuagcuucuggc

SEQ ID NO: 3226763 - RNA, 20 nt, Human
ccuuaggugauccacucgcc

SEQ ID NO: 3226764 - RNA, 20 nt, Human
ccuuauauaugcacuuaauu

SEQ ID NO: 3226765 - RNA, 13 nt, Human
ccuuaucaaagga

SEQ ID NO: 3226766 - RNA, 16 nt, Human
ccuuaggguuuucucu

SEQ ID NO: 3226767 - RNA, 12 nt, Human
ccuuauggaaca

SEQ ID NO: 3226768 - RNA, 15 nt, Human
ccuuaucuagcugca

SEQ ID NO: 3226769 - RNA, 19 nt, Human
ccuuaucuaguguuugauu

SEQ ID NO: 3226770 - RNA, 14 nt, Human
ccuuaucaaaggac

SEQ ID NO: 3226771 - RNA, 18 nt, Human
ccuuaucaaaggacacca

SEQ ID NO: 3226772 - RNA, 16 nt, Human
ccuuaucauaaauuca

SEQ ID NO: 3226773 - RNA, 14 nt, Human
ccuuaucauaaauu

SEQ ID NO: 3226774 - RNA, 22 nt, Human
ccuuauggaacacucugagacu

SEQ ID NO: 3226775 - RNA, 19 nt, Human
ccuuauggaacacucugag

SEQ ID NO: 3226776 - RNA, 20 nt, Human
ccuuauggaacacucugaga

SEQ ID NO: 3226777 - RNA, 14 nt, Human
ccuuauggaacacu

SEQ ID NO: 3226778 - RNA, 16 nt, Human
ccuuauggaacacucu

SEQ ID NO: 3226779 - RNA, 17 nt, Human
ccuuauggaacacucug

SEQ ID NO: 3226780 - RNA, 18 nt, Human
ccuuauggaacacucuga

SEQ ID NO: 3226781 - RNA, 14 nt, Human
ccuucccaccucuc

SEQ ID NO: 3226782 - RNA, 19 nt, Human
ccuucccaccucucucacu

SEQ ID NO: 3226783 - RNA, 12 nt, Human
ccuucccaccuc

SEQ ID NO: 3226784 - RNA, 22 nt, Human
ccuucccacucugucgagccug

SEQ ID NO: 3226785 - RNA, 18 nt, Human
ccuucccacucuucucau

SEQ ID NO: 3226786 - RNA, 15 nt, Human
ccuucccaugcccug

SEQ ID NO: 3226787 - RNA, 20 nt, Human
ccuuagcagggaaacagcua

SEQ ID NO: 3226788 - RNA, 19 nt, Human
ccuuagcagggaaacagcu

SEQ ID NO: 3226789 - RNA, 16 nt, Human
ccuuagcaaauucugu

SEQ ID NO: 3226790 - RNA, 17 nt, Human
ccuguugggccaggagc

SEQ ID NO: 3226791 - RNA, 18 nt, Human
ccuguugggccaggagcc

SEQ ID NO: 3226792 - RNA, 19 nt, Human
ccuguugggccaggagccu

SEQ ID NO: 3226793 - RNA, 20 nt, Human
ccuguugggccaggagccuc

SEQ ID NO: 3226794 - RNA, 16 nt, Human
ccuguugggccaggag

SEQ ID NO: 3226795 - RNA, 22 nt, Human
ccuguugauuaauuucugccau

SEQ ID NO: 3226796 - RNA, 23 nt, Human
ccuguugauuaauuucugccauu

SEQ ID NO: 3226797 - RNA, 18 nt, Human
ccuguucccaugagauga

SEQ ID NO: 3226798 - RNA, 12 nt, Human
ccuguucccauu

SEQ ID NO: 3226799 - RNA, 12 nt, Human
ccuguucuggca

SEQ ID NO: 3226800 - RNA, 17 nt, Human
ccuguucuggcagaguu

SEQ ID NO: 3226801 - RNA, 16 nt, Human
ccuguucugcuuuccu

SEQ ID NO: 3226802 - RNA, 19 nt, Human
ccuguucagcuccagcuca

SEQ ID NO: 3226803 - RNA, 16 nt, Human
ccuguucagcuccagc

SEQ ID NO: 3226804 - RNA, 15 nt, Human
ccuguucagcuccag

SEQ ID NO: 3226805 - RNA, 14 nt, Human
ccuguucagcucca

SEQ ID NO: 3226806 - RNA, 21 nt, Human
ccuguucagcuccagcucacc

SEQ ID NO: 3226807 - RNA, 20 nt, Human
ccuguucagcuccagcucac

SEQ ID NO: 3226808 - RNA, 23 nt, Human
ccuguucagcuccagcucaccag

SEQ ID NO: 3226809 - RNA, 13 nt, Human
ccuguucagcucc

SEQ ID NO: 3226810 - RNA, 21 nt, Human
ccuguucacucuacuuagcau

SEQ ID NO: 3226811 - RNA, 12 nt, Human
uugugauguguc

SEQ ID NO: 3226812 - RNA, 22 nt, Human
uugugaugucccaacuuguaaa

SEQ ID NO: 3226813 - RNA, 18 nt, Human
uugugaugucccaacuug

SEQ ID NO: 3226814 - RNA, 14 nt, Human
uuguguaauauuac

SEQ ID NO: 3226815 - RNA, 18 nt, Human
uuguguaauauuacuuua

SEQ ID NO: 3226816 - RNA, 23 nt, Human
uuguguaauauuacuuuaacaug

SEQ ID NO: 3226817 - RNA, 13 nt, Human
uugugaggaagcc

SEQ ID NO: 3226818 - RNA, 17 nt, Human
uugugaggaagccgcug

SEQ ID NO: 3226819 - RNA, 18 nt, Human
uugugaggaagccgcugg

SEQ ID NO: 3226820 - RNA, 18 nt, Human
uuguccccaccgcagaca

SEQ ID NO: 3226821 - RNA, 20 nt, Human
uuguccccaccgcagacagg

SEQ ID NO: 3226822 - RNA, 17 nt, Human
uuguccccaaugaauau

SEQ ID NO: 3226823 - RNA, 18 nt, Human
uuguccccaaugaauaua

SEQ ID NO: 3226824 - RNA, 15 nt, Human
uuguccccgacccuu

SEQ ID NO: 3226825 - RNA, 21 nt, Human
uugugaauaauuacagugccu

SEQ ID NO: 3226826 - RNA, 15 nt, Human
uugugaauaauuaca

SEQ ID NO: 3226827 - RNA, 14 nt, Human
uugugaauaauuac

SEQ ID NO: 3226828 - RNA, 13 nt, Human
uugugaauaauua

SEQ ID NO: 3226829 - RNA, 18 nt, Human
augaguuggcugggaaua

SEQ ID NO: 3226830 - RNA, 23 nt, Human
augagugugauccaguuuuucau

SEQ ID NO: 3226831 - RNA, 13 nt, Human
augaguccccugu

SEQ ID NO: 3226832 - RNA, 16 nt, Human
augaguccaaacugga

SEQ ID NO: 3226833 - RNA, 19 nt, Human
augaguccaaacuggaaug

SEQ ID NO: 3226834 - RNA, 13 nt, Human
augaguuuuggga

SEQ ID NO: 3226835 - RNA, 19 nt, Human
augaguuuugggaaguuaa

SEQ ID NO: 3226836 - RNA, 18 nt, Human
augaguuuugggaaguua

SEQ ID NO: 3226837 - RNA, 15 nt, Human
augaguuucuuagac

SEQ ID NO: 3226838 - RNA, 14 nt, Human
augaguuucuuaga

SEQ ID NO: 3226839 - RNA, 22 nt, Human
augaguuucacagugugauuuu

SEQ ID NO: 3226840 - RNA, 15 nt, Human
augaguuucacagug

SEQ ID NO: 3226841 - RNA, 13 nt, Human
augaguuucacag

SEQ ID NO: 3226842 - RNA, 16 nt, Human
uugucagaccauaaga

SEQ ID NO: 3226843 - RNA, 20 nt, Human
uugucaaugcuggagaaaaa

SEQ ID NO: 3226844 - RNA, 17 nt, Human
uugucacacacuuuggc

SEQ ID NO: 3226845 - RNA, 20 nt, Human
augaguuuugggaaguuaaa

SEQ ID NO: 3226846 - RNA, 18 nt, Human
uugucaaugcuggagaaa

SEQ ID NO: 3226847 - RNA, 21 nt, Human
uugucauauaagauucauauu

SEQ ID NO: 3226848 - RNA, 21 nt, Human
uuguccaauuguauaacuuug

SEQ ID NO: 3226849 - RNA, 19 nt, Human
uuguccagagcugcuuccc

SEQ ID NO: 3226850 - RNA, 18 nt, Human
uuguccagagcugcuucc

SEQ ID NO: 3226851 - RNA, 16 nt, Human
uuguccagagcugcuu

SEQ ID NO: 3226852 - RNA, 13 nt, Human
uuguccagagcug

SEQ ID NO: 3226853 - RNA, 19 nt, Human
uugucaucagccaaaacgu

SEQ ID NO: 3226854 - RNA, 16 nt, Human
uugucaucaccaugga

SEQ ID NO: 3226855 - RNA, 14 nt, Human
uugucauuuugguc

SEQ ID NO: 3226856 - RNA, 21 nt, Human
uuguccaaaguuaccuggaau

SEQ ID NO: 3226857 - RNA, 20 nt, Human
augagggucuugguuccagc

SEQ ID NO: 3226858 - RNA, 19 nt, Human
augaggguuugagagagca

SEQ ID NO: 3226859 - RNA, 21 nt, Human
augagguacaaccuguucugc

SEQ ID NO: 3226860 - RNA, 15 nt, Human
augaggucagagccu

SEQ ID NO: 3226861 - RNA, 18 nt, Human
augaggucagagccugca

SEQ ID NO: 3226862 - RNA, 16 nt, Human
augaggucagagccug

SEQ ID NO: 3226863 - RNA, 20 nt, Human
augaggucagagccugcagu

SEQ ID NO: 3226864 - RNA, 19 nt, Human
augaggucagagccugcag

SEQ ID NO: 3226865 - RNA, 14 nt, Human
augagguucucucu

SEQ ID NO: 3226866 - RNA, 15 nt, Human
augagguacugagag

SEQ ID NO: 3226867 - RNA, 17 nt, Human
augagguacugagagug

SEQ ID NO: 3226868 - RNA, 18 nt, Human
augagguacugagaguga

SEQ ID NO: 3226869 - RNA, 23 nt, Human
uuguucaggaaaagguugaauaa

SEQ ID NO: 3226870 - RNA, 18 nt, Human
uuguucuuccaaagcaga

SEQ ID NO: 3226871 - RNA, 14 nt, Human
uuguucuuccaaag

SEQ ID NO: 3226872 - RNA, 17 nt, Human
augauuuaauuugaaau

SEQ ID NO: 3226873 - RNA, 21 nt, Human
uuguucuuggcaauaaauuuu

SEQ ID NO: 3226874 - RNA, 19 nt, Human
uuguucuuggcaauaaauu

SEQ ID NO: 3226875 - RNA, 13 nt, Human
uuguucuugauag

SEQ ID NO: 3226876 - RNA, 13 nt, Human
augauuucauuca

SEQ ID NO: 3226877 - RNA, 12 nt, Human
augauuucacaa

SEQ ID NO: 3226878 - RNA, 14 nt, Human
augauuucacaaau

SEQ ID NO: 3226879 - RNA, 13 nt, Human
augauuucacaaa

SEQ ID NO: 3226880 - RNA, 13 nt, Human
augcaaaaaaucu

SEQ ID NO: 3226881 - RNA, 23 nt, Human
augcaaaaaaucuuaauacuguu

SEQ ID NO: 3226882 - RNA, 17 nt, Human
augcaaaaaaucuuaau

SEQ ID NO: 3226883 - RNA, 15 nt, Human
augcaaaaaaucuua

SEQ ID NO: 3226884 - RNA, 14 nt, Human
augcaaaaaaucuu

SEQ ID NO: 3226885 - RNA, 15 nt, Human
augauuuuuugaaag

SEQ ID NO: 3226886 - RNA, 17 nt, Human
augauuuuuugaaaguu

SEQ ID NO: 3226887 - RNA, 23 nt, Human
augauuuuuugaaaguuaacauu

SEQ ID NO: 3226888 - RNA, 23 nt, Human
augcaaaaagcuagucaacagua

SEQ ID NO: 3226889 - RNA, 17 nt, Human
augcaaacauuggaaga

SEQ ID NO: 3226890 - RNA, 17 nt, Human
augcagagguccacaac

SEQ ID NO: 3226891 - RNA, 18 nt, Human
augcagagguccacaaca

SEQ ID NO: 3226892 - RNA, 23 nt, Human
augcacuuuguucuggcucuucc

SEQ ID NO: 3226893 - RNA, 11 nt, Human
augcagaaaua

SEQ ID NO: 3226894 - RNA, 18 nt, Human
augcagaaauagacaaaa

SEQ ID NO: 3226895 - RNA, 20 nt, Human
augcagaaauagacaaaaag

SEQ ID NO: 3226896 - RNA, 21 nt, Human
augcagaaauagacaaaaagu

SEQ ID NO: 3226897 - RNA, 22 nt, Human
augcagaaauagacaaaaagua

SEQ ID NO: 3226898 - RNA, 17 nt, Human
augcagaauggcauuug

SEQ ID NO: 3226899 - RNA, 14 nt, Human
augcaaagcacuga

SEQ ID NO: 3226900 - RNA, 13 nt, Human
augcaaagcacug

SEQ ID NO: 3226901 - RNA, 12 nt, Human
augcaaagcacu

SEQ ID NO: 3226902 - RNA, 21 nt, Human
augcacuuuguucuggcucuu

SEQ ID NO: 3226903 - RNA, 20 nt, Human
augcacuaagucucuuuuuu

SEQ ID NO: 3226904 - RNA, 12 nt, Human
uuuaagagaaau

SEQ ID NO: 3226905 - RNA, 21 nt, Human
uuuaagcuguuacugucuuca

SEQ ID NO: 3226906 - RNA, 12 nt, Human
uuuaaggaauau

SEQ ID NO: 3226907 - RNA, 15 nt, Human
uuuaaggaaaggcaa

SEQ ID NO: 3226908 - RNA, 19 nt, Human
uuuaaggauaaaucauaaa

SEQ ID NO: 3226909 - RNA, 18 nt, Human
uuuaaggacugacugagg

SEQ ID NO: 3226910 - RNA, 19 nt, Human
uuuaaggacugacugaggc

SEQ ID NO: 3226911 - RNA, 16 nt, Human
uuuaaugaaagacugu

SEQ ID NO: 3226912 - RNA, 22 nt, Human
uuuaaggguuuguggaaaauga

SEQ ID NO: 3226913 - RNA, 20 nt, Human
uuuaaggguuuguggaaaau

SEQ ID NO: 3226914 - RNA, 17 nt, Human
uuuaaggguuuguggaa

SEQ ID NO: 3226915 - RNA, 15 nt, Human
uuuaaauauuaagca

SEQ ID NO: 3226916 - RNA, 16 nt, Human
uuuaaaaaguguuuaa

SEQ ID NO: 3226917 - RNA, 20 nt, Human
uuuaaaaaguguuuaaaugu

SEQ ID NO: 3226918 - RNA, 13 nt, Human
uuuaaaaaguauu

SEQ ID NO: 3226919 - RNA, 16 nt, Human
uuuaaaaaguauugcc

SEQ ID NO: 3226920 - RNA, 20 nt, Human
uuuaaaaaguauugccaaac

SEQ ID NO: 3226921 - RNA, 17 nt, Human
uuuaaaaaguauugcca

SEQ ID NO: 3226922 - RNA, 14 nt, Human
uuuaaaaacuguuu

SEQ ID NO: 3226923 - RNA, 18 nt, Human
uuuaaaaacaaaaggcaa

SEQ ID NO: 3226924 - RNA, 19 nt, Human
uuuaaaaaacuuucuacuc

SEQ ID NO: 3226925 - RNA, 18 nt, Human
uuuaaaaaacuuucuacu

SEQ ID NO: 3226926 - RNA, 14 nt, Human
uuuaaaaaacuuuc

SEQ ID NO: 3226927 - RNA, 16 nt, Human
uuuaaaaaacuuucua

SEQ ID NO: 3226928 - RNA, 21 nt, Human
uuuaaaaaauuaaucugggcc

SEQ ID NO: 3226929 - RNA, 20 nt, Human
augcagaguucagggaagau

SEQ ID NO: 3226930 - RNA, 11 nt, Human
uuuaaaaaacu

SEQ ID NO: 3226931 - RNA, 12 nt, Human
augcgugugugu

SEQ ID NO: 3226932 - RNA, 14 nt, Human
augcgcaggcuggc

SEQ ID NO: 3226933 - RNA, 18 nt, Human
augcgcaggcuggcccug

SEQ ID NO: 3226934 - RNA, 20 nt, Human
augcgcaggcuggcccugcc

SEQ ID NO: 3226935 - RNA, 22 nt, Human
augcgcaggcuggcccugcccu

SEQ ID NO: 3226936 - RNA, 13 nt, Human
augcgcaggcugg

SEQ ID NO: 3226937 - RNA, 15 nt, Human
augccucucucaggc

SEQ ID NO: 3226938 - RNA, 13 nt, Human
augccucucucag

SEQ ID NO: 3226939 - RNA, 14 nt, Human
augccucucucagg

SEQ ID NO: 3226940 - RNA, 20 nt, Human
augccaguccagaugugccu

SEQ ID NO: 3226941 - RNA, 13 nt, Human
augccaguauuuu

SEQ ID NO: 3226942 - RNA, 14 nt, Human
augccaguauuuuu

SEQ ID NO: 3226943 - RNA, 20 nt, Human
augccaguauuuuuaaaggc

SEQ ID NO: 3226944 - RNA, 22 nt, Human
augccaguauuuuuaaaggcau

SEQ ID NO: 3226945 - RNA, 13 nt, Human
augccaggggccu

SEQ ID NO: 3226946 - RNA, 21 nt, Human
uuuaaugaaagacuguacaaa

SEQ ID NO: 3226947 - RNA, 14 nt, Human
uuuaaggucuguuu

SEQ ID NO: 3226948 - RNA, 21 nt, Human
augccaugaggaacaaggcaa

SEQ ID NO: 3226949 - RNA, 16 nt, Human
augcccagccccuucu

SEQ ID NO: 3226950 - RNA, 15 nt, Human
augcccagccccuuc

SEQ ID NO: 3226951 - RNA, 17 nt, Human
augcccagccccuucug

SEQ ID NO: 3226952 - RNA, 21 nt, Human
augccccgucccccucuggcu

SEQ ID NO: 3226953 - RNA, 18 nt, Human
augccccgucccccucug

SEQ ID NO: 3226954 - RNA, 18 nt, Human
uuuaccugaagucuuugu

SEQ ID NO: 3226955 - RNA, 16 nt, Human
augcgugugugugugu

SEQ ID NO: 3226956 - RNA, 22 nt, Human
uuuacuccagguuauugcaaua

SEQ ID NO: 3226957 - RNA, 19 nt, Human
uuuaccucucugucaugug

SEQ ID NO: 3226958 - RNA, 16 nt, Human
uuuacugcagcuuugu

SEQ ID NO: 3226959 - RNA, 11 nt, Human
uuuacuuaaac

SEQ ID NO: 3226960 - RNA, 22 nt, Human
uuuacuguuugauauaccaaau

SEQ ID NO: 3226961 - RNA, 17 nt, Human
uuuacugugacuuuauu

SEQ ID NO: 3226962 - RNA, 18 nt, Human
uuuacugcauucuucuga

SEQ ID NO: 3226963 - RNA, 14 nt, Human
uuuacugcauucuu

SEQ ID NO: 3226964 - RNA, 14 nt, Human
uuuaguuauaaagg

SEQ ID NO: 3226965 - RNA, 20 nt, Human
uuuaguggccaucauuucug

SEQ ID NO: 3226966 - RNA, 22 nt, Human
uuuaguggacccugaaaugugu

SEQ ID NO: 3226967 - RNA, 13 nt, Human
uuuagugugguuu

SEQ ID NO: 3226968 - RNA, 21 nt, Human
uuuaguggacccugaaaugug

SEQ ID NO: 3226969 - RNA, 20 nt, Human
uuuaguggacccugaaaugu

SEQ ID NO: 3226970 - RNA, 19 nt, Human
uuuaguggacccugaaaug

SEQ ID NO: 3226971 - RNA, 17 nt, Human
uuuagucuuuagcuauu

SEQ ID NO: 3226972 - RNA, 13 nt, Human
uuuaguggaaaau

SEQ ID NO: 3226973 - RNA, 15 nt, Human
uuuaguggaaaauag

SEQ ID NO: 3226974 - RNA, 13 nt, Human
uuuagucuuuaua

SEQ ID NO: 3226975 - RNA, 18 nt, Human
uuuagggaguauucuaau

SEQ ID NO: 3226976 - RNA, 15 nt, Human
uuuagggaguauucu

SEQ ID NO: 3226977 - RNA, 20 nt, Human
uuuaggcauaugcuucuuua

SEQ ID NO: 3226978 - RNA, 19 nt, Human
uuuaggccaaucagaagcu

SEQ ID NO: 3226979 - RNA, 21 nt, Human
uuuaggcauaugcuucuuuaa

SEQ ID NO: 3226980 - RNA, 13 nt, Human
uuuacuucuuaua

SEQ ID NO: 3226981 - RNA, 14 nt, Human
uuuacuucuuauac

SEQ ID NO: 3226982 - RNA, 16 nt, Human
uuucaccuuuucagga

SEQ ID NO: 3226983 - RNA, 18 nt, Human
uuucaccuuuucaggaaa

SEQ ID NO: 3226984 - RNA, 21 nt, Human
uuucaccuuuucaggaaaaua

SEQ ID NO: 3226985 - RNA, 15 nt, Human
uuucacgauucauuu

SEQ ID NO: 3226986 - RNA, 16 nt, Human
uuucacgauucauuuu

SEQ ID NO: 3226987 - RNA, 16 nt, Human
uuucacuauaauguga

SEQ ID NO: 3226988 - RNA, 20 nt, Human
uuucacuauaaugugaaaug

SEQ ID NO: 3226989 - RNA, 21 nt, Human
uuucagaaagaaguggggaca

SEQ ID NO: 3226990 - RNA, 21 nt, Human
uuucacgucauaggaaguuag

SEQ ID NO: 3226991 - RNA, 22 nt, Human
uuucagaaauacagauaaauga

SEQ ID NO: 3226992 - RNA, 13 nt, Human
uuucagaaauaca

SEQ ID NO: 3226993 - RNA, 21 nt, Human
uuucagaaagccuuucauuuu

SEQ ID NO: 3226994 - RNA, 16 nt, Human
uuucagaaagccuuuc

SEQ ID NO: 3226995 - RNA, 15 nt, Human
uuucagaaagccuuu

SEQ ID NO: 3226996 - RNA, 15 nt, Human
uuucaccugcugcuu

SEQ ID NO: 3226997 - RNA, 14 nt, Human
uuucauccuuccca

SEQ ID NO: 3226998 - RNA, 14 nt, Human
uuucauccaugucc

SEQ ID NO: 3226999 - RNA, 14 nt, Human
uuucaugcuuuauc

SEQ ID NO: 3227000 - RNA, 13 nt, Human
uuucaugcuuuau

SEQ ID NO: 3227001 - RNA, 16 nt, Human
uuucauccuucccacu

SEQ ID NO: 3227002 - RNA, 16 nt, Human
uuucccuauuagagaa

SEQ ID NO: 3227003 - RNA, 18 nt, Human
uuuccauuuuauaaaugu

SEQ ID NO: 3227004 - RNA, 13 nt, Human
uuuccauuuuaua

SEQ ID NO: 3227005 - RNA, 20 nt, Human
uuuccauguaugcauaauaa

SEQ ID NO: 3227006 - RNA, 15 nt, Human
uuuccauguaugcau

SEQ ID NO: 3227007 - RNA, 14 nt, Human
uuuccauguaugca

SEQ ID NO: 3227008 - RNA, 16 nt, Human
uuucaugcuuuaucaa

SEQ ID NO: 3227009 - RNA, 20 nt, Human
augcuggcuguuggcugggg

SEQ ID NO: 3227010 - RNA, 19 nt, Human
augcuggcuguuggcuggg

SEQ ID NO: 3227011 - RNA, 13 nt, Human
augcuuaaauuuu

SEQ ID NO: 3227012 - RNA, 14 nt, Human
augcuuaaauuuua

SEQ ID NO: 3227013 - RNA, 16 nt, Human
augcuucucacugcca

SEQ ID NO: 3227014 - RNA, 20 nt, Human
augcuucucacugccaugcc

SEQ ID NO: 3227015 - RNA, 17 nt, Human
auggaagacagcucuua

SEQ ID NO: 3227016 - RNA, 18 nt, Human
auggaagacagcucuuau

SEQ ID NO: 3227017 - RNA, 14 nt, Human
auggaaggggcuga

SEQ ID NO: 3227018 - RNA, 20 nt, Human
auggaagcgguggucagaag

SEQ ID NO: 3227019 - RNA, 14 nt, Human
auggaagagagaaa

SEQ ID NO: 3227020 - RNA, 15 nt, Human
auggaagagagaaag

SEQ ID NO: 3227021 - RNA, 18 nt, Human
augcuggcuguuggcugg

SEQ ID NO: 3227022 - RNA, 12 nt, Human
augcuggcuggc

SEQ ID NO: 3227023 - RNA, 16 nt, Human
augcuggcuggccuug

SEQ ID NO: 3227024 - RNA, 23 nt, Human
augcuggcuggccuuguggucca

SEQ ID NO: 3227025 - RNA, 14 nt, Human
augcuccuggccca

SEQ ID NO: 3227026 - RNA, 23 nt, Human
augcuggagaaaaauaucuguaa

SEQ ID NO: 3227027 - RNA, 16 nt, Human
augcuggagaaaaaua

SEQ ID NO: 3227028 - RNA, 14 nt, Human
uuuaucagaauucu

SEQ ID NO: 3227029 - RNA, 14 nt, Human
uuuaucagauugcu

SEQ ID NO: 3227030 - RNA, 22 nt, Human
uuuaucagauugcuuuugugca

SEQ ID NO: 3227031 - RNA, 23 nt, Human
uuuaucagauugcuuuugugcau

SEQ ID NO: 3227032 - RNA, 19 nt, Human
uuuaucagggaaacuaaga

SEQ ID NO: 3227033 - RNA, 20 nt, Human
uuuaucagggaaacuaagau

SEQ ID NO: 3227034 - RNA, 21 nt, Human
aucugugaggggcucucucau

SEQ ID NO: 3227035 - RNA, 22 nt, Human
aucugugaggggcucucucaug

SEQ ID NO: 3227036 - RNA, 17 nt, Human
aucugucauuugagcag

SEQ ID NO: 3227037 - RNA, 12 nt, Human
aucugucauuug

SEQ ID NO: 3227038 - RNA, 23 nt, Human
aucugugccuuuuuuauaucuug

SEQ ID NO: 3227039 - RNA, 15 nt, Human
aucuguuuuuacgua

SEQ ID NO: 3227040 - RNA, 18 nt, Human
aucuguuuuuacguaugu

SEQ ID NO: 3227041 - RNA, 22 nt, Human
aucuuaauacuguuauucuuug

SEQ ID NO: 3227042 - RNA, 16 nt, Human
aucuugcucugcugac

SEQ ID NO: 3227043 - RNA, 15 nt, Human
aucuugcucugcuga

SEQ ID NO: 3227044 - RNA, 17 nt, Human
aucuuguuuugaaaaua

SEQ ID NO: 3227045 - RNA, 14 nt, Human
aucuuguucaggaa

SEQ ID NO: 3227046 - RNA, 15 nt, Human
aucuuguucaggaaa

SEQ ID NO: 3227047 - RNA, 17 nt, Human
aucuuguucaggaaaag

SEQ ID NO: 3227048 - RNA, 19 nt, Human
aucuuguucaggaaaaggu

SEQ ID NO: 3227049 - RNA, 17 nt, Human
aucuuggccuuacugua

SEQ ID NO: 3227050 - RNA, 16 nt, Human
aucuuggccuuacugu

SEQ ID NO: 3227051 - RNA, 18 nt, Human
aucuuggcagguaggaau

SEQ ID NO: 3227052 - RNA, 15 nt, Human
aucuuggagagcugg

SEQ ID NO: 3227053 - RNA, 19 nt, Human
aucuuggcccuguuaaggc

SEQ ID NO: 3227054 - RNA, 20 nt, Human
aucuuggcagguaggaauau

SEQ ID NO: 3227055 - RNA, 19 nt, Human
aucuuggcagguaggaaua

SEQ ID NO: 3227056 - RNA, 19 nt, Human
aucuuaaaagcuaucuuca

SEQ ID NO: 3227057 - RNA, 20 nt, Human
aucuuaaaagcuaucuucau

SEQ ID NO: 3227058 - RNA, 16 nt, Human
aucuuaagaaauaaau

SEQ ID NO: 3227059 - RNA, 13 nt, Human
aucuuaagaaaua

SEQ ID NO: 3227060 - RNA, 13 nt, Human
aucuuaauacugu

SEQ ID NO: 3227061 - RNA, 15 nt, Human
aucuuaauacuguua

SEQ ID NO: 3227062 - RNA, 14 nt, Human
aucuuaauacuguu

SEQ ID NO: 3227063 - RNA, 21 nt, Human
aucuuaauacuguuauucuuu

SEQ ID NO: 3227064 - RNA, 20 nt, Human
aucuuaauacuguuauucuu

SEQ ID NO: 3227065 - RNA, 18 nt, Human
aucuuaauacuguuauuc

SEQ ID NO: 3227066 - RNA, 17 nt, Human
aucuuaauacuguuauu

SEQ ID NO: 3227067 - RNA, 14 nt, Human
aucuugcucugcug

SEQ ID NO: 3227068 - RNA, 14 nt, Human
aucuuaauguauau

SEQ ID NO: 3227069 - RNA, 17 nt, Human
aucuuaauguauaucgu

SEQ ID NO: 3227070 - RNA, 13 nt, Human
aucuugcucugcu

SEQ ID NO: 3227071 - RNA, 11 nt, Human
uuggagccugc

SEQ ID NO: 3227072 - RNA, 15 nt, Human
uuggagcacaaaauu

SEQ ID NO: 3227073 - RNA, 21 nt, Human
uuggagcacaaaauucaaagc

SEQ ID NO: 3227074 - RNA, 15 nt, Human
uuggagccugcagag

SEQ ID NO: 3227075 - RNA, 11 nt, Human
uuggagcauug

SEQ ID NO: 3227076 - RNA, 12 nt, Human
uuggacuuuguu

SEQ ID NO: 3227077 - RNA, 14 nt, Human
uuggacuuuguuac

SEQ ID NO: 3227078 - RNA, 17 nt, Human
uuggaaaauaaauuauu

SEQ ID NO: 3227079 - RNA, 15 nt, Human
uuggaaaauaaauca

SEQ ID NO: 3227080 - RNA, 12 nt, Human
uuggaaaauaaa

SEQ ID NO: 3227081 - RNA, 17 nt, Human
uuggaaacacuaaaugu

SEQ ID NO: 3227082 - RNA, 16 nt, Human
uuggaaacacuaaaug

SEQ ID NO: 3227083 - RNA, 15 nt, Human
uuggaaacacuaaau

SEQ ID NO: 3227084 - RNA, 14 nt, Human
uuggaaacacuaaa

SEQ ID NO: 3227085 - RNA, 16 nt, Human
uugcuuuguaugcacu

SEQ ID NO: 3227086 - RNA, 17 nt, Human
uugcuuuuaaaacuacu

SEQ ID NO: 3227087 - RNA, 14 nt, Human
uugcuuuuaaaacu

SEQ ID NO: 3227088 - RNA, 15 nt, Human
uuggaaaaaauuugu

SEQ ID NO: 3227089 - RNA, 20 nt, Human
uuggaaaacgauuuaauuua

SEQ ID NO: 3227090 - RNA, 13 nt, Human
uugcuuuuaaaau

SEQ ID NO: 3227091 - RNA, 21 nt, Human
uugcuuuuaaaacuacuuagc

SEQ ID NO: 3227092 - RNA, 15 nt, Human
aucuuuaaaauacac

SEQ ID NO: 3227093 - RNA, 12 nt, Human
aucuuuaaaaua

SEQ ID NO: 3227094 - RNA, 11 nt, Human
aucuuuaauua

SEQ ID NO: 3227095 - RNA, 13 nt, Human
aucuuuaauuaaa

SEQ ID NO: 3227096 - RNA, 17 nt, Human
uugcuuuggaaguuuua

SEQ ID NO: 3227097 - RNA, 13 nt, Human
uugcuuuguaugc

SEQ ID NO: 3227098 - RNA, 23 nt, Human
uugcuucccuuuuuuccuuucca

SEQ ID NO: 3227099 - RNA, 19 nt, Human
uuguaaauuuaugugaugg

SEQ ID NO: 3227100 - RNA, 15 nt, Human
uuguaacaagaaaau

SEQ ID NO: 3227101 - RNA, 16 nt, Human
uugguuuuaugaugac

SEQ ID NO: 3227102 - RNA, 19 nt, Human
uugguuuuaugaugacgua

SEQ ID NO: 3227103 - RNA, 13 nt, Human
uuguaaauuguca

SEQ ID NO: 3227104 - RNA, 17 nt, Human
uuguaagaaauacugua

SEQ ID NO: 3227105 - RNA, 21 nt, Human
uuguaacauucuauuucaacu

SEQ ID NO: 3227106 - RNA, 14 nt, Human
uuguaagaaauacu

SEQ ID NO: 3227107 - RNA, 20 nt, Human
uuguaauuuaaggucuguuu

SEQ ID NO: 3227108 - RNA, 15 nt, Human
uuguaauauguaaau

SEQ ID NO: 3227109 - RNA, 14 nt, Human
uuguaauauguaaa

SEQ ID NO: 3227110 - RNA, 21 nt, Human
uuguaauauagaaaaaaacau

SEQ ID NO: 3227111 - RNA, 23 nt, Human
uuguaauaaacccuuaacuggca

SEQ ID NO: 3227112 - RNA, 15 nt, Human
uuguaauaauaaaga

SEQ ID NO: 3227113 - RNA, 16 nt, Human
augaaugucaguguga

SEQ ID NO: 3227114 - RNA, 18 nt, Human
augaaugucagugugacu

SEQ ID NO: 3227115 - RNA, 19 nt, Human
uugggugcugcuaauucuu

SEQ ID NO: 3227116 - RNA, 15 nt, Human
uugggugaucauuca

SEQ ID NO: 3227117 - RNA, 16 nt, Human
uugguuucucuucucc

SEQ ID NO: 3227118 - RNA, 12 nt, Human
uugguuuuauga

SEQ ID NO: 3227119 - RNA, 16 nt, Human
uugguuuuaaaauacu

SEQ ID NO: 3227120 - RNA, 13 nt, Human
uugguuuuaaaau

SEQ ID NO: 3227121 - RNA, 18 nt, Human
uuggugggugaaaggaau

SEQ ID NO: 3227122 - RNA, 22 nt, Human
uugguuuagcccaaguggagcc

SEQ ID NO: 3227123 - RNA, 18 nt, Human
uuggugucgggcaugaca

SEQ ID NO: 3227124 - RNA, 19 nt, Human
uuggugucgggcaugacac

SEQ ID NO: 3227125 - RNA, 17 nt, Human
uuggugucgggcaugac

SEQ ID NO: 3227126 - RNA, 18 nt, Human
uuggagccugcagagcug

SEQ ID NO: 3227127 - RNA, 13 nt, Human
uuggagcucugag

SEQ ID NO: 3227128 - RNA, 18 nt, Human
augaaauaacacagcagu

SEQ ID NO: 3227129 - RNA, 22 nt, Human
augaaccacaucuugcucugcu

SEQ ID NO: 3227130 - RNA, 23 nt, Human
augaaccacaucuugcucugcug

SEQ ID NO: 3227131 - RNA, 14 nt, Human
augaacacaaauua

SEQ ID NO: 3227132 - RNA, 13 nt, Human
augaacacaaauu

SEQ ID NO: 3227133 - RNA, 20 nt, Human
augaacacaaauuaugcuaa

SEQ ID NO: 3227134 - RNA, 16 nt, Human
augaacacaaauuaug

SEQ ID NO: 3227135 - RNA, 15 nt, Human
augaacacaaauuau

SEQ ID NO: 3227136 - RNA, 14 nt, Human
augaacaaaauuau

SEQ ID NO: 3227137 - RNA, 15 nt, Human
augaacaaaauuauu

SEQ ID NO: 3227138 - RNA, 16 nt, Human
augaacaaaauuauuu

SEQ ID NO: 3227139 - RNA, 17 nt, Human
augaacaaaauuauuug

SEQ ID NO: 3227140 - RNA, 19 nt, Human
augaacaaaauuauuugua

SEQ ID NO: 3227141 - RNA, 19 nt, Human
augaacaaagaccaauuuu

SEQ ID NO: 3227142 - RNA, 22 nt, Human
augaaauaggagggaaaccuuu

SEQ ID NO: 3227143 - RNA, 15 nt, Human
augaaauauauguga

SEQ ID NO: 3227144 - RNA, 17 nt, Human
augaaauauaugugaaa

SEQ ID NO: 3227145 - RNA, 13 nt, Human
augaagcaguauu

SEQ ID NO: 3227146 - RNA, 16 nt, Human
augaauccaacugcuu

SEQ ID NO: 3227147 - RNA, 17 nt, Human
augaaugaaacauuuug

SEQ ID NO: 3227148 - RNA, 15 nt, Human
augaagaaaauacuu

SEQ ID NO: 3227149 - RNA, 14 nt, Human
augaagaaaauacu

SEQ ID NO: 3227150 - RNA, 21 nt, Human
augaagaaaauacuuaaaugu

SEQ ID NO: 3227151 - RNA, 20 nt, Human
augaagaaaauacuuaaaug

SEQ ID NO: 3227152 - RNA, 19 nt, Human
augaagaaaauacuuaaau

SEQ ID NO: 3227153 - RNA, 17 nt, Human
augaagaaaauacuuaa

SEQ ID NO: 3227154 - RNA, 23 nt, Human
augaagaaaauacuuaaauguua

SEQ ID NO: 3227155 - RNA, 22 nt, Human
augaagaaaauacuuaaauguu

SEQ ID NO: 3227156 - RNA, 15 nt, Human
augaagaacauaaaa

SEQ ID NO: 3227157 - RNA, 22 nt, Human
aucugagagaggcuaaaauguu

SEQ ID NO: 3227158 - RNA, 21 nt, Human
aucugagagaggcuaaaaugu

SEQ ID NO: 3227159 - RNA, 17 nt, Human
aucugagaaugaacaaa

SEQ ID NO: 3227160 - RNA, 14 nt, Human
aucugagaaugaac

SEQ ID NO: 3227161 - RNA, 13 nt, Human
aucugagaaugaa

SEQ ID NO: 3227162 - RNA, 23 nt, Human
uugauguucuuucacccuuuucu

SEQ ID NO: 3227163 - RNA, 23 nt, Human
aucugagagaggcuaaaauguuu

SEQ ID NO: 3227164 - RNA, 15 nt, Human
uugauguugaugcaa

SEQ ID NO: 3227165 - RNA, 14 nt, Human
uugauguugaugca

SEQ ID NO: 3227166 - RNA, 16 nt, Human
uugauguugaugcaau

SEQ ID NO: 3227167 - RNA, 13 nt, Human
uugauguuuccuu

SEQ ID NO: 3227168 - RNA, 15 nt, Human
aucucuuucuaaaga

SEQ ID NO: 3227169 - RNA, 22 nt, Human
aucucuuucuaaagacaggaga

SEQ ID NO: 3227170 - RNA, 13 nt, Human
aucugaacauucu

SEQ ID NO: 3227171 - RNA, 13 nt, Human
aucugaagauugu

SEQ ID NO: 3227172 - RNA, 21 nt, Human
aucugaagauuguuuaucuag

SEQ ID NO: 3227173 - RNA, 20 nt, Human
aucugaagauuguuuaucua

SEQ ID NO: 3227174 - RNA, 16 nt, Human
aucugaagauuguuua

SEQ ID NO: 3227175 - RNA, 15 nt, Human
aucugaagauuguuu

SEQ ID NO: 3227176 - RNA, 14 nt, Human
aucugaagauuguu

SEQ ID NO: 3227177 - RNA, 23 nt, Human
aucucacacaugagcaucaggcc

SEQ ID NO: 3227178 - RNA, 12 nt, Human
aucucaaaauua

SEQ ID NO: 3227179 - RNA, 20 nt, Human
aucucaaauaggcuauuaaa

SEQ ID NO: 3227180 - RNA, 23 nt, Human
aucucaaauaggcuauuaaaaaa

SEQ ID NO: 3227181 - RNA, 17 nt, Human
aucucaaauuguaauua

SEQ ID NO: 3227182 - RNA, 19 nt, Human
aucucaaauuguaauuaau

SEQ ID NO: 3227183 - RNA, 18 nt, Human
aucucuugagccugggag

SEQ ID NO: 3227184 - RNA, 12 nt, Human
aucucacagcua

SEQ ID NO: 3227185 - RNA, 15 nt, Human
aucucacagcuaugc

SEQ ID NO: 3227186 - RNA, 14 nt, Human
aucucaacaugucu

SEQ ID NO: 3227187 - RNA, 16 nt, Human
aucucacacaugagca

SEQ ID NO: 3227188 - RNA, 20 nt, Human
uugcccaguacauuuaaauu

SEQ ID NO: 3227189 - RNA, 11 nt, Human
uugcccaggca

SEQ ID NO: 3227190 - RNA, 21 nt, Human
uugcccccaaacccccauucu

SEQ ID NO: 3227191 - RNA, 17 nt, Human
uugccccaacccuucuu

SEQ ID NO: 3227192 - RNA, 18 nt, Human
uugccccaacccuucuuc

SEQ ID NO: 3227193 - RNA, 15 nt, Human
uugcccaugauauaa

SEQ ID NO: 3227194 - RNA, 17 nt, Human
uugcccaggcuggagug

SEQ ID NO: 3227195 - RNA, 20 nt, Human
uugcccaugcugggcucccg

SEQ ID NO: 3227196 - RNA, 23 nt, Human
uugcccaggcuggcgugcagugg

SEQ ID NO: 3227197 - RNA, 14 nt, Human
uugcccaggcuggc

SEQ ID NO: 3227198 - RNA, 12 nt, Human
uugcccaggcug

SEQ ID NO: 3227199 - RNA, 11 nt, Human
uugcccaggcu

SEQ ID NO: 3227200 - RNA, 18 nt, Human
uugcccaggcaggucuug

SEQ ID NO: 3227201 - RNA, 16 nt, Human
uugcccaggcaggucu

SEQ ID NO: 3227202 - RNA, 14 nt, Human
uugcccaggcaggu

SEQ ID NO: 3227203 - RNA, 13 nt, Human
uugcccaggcagg

SEQ ID NO: 3227204 - RNA, 14 nt, Human
uugcaugaggcuag

SEQ ID NO: 3227205 - RNA, 12 nt, Human
uugcaugaggcu

SEQ ID NO: 3227206 - RNA, 17 nt, Human
uugcauguaaaagccua

SEQ ID NO: 3227207 - RNA, 24 nt, Human
uugccaaacauuaauguugauuuc

SEQ ID NO: 3227208 - RNA, 16 nt, Human
uugccaaaguacagaa

SEQ ID NO: 3227209 - RNA, 21 nt, Human
uugccaaaguacagaauuuga

SEQ ID NO: 3227210 - RNA, 21 nt, Human
uugccaaauaaaguuaaaagu

SEQ ID NO: 3227211 - RNA, 22 nt, Human
uugccaaauaaaguuaaaagua

SEQ ID NO: 3227212 - RNA, 21 nt, Human
uugccaaacauuaauguugau

SEQ ID NO: 3227213 - RNA, 15 nt, Human
uugccaagagcccgu

SEQ ID NO: 3227214 - RNA, 18 nt, Human
uugcaccacugcacucca

SEQ ID NO: 3227215 - RNA, 21 nt, Human
uugcaccacugcacuccagcc

SEQ ID NO: 3227216 - RNA, 13 nt, Human
uugcaaucuauaa

SEQ ID NO: 3227217 - RNA, 16 nt, Human
uugcaaucuauaauau

SEQ ID NO: 3227218 - RNA, 13 nt, Human
uugacauggaaau

SEQ ID NO: 3227219 - RNA, 16 nt, Human
uugacauggaaaugaa

SEQ ID NO: 3227220 - RNA, 15 nt, Human
uugacacugaaauaa

SEQ ID NO: 3227221 - RNA, 13 nt, Human
uugacaucaacug

SEQ ID NO: 3227222 - RNA, 16 nt, Human
uugacaucaacugcau

SEQ ID NO: 3227223 - RNA, 12 nt, Human
uugacagggcac

SEQ ID NO: 3227224 - RNA, 10 nt, Human
uugacagggc

SEQ ID NO: 3227225 - RNA, 19 nt, Human
uugacaggauuauuggaaa

SEQ ID NO: 3227226 - RNA, 22 nt, Human
aucccuucucuuccaggcagcc

SEQ ID NO: 3227227 - RNA, 21 nt, Human
aucccuucucuuccaggcagc

SEQ ID NO: 3227228 - RNA, 22 nt, Human
aucccuuccaccugcucugcug

SEQ ID NO: 3227229 - RNA, 17 nt, Human
aucccuucucuuccagg

SEQ ID NO: 3227230 - RNA, 15 nt, Human
aucccuucucuucca

SEQ ID NO: 3227231 - RNA, 14 nt, Human
aucccuucucuucc

SEQ ID NO: 3227232 - RNA, 13 nt, Human
aucccuucucuuc

SEQ ID NO: 3227233 - RNA, 19 nt, Human
aucccuuccaccugcucug

SEQ ID NO: 3227234 - RNA, 16 nt, Human
aucccuuccaccugcu

SEQ ID NO: 3227235 - RNA, 14 nt, Human
aucccuuccaccug

SEQ ID NO: 3227236 - RNA, 21 nt, Human
aucccuuaagaaugaguuucu

SEQ ID NO: 3227237 - RNA, 15 nt, Human
auccgaaaucagcag

SEQ ID NO: 3227238 - RNA, 17 nt, Human
uugaccaggcaccuccc

SEQ ID NO: 3227239 - RNA, 16 nt, Human
uugacuuuuuagaugu

SEQ ID NO: 3227240 - RNA, 12 nt, Human
uugacaggaggu

SEQ ID NO: 3227241 - RNA, 18 nt, Human
uugaccaguauaaaauua

SEQ ID NO: 3227242 - RNA, 19 nt, Human
uugaccaguauaaaauuac

SEQ ID NO: 3227243 - RNA, 16 nt, Human
uugagcagggcucagc

SEQ ID NO: 3227244 - RNA, 21 nt, Human
uugagcaguggccuacaaauc

SEQ ID NO: 3227245 - RNA, 22 nt, Human
uugagcaguggccuacaaauca

SEQ ID NO: 3227246 - RNA, 12 nt, Human
uugagcagggcu

SEQ ID NO: 3227247 - RNA, 14 nt, Human
uugagcagaauuca

SEQ ID NO: 3227248 - RNA, 11 nt, Human
uugagacagag

SEQ ID NO: 3227249 - RNA, 10 nt, Human
uugagacaga

SEQ ID NO: 3227250 - RNA, 15 nt, Human
aucucaaaacugcac

SEQ ID NO: 3227251 - RNA, 20 nt, Human
aucucaaaacugcacuguca

SEQ ID NO: 3227252 - RNA, 19 nt, Human
aucucaaaacugcacuguc

SEQ ID NO: 3227253 - RNA, 21 nt, Human
aucucaaauaacuaaaaggua

SEQ ID NO: 3227254 - RNA, 14 nt, Human
aucucaaauaacua

SEQ ID NO: 3227255 - RNA, 23 nt, Human
aucucaaauaacuaaaagguaug

SEQ ID NO: 3227256 - RNA, 17 nt, Human
aucuaggaagacuuugg

SEQ ID NO: 3227257 - RNA, 18 nt, Human
aucuaggaagacuuugga

SEQ ID NO: 3227258 - RNA, 19 nt, Human
aucuaggaagacuuuggaa

SEQ ID NO: 3227259 - RNA, 21 nt, Human
aucuagaucuuugugccaaac

SEQ ID NO: 3227260 - RNA, 10 nt, Human
aucuacugca

SEQ ID NO: 3227261 - RNA, 17 nt, Human
aucuagauguaaauuuu

SEQ ID NO: 3227262 - RNA, 13 nt, Human
aucuagauguaaa

SEQ ID NO: 3227263 - RNA, 15 nt, Human
aucuagauguaaauu

SEQ ID NO: 3227264 - RNA, 14 nt, Human
aucuagauguaaau

SEQ ID NO: 3227265 - RNA, 19 nt, Human
aucuagccagugaacauaa

SEQ ID NO: 3227266 - RNA, 19 nt, Human
aucuaccaacuuucaagaa

SEQ ID NO: 3227267 - RNA, 23 nt, Human
aucuaauauguaacaagccaccc

SEQ ID NO: 3227268 - RNA, 20 nt, Human
aucuaauauguaacaagcca

SEQ ID NO: 3227269 - RNA, 12 nt, Human
aucuaccaacuu

SEQ ID NO: 3227270 - RNA, 18 nt, Human
aucuaccaacuuucaaga

SEQ ID NO: 3227271 - RNA, 17 nt, Human
aucuaccaacuuucaag

SEQ ID NO: 3227272 - RNA, 16 nt, Human
aucuaccaacuuucaa

SEQ ID NO: 3227273 - RNA, 15 nt, Human
aucuaccaacuuuca

SEQ ID NO: 3227274 - RNA, 21 nt, Human
uugagugcugucuccauguuu

SEQ ID NO: 3227275 - RNA, 11 nt, Human
uugagugccuu

SEQ ID NO: 3227276 - RNA, 22 nt, Human
uugaguggggggaacgcccacu

SEQ ID NO: 3227277 - RNA, 16 nt, Human
aucagugucuuuccac

SEQ ID NO: 3227278 - RNA, 16 nt, Human
aucaguccuagaaugu

SEQ ID NO: 3227279 - RNA, 21 nt, Human
aucaguccuagaauguuucau

SEQ ID NO: 3227280 - RNA, 22 nt, Human
aucaguccuagaauguuucauu

SEQ ID NO: 3227281 - RNA, 23 nt, Human
aucaguccuagaauguuucauuu

SEQ ID NO: 3227282 - RNA, 19 nt, Human
aucauaaguauuuggaauu

SEQ ID NO: 3227283 - RNA, 18 nt, Human
aucauaaguauuuggaau

SEQ ID NO: 3227284 - RNA, 17 nt, Human
aucauaaguauuuggaa

SEQ ID NO: 3227285 - RNA, 14 nt, Human
aucauaaguauuug

SEQ ID NO: 3227286 - RNA, 19 nt, Human
aucauacuccuaugcuuua

SEQ ID NO: 3227287 - RNA, 18 nt, Human
aucauacuccuaugcuuu

SEQ ID NO: 3227288 - RNA, 17 nt, Human
aucauacuccuaugcuu

SEQ ID NO: 3227289 - RNA, 23 nt, Human
aucauaaguauuuggaauuagaa

SEQ ID NO: 3227290 - RNA, 15 nt, Human
aucagagguaucuua

SEQ ID NO: 3227291 - RNA, 14 nt, Human
aucauugaaaucuu

SEQ ID NO: 3227292 - RNA, 15 nt, Human
aucauugaaaucuuu

SEQ ID NO: 3227293 - RNA, 13 nt, Human
aucauugaaaucu

SEQ ID NO: 3227294 - RNA, 14 nt, Human
aucauuccuuuuua

SEQ ID NO: 3227295 - RNA, 15 nt, Human
aucauuccuuuuuau

SEQ ID NO: 3227296 - RNA, 20 nt, Human
aucauuccuuuuuauuuaua

SEQ ID NO: 3227297 - RNA, 21 nt, Human
aucauuccuuuuuauuuauau

SEQ ID NO: 3227298 - RNA, 18 nt, Human
aucauguuuacagaggac

SEQ ID NO: 3227299 - RNA, 23 nt, Human
aucauguuuacagaggacaguau

SEQ ID NO: 3227300 - RNA, 12 nt, Human
aucauguuucuu

SEQ ID NO: 3227301 - RNA, 23 nt, Human
aucauguuucuuugaucaugaau

SEQ ID NO: 3227302 - RNA, 16 nt, Human
aucauguuucuuugau

SEQ ID NO: 3227303 - RNA, 15 nt, Human
aucauguuucuuuga

SEQ ID NO: 3227304 - RNA, 14 nt, Human
aucauguuucuuug

SEQ ID NO: 3227305 - RNA, 17 nt, Human
aucaucacguauguuau

SEQ ID NO: 3227306 - RNA, 21 nt, Human
aucaucacguauguuauacaa

SEQ ID NO: 3227307 - RNA, 22 nt, Human
aucaucacguauguuauacaac

SEQ ID NO: 3227308 - RNA, 23 nt, Human
aucauauugguauauccuuuucu

SEQ ID NO: 3227309 - RNA, 16 nt, Human
aucauauuauacagac

SEQ ID NO: 3227310 - RNA, 15 nt, Human
aucauauuauacaga

SEQ ID NO: 3227311 - RNA, 13 nt, Human
uucuaggccuggg

SEQ ID NO: 3227312 - RNA, 20 nt, Human
uuccuuuuuauuuauaugua

SEQ ID NO: 3227313 - RNA, 18 nt, Human
uuccuuuuuauuuauaug

SEQ ID NO: 3227314 - RNA, 21 nt, Human
uucucaagggacguccuccaa

SEQ ID NO: 3227315 - RNA, 22 nt, Human
uucucagaaucucaaauaacua

SEQ ID NO: 3227316 - RNA, 19 nt, Human
uucucagaaucucaaauaa

SEQ ID NO: 3227317 - RNA, 13 nt, Human
uucucagaaucuc

SEQ ID NO: 3227318 - RNA, 20 nt, Human
uucucacacucuaacuguau

SEQ ID NO: 3227319 - RNA, 21 nt, Human
uucucacacucuaacuguaua

SEQ ID NO: 3227320 - RNA, 22 nt, Human
uucucacacucuaacuguauau

SEQ ID NO: 3227321 - RNA, 23 nt, Human
uucucagaaucucaaauaacuaa

SEQ ID NO: 3227322 - RNA, 19 nt, Human
uucucaguuuuucuuaaua

SEQ ID NO: 3227323 - RNA, 18 nt, Human
uucucaguuuuucuuaau

SEQ ID NO: 3227324 - RNA, 16 nt, Human
uucucaguuuuucuua

SEQ ID NO: 3227325 - RNA, 15 nt, Human
uucucaguuuuucuu

SEQ ID NO: 3227326 - RNA, 14 nt, Human
uucucaguuuuucu

SEQ ID NO: 3227327 - RNA, 12 nt, Human
uucucauauuug

SEQ ID NO: 3227328 - RNA, 16 nt, Human
aucagaaauaauaaaa

SEQ ID NO: 3227329 - RNA, 14 nt, Human
aucagaacagcugu

SEQ ID NO: 3227330 - RNA, 13 nt, Human
aucagaacagcug

SEQ ID NO: 3227331 - RNA, 15 nt, Human
aucagaacagcuguu

SEQ ID NO: 3227332 - RNA, 17 nt, Human
aucccaggauguacaag

SEQ ID NO: 3227333 - RNA, 13 nt, Human
auccauuaauuua

SEQ ID NO: 3227334 - RNA, 15 nt, Human
auccauuaauuuaaa

SEQ ID NO: 3227335 - RNA, 23 nt, Human
auccauggggucucucacagaca

SEQ ID NO: 3227336 - RNA, 22 nt, Human
auccauggggucucucacagac

SEQ ID NO: 3227337 - RNA, 19 nt, Human
auccauggggucucucaca

SEQ ID NO: 3227338 - RNA, 20 nt, Human
aucauuucugcaucagcugc

SEQ ID NO: 3227339 - RNA, 11 nt, Human
aucauuucugg

SEQ ID NO: 3227340 - RNA, 19 nt, Human
aucauuuguucaaagcugu

SEQ ID NO: 3227341 - RNA, 14 nt, Human
aucauuugaguuca

SEQ ID NO: 3227342 - RNA, 11 nt, Human
aucauuugagu

SEQ ID NO: 3227343 - RNA, 12 nt, Human
aucauuuguuca

SEQ ID NO: 3227344 - RNA, 16 nt, Human
auccagguucagcuug

SEQ ID NO: 3227345 - RNA, 15 nt, Human
auccagguucagcuu

SEQ ID NO: 3227346 - RNA, 17 nt, Human
auccaggguggugguga

SEQ ID NO: 3227347 - RNA, 15 nt, Human
aucccuccuuaagag

SEQ ID NO: 3227348 - RNA, 17 nt, Human
aucccuccuuaagagau

SEQ ID NO: 3227349 - RNA, 16 nt, Human
aucccauaugccuggg

SEQ ID NO: 3227350 - RNA, 12 nt, Human
aucccugcucac

SEQ ID NO: 3227351 - RNA, 15 nt, Human
aucccugcucacugc

SEQ ID NO: 3227352 - RNA, 13 nt, Human
aucccugcucacu

SEQ ID NO: 3227353 - RNA, 20 nt, Human
aucccugcucacugcagccu

SEQ ID NO: 3227354 - RNA, 16 nt, Human
aucccugcucacugca

SEQ ID NO: 3227355 - RNA, 14 nt, Human
aucccuuaagaaug

SEQ ID NO: 3227356 - RNA, 12 nt, Human
aucccuuaagaa

SEQ ID NO: 3227357 - RNA, 15 nt, Human
aucccuguguuaauu

SEQ ID NO: 3227358 - RNA, 20 nt, Human
aucccuguguuaauuuaagu

SEQ ID NO: 3227359 - RNA, 21 nt, Human
uucugccacccugcugagucu

SEQ ID NO: 3227360 - RNA, 23 nt, Human
uucugccgcagcccugcagaggg

SEQ ID NO: 3227361 - RNA, 16 nt, Human
uucugccgcagcccug

SEQ ID NO: 3227362 - RNA, 22 nt, Human
uucugccagauguccuaauggu

SEQ ID NO: 3227363 - RNA, 22 nt, Human
uucugggacacaguucaauucu

SEQ ID NO: 3227364 - RNA, 11 nt, Human
uucugggacac

SEQ ID NO: 3227365 - RNA, 10 nt, Human
uucugggaca

SEQ ID NO: 3227366 - RNA, 15 nt, Human
uucugccucugaugu

SEQ ID NO: 3227367 - RNA, 23 nt, Human
uucugccugaggggcagccugcc

SEQ ID NO: 3227368 - RNA, 21 nt, Human
uucugccugaggggcagccug

SEQ ID NO: 3227369 - RNA, 22 nt, Human
uucugccucugauguauuuugu

SEQ ID NO: 3227370 - RNA, 16 nt, Human
uucugccucugaugua

SEQ ID NO: 3227371 - RNA, 23 nt, Human
uucuguaauaacuagaacaaaua

SEQ ID NO: 3227372 - RNA, 20 nt, Human
uucuguaauauuuacaaugu

SEQ ID NO: 3227373 - RNA, 21 nt, Human
uucuguaauauuuacaaugua

SEQ ID NO: 3227374 - RNA, 23 nt, Human
uucuguaauauuuacaauguauu

SEQ ID NO: 3227375 - RNA, 15 nt, Human
uucugggguuuuucu

SEQ ID NO: 3227376 - RNA, 23 nt, Human
uucugggaauguauaguauuuga

SEQ ID NO: 3227377 - RNA, 11 nt, Human
uucugguaauc

SEQ ID NO: 3227378 - RNA, 13 nt, Human
uucucuucacuca

SEQ ID NO: 3227379 - RNA, 12 nt, Human
uucucuuagaaa

SEQ ID NO: 3227380 - RNA, 15 nt, Human
uucugaaagggacgc

SEQ ID NO: 3227381 - RNA, 19 nt, Human
uucugaaagagucuuucuu

SEQ ID NO: 3227382 - RNA, 12 nt, Human
uucugaaagagu

SEQ ID NO: 3227383 - RNA, 22 nt, Human
uucucuuagaaaaggugauaaa

SEQ ID NO: 3227384 - RNA, 19 nt, Human
aucauugaaaucuuuuugc

SEQ ID NO: 3227385 - RNA, 23 nt, Human
aucauuccuuuuuauuuauaugu

SEQ ID NO: 3227386 - RNA, 16 nt, Human
uucugcaucagcugcu

SEQ ID NO: 3227387 - RNA, 16 nt, Human
uucugaaccugucuuu

SEQ ID NO: 3227388 - RNA, 23 nt, Human
uucugcaucagcugcugaaacaa

SEQ ID NO: 3227389 - RNA, 23 nt, Human
uucugaacuuggcgcugccccug

SEQ ID NO: 3227390 - RNA, 20 nt, Human
auauuuguaaauuuauguga

SEQ ID NO: 3227391 - RNA, 15 nt, Human
auauuuguacuuucu

SEQ ID NO: 3227392 - RNA, 14 nt, Human
auauuuguacuuuc

SEQ ID NO: 3227393 - RNA, 21 nt, Human
auauuuguacuuucuguuaaa

SEQ ID NO: 3227394 - RNA, 20 nt, Human
auauuuguacuuucuguuaa

SEQ ID NO: 3227395 - RNA, 19 nt, Human
auauuuguacuuucuguua

SEQ ID NO: 3227396 - RNA, 17 nt, Human
auauuuguacuuucugu

SEQ ID NO: 3227397 - RNA, 12 nt, Human
auauuucuucaa

SEQ ID NO: 3227398 - RNA, 13 nt, Human
auauuucuucaaa

SEQ ID NO: 3227399 - RNA, 14 nt, Human
auauuucuucaaau

SEQ ID NO: 3227400 - RNA, 15 nt, Human
auauuucuucaaaua

SEQ ID NO: 3227401 - RNA, 18 nt, Human
auauuucuucaaauaucu

SEQ ID NO: 3227402 - RNA, 22 nt, Human
auauuuguaucacaaaucuuaa

SEQ ID NO: 3227403 - RNA, 13 nt, Human
auauuuguaugau

SEQ ID NO: 3227404 - RNA, 19 nt, Human
auauuuguauuuauucuuu

SEQ ID NO: 3227405 - RNA, 18 nt, Human
auauuuguauuuauucuu

SEQ ID NO: 3227406 - RNA, 17 nt, Human
auauuuguauuuauucu

SEQ ID NO: 3227407 - RNA, 12 nt, Human
auauuuuaacuu

SEQ ID NO: 3227408 - RNA, 14 nt, Human
auauuuuaaacaga

SEQ ID NO: 3227409 - RNA, 17 nt, Human
auauuuguguguucacu

SEQ ID NO: 3227410 - RNA, 23 nt, Human
auauuugugugcuaaacguguau

SEQ ID NO: 3227411 - RNA, 22 nt, Human
auauuugugugcuaaacgugua

SEQ ID NO: 3227412 - RNA, 16 nt, Human
auauuugugugcuaaa

SEQ ID NO: 3227413 - RNA, 11 nt, Human
auauuugugua

SEQ ID NO: 3227414 - RNA, 14 nt, Human
auauuuguuuaguu

SEQ ID NO: 3227415 - RNA, 23 nt, Human
auauuuguuuaguucagcaaaac

SEQ ID NO: 3227416 - RNA, 17 nt, Human
auauuuuaaaauaaacu

SEQ ID NO: 3227417 - RNA, 20 nt, Human
auauuuuaaaaucuccuaaa

SEQ ID NO: 3227418 - RNA, 19 nt, Human
auauugcugaagaaucuac

SEQ ID NO: 3227419 - RNA, 21 nt, Human
auauugcugaagaaucuacuu

SEQ ID NO: 3227420 - RNA, 20 nt, Human
auauuguguugacuuuauaa

SEQ ID NO: 3227421 - RNA, 17 nt, Human
auauugcugauggugca

SEQ ID NO: 3227422 - RNA, 17 nt, Human
auauugccauuaugcuu

SEQ ID NO: 3227423 - RNA, 20 nt, Human
auauugaaaggcaaacauuu

SEQ ID NO: 3227424 - RNA, 17 nt, Human
auauugcacaauuauaa

SEQ ID NO: 3227425 - RNA, 14 nt, Human
auauuuaaaacuuu

SEQ ID NO: 3227426 - RNA, 20 nt, Human
auauuguuuucaguguacau

SEQ ID NO: 3227427 - RNA, 22 nt, Human
auauuuaaaaacaaaaggcaau

SEQ ID NO: 3227428 - RNA, 19 nt, Human
auauuuaaaaacaaaaggc

SEQ ID NO: 3227429 - RNA, 17 nt, Human
auauuguuuucagugua

SEQ ID NO: 3227430 - RNA, 12 nt, Human
auauuguuaagg

SEQ ID NO: 3227431 - RNA, 20 nt, Human
auauucuuuguuaauuugga

SEQ ID NO: 3227432 - RNA, 14 nt, Human
auauucuuuguuaa

SEQ ID NO: 3227433 - RNA, 22 nt, Human
auauucuuccuggggcccaaau

SEQ ID NO: 3227434 - RNA, 14 nt, Human
auauugaaaauuga

SEQ ID NO: 3227435 - RNA, 16 nt, Human
auauugaaaauugaaa

SEQ ID NO: 3227436 - RNA, 20 nt, Human
auauugaaaauugaaaagua

SEQ ID NO: 3227437 - RNA, 21 nt, Human
auauugaaaauugaaaaguac

SEQ ID NO: 3227438 - RNA, 23 nt, Human
auauugaaaauugaaaaguacaa

SEQ ID NO: 3227439 - RNA, 16 nt, Human
auauucuguuggccag

SEQ ID NO: 3227440 - RNA, 19 nt, Human
auauucucuguacauauua

SEQ ID NO: 3227441 - RNA, 16 nt, Human
auauucucuguacaua

SEQ ID NO: 3227442 - RNA, 15 nt, Human
auauucucuguacau

SEQ ID NO: 3227443 - RNA, 12 nt, Human
auauucucugua

SEQ ID NO: 3227444 - RNA, 14 nt, Human
auauucucuguaca

SEQ ID NO: 3227445 - RNA, 13 nt, Human
auauucucuguac

SEQ ID NO: 3227446 - RNA, 20 nt, Human
auauuccagguuuaaguaga

SEQ ID NO: 3227447 - RNA, 16 nt, Human
auauguuuccuucccu

SEQ ID NO: 3227448 - RNA, 18 nt, Human
auauguuuuaagaggcag

SEQ ID NO: 3227449 - RNA, 20 nt, Human
auauguuuuaagaggcaggg

SEQ ID NO: 3227450 - RNA, 17 nt, Human
auauguuuccuucccuc

SEQ ID NO: 3227451 - RNA, 23 nt, Human
uucauguccugugucaguuuaug

SEQ ID NO: 3227452 - RNA, 22 nt, Human
uucauguccugugucaguuuau

SEQ ID NO: 3227453 - RNA, 22 nt, Human
uucaugugggaucccaucuuuu

SEQ ID NO: 3227454 - RNA, 20 nt, Human
uucaugugggaucccaucuu

SEQ ID NO: 3227455 - RNA, 17 nt, Human
uucauguucccacuuca

SEQ ID NO: 3227456 - RNA, 22 nt, Human
auauuaaggaagacaaugugaa

SEQ ID NO: 3227457 - RNA, 24 nt, Human
auauuaagaaagacuaucuaaaug

SEQ ID NO: 3227458 - RNA, 22 nt, Human
auauuaagaaagacuaucuaaa

SEQ ID NO: 3227459 - RNA, 23 nt, Human
auauuaagcaugacagaaaauau

SEQ ID NO: 3227460 - RNA, 20 nt, Human
auauuaaguaagucucaagg

SEQ ID NO: 3227461 - RNA, 20 nt, Human
auauuaagcaugacagaaaa

SEQ ID NO: 3227462 - RNA, 19 nt, Human
aucaauuuuucuuauuuca

SEQ ID NO: 3227463 - RNA, 12 nt, Human
aucacaaaugac

SEQ ID NO: 3227464 - RNA, 13 nt, Human
aucacaaaugacu

SEQ ID NO: 3227465 - RNA, 11 nt, Human
aucacaaauga

SEQ ID NO: 3227466 - RNA, 20 nt, Human
aucacaaaugacuuuauuau

SEQ ID NO: 3227467 - RNA, 14 nt, Human
aucacaaaugacuu

SEQ ID NO: 3227468 - RNA, 15 nt, Human
aucacaaaugacuuu

SEQ ID NO: 3227469 - RNA, 16 nt, Human
aucacaaaugacuuua

SEQ ID NO: 3227470 - RNA, 19 nt, Human
aucacaaaugacuuuauua

SEQ ID NO: 3227471 - RNA, 19 nt, Human
aucacggcucacugcagcc

SEQ ID NO: 3227472 - RNA, 22 nt, Human
aucacggcucacugcagccuca

SEQ ID NO: 3227473 - RNA, 17 nt, Human
aucacguuaaaguagga

SEQ ID NO: 3227474 - RNA, 23 nt, Human
uuccuuuucccaggaaagaagca

SEQ ID NO: 3227475 - RNA, 22 nt, Human
uuccuuuuaaaacacuuccaua

SEQ ID NO: 3227476 - RNA, 21 nt, Human
uuccuuuuaaaacacuuccau

SEQ ID NO: 3227477 - RNA, 20 nt, Human
uuccuuuuaaaacacuucca

SEQ ID NO: 3227478 - RNA, 16 nt, Human
aucacuguuuagauuu

SEQ ID NO: 3227479 - RNA, 15 nt, Human
aucacuguuuagauu

SEQ ID NO: 3227480 - RNA, 20 nt, Human
aucacuguguauauuugauu

SEQ ID NO: 3227481 - RNA, 14 nt, Human
aucacuguuuagau

SEQ ID NO: 3227482 - RNA, 22 nt, Human
aucacugugcaguugcuguuua

SEQ ID NO: 3227483 - RNA, 15 nt, Human
aucacuguguauauu

SEQ ID NO: 3227484 - RNA, 17 nt, Human
aucacuguguauauuug

SEQ ID NO: 3227485 - RNA, 18 nt, Human
aucacuguguauauuuga

SEQ ID NO: 3227486 - RNA, 19 nt, Human
aucacuguguauauuugau

SEQ ID NO: 3227487 - RNA, 17 nt, Human
aucacuggcaugguggu

SEQ ID NO: 3227488 - RNA, 16 nt, Human
aucacuggcauggugg

SEQ ID NO: 3227489 - RNA, 12 nt, Human
aucaaguauuac

SEQ ID NO: 3227490 - RNA, 20 nt, Human
aucaaguauuacuaaauuga

SEQ ID NO: 3227491 - RNA, 21 nt, Human
aucaaguauuacuaaauugac

SEQ ID NO: 3227492 - RNA, 14 nt, Human
aucaaguauuauaa

SEQ ID NO: 3227493 - RNA, 23 nt, Human
aucaauaugcagaauggcauuug

SEQ ID NO: 3227494 - RNA, 15 nt, Human
aucaauaugcagaau

SEQ ID NO: 3227495 - RNA, 13 nt, Human
aucaauaguugaa

SEQ ID NO: 3227496 - RNA, 14 nt, Human
aucaauaguugaau

SEQ ID NO: 3227497 - RNA, 17 nt, Human
aucaauaguugaauuag

SEQ ID NO: 3227498 - RNA, 13 nt, Human
auauuuuguaaau

SEQ ID NO: 3227499 - RNA, 19 nt, Human
auauuuuguaaaauguauu

SEQ ID NO: 3227500 - RNA, 20 nt, Human
auauuuuguaaaauguauua

SEQ ID NO: 3227501 - RNA, 21 nt, Human
aucaagagccuuaaaacauca

SEQ ID NO: 3227502 - RNA, 15 nt, Human
aucaagagccuuaaa

SEQ ID NO: 3227503 - RNA, 16 nt, Human
aucaagagccuuaaaa

SEQ ID NO: 3227504 - RNA, 18 nt, Human
aucaagagccuuaaaaca

SEQ ID NO: 3227505 - RNA, 16 nt, Human
auauuuuguaugcaag

SEQ ID NO: 3227506 - RNA, 14 nt, Human
auauuuuguaugca

SEQ ID NO: 3227507 - RNA, 14 nt, Human
aucaagagccuuaa

SEQ ID NO: 3227508 - RNA, 17 nt, Human
auauuuuaacuccacug

SEQ ID NO: 3227509 - RNA, 15 nt, Human
auauuuuauauaaag

SEQ ID NO: 3227510 - RNA, 22 nt, Human
auauuuuauauaaaguauucuu

SEQ ID NO: 3227511 - RNA, 15 nt, Human
auauuuuauuucaau

SEQ ID NO: 3227512 - RNA, 17 nt, Human
auauuuuauuucaaugu

SEQ ID NO: 3227513 - RNA, 19 nt, Human
auauuuuauuucaauguaa

SEQ ID NO: 3227514 - RNA, 20 nt, Human
auauuuuauuucaauguaau

SEQ ID NO: 3227515 - RNA, 21 nt, Human
auauuuuauuucaauguaauu

SEQ ID NO: 3227516 - RNA, 13 nt, Human
uuccuaauccucu

SEQ ID NO: 3227517 - RNA, 15 nt, Human
uuccuaauccucuag

SEQ ID NO: 3227518 - RNA, 14 nt, Human
auauuuuauuuuua

SEQ ID NO: 3227519 - RNA, 20 nt, Human
auauuuuauuuuuagaauuu

SEQ ID NO: 3227520 - RNA, 19 nt, Human
uuccucuuagaagaauauu

SEQ ID NO: 3227521 - RNA, 21 nt, Human
uuccucuuagaagaauauugu

SEQ ID NO: 3227522 - RNA, 22 nt, Human
uuccucuuagaagaauauugua

SEQ ID NO: 3227523 - RNA, 12 nt, Human
uuccucugcucc

SEQ ID NO: 3227524 - RNA, 11 nt, Human
uuccucugcuc

SEQ ID NO: 3227525 - RNA, 22 nt, Human
uuccucugcuaaauugauguug

SEQ ID NO: 3227526 - RNA, 21 nt, Human
uuccucugcucccccuuuucc

SEQ ID NO: 3227527 - RNA, 14 nt, Human
uuccucugcucccc

SEQ ID NO: 3227528 - RNA, 13 nt, Human
uuccucugcuccc

SEQ ID NO: 3227529 - RNA, 21 nt, Human
uuccuccuucacuguuucauc

SEQ ID NO: 3227530 - RNA, 15 nt, Human
uuccucgcuucuuuc

SEQ ID NO: 3227531 - RNA, 13 nt, Human
uuccucgcuucuu

SEQ ID NO: 3227532 - RNA, 20 nt, Human
uuccuaaucacucagagcag

SEQ ID NO: 3227533 - RNA, 11 nt, Human
uuccucuuucc

SEQ ID NO: 3227534 - RNA, 15 nt, Human
uuccucuugaaccag

SEQ ID NO: 3227535 - RNA, 13 nt, Human
uuccucuugaacc

SEQ ID NO: 3227536 - RNA, 20 nt, Human
uuccugggcacacgcugcuc

SEQ ID NO: 3227537 - RNA, 19 nt, Human
uuccugggcacacgcugcu

SEQ ID NO: 3227538 - RNA, 16 nt, Human
uuccugggcacacgcu

SEQ ID NO: 3227539 - RNA, 19 nt, Human
uuccuggggcauccauggg

SEQ ID NO: 3227540 - RNA, 18 nt, Human
uuccuggggcccaaaugc

SEQ ID NO: 3227541 - RNA, 22 nt, Human
uuccugggcacacgcugcucug

SEQ ID NO: 3227542 - RNA, 11 nt, Human
uuccugugucu

SEQ ID NO: 3227543 - RNA, 17 nt, Human
uuccuguucccaugaga

SEQ ID NO: 3227544 - RNA, 11 nt, Human
uuccuucagug

SEQ ID NO: 3227545 - RNA, 14 nt, Human
uuccuucagugccu

SEQ ID NO: 3227546 - RNA, 20 nt, Human
auauuuucaacgcagcccug

SEQ ID NO: 3227547 - RNA, 19 nt, Human
auauuuucaacgcagcccu

SEQ ID NO: 3227548 - RNA, 19 nt, Human
auagcucaggugucccugc

SEQ ID NO: 3227549 - RNA, 12 nt, Human
auagcugggacu

SEQ ID NO: 3227550 - RNA, 21 nt, Human
auagcucaggugucccugcac

SEQ ID NO: 3227551 - RNA, 20 nt, Human
auagcucaggugucccugca

SEQ ID NO: 3227552 - RNA, 22 nt, Human
auagcucaggugucccugcacu

SEQ ID NO: 3227553 - RNA, 12 nt, Human
auagcgugugua

SEQ ID NO: 3227554 - RNA, 15 nt, Human
auagcguguguagau

SEQ ID NO: 3227555 - RNA, 18 nt, Human
auagccugccucuucucu

SEQ ID NO: 3227556 - RNA, 15 nt, Human
auaagauauuuuauu

SEQ ID NO: 3227557 - RNA, 20 nt, Human
auaagauauuuuauuuugaa

SEQ ID NO: 3227558 - RNA, 17 nt, Human
auaagauaaaugugcug

SEQ ID NO: 3227559 - RNA, 13 nt, Human
auaagauaaaugu

SEQ ID NO: 3227560 - RNA, 22 nt, Human
auaagagcuuccaauuuuccuu

SEQ ID NO: 3227561 - RNA, 16 nt, Human
auaacuuuagaaauaa

SEQ ID NO: 3227562 - RNA, 22 nt, Human
uuauuuaaugaaagacuguaca

SEQ ID NO: 3227563 - RNA, 18 nt, Human
uuauuuaaugaaagacug

SEQ ID NO: 3227564 - RNA, 14 nt, Human
uuauuuaaauuuua

SEQ ID NO: 3227565 - RNA, 21 nt, Human
uuauuuaaaauguaaaaagga

SEQ ID NO: 3227566 - RNA, 17 nt, Human
uuauuguuuaaaaucau

SEQ ID NO: 3227567 - RNA, 15 nt, Human
auagcuguacuucuu

SEQ ID NO: 3227568 - RNA, 22 nt, Human
auagcuguacuucuugaauaua

SEQ ID NO: 3227569 - RNA, 17 nt, Human
auagcugggacuacagg

SEQ ID NO: 3227570 - RNA, 16 nt, Human
uuauuuaguuccuuga

SEQ ID NO: 3227571 - RNA, 15 nt, Human
uuauuuaguauuuau

SEQ ID NO: 3227572 - RNA, 13 nt, Human
uuauuuauaugua

SEQ ID NO: 3227573 - RNA, 14 nt, Human
uuauuuauauguau

SEQ ID NO: 3227574 - RNA, 11 nt, Human
uuauuuacaag

SEQ ID NO: 3227575 - RNA, 17 nt, Human
uuauuuacaagaagaac

SEQ ID NO: 3227576 - RNA, 17 nt, Human
uuauuuagcaccaggga

SEQ ID NO: 3227577 - RNA, 15 nt, Human
uuauuuacugcuagu

SEQ ID NO: 3227578 - RNA, 22 nt, Human
uuauuuauucugggaauguaua

SEQ ID NO: 3227579 - RNA, 12 nt, Human
uuauuuauucug

SEQ ID NO: 3227580 - RNA, 17 nt, Human
uuauuuauauuuauuga

SEQ ID NO: 3227581 - RNA, 15 nt, Human
uuauuuauauguaug

SEQ ID NO: 3227582 - RNA, 16 nt, Human
uuauuuauauguaugu

SEQ ID NO: 3227583 - RNA, 15 nt, Human
uuauuuauauuuauu

SEQ ID NO: 3227584 - RNA, 16 nt, Human
uuauuuauauuuauug

SEQ ID NO: 3227585 - RNA, 12 nt, Human
uuauuucaauau

SEQ ID NO: 3227586 - RNA, 12 nt, Human
uuauuucaaugu

SEQ ID NO: 3227587 - RNA, 15 nt, Human
uuauuucaauguaau

SEQ ID NO: 3227588 - RNA, 16 nt, Human
uuauuucaauguaauu

SEQ ID NO: 3227589 - RNA, 18 nt, Human
uuauuucaauguaauuaa

SEQ ID NO: 3227590 - RNA, 24 nt, Human
uuauuucaauguaauuaaacuguu

SEQ ID NO: 3227591 - RNA, 20 nt, Human
uuauuucaucauauuauaca

SEQ ID NO: 3227592 - RNA, 19 nt, Human
uuauuucccccauuuuucc

SEQ ID NO: 3227593 - RNA, 22 nt, Human
uucaccacaugugcacaugcac

SEQ ID NO: 3227594 - RNA, 14 nt, Human
uucacauuuagaaa

SEQ ID NO: 3227595 - RNA, 15 nt, Human
uucaccacagacuuu

SEQ ID NO: 3227596 - RNA, 14 nt, Human
uucaccacagacuu

SEQ ID NO: 3227597 - RNA, 23 nt, Human
uucaccaguacauucucaguuuu

SEQ ID NO: 3227598 - RNA, 22 nt, Human
uucaccaguacauucucaguuu

SEQ ID NO: 3227599 - RNA, 14 nt, Human
uucaauaaaguuug

SEQ ID NO: 3227600 - RNA, 13 nt, Human
uucaauaaaguuu

SEQ ID NO: 3227601 - RNA, 14 nt, Human
auaggcaaauuaau

SEQ ID NO: 3227602 - RNA, 22 nt, Human
auaggcaccuaccaccacgccc

SEQ ID NO: 3227603 - RNA, 17 nt, Human
auaggagggaaaccuuu

SEQ ID NO: 3227604 - RNA, 23 nt, Human
auaggaaguuagccuuuaucuac

SEQ ID NO: 3227605 - RNA, 22 nt, Human
auaggaaguuagccuuuaucua

SEQ ID NO: 3227606 - RNA, 21 nt, Human
auaggaaguuagccuuuaucu

SEQ ID NO: 3227607 - RNA, 19 nt, Human
auaggaaggucauuuccau

SEQ ID NO: 3227608 - RNA, 19 nt, Human
auaggaugggcuucugugc

SEQ ID NO: 3227609 - RNA, 23 nt, Human
auaggcccaaccaccagaugaga

SEQ ID NO: 3227610 - RNA, 15 nt, Human
auaggcuuuuuaauc

SEQ ID NO: 3227611 - RNA, 22 nt, Human
auagggcccaugggagggagcu

SEQ ID NO: 3227612 - RNA, 21 nt, Human
auaggaauugacccacaagaa

SEQ ID NO: 3227613 - RNA, 13 nt, Human
auaggaagacaca

SEQ ID NO: 3227614 - RNA, 15 nt, Human
auagcuuuauuucuu

SEQ ID NO: 3227615 - RNA, 17 nt, Human
auaggaaggucauuucc

SEQ ID NO: 3227616 - RNA, 15 nt, Human
auaggaaggucauuu

SEQ ID NO: 3227617 - RNA, 18 nt, Human
auagcuguucuaauggau

SEQ ID NO: 3227618 - RNA, 13 nt, Human
uucaccauucgua

SEQ ID NO: 3227619 - RNA, 22 nt, Human
uucaccauguuggccaggcugc

SEQ ID NO: 3227620 - RNA, 22 nt, Human
uucaccauguuggccaggcugg

SEQ ID NO: 3227621 - RNA, 15 nt, Human
uucaaggauccugag

SEQ ID NO: 3227622 - RNA, 14 nt, Human
uucaagaaaugaag

SEQ ID NO: 3227623 - RNA, 11 nt, Human
uucaagaaaug

SEQ ID NO: 3227624 - RNA, 16 nt, Human
uucaaggauccugagc

SEQ ID NO: 3227625 - RNA, 18 nt, Human
uucaaggauccugagcca

SEQ ID NO: 3227626 - RNA, 19 nt, Human
uucaaggauccugagccag

SEQ ID NO: 3227627 - RNA, 21 nt, Human
uucaaggauccugagccagau

SEQ ID NO: 3227628 - RNA, 15 nt, Human
uucaagaaaugaaga

SEQ ID NO: 3227629 - RNA, 20 nt, Human
uucaagugauucucaugccu

SEQ ID NO: 3227630 - RNA, 22 nt, Human
uucaagugauucucaugccuca

SEQ ID NO: 3227631 - RNA, 22 nt, Human
uucaagggcuuuccugugccag

SEQ ID NO: 3227632 - RNA, 14 nt, Human
uucaaguuuuaaag

SEQ ID NO: 3227633 - RNA, 15 nt, Human
uucaaguuuuaaagu

SEQ ID NO: 3227634 - RNA, 16 nt, Human
uucaaguuuuaaaguu

SEQ ID NO: 3227635 - RNA, 18 nt, Human
uucaaguuuuaaaguuca

SEQ ID NO: 3227636 - RNA, 16 nt, Human
uucaaaaaacuuguaa

SEQ ID NO: 3227637 - RNA, 17 nt, Human
uucaaaauaaaaaugag

SEQ ID NO: 3227638 - RNA, 13 nt, Human
uucaaaaauuuca

SEQ ID NO: 3227639 - RNA, 21 nt, Human
uucaaaaaucugaagauuguu

SEQ ID NO: 3227640 - RNA, 18 nt, Human
uucaaaaaucugaagauu

SEQ ID NO: 3227641 - RNA, 21 nt, Human
uucaaaaagucacaguuaagg

SEQ ID NO: 3227642 - RNA, 12 nt, Human
uucaaaaaucug

SEQ ID NO: 3227643 - RNA, 16 nt, Human
uucaaaaaucugaaga

SEQ ID NO: 3227644 - RNA, 14 nt, Human
uucaaaaaucugaa

SEQ ID NO: 3227645 - RNA, 14 nt, Human
uuauuucuccuuuu

SEQ ID NO: 3227646 - RNA, 12 nt, Human
uuauuucuccuu

SEQ ID NO: 3227647 - RNA, 18 nt, Human
uuauuucuagcuuuuuaa

SEQ ID NO: 3227648 - RNA, 13 nt, Human
uuauuuuuuugaa

SEQ ID NO: 3227649 - RNA, 19 nt, Human
uuauuuuuuuuaauuguau

SEQ ID NO: 3227650 - RNA, 13 nt, Human
uucaaagaaucac

SEQ ID NO: 3227651 - RNA, 16 nt, Human
uucaacuucaggaaag

SEQ ID NO: 3227652 - RNA, 17 nt, Human
uucaaacugaaaagcug

SEQ ID NO: 3227653 - RNA, 13 nt, Human
uucaaacugaaaa

SEQ ID NO: 3227654 - RNA, 15 nt, Human
uucaaaccugugaag

SEQ ID NO: 3227655 - RNA, 17 nt, Human
uucaaaauaaaauauca

SEQ ID NO: 3227656 - RNA, 22 nt, Human
uucaaaaaucugaagauuguuu

SEQ ID NO: 3227657 - RNA, 14 nt, Human
uucaaaauauugag

SEQ ID NO: 3227658 - RNA, 16 nt, Human
uucaaaauauugagca

SEQ ID NO: 3227659 - RNA, 23 nt, Human
uucaaaauauugagcagaauuca

SEQ ID NO: 3227660 - RNA, 18 nt, Human
auaucuaaaucuguccaa

SEQ ID NO: 3227661 - RNA, 21 nt, Human
auauccuuuuagucugcauau

SEQ ID NO: 3227662 - RNA, 21 nt, Human
uucaucauccuaagcuauuca

SEQ ID NO: 3227663 - RNA, 22 nt, Human
uucauauuuguacuuucuguua

SEQ ID NO: 3227664 - RNA, 20 nt, Human
uucauauuuguacuuucugu

SEQ ID NO: 3227665 - RNA, 17 nt, Human
uucauauuuuaaacaga

SEQ ID NO: 3227666 - RNA, 18 nt, Human
uucaucauccuaagcuau

SEQ ID NO: 3227667 - RNA, 11 nt, Human
uucauauuugu

SEQ ID NO: 3227668 - RNA, 15 nt, Human
uucauauuuguacuu

SEQ ID NO: 3227669 - RNA, 14 nt, Human
uucauauuuguacu

SEQ ID NO: 3227670 - RNA, 21 nt, Human
uucauauuuuaaacagaggau

SEQ ID NO: 3227671 - RNA, 18 nt, Human
auauauguuuuugaaggc

SEQ ID NO: 3227672 - RNA, 17 nt, Human
auauauguuuuugaagg

SEQ ID NO: 3227673 - RNA, 16 nt, Human
auauauuaaaauucca

SEQ ID NO: 3227674 - RNA, 20 nt, Human
auauauuaaaauuccaaauu

SEQ ID NO: 3227675 - RNA, 13 nt, Human
uucagccuaagag

SEQ ID NO: 3227676 - RNA, 18 nt, Human
uucagggcagauuuuagu

SEQ ID NO: 3227677 - RNA, 16 nt, Human
uucagggcagauuuua

SEQ ID NO: 3227678 - RNA, 23 nt, Human
uucagggcagauuuuaguuuuau

SEQ ID NO: 3227679 - RNA, 20 nt, Human
uucagggcagauuuuaguuu

SEQ ID NO: 3227680 - RNA, 14 nt, Human
uucaguaauaacuc

SEQ ID NO: 3227681 - RNA, 23 nt, Human
uucaggggcuagcuaagccaaga

SEQ ID NO: 3227682 - RNA, 17 nt, Human
uucaggggaaacuugau

SEQ ID NO: 3227683 - RNA, 21 nt, Human
uucauauuuacuucuuauaca

SEQ ID NO: 3227684 - RNA, 16 nt, Human
uucauauuuacuucuu

SEQ ID NO: 3227685 - RNA, 15 nt, Human
uucauagcuguacuu

SEQ ID NO: 3227686 - RNA, 18 nt, Human
uucauagcuguacuucuu

SEQ ID NO: 3227687 - RNA, 14 nt, Human
uucauacuuaaaaa

SEQ ID NO: 3227688 - RNA, 18 nt, Human
uucauacuuaaaaauuua

SEQ ID NO: 3227689 - RNA, 23 nt, Human
auaugcaaagcacugacuucuaa

SEQ ID NO: 3227690 - RNA, 15 nt, Human
auaugcaaagcacug

SEQ ID NO: 3227691 - RNA, 21 nt, Human
auaucuuggcagguaggaaua

SEQ ID NO: 3227692 - RNA, 16 nt, Human
auaugcaaagcacuga

SEQ ID NO: 3227693 - RNA, 23 nt, Human
auauguauguguuuagaauugaa

SEQ ID NO: 3227694 - RNA, 21 nt, Human
auauguauuaacacuacucaa

SEQ ID NO: 3227695 - RNA, 14 nt, Human
auauguauguguuu

SEQ ID NO: 3227696 - RNA, 15 nt, Human
auauguauguguuua

SEQ ID NO: 3227697 - RNA, 17 nt, Human
auauguauguguuuaga

SEQ ID NO: 3227698 - RNA, 18 nt, Human
auauguauguguuuagaa

SEQ ID NO: 3227699 - RNA, 19 nt, Human
auauguauguguuuagaau

SEQ ID NO: 3227700 - RNA, 20 nt, Human
auauguauguguuuagaauu

SEQ ID NO: 3227701 - RNA, 21 nt, Human
auauguauguguuuagaauug

SEQ ID NO: 3227702 - RNA, 22 nt, Human
auauguauguguuuagaauuga

SEQ ID NO: 3227703 - RNA, 15 nt, Human
auauguauacaugug

SEQ ID NO: 3227704 - RNA, 13 nt, Human
auauguauguguu

SEQ ID NO: 3227705 - RNA, 11 nt, Human
auauguaugug

SEQ ID NO: 3227706 - RNA, 14 nt, Human
auaugucaagccau

SEQ ID NO: 3227707 - RNA, 21 nt, Human
auauguauucuguaaaagaaa

SEQ ID NO: 3227708 - RNA, 18 nt, Human
auaugucagucacuaaaa

SEQ ID NO: 3227709 - RNA, 20 nt, Human
auauguccucuuuuguuguu

SEQ ID NO: 3227710 - RNA, 21 nt, Human
uucauggcaugcuuaaauuuu

SEQ ID NO: 3227711 - RNA, 16 nt, Human
uucaugucccagaacu

SEQ ID NO: 3227712 - RNA, 22 nt, Human
uucaugucccagaacuuagccu

SEQ ID NO: 3227713 - RNA, 21 nt, Human
uucauguccugugucaguuua

SEQ ID NO: 3227714 - RNA, 20 nt, Human
uucauguccugugucaguuu

SEQ ID NO: 3227715 - RNA, 19 nt, Human
uucauguccugugucaguu

SEQ ID NO: 3227716 - RNA, 17 nt, Human
uucauguccugugucag

SEQ ID NO: 3227717 - RNA, 13 nt, Human
uucauguaauuuu

SEQ ID NO: 3227718 - RNA, 21 nt, Human
uucauguaauuuuauuuuaaa

SEQ ID NO: 3227719 - RNA, 22 nt, Human
auaucugaaaauguauguguaa

SEQ ID NO: 3227720 - RNA, 20 nt, Human
auaugauuuaaaucagccgu

SEQ ID NO: 3227721 - RNA, 15 nt, Human
auaucuuggcaggua

SEQ ID NO: 3227722 - RNA, 23 nt, Human
auaucuugcuugaacuuacaggu

SEQ ID NO: 3227723 - RNA, 14 nt, Human
auaucuugcuugaa

SEQ ID NO: 3227724 - RNA, 16 nt, Human
auaucuucauuucuaa

SEQ ID NO: 3227725 - RNA, 18 nt, Human
auaucuucauuucuaaau

SEQ ID NO: 3227726 - RNA, 18 nt, Human
auaucuucguuaguaauc

SEQ ID NO: 3227727 - RNA, 23 nt, Human
auaucuucguuaguaaucuguau

SEQ ID NO: 3227728 - RNA, 13 nt, Human
auaucugugaaau

SEQ ID NO: 3227729 - RNA, 15 nt, Human
auaucugugaaauau

SEQ ID NO: 3227730 - RNA, 17 nt, Human
auaucugugaaauauca

SEQ ID NO: 3227731 - RNA, 15 nt, Human
auaucuguuagaugc

SEQ ID NO: 3227732 - RNA, 16 nt, Human
auaucuguuagaugcu

SEQ ID NO: 3227733 - RNA, 19 nt, Human
auaucuguuagaugcuacu

SEQ ID NO: 3227734 - RNA, 20 nt, Human
auaucuguuagaugcuacua

SEQ ID NO: 3227735 - RNA, 14 nt, Human
auaucuucauuucu

SEQ ID NO: 3227736 - RNA, 20 nt, Human
uucacuggccacaguuguuu

SEQ ID NO: 3227737 - RNA, 22 nt, Human
uucagaaacaaagcauuugacu

SEQ ID NO: 3227738 - RNA, 15 nt, Human
uucagaaagaagugg

SEQ ID NO: 3227739 - RNA, 15 nt, Human
uucagaaguuuaaau

SEQ ID NO: 3227740 - RNA, 14 nt, Human
uucagaaguuuaaa

SEQ ID NO: 3227741 - RNA, 13 nt, Human
uucagaaguuuaa

SEQ ID NO: 3227742 - RNA, 19 nt, Human
uucacugcuggcugccuua

SEQ ID NO: 3227743 - RNA, 18 nt, Human
uucacugcuggcugccuu

SEQ ID NO: 3227744 - RNA, 17 nt, Human
uucacugcuggcugccu

SEQ ID NO: 3227745 - RNA, 16 nt, Human
uucacugcuggcugcc

SEQ ID NO: 3227746 - RNA, 15 nt, Human
uucacugcuggcugc

SEQ ID NO: 3227747 - RNA, 13 nt, Human
uucacugcuggcu

SEQ ID NO: 3227748 - RNA, 16 nt, Human
auauauagcauuuaug

SEQ ID NO: 3227749 - RNA, 14 nt, Human
auauauagcauuua

SEQ ID NO: 3227750 - RNA, 21 nt, Human
uucagccacugagggacaaaa

SEQ ID NO: 3227751 - RNA, 17 nt, Human
uucagccacugagggac

SEQ ID NO: 3227752 - RNA, 14 nt, Human
uucagccaagaauu

SEQ ID NO: 3227753 - RNA, 19 nt, Human
uucagccaagaauucuuaa

SEQ ID NO: 3227754 - RNA, 22 nt, Human
uucagcaaacuuguugaauuua

SEQ ID NO: 3227755 - RNA, 15 nt, Human
uucagcaaacuuguu

SEQ ID NO: 3227756 - RNA, 21 nt, Human
uucagcaaggcgcuaacuugc

SEQ ID NO: 3227757 - RNA, 22 nt, Human
auauaagcccuugauuggaagg

SEQ ID NO: 3227758 - RNA, 16 nt, Human
auauaaauugucuuaa

SEQ ID NO: 3227759 - RNA, 14 nt, Human
auauaggacauuga

SEQ ID NO: 3227760 - RNA, 14 nt, Human
auagucaagacgaa

SEQ ID NO: 3227761 - RNA, 21 nt, Human
auagucaagacgaacauguag

SEQ ID NO: 3227762 - RNA, 19 nt, Human
auaguuuauuuuaaaacaa

SEQ ID NO: 3227763 - RNA, 12 nt, Human
auauaaaauaac

SEQ ID NO: 3227764 - RNA, 13 nt, Human
auauaaaauaacu

SEQ ID NO: 3227765 - RNA, 13 nt, Human
auauaaacagcuu

SEQ ID NO: 3227766 - RNA, 23 nt, Human
auauaaaauggcaacaaacugca

SEQ ID NO: 3227767 - RNA, 19 nt, Human
auauaaaauggcaacaaac

SEQ ID NO: 3227768 - RNA, 14 nt, Human
auauaaaauggcaa

SEQ ID NO: 3227769 - RNA, 12 nt, Human
auauaaaaugcc

SEQ ID NO: 3227770 - RNA, 15 nt, Human
auauaaaaugccaag

SEQ ID NO: 3227771 - RNA, 13 nt, Human
auauaaaaugcca

SEQ ID NO: 3227772 - RNA, 11 nt, Human
auauaaaugug

SEQ ID NO: 3227773 - RNA, 12 nt, Human
auauaaaugugu

SEQ ID NO: 3227774 - RNA, 14 nt, Human
auauaaaugugugu

SEQ ID NO: 3227775 - RNA, 16 nt, Human
auauaaauguguguau

SEQ ID NO: 3227776 - RNA, 14 nt, Human
uuuguacagacaac

SEQ ID NO: 3227777 - RNA, 21 nt, Human
uuuguacacccaugaaagaaa

SEQ ID NO: 3227778 - RNA, 17 nt, Human
uuuguacaagauuguca

SEQ ID NO: 3227779 - RNA, 13 nt, Human
uuuguaauuuaag

SEQ ID NO: 3227780 - RNA, 19 nt, Human
uuuguaagauauuugcagu

SEQ ID NO: 3227781 - RNA, 16 nt, Human
augugaucucauuguu

SEQ ID NO: 3227782 - RNA, 18 nt, Human
augugauccuuuuggagu

SEQ ID NO: 3227783 - RNA, 11 nt, Human
augugaucuca

SEQ ID NO: 3227784 - RNA, 23 nt, Human
uuugucuuaaaaaguggaaaaau

SEQ ID NO: 3227785 - RNA, 13 nt, Human
uuugucuuaaaaa

SEQ ID NO: 3227786 - RNA, 14 nt, Human
uuugucuuaaaaag

SEQ ID NO: 3227787 - RNA, 16 nt, Human
uuugugauguacugua

SEQ ID NO: 3227788 - RNA, 14 nt, Human
uuuguuucugaaag

SEQ ID NO: 3227789 - RNA, 16 nt, Human
uuuguuucugaaaggg

SEQ ID NO: 3227790 - RNA, 16 nt, Human
uuuguuuguucuuguu

SEQ ID NO: 3227791 - RNA, 15 nt, Human
augucgccucugcau

SEQ ID NO: 3227792 - RNA, 22 nt, Human
augucguaguuacucucaggca

SEQ ID NO: 3227793 - RNA, 19 nt, Human
augucguaguuacucucag

SEQ ID NO: 3227794 - RNA, 18 nt, Human
augucgucgagcuccccc

SEQ ID NO: 3227795 - RNA, 13 nt, Human
augugagaccauu

SEQ ID NO: 3227796 - RNA, 13 nt, Human
augugacuuugaa

SEQ ID NO: 3227797 - RNA, 22 nt, Human
augugacauuugucauuuucau

SEQ ID NO: 3227798 - RNA, 19 nt, Human
augugacauuugucauuuu

SEQ ID NO: 3227799 - RNA, 18 nt, Human
augugacauuugucauuu

SEQ ID NO: 3227800 - RNA, 15 nt, Human
augugacauuuguca

SEQ ID NO: 3227801 - RNA, 14 nt, Human
augugacauuuguc

SEQ ID NO: 3227802 - RNA, 13 nt, Human
augugacauuugu

SEQ ID NO: 3227803 - RNA, 11 nt, Human
augugacauuu

SEQ ID NO: 3227804 - RNA, 21 nt, Human
augugacuuugaaaauauaua

SEQ ID NO: 3227805 - RNA, 23 nt, Human
augugagcugcugccaugaacug

SEQ ID NO: 3227806 - RNA, 19 nt, Human
augugagcugcugccauga

SEQ ID NO: 3227807 - RNA, 16 nt, Human
augugagcugcugcca

SEQ ID NO: 3227808 - RNA, 15 nt, Human
augugagcugcugcc

SEQ ID NO: 3227809 - RNA, 14 nt, Human
augugaguauucuc

SEQ ID NO: 3227810 - RNA, 15 nt, Human
augugagugguugaa

SEQ ID NO: 3227811 - RNA, 17 nt, Human
augugaguauucucauu

SEQ ID NO: 3227812 - RNA, 16 nt, Human
augugagugguugaau

SEQ ID NO: 3227813 - RNA, 19 nt, Human
augugagugguugaauaug

SEQ ID NO: 3227814 - RNA, 22 nt, Human
augugagugguugaauaugauu

SEQ ID NO: 3227815 - RNA, 19 nt, Human
augugauauaaacagcuuc

SEQ ID NO: 3227816 - RNA, 18 nt, Human
augugauauaaacagcuu

SEQ ID NO: 3227817 - RNA, 16 nt, Human
augucccuuucuucuc

SEQ ID NO: 3227818 - RNA, 18 nt, Human
augucccuuucuucuccc

SEQ ID NO: 3227819 - RNA, 17 nt, Human
augucccuuucuucucc

SEQ ID NO: 3227820 - RNA, 15 nt, Human
auguccuagacaggu

SEQ ID NO: 3227821 - RNA, 16 nt, Human
auguccuaauggugau

SEQ ID NO: 3227822 - RNA, 15 nt, Human
auguccuaaugguga

SEQ ID NO: 3227823 - RNA, 16 nt, Human
auguccaagaagccca

SEQ ID NO: 3227824 - RNA, 17 nt, Human
auguccaagaagcccag

SEQ ID NO: 3227825 - RNA, 19 nt, Human
auguauauuuuauaucaau

SEQ ID NO: 3227826 - RNA, 22 nt, Human
auguauaugaacuuaacaugcu

SEQ ID NO: 3227827 - RNA, 12 nt, Human
auguaucaauga

SEQ ID NO: 3227828 - RNA, 14 nt, Human
augucauaaaguga

SEQ ID NO: 3227829 - RNA, 23 nt, Human
augucauaaagugagaaaacugu

SEQ ID NO: 3227830 - RNA, 18 nt, Human
auguauauuuuauauaaa

SEQ ID NO: 3227831 - RNA, 17 nt, Human
auguaucaaauacauuu

SEQ ID NO: 3227832 - RNA, 14 nt, Human
augucauuucaugu

SEQ ID NO: 3227833 - RNA, 13 nt, Human
augucauuucaug

SEQ ID NO: 3227834 - RNA, 14 nt, Human
uuugauccaagcug

SEQ ID NO: 3227835 - RNA, 15 nt, Human
uuugauccaagcugg

SEQ ID NO: 3227836 - RNA, 22 nt, Human
uuugaucuuccucugcuaaauu

SEQ ID NO: 3227837 - RNA, 18 nt, Human
uuugaucuuccucugcua

SEQ ID NO: 3227838 - RNA, 20 nt, Human
uuugaucuuccucugcuaaa

SEQ ID NO: 3227839 - RNA, 19 nt, Human
uuugaucuuccucugcuaa

SEQ ID NO: 3227840 - RNA, 14 nt, Human
uuugaucucacauu

SEQ ID NO: 3227841 - RNA, 18 nt, Human
uuugaucucacauuuuua

SEQ ID NO: 3227842 - RNA, 16 nt, Human
uuugaucucacauuuu

SEQ ID NO: 3227843 - RNA, 12 nt, Human
uuugauucacau

SEQ ID NO: 3227844 - RNA, 15 nt, Human
uuugauucagacagc

SEQ ID NO: 3227845 - RNA, 22 nt, Human
uuugauucacauguuuucaaau

SEQ ID NO: 3227846 - RNA, 21 nt, Human
uuugauucacauguuuucaaa

SEQ ID NO: 3227847 - RNA, 20 nt, Human
uuugauucacauguuuucaa

SEQ ID NO: 3227848 - RNA, 19 nt, Human
uuugauucacauguuuuca

SEQ ID NO: 3227849 - RNA, 18 nt, Human
uuugauucacauguuuuc

SEQ ID NO: 3227850 - RNA, 16 nt, Human
uuugauucacauguuu

SEQ ID NO: 3227851 - RNA, 14 nt, Human
uuugauucacaugu

SEQ ID NO: 3227852 - RNA, 13 nt, Human
uuugauucacaug

SEQ ID NO: 3227853 - RNA, 23 nt, Human
uuugaccuguugggagugaggau

SEQ ID NO: 3227854 - RNA, 13 nt, Human
uuugagacagagu

SEQ ID NO: 3227855 - RNA, 22 nt, Human
uuugagagagagucuuacucug

SEQ ID NO: 3227856 - RNA, 18 nt, Human
uuugagagagcagccagg

SEQ ID NO: 3227857 - RNA, 14 nt, Human
uuucccuuccaguu

SEQ ID NO: 3227858 - RNA, 13 nt, Human
uuucccuuccagu

SEQ ID NO: 3227859 - RNA, 12 nt, Human
uuucccuuccag

SEQ ID NO: 3227860 - RNA, 16 nt, Human
uuugaauuaucagcaa

SEQ ID NO: 3227861 - RNA, 17 nt, Human
uuugaauuuucauuuua

SEQ ID NO: 3227862 - RNA, 23 nt, Human
uuucccucccuuccucuuuccau

SEQ ID NO: 3227863 - RNA, 16 nt, Human
uuucccucagaaaaug

SEQ ID NO: 3227864 - RNA, 21 nt, Human
uuucccugaaguuauguguau

SEQ ID NO: 3227865 - RNA, 13 nt, Human
uuucccugaaguu

SEQ ID NO: 3227866 - RNA, 23 nt, Human
uuugacaagcuggcuuacacugg

SEQ ID NO: 3227867 - RNA, 23 nt, Human
uuugaauuuucauuuuacaguua

SEQ ID NO: 3227868 - RNA, 20 nt, Human
uuugaauuuucauuuuacag

SEQ ID NO: 3227869 - RNA, 18 nt, Human
uuuggcaaacucuccacc

SEQ ID NO: 3227870 - RNA, 15 nt, Human
uuuggcuccugccca

SEQ ID NO: 3227871 - RNA, 14 nt, Human
uuuggcuccugccc

SEQ ID NO: 3227872 - RNA, 13 nt, Human
uuuggcuccugcc

SEQ ID NO: 3227873 - RNA, 12 nt, Human
uuuggcugcuga

SEQ ID NO: 3227874 - RNA, 13 nt, Human
uuuggcugcugaa

SEQ ID NO: 3227875 - RNA, 14 nt, Human
uuugggcugaaugu

SEQ ID NO: 3227876 - RNA, 19 nt, Human
uuugggcugaauguaugua

SEQ ID NO: 3227877 - RNA, 14 nt, Human
uuugggcugcccug

SEQ ID NO: 3227878 - RNA, 17 nt, Human
uuugggcagagaggcug

SEQ ID NO: 3227879 - RNA, 17 nt, Human
auguauauaaacaugcu

SEQ ID NO: 3227880 - RNA, 13 nt, Human
auguauauaaaaa

SEQ ID NO: 3227881 - RNA, 14 nt, Human
auguauauaaaaau

SEQ ID NO: 3227882 - RNA, 15 nt, Human
auguauauaaaaaug

SEQ ID NO: 3227883 - RNA, 20 nt, Human
auguauaguauuugaaaaca

SEQ ID NO: 3227884 - RNA, 18 nt, Human
auguauaguauuugaaaa

SEQ ID NO: 3227885 - RNA, 17 nt, Human
auguauaguauuugaaa

SEQ ID NO: 3227886 - RNA, 16 nt, Human
auguauaguauuugaa

SEQ ID NO: 3227887 - RNA, 14 nt, Human
auguauaguauuug

SEQ ID NO: 3227888 - RNA, 21 nt, Human
auguauaauucaaagcaccaa

SEQ ID NO: 3227889 - RNA, 14 nt, Human
auguauacaugugc

SEQ ID NO: 3227890 - RNA, 21 nt, Human
uuugggguacccacugcucug

SEQ ID NO: 3227891 - RNA, 23 nt, Human
uuugggcuuguuguuuguaacaa

SEQ ID NO: 3227892 - RNA, 22 nt, Human
uuugggguacccacugcucugg

SEQ ID NO: 3227893 - RNA, 20 nt, Human
uuugcuggagcucugcccau

SEQ ID NO: 3227894 - RNA, 22 nt, Human
uuuggauuggaugaauuccaaa

SEQ ID NO: 3227895 - RNA, 18 nt, Human
uuuggauuauucuuucuc

SEQ ID NO: 3227896 - RNA, 22 nt, Human
uuugcgaauauuuuguaaauua

SEQ ID NO: 3227897 - RNA, 22 nt, Human
uuugcaaaaauccaaauauugu

SEQ ID NO: 3227898 - RNA, 15 nt, Human
uuugcaaaggagcuc

SEQ ID NO: 3227899 - RNA, 13 nt, Human
uuugauuuauuaa

SEQ ID NO: 3227900 - RNA, 16 nt, Human
uuugauuuauuaacuu

SEQ ID NO: 3227901 - RNA, 21 nt, Human
uuugauuuauuaacuuaauaa

SEQ ID NO: 3227902 - RNA, 14 nt, Human
uuugauuugucacu

SEQ ID NO: 3227903 - RNA, 14 nt, Human
uuugauuuguacag

SEQ ID NO: 3227904 - RNA, 16 nt, Human
auguuaaccucugcuu

SEQ ID NO: 3227905 - RNA, 19 nt, Human
auguuaaccucugcuuuua

SEQ ID NO: 3227906 - RNA, 19 nt, Human
auguuacauaagauaaaug

SEQ ID NO: 3227907 - RNA, 20 nt, Human
auguuaauuuguguguuuuu

SEQ ID NO: 3227908 - RNA, 18 nt, Human
auguuaacaaugccuauu

SEQ ID NO: 3227909 - RNA, 21 nt, Human
auguuaacaaugccuauugua

SEQ ID NO: 3227910 - RNA, 22 nt, Human
auguuaacaaugccuauuguaa

SEQ ID NO: 3227911 - RNA, 23 nt, Human
auguuaacaaugccuauuguaau

SEQ ID NO: 3227912 - RNA, 20 nt, Human
auguuacauaagauaaaugu

SEQ ID NO: 3227913 - RNA, 13 nt, Human
auguuauguauau

SEQ ID NO: 3227914 - RNA, 12 nt, Human
auguuauguaua

SEQ ID NO: 3227915 - RNA, 16 nt, Human
auguuauguauauggu

SEQ ID NO: 3227916 - RNA, 15 nt, Human
auguugcccaggcag

SEQ ID NO: 3227917 - RNA, 14 nt, Human
auguugcccaggca

SEQ ID NO: 3227918 - RNA, 18 nt, Human
auguugaaagaucaaaag

SEQ ID NO: 3227919 - RNA, 13 nt, Human
auguugcccaggc

SEQ ID NO: 3227920 - RNA, 20 nt, Human
auguucuuucacccuuuucu

SEQ ID NO: 3227921 - RNA, 12 nt, Human
auguucaauuau

SEQ ID NO: 3227922 - RNA, 18 nt, Human
auguucaauuauuucccc

SEQ ID NO: 3227923 - RNA, 12 nt, Human
auguugaaagau

SEQ ID NO: 3227924 - RNA, 21 nt, Human
auguugaaaaaauuuaaaagu

SEQ ID NO: 3227925 - RNA, 21 nt, Human
uuuuagacccuauugcugcuu

SEQ ID NO: 3227926 - RNA, 21 nt, Human
auguuggcagaugcagcucuu

SEQ ID NO: 3227927 - RNA, 18 nt, Human
uuuuagaauuuugugaaa

SEQ ID NO: 3227928 - RNA, 20 nt, Human
auguuggcagaugcagcucu

SEQ ID NO: 3227929 - RNA, 19 nt, Human
auguuggcagaugcagcuc

SEQ ID NO: 3227930 - RNA, 15 nt, Human
auguugaacaaaaua

SEQ ID NO: 3227931 - RNA, 13 nt, Human
auguugaacaaaa

SEQ ID NO: 3227932 - RNA, 19 nt, Human
auguugcuaugugccuuau

SEQ ID NO: 3227933 - RNA, 22 nt, Human
auguugcuaugugccuuauguu

SEQ ID NO: 3227934 - RNA, 19 nt, Human
auguugaacaaaauaaauu

SEQ ID NO: 3227935 - RNA, 13 nt, Human
auguuaaagaugu

SEQ ID NO: 3227936 - RNA, 17 nt, Human
auguuaaagauguagca

SEQ ID NO: 3227937 - RNA, 15 nt, Human
auguuaaagauguag

SEQ ID NO: 3227938 - RNA, 20 nt, Human
auguuaaagauguagcaaac

SEQ ID NO: 3227939 - RNA, 18 nt, Human
auguuaaagauguagcaa

SEQ ID NO: 3227940 - RNA, 17 nt, Human
auguguuuagaauugaa

SEQ ID NO: 3227941 - RNA, 20 nt, Human
auguguuuagaauugaaggu

SEQ ID NO: 3227942 - RNA, 14 nt, Human
auguguuuagaauu

SEQ ID NO: 3227943 - RNA, 16 nt, Human
auguguuuagaauuga

SEQ ID NO: 3227944 - RNA, 13 nt, Human
auguguuuagaau

SEQ ID NO: 3227945 - RNA, 14 nt, Human
auguguguuucugu

SEQ ID NO: 3227946 - RNA, 12 nt, Human
auguguuuagaa

SEQ ID NO: 3227947 - RNA, 13 nt, Human
augugugugaugu

SEQ ID NO: 3227948 - RNA, 23 nt, Human
auguggaaaagccaagaggcugc

SEQ ID NO: 3227949 - RNA, 18 nt, Human
auguguguguguugugug

SEQ ID NO: 3227950 - RNA, 22 nt, Human
auguguguguguuguguguggg

SEQ ID NO: 3227951 - RNA, 23 nt, Human
auguguguguguuguguguggga

SEQ ID NO: 3227952 - RNA, 16 nt, Human
auguguguaugugugu

SEQ ID NO: 3227953 - RNA, 14 nt, Human
auguguguaugugu

SEQ ID NO: 3227954 - RNA, 13 nt, Human
auguguguaugug

SEQ ID NO: 3227955 - RNA, 17 nt, Human
augugcucaucagaaac

SEQ ID NO: 3227956 - RNA, 16 nt, Human
augugcucaucagaaa

SEQ ID NO: 3227957 - RNA, 13 nt, Human
augugcuauuaau

SEQ ID NO: 3227958 - RNA, 16 nt, Human
augugcuauuaauauu

SEQ ID NO: 3227959 - RNA, 17 nt, Human
augugcuauuaauauuu

SEQ ID NO: 3227960 - RNA, 18 nt, Human
augugcuauuaauauuug

SEQ ID NO: 3227961 - RNA, 19 nt, Human
augugcuauuaauauuugu

SEQ ID NO: 3227962 - RNA, 20 nt, Human
augugcugcuuugauauaua

SEQ ID NO: 3227963 - RNA, 19 nt, Human
augugcugcuuugauauau

SEQ ID NO: 3227964 - RNA, 16 nt, Human
augugcugcuuugaua

SEQ ID NO: 3227965 - RNA, 22 nt, Human
augugcuauaaucuguuuuuac

SEQ ID NO: 3227966 - RNA, 14 nt, Human
augugcugcuuuga

SEQ ID NO: 3227967 - RNA, 13 nt, Human
augugcugcuuug

SEQ ID NO: 3227968 - RNA, 16 nt, Human
augugccacauuuucu

SEQ ID NO: 3227969 - RNA, 18 nt, Human
uuuuaaaaaacugcugac

SEQ ID NO: 3227970 - RNA, 18 nt, Human
uuuguuuuuuguuuuucu

SEQ ID NO: 3227971 - RNA, 19 nt, Human
uuuguuuuuugagucuuuu

SEQ ID NO: 3227972 - RNA, 18 nt, Human
uuuguuuuuugagucuuu

SEQ ID NO: 3227973 - RNA, 16 nt, Human
uuuguuuuuugagucu

SEQ ID NO: 3227974 - RNA, 15 nt, Human
uuuguuuuucugcuu

SEQ ID NO: 3227975 - RNA, 16 nt, Human
uuuguuuuuugaagug

SEQ ID NO: 3227976 - RNA, 19 nt, Human
uuuguuuuuugaaguguug

SEQ ID NO: 3227977 - RNA, 17 nt, Human
uuuguuuuuugaagugu

SEQ ID NO: 3227978 - RNA, 11 nt, Human
uuuguuuuguu

SEQ ID NO: 3227979 - RNA, 14 nt, Human
uuuguuuuguugca

SEQ ID NO: 3227980 - RNA, 15 nt, Human
auuaaaaaaaaauug

SEQ ID NO: 3227981 - RNA, 17 nt, Human
auuaaaaaaaaauugua

SEQ ID NO: 3227982 - RNA, 22 nt, Human
auuaaaaaacuucauguaauuu

SEQ ID NO: 3227983 - RNA, 19 nt, Human
auuaaaacacaacaucuuu

SEQ ID NO: 3227984 - RNA, 20 nt, Human
auguuuauuaaaugcuucau

SEQ ID NO: 3227985 - RNA, 13 nt, Human
auguuuuuaaaau

SEQ ID NO: 3227986 - RNA, 22 nt, Human
auguuuuucaguucaaagucau

SEQ ID NO: 3227987 - RNA, 19 nt, Human
auguuuuucaguucaaagu

SEQ ID NO: 3227988 - RNA, 17 nt, Human
auguuuuucaguucaaa

SEQ ID NO: 3227989 - RNA, 16 nt, Human
auguuuuucaguucaa

SEQ ID NO: 3227990 - RNA, 13 nt, Human
auguuuuucaguu

SEQ ID NO: 3227991 - RNA, 23 nt, Human
auguuuuuaaaaucuuauuaaag

SEQ ID NO: 3227992 - RNA, 17 nt, Human
auguuuuuaaaaucuua

SEQ ID NO: 3227993 - RNA, 16 nt, Human
auguuuuuaaaaucuu

SEQ ID NO: 3227994 - RNA, 15 nt, Human
auguuuuuaaaaucu

SEQ ID NO: 3227995 - RNA, 14 nt, Human
auguuuuuaaaauc

SEQ ID NO: 3227996 - RNA, 22 nt, Human
auguuuaaaguaauuguuccag

SEQ ID NO: 3227997 - RNA, 21 nt, Human
auguuuaaaguaauuguucca

SEQ ID NO: 3227998 - RNA, 18 nt, Human
auguuuaaaguaauuguu

SEQ ID NO: 3227999 - RNA, 14 nt, Human
auguuuaaaguaau

SEQ ID NO: 3228000 - RNA, 14 nt, Human
auguuuaagcagaa

SEQ ID NO: 3228001 - RNA, 20 nt, Human
auguuuaagcagaauuggaa

SEQ ID NO: 3228002 - RNA, 16 nt, Human
auguuuaagcagaauu

SEQ ID NO: 3228003 - RNA, 22 nt, Human
auguuuaagcagaauuggaaaa

SEQ ID NO: 3228004 - RNA, 21 nt, Human
auguuuaagcagaauuggaaa

SEQ ID NO: 3228005 - RNA, 17 nt, Human
auguuggccaggcuggu

SEQ ID NO: 3228006 - RNA, 18 nt, Human
uuuucuguguguuccugg

SEQ ID NO: 3228007 - RNA, 19 nt, Human
uuuucuguguguuccuggc

SEQ ID NO: 3228008 - RNA, 22 nt, Human
uuuucuguuaccucaacaagaa

SEQ ID NO: 3228009 - RNA, 22 nt, Human
uuuucugcuuuagacuugaaaa

SEQ ID NO: 3228010 - RNA, 15 nt, Human
uuuucugcuuuagac

SEQ ID NO: 3228011 - RNA, 19 nt, Human
uuuucugcuuuagacuuga

SEQ ID NO: 3228012 - RNA, 12 nt, Human
uuuucugcuuua

SEQ ID NO: 3228013 - RNA, 12 nt, Human
uuuucuuaaaaa

SEQ ID NO: 3228014 - RNA, 14 nt, Human
uuuucuuaaaaagu

SEQ ID NO: 3228015 - RNA, 13 nt, Human
uuuucuuaaaaag

SEQ ID NO: 3228016 - RNA, 16 nt, Human
auguuggccaggcugg

SEQ ID NO: 3228017 - RNA, 22 nt, Human
uuuuauuaagcuuuuuggaauc

SEQ ID NO: 3228018 - RNA, 12 nt, Human
uuuuauuaauca

SEQ ID NO: 3228019 - RNA, 13 nt, Human
uuuuauuaaucac

SEQ ID NO: 3228020 - RNA, 14 nt, Human
uuuuauuaaucacu

SEQ ID NO: 3228021 - RNA, 15 nt, Human
uuuuauuaaucacug

SEQ ID NO: 3228022 - RNA, 12 nt, Human
uuuuauuaaauu

SEQ ID NO: 3228023 - RNA, 13 nt, Human
uuuuauucuugau

SEQ ID NO: 3228024 - RNA, 13 nt, Human
uuuuauucuuuuu

SEQ ID NO: 3228025 - RNA, 23 nt, Human
uuuuauuaaucacuguguauauu

SEQ ID NO: 3228026 - RNA, 23 nt, Human
uuuuauuccugcccugcuguuua

SEQ ID NO: 3228027 - RNA, 18 nt, Human
uuuuauuaaucacugugu

SEQ ID NO: 3228028 - RNA, 20 nt, Human
uuuuauuaaucacuguguau

SEQ ID NO: 3228029 - RNA, 21 nt, Human
uuuuauuaaucacuguguaua

SEQ ID NO: 3228030 - RNA, 22 nt, Human
uuuuauuaaucacuguguauau

SEQ ID NO: 3228031 - RNA, 23 nt, Human
uuuuaguggacccugaaaugugu

SEQ ID NO: 3228032 - RNA, 18 nt, Human
uuuuagugugugcauaau

SEQ ID NO: 3228033 - RNA, 19 nt, Human
uuuuagugugugcauaaua

SEQ ID NO: 3228034 - RNA, 21 nt, Human
uuuuaguggacccugaaaugu

SEQ ID NO: 3228035 - RNA, 20 nt, Human
uuuuaguggacccugaaaug

SEQ ID NO: 3228036 - RNA, 15 nt, Human
uuuuaguagagacag

SEQ ID NO: 3228037 - RNA, 17 nt, Human
uuuuagguuuaucuuuu

SEQ ID NO: 3228038 - RNA, 14 nt, Human
uuuuaguaaguuaa

SEQ ID NO: 3228039 - RNA, 18 nt, Human
uuuuaguaaguuaaugua

SEQ ID NO: 3228040 - RNA, 20 nt, Human
uuuuccagagcauuccaguc

SEQ ID NO: 3228041 - RNA, 19 nt, Human
uuuuccagagcauuccagu

SEQ ID NO: 3228042 - RNA, 13 nt, Human
uuuuauuguugaa

SEQ ID NO: 3228043 - RNA, 19 nt, Human
uuuucagcuaggaacaaau

SEQ ID NO: 3228044 - RNA, 21 nt, Human
uuuucagcuaggaacaaaucu

SEQ ID NO: 3228045 - RNA, 21 nt, Human
uuuucaggugcucaaaaugca

SEQ ID NO: 3228046 - RNA, 18 nt, Human
uuuucaggugcucaaaau

SEQ ID NO: 3228047 - RNA, 23 nt, Human
uuuucagcuaggaacaaaucuuc

SEQ ID NO: 3228048 - RNA, 22 nt, Human
uuuucagcuaggaacaaaucuu

SEQ ID NO: 3228049 - RNA, 22 nt, Human
uuuucucugauacuuuuuugaa

SEQ ID NO: 3228050 - RNA, 14 nt, Human
uuuucucuuagaaa

SEQ ID NO: 3228051 - RNA, 14 nt, Human
uuuucucuucauau

SEQ ID NO: 3228052 - RNA, 13 nt, Human
uuuucucuucaua

SEQ ID NO: 3228053 - RNA, 16 nt, Human
uuuucucuuaucugug

SEQ ID NO: 3228054 - RNA, 23 nt, Human
uuuucuacucgaguuacagacaa

SEQ ID NO: 3228055 - RNA, 18 nt, Human
auucaggggaaacuugau

SEQ ID NO: 3228056 - RNA, 16 nt, Human
auucagugaugugccu

SEQ ID NO: 3228057 - RNA, 19 nt, Human
auucagcauuagugggaaa

SEQ ID NO: 3228058 - RNA, 12 nt, Human
auucagcaucug

SEQ ID NO: 3228059 - RNA, 14 nt, Human
auucagauuucucu

SEQ ID NO: 3228060 - RNA, 20 nt, Human
auucagauuucucuuugaaa

SEQ ID NO: 3228061 - RNA, 19 nt, Human
auucagauuucucuuugaa

SEQ ID NO: 3228062 - RNA, 20 nt, Human
auucagcaaggcgcuaacuu

SEQ ID NO: 3228063 - RNA, 23 nt, Human
auucagcaaggcgcuaacuugcu

SEQ ID NO: 3228064 - RNA, 21 nt, Human
auucagcaaggcgcuaacuug

SEQ ID NO: 3228065 - RNA, 20 nt, Human
auucacuuugacacuuuuca

SEQ ID NO: 3228066 - RNA, 20 nt, Human
auucagaaaugacuuuuuga

SEQ ID NO: 3228067 - RNA, 12 nt, Human
auuccacagcug

SEQ ID NO: 3228068 - RNA, 23 nt, Human
auuccaagucagaaacuguuucu

SEQ ID NO: 3228069 - RNA, 17 nt, Human
auucccaagcucugcuc

SEQ ID NO: 3228070 - RNA, 18 nt, Human
auuccagagaguggcucc

SEQ ID NO: 3228071 - RNA, 18 nt, Human
auuccagaaugaagaauu

SEQ ID NO: 3228072 - RNA, 23 nt, Human
auuccagacagucacaaauuucu

SEQ ID NO: 3228073 - RNA, 16 nt, Human
auuccagacagucaca

SEQ ID NO: 3228074 - RNA, 19 nt, Human
auucccaagcucugcuccu

SEQ ID NO: 3228075 - RNA, 18 nt, Human
auucccaagcucugcucc

SEQ ID NO: 3228076 - RNA, 19 nt, Human
auuccccaggaggccagcc

SEQ ID NO: 3228077 - RNA, 20 nt, Human
auuccccaggaggccagccu

SEQ ID NO: 3228078 - RNA, 22 nt, Human
auuccccaggaggccagccuug

SEQ ID NO: 3228079 - RNA, 15 nt, Human
auuauucaggcuuua

SEQ ID NO: 3228080 - RNA, 18 nt, Human
auuauaucagacugcuuu

SEQ ID NO: 3228081 - RNA, 20 nt, Human
auuagacuucuguuuucaau

SEQ ID NO: 3228082 - RNA, 19 nt, Human
auuagacuucuguuuucaa

SEQ ID NO: 3228083 - RNA, 22 nt, Human
auuauaaacaagaaugaagguu

SEQ ID NO: 3228084 - RNA, 19 nt, Human
auuauaaacucauuuugcu

SEQ ID NO: 3228085 - RNA, 17 nt, Human
auuauaaacucauuuug

SEQ ID NO: 3228086 - RNA, 18 nt, Human
auuauaaacaagaaugaa

SEQ ID NO: 3228087 - RNA, 11 nt, Human
auuauaaaaau

SEQ ID NO: 3228088 - RNA, 13 nt, Human
auuauaaaaauau

SEQ ID NO: 3228089 - RNA, 14 nt, Human
auuauaaaaauauu

SEQ ID NO: 3228090 - RNA, 22 nt, Human
auuauaaaaauauuaagacaau

SEQ ID NO: 3228091 - RNA, 15 nt, Human
auucaaaaauuucac

SEQ ID NO: 3228092 - RNA, 19 nt, Human
auucaaaaagucacaguua

SEQ ID NO: 3228093 - RNA, 12 nt, Human
auucaaaaaguc

SEQ ID NO: 3228094 - RNA, 22 nt, Human
auuauuguccuuugauuccaaa

SEQ ID NO: 3228095 - RNA, 14 nt, Human
auuauugaugaaaa

SEQ ID NO: 3228096 - RNA, 21 nt, Human
auuauuggaaaggaccuaaaa

SEQ ID NO: 3228097 - RNA, 22 nt, Human
auucaaacagucucaggaaauc

SEQ ID NO: 3228098 - RNA, 18 nt, Human
auucaaacugaaaagcug

SEQ ID NO: 3228099 - RNA, 15 nt, Human
auucaaaccuaaguu

SEQ ID NO: 3228100 - RNA, 20 nt, Human
auucaaacagucucaggaaa

SEQ ID NO: 3228101 - RNA, 14 nt, Human
auucaaagaaucac

SEQ ID NO: 3228102 - RNA, 19 nt, Human
auucaaagcaccaaaauaa

SEQ ID NO: 3228103 - RNA, 12 nt, Human
auucaaagcaug

SEQ ID NO: 3228104 - RNA, 21 nt, Human
auucaaagaaucaccuaauua

SEQ ID NO: 3228105 - RNA, 13 nt, Human
auucaaagagaaa

SEQ ID NO: 3228106 - RNA, 14 nt, Human
auucaaagagaaaa

SEQ ID NO: 3228107 - RNA, 13 nt, Human
auucaccuucagu

SEQ ID NO: 3228108 - RNA, 19 nt, Human
uuuuuguaaagauuucugu

SEQ ID NO: 3228109 - RNA, 14 nt, Human
uuuuuguaaagauu

SEQ ID NO: 3228110 - RNA, 10 nt, Human
uuuuuguaaa

SEQ ID NO: 3228111 - RNA, 9 nt, Human
uuuuuguau

SEQ ID NO: 3228112 - RNA, 22 nt, Human
uuuuuguauauugguuuuauga

SEQ ID NO: 3228113 - RNA, 22 nt, Human
uuuuugggaaaagaaaagucaa

SEQ ID NO: 3228114 - RNA, 13 nt, Human
auuaaggaagaca

SEQ ID NO: 3228115 - RNA, 11 nt, Human
uuuuuguauuu

SEQ ID NO: 3228116 - RNA, 20 nt, Human
auuaagcccacaguauauuu

SEQ ID NO: 3228117 - RNA, 11 nt, Human
uuuuuguauuc

SEQ ID NO: 3228118 - RNA, 17 nt, Human
auuaagcuuuuuggaau

SEQ ID NO: 3228119 - RNA, 18 nt, Human
auuaagcuuuuuggaauc

SEQ ID NO: 3228120 - RNA, 19 nt, Human
auuaaguacuauguaucaa

SEQ ID NO: 3228121 - RNA, 16 nt, Human
auuaaguacuauguau

SEQ ID NO: 3228122 - RNA, 18 nt, Human
auuaaguacuauguauca

SEQ ID NO: 3228123 - RNA, 14 nt, Human
uuuuugaaguguug

SEQ ID NO: 3228124 - RNA, 16 nt, Human
uuuuugagucaaagac

SEQ ID NO: 3228125 - RNA, 14 nt, Human
uuuuugauagcauu

SEQ ID NO: 3228126 - RNA, 19 nt, Human
uuuuugauagcauuguaag

SEQ ID NO: 3228127 - RNA, 13 nt, Human
uuuuugauagcau

SEQ ID NO: 3228128 - RNA, 15 nt, Human
uuuuuggaaagucag

SEQ ID NO: 3228129 - RNA, 17 nt, Human
uuuuuggaaagucagaa

SEQ ID NO: 3228130 - RNA, 15 nt, Human
uuuuuggaagugaaa

SEQ ID NO: 3228131 - RNA, 19 nt, Human
uuuuuggaagugaaaacuu

SEQ ID NO: 3228132 - RNA, 15 nt, Human
uuuuuggacacauuu

SEQ ID NO: 3228133 - RNA, 18 nt, Human
uuuuugcaggagcaguau

SEQ ID NO: 3228134 - RNA, 14 nt, Human
uuuuugcucuaaaa

SEQ ID NO: 3228135 - RNA, 23 nt, Human
uuuuugaaggcagaaagcaaaau

SEQ ID NO: 3228136 - RNA, 22 nt, Human
uuuuugaaggcagaaagcaaaa

SEQ ID NO: 3228137 - RNA, 22 nt, Human
uuuuuauuucugucaguuauga

SEQ ID NO: 3228138 - RNA, 15 nt, Human
uuuuuauuucuccuu

SEQ ID NO: 3228139 - RNA, 21 nt, Human
uuuuuauuuauauguaugugu

SEQ ID NO: 3228140 - RNA, 14 nt, Human
uuuuuauuucuccu

SEQ ID NO: 3228141 - RNA, 13 nt, Human
uuuuuauuuauau

SEQ ID NO: 3228142 - RNA, 22 nt, Human
uuuuuauauuucaaguacacug

SEQ ID NO: 3228143 - RNA, 17 nt, Human
uuuuuauuuauauguau

SEQ ID NO: 3228144 - RNA, 14 nt, Human
uuuuuauuuauaug

SEQ ID NO: 3228145 - RNA, 18 nt, Human
uuuuguugcacugaaguu

SEQ ID NO: 3228146 - RNA, 15 nt, Human
uuuuguugcacugaa

SEQ ID NO: 3228147 - RNA, 13 nt, Human
uuuuguugcacug

SEQ ID NO: 3228148 - RNA, 12 nt, Human
uuuuguugcacu

SEQ ID NO: 3228149 - RNA, 11 nt, Human
uuuuguugcac

SEQ ID NO: 3228150 - RNA, 14 nt, Human
uuuugugcauugga

SEQ ID NO: 3228151 - RNA, 21 nt, Human
uuuuguuccacaaguuaaaua

SEQ ID NO: 3228152 - RNA, 16 nt, Human
uuuuguuacucuuggg

SEQ ID NO: 3228153 - RNA, 21 nt, Human
uuuuguugcacugaaguuuga

SEQ ID NO: 3228154 - RNA, 13 nt, Human
uuuuguuguuucu

SEQ ID NO: 3228155 - RNA, 23 nt, Human
uuuuguuguuucuuaauuuggaa

SEQ ID NO: 3228156 - RNA, 15 nt, Human
uuuuguuuucauuau

SEQ ID NO: 3228157 - RNA, 16 nt, Human
uuuuguuuuugucuua

SEQ ID NO: 3228158 - RNA, 13 nt, Human
uuuuguuuugcuu

SEQ ID NO: 3228159 - RNA, 14 nt, Human
uuuuuauaucuugg

SEQ ID NO: 3228160 - RNA, 21 nt, Human
uuuuuauauuucaaguacacu

SEQ ID NO: 3228161 - RNA, 14 nt, Human
uuuuuauauuucaa

SEQ ID NO: 3228162 - RNA, 21 nt, Human
uuuuuauaccuguuuaaauug

SEQ ID NO: 3228163 - RNA, 17 nt, Human
uuuuuauauauaugcau

SEQ ID NO: 3228164 - RNA, 16 nt, Human
uuuuguuuuuugaguc

SEQ ID NO: 3228165 - RNA, 18 nt, Human
uuuuguuuuucugcuuua

SEQ ID NO: 3228166 - RNA, 15 nt, Human
uuuuguuuuguugca

SEQ ID NO: 3228167 - RNA, 20 nt, Human
uuuuuacaaguuauaguacu

SEQ ID NO: 3228168 - RNA, 13 nt, Human
uuuuuaauuguau

SEQ ID NO: 3228169 - RNA, 19 nt, Human
uuuugugaagugaaggauu

SEQ ID NO: 3228170 - RNA, 22 nt, Human
uuuugugaaauuuuucauauuu

SEQ ID NO: 3228171 - RNA, 20 nt, Human
uuuugugaaauuuuucauau

SEQ ID NO: 3228172 - RNA, 17 nt, Human
uuuugugaaauuuuuca

SEQ ID NO: 3228173 - RNA, 13 nt, Human
uuuugugaaauuu

SEQ ID NO: 3228174 - RNA, 12 nt, Human
uuuugugaaauu

SEQ ID NO: 3228175 - RNA, 15 nt, Human
uuuugugcugcuucu

SEQ ID NO: 3228176 - RNA, 14 nt, Human
uuuugugaguuugu

SEQ ID NO: 3228177 - RNA, 23 nt, Human
uuuugugaguuuguuucuuugaa

SEQ ID NO: 3228178 - RNA, 16 nt, Human
uuuugugguuuggaau

SEQ ID NO: 3228179 - RNA, 17 nt, Human
uuuugugguuuggaaua

SEQ ID NO: 3228180 - RNA, 12 nt, Human
uuuuguguuuau

SEQ ID NO: 3228181 - RNA, 16 nt, Human
uuuuguguugaagagc

SEQ ID NO: 3228182 - RNA, 23 nt, Human
uuuuguguuuauucuugaugaaa

SEQ ID NO: 3228183 - RNA, 14 nt, Human
uuuuggacuuuguu

SEQ ID NO: 3228184 - RNA, 15 nt, Human
uuuuggacuuuguua

SEQ ID NO: 3228185 - RNA, 14 nt, Human
uuuuggaaagucag

SEQ ID NO: 3228186 - RNA, 17 nt, Human
uuuuggaaagucagaau

SEQ ID NO: 3228187 - RNA, 22 nt, Human
uuuuggaaaacgauuuaauuua

SEQ ID NO: 3228188 - RNA, 19 nt, Human
uuuugcuuuaauuccauga

SEQ ID NO: 3228189 - RNA, 13 nt, Human
uuuugcuuuaauu

SEQ ID NO: 3228190 - RNA, 22 nt, Human
uuuugcuugaagcaaacaguug

SEQ ID NO: 3228191 - RNA, 13 nt, Human
uuuugcuuccccu

SEQ ID NO: 3228192 - RNA, 18 nt, Human
uuuugcuuuaauuuuagc

SEQ ID NO: 3228193 - RNA, 17 nt, Human
uuuugcuuuaauuuuag

SEQ ID NO: 3228194 - RNA, 11 nt, Human
uuuugcuuuug

SEQ ID NO: 3228195 - RNA, 13 nt, Human
auuaaaauuguug

SEQ ID NO: 3228196 - RNA, 13 nt, Human
auuaaacaaaguu

SEQ ID NO: 3228197 - RNA, 20 nt, Human
auuaaacaaaguuucagagu

SEQ ID NO: 3228198 - RNA, 23 nt, Human
auuaaaauaugcacuaagucucu

SEQ ID NO: 3228199 - RNA, 17 nt, Human
auuacuguuuaagacac

SEQ ID NO: 3228200 - RNA, 12 nt, Human
auuaauauuugu

SEQ ID NO: 3228201 - RNA, 17 nt, Human
auuaauauuuguuuagu

SEQ ID NO: 3228202 - RNA, 22 nt, Human
auuaaucacccuaccaacuuua

SEQ ID NO: 3228203 - RNA, 12 nt, Human
auuaaucacugu

SEQ ID NO: 3228204 - RNA, 13 nt, Human
auuaaucacugug

SEQ ID NO: 3228205 - RNA, 14 nt, Human
auuaaucacugugu

SEQ ID NO: 3228206 - RNA, 15 nt, Human
auuaaucacugugua

SEQ ID NO: 3228207 - RNA, 16 nt, Human
auuaaucacuguguau

SEQ ID NO: 3228208 - RNA, 17 nt, Human
auuaaucacuguguaua

SEQ ID NO: 3228209 - RNA, 18 nt, Human
auuaaucacuguguauau

SEQ ID NO: 3228210 - RNA, 19 nt, Human
auuaaucacuguguauauu

SEQ ID NO: 3228211 - RNA, 20 nt, Human
auuaaucacuguguauauuu

SEQ ID NO: 3228212 - RNA, 21 nt, Human
auuaaucacuguguauauuug

SEQ ID NO: 3228213 - RNA, 22 nt, Human
auuaaucacuguguauauuuga

SEQ ID NO: 3228214 - RNA, 23 nt, Human
auuaaucacuguguauauuugau

SEQ ID NO: 3228215 - RNA, 16 nt, Human
auuagacuucuguuuu

SEQ ID NO: 3228216 - RNA, 15 nt, Human
auuagacuucuguuu

SEQ ID NO: 3228217 - RNA, 14 nt, Human
auuagacuucuguu

SEQ ID NO: 3228218 - RNA, 13 nt, Human
auuacuucugcua

SEQ ID NO: 3228219 - RNA, 12 nt, Human
auuacuucugcu

SEQ ID NO: 3228220 - RNA, 14 nt, Human
auuacuucugcuac

SEQ ID NO: 3228221 - RNA, 15 nt, Human
auuacuuguugccua

SEQ ID NO: 3228222 - RNA, 19 nt, Human
auuuaugguaaucauauua

SEQ ID NO: 3228223 - RNA, 12 nt, Human
auuuauuacaua

SEQ ID NO: 3228224 - RNA, 17 nt, Human
auuuaguuguuucuaga

SEQ ID NO: 3228225 - RNA, 20 nt, Human
auuuacuucuuauacauuug

SEQ ID NO: 3228226 - RNA, 19 nt, Human
auuuacuucuuauacauuu

SEQ ID NO: 3228227 - RNA, 15 nt, Human
auuuaaaauugugau

SEQ ID NO: 3228228 - RNA, 12 nt, Human
auuuaaaaugua

SEQ ID NO: 3228229 - RNA, 14 nt, Human
auuuacaagaagaa

SEQ ID NO: 3228230 - RNA, 13 nt, Human
auuuacaauguau

SEQ ID NO: 3228231 - RNA, 14 nt, Human
auuuacaauguauu

SEQ ID NO: 3228232 - RNA, 15 nt, Human
auuuacaauguauua

SEQ ID NO: 3228233 - RNA, 16 nt, Human
auuuacaauguauuaa

SEQ ID NO: 3228234 - RNA, 17 nt, Human
auuuacaauguauuaag

SEQ ID NO: 3228235 - RNA, 13 nt, Human
auuuaaaugauuu

SEQ ID NO: 3228236 - RNA, 19 nt, Human
auuuacaagacaacauugu

SEQ ID NO: 3228237 - RNA, 17 nt, Human
auuuacuucuuauacau

SEQ ID NO: 3228238 - RNA, 22 nt, Human
auuuacuacaauauguacauuu

SEQ ID NO: 3228239 - RNA, 17 nt, Human
auuguagagccagaggu

SEQ ID NO: 3228240 - RNA, 18 nt, Human
auuguagagccagagguc

SEQ ID NO: 3228241 - RNA, 17 nt, Human
auuguuuucaguguaca

SEQ ID NO: 3228242 - RNA, 17 nt, Human
auuuaaaaaaaaaccug

SEQ ID NO: 3228243 - RNA, 19 nt, Human
auuguuuucaguguacaug

SEQ ID NO: 3228244 - RNA, 18 nt, Human
auuguuuucaguguacau

SEQ ID NO: 3228245 - RNA, 20 nt, Human
auuguuuuucugauauguuu

SEQ ID NO: 3228246 - RNA, 20 nt, Human
auuuaaaaguaaaaugucuu

SEQ ID NO: 3228247 - RNA, 21 nt, Human
auuuaaaaguaaaaugucuuu

SEQ ID NO: 3228248 - RNA, 14 nt, Human
auuucccaaagcag

SEQ ID NO: 3228249 - RNA, 16 nt, Human
auuucccaaagcagug

SEQ ID NO: 3228250 - RNA, 15 nt, Human
auuuccuauaccauu

SEQ ID NO: 3228251 - RNA, 18 nt, Human
auuucuuaauuauuauaa

SEQ ID NO: 3228252 - RNA, 19 nt, Human
auuucuuaauuauuauaaa

SEQ ID NO: 3228253 - RNA, 22 nt, Human
auuucuuaauuauuauaaaaau

SEQ ID NO: 3228254 - RNA, 23 nt, Human
auuucuuaauuauuauaaaaaua

SEQ ID NO: 3228255 - RNA, 16 nt, Human
auuucgugacuuuuuu

SEQ ID NO: 3228256 - RNA, 15 nt, Human
auuucgcuucuuaga

SEQ ID NO: 3228257 - RNA, 16 nt, Human
auuuccucuugaacca

SEQ ID NO: 3228258 - RNA, 20 nt, Human
auuuauuuuuaagaaagaaa

SEQ ID NO: 3228259 - RNA, 19 nt, Human
auuuauuuuuaagaaagaa

SEQ ID NO: 3228260 - RNA, 18 nt, Human
auuuauuuuuaagaaaga

SEQ ID NO: 3228261 - RNA, 19 nt, Human
auuuauuuuuuuuaauugu

SEQ ID NO: 3228262 - RNA, 21 nt, Human
auuuauuuuuuuuaauuguau

SEQ ID NO: 3228263 - RNA, 15 nt, Human
auuuauuuuguauga

SEQ ID NO: 3228264 - RNA, 16 nt, Human
auuuauuuuguaugaa

SEQ ID NO: 3228265 - RNA, 20 nt, Human
auuuauuuuguaugaaauau

SEQ ID NO: 3228266 - RNA, 22 nt, Human
auuuauuuuguaugaaauauau

SEQ ID NO: 3228267 - RNA, 18 nt, Human
auuuccauguaugcauaa

SEQ ID NO: 3228268 - RNA, 17 nt, Human
auuuccauguaugcaua

SEQ ID NO: 3228269 - RNA, 15 nt, Human
auuuccauguaugca

SEQ ID NO: 3228270 - RNA, 14 nt, Human
auuuccauguaugc

SEQ ID NO: 3228271 - RNA, 23 nt, Human
auuucauguccugugucaguuua

SEQ ID NO: 3228272 - RNA, 22 nt, Human
auuucauguccugugucaguuu

SEQ ID NO: 3228273 - RNA, 21 nt, Human
auuucauguccugugucaguu

SEQ ID NO: 3228274 - RNA, 18 nt, Human
auuucauguccuguguca

SEQ ID NO: 3228275 - RNA, 13 nt, Human
auuucauguccau

SEQ ID NO: 3228276 - RNA, 21 nt, Human
auuucauguccauaaaagaga

SEQ ID NO: 3228277 - RNA, 22 nt, Human
auuuauuuuuuuuaauuguauu

SEQ ID NO: 3228278 - RNA, 23 nt, Human
auuuauuuuuuuuaauuguauuu

SEQ ID NO: 3228279 - RNA, 22 nt, Human
auuuauucugggaauguauagu

SEQ ID NO: 3228280 - RNA, 21 nt, Human
auuuauucugggaauguauag

SEQ ID NO: 3228281 - RNA, 20 nt, Human
auuuauucugggaauguaua

SEQ ID NO: 3228282 - RNA, 19 nt, Human
auuuauucugggaauguau

SEQ ID NO: 3228283 - RNA, 18 nt, Human
auuuauucugggaaugua

SEQ ID NO: 3228284 - RNA, 16 nt, Human
auuuauucugggaaug

SEQ ID NO: 3228285 - RNA, 21 nt, Human
auuuauugaggaaaaauaugu

SEQ ID NO: 3228286 - RNA, 18 nt, Human
auuuauugaggaaaaaua

SEQ ID NO: 3228287 - RNA, 17 nt, Human
auuuauugaggaaaaau

SEQ ID NO: 3228288 - RNA, 15 nt, Human
auuuauugaggaaaa

SEQ ID NO: 3228289 - RNA, 14 nt, Human
auuuauugaggaaa

SEQ ID NO: 3228290 - RNA, 11 nt, Human
auuuauucuuu

SEQ ID NO: 3228291 - RNA, 13 nt, Human
auuuauugacucu

SEQ ID NO: 3228292 - RNA, 14 nt, Human
auuuauugacucuu

SEQ ID NO: 3228293 - RNA, 16 nt, Human
auuuauugacucuuga

SEQ ID NO: 3228294 - RNA, 19 nt, Human
auuuauugacucuugaguu

SEQ ID NO: 3228295 - RNA, 20 nt, Human
auuuauugacucuugaguug

SEQ ID NO: 3228296 - RNA, 22 nt, Human
auuuauugacucuugaguuguu

SEQ ID NO: 3228297 - RNA, 23 nt, Human
auuuggaggcuggaguaaucaga

SEQ ID NO: 3228298 - RNA, 15 nt, Human
auuuggagggccugg

SEQ ID NO: 3228299 - RNA, 16 nt, Human
auuuggauaucuguua

SEQ ID NO: 3228300 - RNA, 17 nt, Human
auuuggauaucuguuag

SEQ ID NO: 3228301 - RNA, 17 nt, Human
auuuggagggccugggc

SEQ ID NO: 3228302 - RNA, 16 nt, Human
auuuggagggccuggg

SEQ ID NO: 3228303 - RNA, 14 nt, Human
auuuggagagaaau

SEQ ID NO: 3228304 - RNA, 18 nt, Human
auuuggagagaaauauuu

SEQ ID NO: 3228305 - RNA, 20 nt, Human
auuuggagcacaaaauucaa

SEQ ID NO: 3228306 - RNA, 17 nt, Human
auuuggagagaaauauu

SEQ ID NO: 3228307 - RNA, 16 nt, Human
auuuggagagaaauau

SEQ ID NO: 3228308 - RNA, 15 nt, Human
auuuggagagaaaua

SEQ ID NO: 3228309 - RNA, 12 nt, Human
auuugagauuuu

SEQ ID NO: 3228310 - RNA, 19 nt, Human
auuuggauuauucuuucuc

SEQ ID NO: 3228311 - RNA, 22 nt, Human
auuuggagggccugggccuggc

SEQ ID NO: 3228312 - RNA, 14 nt, Human
auuuggaugcagag

SEQ ID NO: 3228313 - RNA, 21 nt, Human
auuuguacagauucuuuauua

SEQ ID NO: 3228314 - RNA, 13 nt, Human
auuuguaauuuaa

SEQ ID NO: 3228315 - RNA, 18 nt, Human
auuugaauuaucagcaaa

SEQ ID NO: 3228316 - RNA, 23 nt, Human
auuugaauuaucagcaaagaaaa

SEQ ID NO: 3228317 - RNA, 17 nt, Human
auuugaauuauuucugu

SEQ ID NO: 3228318 - RNA, 15 nt, Human
auuugagcagggcuc

SEQ ID NO: 3228319 - RNA, 23 nt, Human
auuugaauguaugcuucauacag

SEQ ID NO: 3228320 - RNA, 13 nt, Human
auugccuuucugu

SEQ ID NO: 3228321 - RNA, 17 nt, Human
auuggaaugcacucaga

SEQ ID NO: 3228322 - RNA, 22 nt, Human
auuggaagcagguuaaauguuu

SEQ ID NO: 3228323 - RNA, 21 nt, Human
auuggaagcagguuaaauguu

SEQ ID NO: 3228324 - RNA, 20 nt, Human
auuggaagcagguuaaaugu

SEQ ID NO: 3228325 - RNA, 19 nt, Human
auuggaagcagguuaaaug

SEQ ID NO: 3228326 - RNA, 12 nt, Human
auuggaagcagg

SEQ ID NO: 3228327 - RNA, 14 nt, Human
auuggaaauuucac

SEQ ID NO: 3228328 - RNA, 15 nt, Human
auuggaaauuucacg

SEQ ID NO: 3228329 - RNA, 13 nt, Human
auuggaaauuuca

SEQ ID NO: 3228330 - RNA, 22 nt, Human
auugcauauaacuuauauugua

SEQ ID NO: 3228331 - RNA, 18 nt, Human
auugcauauaacuuauau

SEQ ID NO: 3228332 - RNA, 16 nt, Human
auugcauauaacuuau

SEQ ID NO: 3228333 - RNA, 15 nt, Human
auugcaucauuuaca

SEQ ID NO: 3228334 - RNA, 21 nt, Human
auugcaucuggguagcuguaa

SEQ ID NO: 3228335 - RNA, 20 nt, Human
auugcaucuggguagcugua

SEQ ID NO: 3228336 - RNA, 23 nt, Human
auugcaugccgggugcagcaucu

SEQ ID NO: 3228337 - RNA, 19 nt, Human
auugcaugccgggugcagc

SEQ ID NO: 3228338 - RNA, 22 nt, Human
auugcaucuggguagcuguaag

SEQ ID NO: 3228339 - RNA, 12 nt, Human
auugauguugau

SEQ ID NO: 3228340 - RNA, 14 nt, Human
auugauguugaugc

SEQ ID NO: 3228341 - RNA, 13 nt, Human
auugauguugaug

SEQ ID NO: 3228342 - RNA, 18 nt, Human
auugauguugaugcaauc

SEQ ID NO: 3228343 - RNA, 16 nt, Human
auugauguugaugcaa

SEQ ID NO: 3228344 - RNA, 15 nt, Human
auugauuugauuuuu

SEQ ID NO: 3228345 - RNA, 14 nt, Human
auugauguuuccuu

SEQ ID NO: 3228346 - RNA, 20 nt, Human
auugauuuuaaaauguacau

SEQ ID NO: 3228347 - RNA, 19 nt, Human
auugauuuuaaaauguaca

SEQ ID NO: 3228348 - RNA, 16 nt, Human
auugauuuuaaaaugu

SEQ ID NO: 3228349 - RNA, 15 nt, Human
auugauuuuaaaaug

SEQ ID NO: 3228350 - RNA, 18 nt, Human
auugcaacaggcugggcu

SEQ ID NO: 3228351 - RNA, 17 nt, Human
auugcaacaggcugggc

SEQ ID NO: 3228352 - RNA, 12 nt, Human
auugcaccacug

SEQ ID NO: 3228353 - RNA, 19 nt, Human
auugcaacaggcugggcuu

SEQ ID NO: 3228354 - RNA, 16 nt, Human
auugcaacaggcuggg

SEQ ID NO: 3228355 - RNA, 12 nt, Human
auugaaauucua

SEQ ID NO: 3228356 - RNA, 18 nt, Human
auugaagguuuuugauag

SEQ ID NO: 3228357 - RNA, 19 nt, Human
auugaagguuuuugauagc

SEQ ID NO: 3228358 - RNA, 13 nt, Human
auugaagguuuuu

SEQ ID NO: 3228359 - RNA, 17 nt, Human
auugaagguuuuugaua

SEQ ID NO: 3228360 - RNA, 20 nt, Human
auugaaggugauaagggaaa

SEQ ID NO: 3228361 - RNA, 22 nt, Human
auugaaggugauaagggaaaag

SEQ ID NO: 3228362 - RNA, 20 nt, Human
auugaagguuuuugauagca

SEQ ID NO: 3228363 - RNA, 13 nt, Human
auugaaguuucaa

SEQ ID NO: 3228364 - RNA, 15 nt, Human
auugaaguuucaagu

SEQ ID NO: 3228365 - RNA, 16 nt, Human
auugaaguuucaaguu

SEQ ID NO: 3228366 - RNA, 20 nt, Human
auugaaguuucaaguuuuaa

SEQ ID NO: 3228367 - RNA, 20 nt, Human
auugaauuuuuauuuuugaa

SEQ ID NO: 3228368 - RNA, 20 nt, Human
auugaauggugcauuguaua

SEQ ID NO: 3228369 - RNA, 15 nt, Human
ugaugggucaguugu

SEQ ID NO: 3228370 - RNA, 22 nt, Human
ugaugggcagccugcuggucag

SEQ ID NO: 3228371 - RNA, 17 nt, Human
ugaugggcagccugcug

SEQ ID NO: 3228372 - RNA, 22 nt, Human
ugauggggcccugccuccuuug

SEQ ID NO: 3228373 - RNA, 19 nt, Human
ugauggguuaguggaugga

SEQ ID NO: 3228374 - RNA, 23 nt, Human
ugauggguuaguggauggaaggg

SEQ ID NO: 3228375 - RNA, 17 nt, Human
ugauguuuuccaugagu

SEQ ID NO: 3228376 - RNA, 19 nt, Human
ugauguuuuccaugagucc

SEQ ID NO: 3228377 - RNA, 21 nt, Human
ugauuaacuuggaugaguuuu

SEQ ID NO: 3228378 - RNA, 14 nt, Human
ugauuaacuuggau

SEQ ID NO: 3228379 - RNA, 13 nt, Human
ugauuaacuugga

SEQ ID NO: 3228380 - RNA, 17 nt, Human
ugauuaacucaguccug

SEQ ID NO: 3228381 - RNA, 16 nt, Human
agccacggccaggcca

SEQ ID NO: 3228382 - RNA, 20 nt, Human
ugauuaaccacuucagcuga

SEQ ID NO: 3228383 - RNA, 18 nt, Human
ugaugaaaauauuuaaag

SEQ ID NO: 3228384 - RNA, 22 nt, Human
ugaugaaaugaggucagagccu

SEQ ID NO: 3228385 - RNA, 14 nt, Human
ugaucuaggaagac

SEQ ID NO: 3228386 - RNA, 15 nt, Human
ugaugaaaauauuua

SEQ ID NO: 3228387 - RNA, 17 nt, Human
ugaugaucuuuaaaaua

SEQ ID NO: 3228388 - RNA, 23 nt, Human
ugaugaaaugaggucagagccug

SEQ ID NO: 3228389 - RNA, 20 nt, Human
ugaugaucuuugcagacagg

SEQ ID NO: 3228390 - RNA, 19 nt, Human
ugaugaucuuugcagacag

SEQ ID NO: 3228391 - RNA, 21 nt, Human
ugaugaucuuugcagacaggc

SEQ ID NO: 3228392 - RNA, 19 nt, Human
ugaugaaauaacacagcag

SEQ ID NO: 3228393 - RNA, 13 nt, Human
ugauggggcccug

SEQ ID NO: 3228394 - RNA, 22 nt, Human
ugaugggcaacccccagccugc

SEQ ID NO: 3228395 - RNA, 21 nt, Human
ugaugggcaacccccagccug

SEQ ID NO: 3228396 - RNA, 17 nt, Human
ugauggcuuaugauagc

SEQ ID NO: 3228397 - RNA, 18 nt, Human
ugauccacucgccuucau

SEQ ID NO: 3228398 - RNA, 14 nt, Human
ugauccacucgccu

SEQ ID NO: 3228399 - RNA, 15 nt, Human
agccacccaaagcag

SEQ ID NO: 3228400 - RNA, 14 nt, Human
agccacccaaagca

SEQ ID NO: 3228401 - RNA, 18 nt, Human
agccacccaaagcagugg

SEQ ID NO: 3228402 - RNA, 18 nt, Human
ugauccucccaccucagc

SEQ ID NO: 3228403 - RNA, 23 nt, Human
ugaucccuuccaccugcucugcu

SEQ ID NO: 3228404 - RNA, 20 nt, Human
ugaucccuuccaccugcucu

SEQ ID NO: 3228405 - RNA, 20 nt, Human
ugauccucccaccucagccu

SEQ ID NO: 3228406 - RNA, 19 nt, Human
ugauccucccaccucagcc

SEQ ID NO: 3228407 - RNA, 13 nt, Human
ugaucuaggaaga

SEQ ID NO: 3228408 - RNA, 16 nt, Human
ugauccucccaccuca

SEQ ID NO: 3228409 - RNA, 13 nt, Human
agccaccacgccc

SEQ ID NO: 3228410 - RNA, 22 nt, Human
agccaccagaugugacaguguu

SEQ ID NO: 3228411 - RNA, 14 nt, Human
agccaccagaugug

SEQ ID NO: 3228412 - RNA, 21 nt, Human
agcauauucaggaagcucagg

SEQ ID NO: 3228413 - RNA, 17 nt, Human
agcauauucaggaagcu

SEQ ID NO: 3228414 - RNA, 19 nt, Human
agcauauucaggaagcuca

SEQ ID NO: 3228415 - RNA, 14 nt, Human
ugaucacggcucac

SEQ ID NO: 3228416 - RNA, 13 nt, Human
ugaucacggcuca

SEQ ID NO: 3228417 - RNA, 15 nt, Human
ugaucacggcucacu

SEQ ID NO: 3228418 - RNA, 14 nt, Human
ugaucaccugcccu

SEQ ID NO: 3228419 - RNA, 21 nt, Human
ugauaauuuuccuuuaauaug

SEQ ID NO: 3228420 - RNA, 13 nt, Human
agcauggcugcca

SEQ ID NO: 3228421 - RNA, 16 nt, Human
agcauauucaggaagc

SEQ ID NO: 3228422 - RNA, 14 nt, Human
agcaucacuuaaaa

SEQ ID NO: 3228423 - RNA, 16 nt, Human
agcaucacuuaaaaca

SEQ ID NO: 3228424 - RNA, 17 nt, Human
agcaucacuuaaaacac

SEQ ID NO: 3228425 - RNA, 18 nt, Human
agcaucacuuaaaacacg

SEQ ID NO: 3228426 - RNA, 22 nt, Human
agcaucacuuaaaacacguuuu

SEQ ID NO: 3228427 - RNA, 22 nt, Human
agcaucaggccaggcccucugc

SEQ ID NO: 3228428 - RNA, 21 nt, Human
agcaucaggccaggcccucug

SEQ ID NO: 3228429 - RNA, 23 nt, Human
agcaucaggccaggcccucugcc

SEQ ID NO: 3228430 - RNA, 20 nt, Human
agcaucaguacuuguuucua

SEQ ID NO: 3228431 - RNA, 12 nt, Human
agcauucucucc

SEQ ID NO: 3228432 - RNA, 19 nt, Human
agcauucuuuggaguuaaa

SEQ ID NO: 3228433 - RNA, 22 nt, Human
agcauucuuuggaguuaaaaug

SEQ ID NO: 3228434 - RNA, 24 nt, Human
agcauucuuuggaguuaaaaugca

SEQ ID NO: 3228435 - RNA, 22 nt, Human
agcauucucacuccuaccuggu

SEQ ID NO: 3228436 - RNA, 14 nt, Human
agcauuccagucag

SEQ ID NO: 3228437 - RNA, 14 nt, Human
agcauucggaggga

SEQ ID NO: 3228438 - RNA, 20 nt, Human
agcauucucacuccuaccug

SEQ ID NO: 3228439 - RNA, 18 nt, Human
agcauucucacuccuacc

SEQ ID NO: 3228440 - RNA, 19 nt, Human
agcauggcugccaauggga

SEQ ID NO: 3228441 - RNA, 23 nt, Human
agcauuaccucuuuggaaaagga

SEQ ID NO: 3228442 - RNA, 19 nt, Human
agcauuaccucuuuggaaa

SEQ ID NO: 3228443 - RNA, 17 nt, Human
agcauuaccucuuugga

SEQ ID NO: 3228444 - RNA, 14 nt, Human
agcauuacaggcaa

SEQ ID NO: 3228445 - RNA, 17 nt, Human
agcauuagauuucucau

SEQ ID NO: 3228446 - RNA, 21 nt, Human
agcauuauaaucaccagggcc

SEQ ID NO: 3228447 - RNA, 16 nt, Human
agcauuagugggaaaa

SEQ ID NO: 3228448 - RNA, 15 nt, Human
agcauuuugcuaaau

SEQ ID NO: 3228449 - RNA, 22 nt, Human
agcauuuugcuaaaugugaaug

SEQ ID NO: 3228450 - RNA, 14 nt, Human
agcauuuuggcgcu

SEQ ID NO: 3228451 - RNA, 13 nt, Human
agcauuuuguaau

SEQ ID NO: 3228452 - RNA, 23 nt, Human
agccaaaaugugagugguugaau

SEQ ID NO: 3228453 - RNA, 15 nt, Human
agccaaaauuaaggu

SEQ ID NO: 3228454 - RNA, 18 nt, Human
agccaaacauccuacaag

SEQ ID NO: 3228455 - RNA, 17 nt, Human
agccaaaauuaaggugu

SEQ ID NO: 3228456 - RNA, 18 nt, Human
agccaaaauuaagguguu

SEQ ID NO: 3228457 - RNA, 22 nt, Human
agccaaacacacagaaggggac

SEQ ID NO: 3228458 - RNA, 18 nt, Human
agccaaacacacagaagg

SEQ ID NO: 3228459 - RNA, 15 nt, Human
agcauuuggugcuug

SEQ ID NO: 3228460 - RNA, 14 nt, Human
agcauuuggugcuu

SEQ ID NO: 3228461 - RNA, 13 nt, Human
agcauuuggugcu

SEQ ID NO: 3228462 - RNA, 12 nt, Human
agcauuugauau

SEQ ID NO: 3228463 - RNA, 21 nt, Human
agcauuugacuuucugucugu

SEQ ID NO: 3228464 - RNA, 17 nt, Human
agcauuugacuuucugu

SEQ ID NO: 3228465 - RNA, 16 nt, Human
agcauuugacuuucug

SEQ ID NO: 3228466 - RNA, 17 nt, Human
agcauuuaugguaauca

SEQ ID NO: 3228467 - RNA, 16 nt, Human
agcauuuguguguuac

SEQ ID NO: 3228468 - RNA, 20 nt, Human
agcagguccccagcuuuggc

SEQ ID NO: 3228469 - RNA, 21 nt, Human
agcagguccccagcuuuggcu

SEQ ID NO: 3228470 - RNA, 22 nt, Human
agcagggcucagcggggacagc

SEQ ID NO: 3228471 - RNA, 19 nt, Human
agcagggcauggcugggaa

SEQ ID NO: 3228472 - RNA, 20 nt, Human
agcagggagggcuucugcca

SEQ ID NO: 3228473 - RNA, 15 nt, Human
agcagggcucagcgg

SEQ ID NO: 3228474 - RNA, 14 nt, Human
agcagggcucagcg

SEQ ID NO: 3228475 - RNA, 13 nt, Human
agcagggcucagc

SEQ ID NO: 3228476 - RNA, 17 nt, Human
agcaggcucgggcuccc

SEQ ID NO: 3228477 - RNA, 13 nt, Human
agcaggcucucag

SEQ ID NO: 3228478 - RNA, 14 nt, Human
agcaggcucucagg

SEQ ID NO: 3228479 - RNA, 15 nt, Human
agcaggcucucaggc

SEQ ID NO: 3228480 - RNA, 16 nt, Human
agcaggcucucaggcc

SEQ ID NO: 3228481 - RNA, 17 nt, Human
agcaggcucucaggcca

SEQ ID NO: 3228482 - RNA, 18 nt, Human
agcaggcucucaggccag

SEQ ID NO: 3228483 - RNA, 19 nt, Human
agcaggcucucaggccagc

SEQ ID NO: 3228484 - RNA, 21 nt, Human
agcaggcucucaggccagcug

SEQ ID NO: 3228485 - RNA, 22 nt, Human
agcaggcucucaggccagcugc

SEQ ID NO: 3228486 - RNA, 23 nt, Human
agcaggcucucaggccagcugcu

SEQ ID NO: 3228487 - RNA, 15 nt, Human
agcagggaaacagcu

SEQ ID NO: 3228488 - RNA, 14 nt, Human
agcagggaaacagc

SEQ ID NO: 3228489 - RNA, 13 nt, Human
agcagggaaacag

SEQ ID NO: 3228490 - RNA, 15 nt, Human
agcaggcugugaguu

SEQ ID NO: 3228491 - RNA, 14 nt, Human
agcaggcuacuguc

SEQ ID NO: 3228492 - RNA, 23 nt, Human
agcaggcccaugggaggcuggag

SEQ ID NO: 3228493 - RNA, 13 nt, Human
agcaggcagccuu

SEQ ID NO: 3228494 - RNA, 10 nt, Human
agcaggcagc

SEQ ID NO: 3228495 - RNA, 20 nt, Human
agcaggcuacugucagcucc

SEQ ID NO: 3228496 - RNA, 19 nt, Human
agcaggcuacugucagcuc

SEQ ID NO: 3228497 - RNA, 17 nt, Human
agcaggcuacugucagc

SEQ ID NO: 3228498 - RNA, 16 nt, Human
agcaggcuacugucag

SEQ ID NO: 3228499 - RNA, 10 nt, Human
agcaggaggc

SEQ ID NO: 3228500 - RNA, 14 nt, Human
agcaggagggacag

SEQ ID NO: 3228501 - RNA, 15 nt, Human
agcaggaggcuggga

SEQ ID NO: 3228502 - RNA, 19 nt, Human
agcaggagggacagucuca

SEQ ID NO: 3228503 - RNA, 18 nt, Human
agcaggagggacagucuc

SEQ ID NO: 3228504 - RNA, 11 nt, Human
agcaggcagcc

SEQ ID NO: 3228505 - RNA, 13 nt, Human
agcaggacaugga

SEQ ID NO: 3228506 - RNA, 11 nt, Human
agcagccacau

SEQ ID NO: 3228507 - RNA, 16 nt, Human
agcagcagggagggcu

SEQ ID NO: 3228508 - RNA, 20 nt, Human
ugacccaugcugcccuguga

SEQ ID NO: 3228509 - RNA, 18 nt, Human
ugacccaugcugcccugu

SEQ ID NO: 3228510 - RNA, 19 nt, Human
ugacccaugcugcccugug

SEQ ID NO: 3228511 - RNA, 17 nt, Human
ugacccaugcugcccug

SEQ ID NO: 3228512 - RNA, 17 nt, Human
ugauaauauauuguguu

SEQ ID NO: 3228513 - RNA, 21 nt, Human
ugauaauauauuguguugacu

SEQ ID NO: 3228514 - RNA, 15 nt, Human
ugauaauagaagagu

SEQ ID NO: 3228515 - RNA, 13 nt, Human
ugauaauagaaga

SEQ ID NO: 3228516 - RNA, 13 nt, Human
ugauaauuuuccu

SEQ ID NO: 3228517 - RNA, 19 nt, Human
ugauaauuuuccuuuaaua

SEQ ID NO: 3228518 - RNA, 17 nt, Human
ugauaauuuuccuuuaa

SEQ ID NO: 3228519 - RNA, 14 nt, Human
ugauaauuuuccuu

SEQ ID NO: 3228520 - RNA, 18 nt, Human
ugaguuccuagccaccgc

SEQ ID NO: 3228521 - RNA, 17 nt, Human
ugaguuccggcaccagu

SEQ ID NO: 3228522 - RNA, 16 nt, Human
ugaguuccaguugaag

SEQ ID NO: 3228523 - RNA, 17 nt, Human
ugaguuccaguugaagu

SEQ ID NO: 3228524 - RNA, 19 nt, Human
ugaguuccaguugaaguua

SEQ ID NO: 3228525 - RNA, 14 nt, Human
ugaguuccuagcca

SEQ ID NO: 3228526 - RNA, 18 nt, Human
ugaguucauacccuguua

SEQ ID NO: 3228527 - RNA, 14 nt, Human
ugaguuaagucuau

SEQ ID NO: 3228528 - RNA, 18 nt, Human
ugagugucuuaauuaaaa

SEQ ID NO: 3228529 - RNA, 21 nt, Human
ugagugggggaucacagccuc

SEQ ID NO: 3228530 - RNA, 21 nt, Human
ugagugugauccaguuuuuca

SEQ ID NO: 3228531 - RNA, 17 nt, Human
ugagugcagcucuggag

SEQ ID NO: 3228532 - RNA, 16 nt, Human
ugagugcaggcccacc

SEQ ID NO: 3228533 - RNA, 15 nt, Human
ugagugcaggcccac

SEQ ID NO: 3228534 - RNA, 14 nt, Human
ugagugcaggccca

SEQ ID NO: 3228535 - RNA, 13 nt, Human
ugagugcaggccc

SEQ ID NO: 3228536 - RNA, 13 nt, Human
ugagugccuuaca

SEQ ID NO: 3228537 - RNA, 14 nt, Human
ugagugccuuacac

SEQ ID NO: 3228538 - RNA, 14 nt, Human
ugagugcauguacu

SEQ ID NO: 3228539 - RNA, 18 nt, Human
ugagugcaggcccacccu

SEQ ID NO: 3228540 - RNA, 20 nt, Human
ugaguccaaacuggaaugag

SEQ ID NO: 3228541 - RNA, 20 nt, Human
ugaguacaugcacacucaug

SEQ ID NO: 3228542 - RNA, 18 nt, Human
ugagucaccaagcccagu

SEQ ID NO: 3228543 - RNA, 14 nt, Human
agcaguauauguua

SEQ ID NO: 3228544 - RNA, 15 nt, Human
agcaguauauguuaa

SEQ ID NO: 3228545 - RNA, 20 nt, Human
agcaguauauguuaauuugu

SEQ ID NO: 3228546 - RNA, 15 nt, Human
agcaguauauuagua

SEQ ID NO: 3228547 - RNA, 16 nt, Human
agcaguauauuaguau

SEQ ID NO: 3228548 - RNA, 15 nt, Human
agcaguaagggaaca

SEQ ID NO: 3228549 - RNA, 16 nt, Human
agcaguaucaugaagc

SEQ ID NO: 3228550 - RNA, 11 nt, Human
agcaguauuuu

SEQ ID NO: 3228551 - RNA, 13 nt, Human
agcaguauuuugg

SEQ ID NO: 3228552 - RNA, 22 nt, Human
agcagguuaaauguuuuguaaa

SEQ ID NO: 3228553 - RNA, 14 nt, Human
agcagguuaaaugu

SEQ ID NO: 3228554 - RNA, 18 nt, Human
agcaggugugagggcagu

SEQ ID NO: 3228555 - RNA, 20 nt, Human
agcagguuaaauguuuugua

SEQ ID NO: 3228556 - RNA, 18 nt, Human
agcagguuaaauguuuug

SEQ ID NO: 3228557 - RNA, 16 nt, Human
agcagguuaaauguuu

SEQ ID NO: 3228558 - RNA, 15 nt, Human
agcagguuaaauguu

SEQ ID NO: 3228559 - RNA, 17 nt, Human
agcaguuucaauaaagu

SEQ ID NO: 3228560 - RNA, 15 nt, Human
agcaguuucaauaaa

SEQ ID NO: 3228561 - RNA, 14 nt, Human
agcaguuucaauaa

SEQ ID NO: 3228562 - RNA, 14 nt, Human
agcaguuugcuuug

SEQ ID NO: 3228563 - RNA, 14 nt, Human
agcaguuucaggua

SEQ ID NO: 3228564 - RNA, 21 nt, Human
agcaguuucaauaaaguuuga

SEQ ID NO: 3228565 - RNA, 20 nt, Human
agcaguuucaauaaaguuug

SEQ ID NO: 3228566 - RNA, 19 nt, Human
agcauaaaaauuagccaag

SEQ ID NO: 3228567 - RNA, 13 nt, Human
agcauaccaacac

SEQ ID NO: 3228568 - RNA, 23 nt, Human
agcauaaaaauuagccaagugug

SEQ ID NO: 3228569 - RNA, 20 nt, Human
agcaguuuucuuuuaauuuu

SEQ ID NO: 3228570 - RNA, 22 nt, Human
agcauaccaacacgagcaggcu

SEQ ID NO: 3228571 - RNA, 19 nt, Human
agcauaccaacacgagcag

SEQ ID NO: 3228572 - RNA, 23 nt, Human
agcauauaaaauggcaacaaacu

SEQ ID NO: 3228573 - RNA, 19 nt, Human
agcauauaaaauggcaaca

SEQ ID NO: 3228574 - RNA, 15 nt, Human
agcauauaaaauggc

SEQ ID NO: 3228575 - RNA, 16 nt, Human
agcauagcucuguaca

SEQ ID NO: 3228576 - RNA, 14 nt, Human
agcauauaaaaugg

SEQ ID NO: 3228577 - RNA, 19 nt, Human
ugcagggcuuuaaaauucu

SEQ ID NO: 3228578 - RNA, 17 nt, Human
ugcagggcuuuaaaauu

SEQ ID NO: 3228579 - RNA, 18 nt, Human
ugcagccuccgcuucccu

SEQ ID NO: 3228580 - RNA, 17 nt, Human
ugcagccucacaguccu

SEQ ID NO: 3228581 - RNA, 21 nt, Human
ugcagccucacaguccuuacc

SEQ ID NO: 3228582 - RNA, 18 nt, Human
ugcagccucacaguccuu

SEQ ID NO: 3228583 - RNA, 21 nt, Human
agccucuuucccuuccaguuu

SEQ ID NO: 3228584 - RNA, 20 nt, Human
agccucuuucccuuccaguu

SEQ ID NO: 3228585 - RNA, 13 nt, Human
agccucuuucccu

SEQ ID NO: 3228586 - RNA, 12 nt, Human
agccucuuuccc

SEQ ID NO: 3228587 - RNA, 18 nt, Human
agccucgacacagagugg

SEQ ID NO: 3228588 - RNA, 17 nt, Human
agccucgacacagagug

SEQ ID NO: 3228589 - RNA, 23 nt, Human
agccucgcaggccucccugccag

SEQ ID NO: 3228590 - RNA, 22 nt, Human
agccucgcaggccucccugcca

SEQ ID NO: 3228591 - RNA, 20 nt, Human
agccucgcaggccucccugc

SEQ ID NO: 3228592 - RNA, 21 nt, Human
ugcagacaggcaagcaccucc

SEQ ID NO: 3228593 - RNA, 13 nt, Human
ugcagacaggcaa

SEQ ID NO: 3228594 - RNA, 12 nt, Human
ugcagacaggca

SEQ ID NO: 3228595 - RNA, 17 nt, Human
ugcagacaaucuucugu

SEQ ID NO: 3228596 - RNA, 14 nt, Human
ugcagaauuguuua

SEQ ID NO: 3228597 - RNA, 14 nt, Human
agccuccugcccuu

SEQ ID NO: 3228598 - RNA, 18 nt, Human
agccuccugcccuuaccu

SEQ ID NO: 3228599 - RNA, 13 nt, Human
agccuccugcccu

SEQ ID NO: 3228600 - RNA, 20 nt, Human
ugcauagauucccugagcag

SEQ ID NO: 3228601 - RNA, 19 nt, Human
ugcauacucauuaggaugg

SEQ ID NO: 3228602 - RNA, 13 nt, Human
ugcauacucauua

SEQ ID NO: 3228603 - RNA, 18 nt, Human
ugcagguuaguuacauau

SEQ ID NO: 3228604 - RNA, 16 nt, Human
ugcaguaucugugaac

SEQ ID NO: 3228605 - RNA, 13 nt, Human
ugcagucacugca

SEQ ID NO: 3228606 - RNA, 19 nt, Human
ugcaugcugucccuuacgu

SEQ ID NO: 3228607 - RNA, 21 nt, Human
ugcaugcugucccuuacguga

SEQ ID NO: 3228608 - RNA, 18 nt, Human
ugcaugcuuuccauauuu

SEQ ID NO: 3228609 - RNA, 15 nt, Human
ugcaugcuuuccaua

SEQ ID NO: 3228610 - RNA, 14 nt, Human
ugcaugcuuuccau

SEQ ID NO: 3228611 - RNA, 18 nt, Human
ugcaugcugucccuuacg

SEQ ID NO: 3228612 - RNA, 21 nt, Human
ugcaugcuauucacaauuauu

SEQ ID NO: 3228613 - RNA, 17 nt, Human
ugcaucguuucaucuuc

SEQ ID NO: 3228614 - RNA, 14 nt, Human
ugcaucucagccca

SEQ ID NO: 3228615 - RNA, 13 nt, Human
ugcaucucagccc

SEQ ID NO: 3228616 - RNA, 12 nt, Human
ugcaucuuaaaa

SEQ ID NO: 3228617 - RNA, 16 nt, Human
ugcaucuuugaugugu

SEQ ID NO: 3228618 - RNA, 17 nt, Human
ugcaucuuugauguguu

SEQ ID NO: 3228619 - RNA, 12 nt, Human
ugcaucuuugau

SEQ ID NO: 3228620 - RNA, 18 nt, Human
ugcaucuuugauguguug

SEQ ID NO: 3228621 - RNA, 16 nt, Human
ugcaugauugcagaau

SEQ ID NO: 3228622 - RNA, 15 nt, Human
ugcaugauugcagaa

SEQ ID NO: 3228623 - RNA, 19 nt, Human
agccuuaaaacaucauucc

SEQ ID NO: 3228624 - RNA, 22 nt, Human
agccuuaaaacaucauuccuuu

SEQ ID NO: 3228625 - RNA, 20 nt, Human
agccuuagaagucacacagu

SEQ ID NO: 3228626 - RNA, 16 nt, Human
agccuuaagcugcagg

SEQ ID NO: 3228627 - RNA, 14 nt, Human
agccuuaagcugca

SEQ ID NO: 3228628 - RNA, 19 nt, Human
agccuucugagcuggccuc

SEQ ID NO: 3228629 - RNA, 13 nt, Human
agccuucugagcu

SEQ ID NO: 3228630 - RNA, 19 nt, Human
agccuugcggaagguucua

SEQ ID NO: 3228631 - RNA, 21 nt, Human
agccuugaccauucuccaccu

SEQ ID NO: 3228632 - RNA, 18 nt, Human
agccuugaccauucucca

SEQ ID NO: 3228633 - RNA, 19 nt, Human
agccuugaccauucuccac

SEQ ID NO: 3228634 - RNA, 17 nt, Human
agccuuggccucagagg

SEQ ID NO: 3228635 - RNA, 16 nt, Human
agccuugggaccccug

SEQ ID NO: 3228636 - RNA, 22 nt, Human
agcgcccaguuggguggaugcc

SEQ ID NO: 3228637 - RNA, 19 nt, Human
agccugagcgacagugaga

SEQ ID NO: 3228638 - RNA, 18 nt, Human
agccugugccucugggac

SEQ ID NO: 3228639 - RNA, 17 nt, Human
agccugugccucuggga

SEQ ID NO: 3228640 - RNA, 17 nt, Human
ugccaguuauggcuaua

SEQ ID NO: 3228641 - RNA, 16 nt, Human
ugccaguggggccuga

SEQ ID NO: 3228642 - RNA, 13 nt, Human
ugccauaauuacu

SEQ ID NO: 3228643 - RNA, 19 nt, Human
ugccaguuuuguuuccuuu

SEQ ID NO: 3228644 - RNA, 15 nt, Human
ugccagcccauuugg

SEQ ID NO: 3228645 - RNA, 15 nt, Human
ugccagcccagaggc

SEQ ID NO: 3228646 - RNA, 17 nt, Human
ugccagccgagauagcc

SEQ ID NO: 3228647 - RNA, 22 nt, Human
ugccagccgagauagccaaggc

SEQ ID NO: 3228648 - RNA, 17 nt, Human
ugcauugggugaucauu

SEQ ID NO: 3228649 - RNA, 11 nt, Human
ugcauugucug

SEQ ID NO: 3228650 - RNA, 12 nt, Human
ugcauugucugu

SEQ ID NO: 3228651 - RNA, 17 nt, Human
ugcauugucugucugca

SEQ ID NO: 3228652 - RNA, 18 nt, Human
ugcauuggauaacaccac

SEQ ID NO: 3228653 - RNA, 22 nt, Human
ugcauuggauaacaccaccauu

SEQ ID NO: 3228654 - RNA, 20 nt, Human
agcgcccuggcccccacaug

SEQ ID NO: 3228655 - RNA, 18 nt, Human
agcgcccuggcccccaca

SEQ ID NO: 3228656 - RNA, 16 nt, Human
agcgcccuggccccca

SEQ ID NO: 3228657 - RNA, 14 nt, Human
agcgcccuggcccc

SEQ ID NO: 3228658 - RNA, 13 nt, Human
agcgcccuggccc

SEQ ID NO: 3228659 - RNA, 13 nt, Human
ugccaauggacua

SEQ ID NO: 3228660 - RNA, 14 nt, Human
ugccaaugggagcu

SEQ ID NO: 3228661 - RNA, 23 nt, Human
ugccacacuucaggcucuucucc

SEQ ID NO: 3228662 - RNA, 14 nt, Human
agcccugaguuccu

SEQ ID NO: 3228663 - RNA, 23 nt, Human
agcccugaguuccuagccaccgc

SEQ ID NO: 3228664 - RNA, 20 nt, Human
agcccugaguuccuagccac

SEQ ID NO: 3228665 - RNA, 18 nt, Human
agcccugaguuccuagcc

SEQ ID NO: 3228666 - RNA, 16 nt, Human
agcccgggcucugccu

SEQ ID NO: 3228667 - RNA, 14 nt, Human
agcccugcagaggg

SEQ ID NO: 3228668 - RNA, 15 nt, Human
agcccugcagagggc

SEQ ID NO: 3228669 - RNA, 16 nt, Human
agcccugcagagggca

SEQ ID NO: 3228670 - RNA, 19 nt, Human
agcccugcagagggcacag

SEQ ID NO: 3228671 - RNA, 13 nt, Human
agcccgggcucug

SEQ ID NO: 3228672 - RNA, 14 nt, Human
agcccgggcucugc

SEQ ID NO: 3228673 - RNA, 15 nt, Human
agcccgggcucugcc

SEQ ID NO: 3228674 - RNA, 15 nt, Human
agccccuucugaccc

SEQ ID NO: 3228675 - RNA, 16 nt, Human
agccccuucugaccca

SEQ ID NO: 3228676 - RNA, 14 nt, Human
agccccuucugacc

SEQ ID NO: 3228677 - RNA, 14 nt, Human
agccccgaggccuu

SEQ ID NO: 3228678 - RNA, 14 nt, Human
agcccaggccuccu

SEQ ID NO: 3228679 - RNA, 19 nt, Human
agcccaggccuccuacagc

SEQ ID NO: 3228680 - RNA, 18 nt, Human
agcccccuggucuuugag

SEQ ID NO: 3228681 - RNA, 22 nt, Human
agcccccuggucuuugagcucc

SEQ ID NO: 3228682 - RNA, 12 nt, Human
agcccccugguc

SEQ ID NO: 3228683 - RNA, 22 nt, Human
agccccuggaugcagccucaca

SEQ ID NO: 3228684 - RNA, 21 nt, Human
agccccucuccccgcaguguu

SEQ ID NO: 3228685 - RNA, 16 nt, Human
agccccucccuccucu

SEQ ID NO: 3228686 - RNA, 15 nt, Human
agccccucccuccuc

SEQ ID NO: 3228687 - RNA, 18 nt, Human
agccccucccuccucuga

SEQ ID NO: 3228688 - RNA, 22 nt, Human
agcccugccucuccgccccuga

SEQ ID NO: 3228689 - RNA, 16 nt, Human
agcccugcauuuucau

SEQ ID NO: 3228690 - RNA, 18 nt, Human
agcccugccucuccgccc

SEQ ID NO: 3228691 - RNA, 16 nt, Human
agcccugccucuccgc

SEQ ID NO: 3228692 - RNA, 15 nt, Human
agcccugccucuccg

SEQ ID NO: 3228693 - RNA, 13 nt, Human
agcccugccucuc

SEQ ID NO: 3228694 - RNA, 21 nt, Human
ugcaccacugcacuccagccu

SEQ ID NO: 3228695 - RNA, 13 nt, Human
ugcaccagcccuu

SEQ ID NO: 3228696 - RNA, 15 nt, Human
ugcaccacugcacuc

SEQ ID NO: 3228697 - RNA, 21 nt, Human
ugcaccagguagaacgccagg

SEQ ID NO: 3228698 - RNA, 17 nt, Human
ugcaccauacucaugca

SEQ ID NO: 3228699 - RNA, 13 nt, Human
ugcaccauacuca

SEQ ID NO: 3228700 - RNA, 15 nt, Human
ugcacuccagccuga

SEQ ID NO: 3228701 - RNA, 14 nt, Human
ugcacuccagccug

SEQ ID NO: 3228702 - RNA, 16 nt, Human
ugcaccggcuggccug

SEQ ID NO: 3228703 - RNA, 16 nt, Human
ugcacucagacuguau

SEQ ID NO: 3228704 - RNA, 14 nt, Human
ugcaccggcuggcc

SEQ ID NO: 3228705 - RNA, 15 nt, Human
ugcaccggcuggccu

SEQ ID NO: 3228706 - RNA, 19 nt, Human
ugcaccccuuccugggcac

SEQ ID NO: 3228707 - RNA, 18 nt, Human
ugcaccccuuccugggca

SEQ ID NO: 3228708 - RNA, 17 nt, Human
ugcaccccuuccugggc

SEQ ID NO: 3228709 - RNA, 13 nt, Human
ugcaccccuuccu

SEQ ID NO: 3228710 - RNA, 16 nt, Human
ugcaccccuuccuggg

SEQ ID NO: 3228711 - RNA, 15 nt, Human
ugcaccccuuccugg

SEQ ID NO: 3228712 - RNA, 22 nt, Human
ugcagaagacaguauggcagcu

SEQ ID NO: 3228713 - RNA, 18 nt, Human
ugcagaauggcauuugca

SEQ ID NO: 3228714 - RNA, 17 nt, Human
ugcagaauggcauuugc

SEQ ID NO: 3228715 - RNA, 22 nt, Human
ugcagaauggcauuugcaauaa

SEQ ID NO: 3228716 - RNA, 21 nt, Human
ugcagaauggcauuugcaaua

SEQ ID NO: 3228717 - RNA, 22 nt, Human
ugcagaagggagcuggcuccag

SEQ ID NO: 3228718 - RNA, 15 nt, Human
ugcagaagggagcug

SEQ ID NO: 3228719 - RNA, 17 nt, Human
ugcacuccagccugagc

SEQ ID NO: 3228720 - RNA, 15 nt, Human
ugcacuccagccugg

SEQ ID NO: 3228721 - RNA, 16 nt, Human
ugcacuccagccuggg

SEQ ID NO: 3228722 - RNA, 15 nt, Human
ugcaauauauuuugu

SEQ ID NO: 3228723 - RNA, 14 nt, Human
ugcaauauauuuug

SEQ ID NO: 3228724 - RNA, 21 nt, Human
ugcaauauauuuuguaugcaa

SEQ ID NO: 3228725 - RNA, 20 nt, Human
ugcaauauauuuuguaugca

SEQ ID NO: 3228726 - RNA, 18 nt, Human
ugcaauauauuuuguaug

SEQ ID NO: 3228727 - RNA, 16 nt, Human
ugcaauauauuuugua

SEQ ID NO: 3228728 - RNA, 14 nt, Human
ugcaauaaaguaua

SEQ ID NO: 3228729 - RNA, 15 nt, Human
ugcaauaaaguauaa

SEQ ID NO: 3228730 - RNA, 16 nt, Human
ugcaauaaaguauaau

SEQ ID NO: 3228731 - RNA, 12 nt, Human
agcccaggccuc

SEQ ID NO: 3228732 - RNA, 18 nt, Human
ugcaaucuauaauauuug

SEQ ID NO: 3228733 - RNA, 20 nt, Human
ugcaauccuuacaaaugauu

SEQ ID NO: 3228734 - RNA, 17 nt, Human
ugcaauccuuacaaaug

SEQ ID NO: 3228735 - RNA, 16 nt, Human
ugcaauccuuacaaau

SEQ ID NO: 3228736 - RNA, 15 nt, Human
ugcaauccuuacaaa

SEQ ID NO: 3228737 - RNA, 13 nt, Human
ugcaauaucuucg

SEQ ID NO: 3228738 - RNA, 21 nt, Human
ugcaauaucuucguuaguaau

SEQ ID NO: 3228739 - RNA, 14 nt, Human
ugcaauccuuacaa

SEQ ID NO: 3228740 - RNA, 12 nt, Human
ugcaauccuuac

SEQ ID NO: 3228741 - RNA, 16 nt, Human
ugcaagguaaaauuuu

SEQ ID NO: 3228742 - RNA, 15 nt, Human
ugcaagguaaaauuu

SEQ ID NO: 3228743 - RNA, 19 nt, Human
ugcaaggucuugcauuuaa

SEQ ID NO: 3228744 - RNA, 20 nt, Human
ugcaagggcggccuuuccca

SEQ ID NO: 3228745 - RNA, 22 nt, Human
ugcaagggaugaauuguaaaag

SEQ ID NO: 3228746 - RNA, 23 nt, Human
ugcaagcaguuucaauaaaguuu

SEQ ID NO: 3228747 - RNA, 17 nt, Human
ugcaagcuuuuccuaau

SEQ ID NO: 3228748 - RNA, 13 nt, Human
ugcaagcuuuucc

SEQ ID NO: 3228749 - RNA, 21 nt, Human
ugcaagcaguuucaauaaagu

SEQ ID NO: 3228750 - RNA, 17 nt, Human
ugcaagcaguuucaaua

SEQ ID NO: 3228751 - RNA, 15 nt, Human
ugcaagcaguuucaa

SEQ ID NO: 3228752 - RNA, 12 nt, Human
ugcaacaaaaua

SEQ ID NO: 3228753 - RNA, 16 nt, Human
ugcaacaaaauacauu

SEQ ID NO: 3228754 - RNA, 18 nt, Human
ugcaaagcacugacuucu

SEQ ID NO: 3228755 - RNA, 22 nt, Human
ugcaaagcacugacuucuaagu

SEQ ID NO: 3228756 - RNA, 20 nt, Human
ugcaaagcacugacuucuaa

SEQ ID NO: 3228757 - RNA, 18 nt, Human
ugcaaaccaucauugaaa

SEQ ID NO: 3228758 - RNA, 23 nt, Human
ugcaaacugggcuggaagauauu

SEQ ID NO: 3228759 - RNA, 22 nt, Human
ugcaaacugggcuggaagauau

SEQ ID NO: 3228760 - RNA, 15 nt, Human
ugcaaaguauuguaa

SEQ ID NO: 3228761 - RNA, 21 nt, Human
ugcaaaguacagguacuuugu

SEQ ID NO: 3228762 - RNA, 17 nt, Human
ugcaaaguacagguacu

SEQ ID NO: 3228763 - RNA, 19 nt, Human
ugcaaaguauaaauuugug

SEQ ID NO: 3228764 - RNA, 21 nt, Human
ugcaaaguauaaauuugugua

SEQ ID NO: 3228765 - RNA, 22 nt, Human
ugcaaaguauaaauuuguguaa

SEQ ID NO: 3228766 - RNA, 23 nt, Human
ugcaaaguucccuacuuccugug

SEQ ID NO: 3228767 - RNA, 21 nt, Human
ugcaaaggguaucaggugcug

SEQ ID NO: 3228768 - RNA, 14 nt, Human
ugcaaagcccagcu

SEQ ID NO: 3228769 - RNA, 15 nt, Human
ugcaaagcccagcuu

SEQ ID NO: 3228770 - RNA, 17 nt, Human
ugcaaagcccagcuuga

SEQ ID NO: 3228771 - RNA, 16 nt, Human
ugcaaaggaaauacca

SEQ ID NO: 3228772 - RNA, 13 nt, Human
ugcaaaggaaaua

SEQ ID NO: 3228773 - RNA, 13 nt, Human
ugauuucauucaa

SEQ ID NO: 3228774 - RNA, 13 nt, Human
ugauuucagaaac

SEQ ID NO: 3228775 - RNA, 23 nt, Human
ugauuucacaaauauuaaaaagu

SEQ ID NO: 3228776 - RNA, 20 nt, Human
ugauuucacaaauauuaaaa

SEQ ID NO: 3228777 - RNA, 19 nt, Human
ugauuuauuaacuuaauaa

SEQ ID NO: 3228778 - RNA, 22 nt, Human
ugauuuauuaacuuaauaauca

SEQ ID NO: 3228779 - RNA, 18 nt, Human
ugauuuauuuuguaugaa

SEQ ID NO: 3228780 - RNA, 15 nt, Human
ugauuucacaaauau

SEQ ID NO: 3228781 - RNA, 19 nt, Human
ugauuucacaaauauuaaa

SEQ ID NO: 3228782 - RNA, 16 nt, Human
ugauuucacaaauauu

SEQ ID NO: 3228783 - RNA, 18 nt, Human
agccacggccaggccaga

SEQ ID NO: 3228784 - RNA, 17 nt, Human
agccacggccaggccag

SEQ ID NO: 3228785 - RNA, 12 nt, Human
ugauuuauuaac

SEQ ID NO: 3228786 - RNA, 15 nt, Human
ugauuuauuaacuua

SEQ ID NO: 3228787 - RNA, 16 nt, Human
ugauuuauuaacuuaa

SEQ ID NO: 3228788 - RNA, 14 nt, Human
ugauuugagauuuu

SEQ ID NO: 3228789 - RNA, 13 nt, Human
ugauuugagauuu

SEQ ID NO: 3228790 - RNA, 12 nt, Human
ugcaaaccauca

SEQ ID NO: 3228791 - RNA, 13 nt, Human
ugcaaaccaucau

SEQ ID NO: 3228792 - RNA, 16 nt, Human
ugcaaacauuggaaga

SEQ ID NO: 3228793 - RNA, 18 nt, Human
ugcaaacauuggaagauu

SEQ ID NO: 3228794 - RNA, 16 nt, Human
ugccgagcccuugccc

SEQ ID NO: 3228795 - RNA, 12 nt, Human
ugccgcagcccu

SEQ ID NO: 3228796 - RNA, 13 nt, Human
ugccucagccucc

SEQ ID NO: 3228797 - RNA, 12 nt, Human
ugccucagccuc

SEQ ID NO: 3228798 - RNA, 19 nt, Human
ugcccuguuaaaagaugaa

SEQ ID NO: 3228799 - RNA, 20 nt, Human
ugcccuguuaaaagaugaaa

SEQ ID NO: 3228800 - RNA, 18 nt, Human
ugcccuuaccugccagga

SEQ ID NO: 3228801 - RNA, 19 nt, Human
agcugcaaucgcuuuccua

SEQ ID NO: 3228802 - RNA, 15 nt, Human
agcugcaccccuucc

SEQ ID NO: 3228803 - RNA, 13 nt, Human
agcugcaccccuu

SEQ ID NO: 3228804 - RNA, 21 nt, Human
agcucuguccugggagugagc

SEQ ID NO: 3228805 - RNA, 16 nt, Human
agcucuguccugggag

SEQ ID NO: 3228806 - RNA, 21 nt, Human
agcugauuuugaggguuuuua

SEQ ID NO: 3228807 - RNA, 16 nt, Human
agcugcaaaaauaauc

SEQ ID NO: 3228808 - RNA, 18 nt, Human
agcugcaaaaauaaucau

SEQ ID NO: 3228809 - RNA, 20 nt, Human
agcugccagccgagauagcc

SEQ ID NO: 3228810 - RNA, 14 nt, Human
agcugccagccgag

SEQ ID NO: 3228811 - RNA, 19 nt, Human
agcugcagauaaguggccu

SEQ ID NO: 3228812 - RNA, 16 nt, Human
ugccaucauguuuaca

SEQ ID NO: 3228813 - RNA, 13 nt, Human
ugccaucaaauga

SEQ ID NO: 3228814 - RNA, 15 nt, Human
ugccaucaaaugaau

SEQ ID NO: 3228815 - RNA, 15 nt, Human
ugccauagaguacac

SEQ ID NO: 3228816 - RNA, 18 nt, Human
ugccauagaguacacugc

SEQ ID NO: 3228817 - RNA, 14 nt, Human
ugccauagaguaca

SEQ ID NO: 3228818 - RNA, 23 nt, Human
agcucccaggcauuccccaggag

SEQ ID NO: 3228819 - RNA, 15 nt, Human
agcuccuucuguccu

SEQ ID NO: 3228820 - RNA, 13 nt, Human
agcuccuucuguc

SEQ ID NO: 3228821 - RNA, 13 nt, Human
agcucccaggcau

SEQ ID NO: 3228822 - RNA, 16 nt, Human
agcuccaucuccacuc

SEQ ID NO: 3228823 - RNA, 23 nt, Human
agcuccauacacacgcugccuuc

SEQ ID NO: 3228824 - RNA, 15 nt, Human
agcuccaucuccacu

SEQ ID NO: 3228825 - RNA, 13 nt, Human
agcuccaucucca

SEQ ID NO: 3228826 - RNA, 22 nt, Human
agcuccauacacacgcugccuu

SEQ ID NO: 3228827 - RNA, 20 nt, Human
agcuccauacacacgcugcc

SEQ ID NO: 3228828 - RNA, 19 nt, Human
agcuccauacacacgcugc

SEQ ID NO: 3228829 - RNA, 18 nt, Human
agcuccauacacacgcug

SEQ ID NO: 3228830 - RNA, 16 nt, Human
agcucucuccucccuu

SEQ ID NO: 3228831 - RNA, 21 nt, Human
agcuccuucuguccuacucug

SEQ ID NO: 3228832 - RNA, 16 nt, Human
agcuccuucuguccua

SEQ ID NO: 3228833 - RNA, 19 nt, Human
agcuccuuuuccagagcau

SEQ ID NO: 3228834 - RNA, 18 nt, Human
agcuccuuuuccagagca

SEQ ID NO: 3228835 - RNA, 14 nt, Human
agcuccuuuuccag

SEQ ID NO: 3228836 - RNA, 12 nt, Human
agcucuggucca

SEQ ID NO: 3228837 - RNA, 17 nt, Human
agcucugguccauagag

SEQ ID NO: 3228838 - RNA, 14 nt, Human
agcucuguccuggg

SEQ ID NO: 3228839 - RNA, 15 nt, Human
ugccugcuuuuugga

SEQ ID NO: 3228840 - RNA, 16 nt, Human
ugccugcuuuuuggaa

SEQ ID NO: 3228841 - RNA, 17 nt, Human
ugccugcuuuuuggaaa

SEQ ID NO: 3228842 - RNA, 21 nt, Human
ugccugcuuuuuggaaaguca

SEQ ID NO: 3228843 - RNA, 22 nt, Human
ugccugcuuuuuggaaagucag

SEQ ID NO: 3228844 - RNA, 23 nt, Human
ugccugcccaggccccugccacc

SEQ ID NO: 3228845 - RNA, 22 nt, Human
ugccugcccaggccccugccac

SEQ ID NO: 3228846 - RNA, 20 nt, Human
ugccugcccaggccccugcc

SEQ ID NO: 3228847 - RNA, 17 nt, Human
ugccucugccucugaca

SEQ ID NO: 3228848 - RNA, 20 nt, Human
ugccucugccucugacacac

SEQ ID NO: 3228849 - RNA, 18 nt, Human
ugccucugccucugacac

SEQ ID NO: 3228850 - RNA, 14 nt, Human
ugccucagccuccc

SEQ ID NO: 3228851 - RNA, 16 nt, Human
ugccuggauggggcug

SEQ ID NO: 3228852 - RNA, 17 nt, Human
ugccuggauggggcugc

SEQ ID NO: 3228853 - RNA, 20 nt, Human
ugccuggauggggcugcacc

SEQ ID NO: 3228854 - RNA, 16 nt, Human
agcugccuguucagcu

SEQ ID NO: 3228855 - RNA, 14 nt, Human
agcugccuguucag

SEQ ID NO: 3228856 - RNA, 18 nt, Human
agcugccuguucagcucc

SEQ ID NO: 3228857 - RNA, 16 nt, Human
agcugcuugggcuuca

SEQ ID NO: 3228858 - RNA, 21 nt, Human
agcugcugagccgcagagaag

SEQ ID NO: 3228859 - RNA, 17 nt, Human
agcugcugagccgcaga

SEQ ID NO: 3228860 - RNA, 16 nt, Human
agcugcugagccgcag

SEQ ID NO: 3228861 - RNA, 13 nt, Human
agcugcugagccg

SEQ ID NO: 3228862 - RNA, 12 nt, Human
agcugcugccau

SEQ ID NO: 3228863 - RNA, 19 nt, Human
agcuggccgggagccugau

SEQ ID NO: 3228864 - RNA, 18 nt, Human
agcuggccgggagccuga

SEQ ID NO: 3228865 - RNA, 15 nt, Human
agcuggcuccagccu

SEQ ID NO: 3228866 - RNA, 12 nt, Human
agcuggcuccag

SEQ ID NO: 3228867 - RNA, 22 nt, Human
agcuggccucucacugccuccc

SEQ ID NO: 3228868 - RNA, 16 nt, Human
agcuggccucucacug

SEQ ID NO: 3228869 - RNA, 23 nt, Human
agcugugcucuggacaggcaugu

SEQ ID NO: 3228870 - RNA, 18 nt, Human
agcugugcucuggacagg

SEQ ID NO: 3228871 - RNA, 17 nt, Human
agcugugcucuggacag

SEQ ID NO: 3228872 - RNA, 22 nt, Human
agcugugggcaaaagaguguaa

SEQ ID NO: 3228873 - RNA, 23 nt, Human
agcugugggcaaaagaguguaaa

SEQ ID NO: 3228874 - RNA, 20 nt, Human
agcuguguccggcccaguuu

SEQ ID NO: 3228875 - RNA, 23 nt, Human
agcuguguccuaguucuugaaca

SEQ ID NO: 3228876 - RNA, 18 nt, Human
agcuguuacugucuucag

SEQ ID NO: 3228877 - RNA, 14 nt, Human
agcuguuacugucu

SEQ ID NO: 3228878 - RNA, 19 nt, Human
agcugggacuacaggcacc

SEQ ID NO: 3228879 - RNA, 17 nt, Human
agcuggcuccagccugg

SEQ ID NO: 3228880 - RNA, 16 nt, Human
agcuggcuccagccug

SEQ ID NO: 3228881 - RNA, 22 nt, Human
agcugggguggggaccucaggc

SEQ ID NO: 3228882 - RNA, 23 nt, Human
agcugggguggggaccucaggcc

SEQ ID NO: 3228883 - RNA, 20 nt, Human
agcugggguggggaccucag

SEQ ID NO: 3228884 - RNA, 16 nt, Human
agcugggacuacaggu

SEQ ID NO: 3228885 - RNA, 23 nt, Human
agcugggacuacaggcacccacc

SEQ ID NO: 3228886 - RNA, 20 nt, Human
agcugggacuacaggcaccc

SEQ ID NO: 3228887 - RNA, 19 nt, Human
agcuguuacugucuucagu

SEQ ID NO: 3228888 - RNA, 14 nt, Human
ugccuguucccauu

SEQ ID NO: 3228889 - RNA, 21 nt, Human
ugccuguucagcuccagcuca

SEQ ID NO: 3228890 - RNA, 16 nt, Human
ugccuguugggccagg

SEQ ID NO: 3228891 - RNA, 17 nt, Human
ugccuguugggccagga

SEQ ID NO: 3228892 - RNA, 24 nt, Human
ugccuuaaagacaagacagcauuu

SEQ ID NO: 3228893 - RNA, 15 nt, Human
ugccuuaagugagga

SEQ ID NO: 3228894 - RNA, 16 nt, Human
ugccuuggggacaaga

SEQ ID NO: 3228895 - RNA, 21 nt, Human
ugccuuaagugaggaaaucaa

SEQ ID NO: 3228896 - RNA, 22 nt, Human
ugccuuaagugaggaaaucaaa

SEQ ID NO: 3228897 - RNA, 22 nt, Human
ugcuaugagcuggggaugucuc

SEQ ID NO: 3228898 - RNA, 21 nt, Human
ugcuaugauguuaguuuuccu

SEQ ID NO: 3228899 - RNA, 22 nt, Human
ugcuaugauguuaguuuuccuu

SEQ ID NO: 3228900 - RNA, 19 nt, Human
ugcuaugagcuggggaugu

SEQ ID NO: 3228901 - RNA, 20 nt, Human
ugcuaugagcuggggauguc

SEQ ID NO: 3228902 - RNA, 16 nt, Human
ugcuaugagcugggga

SEQ ID NO: 3228903 - RNA, 15 nt, Human
ugcucaaaaagaaau

SEQ ID NO: 3228904 - RNA, 15 nt, Human
ugcucaaaaugcaaa

SEQ ID NO: 3228905 - RNA, 13 nt, Human
ugcucaaaaugca

SEQ ID NO: 3228906 - RNA, 14 nt, Human
ugcuaucuccccca

SEQ ID NO: 3228907 - RNA, 17 nt, Human
ugcuaucucccccagcc

SEQ ID NO: 3228908 - RNA, 13 nt, Human
ugcuaucuccccc

SEQ ID NO: 3228909 - RNA, 21 nt, Human
ugcuccagcuguucagcuggu

SEQ ID NO: 3228910 - RNA, 20 nt, Human
ugcuccagcuguucagcugg

SEQ ID NO: 3228911 - RNA, 12 nt, Human
ugcucugagagc

SEQ ID NO: 3228912 - RNA, 23 nt, Human
ugcucugagagcaaacuggcuug

SEQ ID NO: 3228913 - RNA, 23 nt, Human
ugcucugccccagcuugggcaga

SEQ ID NO: 3228914 - RNA, 17 nt, Human
ugcucugccccagcuug

SEQ ID NO: 3228915 - RNA, 15 nt, Human
ugcucugcugacaga

SEQ ID NO: 3228916 - RNA, 14 nt, Human
ugcucugcugacag

SEQ ID NO: 3228917 - RNA, 10 nt, Human
ugcucugcug

SEQ ID NO: 3228918 - RNA, 14 nt, Human
ugcucugcucgccu

SEQ ID NO: 3228919 - RNA, 20 nt, Human
ugcucuugaacuccugaccu

SEQ ID NO: 3228920 - RNA, 22 nt, Human
ugcucuugaacuccugaccuca

SEQ ID NO: 3228921 - RNA, 15 nt, Human
ugcucuugaacuccu

SEQ ID NO: 3228922 - RNA, 14 nt, Human
ugcugacuuagaau

SEQ ID NO: 3228923 - RNA, 15 nt, Human
ugcugacuuagaauc

SEQ ID NO: 3228924 - RNA, 13 nt, Human
ugcugacuuagaa

SEQ ID NO: 3228925 - RNA, 19 nt, Human
aggaaaucaaauaugcaaa

SEQ ID NO: 3228926 - RNA, 20 nt, Human
aggaaaucaaauaugcaaag

SEQ ID NO: 3228927 - RNA, 22 nt, Human
aggaaaguggcaccugucugcu

SEQ ID NO: 3228928 - RNA, 22 nt, Human
aggaaaucaaauaugcaaagca

SEQ ID NO: 3228929 - RNA, 21 nt, Human
aggaaaucaaauaugcaaagc

SEQ ID NO: 3228930 - RNA, 23 nt, Human
aggaaaggcuccaggagcagcca

SEQ ID NO: 3228931 - RNA, 17 nt, Human
aggaaaguacauuuuuu

SEQ ID NO: 3228932 - RNA, 14 nt, Human
aggaaaguacauuu

SEQ ID NO: 3228933 - RNA, 13 nt, Human
aggaagcucaggg

SEQ ID NO: 3228934 - RNA, 14 nt, Human
aggaagcucagggc

SEQ ID NO: 3228935 - RNA, 12 nt, Human
aggaagcucagg

SEQ ID NO: 3228936 - RNA, 18 nt, Human
aggaagcagcuuucccca

SEQ ID NO: 3228937 - RNA, 15 nt, Human
aggaagcucagggcc

SEQ ID NO: 3228938 - RNA, 15 nt, Human
aggaaggcacuucug

SEQ ID NO: 3228939 - RNA, 16 nt, Human
ugccuuggugugcugu

SEQ ID NO: 3228940 - RNA, 16 nt, Human
ugccuuguauaauauu

SEQ ID NO: 3228941 - RNA, 15 nt, Human
ugcgguccacccagg

SEQ ID NO: 3228942 - RNA, 14 nt, Human
ugcgguccacccag

SEQ ID NO: 3228943 - RNA, 23 nt, Human
ugcuaagugcuuauuacauuuua

SEQ ID NO: 3228944 - RNA, 12 nt, Human
ugcuaauucuuu

SEQ ID NO: 3228945 - RNA, 23 nt, Human
ugcuaaucuugugaaaauaauug

SEQ ID NO: 3228946 - RNA, 18 nt, Human
ugcuaaucuugugaaaau

SEQ ID NO: 3228947 - RNA, 21 nt, Human
ugcuaaucuugugaaaauaau

SEQ ID NO: 3228948 - RNA, 19 nt, Human
ugcuaaucuugugaaaaua

SEQ ID NO: 3228949 - RNA, 22 nt, Human
ugcuaauucuuugcaaaaaucc

SEQ ID NO: 3228950 - RNA, 21 nt, Human
ugcuaauucuuugcaaaaauc

SEQ ID NO: 3228951 - RNA, 20 nt, Human
ugcuaauucuuugcaaaaau

SEQ ID NO: 3228952 - RNA, 17 nt, Human
ugcuaauucuuugcaaa

SEQ ID NO: 3228953 - RNA, 16 nt, Human
ugcuaauucuuugcaa

SEQ ID NO: 3228954 - RNA, 15 nt, Human
ugcuaauucuuugca

SEQ ID NO: 3228955 - RNA, 14 nt, Human
ugcuaauucuuugc

SEQ ID NO: 3228956 - RNA, 13 nt, Human
ugcuaauucuuug

SEQ ID NO: 3228957 - RNA, 14 nt, Human
ugcuacaaaaacac

SEQ ID NO: 3228958 - RNA, 18 nt, Human
ugcuacagaaaagaaacu

SEQ ID NO: 3228959 - RNA, 21 nt, Human
ugcuaccacggccuccuuucc

SEQ ID NO: 3228960 - RNA, 20 nt, Human
ugcuaccacggccuccuuuc

SEQ ID NO: 3228961 - RNA, 18 nt, Human
ugcuaccacggccuccuu

SEQ ID NO: 3228962 - RNA, 21 nt, Human
agcuguugucucuucuccuua

SEQ ID NO: 3228963 - RNA, 20 nt, Human
agcuguugucucuucuccuu

SEQ ID NO: 3228964 - RNA, 19 nt, Human
agcuguugucucuucuccu

SEQ ID NO: 3228965 - RNA, 17 nt, Human
agcuguugucucuucuc

SEQ ID NO: 3228966 - RNA, 16 nt, Human
agcuguugucucuucu

SEQ ID NO: 3228967 - RNA, 16 nt, Human
agcuuaagggucauau

SEQ ID NO: 3228968 - RNA, 14 nt, Human
agcuuaagaaaaaa

SEQ ID NO: 3228969 - RNA, 20 nt, Human
agcuuaaaggggcuagagug

SEQ ID NO: 3228970 - RNA, 13 nt, Human
agcuuaacagugu

SEQ ID NO: 3228971 - RNA, 22 nt, Human
agcuuugagguggaagagggcu

SEQ ID NO: 3228972 - RNA, 13 nt, Human
agcuuguuuugga

SEQ ID NO: 3228973 - RNA, 22 nt, Human
agcuuuccccaugucucgacuc

SEQ ID NO: 3228974 - RNA, 20 nt, Human
agcuuuggcuaugagggccu

SEQ ID NO: 3228975 - RNA, 21 nt, Human
agcuuuggcuaugagggccuu

SEQ ID NO: 3228976 - RNA, 12 nt, Human
aggaaaagaaau

SEQ ID NO: 3228977 - RNA, 17 nt, Human
aggaaaagaaaucuaua

SEQ ID NO: 3228978 - RNA, 16 nt, Human
aggaaaagaaaucuau

SEQ ID NO: 3228979 - RNA, 15 nt, Human
aggaaaagaaaucua

SEQ ID NO: 3228980 - RNA, 14 nt, Human
aggaaaagaaaucu

SEQ ID NO: 3228981 - RNA, 14 nt, Human
aggaaaagcugcug

SEQ ID NO: 3228982 - RNA, 19 nt, Human
agcuugcccuguuaaaaga

SEQ ID NO: 3228983 - RNA, 18 nt, Human
agcuugcccuguuaaaag

SEQ ID NO: 3228984 - RNA, 16 nt, Human
agcuugcccuguuaaa

SEQ ID NO: 3228985 - RNA, 21 nt, Human
agcuuguaaauagcucaggug

SEQ ID NO: 3228986 - RNA, 20 nt, Human
agcuugcccuggugccucac

SEQ ID NO: 3228987 - RNA, 15 nt, Human
agcuugcacauuugg

SEQ ID NO: 3228988 - RNA, 14 nt, Human
agcuugcacauuug

SEQ ID NO: 3228989 - RNA, 15 nt, Human
agcuugauuaaauca

SEQ ID NO: 3228990 - RNA, 23 nt, Human
agcuugaccgugaggccagagac

SEQ ID NO: 3228991 - RNA, 22 nt, Human
agcuugaggguugggcuggugu

SEQ ID NO: 3228992 - RNA, 20 nt, Human
agcuugaccgugaggccaga

SEQ ID NO: 3228993 - RNA, 22 nt, Human
agcuugaccgugaggccagaga

SEQ ID NO: 3228994 - RNA, 19 nt, Human
agcuugaccgugaggccag

SEQ ID NO: 3228995 - RNA, 20 nt, Human
agcuuaagggucauauguuu

SEQ ID NO: 3228996 - RNA, 19 nt, Human
agcuuaagggucauauguu

SEQ ID NO: 3228997 - RNA, 16 nt, Human
aggagccuccugcccu

SEQ ID NO: 3228998 - RNA, 22 nt, Human
aggagcccauuuggagggccug

SEQ ID NO: 3228999 - RNA, 15 nt, Human
aggagcacugaaagu

SEQ ID NO: 3229000 - RNA, 12 nt, Human
aggagcagccac

SEQ ID NO: 3229001 - RNA, 13 nt, Human
aggagcagccaca

SEQ ID NO: 3229002 - RNA, 15 nt, Human
aggagaugcugugcc

SEQ ID NO: 3229003 - RNA, 18 nt, Human
aggagaaacuggaacucu

SEQ ID NO: 3229004 - RNA, 19 nt, Human
aggagaaacuggaacucuc

SEQ ID NO: 3229005 - RNA, 17 nt, Human
aggagaaacuggaacuc

SEQ ID NO: 3229006 - RNA, 22 nt, Human
aggacuuuucuuuguggcuucc

SEQ ID NO: 3229007 - RNA, 19 nt, Human
aggacuuuucuuuguggcu

SEQ ID NO: 3229008 - RNA, 17 nt, Human
aggacuuuucuuugugg

SEQ ID NO: 3229009 - RNA, 16 nt, Human
aggacucugccuccuc

SEQ ID NO: 3229010 - RNA, 14 nt, Human
aggacucugccucc

SEQ ID NO: 3229011 - RNA, 13 nt, Human
aggacucugccuc

SEQ ID NO: 3229012 - RNA, 12 nt, Human
aggacucugccu

SEQ ID NO: 3229013 - RNA, 18 nt, Human
aggacucugccuccucuu

SEQ ID NO: 3229014 - RNA, 17 nt, Human
aggacucugccuccucu

SEQ ID NO: 3229015 - RNA, 13 nt, Human
aggacgcucucug

SEQ ID NO: 3229016 - RNA, 14 nt, Human
aggacgcucucugg

SEQ ID NO: 3229017 - RNA, 23 nt, Human
aggaccuucacucuaagauguua

SEQ ID NO: 3229018 - RNA, 21 nt, Human
aggaccuucacucuaagaugu

SEQ ID NO: 3229019 - RNA, 16 nt, Human
aggacgcucucuggcc

SEQ ID NO: 3229020 - RNA, 17 nt, Human
aggacgcucucuggccu

SEQ ID NO: 3229021 - RNA, 19 nt, Human
aggacgcucucuggccuuc

SEQ ID NO: 3229022 - RNA, 20 nt, Human
aggacgcucucuggccuucg

SEQ ID NO: 3229023 - RNA, 23 nt, Human
aggacaaggugcaggcaggcugg

SEQ ID NO: 3229024 - RNA, 20 nt, Human
aggacaaggugcaggcaggc

SEQ ID NO: 3229025 - RNA, 19 nt, Human
aggacaaggugcaggcagg

SEQ ID NO: 3229026 - RNA, 18 nt, Human
aggacaaggugcaggcag

SEQ ID NO: 3229027 - RNA, 13 nt, Human
aggaccugugucc

SEQ ID NO: 3229028 - RNA, 19 nt, Human
aggacgcuucacaggacag

SEQ ID NO: 3229029 - RNA, 17 nt, Human
aggacgcuucacaggac

SEQ ID NO: 3229030 - RNA, 20 nt, Human
aggacgcuucacaggacagg

SEQ ID NO: 3229031 - RNA, 19 nt, Human
aggacuaggguccugggga

SEQ ID NO: 3229032 - RNA, 16 nt, Human
aggacuaggguccugg

SEQ ID NO: 3229033 - RNA, 18 nt, Human
aggacuaggguccugggg

SEQ ID NO: 3229034 - RNA, 15 nt, Human
aggacuaggguccug

SEQ ID NO: 3229035 - RNA, 21 nt, Human
aggacucucacgauaugcaag

SEQ ID NO: 3229036 - RNA, 15 nt, Human
uggaagagggcugca

SEQ ID NO: 3229037 - RNA, 18 nt, Human
uggaagagcuaggcaggg

SEQ ID NO: 3229038 - RNA, 14 nt, Human
uggaagagagaaag

SEQ ID NO: 3229039 - RNA, 16 nt, Human
uggaagagagaaagca

SEQ ID NO: 3229040 - RNA, 19 nt, Human
uggaagagagaaagcauau

SEQ ID NO: 3229041 - RNA, 23 nt, Human
uggaagagagaaagcauauugac

SEQ ID NO: 3229042 - RNA, 16 nt, Human
uggaagacagcucuua

SEQ ID NO: 3229043 - RNA, 15 nt, Human
uggaagacagcucuu

SEQ ID NO: 3229044 - RNA, 14 nt, Human
uggaaauuucacgu

SEQ ID NO: 3229045 - RNA, 23 nt, Human
uggaaauuuguuauaaugaauga

SEQ ID NO: 3229046 - RNA, 21 nt, Human
uggaaauuuguuauaaugaau

SEQ ID NO: 3229047 - RNA, 13 nt, Human
uggaaauuucacg

SEQ ID NO: 3229048 - RNA, 12 nt, Human
uggaaauuucac

SEQ ID NO: 3229049 - RNA, 10 nt, Human
ugcuuuuaaa

SEQ ID NO: 3229050 - RNA, 15 nt, Human
ugcuuuuuauaaaaa

SEQ ID NO: 3229051 - RNA, 16 nt, Human
ugcuuuuuauaaaaag

SEQ ID NO: 3229052 - RNA, 24 nt, Human
ugcuuuguugugugccucuagcug

SEQ ID NO: 3229053 - RNA, 23 nt, Human
ugcuuuguugugugccucuagcu

SEQ ID NO: 3229054 - RNA, 12 nt, Human
uggaaagucaga

SEQ ID NO: 3229055 - RNA, 13 nt, Human
uggaaagucagaa

SEQ ID NO: 3229056 - RNA, 13 nt, Human
ugcuuuuuggaaa

SEQ ID NO: 3229057 - RNA, 14 nt, Human
ugcuuuuuggaaag

SEQ ID NO: 3229058 - RNA, 18 nt, Human
ugcuuuuggucuguguga

SEQ ID NO: 3229059 - RNA, 17 nt, Human
ugcuuuuggucugugug

SEQ ID NO: 3229060 - RNA, 23 nt, Human
ugcuuuuuaauauugauaugcuu

SEQ ID NO: 3229061 - RNA, 20 nt, Human
ugcuuuugucuaugggacuc

SEQ ID NO: 3229062 - RNA, 16 nt, Human
ugcuuugggcugcccu

SEQ ID NO: 3229063 - RNA, 18 nt, Human
ugcuuuguuaccuuaaaa

SEQ ID NO: 3229064 - RNA, 20 nt, Human
ugcuuuguuaccuuaaaacu

SEQ ID NO: 3229065 - RNA, 21 nt, Human
ugcuuuguuaccuuaaaacua

SEQ ID NO: 3229066 - RNA, 16 nt, Human
ugcuuuguugugugcc

SEQ ID NO: 3229067 - RNA, 15 nt, Human
ugcuuuguugugugc

SEQ ID NO: 3229068 - RNA, 21 nt, Human
ugcuuuguugugugccucuag

SEQ ID NO: 3229069 - RNA, 20 nt, Human
ugcuuuguugugugccucua

SEQ ID NO: 3229070 - RNA, 19 nt, Human
ugcuuuguugugugccucu

SEQ ID NO: 3229071 - RNA, 18 nt, Human
ugcuuuguugugugccuc

SEQ ID NO: 3229072 - RNA, 15 nt, Human
ugcuugagcucagga

SEQ ID NO: 3229073 - RNA, 20 nt, Human
ugcuugaauaaacaccacug

SEQ ID NO: 3229074 - RNA, 15 nt, Human
ugcuugaauaaacac

SEQ ID NO: 3229075 - RNA, 20 nt, Human
ugcuugaagcaaacaguuga

SEQ ID NO: 3229076 - RNA, 12 nt, Human
ugcuugaauaaa

SEQ ID NO: 3229077 - RNA, 19 nt, Human
ugcuugaagcaaacaguug

SEQ ID NO: 3229078 - RNA, 17 nt, Human
ugcuugaacuuacaggu

SEQ ID NO: 3229079 - RNA, 13 nt, Human
ugcuuuggaaauc

SEQ ID NO: 3229080 - RNA, 15 nt, Human
ugcuuugggcugccc

SEQ ID NO: 3229081 - RNA, 14 nt, Human
ugcuuugggcugcc

SEQ ID NO: 3229082 - RNA, 12 nt, Human
aggaucagucug

SEQ ID NO: 3229083 - RNA, 13 nt, Human
aggaucagucuga

SEQ ID NO: 3229084 - RNA, 21 nt, Human
aggauaucggcauuuguuucu

SEQ ID NO: 3229085 - RNA, 17 nt, Human
aggauaucggcauuugu

SEQ ID NO: 3229086 - RNA, 23 nt, Human
aggaugacaaaauucuuucuggu

SEQ ID NO: 3229087 - RNA, 19 nt, Human
aggauucuuccucccuccc

SEQ ID NO: 3229088 - RNA, 17 nt, Human
aggauucuuccucccuc

SEQ ID NO: 3229089 - RNA, 22 nt, Human
aggaugaucuaggaagacuuug

SEQ ID NO: 3229090 - RNA, 23 nt, Human
aggaugaucuaggaagacuuugg

SEQ ID NO: 3229091 - RNA, 16 nt, Human
aggauucuuccucccu

SEQ ID NO: 3229092 - RNA, 20 nt, Human
aggaugaucuaggaagacuu

SEQ ID NO: 3229093 - RNA, 16 nt, Human
uggaagcacagcuuca

SEQ ID NO: 3229094 - RNA, 20 nt, Human
uggaagcagguuaaauguuu

SEQ ID NO: 3229095 - RNA, 19 nt, Human
uggaagcagguuaaauguu

SEQ ID NO: 3229096 - RNA, 18 nt, Human
uggaagcagguuaaaugu

SEQ ID NO: 3229097 - RNA, 17 nt, Human
uggaagcagguuaaaug

SEQ ID NO: 3229098 - RNA, 20 nt, Human
uggaagcagugcccaggugg

SEQ ID NO: 3229099 - RNA, 19 nt, Human
uggaagcagugcccaggug

SEQ ID NO: 3229100 - RNA, 18 nt, Human
uggaagcagugcccaggu

SEQ ID NO: 3229101 - RNA, 17 nt, Human
uggaagcagugcccagg

SEQ ID NO: 3229102 - RNA, 16 nt, Human
uggaagcagugcccag

SEQ ID NO: 3229103 - RNA, 14 nt, Human
uggaagcagugccc

SEQ ID NO: 3229104 - RNA, 21 nt, Human
uggaagcagguuaaauguuuu

SEQ ID NO: 3229105 - RNA, 13 nt, Human
aggauauauuuua

SEQ ID NO: 3229106 - RNA, 18 nt, Human
aggauauauuuuauuuuu

SEQ ID NO: 3229107 - RNA, 14 nt, Human
aggauauauuuuau

SEQ ID NO: 3229108 - RNA, 18 nt, Human
aggaggcuccaggcagca

SEQ ID NO: 3229109 - RNA, 17 nt, Human
aggaggcuccaggcagc

SEQ ID NO: 3229110 - RNA, 12 nt, Human
aggaggcuccag

SEQ ID NO: 3229111 - RNA, 21 nt, Human
aggaggccuugggcucugcug

SEQ ID NO: 3229112 - RNA, 20 nt, Human
aggaggccuugggcucugcu

SEQ ID NO: 3229113 - RNA, 17 nt, Human
uggauucugagagcugu

SEQ ID NO: 3229114 - RNA, 16 nt, Human
uggauucugagagcug

SEQ ID NO: 3229115 - RNA, 17 nt, Human
uggauucuuguuuugcu

SEQ ID NO: 3229116 - RNA, 14 nt, Human
uggauuccuguuuc

SEQ ID NO: 3229117 - RNA, 23 nt, Human
uggaugccugguggcagcugcgg

SEQ ID NO: 3229118 - RNA, 21 nt, Human
uggaugccugguggcagcugc

SEQ ID NO: 3229119 - RNA, 20 nt, Human
uggaugccugguggcagcug

SEQ ID NO: 3229120 - RNA, 19 nt, Human
uggaguucucaaagaccug

SEQ ID NO: 3229121 - RNA, 15 nt, Human
uggaguuaaaaugca

SEQ ID NO: 3229122 - RNA, 16 nt, Human
uggagugcaaaaggcu

SEQ ID NO: 3229123 - RNA, 14 nt, Human
uggagugcagugag

SEQ ID NO: 3229124 - RNA, 12 nt, Human
uggagugaccaa

SEQ ID NO: 3229125 - RNA, 16 nt, Human
aggcauuugcugaaua

SEQ ID NO: 3229126 - RNA, 20 nt, Human
aggcauuugcugaauacaga

SEQ ID NO: 3229127 - RNA, 20 nt, Human
uggagguacgaaaagagggg

SEQ ID NO: 3229128 - RNA, 15 nt, Human
aggcccccaggugcc

SEQ ID NO: 3229129 - RNA, 14 nt, Human
aggccccgcccagg

SEQ ID NO: 3229130 - RNA, 18 nt, Human
aggcccccugccugcccu

SEQ ID NO: 3229131 - RNA, 15 nt, Human
aggcccccugccugc

SEQ ID NO: 3229132 - RNA, 17 nt, Human
aggcccggcuccaggcu

SEQ ID NO: 3229133 - RNA, 15 nt, Human
aggcccggccucuca

SEQ ID NO: 3229134 - RNA, 13 nt, Human
aggcccggcucca

SEQ ID NO: 3229135 - RNA, 13 nt, Human
aggcccggccucu

SEQ ID NO: 3229136 - RNA, 14 nt, Human
aggcccggccucuc

SEQ ID NO: 3229137 - RNA, 13 nt, Human
aggcccagagggc

SEQ ID NO: 3229138 - RNA, 20 nt, Human
aggcccagagagaagagccc

SEQ ID NO: 3229139 - RNA, 23 nt, Human
aggcccacccugcuuggcccagg

SEQ ID NO: 3229140 - RNA, 22 nt, Human
aggcccacccugcuuggcccag

SEQ ID NO: 3229141 - RNA, 15 nt, Human
aggcccacccugcuu

SEQ ID NO: 3229142 - RNA, 14 nt, Human
aggcccacccugcu

SEQ ID NO: 3229143 - RNA, 13 nt, Human
aggcccacccugc

SEQ ID NO: 3229144 - RNA, 12 nt, Human
aggcccacccug

SEQ ID NO: 3229145 - RNA, 18 nt, Human
aggcccaaccaccagaug

SEQ ID NO: 3229146 - RNA, 19 nt, Human
aggcccaaccaccagauga

SEQ ID NO: 3229147 - RNA, 23 nt, Human
aggcccagagagaagagccccac

SEQ ID NO: 3229148 - RNA, 22 nt, Human
aggcccagagagaagagcccca

SEQ ID NO: 3229149 - RNA, 13 nt, Human
aggccagccuuga

SEQ ID NO: 3229150 - RNA, 15 nt, Human
aggccagccuugacc

SEQ ID NO: 3229151 - RNA, 12 nt, Human
aggccaccuccu

SEQ ID NO: 3229152 - RNA, 23 nt, Human
aggccaccuccuaaaaggcccag

SEQ ID NO: 3229153 - RNA, 22 nt, Human
aggccaccuccuaaaaggccca

SEQ ID NO: 3229154 - RNA, 21 nt, Human
aggccaccuccuaaaaggccc

SEQ ID NO: 3229155 - RNA, 13 nt, Human
aggccaccuccua

SEQ ID NO: 3229156 - RNA, 23 nt, Human
aggccaccucuuccuggccggug

SEQ ID NO: 3229157 - RNA, 21 nt, Human
aggccaccucuuccuggccgg

SEQ ID NO: 3229158 - RNA, 15 nt, Human
aggccaccucuuccu

SEQ ID NO: 3229159 - RNA, 14 nt, Human
aggccaccucuucc

SEQ ID NO: 3229160 - RNA, 23 nt, Human
uggcagcucaccucucccuugga

SEQ ID NO: 3229161 - RNA, 21 nt, Human
uggcagcucaccucucccuug

SEQ ID NO: 3229162 - RNA, 22 nt, Human
uggcagcucaccucucccuugg

SEQ ID NO: 3229163 - RNA, 20 nt, Human
uggcacccggccccugcugg

SEQ ID NO: 3229164 - RNA, 19 nt, Human
uggcacccggccccugcug

SEQ ID NO: 3229165 - RNA, 18 nt, Human
uggcacccggccccugcu

SEQ ID NO: 3229166 - RNA, 16 nt, Human
uggcacccggccccug

SEQ ID NO: 3229167 - RNA, 15 nt, Human
uggagcacaaaauuc

SEQ ID NO: 3229168 - RNA, 16 nt, Human
uggagcacaaaauuca

SEQ ID NO: 3229169 - RNA, 17 nt, Human
uggagcacaaaauucaa

SEQ ID NO: 3229170 - RNA, 16 nt, Human
uggacuguucccugag

SEQ ID NO: 3229171 - RNA, 18 nt, Human
aggauugcuacuguccua

SEQ ID NO: 3229172 - RNA, 17 nt, Human
aggauugcuacuguccu

SEQ ID NO: 3229173 - RNA, 15 nt, Human
aggauugcuacuguc

SEQ ID NO: 3229174 - RNA, 17 nt, Human
uggacuguucccugagg

SEQ ID NO: 3229175 - RNA, 14 nt, Human
uggagaaaauggac

SEQ ID NO: 3229176 - RNA, 13 nt, Human
uggacuuaggaag

SEQ ID NO: 3229177 - RNA, 17 nt, Human
uggagccaauggagacu

SEQ ID NO: 3229178 - RNA, 17 nt, Human
aggcaagcaccuccugc

SEQ ID NO: 3229179 - RNA, 15 nt, Human
aggcaagcugaaauu

SEQ ID NO: 3229180 - RNA, 16 nt, Human
aggcaagcugaaauuu

SEQ ID NO: 3229181 - RNA, 21 nt, Human
aggcaagcugaaauuuuagaa

SEQ ID NO: 3229182 - RNA, 20 nt, Human
aggcaagcaccuccugccuc

SEQ ID NO: 3229183 - RNA, 19 nt, Human
aggcaagcaccuccugccu

SEQ ID NO: 3229184 - RNA, 18 nt, Human
aggcaagcaccuccugcc

SEQ ID NO: 3229185 - RNA, 16 nt, Human
aggcaaggcugucaau

SEQ ID NO: 3229186 - RNA, 13 nt, Human
aggcagcuguugu

SEQ ID NO: 3229187 - RNA, 12 nt, Human
aggcacaggcag

SEQ ID NO: 3229188 - RNA, 14 nt, Human
aggcacaggcaggg

SEQ ID NO: 3229189 - RNA, 13 nt, Human
aggcacaggcagg

SEQ ID NO: 3229190 - RNA, 15 nt, Human
aggcagcuugaaacu

SEQ ID NO: 3229191 - RNA, 21 nt, Human
aggcagcuguugucucuucuc

SEQ ID NO: 3229192 - RNA, 20 nt, Human
aggcagcuguugucucuucu

SEQ ID NO: 3229193 - RNA, 20 nt, Human
aggcaggggcccugcagcuc

SEQ ID NO: 3229194 - RNA, 19 nt, Human
aggcaggggcccugcagcu

SEQ ID NO: 3229195 - RNA, 18 nt, Human
aggcaggggcccugcagc

SEQ ID NO: 3229196 - RNA, 17 nt, Human
aggcaggggcccugcag

SEQ ID NO: 3229197 - RNA, 22 nt, Human
aggcaggggcccugcagcucuc

SEQ ID NO: 3229198 - RNA, 21 nt, Human
aggcaggggcccugcagcucu

SEQ ID NO: 3229199 - RNA, 22 nt, Human
aggcaggucuugaacuccuggc

SEQ ID NO: 3229200 - RNA, 12 nt, Human
aggcagggucuc

SEQ ID NO: 3229201 - RNA, 23 nt, Human
aggcaguuugaggauuaguuuag

SEQ ID NO: 3229202 - RNA, 20 nt, Human
aggcaguuugaggauuaguu

SEQ ID NO: 3229203 - RNA, 15 nt, Human
aggcauaaagucagg

SEQ ID NO: 3229204 - RNA, 17 nt, Human
aggcaggugggauggau

SEQ ID NO: 3229205 - RNA, 20 nt, Human
aggcaggugaucugcugcag

SEQ ID NO: 3229206 - RNA, 23 nt, Human
aggcaggugaucugcugcagagc

SEQ ID NO: 3229207 - RNA, 20 nt, Human
aggcauuuaggccaugggac

SEQ ID NO: 3229208 - RNA, 18 nt, Human
aggcauugugggaagggg

SEQ ID NO: 3229209 - RNA, 18 nt, Human
aggcauuucccacccuga

SEQ ID NO: 3229210 - RNA, 22 nt, Human
aggcauaaagucagggguuccc

SEQ ID NO: 3229211 - RNA, 21 nt, Human
aggcauugccucggcuggcuc

SEQ ID NO: 3229212 - RNA, 23 nt, Human
aguaaugucauaaagugagaaaa

SEQ ID NO: 3229213 - RNA, 20 nt, Human
aguaauauaauacacaaaau

SEQ ID NO: 3229214 - RNA, 14 nt, Human
aguaauauaauaca

SEQ ID NO: 3229215 - RNA, 17 nt, Human
aguaauauauuuaaagg

SEQ ID NO: 3229216 - RNA, 16 nt, Human
aguaauauauuuaaag

SEQ ID NO: 3229217 - RNA, 21 nt, Human
aguaauauauuuaaagggaaa

SEQ ID NO: 3229218 - RNA, 16 nt, Human
aguacagguacuuugu

SEQ ID NO: 3229219 - RNA, 20 nt, Human
aguacagguacuuugucuaa

SEQ ID NO: 3229220 - RNA, 17 nt, Human
aguacagguacuuuguc

SEQ ID NO: 3229221 - RNA, 20 nt, Human
aguacauucucaguuuuucu

SEQ ID NO: 3229222 - RNA, 17 nt, Human
aguacauucucaguuuu

SEQ ID NO: 3229223 - RNA, 16 nt, Human
aguacauucucaguuu

SEQ ID NO: 3229224 - RNA, 13 nt, Human
aguacauucucag

SEQ ID NO: 3229225 - RNA, 13 nt, Human
aguacauuuaaau

SEQ ID NO: 3229226 - RNA, 15 nt, Human
aguacauuuaaauuu

SEQ ID NO: 3229227 - RNA, 16 nt, Human
aguacauuuaaauuuu

SEQ ID NO: 3229228 - RNA, 19 nt, Human
aguacauuuaaauuuuuug

SEQ ID NO: 3229229 - RNA, 21 nt, Human
aguacauuuaaauuuuuuggc

SEQ ID NO: 3229230 - RNA, 23 nt, Human
aguaccauuuaauggggaggaca

SEQ ID NO: 3229231 - RNA, 12 nt, Human
aguaccauuuaa

SEQ ID NO: 3229232 - RNA, 12 nt, Human
aguacccugguu

SEQ ID NO: 3229233 - RNA, 18 nt, Human
aguacccugguugugugu

SEQ ID NO: 3229234 - RNA, 19 nt, Human
aguacccugguuguguguc

SEQ ID NO: 3229235 - RNA, 20 nt, Human
aguagaagucuuagauguau

SEQ ID NO: 3229236 - RNA, 19 nt, Human
aguagaagucuuagaugua

SEQ ID NO: 3229237 - RNA, 21 nt, Human
aguagaagucuuagauguaua

SEQ ID NO: 3229238 - RNA, 17 nt, Human
aguagaagucuuagaug

SEQ ID NO: 3229239 - RNA, 13 nt, Human
aguagaauguagu

SEQ ID NO: 3229240 - RNA, 17 nt, Human
uguaggcauaaagucag

SEQ ID NO: 3229241 - RNA, 20 nt, Human
uguaggcauaaagucagggg

SEQ ID NO: 3229242 - RNA, 11 nt, Human
aguagagacag

SEQ ID NO: 3229243 - RNA, 14 nt, Human
aguagacuccaaca

SEQ ID NO: 3229244 - RNA, 15 nt, Human
aguagacuacuguuc

SEQ ID NO: 3229245 - RNA, 19 nt, Human
aguagacuugcuuugguca

SEQ ID NO: 3229246 - RNA, 12 nt, Human
aguagacauuua

SEQ ID NO: 3229247 - RNA, 14 nt, Human
aguagacauuuaua

SEQ ID NO: 3229248 - RNA, 19 nt, Human
aguagcgguaccaaugcag

SEQ ID NO: 3229249 - RNA, 16 nt, Human
aguagcgcuauaguua

SEQ ID NO: 3229250 - RNA, 21 nt, Human
aguagcgcuauaguuacuguc

SEQ ID NO: 3229251 - RNA, 19 nt, Human
uguacuuuaucaugaaugc

SEQ ID NO: 3229252 - RNA, 20 nt, Human
uguacuuuaucaugaaugcu

SEQ ID NO: 3229253 - RNA, 21 nt, Human
uguacuuuaucaugaaugcuu

SEQ ID NO: 3229254 - RNA, 15 nt, Human
uguacuuucuguuaa

SEQ ID NO: 3229255 - RNA, 13 nt, Human
uguacuuucuguu

SEQ ID NO: 3229256 - RNA, 12 nt, Human
uguacuuucugu

SEQ ID NO: 3229257 - RNA, 20 nt, Human
uguacuuugauucacauguu

SEQ ID NO: 3229258 - RNA, 19 nt, Human
uguacuuugauucacaugu

SEQ ID NO: 3229259 - RNA, 18 nt, Human
uguacuuugauucacaug

SEQ ID NO: 3229260 - RNA, 17 nt, Human
uguacuuugauucacau

SEQ ID NO: 3229261 - RNA, 19 nt, Human
uguacuuucuguuaaaaug

SEQ ID NO: 3229262 - RNA, 23 nt, Human
agguuuguuuagaagaagugugu

SEQ ID NO: 3229263 - RNA, 14 nt, Human
uguagagcuucugg

SEQ ID NO: 3229264 - RNA, 18 nt, Human
agguuuuaaaagccuugg

SEQ ID NO: 3229265 - RNA, 17 nt, Human
agguuuguuuugugaau

SEQ ID NO: 3229266 - RNA, 20 nt, Human
agguuuguuuugugaauuuu

SEQ ID NO: 3229267 - RNA, 18 nt, Human
uguagagccagggucuca

SEQ ID NO: 3229268 - RNA, 16 nt, Human
uguagagccagggucu

SEQ ID NO: 3229269 - RNA, 20 nt, Human
aguaaaaccacagcaguuga

SEQ ID NO: 3229270 - RNA, 17 nt, Human
agguuuuuguaaagauu

SEQ ID NO: 3229271 - RNA, 16 nt, Human
agguuuuuguaaagau

SEQ ID NO: 3229272 - RNA, 23 nt, Human
aguaaaagaagaaauaguucugu

SEQ ID NO: 3229273 - RNA, 22 nt, Human
agguuuuuguaaagauuucugu

SEQ ID NO: 3229274 - RNA, 23 nt, Human
agguuuuugauagcauuguaagc

SEQ ID NO: 3229275 - RNA, 15 nt, Human
agguuuuuguaaaga

SEQ ID NO: 3229276 - RNA, 13 nt, Human
agguuuuuguaaa

SEQ ID NO: 3229277 - RNA, 17 nt, Human
aguaaaauacucuuuuu

SEQ ID NO: 3229278 - RNA, 16 nt, Human
aguaaaauuauacugu

SEQ ID NO: 3229279 - RNA, 18 nt, Human
aguaaaauuauacugugu

SEQ ID NO: 3229280 - RNA, 21 nt, Human
aguaaaauuauacugugugug

SEQ ID NO: 3229281 - RNA, 17 nt, Human
aguaaaauaauaauuuu

SEQ ID NO: 3229282 - RNA, 12 nt, Human
uguauguggggg

SEQ ID NO: 3229283 - RNA, 19 nt, Human
uguauguguguuucugucc

SEQ ID NO: 3229284 - RNA, 20 nt, Human
uguauguguguuucuguccu

SEQ ID NO: 3229285 - RNA, 15 nt, Human
uguauguguuuagaa

SEQ ID NO: 3229286 - RNA, 16 nt, Human
uguauguguuuagaau

SEQ ID NO: 3229287 - RNA, 19 nt, Human
uguauguguuuagaauuga

SEQ ID NO: 3229288 - RNA, 20 nt, Human
uguauguguuuagaauugaa

SEQ ID NO: 3229289 - RNA, 12 nt, Human
uguauguguuua

SEQ ID NO: 3229290 - RNA, 14 nt, Human
uguauguguuuaga

SEQ ID NO: 3229291 - RNA, 11 nt, Human
uguauguguuu

SEQ ID NO: 3229292 - RNA, 23 nt, Human
uguaucaaauacauuuaaaacau

SEQ ID NO: 3229293 - RNA, 21 nt, Human
uguaucaaauacauuuaaaac

SEQ ID NO: 3229294 - RNA, 14 nt, Human
uguaucaaauacau

SEQ ID NO: 3229295 - RNA, 13 nt, Human
uguaucaguguuu

SEQ ID NO: 3229296 - RNA, 15 nt, Human
uguaucaguguuuau

SEQ ID NO: 3229297 - RNA, 18 nt, Human
uguaucaguguuuaugug

SEQ ID NO: 3229298 - RNA, 23 nt, Human
uguaucaguguuuaugugcuauu

SEQ ID NO: 3229299 - RNA, 15 nt, Human
uguaugucaaagcuu

SEQ ID NO: 3229300 - RNA, 17 nt, Human
uguaugucaaagcuuug

SEQ ID NO: 3229301 - RNA, 15 nt, Human
uguauguauaauuca

SEQ ID NO: 3229302 - RNA, 12 nt, Human
uguauguauaau

SEQ ID NO: 3229303 - RNA, 13 nt, Human
uguauguauaauu

SEQ ID NO: 3229304 - RNA, 16 nt, Human
uguaguguucagaaaa

SEQ ID NO: 3229305 - RNA, 17 nt, Human
uguagugccgcucuugg

SEQ ID NO: 3229306 - RNA, 12 nt, Human
uguauauuuuau

SEQ ID NO: 3229307 - RNA, 15 nt, Human
uguauauuuuauaua

SEQ ID NO: 3229308 - RNA, 17 nt, Human
uguauauuuuauauaaa

SEQ ID NO: 3229309 - RNA, 22 nt, Human
uguauauuuuuaucuauauaaa

SEQ ID NO: 3229310 - RNA, 18 nt, Human
uguaucacaaaucuuaac

SEQ ID NO: 3229311 - RNA, 15 nt, Human
uguaucacaaaucuu

SEQ ID NO: 3229312 - RNA, 17 nt, Human
uguaucaaugaguaaca

SEQ ID NO: 3229313 - RNA, 18 nt, Human
uguaguguucagaaaaaa

SEQ ID NO: 3229314 - RNA, 17 nt, Human
uguauucccauaucaaa

SEQ ID NO: 3229315 - RNA, 22 nt, Human
uguauguuuuucaguucaaagu

SEQ ID NO: 3229316 - RNA, 21 nt, Human
uguauguuuuucaguucaaag

SEQ ID NO: 3229317 - RNA, 20 nt, Human
uguauguuuuucaguucaaa

SEQ ID NO: 3229318 - RNA, 18 nt, Human
uguauguuuuucaguuca

SEQ ID NO: 3229319 - RNA, 13 nt, Human
uguauguuuuuca

SEQ ID NO: 3229320 - RNA, 16 nt, Human
uguauguuuuucaguu

SEQ ID NO: 3229321 - RNA, 15 nt, Human
uguauguuuuucagu

SEQ ID NO: 3229322 - RNA, 16 nt, Human
ugucaaaaaucaauau

SEQ ID NO: 3229323 - RNA, 20 nt, Human
ugucaaacauuaguacuuua

SEQ ID NO: 3229324 - RNA, 20 nt, Human
ugucaaaaguagaacuuugu

SEQ ID NO: 3229325 - RNA, 21 nt, Human
ugucaaaaguagaacuuugua

SEQ ID NO: 3229326 - RNA, 12 nt, Human
ugucaaaaguag

SEQ ID NO: 3229327 - RNA, 17 nt, Human
ugucaaaaguagaacuu

SEQ ID NO: 3229328 - RNA, 22 nt, Human
ugucaaaaguagaacuuuguau

SEQ ID NO: 3229329 - RNA, 12 nt, Human
ugucaaacauua

SEQ ID NO: 3229330 - RNA, 20 nt, Human
aguaggucguuuuaaaaaca

SEQ ID NO: 3229331 - RNA, 17 nt, Human
ugucaauuacaggaagu

SEQ ID NO: 3229332 - RNA, 20 nt, Human
aguagggguaccacugaauc

SEQ ID NO: 3229333 - RNA, 12 nt, Human
ugucaaugugug

SEQ ID NO: 3229334 - RNA, 13 nt, Human
ugucaaugugugc

SEQ ID NO: 3229335 - RNA, 14 nt, Human
ugucaauuacagga

SEQ ID NO: 3229336 - RNA, 15 nt, Human
ugucaauuacaggaa

SEQ ID NO: 3229337 - RNA, 18 nt, Human
ugucaaguggcaaagcug

SEQ ID NO: 3229338 - RNA, 17 nt, Human
ugucaagugucaguaag

SEQ ID NO: 3229339 - RNA, 17 nt, Human
ugucaaguggcaaagcu

SEQ ID NO: 3229340 - RNA, 18 nt, Human
aguauuacuucugcuaca

SEQ ID NO: 3229341 - RNA, 15 nt, Human
aguauuacuucugcu

SEQ ID NO: 3229342 - RNA, 16 nt, Human
aguaugguggcugggu

SEQ ID NO: 3229343 - RNA, 15 nt, Human
aguaugguggcuggg

SEQ ID NO: 3229344 - RNA, 20 nt, Human
aguaguaaaagaagaaauag

SEQ ID NO: 3229345 - RNA, 17 nt, Human
aguaguacuucuucugu

SEQ ID NO: 3229346 - RNA, 18 nt, Human
aguaguacuucuucugua

SEQ ID NO: 3229347 - RNA, 20 nt, Human
aguaguacuucuucuguaau

SEQ ID NO: 3229348 - RNA, 21 nt, Human
aguaguacuucuucuguaaua

SEQ ID NO: 3229349 - RNA, 22 nt, Human
aguaguacuucuucuguaauau

SEQ ID NO: 3229350 - RNA, 23 nt, Human
aguaguacuucuucuguaauauu

SEQ ID NO: 3229351 - RNA, 23 nt, Human
agucacacaguauuacuucugcu

SEQ ID NO: 3229352 - RNA, 14 nt, Human
aguaugguggcugg

SEQ ID NO: 3229353 - RNA, 12 nt, Human
aguauucuuuuu

SEQ ID NO: 3229354 - RNA, 14 nt, Human
aguauucuuuuucu

SEQ ID NO: 3229355 - RNA, 23 nt, Human
agucacacagugagucgaggaca

SEQ ID NO: 3229356 - RNA, 15 nt, Human
agucacacagugagu

SEQ ID NO: 3229357 - RNA, 19 nt, Human
agucaccccggccaccugc

SEQ ID NO: 3229358 - RNA, 22 nt, Human
aggugcccagaaugaggcugcu

SEQ ID NO: 3229359 - RNA, 18 nt, Human
aggugcccagaaugaggc

SEQ ID NO: 3229360 - RNA, 15 nt, Human
aggugcccgccacca

SEQ ID NO: 3229361 - RNA, 20 nt, Human
aggugauccacccaccucag

SEQ ID NO: 3229362 - RNA, 14 nt, Human
aggugauccaccca

SEQ ID NO: 3229363 - RNA, 16 nt, Human
aggugggauccuccag

SEQ ID NO: 3229364 - RNA, 17 nt, Human
aggugggauccuccagg

SEQ ID NO: 3229365 - RNA, 23 nt, Human
agguggggcagcuugaggguugg

SEQ ID NO: 3229366 - RNA, 16 nt, Human
agguggggcagcuuga

SEQ ID NO: 3229367 - RNA, 18 nt, Human
aggugccucaagagaagg

SEQ ID NO: 3229368 - RNA, 15 nt, Human
aggugggauccucca

SEQ ID NO: 3229369 - RNA, 13 nt, Human
aggugccuccuga

SEQ ID NO: 3229370 - RNA, 20 nt, Human
aggugugcucugaucaucca

SEQ ID NO: 3229371 - RNA, 15 nt, Human
aggugugcucugauc

SEQ ID NO: 3229372 - RNA, 17 nt, Human
aggugugaaccaccaca

SEQ ID NO: 3229373 - RNA, 19 nt, Human
agguggggucacucuggca

SEQ ID NO: 3229374 - RNA, 20 nt, Human
aggugucccugcacuugcag

SEQ ID NO: 3229375 - RNA, 14 nt, Human
agguuuaagcuguu

SEQ ID NO: 3229376 - RNA, 19 nt, Human
agguuuaaguagauuucau

SEQ ID NO: 3229377 - RNA, 20 nt, Human
agguuuaaguagauuucaug

SEQ ID NO: 3229378 - RNA, 18 nt, Human
agguucugggugcaggag

SEQ ID NO: 3229379 - RNA, 20 nt, Human
agguucucucuacugguccu

SEQ ID NO: 3229380 - RNA, 12 nt, Human
agguucucucua

SEQ ID NO: 3229381 - RNA, 12 nt, Human
aggugugcucug

SEQ ID NO: 3229382 - RNA, 24 nt, Human
agguguggcagaagcuugcagaug

SEQ ID NO: 3229383 - RNA, 21 nt, Human
uguaaauacuguuuuuaacaa

SEQ ID NO: 3229384 - RNA, 12 nt, Human
uguaaauagguu

SEQ ID NO: 3229385 - RNA, 13 nt, Human
uguaaauagguuu

SEQ ID NO: 3229386 - RNA, 22 nt, Human
uguaaauaauucuuuuuuauua

SEQ ID NO: 3229387 - RNA, 23 nt, Human
uguaaauaauucuuuuuuauuaa

SEQ ID NO: 3229388 - RNA, 16 nt, Human
uguaaauagcucaggu

SEQ ID NO: 3229389 - RNA, 15 nt, Human
uguaaauagcucagg

SEQ ID NO: 3229390 - RNA, 17 nt, Human
uguaaauaaaggaacca

SEQ ID NO: 3229391 - RNA, 14 nt, Human
uguaaauaauucuu

SEQ ID NO: 3229392 - RNA, 15 nt, Human
uguaaauaauucuuu

SEQ ID NO: 3229393 - RNA, 20 nt, Human
uguaaagugugugauugaag

SEQ ID NO: 3229394 - RNA, 19 nt, Human
uguaaauaaagaacuagca

SEQ ID NO: 3229395 - RNA, 18 nt, Human
uguaaagaaaaauauuua

SEQ ID NO: 3229396 - RNA, 21 nt, Human
uguaaaggucacuuuucacau

SEQ ID NO: 3229397 - RNA, 18 nt, Human
uguaaaggucacuuuuca

SEQ ID NO: 3229398 - RNA, 16 nt, Human
uguaaaggucacuuuu

SEQ ID NO: 3229399 - RNA, 16 nt, Human
uguaaagaaaaauauu

SEQ ID NO: 3229400 - RNA, 15 nt, Human
uguaaagaaaaauau

SEQ ID NO: 3229401 - RNA, 13 nt, Human
uguaaagaaaaau

SEQ ID NO: 3229402 - RNA, 18 nt, Human
uguaaacuuugaaauaua

SEQ ID NO: 3229403 - RNA, 17 nt, Human
uguaaacuuugaaauau

SEQ ID NO: 3229404 - RNA, 16 nt, Human
uguaaacuuugaaaua

SEQ ID NO: 3229405 - RNA, 15 nt, Human
uguaaacuuugaaau

SEQ ID NO: 3229406 - RNA, 14 nt, Human
uguaaacuuugaaa

SEQ ID NO: 3229407 - RNA, 13 nt, Human
uguaaacuuugaa

SEQ ID NO: 3229408 - RNA, 12 nt, Human
uguaaacuuuga

SEQ ID NO: 3229409 - RNA, 22 nt, Human
ugguuauagugcaauauauuuu

SEQ ID NO: 3229410 - RNA, 21 nt, Human
ugguuauagugcaauauauuu

SEQ ID NO: 3229411 - RNA, 20 nt, Human
ugguuauagugcaauauauu

SEQ ID NO: 3229412 - RNA, 19 nt, Human
ugguuauagugcaauauau

SEQ ID NO: 3229413 - RNA, 18 nt, Human
ugguuauagugcaauaua

SEQ ID NO: 3229414 - RNA, 13 nt, Human
ugguuagaaaaca

SEQ ID NO: 3229415 - RNA, 14 nt, Human
ugguuauagugcaa

SEQ ID NO: 3229416 - RNA, 14 nt, Human
ugguuuccugcccu

SEQ ID NO: 3229417 - RNA, 15 nt, Human
ugguuuccugcccug

SEQ ID NO: 3229418 - RNA, 12 nt, Human
ugguuuccugcc

SEQ ID NO: 3229419 - RNA, 13 nt, Human
ugguuuccugccc

SEQ ID NO: 3229420 - RNA, 17 nt, Human
ugguuaugaauacuuug

SEQ ID NO: 3229421 - RNA, 17 nt, Human
ugguuuucaaaauaaaa

SEQ ID NO: 3229422 - RNA, 15 nt, Human
ugguuuucaaaauaa

SEQ ID NO: 3229423 - RNA, 22 nt, Human
ugguuuggugcuuuuuauaaaa

SEQ ID NO: 3229424 - RNA, 17 nt, Human
ugguuugggggagaaga

SEQ ID NO: 3229425 - RNA, 19 nt, Human
ugguuuucaaccucuagaa

SEQ ID NO: 3229426 - RNA, 15 nt, Human
ugguuuuaugaugac

SEQ ID NO: 3229427 - RNA, 21 nt, Human
ugguuuucaaccucuagaauu

SEQ ID NO: 3229428 - RNA, 20 nt, Human
ugguuuucaaccucuagaau

SEQ ID NO: 3229429 - RNA, 14 nt, Human
ugguuuucaaaaua

SEQ ID NO: 3229430 - RNA, 11 nt, Human
ugguuuggaau

SEQ ID NO: 3229431 - RNA, 17 nt, Human
ugguuuggaauauuaaa

SEQ ID NO: 3229432 - RNA, 20 nt, Human
ugguuuggaauauuaaaaaa

SEQ ID NO: 3229433 - RNA, 15 nt, Human
aggugauaaaaucau

SEQ ID NO: 3229434 - RNA, 15 nt, Human
aggugauaagggaaa

SEQ ID NO: 3229435 - RNA, 21 nt, Human
aggugauaagggaaaagauaa

SEQ ID NO: 3229436 - RNA, 14 nt, Human
aggugauaaaauca

SEQ ID NO: 3229437 - RNA, 17 nt, Human
uggugcgaucuggguuc

SEQ ID NO: 3229438 - RNA, 16 nt, Human
uggugcgaucuggguu

SEQ ID NO: 3229439 - RNA, 13 nt, Human
uggugcugccaca

SEQ ID NO: 3229440 - RNA, 18 nt, Human
uggugcugccacacuuca

SEQ ID NO: 3229441 - RNA, 19 nt, Human
uggugucgggcaugacacg

SEQ ID NO: 3229442 - RNA, 15 nt, Human
ugguggcagcugcgg

SEQ ID NO: 3229443 - RNA, 13 nt, Human
ugguggcagcugc

SEQ ID NO: 3229444 - RNA, 14 nt, Human
ugguggcagcugcg

SEQ ID NO: 3229445 - RNA, 18 nt, Human
uggugcuuuccuguuucu

SEQ ID NO: 3229446 - RNA, 17 nt, Human
uggugcuuuuuauaaaa

SEQ ID NO: 3229447 - RNA, 21 nt, Human
ugguggagaggcccggccucu

SEQ ID NO: 3229448 - RNA, 18 nt, Human
ugguuaggcauuguggga

SEQ ID NO: 3229449 - RNA, 20 nt, Human
ugguuaggcauugugggaag

SEQ ID NO: 3229450 - RNA, 15 nt, Human
uggucagauuugaac

SEQ ID NO: 3229451 - RNA, 20 nt, Human
ugguagcugggaaagcauaa

SEQ ID NO: 3229452 - RNA, 16 nt, Human
uggucagauuugaacu

SEQ ID NO: 3229453 - RNA, 13 nt, Human
aggucagagccug

SEQ ID NO: 3229454 - RNA, 18 nt, Human
aggucagagccugcaguu

SEQ ID NO: 3229455 - RNA, 17 nt, Human
aggucagagccugcagu

SEQ ID NO: 3229456 - RNA, 15 nt, Human
aggucagagccugca

SEQ ID NO: 3229457 - RNA, 14 nt, Human
aggucagagccugc

SEQ ID NO: 3229458 - RNA, 16 nt, Human
aggucuugaacuccug

SEQ ID NO: 3229459 - RNA, 15 nt, Human
aggucagcucagagc

SEQ ID NO: 3229460 - RNA, 16 nt, Human
uggucacuucuucugu

SEQ ID NO: 3229461 - RNA, 15 nt, Human
uggucacuucuucug

SEQ ID NO: 3229462 - RNA, 19 nt, Human
agguccacaacacacagau

SEQ ID NO: 3229463 - RNA, 16 nt, Human
aggugagaagcagagg

SEQ ID NO: 3229464 - RNA, 21 nt, Human
aggugagaagcagaggaagga

SEQ ID NO: 3229465 - RNA, 23 nt, Human
aggugagaagcagaggaaggaga

SEQ ID NO: 3229466 - RNA, 22 nt, Human
aggugagcaagcccaggagaau

SEQ ID NO: 3229467 - RNA, 15 nt, Human
aggugacagagugag

SEQ ID NO: 3229468 - RNA, 13 nt, Human
aggugacagagug

SEQ ID NO: 3229469 - RNA, 17 nt, Human
aggucuugaacuccugg

SEQ ID NO: 3229470 - RNA, 13 nt, Human
aggugaccccagg

SEQ ID NO: 3229471 - RNA, 22 nt, Human
aggugacagagugagacucugu

SEQ ID NO: 3229472 - RNA, 23 nt, Human
aggugaaggaggcuccaggcagc

SEQ ID NO: 3229473 - RNA, 15 nt, Human
uggggcucagagugg

SEQ ID NO: 3229474 - RNA, 22 nt, Human
uggggcugcaccggcuggccug

SEQ ID NO: 3229475 - RNA, 23 nt, Human
uggggcugcaccggcuggccugg

SEQ ID NO: 3229476 - RNA, 15 nt, Human
uggggcucccgccuc

SEQ ID NO: 3229477 - RNA, 23 nt, Human
uggggcucccgccuccaaccccu

SEQ ID NO: 3229478 - RNA, 16 nt, Human
uggggcucccgccucc

SEQ ID NO: 3229479 - RNA, 22 nt, Human
uggggagggauuuggggcucag

SEQ ID NO: 3229480 - RNA, 21 nt, Human
uggggccaguuggucccccuu

SEQ ID NO: 3229481 - RNA, 20 nt, Human
uggggccauugcuuaccuug

SEQ ID NO: 3229482 - RNA, 13 nt, Human
uggggcccaaaug

SEQ ID NO: 3229483 - RNA, 14 nt, Human
uggggcccaaaugc

SEQ ID NO: 3229484 - RNA, 12 nt, Human
uggggcccugcc

SEQ ID NO: 3229485 - RNA, 16 nt, Human
uggggaccucaggccu

SEQ ID NO: 3229486 - RNA, 17 nt, Human
uggggaccucaggccug

SEQ ID NO: 3229487 - RNA, 14 nt, Human
uggggagggauuug

SEQ ID NO: 3229488 - RNA, 12 nt, Human
uggggaggacaa

SEQ ID NO: 3229489 - RNA, 12 nt, Human
agggcuccagac

SEQ ID NO: 3229490 - RNA, 14 nt, Human
uggggaccucaggc

SEQ ID NO: 3229491 - RNA, 15 nt, Human
uggggaccucaggcc

SEQ ID NO: 3229492 - RNA, 17 nt, Human
agggcucugacaaagcu

SEQ ID NO: 3229493 - RNA, 22 nt, Human
uggggucagguugacaggaggu

SEQ ID NO: 3229494 - RNA, 22 nt, Human
uggggucaggccgggcagagca

SEQ ID NO: 3229495 - RNA, 20 nt, Human
uggggucaggccgggcagag

SEQ ID NO: 3229496 - RNA, 22 nt, Human
uggggucacucuggcagcucag

SEQ ID NO: 3229497 - RNA, 19 nt, Human
uggggucaggccgggcaga

SEQ ID NO: 3229498 - RNA, 16 nt, Human
uggggucacucuggca

SEQ ID NO: 3229499 - RNA, 20 nt, Human
uggggucacucuggcagcuc

SEQ ID NO: 3229500 - RNA, 14 nt, Human
uggggcugcuguga

SEQ ID NO: 3229501 - RNA, 13 nt, Human
uggggucacucug

SEQ ID NO: 3229502 - RNA, 14 nt, Human
uggggucacucugg

SEQ ID NO: 3229503 - RNA, 15 nt, Human
ugggguaugggagag

SEQ ID NO: 3229504 - RNA, 19 nt, Human
ugggguacccacugcucug

SEQ ID NO: 3229505 - RNA, 18 nt, Human
ugggguacccacugcucu

SEQ ID NO: 3229506 - RNA, 17 nt, Human
ugggguacccacugcuc

SEQ ID NO: 3229507 - RNA, 13 nt, Human
aggggaauguuug

SEQ ID NO: 3229508 - RNA, 21 nt, Human
aggggaauaaacuguugaguc

SEQ ID NO: 3229509 - RNA, 16 nt, Human
aggggaagaauaauuu

SEQ ID NO: 3229510 - RNA, 18 nt, Human
aggggaaaaucagccugc

SEQ ID NO: 3229511 - RNA, 22 nt, Human
aggggaaaaucagccugcucca

SEQ ID NO: 3229512 - RNA, 14 nt, Human
aggggaacagacug

SEQ ID NO: 3229513 - RNA, 13 nt, Human
aggggaaaagagg

SEQ ID NO: 3229514 - RNA, 14 nt, Human
agggcuuuucaaaa

SEQ ID NO: 3229515 - RNA, 13 nt, Human
agggcuuuucaaa

SEQ ID NO: 3229516 - RNA, 18 nt, Human
agggcuuuccugugccag

SEQ ID NO: 3229517 - RNA, 23 nt, Human
agggcuuuaaaauucucuuccaa

SEQ ID NO: 3229518 - RNA, 18 nt, Human
agggcuuuaaaauucucu

SEQ ID NO: 3229519 - RNA, 20 nt, Human
agggcuuuaaaauucucuuc

SEQ ID NO: 3229520 - RNA, 19 nt, Human
agggcuuuaaaauucucuu

SEQ ID NO: 3229521 - RNA, 21 nt, Human
uggggucucucacagacagga

SEQ ID NO: 3229522 - RNA, 17 nt, Human
uggggucucucacagac

SEQ ID NO: 3229523 - RNA, 22 nt, Human
uggggucuccucaggaccaggg

SEQ ID NO: 3229524 - RNA, 19 nt, Human
uggggucuccucaggacca

SEQ ID NO: 3229525 - RNA, 15 nt, Human
agggugggagugggc

SEQ ID NO: 3229526 - RNA, 16 nt, Human
aggguggugaccucug

SEQ ID NO: 3229527 - RNA, 19 nt, Human
uggguccccagcccuuccu

SEQ ID NO: 3229528 - RNA, 16 nt, Human
uggguccccagcccuu

SEQ ID NO: 3229529 - RNA, 15 nt, Human
uggguccccagcccu

SEQ ID NO: 3229530 - RNA, 14 nt, Human
ugggugcaggagcg

SEQ ID NO: 3229531 - RNA, 20 nt, Human
ugggugcaggagcgcucccu

SEQ ID NO: 3229532 - RNA, 16 nt, Human
ugggucgcccaugaga

SEQ ID NO: 3229533 - RNA, 12 nt, Human
ugguaagagaaa

SEQ ID NO: 3229534 - RNA, 13 nt, Human
ugguaagagaaaa

SEQ ID NO: 3229535 - RNA, 14 nt, Human
ugguaagagaaaag

SEQ ID NO: 3229536 - RNA, 22 nt, Human
ugguaagaaaaagcaaaaggca

SEQ ID NO: 3229537 - RNA, 17 nt, Human
ugguaagaaaaagcaaa

SEQ ID NO: 3229538 - RNA, 13 nt, Human
ugguaagaaaaag

SEQ ID NO: 3229539 - RNA, 12 nt, Human
ugguaagaaaaa

SEQ ID NO: 3229540 - RNA, 10 nt, Human
ugguaacauu

SEQ ID NO: 3229541 - RNA, 17 nt, Human
uggguggcaccagcagc

SEQ ID NO: 3229542 - RNA, 20 nt, Human
uggguggcaccagcagccug

SEQ ID NO: 3229543 - RNA, 21 nt, Human
uggguggcaccagcagccugg

SEQ ID NO: 3229544 - RNA, 20 nt, Human
ugguagagugugccugaagu

SEQ ID NO: 3229545 - RNA, 13 nt, Human
ugguaccuugcac

SEQ ID NO: 3229546 - RNA, 23 nt, Human
ugguaagaaaaagcaaaaggcau

SEQ ID NO: 3229547 - RNA, 18 nt, Human
aggggagcaugggaagug

SEQ ID NO: 3229548 - RNA, 20 nt, Human
aggggaaucuggagguagcc

SEQ ID NO: 3229549 - RNA, 14 nt, Human
aggggaaugagggg

SEQ ID NO: 3229550 - RNA, 17 nt, Human
aggggaaugagggggcu

SEQ ID NO: 3229551 - RNA, 19 nt, Human
aggggaaugagggggcuca

SEQ ID NO: 3229552 - RNA, 20 nt, Human
aggggaaugagggggcucag

SEQ ID NO: 3229553 - RNA, 16 nt, Human
aggggagccaggaggg

SEQ ID NO: 3229554 - RNA, 15 nt, Human
aggggagccaggagg

SEQ ID NO: 3229555 - RNA, 13 nt, Human
aggggagccagga

SEQ ID NO: 3229556 - RNA, 12 nt, Human
aggggagccagg

SEQ ID NO: 3229557 - RNA, 20 nt, Human
aggggaauguuugccucugc

SEQ ID NO: 3229558 - RNA, 19 nt, Human
aggggaauguuugccucug

SEQ ID NO: 3229559 - RNA, 21 nt, Human
aggggaauguuugccucugcc

SEQ ID NO: 3229560 - RNA, 20 nt, Human
aggggguggccucccaacuc

SEQ ID NO: 3229561 - RNA, 18 nt, Human
aggggguggccucccaac

SEQ ID NO: 3229562 - RNA, 19 nt, Human
agggguaccacugaaucug

SEQ ID NO: 3229563 - RNA, 16 nt, Human
agggguaccacugaau

SEQ ID NO: 3229564 - RNA, 16 nt, Human
agggucucacucuguc

SEQ ID NO: 3229565 - RNA, 15 nt, Human
agggucucacucugu

SEQ ID NO: 3229566 - RNA, 14 nt, Human
agggucucacucug

SEQ ID NO: 3229567 - RNA, 15 nt, Human
aggguaaggcugugg

SEQ ID NO: 3229568 - RNA, 21 nt, Human
agggguuuucuugauaauuuu

SEQ ID NO: 3229569 - RNA, 11 nt, Human
agggguuuaca

SEQ ID NO: 3229570 - RNA, 14 nt, Human
agggguuuacagug

SEQ ID NO: 3229571 - RNA, 15 nt, Human
agggguuuacaguga

SEQ ID NO: 3229572 - RNA, 19 nt, Human
ugggagaaugucaguaugu

SEQ ID NO: 3229573 - RNA, 20 nt, Human
ugggagaaugucaguaugug

SEQ ID NO: 3229574 - RNA, 22 nt, Human
ugggagaaugucaguaugugga

SEQ ID NO: 3229575 - RNA, 22 nt, Human
ugggagaaccaaaaagaggcua

SEQ ID NO: 3229576 - RNA, 17 nt, Human
ugggagaagggcagagu

SEQ ID NO: 3229577 - RNA, 16 nt, Human
ugggagaagggcagag

SEQ ID NO: 3229578 - RNA, 18 nt, Human
ugggacucaaugcacuga

SEQ ID NO: 3229579 - RNA, 20 nt, Human
ugggacucaaugcacugaca

SEQ ID NO: 3229580 - RNA, 19 nt, Human
ugggagagaagagaaugca

SEQ ID NO: 3229581 - RNA, 21 nt, Human
ugggagagaagagaaugcaca

SEQ ID NO: 3229582 - RNA, 18 nt, Human
ugggaggaucucuugagc

SEQ ID NO: 3229583 - RNA, 16 nt, Human
ugggagagccuuccag

SEQ ID NO: 3229584 - RNA, 18 nt, Human
ugggagacugcugaguca

SEQ ID NO: 3229585 - RNA, 23 nt, Human
agggaggacgcucucuggccuuc

SEQ ID NO: 3229586 - RNA, 21 nt, Human
agggaggacgcucucuggccu

SEQ ID NO: 3229587 - RNA, 22 nt, Human
agggaggacgcucucuggccuu

SEQ ID NO: 3229588 - RNA, 15 nt, Human
ugggacuacaggcac

SEQ ID NO: 3229589 - RNA, 14 nt, Human
ugggacuacaggca

SEQ ID NO: 3229590 - RNA, 12 nt, Human
agggagaggccg

SEQ ID NO: 3229591 - RNA, 21 nt, Human
agggagcacaacccccagcuc

SEQ ID NO: 3229592 - RNA, 23 nt, Human
agggagcacaacccccagcuccc

SEQ ID NO: 3229593 - RNA, 22 nt, Human
agggagcacaacccccagcucc

SEQ ID NO: 3229594 - RNA, 15 nt, Human
agggagcuggcucca

SEQ ID NO: 3229595 - RNA, 19 nt, Human
agggagcuggcuccagccu

SEQ ID NO: 3229596 - RNA, 16 nt, Human
agggagcuggcuccag

SEQ ID NO: 3229597 - RNA, 21 nt, Human
agggagcuggcuccagccugg

SEQ ID NO: 3229598 - RNA, 20 nt, Human
agggagcuggcuccagccug

SEQ ID NO: 3229599 - RNA, 22 nt, Human
agggagcuggcuccagccugga

SEQ ID NO: 3229600 - RNA, 13 nt, Human
agggaaggggaca

SEQ ID NO: 3229601 - RNA, 22 nt, Human
agggaaggggacaaggacuagg

SEQ ID NO: 3229602 - RNA, 19 nt, Human
agggaaggggggucagaag

SEQ ID NO: 3229603 - RNA, 21 nt, Human
agggaauuucuucaacucccu

SEQ ID NO: 3229604 - RNA, 13 nt, Human
agggacaaaacuu

SEQ ID NO: 3229605 - RNA, 23 nt, Human
agggaaguugcuggaaagagcau

SEQ ID NO: 3229606 - RNA, 20 nt, Human
agggaaguugcuggaaagag

SEQ ID NO: 3229607 - RNA, 15 nt, Human
agggaauagaaaugu

SEQ ID NO: 3229608 - RNA, 22 nt, Human
aggcccuaucuguuuacagugu

SEQ ID NO: 3229609 - RNA, 22 nt, Human
aggcccuccucccucccagcuc

SEQ ID NO: 3229610 - RNA, 19 nt, Human
aggcccuccucccucccag

SEQ ID NO: 3229611 - RNA, 20 nt, Human
aggcccggcuccaggcuccu

SEQ ID NO: 3229612 - RNA, 18 nt, Human
aggcccggcuccaggcuc

SEQ ID NO: 3229613 - RNA, 21 nt, Human
aggcccggcuccaggcuccuu

SEQ ID NO: 3229614 - RNA, 21 nt, Human
agggaacaaguugagcuauga

SEQ ID NO: 3229615 - RNA, 20 nt, Human
agggaacaaguugagcuaug

SEQ ID NO: 3229616 - RNA, 23 nt, Human
aggcccuccucccucccagcucc

SEQ ID NO: 3229617 - RNA, 16 nt, Human
agggaacuaggaaggc

SEQ ID NO: 3229618 - RNA, 19 nt, Human
agggaagaauaaagagcug

SEQ ID NO: 3229619 - RNA, 17 nt, Human
agggaagauaaguugga

SEQ ID NO: 3229620 - RNA, 21 nt, Human
agggaagauaaguuggaaaca

SEQ ID NO: 3229621 - RNA, 20 nt, Human
agggaagauaaguuggaaac

SEQ ID NO: 3229622 - RNA, 19 nt, Human
agggaagauaaguuggaaa

SEQ ID NO: 3229623 - RNA, 18 nt, Human
agggaagauaaguuggaa

SEQ ID NO: 3229624 - RNA, 15 nt, Human
ugggccccugccaga

SEQ ID NO: 3229625 - RNA, 15 nt, Human
agggagggagggcuc

SEQ ID NO: 3229626 - RNA, 13 nt, Human
agggagggcucca

SEQ ID NO: 3229627 - RNA, 14 nt, Human
agggaggcccagcg

SEQ ID NO: 3229628 - RNA, 21 nt, Human
ugggcccccaaauggaaaugg

SEQ ID NO: 3229629 - RNA, 16 nt, Human
ugggcccccaaaugga

SEQ ID NO: 3229630 - RNA, 22 nt, Human
ugggccccaguuguauuuauuu

SEQ ID NO: 3229631 - RNA, 18 nt, Human
ugggccccaguuguauuu

SEQ ID NO: 3229632 - RNA, 11 nt, Human
ugggcagagca

SEQ ID NO: 3229633 - RNA, 12 nt, Human
ugggcagagcag

SEQ ID NO: 3229634 - RNA, 18 nt, Human
ugggccaggagccuccug

SEQ ID NO: 3229635 - RNA, 12 nt, Human
ugggcagaagga

SEQ ID NO: 3229636 - RNA, 23 nt, Human
ugggcagaaggaagacuucaucc

SEQ ID NO: 3229637 - RNA, 20 nt, Human
ugggaggaucucuugagccu

SEQ ID NO: 3229638 - RNA, 21 nt, Human
ugggaggaucucuugagccug

SEQ ID NO: 3229639 - RNA, 19 nt, Human
ugggaggccaaggugggag

SEQ ID NO: 3229640 - RNA, 22 nt, Human
ugggaggauugcuugagcucag

SEQ ID NO: 3229641 - RNA, 20 nt, Human
ugggaggccaaggugggagg

SEQ ID NO: 3229642 - RNA, 18 nt, Human
ugggcacugcucucaccu

SEQ ID NO: 3229643 - RNA, 16 nt, Human
agggcccgggaagcaa

SEQ ID NO: 3229644 - RNA, 23 nt, Human
agggcucagcggggacagcuccu

SEQ ID NO: 3229645 - RNA, 22 nt, Human
agggcucagcggggacagcucc

SEQ ID NO: 3229646 - RNA, 20 nt, Human
agggcucagcggggacagcu

SEQ ID NO: 3229647 - RNA, 19 nt, Human
agggcucagcggggacagc

SEQ ID NO: 3229648 - RNA, 21 nt, Human
agggccauugaacucugagag

SEQ ID NO: 3229649 - RNA, 17 nt, Human
agggccagaaguagcuu

SEQ ID NO: 3229650 - RNA, 14 nt, Human
agggagggcuccag

SEQ ID NO: 3229651 - RNA, 15 nt, Human
agggagggcuccaga

SEQ ID NO: 3229652 - RNA, 16 nt, Human
agggagggcuccagac

SEQ ID NO: 3229653 - RNA, 20 nt, Human
agggcacagggccuggccca

SEQ ID NO: 3229654 - RNA, 19 nt, Human
agggcacagggccuggccc

SEQ ID NO: 3229655 - RNA, 18 nt, Human
agggcacagggccuggcc

SEQ ID NO: 3229656 - RNA, 14 nt, Human
agggcacugguggc

SEQ ID NO: 3229657 - RNA, 16 nt, Human
agggcacugguggccc

SEQ ID NO: 3229658 - RNA, 14 nt, Human
agggcaugaaauga

SEQ ID NO: 3229659 - RNA, 13 nt, Human
agggcaugaaaug

SEQ ID NO: 3229660 - RNA, 12 nt, Human
agggcaugaaau

SEQ ID NO: 3229661 - RNA, 12 nt, Human
agggcaggacca

SEQ ID NO: 3229662 - RNA, 19 nt, Human
agggcaggaccagcccacg

SEQ ID NO: 3229663 - RNA, 18 nt, Human
agggcaggaccagcccac

SEQ ID NO: 3229664 - RNA, 17 nt, Human
agggcaggaccagccca

SEQ ID NO: 3229665 - RNA, 16 nt, Human
agggcaggaccagccc

SEQ ID NO: 3229666 - RNA, 14 nt, Human
agggcaggaccagc

SEQ ID NO: 3229667 - RNA, 13 nt, Human
agggcaggaccag

SEQ ID NO: 3229668 - RNA, 21 nt, Human
aguucugccucugauguauuu

SEQ ID NO: 3229669 - RNA, 14 nt, Human
aguucugguuccua

SEQ ID NO: 3229670 - RNA, 11 nt, Human
aguucugggca

SEQ ID NO: 3229671 - RNA, 18 nt, Human
aguucuuaacccaguguc

SEQ ID NO: 3229672 - RNA, 14 nt, Human
aguucuuaacccag

SEQ ID NO: 3229673 - RNA, 23 nt, Human
aguucuuacugcuuaauucaaau

SEQ ID NO: 3229674 - RNA, 19 nt, Human
aguucuuacugcuuaauuc

SEQ ID NO: 3229675 - RNA, 21 nt, Human
aguucugcagauaaacaguag

SEQ ID NO: 3229676 - RNA, 16 nt, Human
aguucugcagauaaac

SEQ ID NO: 3229677 - RNA, 13 nt, Human
uguuuugcaugua

SEQ ID NO: 3229678 - RNA, 19 nt, Human
uguuuucauuaucucaaaa

SEQ ID NO: 3229679 - RNA, 20 nt, Human
uguuuuccaugaguccccug

SEQ ID NO: 3229680 - RNA, 13 nt, Human
uguuuuaucuggu

SEQ ID NO: 3229681 - RNA, 17 nt, Human
uguuuucaguguacaug

SEQ ID NO: 3229682 - RNA, 16 nt, Human
uguuuggaaaagacag

SEQ ID NO: 3229683 - RNA, 17 nt, Human
uguuuggaaaagacagu

SEQ ID NO: 3229684 - RNA, 21 nt, Human
uguuugaugcauuaaaagaaa

SEQ ID NO: 3229685 - RNA, 20 nt, Human
uguuugcugaacauuggaga

SEQ ID NO: 3229686 - RNA, 21 nt, Human
uguuucuuucucugaggacaa

SEQ ID NO: 3229687 - RNA, 20 nt, Human
uguuucuuucucugaggaca

SEQ ID NO: 3229688 - RNA, 12 nt, Human
uguuucuuugau

SEQ ID NO: 3229689 - RNA, 23 nt, Human
uguuucuuugaauuuucauuuua

SEQ ID NO: 3229690 - RNA, 19 nt, Human
uguuucuuugaauuuucau

SEQ ID NO: 3229691 - RNA, 18 nt, Human
uguuucuuugaauuuuca

SEQ ID NO: 3229692 - RNA, 16 nt, Human
uguuucuuugaauuuu

SEQ ID NO: 3229693 - RNA, 13 nt, Human
uguuucuuugaau

SEQ ID NO: 3229694 - RNA, 12 nt, Human
uguuucuuugaa

SEQ ID NO: 3229695 - RNA, 18 nt, Human
uguuucuguccuguaacu

SEQ ID NO: 3229696 - RNA, 20 nt, Human
uguuucuguccuguaacugu

SEQ ID NO: 3229697 - RNA, 22 nt, Human
uguuucuguccuguaacuguua

SEQ ID NO: 3229698 - RNA, 15 nt, Human
uguuucuuaauuugg

SEQ ID NO: 3229699 - RNA, 16 nt, Human
uguuucuuaauuugga

SEQ ID NO: 3229700 - RNA, 23 nt, Human
uguuucuuaauuuggaaacuaau

SEQ ID NO: 3229701 - RNA, 17 nt, Human
uguuugauucagacagc

SEQ ID NO: 3229702 - RNA, 22 nt, Human
uguuugauucagacagcugccu

SEQ ID NO: 3229703 - RNA, 19 nt, Human
uguuugaugcauuaaaaga

SEQ ID NO: 3229704 - RNA, 16 nt, Human
uguuugaugcauuaaa

SEQ ID NO: 3229705 - RNA, 13 nt, Human
uguuugaugcauu

SEQ ID NO: 3229706 - RNA, 21 nt, Human
uguuugauauaccaaauuaaa

SEQ ID NO: 3229707 - RNA, 16 nt, Human
uguuugaaaauaguuu

SEQ ID NO: 3229708 - RNA, 17 nt, Human
uguuugaaaauaguuua

SEQ ID NO: 3229709 - RNA, 18 nt, Human
uguuugaaaauaguuuau

SEQ ID NO: 3229710 - RNA, 19 nt, Human
uguuugaaaauaguuuauu

SEQ ID NO: 3229711 - RNA, 15 nt, Human
uguuucuuugaucau

SEQ ID NO: 3229712 - RNA, 19 nt, Human
uguugcccaggcaggucuu

SEQ ID NO: 3229713 - RNA, 15 nt, Human
uguuuagucuuuaua

SEQ ID NO: 3229714 - RNA, 17 nt, Human
uguugcuaugugccuua

SEQ ID NO: 3229715 - RNA, 16 nt, Human
uguuuaugugugugug

SEQ ID NO: 3229716 - RNA, 15 nt, Human
uguuuauuaaaugcu

SEQ ID NO: 3229717 - RNA, 16 nt, Human
uguuuauuaaaugcuu

SEQ ID NO: 3229718 - RNA, 13 nt, Human
uguuuaugugugu

SEQ ID NO: 3229719 - RNA, 17 nt, Human
uguuuaugugcuauuaa

SEQ ID NO: 3229720 - RNA, 22 nt, Human
uguuuaugugcuauuaauauuu

SEQ ID NO: 3229721 - RNA, 17 nt, Human
uguuuauauggaagaaa

SEQ ID NO: 3229722 - RNA, 13 nt, Human
uguuuaguggaaa

SEQ ID NO: 3229723 - RNA, 16 nt, Human
uguuuaguucagcaaa

SEQ ID NO: 3229724 - RNA, 17 nt, Human
uguuuauugucaaagug

SEQ ID NO: 3229725 - RNA, 19 nt, Human
uguuuauugucaaaguggu

SEQ ID NO: 3229726 - RNA, 13 nt, Human
uuaaaauugugau

SEQ ID NO: 3229727 - RNA, 23 nt, Human
uuaaaauucucuuccaaccauuu

SEQ ID NO: 3229728 - RNA, 18 nt, Human
uuaaaauugugauguguc

SEQ ID NO: 3229729 - RNA, 12 nt, Human
uuaaaaaguauu

SEQ ID NO: 3229730 - RNA, 16 nt, Human
uuaaaauuacaacuaa

SEQ ID NO: 3229731 - RNA, 23 nt, Human
uuaaaaaguauugccaaacauua

SEQ ID NO: 3229732 - RNA, 22 nt, Human
uuaaaaaguauugccaaacauu

SEQ ID NO: 3229733 - RNA, 21 nt, Human
uuaaaaaguauugccaaacau

SEQ ID NO: 3229734 - RNA, 20 nt, Human
uuaaaaaguauugccaaaca

SEQ ID NO: 3229735 - RNA, 22 nt, Human
aguuuagugugguuuucuguuu

SEQ ID NO: 3229736 - RNA, 17 nt, Human
uuaaaaacaaaaggcaa

SEQ ID NO: 3229737 - RNA, 16 nt, Human
uuaaaaacaaaaggca

SEQ ID NO: 3229738 - RNA, 17 nt, Human
uuaaaaagcccaaccuc

SEQ ID NO: 3229739 - RNA, 14 nt, Human
uuaaaaagcccaac

SEQ ID NO: 3229740 - RNA, 23 nt, Human
uuaaaaagauaaaaaaacagcuu

SEQ ID NO: 3229741 - RNA, 15 nt, Human
uuaaagcuuuugaug

SEQ ID NO: 3229742 - RNA, 17 nt, Human
uuaaagcuuuugaugug

SEQ ID NO: 3229743 - RNA, 21 nt, Human
uuaaaauuuuaagcuaggaaa

SEQ ID NO: 3229744 - RNA, 12 nt, Human
uuaaaauuuuaa

SEQ ID NO: 3229745 - RNA, 13 nt, Human
uuaaaauuucaua

SEQ ID NO: 3229746 - RNA, 13 nt, Human
uuaaaauuugaaa

SEQ ID NO: 3229747 - RNA, 18 nt, Human
uuaaaauuugaaacauug

SEQ ID NO: 3229748 - RNA, 17 nt, Human
uuaaaauuugaaacauu

SEQ ID NO: 3229749 - RNA, 15 nt, Human
uuaaaauuugaaaca

SEQ ID NO: 3229750 - RNA, 14 nt, Human
uuaaaauuugaaac

SEQ ID NO: 3229751 - RNA, 23 nt, Human
uuaaagggaagaaaacacuguua

SEQ ID NO: 3229752 - RNA, 22 nt, Human
uuaaagggaagaaaacacuguu

SEQ ID NO: 3229753 - RNA, 17 nt, Human
uuaaagggcccaaugaa

SEQ ID NO: 3229754 - RNA, 15 nt, Human
uuaaagggaaauuga

SEQ ID NO: 3229755 - RNA, 18 nt, Human
uuaaagggaagaaaacac

SEQ ID NO: 3229756 - RNA, 16 nt, Human
uuaaagggaagaaaac

SEQ ID NO: 3229757 - RNA, 15 nt, Human
uuaaagggaagaaaa

SEQ ID NO: 3229758 - RNA, 13 nt, Human
uuaaagggaagaa

SEQ ID NO: 3229759 - RNA, 17 nt, Human
uuaacaaauaacaacuu

SEQ ID NO: 3229760 - RNA, 18 nt, Human
uuaacaggcaaacauuuu

SEQ ID NO: 3229761 - RNA, 17 nt, Human
uuaacaggcaaacauuu

SEQ ID NO: 3229762 - RNA, 22 nt, Human
uuaacagggucucuagugcugu

SEQ ID NO: 3229763 - RNA, 23 nt, Human
uuaacaggcaaacauuuucucuu

SEQ ID NO: 3229764 - RNA, 16 nt, Human
aguuucagaguucuca

SEQ ID NO: 3229765 - RNA, 17 nt, Human
aguuucagaguauauug

SEQ ID NO: 3229766 - RNA, 21 nt, Human
uuaaauugcucacaguuauua

SEQ ID NO: 3229767 - RNA, 14 nt, Human
uuaaauugcucaca

SEQ ID NO: 3229768 - RNA, 11 nt, Human
uuaacaaauaa

SEQ ID NO: 3229769 - RNA, 15 nt, Human
aguuguuuuuguaua

SEQ ID NO: 3229770 - RNA, 16 nt, Human
aguuguuuuuguauau

SEQ ID NO: 3229771 - RNA, 17 nt, Human
aguuguuuuuguauauu

SEQ ID NO: 3229772 - RNA, 18 nt, Human
aguuguuuuuguauauug

SEQ ID NO: 3229773 - RNA, 14 nt, Human
aguuuaaggaauau

SEQ ID NO: 3229774 - RNA, 19 nt, Human
aguuguuuuuguauauugg

SEQ ID NO: 3229775 - RNA, 20 nt, Human
aguuguuuuuguauauuggu

SEQ ID NO: 3229776 - RNA, 22 nt, Human
aguuguuuuuguauauugguuu

SEQ ID NO: 3229777 - RNA, 18 nt, Human
aguuggucccccuuccau

SEQ ID NO: 3229778 - RNA, 21 nt, Human
aguuguuugauucagacagcu

SEQ ID NO: 3229779 - RNA, 23 nt, Human
aguuguuugauucagacagcugc

SEQ ID NO: 3229780 - RNA, 21 nt, Human
aguuguaacauucuauuucaa

SEQ ID NO: 3229781 - RNA, 14 nt, Human
aguucuuccuguaa

SEQ ID NO: 3229782 - RNA, 15 nt, Human
aguucuuccuguaau

SEQ ID NO: 3229783 - RNA, 17 nt, Human
aguugcauagcaguaua

SEQ ID NO: 3229784 - RNA, 18 nt, Human
aguugcauagcaguauau

SEQ ID NO: 3229785 - RNA, 21 nt, Human
aguuggguggaugccuggugg

SEQ ID NO: 3229786 - RNA, 17 nt, Human
aguuggguggaugccug

SEQ ID NO: 3229787 - RNA, 13 nt, Human
aguuggcuucuaa

SEQ ID NO: 3229788 - RNA, 16 nt, Human
aguuggcuaggacccc

SEQ ID NO: 3229789 - RNA, 16 nt, Human
aguuggcaugcauccc

SEQ ID NO: 3229790 - RNA, 15 nt, Human
aguugcucaaaaaga

SEQ ID NO: 3229791 - RNA, 16 nt, Human
aguugcucaaaaagaa

SEQ ID NO: 3229792 - RNA, 16 nt, Human
uuagaagaaguguguc

SEQ ID NO: 3229793 - RNA, 13 nt, Human
uuagaauugaagg

SEQ ID NO: 3229794 - RNA, 14 nt, Human
uuagaauugaaggu

SEQ ID NO: 3229795 - RNA, 16 nt, Human
uuagaauugaagguuu

SEQ ID NO: 3229796 - RNA, 17 nt, Human
uuagaauugaagguuuu

SEQ ID NO: 3229797 - RNA, 14 nt, Human
uuagaagaagugug

SEQ ID NO: 3229798 - RNA, 15 nt, Human
uuagaagaagugugu

SEQ ID NO: 3229799 - RNA, 13 nt, Human
uuagaaccuuucu

SEQ ID NO: 3229800 - RNA, 12 nt, Human
uuagaagaaaga

SEQ ID NO: 3229801 - RNA, 15 nt, Human
uuagaacagguuuuu

SEQ ID NO: 3229802 - RNA, 11 nt, Human
uuagaaauauu

SEQ ID NO: 3229803 - RNA, 13 nt, Human
uuagaaauauuca

SEQ ID NO: 3229804 - RNA, 15 nt, Human
uuagaaauauucaca

SEQ ID NO: 3229805 - RNA, 19 nt, Human
uuagaaauauucacaucuu

SEQ ID NO: 3229806 - RNA, 11 nt, Human
uuagacagagu

SEQ ID NO: 3229807 - RNA, 18 nt, Human
uuagaauugaagguuuuu

SEQ ID NO: 3229808 - RNA, 19 nt, Human
uuagaauuuugugaaacag

SEQ ID NO: 3229809 - RNA, 20 nt, Human
auaacuuauauuguaagaaa

SEQ ID NO: 3229810 - RNA, 23 nt, Human
auaacuuauauuguaagaaauac

SEQ ID NO: 3229811 - RNA, 22 nt, Human
auaacuuauauuguaagaaaua

SEQ ID NO: 3229812 - RNA, 21 nt, Human
auaacuuauauuguaagaaau

SEQ ID NO: 3229813 - RNA, 20 nt, Human
uuacuguaaaaugcaaaaaa

SEQ ID NO: 3229814 - RNA, 16 nt, Human
uuacuguaaaaugcaa

SEQ ID NO: 3229815 - RNA, 15 nt, Human
uuacuguaaaaugca

SEQ ID NO: 3229816 - RNA, 14 nt, Human
uuacuguaaaaugc

SEQ ID NO: 3229817 - RNA, 14 nt, Human
uuagaaauauaauu

SEQ ID NO: 3229818 - RNA, 12 nt, Human
uuagaaauauaa

SEQ ID NO: 3229819 - RNA, 11 nt, Human
uuagaaauaua

SEQ ID NO: 3229820 - RNA, 14 nt, Human
uuaccuuacagaag

SEQ ID NO: 3229821 - RNA, 19 nt, Human
uuaccugugaaguguuacu

SEQ ID NO: 3229822 - RNA, 20 nt, Human
uuacauaagauaaaugugcu

SEQ ID NO: 3229823 - RNA, 16 nt, Human
uuacauacuuuaucaa

SEQ ID NO: 3229824 - RNA, 21 nt, Human
uuacauacuuuaucaaugugu

SEQ ID NO: 3229825 - RNA, 24 nt, Human
uuacauacuuuaucaaugugucuu

SEQ ID NO: 3229826 - RNA, 21 nt, Human
uuacauaauuuaguuguuucu

SEQ ID NO: 3229827 - RNA, 22 nt, Human
uuacauaauuuaguuguuucua

SEQ ID NO: 3229828 - RNA, 13 nt, Human
uuacauagucuga

SEQ ID NO: 3229829 - RNA, 18 nt, Human
uuacauagucugaaguga

SEQ ID NO: 3229830 - RNA, 19 nt, Human
uuacauauguauacaugug

SEQ ID NO: 3229831 - RNA, 23 nt, Human
uuaccuuaaaacuaggcauuugu

SEQ ID NO: 3229832 - RNA, 18 nt, Human
uuacuauucgguguguuu

SEQ ID NO: 3229833 - RNA, 15 nt, Human
uuacucaaugugugc

SEQ ID NO: 3229834 - RNA, 20 nt, Human
uuacugaccucaccuaggaa

SEQ ID NO: 3229835 - RNA, 15 nt, Human
uuacucacagccagc

SEQ ID NO: 3229836 - RNA, 12 nt, Human
auaaauauuaua

SEQ ID NO: 3229837 - RNA, 22 nt, Human
auaaauauuauauuauauauau

SEQ ID NO: 3229838 - RNA, 19 nt, Human
auaaauauucacacuugaa

SEQ ID NO: 3229839 - RNA, 18 nt, Human
auaaaucuuccaaaguuu

SEQ ID NO: 3229840 - RNA, 18 nt, Human
auaaacaccacuggauua

SEQ ID NO: 3229841 - RNA, 20 nt, Human
auaaacaccacuggauuaau

SEQ ID NO: 3229842 - RNA, 15 nt, Human
auaaacaagaaugaa

SEQ ID NO: 3229843 - RNA, 14 nt, Human
auaaaguuaaaagu

SEQ ID NO: 3229844 - RNA, 12 nt, Human
auaaaguuugau

SEQ ID NO: 3229845 - RNA, 15 nt, Human
auaaaguuugaucuu

SEQ ID NO: 3229846 - RNA, 13 nt, Human
auaaaguuugauc

SEQ ID NO: 3229847 - RNA, 22 nt, Human
auaaaguuugaucuuccucugc

SEQ ID NO: 3229848 - RNA, 15 nt, Human
auaacuaaaauguau

SEQ ID NO: 3229849 - RNA, 17 nt, Human
auaacuacauauugaau

SEQ ID NO: 3229850 - RNA, 16 nt, Human
auaacuaaaagguaug

SEQ ID NO: 3229851 - RNA, 15 nt, Human
auaaauguauugauu

SEQ ID NO: 3229852 - RNA, 15 nt, Human
auaaaugauucaaaa

SEQ ID NO: 3229853 - RNA, 20 nt, Human
auaaaugguuuggugcuuuu

SEQ ID NO: 3229854 - RNA, 21 nt, Human
auaaaugguuuggugcuuuuu

SEQ ID NO: 3229855 - RNA, 14 nt, Human
uuacaggaaguacu

SEQ ID NO: 3229856 - RNA, 14 nt, Human
uuacagcugccugc

SEQ ID NO: 3229857 - RNA, 13 nt, Human
uuacagcugccug

SEQ ID NO: 3229858 - RNA, 20 nt, Human
uuacagccugggcaauaaag

SEQ ID NO: 3229859 - RNA, 17 nt, Human
auaaaauucccuaaagc

SEQ ID NO: 3229860 - RNA, 18 nt, Human
auaaaauucccuaaagcc

SEQ ID NO: 3229861 - RNA, 23 nt, Human
auaaacacagcugcuuucuucuu

SEQ ID NO: 3229862 - RNA, 14 nt, Human
auaaacaagaauga

SEQ ID NO: 3229863 - RNA, 19 nt, Human
uuaauuuuuuugagacaga

SEQ ID NO: 3229864 - RNA, 21 nt, Human
uuaauugugugaacuuggaag

SEQ ID NO: 3229865 - RNA, 23 nt, Human
uuaauuuaaguuuugacaagcug

SEQ ID NO: 3229866 - RNA, 15 nt, Human
auaaaauuaaaaguu

SEQ ID NO: 3229867 - RNA, 12 nt, Human
auaaaauuacag

SEQ ID NO: 3229868 - RNA, 16 nt, Human
auaaaauuaaagcuga

SEQ ID NO: 3229869 - RNA, 12 nt, Human
uuacaaaaugua

SEQ ID NO: 3229870 - RNA, 15 nt, Human
uuacaaaauguaacu

SEQ ID NO: 3229871 - RNA, 13 nt, Human
uuacaaaauguaa

SEQ ID NO: 3229872 - RNA, 20 nt, Human
uuaaguuaguuccacugaga

SEQ ID NO: 3229873 - RNA, 20 nt, Human
uuaaugaaagacuguacaaa

SEQ ID NO: 3229874 - RNA, 23 nt, Human
uuaaugaaagacuguacaaagua

SEQ ID NO: 3229875 - RNA, 19 nt, Human
uuaauaaauccuacaguau

SEQ ID NO: 3229876 - RNA, 20 nt, Human
uuaauaaagcgaaaaacuca

SEQ ID NO: 3229877 - RNA, 12 nt, Human
uuaauucucuuu

SEQ ID NO: 3229878 - RNA, 22 nt, Human
uuaauucuguucugauauuaau

SEQ ID NO: 3229879 - RNA, 13 nt, Human
uuaauuuaaauga

SEQ ID NO: 3229880 - RNA, 14 nt, Human
uuaauuuaaaugau

SEQ ID NO: 3229881 - RNA, 16 nt, Human
uuaauuuaaaugauuu

SEQ ID NO: 3229882 - RNA, 23 nt, Human
uuaauuuaaaugauuuaaauuua

SEQ ID NO: 3229883 - RNA, 13 nt, Human
uuaauuuaaguuu

SEQ ID NO: 3229884 - RNA, 15 nt, Human
uuaauuuaaguuuug

SEQ ID NO: 3229885 - RNA, 16 nt, Human
uuaauuuaaguuuuga

SEQ ID NO: 3229886 - RNA, 12 nt, Human
uuaaguaaguuu

SEQ ID NO: 3229887 - RNA, 16 nt, Human
uuaagaggcagggucu

SEQ ID NO: 3229888 - RNA, 15 nt, Human
uuaagaggcaggguc

SEQ ID NO: 3229889 - RNA, 13 nt, Human
uuaagaggcaggg

SEQ ID NO: 3229890 - RNA, 17 nt, Human
uuaaguacuauguauca

SEQ ID NO: 3229891 - RNA, 12 nt, Human
uuaaguagauuu

SEQ ID NO: 3229892 - RNA, 13 nt, Human
uuaaguagauuuc

SEQ ID NO: 3229893 - RNA, 12 nt, Human
uuaagugaaauu

SEQ ID NO: 3229894 - RNA, 14 nt, Human
uuaagugaaauuua

SEQ ID NO: 3229895 - RNA, 13 nt, Human
uuaagugaaauuu

SEQ ID NO: 3229896 - RNA, 17 nt, Human
uuaagugaaaauauagc

SEQ ID NO: 3229897 - RNA, 16 nt, Human
uuaagugaggaaauca

SEQ ID NO: 3229898 - RNA, 17 nt, Human
uuaagugaggaaaucaa

SEQ ID NO: 3229899 - RNA, 15 nt, Human
uuaagugaaauuuau

SEQ ID NO: 3229900 - RNA, 19 nt, Human
uuaagugaggaaaucaaag

SEQ ID NO: 3229901 - RNA, 20 nt, Human
uuaagugaggaaaucaaagu

SEQ ID NO: 3229902 - RNA, 23 nt, Human
uuaagugaggaaaucaaagugcu

SEQ ID NO: 3229903 - RNA, 18 nt, Human
uuaaguguuggaaaaaau

SEQ ID NO: 3229904 - RNA, 20 nt, Human
uuaaguguuggaaaaaauuu

SEQ ID NO: 3229905 - RNA, 15 nt, Human
auaaaaucauaagua

SEQ ID NO: 3229906 - RNA, 12 nt, Human
auaaaaucauaa

SEQ ID NO: 3229907 - RNA, 22 nt, Human
auaaaaucauaaguauuuggaa

SEQ ID NO: 3229908 - RNA, 20 nt, Human
auaaaaucauaaguauuugg

SEQ ID NO: 3229909 - RNA, 19 nt, Human
auaaaaucauaaguauuug

SEQ ID NO: 3229910 - RNA, 16 nt, Human
auaaaaucauaaguau

SEQ ID NO: 3229911 - RNA, 16 nt, Human
auaaaauggcaacaaa

SEQ ID NO: 3229912 - RNA, 14 nt, Human
auaaaauggcaaca

SEQ ID NO: 3229913 - RNA, 19 nt, Human
auaaaauguccaguaagau

SEQ ID NO: 3229914 - RNA, 21 nt, Human
auaaaauguccaguaagauca

SEQ ID NO: 3229915 - RNA, 23 nt, Human
auaaaauguccaguaagaucacu

SEQ ID NO: 3229916 - RNA, 22 nt, Human
auaaaauggcaacaaacugcac

SEQ ID NO: 3229917 - RNA, 15 nt, Human
ugugagaugcuagaa

SEQ ID NO: 3229918 - RNA, 19 nt, Human
ugugagaugcuagaacucc

SEQ ID NO: 3229919 - RNA, 22 nt, Human
agucucaggaaaucaaauaugc

SEQ ID NO: 3229920 - RNA, 16 nt, Human
agucucaggaaaucaa

SEQ ID NO: 3229921 - RNA, 14 nt, Human
agucucuucuccac

SEQ ID NO: 3229922 - RNA, 13 nt, Human
agucucuucucca

SEQ ID NO: 3229923 - RNA, 19 nt, Human
agucucauagguuaaaaaa

SEQ ID NO: 3229924 - RNA, 20 nt, Human
agucucauagguuaaaaaaa

SEQ ID NO: 3229925 - RNA, 21 nt, Human
agucucagugcuagcuuauuu

SEQ ID NO: 3229926 - RNA, 11 nt, Human
agucuuuuaaa

SEQ ID NO: 3229927 - RNA, 14 nt, Human
agucuuuguacaga

SEQ ID NO: 3229928 - RNA, 16 nt, Human
agucuuucuucuucaa

SEQ ID NO: 3229929 - RNA, 23 nt, Human
agucuuagauguauauauuuccu

SEQ ID NO: 3229930 - RNA, 16 nt, Human
agucucuucuccacug

SEQ ID NO: 3229931 - RNA, 15 nt, Human
agucucuucuccacu

SEQ ID NO: 3229932 - RNA, 18 nt, Human
agucuuaugcuuccagaa

SEQ ID NO: 3229933 - RNA, 17 nt, Human
agucuuaugcuuccaga

SEQ ID NO: 3229934 - RNA, 16 nt, Human
agucuuaugcuuccag

SEQ ID NO: 3229935 - RNA, 17 nt, Human
agucucuucuccacugg

SEQ ID NO: 3229936 - RNA, 23 nt, Human
agucuucaugaaaugcuauguca

SEQ ID NO: 3229937 - RNA, 18 nt, Human
agucuucaugaaaugcua

SEQ ID NO: 3229938 - RNA, 17 nt, Human
agucuucaugaaaugcu

SEQ ID NO: 3229939 - RNA, 16 nt, Human
agucuucaugaaaugc

SEQ ID NO: 3229940 - RNA, 15 nt, Human
agucuucaugaaaug

SEQ ID NO: 3229941 - RNA, 14 nt, Human
agucuucaugaaau

SEQ ID NO: 3229942 - RNA, 18 nt, Human
agucuucauguucccacu

SEQ ID NO: 3229943 - RNA, 16 nt, Human
agucuuggaagcuguu

SEQ ID NO: 3229944 - RNA, 22 nt, Human
agucuuggaagcuguuuggaaa

SEQ ID NO: 3229945 - RNA, 21 nt, Human
agucuugccuauauuuuccug

SEQ ID NO: 3229946 - RNA, 18 nt, Human
agucuugccuauauuuuc

SEQ ID NO: 3229947 - RNA, 15 nt, Human
ugugaacagcggcug

SEQ ID NO: 3229948 - RNA, 19 nt, Human
ugugaaccaccacacccag

SEQ ID NO: 3229949 - RNA, 20 nt, Human
ugugaaccaccacacccagc

SEQ ID NO: 3229950 - RNA, 15 nt, Human
ugugaacuuggaagc

SEQ ID NO: 3229951 - RNA, 18 nt, Human
ugugaacuuggaagcaca

SEQ ID NO: 3229952 - RNA, 17 nt, Human
ugugaaccaccacaccc

SEQ ID NO: 3229953 - RNA, 20 nt, Human
ugugaaauuuuucauauuuu

SEQ ID NO: 3229954 - RNA, 18 nt, Human
ugugacuaggaaaaaauu

SEQ ID NO: 3229955 - RNA, 13 nt, Human
ugugaccucacgu

SEQ ID NO: 3229956 - RNA, 14 nt, Human
ugugaaauguaacu

SEQ ID NO: 3229957 - RNA, 19 nt, Human
ugugaaauuuuucauauuu

SEQ ID NO: 3229958 - RNA, 17 nt, Human
ugugaaauuuuucauau

SEQ ID NO: 3229959 - RNA, 15 nt, Human
ugugaaauuuuucau

SEQ ID NO: 3229960 - RNA, 14 nt, Human
ugugaaauaucauc

SEQ ID NO: 3229961 - RNA, 18 nt, Human
ugugaaaggaaagaggcu

SEQ ID NO: 3229962 - RNA, 21 nt, Human
ugugaaaggaaagagggaggu

SEQ ID NO: 3229963 - RNA, 15 nt, Human
ugugaaaggaaagag

SEQ ID NO: 3229964 - RNA, 16 nt, Human
agucacuaaaaggaag

SEQ ID NO: 3229965 - RNA, 21 nt, Human
agucacuaaaaggaagacagu

SEQ ID NO: 3229966 - RNA, 15 nt, Human
agugaggcucugccc

SEQ ID NO: 3229967 - RNA, 14 nt, Human
agugaggcucugcc

SEQ ID NO: 3229968 - RNA, 16 nt, Human
agugaggcucugcccu

SEQ ID NO: 3229969 - RNA, 17 nt, Human
agugaggcucugcccuu

SEQ ID NO: 3229970 - RNA, 19 nt, Human
agugaggcucugcccuugg

SEQ ID NO: 3229971 - RNA, 20 nt, Human
agugaggcucugcccuuggu

SEQ ID NO: 3229972 - RNA, 21 nt, Human
agugaggcucugcccuugguu

SEQ ID NO: 3229973 - RNA, 14 nt, Human
agugagggauuauc

SEQ ID NO: 3229974 - RNA, 21 nt, Human
agugaguugauagcacagacc

SEQ ID NO: 3229975 - RNA, 15 nt, Human
agugagucgaggaca

SEQ ID NO: 3229976 - RNA, 23 nt, Human
uguggcaguuuggcaaacucucc

SEQ ID NO: 3229977 - RNA, 21 nt, Human
uguggaguucaucuugaauug

SEQ ID NO: 3229978 - RNA, 17 nt, Human
uguggaguucaucuuga

SEQ ID NO: 3229979 - RNA, 22 nt, Human
uguggagucagccucgcaggcc

SEQ ID NO: 3229980 - RNA, 17 nt, Human
uguggagucauuucuga

SEQ ID NO: 3229981 - RNA, 18 nt, Human
uguggagucauuucugau

SEQ ID NO: 3229982 - RNA, 21 nt, Human
ugugcccccauguaagcaccc

SEQ ID NO: 3229983 - RNA, 21 nt, Human
ugugcugcccugcccaccugg

SEQ ID NO: 3229984 - RNA, 13 nt, Human
ugugcugcuucuc

SEQ ID NO: 3229985 - RNA, 18 nt, Human
ugugcugcuuugauauau

SEQ ID NO: 3229986 - RNA, 21 nt, Human
ugugcccagaauacugaugga

SEQ ID NO: 3229987 - RNA, 17 nt, Human
ugugcccagaauacuga

SEQ ID NO: 3229988 - RNA, 18 nt, Human
ugugcccagaauacugau

SEQ ID NO: 3229989 - RNA, 23 nt, Human
ugugcccacccuccacucuccuc

SEQ ID NO: 3229990 - RNA, 14 nt, Human
ugugcccacccucc

SEQ ID NO: 3229991 - RNA, 16 nt, Human
ugugccaugugccagg

SEQ ID NO: 3229992 - RNA, 12 nt, Human
ugugccaugugc

SEQ ID NO: 3229993 - RNA, 20 nt, Human
ugugccagguuuuuggucug

SEQ ID NO: 3229994 - RNA, 19 nt, Human
ugugccaggugaaggaggc

SEQ ID NO: 3229995 - RNA, 19 nt, Human
ugugccaaacaaaaugaga

SEQ ID NO: 3229996 - RNA, 19 nt, Human
ugugauggggcccugccuc

SEQ ID NO: 3229997 - RNA, 20 nt, Human
ugugauggggcccugccucc

SEQ ID NO: 3229998 - RNA, 18 nt, Human
ugugauggggcccugccu

SEQ ID NO: 3229999 - RNA, 13 nt, Human
agugaaauuuauu

SEQ ID NO: 3230000 - RNA, 18 nt, Human
agugaaauaccauuauua

SEQ ID NO: 3230001 - RNA, 16 nt, Human
agugaacaaauuuaca

SEQ ID NO: 3230002 - RNA, 16 nt, Human
ugugaucucauuguuc

SEQ ID NO: 3230003 - RNA, 15 nt, Human
ugugaucucauuguu

SEQ ID NO: 3230004 - RNA, 15 nt, Human
uguguguuucugucc

SEQ ID NO: 3230005 - RNA, 11 nt, Human
uguguuccugg

SEQ ID NO: 3230006 - RNA, 12 nt, Human
uguguuccuggc

SEQ ID NO: 3230007 - RNA, 17 nt, Human
uguguugaagagcagcu

SEQ ID NO: 3230008 - RNA, 15 nt, Human
uguguugacuuuaua

SEQ ID NO: 3230009 - RNA, 13 nt, Human
uguuaaagaugua

SEQ ID NO: 3230010 - RNA, 15 nt, Human
uguuaaauaaggccu

SEQ ID NO: 3230011 - RNA, 19 nt, Human
uguuaaagauguagcaaac

SEQ ID NO: 3230012 - RNA, 18 nt, Human
uguuaaagauguagcaaa

SEQ ID NO: 3230013 - RNA, 14 nt, Human
uguuaaagauguag

SEQ ID NO: 3230014 - RNA, 15 nt, Human
uguuacaaaauguaa

SEQ ID NO: 3230015 - RNA, 14 nt, Human
uguuacaaaaugua

SEQ ID NO: 3230016 - RNA, 22 nt, Human
uguuaauuuggaccauuuuccu

SEQ ID NO: 3230017 - RNA, 20 nt, Human
uguuaauuuguguguuuuua

SEQ ID NO: 3230018 - RNA, 15 nt, Human
uguuaauuuggacca

SEQ ID NO: 3230019 - RNA, 15 nt, Human
uguuaauuuaaguuu

SEQ ID NO: 3230020 - RNA, 16 nt, Human
uguuaauuuaaguuuu

SEQ ID NO: 3230021 - RNA, 22 nt, Human
uguuaagguggauugaggccag

SEQ ID NO: 3230022 - RNA, 17 nt, Human
uguuaagggaccaggga

SEQ ID NO: 3230023 - RNA, 15 nt, Human
uguuaaauuaauuau

SEQ ID NO: 3230024 - RNA, 12 nt, Human
ugugugugggag

SEQ ID NO: 3230025 - RNA, 20 nt, Human
ugugugugggaguguguaau

SEQ ID NO: 3230026 - RNA, 14 nt, Human
uguguguguaugug

SEQ ID NO: 3230027 - RNA, 20 nt, Human
ugugugugcuuauguaugag

SEQ ID NO: 3230028 - RNA, 12 nt, Human
ugugucuuucua

SEQ ID NO: 3230029 - RNA, 19 nt, Human
uguguguuuauugucaaag

SEQ ID NO: 3230030 - RNA, 23 nt, Human
uguguguuuauugucaaaguggu

SEQ ID NO: 3230031 - RNA, 11 nt, Human
uguguguuuau

SEQ ID NO: 3230032 - RNA, 17 nt, Human
uguguaagaaauacaga

SEQ ID NO: 3230033 - RNA, 17 nt, Human
ugugucucuugguccug

SEQ ID NO: 3230034 - RNA, 20 nt, Human
ugugucucuugguccugcug

SEQ ID NO: 3230035 - RNA, 21 nt, Human
ugugucucuugguccugcugc

SEQ ID NO: 3230036 - RNA, 20 nt, Human
ugugucuugcaauggcagcc

SEQ ID NO: 3230037 - RNA, 21 nt, Human
ugugucuugcaauggcagccu

SEQ ID NO: 3230038 - RNA, 16 nt, Human
ugugucucuugguccu

SEQ ID NO: 3230039 - RNA, 20 nt, Human
ugugggucugugugugugua

SEQ ID NO: 3230040 - RNA, 16 nt, Human
agugcugugaaaaaaa

SEQ ID NO: 3230041 - RNA, 14 nt, Human
agugcugugaaaaa

SEQ ID NO: 3230042 - RNA, 13 nt, Human
agugcugugaaaa

SEQ ID NO: 3230043 - RNA, 12 nt, Human
agugcugugaaa

SEQ ID NO: 3230044 - RNA, 20 nt, Human
uguggucacaggaaguagag

SEQ ID NO: 3230045 - RNA, 23 nt, Human
uguggguuucuaaagcugccagc

SEQ ID NO: 3230046 - RNA, 21 nt, Human
uguggguuucuaaagcugcca

SEQ ID NO: 3230047 - RNA, 14 nt, Human
ugugguguuuccug

SEQ ID NO: 3230048 - RNA, 16 nt, Human
ugugguguuuccuggc

SEQ ID NO: 3230049 - RNA, 16 nt, Human
ugugguguugaggcuu

SEQ ID NO: 3230050 - RNA, 13 nt, Human
uguggucccaccc

SEQ ID NO: 3230051 - RNA, 15 nt, Human
uguggucccacccca

SEQ ID NO: 3230052 - RNA, 14 nt, Human
uguggugucugugu

SEQ ID NO: 3230053 - RNA, 13 nt, Human
ugugguccaaaua

SEQ ID NO: 3230054 - RNA, 14 nt, Human
ugugguccaaauag

SEQ ID NO: 3230055 - RNA, 22 nt, Human
agugaguacaugcacacucaug

SEQ ID NO: 3230056 - RNA, 22 nt, Human
agugaguugauagcacagaccc

SEQ ID NO: 3230057 - RNA, 23 nt, Human
agugaguugauagcacagacccu

SEQ ID NO: 3230058 - RNA, 21 nt, Human
agugcugcagggcuuuaaaau

SEQ ID NO: 3230059 - RNA, 21 nt, Human
agugcugggauuacaggugug

SEQ ID NO: 3230060 - RNA, 20 nt, Human
agugcugggauuacaggugu

SEQ ID NO: 3230061 - RNA, 16 nt, Human
aguguacuggauuuaa

SEQ ID NO: 3230062 - RNA, 22 nt, Human
aguguaaaauauuuuaaaauaa

SEQ ID NO: 3230063 - RNA, 16 nt, Human
agugugguguuuccug

SEQ ID NO: 3230064 - RNA, 17 nt, Human
agugugcaguaucugug

SEQ ID NO: 3230065 - RNA, 19 nt, Human
agugugguguuuccuggca

SEQ ID NO: 3230066 - RNA, 17 nt, Human
agugugguguuuccugg

SEQ ID NO: 3230067 - RNA, 23 nt, Human
uguuacaaaauguaacuguuacc

SEQ ID NO: 3230068 - RNA, 21 nt, Human
uguuacaaaauguaacuguua

SEQ ID NO: 3230069 - RNA, 19 nt, Human
uguuacaaaauguaacugu

SEQ ID NO: 3230070 - RNA, 18 nt, Human
uguuacaaaauguaacug

SEQ ID NO: 3230071 - RNA, 17 nt, Human
uguuacaaaauguaacu

SEQ ID NO: 3230072 - RNA, 16 nt, Human
uguuacaaaauguaac

SEQ ID NO: 3230073 - RNA, 17 nt, Human
aguggugcgaucugggu

SEQ ID NO: 3230074 - RNA, 16 nt, Human
aguggacccugaaaug

SEQ ID NO: 3230075 - RNA, 16 nt, Human
aguggugcgaucuggg

SEQ ID NO: 3230076 - RNA, 18 nt, Human
aguggacccugaaaugug

SEQ ID NO: 3230077 - RNA, 17 nt, Human
aguggacccugaaaugu

SEQ ID NO: 3230078 - RNA, 21 nt, Human
agugguggugaacagaacaaa

SEQ ID NO: 3230079 - RNA, 14 nt, Human
uguugauuucuagu

SEQ ID NO: 3230080 - RNA, 11 nt, Human
uguugauuucu

SEQ ID NO: 3230081 - RNA, 19 nt, Human
uguugauuucuaguuauuu

SEQ ID NO: 3230082 - RNA, 18 nt, Human
uguugauuucuaguuauu

SEQ ID NO: 3230083 - RNA, 16 nt, Human
uguugauuucuaguua

SEQ ID NO: 3230084 - RNA, 15 nt, Human
uguugauuucuaguu

SEQ ID NO: 3230085 - RNA, 23 nt, Human
uguucuguuacaaaauguaacug

SEQ ID NO: 3230086 - RNA, 22 nt, Human
uguucuguuacaaaauguaacu

SEQ ID NO: 3230087 - RNA, 19 nt, Human
uguucuguuacaaaaugua

SEQ ID NO: 3230088 - RNA, 18 nt, Human
uguucuguuacaaaaugu

SEQ ID NO: 3230089 - RNA, 16 nt, Human
uguucuguuacaaaau

SEQ ID NO: 3230090 - RNA, 15 nt, Human
uguucuguuacaaaa

SEQ ID NO: 3230091 - RNA, 14 nt, Human
uguucuguuacaaa

SEQ ID NO: 3230092 - RNA, 13 nt, Human
uguucuguuacaa

SEQ ID NO: 3230093 - RNA, 18 nt, Human
uguugcccaggcaggucu

SEQ ID NO: 3230094 - RNA, 17 nt, Human
uguugcccaggcagguc

SEQ ID NO: 3230095 - RNA, 16 nt, Human
uguugcccaggcaggu

SEQ ID NO: 3230096 - RNA, 15 nt, Human
uguugcccaggcagg

SEQ ID NO: 3230097 - RNA, 12 nt, Human
uguugcccaggc

SEQ ID NO: 3230098 - RNA, 13 nt, Human
uguugcccaggca

SEQ ID NO: 3230099 - RNA, 21 nt, Human
uguugcaaugugaaaaaucug

SEQ ID NO: 3230100 - RNA, 20 nt, Human
uguugauuucuaguuauuua

SEQ ID NO: 3230101 - RNA, 20 nt, Human
agugugucuuagugugugca

SEQ ID NO: 3230102 - RNA, 20 nt, Human
uguuccacaaguuaaauaaa

SEQ ID NO: 3230103 - RNA, 19 nt, Human
uguuccacaaguuaaauaa

SEQ ID NO: 3230104 - RNA, 19 nt, Human
uguuauagguccuuuagaa

SEQ ID NO: 3230105 - RNA, 17 nt, Human
uguuauacaaccuucau

SEQ ID NO: 3230106 - RNA, 20 nt, Human
uguuauacaaccuucauuua

SEQ ID NO: 3230107 - RNA, 21 nt, Human
uguuauacaaccuucauuuaa

SEQ ID NO: 3230108 - RNA, 22 nt, Human
uguuauacaaccuucauuuaaa

SEQ ID NO: 3230109 - RNA, 21 nt, Human
uguuccgugguuaaacucgcu

SEQ ID NO: 3230110 - RNA, 18 nt, Human
uguuccauaguuaaagaa

SEQ ID NO: 3230111 - RNA, 10 nt, Human
uguuccaguu

SEQ ID NO: 3230112 - RNA, 14 nt, Human
uguuccuagugaaa

SEQ ID NO: 3230113 - RNA, 15 nt, Human
uguucugggacacag

SEQ ID NO: 3230114 - RNA, 16 nt, Human
uguucugggacacagu

SEQ ID NO: 3230115 - RNA, 17 nt, Human
uauuuguaaauuuaugu

SEQ ID NO: 3230116 - RNA, 22 nt, Human
uauuuguaaauuuaugugaugg

SEQ ID NO: 3230117 - RNA, 16 nt, Human
uauuuguaaauuuaug

SEQ ID NO: 3230118 - RNA, 12 nt, Human
uauuuguaagau

SEQ ID NO: 3230119 - RNA, 17 nt, Human
uauuuguaagauauuug

SEQ ID NO: 3230120 - RNA, 16 nt, Human
uauuuuuacauuuaaa

SEQ ID NO: 3230121 - RNA, 16 nt, Human
uauuuuuacaugcaga

SEQ ID NO: 3230122 - RNA, 14 nt, Human
uauuuuucuguuac

SEQ ID NO: 3230123 - RNA, 15 nt, Human
uauuuuucuguuacc

SEQ ID NO: 3230124 - RNA, 13 nt, Human
uauuuuucuuaaa

SEQ ID NO: 3230125 - RNA, 12 nt, Human
uauuuuuaucua

SEQ ID NO: 3230126 - RNA, 18 nt, Human
uauuuuuaucuauauaaa

SEQ ID NO: 3230127 - RNA, 13 nt, Human
ucaaaacugcacu

SEQ ID NO: 3230128 - RNA, 18 nt, Human
ucaaaacuuuaaaccugu

SEQ ID NO: 3230129 - RNA, 14 nt, Human
uauuuuugaaaaau

SEQ ID NO: 3230130 - RNA, 18 nt, Human
uauuuuugacauggaaau

SEQ ID NO: 3230131 - RNA, 18 nt, Human
ucaaaagaaagaaaauca

SEQ ID NO: 3230132 - RNA, 13 nt, Human
ucaaaaugcaaaa

SEQ ID NO: 3230133 - RNA, 19 nt, Human
ucaaaaucuagaagagucu

SEQ ID NO: 3230134 - RNA, 21 nt, Human
ucaaaauaccaugccauuuaa

SEQ ID NO: 3230135 - RNA, 13 nt, Human
ucaaaaguuuguu

SEQ ID NO: 3230136 - RNA, 14 nt, Human
ucaaaaguuuguuu

SEQ ID NO: 3230137 - RNA, 20 nt, Human
ucaaaagagcacuuuaauaa

SEQ ID NO: 3230138 - RNA, 16 nt, Human
ucaaaagagaugaaag

SEQ ID NO: 3230139 - RNA, 13 nt, Human
ucaaaauauugag

SEQ ID NO: 3230140 - RNA, 14 nt, Human
ucaaaauauugagc

SEQ ID NO: 3230141 - RNA, 20 nt, Human
ucaaaauauugagcagaauu

SEQ ID NO: 3230142 - RNA, 22 nt, Human
ucaaaauauugagcagaauuca

SEQ ID NO: 3230143 - RNA, 20 nt, Human
ucaaaauauaaaaugccaag

SEQ ID NO: 3230144 - RNA, 17 nt, Human
ucaaaauagguuuuuau

SEQ ID NO: 3230145 - RNA, 23 nt, Human
ucaaaauaccaugccauuuaaag

SEQ ID NO: 3230146 - RNA, 17 nt, Human
ucaaagccccauuaacu

SEQ ID NO: 3230147 - RNA, 21 nt, Human
ucaaagccccauuaacugcuu

SEQ ID NO: 3230148 - RNA, 20 nt, Human
ucaaagccccauuaacugcu

SEQ ID NO: 3230149 - RNA, 18 nt, Human
ucaaagccccauuaacug

SEQ ID NO: 3230150 - RNA, 15 nt, Human
ucaaagcuuuuugaa

SEQ ID NO: 3230151 - RNA, 22 nt, Human
ucaaagcaccaaaauaagaaaa

SEQ ID NO: 3230152 - RNA, 20 nt, Human
ucaaagcauggacauuuaga

SEQ ID NO: 3230153 - RNA, 22 nt, Human
ucaaagcauggacauuuagaag

SEQ ID NO: 3230154 - RNA, 17 nt, Human
ucaaacacuugugacuu

SEQ ID NO: 3230155 - RNA, 13 nt, Human
ucaaaauuacaua

SEQ ID NO: 3230156 - RNA, 15 nt, Human
ucaaaauuacauaua

SEQ ID NO: 3230157 - RNA, 14 nt, Human
ucaaaauuauagga

SEQ ID NO: 3230158 - RNA, 22 nt, Human
ucaaaauuauaggagacuugua

SEQ ID NO: 3230159 - RNA, 19 nt, Human
acaugauccugcaauucca

SEQ ID NO: 3230160 - RNA, 19 nt, Human
acaugagcaucaggccagg

SEQ ID NO: 3230161 - RNA, 17 nt, Human
acaugagcaucaggcca

SEQ ID NO: 3230162 - RNA, 18 nt, Human
acaugagcaucaggccag

SEQ ID NO: 3230163 - RNA, 17 nt, Human
acaugaucuucuuuaua

SEQ ID NO: 3230164 - RNA, 15 nt, Human
acaugaucuucuuua

SEQ ID NO: 3230165 - RNA, 18 nt, Human
ucaaauaacuaaaaggua

SEQ ID NO: 3230166 - RNA, 15 nt, Human
ucaaauaaaaauucu

SEQ ID NO: 3230167 - RNA, 19 nt, Human
ucaaauaaaaauucuagau

SEQ ID NO: 3230168 - RNA, 20 nt, Human
ucaaauaaaaauucuagauu

SEQ ID NO: 3230169 - RNA, 11 nt, Human
ucaaauaauac

SEQ ID NO: 3230170 - RNA, 21 nt, Human
ucaaauaauaccuuagaaggu

SEQ ID NO: 3230171 - RNA, 19 nt, Human
ucaaauaauaccuuagaag

SEQ ID NO: 3230172 - RNA, 22 nt, Human
ucaaauacauuuaaaacauuaa

SEQ ID NO: 3230173 - RNA, 21 nt, Human
ucaaauacauuuaaaacauua

SEQ ID NO: 3230174 - RNA, 19 nt, Human
ucaagaucuaaaucauaua

SEQ ID NO: 3230175 - RNA, 21 nt, Human
ucaagggcuuuccugugccag

SEQ ID NO: 3230176 - RNA, 19 nt, Human
ucaagggcuuuccugugcc

SEQ ID NO: 3230177 - RNA, 15 nt, Human
ucaagggcuuuccug

SEQ ID NO: 3230178 - RNA, 14 nt, Human
ucaagggcuuuccu

SEQ ID NO: 3230179 - RNA, 22 nt, Human
ucaagaugaugaugaucuuuaa

SEQ ID NO: 3230180 - RNA, 23 nt, Human
ucaagaucaaaaaggcuuauaaa

SEQ ID NO: 3230181 - RNA, 24 nt, Human
ucaagaucaaaaaggcuuauaaaa

SEQ ID NO: 3230182 - RNA, 15 nt, Human
ucaagagccuuaaaa

SEQ ID NO: 3230183 - RNA, 16 nt, Human
ucaagagccuuaaaac

SEQ ID NO: 3230184 - RNA, 17 nt, Human
ucaagagccuuaaaaca

SEQ ID NO: 3230185 - RNA, 18 nt, Human
ucaagagccuuaaaacau

SEQ ID NO: 3230186 - RNA, 19 nt, Human
ucaagagccuuaaaacauc

SEQ ID NO: 3230187 - RNA, 20 nt, Human
ucaagagccuuaaaacauca

SEQ ID NO: 3230188 - RNA, 21 nt, Human
ucaagagccuuaaaacaucau

SEQ ID NO: 3230189 - RNA, 17 nt, Human
ucaagaucaaaaaggcu

SEQ ID NO: 3230190 - RNA, 19 nt, Human
ucaagaucaaaaaggcuua

SEQ ID NO: 3230191 - RNA, 13 nt, Human
ucaagauagaaag

SEQ ID NO: 3230192 - RNA, 16 nt, Human
ucaaguauuuaagccu

SEQ ID NO: 3230193 - RNA, 16 nt, Human
ucaaguauuauaaaca

SEQ ID NO: 3230194 - RNA, 15 nt, Human
ucaaguauuauaaac

SEQ ID NO: 3230195 - RNA, 19 nt, Human
ucaaguagacuacuguuca

SEQ ID NO: 3230196 - RNA, 18 nt, Human
ucaaguagacuacuguuc

SEQ ID NO: 3230197 - RNA, 21 nt, Human
ucaaguagacuacuguucagc

SEQ ID NO: 3230198 - RNA, 12 nt, Human
ucaaguauuacu

SEQ ID NO: 3230199 - RNA, 14 nt, Human
ucaaguauuauaaa

SEQ ID NO: 3230200 - RNA, 17 nt, Human
ucaaguagacuacuguu

SEQ ID NO: 3230201 - RNA, 19 nt, Human
ucaagaauagcauuguaaa

SEQ ID NO: 3230202 - RNA, 13 nt, Human
ucaagaccaaaug

SEQ ID NO: 3230203 - RNA, 22 nt, Human
ucaagaaguucuuugauucugu

SEQ ID NO: 3230204 - RNA, 21 nt, Human
ucaagaccaaauggaaacaga

SEQ ID NO: 3230205 - RNA, 19 nt, Human
ucaagaccaaauggaaaca

SEQ ID NO: 3230206 - RNA, 11 nt, Human
ucaagagccuu

SEQ ID NO: 3230207 - RNA, 17 nt, Human
ucaagacugaauuccaa

SEQ ID NO: 3230208 - RNA, 16 nt, Human
ucaagacugaauucca

SEQ ID NO: 3230209 - RNA, 16 nt, Human
ucaagaacuuguuuaa

SEQ ID NO: 3230210 - RNA, 15 nt, Human
ucaagaacuuguuua

SEQ ID NO: 3230211 - RNA, 14 nt, Human
ucaagaacuuguuu

SEQ ID NO: 3230212 - RNA, 21 nt, Human
ucaagaaaugaagagcuguug

SEQ ID NO: 3230213 - RNA, 18 nt, Human
ucaagaaaugaagagcug

SEQ ID NO: 3230214 - RNA, 22 nt, Human
ucaagaacacagcccugcuucu

SEQ ID NO: 3230215 - RNA, 14 nt, Human
ucaagaaguucuuu

SEQ ID NO: 3230216 - RNA, 10 nt, Human
ucaagaaaug

SEQ ID NO: 3230217 - RNA, 16 nt, Human
ucaagaaaugaagagc

SEQ ID NO: 3230218 - RNA, 15 nt, Human
ucaagaaaugaagag

SEQ ID NO: 3230219 - RNA, 14 nt, Human
ucaagaaaugaaga

SEQ ID NO: 3230220 - RNA, 14 nt, Human
ucaacaguguuuuc

SEQ ID NO: 3230221 - RNA, 17 nt, Human
ucaacauaccuuggcca

SEQ ID NO: 3230222 - RNA, 21 nt, Human
ucaacauggcuacuugcuuug

SEQ ID NO: 3230223 - RNA, 14 nt, Human
ucaacaugucuccu

SEQ ID NO: 3230224 - RNA, 22 nt, Human
ucaacauggcuacuugcuuuga

SEQ ID NO: 3230225 - RNA, 19 nt, Human
acaugucuccuacugagga

SEQ ID NO: 3230226 - RNA, 13 nt, Human
acauuaacaggca

SEQ ID NO: 3230227 - RNA, 21 nt, Human
acauguccaagaagcccagga

SEQ ID NO: 3230228 - RNA, 19 nt, Human
acauguccaagaagcccag

SEQ ID NO: 3230229 - RNA, 22 nt, Human
acauuagcaguuugcuuuguau

SEQ ID NO: 3230230 - RNA, 18 nt, Human
acauuagcaguuugcuuu

SEQ ID NO: 3230231 - RNA, 23 nt, Human
acauuaguacuuuauagaagaau

SEQ ID NO: 3230232 - RNA, 22 nt, Human
acauuaguacuuuauagaagaa

SEQ ID NO: 3230233 - RNA, 16 nt, Human
acauuaguacuuuaua

SEQ ID NO: 3230234 - RNA, 19 nt, Human
acauuaguacuuuauagaa

SEQ ID NO: 3230235 - RNA, 18 nt, Human
acauuaguacuuuauaga

SEQ ID NO: 3230236 - RNA, 20 nt, Human
acauucuggggaaacaacau

SEQ ID NO: 3230237 - RNA, 23 nt, Human
acauucuggggaaacaacauuua

SEQ ID NO: 3230238 - RNA, 16 nt, Human
ucaacagguuuuccug

SEQ ID NO: 3230239 - RNA, 15 nt, Human
ucaacagcaagugug

SEQ ID NO: 3230240 - RNA, 16 nt, Human
ucaacagcaaguguga

SEQ ID NO: 3230241 - RNA, 22 nt, Human
ucaacagcaagugugaauacug

SEQ ID NO: 3230242 - RNA, 20 nt, Human
acauauuagcgacaacagau

SEQ ID NO: 3230243 - RNA, 16 nt, Human
acauauguauacaugu

SEQ ID NO: 3230244 - RNA, 18 nt, Human
acauauguauacaugugc

SEQ ID NO: 3230245 - RNA, 17 nt, Human
acauauguauacaugug

SEQ ID NO: 3230246 - RNA, 14 nt, Human
acauagaauuaaca

SEQ ID NO: 3230247 - RNA, 18 nt, Human
acauagaauuaacacaug

SEQ ID NO: 3230248 - RNA, 16 nt, Human
acauagccaaaaugug

SEQ ID NO: 3230249 - RNA, 19 nt, Human
acauagccaaaaugugagu

SEQ ID NO: 3230250 - RNA, 15 nt, Human
acauauacaacacca

SEQ ID NO: 3230251 - RNA, 16 nt, Human
acauauaaauugucuu

SEQ ID NO: 3230252 - RNA, 22 nt, Human
acauauaaauugucuuaaugga

SEQ ID NO: 3230253 - RNA, 17 nt, Human
acauauaaauugucuua

SEQ ID NO: 3230254 - RNA, 17 nt, Human
acauaguucguuuaccu

SEQ ID NO: 3230255 - RNA, 16 nt, Human
acauaggguucccacg

SEQ ID NO: 3230256 - RNA, 18 nt, Human
acauagucugaagugaag

SEQ ID NO: 3230257 - RNA, 21 nt, Human
acauaggaaguuaaaagcaca

SEQ ID NO: 3230258 - RNA, 21 nt, Human
acauagugaugguuccccugu

SEQ ID NO: 3230259 - RNA, 16 nt, Human
acauagugaugguucc

SEQ ID NO: 3230260 - RNA, 13 nt, Human
acaucaacagaua

SEQ ID NO: 3230261 - RNA, 23 nt, Human
acaucaaauaauugaagagacaa

SEQ ID NO: 3230262 - RNA, 18 nt, Human
acaucaacaucuugguca

SEQ ID NO: 3230263 - RNA, 16 nt, Human
acaucaacaucuuggu

SEQ ID NO: 3230264 - RNA, 20 nt, Human
acaucagaaauaauaaaaaa

SEQ ID NO: 3230265 - RNA, 23 nt, Human
acaucucccuuuuccaugacugu

SEQ ID NO: 3230266 - RNA, 24 nt, Human
acaucucaucaugucuauugucca

SEQ ID NO: 3230267 - RNA, 12 nt, Human
acaucucagaga

SEQ ID NO: 3230268 - RNA, 11 nt, Human
acaucucagag

SEQ ID NO: 3230269 - RNA, 12 nt, Human
acaucacuggca

SEQ ID NO: 3230270 - RNA, 23 nt, Human
acaucacuggcauggugguuggg

SEQ ID NO: 3230271 - RNA, 14 nt, Human
acaucacuggcaug

SEQ ID NO: 3230272 - RNA, 19 nt, Human
acaucuugcucugcugaca

SEQ ID NO: 3230273 - RNA, 18 nt, Human
acaucuugcucugcugac

SEQ ID NO: 3230274 - RNA, 21 nt, Human
acaucuugcucugcugacaga

SEQ ID NO: 3230275 - RNA, 13 nt, Human
acaucuugcucug

SEQ ID NO: 3230276 - RNA, 15 nt, Human
acaucuccuuagaaa

SEQ ID NO: 3230277 - RNA, 11 nt, Human
acaucuccuua

SEQ ID NO: 3230278 - RNA, 15 nt, Human
acaucucugacuuuc

SEQ ID NO: 3230279 - RNA, 16 nt, Human
acaucucugacuuucu

SEQ ID NO: 3230280 - RNA, 15 nt, Human
acaucucuauucccc

SEQ ID NO: 3230281 - RNA, 22 nt, Human
uauuucccugaaggaaccaaag

SEQ ID NO: 3230282 - RNA, 22 nt, Human
uauuucccucaccuuucccauc

SEQ ID NO: 3230283 - RNA, 20 nt, Human
uauuucccccuuucuuccuc

SEQ ID NO: 3230284 - RNA, 15 nt, Human
uauuucccccuuucu

SEQ ID NO: 3230285 - RNA, 23 nt, Human
uauuuccuauauuguuuucagug

SEQ ID NO: 3230286 - RNA, 16 nt, Human
uauuucccuuuagcug

SEQ ID NO: 3230287 - RNA, 13 nt, Human
uauuucccuuuag

SEQ ID NO: 3230288 - RNA, 19 nt, Human
uauuuccuauaccauuucc

SEQ ID NO: 3230289 - RNA, 17 nt, Human
uauuuccuauaccauuu

SEQ ID NO: 3230290 - RNA, 20 nt, Human
uauuucuagacacuuuuucu

SEQ ID NO: 3230291 - RNA, 17 nt, Human
uauuucuagcuuuuuaa

SEQ ID NO: 3230292 - RNA, 13 nt, Human
uauuucauuucuu

SEQ ID NO: 3230293 - RNA, 15 nt, Human
uaugaaauauaugug

SEQ ID NO: 3230294 - RNA, 16 nt, Human
uaugaaauauauguga

SEQ ID NO: 3230295 - RNA, 14 nt, Human
uaugaagaaaauac

SEQ ID NO: 3230296 - RNA, 16 nt, Human
uaugaagaaaauacuu

SEQ ID NO: 3230297 - RNA, 15 nt, Human
uaugaagaaaauacu

SEQ ID NO: 3230298 - RNA, 22 nt, Human
uaugaagaaaauacuuaaaugu

SEQ ID NO: 3230299 - RNA, 20 nt, Human
uaugaagaaaauacuuaaau

SEQ ID NO: 3230300 - RNA, 11 nt, Human
acaguuguuug

SEQ ID NO: 3230301 - RNA, 17 nt, Human
acaguugugcaggaggu

SEQ ID NO: 3230302 - RNA, 12 nt, Human
acaguugugcag

SEQ ID NO: 3230303 - RNA, 22 nt, Human
acaguuguuugaugcauuaaaa

SEQ ID NO: 3230304 - RNA, 15 nt, Human
acaguuguuugaugc

SEQ ID NO: 3230305 - RNA, 13 nt, Human
acaguuguuugau

SEQ ID NO: 3230306 - RNA, 12 nt, Human
acaguuguuuga

SEQ ID NO: 3230307 - RNA, 17 nt, Human
acaguuuaugcagugcu

SEQ ID NO: 3230308 - RNA, 19 nt, Human
acaguuuaugcagugcugc

SEQ ID NO: 3230309 - RNA, 21 nt, Human
acaguuuaugcagugcugcuu

SEQ ID NO: 3230310 - RNA, 15 nt, Human
acaguugaaaaacag

SEQ ID NO: 3230311 - RNA, 16 nt, Human
acaguugaaaaacagc

SEQ ID NO: 3230312 - RNA, 20 nt, Human
acaguugaaaaacagcugag

SEQ ID NO: 3230313 - RNA, 14 nt, Human
acaguuuucuucau

SEQ ID NO: 3230314 - RNA, 21 nt, Human
acaguuuucugagaaagacua

SEQ ID NO: 3230315 - RNA, 20 nt, Human
acaguuuucugagaaagacu

SEQ ID NO: 3230316 - RNA, 19 nt, Human
acaguuuucugagaaagac

SEQ ID NO: 3230317 - RNA, 18 nt, Human
acaguuuucugagaaaga

SEQ ID NO: 3230318 - RNA, 15 nt, Human
acaguuuucugagaa

SEQ ID NO: 3230319 - RNA, 17 nt, Human
acaguuuucugagaaag

SEQ ID NO: 3230320 - RNA, 16 nt, Human
acaguuuucugagaaa

SEQ ID NO: 3230321 - RNA, 13 nt, Human
acauacucccauc

SEQ ID NO: 3230322 - RNA, 15 nt, Human
acauacguaaaaauc

SEQ ID NO: 3230323 - RNA, 16 nt, Human
acauacgugugcaugu

SEQ ID NO: 3230324 - RNA, 15 nt, Human
acauacgugugcaug

SEQ ID NO: 3230325 - RNA, 22 nt, Human
acauacgugugcaugugucuuu

SEQ ID NO: 3230326 - RNA, 21 nt, Human
acauacgugugcaugugucuu

SEQ ID NO: 3230327 - RNA, 14 nt, Human
acauacucugcuua

SEQ ID NO: 3230328 - RNA, 17 nt, Human
acauacucccaucugug

SEQ ID NO: 3230329 - RNA, 15 nt, Human
acauacuuuaucaau

SEQ ID NO: 3230330 - RNA, 13 nt, Human
ucacucuuggagc

SEQ ID NO: 3230331 - RNA, 23 nt, Human
ucacucuuauugcccacgcugga

SEQ ID NO: 3230332 - RNA, 21 nt, Human
ucacucuuauugcccacgcug

SEQ ID NO: 3230333 - RNA, 20 nt, Human
accauuggaaauuucacguc

SEQ ID NO: 3230334 - RNA, 19 nt, Human
accauuggaaauuucacgu

SEQ ID NO: 3230335 - RNA, 18 nt, Human
accauuggaaauuucacg

SEQ ID NO: 3230336 - RNA, 15 nt, Human
accauuggaaauuuc

SEQ ID NO: 3230337 - RNA, 14 nt, Human
accauuggaaauuu

SEQ ID NO: 3230338 - RNA, 23 nt, Human
accauugagaccgugaagauacu

SEQ ID NO: 3230339 - RNA, 16 nt, Human
accauugcaacaaaau

SEQ ID NO: 3230340 - RNA, 13 nt, Human
accauuggaaauu

SEQ ID NO: 3230341 - RNA, 18 nt, Human
accauugcaacaaaauac

SEQ ID NO: 3230342 - RNA, 22 nt, Human
accauugagaccgugaagauac

SEQ ID NO: 3230343 - RNA, 15 nt, Human
accauugcaacaaaa

SEQ ID NO: 3230344 - RNA, 19 nt, Human
accauuaaaauaugcacua

SEQ ID NO: 3230345 - RNA, 14 nt, Human
accauuaaaauaug

SEQ ID NO: 3230346 - RNA, 20 nt, Human
accauuaaaauaugcacuaa

SEQ ID NO: 3230347 - RNA, 13 nt, Human
accauuaaaguca

SEQ ID NO: 3230348 - RNA, 15 nt, Human
accauuaaagucaga

SEQ ID NO: 3230349 - RNA, 17 nt, Human
accauuauuaucaagua

SEQ ID NO: 3230350 - RNA, 14 nt, Human
accauuaccaaaau

SEQ ID NO: 3230351 - RNA, 15 nt, Human
accauuuguuaauau

SEQ ID NO: 3230352 - RNA, 11 nt, Human
acccacugcuc

SEQ ID NO: 3230353 - RNA, 10 nt, Human
acccacugcu

SEQ ID NO: 3230354 - RNA, 15 nt, Human
accauuuuccugcau

SEQ ID NO: 3230355 - RNA, 14 nt, Human
accauuuuccugca

SEQ ID NO: 3230356 - RNA, 12 nt, Human
accauuuuccug

SEQ ID NO: 3230357 - RNA, 11 nt, Human
acccacugcuu

SEQ ID NO: 3230358 - RNA, 15 nt, Human
acccacugcucuggu

SEQ ID NO: 3230359 - RNA, 14 nt, Human
acccacugcucugg

SEQ ID NO: 3230360 - RNA, 13 nt, Human
acccacugcucug

SEQ ID NO: 3230361 - RNA, 17 nt, Human
ucagaagguuguuuuau

SEQ ID NO: 3230362 - RNA, 19 nt, Human
ucagaaggucuguuuugag

SEQ ID NO: 3230363 - RNA, 14 nt, Human
ucagaaggucuguu

SEQ ID NO: 3230364 - RNA, 15 nt, Human
ucagaaguccagagu

SEQ ID NO: 3230365 - RNA, 19 nt, Human
ucagaaguuucucagcucc

SEQ ID NO: 3230366 - RNA, 17 nt, Human
ucagaaguuuaaauauu

SEQ ID NO: 3230367 - RNA, 15 nt, Human
ucagaaguuuaaaua

SEQ ID NO: 3230368 - RNA, 19 nt, Human
ucagaaguuucugccgcag

SEQ ID NO: 3230369 - RNA, 22 nt, Human
ucagaaguuucugccgcagccc

SEQ ID NO: 3230370 - RNA, 14 nt, Human
ucagaagacacuga

SEQ ID NO: 3230371 - RNA, 13 nt, Human
ucagaagauaguc

SEQ ID NO: 3230372 - RNA, 20 nt, Human
ucagaagauagucuuggaag

SEQ ID NO: 3230373 - RNA, 18 nt, Human
ucagagccugcaguuauu

SEQ ID NO: 3230374 - RNA, 15 nt, Human
ucagagccugcaguu

SEQ ID NO: 3230375 - RNA, 14 nt, Human
ucagagccugcagu

SEQ ID NO: 3230376 - RNA, 13 nt, Human
ucagagccugcag

SEQ ID NO: 3230377 - RNA, 16 nt, Human
ucagagagggugggag

SEQ ID NO: 3230378 - RNA, 21 nt, Human
ucagagagggugggagugggc

SEQ ID NO: 3230379 - RNA, 23 nt, Human
ucagagagggugggagugggccc

SEQ ID NO: 3230380 - RNA, 12 nt, Human
ucagagccugca

SEQ ID NO: 3230381 - RNA, 17 nt, Human
ucagagacuccugcagg

SEQ ID NO: 3230382 - RNA, 20 nt, Human
ucagagacuccugcaggcag

SEQ ID NO: 3230383 - RNA, 21 nt, Human
ucagagacuccugcaggcagc

SEQ ID NO: 3230384 - RNA, 16 nt, Human
ucagagacuccugcag

SEQ ID NO: 3230385 - RNA, 19 nt, Human
ucagaaucucaaauaacua

SEQ ID NO: 3230386 - RNA, 18 nt, Human
ucagaaucucaaauaacu

SEQ ID NO: 3230387 - RNA, 22 nt, Human
ucagaauggaagagagaaagca

SEQ ID NO: 3230388 - RNA, 23 nt, Human
ucagaaguuuaaauauuaagcau

SEQ ID NO: 3230389 - RNA, 22 nt, Human
accccacuuagccuuucuuuuc

SEQ ID NO: 3230390 - RNA, 24 nt, Human
acccagcgagcccugguggcagug

SEQ ID NO: 3230391 - RNA, 12 nt, Human
accccaccugcg

SEQ ID NO: 3230392 - RNA, 11 nt, Human
accccaccugc

SEQ ID NO: 3230393 - RNA, 22 nt, Human
ucagcccaaaccaccagaagcc

SEQ ID NO: 3230394 - RNA, 21 nt, Human
ucagcccaaaccaccagaagc

SEQ ID NO: 3230395 - RNA, 21 nt, Human
ucagcccaaucccugaucccu

SEQ ID NO: 3230396 - RNA, 19 nt, Human
ucagcccaaucccugaucc

SEQ ID NO: 3230397 - RNA, 23 nt, Human
ucagccguguaaccauggaccca

SEQ ID NO: 3230398 - RNA, 13 nt, Human
ucagccuaagaga

SEQ ID NO: 3230399 - RNA, 23 nt, Human
acccagcgagcccugguggcagu

SEQ ID NO: 3230400 - RNA, 19 nt, Human
acccagcgagcccuggugg

SEQ ID NO: 3230401 - RNA, 23 nt, Human
ucagcauucucacuccuaccugg

SEQ ID NO: 3230402 - RNA, 22 nt, Human
ucagccaagaauucuuaaauau

SEQ ID NO: 3230403 - RNA, 17 nt, Human
ucagccaucaacuaaag

SEQ ID NO: 3230404 - RNA, 15 nt, Human
ucaggaaaagguuga

SEQ ID NO: 3230405 - RNA, 19 nt, Human
ucaggaaaagguugaauaa

SEQ ID NO: 3230406 - RNA, 17 nt, Human
ucagcuugcacauuugg

SEQ ID NO: 3230407 - RNA, 16 nt, Human
ucagcuugcacauuug

SEQ ID NO: 3230408 - RNA, 21 nt, Human
ucaggaaaucaaauaugcaaa

SEQ ID NO: 3230409 - RNA, 20 nt, Human
ucaggaaaucaaauaugcaa

SEQ ID NO: 3230410 - RNA, 12 nt, Human
ucagcucagagc

SEQ ID NO: 3230411 - RNA, 14 nt, Human
ucagcggggacagc

SEQ ID NO: 3230412 - RNA, 16 nt, Human
ucagcuaggaacaaau

SEQ ID NO: 3230413 - RNA, 23 nt, Human
ucagcuaggaacaaaucuuccug

SEQ ID NO: 3230414 - RNA, 21 nt, Human
ucagcuaggaacaaaucuucc

SEQ ID NO: 3230415 - RNA, 20 nt, Human
ucagcuaggaacaaaucuuc

SEQ ID NO: 3230416 - RNA, 19 nt, Human
ucagcuaggaacaaaucuu

SEQ ID NO: 3230417 - RNA, 13 nt, Human
ucagcucacugca

SEQ ID NO: 3230418 - RNA, 16 nt, Human
ucagcucacugcaacc

SEQ ID NO: 3230419 - RNA, 12 nt, Human
acccccacccaa

SEQ ID NO: 3230420 - RNA, 13 nt, Human
accccccccccac

SEQ ID NO: 3230421 - RNA, 22 nt, Human
acccccccagcuucacuucuga

SEQ ID NO: 3230422 - RNA, 12 nt, Human
acccccccagcu

SEQ ID NO: 3230423 - RNA, 17 nt, Human
accccuguaggccucag

SEQ ID NO: 3230424 - RNA, 16 nt, Human
accccuguaggccuca

SEQ ID NO: 3230425 - RNA, 15 nt, Human
accccuguaggccuc

SEQ ID NO: 3230426 - RNA, 15 nt, Human
accccuucgcuccug

SEQ ID NO: 3230427 - RNA, 14 nt, Human
accccuucgcuccu

SEQ ID NO: 3230428 - RNA, 22 nt, Human
accccuuccugggcacacgcug

SEQ ID NO: 3230429 - RNA, 15 nt, Human
accccuuccugggca

SEQ ID NO: 3230430 - RNA, 16 nt, Human
accccuucgcuccugu

SEQ ID NO: 3230431 - RNA, 23 nt, Human
accccuuccugggcacacgcugc

SEQ ID NO: 3230432 - RNA, 13 nt, Human
ucacaccugcaga

SEQ ID NO: 3230433 - RNA, 22 nt, Human
ucacacgucuggcuucacagau

SEQ ID NO: 3230434 - RNA, 19 nt, Human
ucacaaauuucucuguucc

SEQ ID NO: 3230435 - RNA, 18 nt, Human
ucacaaauuucucuguuc

SEQ ID NO: 3230436 - RNA, 14 nt, Human
ucacaaauuucucu

SEQ ID NO: 3230437 - RNA, 16 nt, Human
ucacaacaaccugguc

SEQ ID NO: 3230438 - RNA, 20 nt, Human
ucacaaaugacuuuauuauu

SEQ ID NO: 3230439 - RNA, 18 nt, Human
ucacaaaugacuuuauua

SEQ ID NO: 3230440 - RNA, 19 nt, Human
ucacaaaugacuuuauuau

SEQ ID NO: 3230441 - RNA, 11 nt, Human
ucacaaaugac

SEQ ID NO: 3230442 - RNA, 23 nt, Human
ucacaaauauuaaaaagucuuuu

SEQ ID NO: 3230443 - RNA, 12 nt, Human
ucacaaaugacu

SEQ ID NO: 3230444 - RNA, 13 nt, Human
ucacaaaugacuu

SEQ ID NO: 3230445 - RNA, 14 nt, Human
ucacaaaugacuuu

SEQ ID NO: 3230446 - RNA, 15 nt, Human
ucacaaaugacuuua

SEQ ID NO: 3230447 - RNA, 16 nt, Human
ucacacucuaacugua

SEQ ID NO: 3230448 - RNA, 18 nt, Human
ucacacucuaacuguaua

SEQ ID NO: 3230449 - RNA, 21 nt, Human
ucacacucuaacuguauauuu

SEQ ID NO: 3230450 - RNA, 15 nt, Human
ucacaguucucuccu

SEQ ID NO: 3230451 - RNA, 17 nt, Human
ucacaguuauuacauac

SEQ ID NO: 3230452 - RNA, 15 nt, Human
ucacauaucugucau

SEQ ID NO: 3230453 - RNA, 12 nt, Human
ucacauaucugu

SEQ ID NO: 3230454 - RNA, 16 nt, Human
ucacauccuugacuuu

SEQ ID NO: 3230455 - RNA, 21 nt, Human
ucacauccuugacuuuuuaga

SEQ ID NO: 3230456 - RNA, 19 nt, Human
ucacauccuugacuuuuua

SEQ ID NO: 3230457 - RNA, 15 nt, Human
ucaccccggccaccu

SEQ ID NO: 3230458 - RNA, 14 nt, Human
ucaccccagcccca

SEQ ID NO: 3230459 - RNA, 20 nt, Human
ucaccccagccccaaaacuc

SEQ ID NO: 3230460 - RNA, 13 nt, Human
ucaccccagcccc

SEQ ID NO: 3230461 - RNA, 19 nt, Human
ucaccagugaccuggaagg

SEQ ID NO: 3230462 - RNA, 21 nt, Human
ucaccaguacauucucaguuu

SEQ ID NO: 3230463 - RNA, 15 nt, Human
ucaccaguacauucu

SEQ ID NO: 3230464 - RNA, 19 nt, Human
ucaccaguacauucucagu

SEQ ID NO: 3230465 - RNA, 17 nt, Human
ucaccaguacauucuca

SEQ ID NO: 3230466 - RNA, 22 nt, Human
accacacguaaugaaacuugga

SEQ ID NO: 3230467 - RNA, 14 nt, Human
accacacuccagcu

SEQ ID NO: 3230468 - RNA, 14 nt, Human
accacaaaauauac

SEQ ID NO: 3230469 - RNA, 15 nt, Human
accaauuuuaacuua

SEQ ID NO: 3230470 - RNA, 22 nt, Human
accaauuuuuugugugugaagc

SEQ ID NO: 3230471 - RNA, 21 nt, Human
accaauuuuuugugugugaag

SEQ ID NO: 3230472 - RNA, 23 nt, Human
ucaauuuuucuuauuucauuucu

SEQ ID NO: 3230473 - RNA, 20 nt, Human
ucaauuuuucuuauuucauu

SEQ ID NO: 3230474 - RNA, 15 nt, Human
ucacaaauauuaaaa

SEQ ID NO: 3230475 - RNA, 14 nt, Human
ucacaaauauuaaa

SEQ ID NO: 3230476 - RNA, 21 nt, Human
ucacaaauauuaaaaagucuu

SEQ ID NO: 3230477 - RNA, 20 nt, Human
ucacaaauauuaaaaagucu

SEQ ID NO: 3230478 - RNA, 18 nt, Human
ucacaaauauuaaaaagu

SEQ ID NO: 3230479 - RNA, 17 nt, Human
ucacaaauauuaaaaag

SEQ ID NO: 3230480 - RNA, 20 nt, Human
ucaauuuuugguugaauaaa

SEQ ID NO: 3230481 - RNA, 15 nt, Human
accaauguucucucu

SEQ ID NO: 3230482 - RNA, 17 nt, Human
accaacauacucccauc

SEQ ID NO: 3230483 - RNA, 19 nt, Human
accaacauacucccaucug

SEQ ID NO: 3230484 - RNA, 21 nt, Human
accaacauacucccaucugug

SEQ ID NO: 3230485 - RNA, 22 nt, Human
accaacauacucccaucuguga

SEQ ID NO: 3230486 - RNA, 23 nt, Human
ucaagugaaaaaggaggaagaga

SEQ ID NO: 3230487 - RNA, 17 nt, Human
ucaagugauucucaugc

SEQ ID NO: 3230488 - RNA, 15 nt, Human
ucaagugaaaaagga

SEQ ID NO: 3230489 - RNA, 22 nt, Human
ucaaguauuuaagccuaaagau

SEQ ID NO: 3230490 - RNA, 19 nt, Human
ucacuauguugcccaggca

SEQ ID NO: 3230491 - RNA, 17 nt, Human
ucacuauguugcccagg

SEQ ID NO: 3230492 - RNA, 18 nt, Human
ucacuauguugcccaggc

SEQ ID NO: 3230493 - RNA, 15 nt, Human
ucaccucucccuugg

SEQ ID NO: 3230494 - RNA, 13 nt, Human
ucaccugccccuc

SEQ ID NO: 3230495 - RNA, 15 nt, Human
ucaccugccccucaa

SEQ ID NO: 3230496 - RNA, 21 nt, Human
accagccuccaugcugccucc

SEQ ID NO: 3230497 - RNA, 20 nt, Human
accagccuccaugcugccuc

SEQ ID NO: 3230498 - RNA, 19 nt, Human
accagccuccaugcugccu

SEQ ID NO: 3230499 - RNA, 14 nt, Human
accagccuccaugc

SEQ ID NO: 3230500 - RNA, 18 nt, Human
accagacuuuuuuaaaca

SEQ ID NO: 3230501 - RNA, 13 nt, Human
accagaagcccag

SEQ ID NO: 3230502 - RNA, 19 nt, Human
accagaaccagucuuucaa

SEQ ID NO: 3230503 - RNA, 14 nt, Human
accagaaccaaacc

SEQ ID NO: 3230504 - RNA, 16 nt, Human
accagaagcccagaau

SEQ ID NO: 3230505 - RNA, 14 nt, Human
accagaagcccaga

SEQ ID NO: 3230506 - RNA, 13 nt, Human
accagacacaaac

SEQ ID NO: 3230507 - RNA, 16 nt, Human
accagacaagcuguug

SEQ ID NO: 3230508 - RNA, 14 nt, Human
accagacaagcugu

SEQ ID NO: 3230509 - RNA, 19 nt, Human
accacuuguagauuugauu

SEQ ID NO: 3230510 - RNA, 13 nt, Human
accacuugcugca

SEQ ID NO: 3230511 - RNA, 13 nt, Human
accacuuguagau

SEQ ID NO: 3230512 - RNA, 14 nt, Human
accacuuguagauu

SEQ ID NO: 3230513 - RNA, 16 nt, Human
accacuuguagauuug

SEQ ID NO: 3230514 - RNA, 16 nt, Human
accagagcccaccuug

SEQ ID NO: 3230515 - RNA, 14 nt, Human
accagagcccaccu

SEQ ID NO: 3230516 - RNA, 12 nt, Human
accagagcccac

SEQ ID NO: 3230517 - RNA, 11 nt, Human
accagacaggu

SEQ ID NO: 3230518 - RNA, 14 nt, Human
accagacaccuuga

SEQ ID NO: 3230519 - RNA, 17 nt, Human
accacugcacuccagcc

SEQ ID NO: 3230520 - RNA, 20 nt, Human
accacugcacuccagccugg

SEQ ID NO: 3230521 - RNA, 17 nt, Human
ucaccccggccaccugc

SEQ ID NO: 3230522 - RNA, 18 nt, Human
ucaccccggccaccugcg

SEQ ID NO: 3230523 - RNA, 21 nt, Human
accacugcacuccagccuggg

SEQ ID NO: 3230524 - RNA, 15 nt, Human
accacugcucugaug

SEQ ID NO: 3230525 - RNA, 17 nt, Human
accacugcucugaugaa

SEQ ID NO: 3230526 - RNA, 23 nt, Human
accacugcucugaugaagaggag

SEQ ID NO: 3230527 - RNA, 18 nt, Human
uccacuggggauugggcc

SEQ ID NO: 3230528 - RNA, 14 nt, Human
uccagacccggcug

SEQ ID NO: 3230529 - RNA, 20 nt, Human
uccagaauuucccaaagcag

SEQ ID NO: 3230530 - RNA, 22 nt, Human
uccagaauuucccaaagcagug

SEQ ID NO: 3230531 - RNA, 16 nt, Human
uccagaauuucccaaa

SEQ ID NO: 3230532 - RNA, 22 nt, Human
uccacugccuucgauacaccgg

SEQ ID NO: 3230533 - RNA, 15 nt, Human
uccacugccuucgau

SEQ ID NO: 3230534 - RNA, 13 nt, Human
uccacugccuucg

SEQ ID NO: 3230535 - RNA, 18 nt, Human
uccagacccggcugcgug

SEQ ID NO: 3230536 - RNA, 15 nt, Human
uccagacccggcugc

SEQ ID NO: 3230537 - RNA, 19 nt, Human
uccagacccggcugcgugg

SEQ ID NO: 3230538 - RNA, 18 nt, Human
uccacuccuccuagccac

SEQ ID NO: 3230539 - RNA, 15 nt, Human
uccacuccuccuagc

SEQ ID NO: 3230540 - RNA, 19 nt, Human
uccaccuucccaugcccug

SEQ ID NO: 3230541 - RNA, 12 nt, Human
uccaccuucuca

SEQ ID NO: 3230542 - RNA, 14 nt, Human
uccaccuucucaca

SEQ ID NO: 3230543 - RNA, 15 nt, Human
uccaccuucucacau

SEQ ID NO: 3230544 - RNA, 18 nt, Human
uccaccuucccaugcccu

SEQ ID NO: 3230545 - RNA, 16 nt, Human
uccaccuucccaugcc

SEQ ID NO: 3230546 - RNA, 15 nt, Human
uccaccuucccaugc

SEQ ID NO: 3230547 - RNA, 17 nt, Human
accuuuugagugccuua

SEQ ID NO: 3230548 - RNA, 20 nt, Human
accuuuugagugccuuacac

SEQ ID NO: 3230549 - RNA, 14 nt, Human
accuuuugagugcc

SEQ ID NO: 3230550 - RNA, 20 nt, Human
accuucaagcugcuuuuugu

SEQ ID NO: 3230551 - RNA, 14 nt, Human
accuucaagcugcu

SEQ ID NO: 3230552 - RNA, 12 nt, Human
accuucaagcug

SEQ ID NO: 3230553 - RNA, 20 nt, Human
accuuaaauuaguacagcac

SEQ ID NO: 3230554 - RNA, 16 nt, Human
uccaggccagggggcc

SEQ ID NO: 3230555 - RNA, 11 nt, Human
uccaggcagcc

SEQ ID NO: 3230556 - RNA, 13 nt, Human
uccaggcagccgc

SEQ ID NO: 3230557 - RNA, 18 nt, Human
uccaggcagcacccaggu

SEQ ID NO: 3230558 - RNA, 12 nt, Human
uccaggcagcac

SEQ ID NO: 3230559 - RNA, 18 nt, Human
uccaggccagggggccag

SEQ ID NO: 3230560 - RNA, 14 nt, Human
uccaggcuguaucc

SEQ ID NO: 3230561 - RNA, 18 nt, Human
uccaggccuacuccuguc

SEQ ID NO: 3230562 - RNA, 16 nt, Human
uccaggccuacuccug

SEQ ID NO: 3230563 - RNA, 17 nt, Human
uccaggccccucccucu

SEQ ID NO: 3230564 - RNA, 12 nt, Human
uccagccccugg

SEQ ID NO: 3230565 - RNA, 15 nt, Human
uccagagaguggcuc

SEQ ID NO: 3230566 - RNA, 17 nt, Human
uccagagaguggcuccu

SEQ ID NO: 3230567 - RNA, 16 nt, Human
uccagagaguggcucc

SEQ ID NO: 3230568 - RNA, 13 nt, Human
uccagccccugga

SEQ ID NO: 3230569 - RNA, 21 nt, Human
uccaggcuguaucccaugagc

SEQ ID NO: 3230570 - RNA, 20 nt, Human
acgagcaggcuacugucagc

SEQ ID NO: 3230571 - RNA, 19 nt, Human
acgagcaggcuacugucag

SEQ ID NO: 3230572 - RNA, 19 nt, Human
acgccagauucuuuccuga

SEQ ID NO: 3230573 - RNA, 17 nt, Human
acgccagauucuuuccu

SEQ ID NO: 3230574 - RNA, 16 nt, Human
acgagcaggcuucuuc

SEQ ID NO: 3230575 - RNA, 13 nt, Human
acgagccuuuuca

SEQ ID NO: 3230576 - RNA, 23 nt, Human
uccaacccucaucaccaacgucu

SEQ ID NO: 3230577 - RNA, 16 nt, Human
uccaacccucaucacc

SEQ ID NO: 3230578 - RNA, 17 nt, Human
uccaacccucaucacca

SEQ ID NO: 3230579 - RNA, 14 nt, Human
uccaacccucauca

SEQ ID NO: 3230580 - RNA, 19 nt, Human
uccaaccccucgcccaguc

SEQ ID NO: 3230581 - RNA, 18 nt, Human
uccaaccccucgcccagu

SEQ ID NO: 3230582 - RNA, 14 nt, Human
uccaaccccucgcc

SEQ ID NO: 3230583 - RNA, 13 nt, Human
uccaaccccucgc

SEQ ID NO: 3230584 - RNA, 12 nt, Human
accugccaggaa

SEQ ID NO: 3230585 - RNA, 14 nt, Human
accugccaggaagc

SEQ ID NO: 3230586 - RNA, 17 nt, Human
uccaaccauuuucauua

SEQ ID NO: 3230587 - RNA, 24 nt, Human
uccaaccccucgcccagucccagc

SEQ ID NO: 3230588 - RNA, 21 nt, Human
uccaacuccaacauccacucu

SEQ ID NO: 3230589 - RNA, 19 nt, Human
uccaacuccaacauccacu

SEQ ID NO: 3230590 - RNA, 23 nt, Human
uccaacugagaaguaccuuauca

SEQ ID NO: 3230591 - RNA, 20 nt, Human
uccaagcuggucccacucag

SEQ ID NO: 3230592 - RNA, 16 nt, Human
uccaagcuggucccac

SEQ ID NO: 3230593 - RNA, 18 nt, Human
uccaaggguacuaaggaa

SEQ ID NO: 3230594 - RNA, 21 nt, Human
uccaagcuggucccacucagu

SEQ ID NO: 3230595 - RNA, 16 nt, Human
uccaaggugauguugu

SEQ ID NO: 3230596 - RNA, 20 nt, Human
uccaaguggccuccgucacu

SEQ ID NO: 3230597 - RNA, 14 nt, Human
uccaagucacugca

SEQ ID NO: 3230598 - RNA, 19 nt, Human
uccaagucuuugcuauugu

SEQ ID NO: 3230599 - RNA, 21 nt, Human
uccaagucuuugcuauuguga

SEQ ID NO: 3230600 - RNA, 23 nt, Human
uccaagucacugcaaaaccaggu

SEQ ID NO: 3230601 - RNA, 18 nt, Human
uccaaucccaccaacccu

SEQ ID NO: 3230602 - RNA, 16 nt, Human
accuggccucugcacu

SEQ ID NO: 3230603 - RNA, 17 nt, Human
accuggccucugcacuc

SEQ ID NO: 3230604 - RNA, 14 nt, Human
accuggccucugca

SEQ ID NO: 3230605 - RNA, 15 nt, Human
uccacccaggagccc

SEQ ID NO: 3230606 - RNA, 14 nt, Human
uccacccaggagcc

SEQ ID NO: 3230607 - RNA, 12 nt, Human
uccacccaggag

SEQ ID NO: 3230608 - RNA, 19 nt, Human
uccacccaccucagccucc

SEQ ID NO: 3230609 - RNA, 18 nt, Human
uccacccaccucagccuc

SEQ ID NO: 3230610 - RNA, 17 nt, Human
uccacccaccucagccu

SEQ ID NO: 3230611 - RNA, 19 nt, Human
accuuagacagucccugcc

SEQ ID NO: 3230612 - RNA, 20 nt, Human
accuuagacagucccugcca

SEQ ID NO: 3230613 - RNA, 18 nt, Human
accuuagacagucccugc

SEQ ID NO: 3230614 - RNA, 21 nt, Human
accuuaaaauuugaaacauug

SEQ ID NO: 3230615 - RNA, 20 nt, Human
accuuaaaauuugaaacauu

SEQ ID NO: 3230616 - RNA, 17 nt, Human
accuuaaaauuugaaac

SEQ ID NO: 3230617 - RNA, 19 nt, Human
accuguuucugcagccacu

SEQ ID NO: 3230618 - RNA, 21 nt, Human
accuggucacaggacucugcc

SEQ ID NO: 3230619 - RNA, 23 nt, Human
accuguuuaaauugcucacaguu

SEQ ID NO: 3230620 - RNA, 16 nt, Human
accuguuuaaauugcu

SEQ ID NO: 3230621 - RNA, 15 nt, Human
accuguuuaaauugc

SEQ ID NO: 3230622 - RNA, 13 nt, Human
accuguuuaaauu

SEQ ID NO: 3230623 - RNA, 12 nt, Human
accuuaaaacua

SEQ ID NO: 3230624 - RNA, 15 nt, Human
accuuaaaauuugaa

SEQ ID NO: 3230625 - RNA, 14 nt, Human
accuuaaaauuuga

SEQ ID NO: 3230626 - RNA, 13 nt, Human
accuuaaaauuug

SEQ ID NO: 3230627 - RNA, 12 nt, Human
accuuaaaauuu

SEQ ID NO: 3230628 - RNA, 23 nt, Human
accuggccucugcacuccccugc

SEQ ID NO: 3230629 - RNA, 15 nt, Human
accuggccugucugu

SEQ ID NO: 3230630 - RNA, 18 nt, Human
accuggccucugcacucc

SEQ ID NO: 3230631 - RNA, 20 nt, Human
accuggccucugcacucccc

SEQ ID NO: 3230632 - RNA, 21 nt, Human
accuggguaacuagggaagau

SEQ ID NO: 3230633 - RNA, 23 nt, Human
accuggguccccagcccuuccuc

SEQ ID NO: 3230634 - RNA, 18 nt, Human
accuaguuaaagaaagga

SEQ ID NO: 3230635 - RNA, 22 nt, Human
accuaguuaaagaaaggaaaag

SEQ ID NO: 3230636 - RNA, 15 nt, Human
accuaccacuacauu

SEQ ID NO: 3230637 - RNA, 20 nt, Human
accuaccccugacuucuguu

SEQ ID NO: 3230638 - RNA, 20 nt, Human
accuaccaccacgcccggcu

SEQ ID NO: 3230639 - RNA, 16 nt, Human
accuaccaccacgccc

SEQ ID NO: 3230640 - RNA, 15 nt, Human
accuaauuaauuuca

SEQ ID NO: 3230641 - RNA, 23 nt, Human
accuaauugcacaacagagacug

SEQ ID NO: 3230642 - RNA, 15 nt, Human
accuaauugcacaac

SEQ ID NO: 3230643 - RNA, 15 nt, Human
accuaauuaauauau

SEQ ID NO: 3230644 - RNA, 14 nt, Human
accuaauuaauuuc

SEQ ID NO: 3230645 - RNA, 23 nt, Human
ucaggaaaucaaauaugcaaagc

SEQ ID NO: 3230646 - RNA, 22 nt, Human
ucaggaaaucaaauaugcaaag

SEQ ID NO: 3230647 - RNA, 12 nt, Human
ucaggaagcuca

SEQ ID NO: 3230648 - RNA, 13 nt, Human
ucaggaagcucag

SEQ ID NO: 3230649 - RNA, 14 nt, Human
ucaggaagcucagg

SEQ ID NO: 3230650 - RNA, 15 nt, Human
ucaggaagcucaggg

SEQ ID NO: 3230651 - RNA, 13 nt, Human
accuaaaugaaua

SEQ ID NO: 3230652 - RNA, 14 nt, Human
accuaaccagggcc

SEQ ID NO: 3230653 - RNA, 16 nt, Human
accuaacccagaaaau

SEQ ID NO: 3230654 - RNA, 13 nt, Human
accuaacccagaa

SEQ ID NO: 3230655 - RNA, 20 nt, Human
accuaacaacauuguagccu

SEQ ID NO: 3230656 - RNA, 18 nt, Human
ucauccuucccacucugu

SEQ ID NO: 3230657 - RNA, 13 nt, Human
ucauccuucccac

SEQ ID NO: 3230658 - RNA, 22 nt, Human
ucauccuuucacuucuuucccu

SEQ ID NO: 3230659 - RNA, 20 nt, Human
ucauccuuucacuucuuucc

SEQ ID NO: 3230660 - RNA, 22 nt, Human
ucauccuucuggaauaaggaga

SEQ ID NO: 3230661 - RNA, 13 nt, Human
ucaugaaugcuuu

SEQ ID NO: 3230662 - RNA, 15 nt, Human
ucaugaaugcuuuua

SEQ ID NO: 3230663 - RNA, 21 nt, Human
ucaugaaugcuuuuagugugu

SEQ ID NO: 3230664 - RNA, 21 nt, Human
ucaugaauaacugauuaguaa

SEQ ID NO: 3230665 - RNA, 14 nt, Human
ucaugaauaugaug

SEQ ID NO: 3230666 - RNA, 14 nt, Human
ucauccuucuggaa

SEQ ID NO: 3230667 - RNA, 18 nt, Human
ucauccucauacccaccc

SEQ ID NO: 3230668 - RNA, 13 nt, Human
ucauccuccucag

SEQ ID NO: 3230669 - RNA, 19 nt, Human
ucauccuccucagaucuuc

SEQ ID NO: 3230670 - RNA, 23 nt, Human
ucaucccuucucuuccaggcagc

SEQ ID NO: 3230671 - RNA, 21 nt, Human
ucaucccuucucuuccaggca

SEQ ID NO: 3230672 - RNA, 16 nt, Human
ucaucccuucucuucc

SEQ ID NO: 3230673 - RNA, 14 nt, Human
ucaucccuucucuu

SEQ ID NO: 3230674 - RNA, 15 nt, Human
ucauccuaagcuauu

SEQ ID NO: 3230675 - RNA, 23 nt, Human
accuccugccucgaacuggcugc

SEQ ID NO: 3230676 - RNA, 20 nt, Human
ucauccccucagaaggucug

SEQ ID NO: 3230677 - RNA, 14 nt, Human
ucauccccucagaa

SEQ ID NO: 3230678 - RNA, 12 nt, Human
accuccugccuc

SEQ ID NO: 3230679 - RNA, 13 nt, Human
accuccugccucg

SEQ ID NO: 3230680 - RNA, 16 nt, Human
accucaacaagaagaa

SEQ ID NO: 3230681 - RNA, 17 nt, Human
accucaacaagaagaau

SEQ ID NO: 3230682 - RNA, 22 nt, Human
accucaaaugaugugccugcuu

SEQ ID NO: 3230683 - RNA, 20 nt, Human
accucaaaugaugugccugc

SEQ ID NO: 3230684 - RNA, 14 nt, Human
accugaggcccuuc

SEQ ID NO: 3230685 - RNA, 21 nt, Human
accugaggacauggcuucuga

SEQ ID NO: 3230686 - RNA, 20 nt, Human
accugaggacauggcuucug

SEQ ID NO: 3230687 - RNA, 12 nt, Human
accucuuguuuu

SEQ ID NO: 3230688 - RNA, 13 nt, Human
accucuuuggaaa

SEQ ID NO: 3230689 - RNA, 12 nt, Human
accuccuggggc

SEQ ID NO: 3230690 - RNA, 22 nt, Human
accucuuuugcuugccaaagua

SEQ ID NO: 3230691 - RNA, 15 nt, Human
accugaggcccuucu

SEQ ID NO: 3230692 - RNA, 16 nt, Human
accugaggcccuucuc

SEQ ID NO: 3230693 - RNA, 20 nt, Human
accugaggcccuucucucca

SEQ ID NO: 3230694 - RNA, 21 nt, Human
accugaggcccuucucuccag

SEQ ID NO: 3230695 - RNA, 22 nt, Human
accugaggcccuucucuccagc

SEQ ID NO: 3230696 - RNA, 16 nt, Human
accugaggggccucuu

SEQ ID NO: 3230697 - RNA, 15 nt, Human
accugauugugucuc

SEQ ID NO: 3230698 - RNA, 14 nt, Human
accugaguuccuga

SEQ ID NO: 3230699 - RNA, 16 nt, Human
accugaguugaagagg

SEQ ID NO: 3230700 - RNA, 14 nt, Human
accugaguugaaga

SEQ ID NO: 3230701 - RNA, 17 nt, Human
accugaguugaagaggg

SEQ ID NO: 3230702 - RNA, 17 nt, Human
accugauugugucucuu

SEQ ID NO: 3230703 - RNA, 18 nt, Human
accugauugugucucuug

SEQ ID NO: 3230704 - RNA, 14 nt, Human
accugauugugucu

SEQ ID NO: 3230705 - RNA, 15 nt, Human
accugauuucuccug

SEQ ID NO: 3230706 - RNA, 15 nt, Human
accugcagcucccuc

SEQ ID NO: 3230707 - RNA, 13 nt, Human
accugcagcuccc

SEQ ID NO: 3230708 - RNA, 17 nt, Human
accugcagauucuagga

SEQ ID NO: 3230709 - RNA, 14 nt, Human
accugcagccuccc

SEQ ID NO: 3230710 - RNA, 17 nt, Human
accugcagccucccucc

SEQ ID NO: 3230711 - RNA, 19 nt, Human
accucggugccuuccucuu

SEQ ID NO: 3230712 - RNA, 13 nt, Human
accuccugggcua

SEQ ID NO: 3230713 - RNA, 22 nt, Human
ucauugaaaucuuuuugcuuug

SEQ ID NO: 3230714 - RNA, 12 nt, Human
ucauugaccuga

SEQ ID NO: 3230715 - RNA, 14 nt, Human
ucauugaccugagg

SEQ ID NO: 3230716 - RNA, 15 nt, Human
ucauugaccugaggc

SEQ ID NO: 3230717 - RNA, 14 nt, Human
ucauugcaucauuu

SEQ ID NO: 3230718 - RNA, 12 nt, Human
ucauugaaaucu

SEQ ID NO: 3230719 - RNA, 13 nt, Human
ucauugaaaucuu

SEQ ID NO: 3230720 - RNA, 12 nt, Human
ucauucuucugu

SEQ ID NO: 3230721 - RNA, 12 nt, Human
ucauuacuuguu

SEQ ID NO: 3230722 - RNA, 17 nt, Human
ucauuacuuguugccua

SEQ ID NO: 3230723 - RNA, 14 nt, Human
ucauucugaauuaa

SEQ ID NO: 3230724 - RNA, 15 nt, Human
ucauuaauuaacccc

SEQ ID NO: 3230725 - RNA, 21 nt, Human
ucaugauguuuuuaaaaucuu

SEQ ID NO: 3230726 - RNA, 20 nt, Human
ucaugauguuuuuaaaaucu

SEQ ID NO: 3230727 - RNA, 19 nt, Human
ucaugauguuuuuaaaauc

SEQ ID NO: 3230728 - RNA, 13 nt, Human
ucaugauguuuuu

SEQ ID NO: 3230729 - RNA, 23 nt, Human
ucaugaugcucuuucccacccag

SEQ ID NO: 3230730 - RNA, 18 nt, Human
ucaugaugcucuuuccca

SEQ ID NO: 3230731 - RNA, 17 nt, Human
ucaugaugcucuuuccc

SEQ ID NO: 3230732 - RNA, 16 nt, Human
ucaugaugcucuuucc

SEQ ID NO: 3230733 - RNA, 12 nt, Human
acuccagccugg

SEQ ID NO: 3230734 - RNA, 23 nt, Human
acuccagaauuucccaaagcagu

SEQ ID NO: 3230735 - RNA, 18 nt, Human
acuccuccuagccaccca

SEQ ID NO: 3230736 - RNA, 16 nt, Human
acuccuccuagccacc

SEQ ID NO: 3230737 - RNA, 15 nt, Human
acuccuccuagccac

SEQ ID NO: 3230738 - RNA, 13 nt, Human
acuccuccuagcc

SEQ ID NO: 3230739 - RNA, 14 nt, Human
acuccuccuagcca

SEQ ID NO: 3230740 - RNA, 13 nt, Human
acuccagccuggg

SEQ ID NO: 3230741 - RNA, 18 nt, Human
acuccugcaggcagccag

SEQ ID NO: 3230742 - RNA, 19 nt, Human
acuccugcaggcagccagg

SEQ ID NO: 3230743 - RNA, 17 nt, Human
acuccugcaggcagcca

SEQ ID NO: 3230744 - RNA, 14 nt, Human
acuccucuguccag

SEQ ID NO: 3230745 - RNA, 13 nt, Human
acuccucugucca

SEQ ID NO: 3230746 - RNA, 13 nt, Human
acucaugugauuu

SEQ ID NO: 3230747 - RNA, 12 nt, Human
acucauuaauua

SEQ ID NO: 3230748 - RNA, 17 nt, Human
acucauuagaauuacca

SEQ ID NO: 3230749 - RNA, 23 nt, Human
acucauuagaauuaccauuuguu

SEQ ID NO: 3230750 - RNA, 18 nt, Human
acucagaaacuccaugau

SEQ ID NO: 3230751 - RNA, 19 nt, Human
acucacuggugguuuuccg

SEQ ID NO: 3230752 - RNA, 23 nt, Human
acucacuggggaacguucucuuu

SEQ ID NO: 3230753 - RNA, 14 nt, Human
acucauugaccuga

SEQ ID NO: 3230754 - RNA, 15 nt, Human
acucauucuucugua

SEQ ID NO: 3230755 - RNA, 14 nt, Human
acucauguuaauug

SEQ ID NO: 3230756 - RNA, 15 nt, Human
acucauucugaauua

SEQ ID NO: 3230757 - RNA, 19 nt, Human
acucauucugaauuaauua

SEQ ID NO: 3230758 - RNA, 23 nt, Human
acuccagaaaugucccuuucuuc

SEQ ID NO: 3230759 - RNA, 20 nt, Human
acuccagaaaugucccuuuc

SEQ ID NO: 3230760 - RNA, 15 nt, Human
acuccagaauuuccc

SEQ ID NO: 3230761 - RNA, 17 nt, Human
acuccagaauuucccaa

SEQ ID NO: 3230762 - RNA, 18 nt, Human
acuccaaagaaauguaag

SEQ ID NO: 3230763 - RNA, 15 nt, Human
acuccaaagaaaugu

SEQ ID NO: 3230764 - RNA, 14 nt, Human
acuccaaagaaaug

SEQ ID NO: 3230765 - RNA, 15 nt, Human
acucauugaccugag

SEQ ID NO: 3230766 - RNA, 17 nt, Human
uccggucccugucccag

SEQ ID NO: 3230767 - RNA, 14 nt, Human
uccgggucuuccua

SEQ ID NO: 3230768 - RNA, 16 nt, Human
uccuagaaauucccca

SEQ ID NO: 3230769 - RNA, 14 nt, Human
uccuacuuccccuu

SEQ ID NO: 3230770 - RNA, 23 nt, Human
uccuacucuucucucugcucuga

SEQ ID NO: 3230771 - RNA, 20 nt, Human
uccuacucuucucucugcuc

SEQ ID NO: 3230772 - RNA, 18 nt, Human
uccuacucuucucucugc

SEQ ID NO: 3230773 - RNA, 17 nt, Human
uccuacucuucucucug

SEQ ID NO: 3230774 - RNA, 13 nt, Human
uccuaacccuggc

SEQ ID NO: 3230775 - RNA, 16 nt, Human
uccuacucuucucucu

SEQ ID NO: 3230776 - RNA, 16 nt, Human
ucccuuucuucucccc

SEQ ID NO: 3230777 - RNA, 12 nt, Human
ucccuuuuccuu

SEQ ID NO: 3230778 - RNA, 20 nt, Human
ucccuuuucaccuuuucagg

SEQ ID NO: 3230779 - RNA, 14 nt, Human
ucccuuuuccauga

SEQ ID NO: 3230780 - RNA, 21 nt, Human
uccgggacguggcaccuccuc

SEQ ID NO: 3230781 - RNA, 16 nt, Human
uccggggccagcuccg

SEQ ID NO: 3230782 - RNA, 15 nt, Human
uccggggccagcucc

SEQ ID NO: 3230783 - RNA, 21 nt, Human
ucccuggguuagacugccagc

SEQ ID NO: 3230784 - RNA, 23 nt, Human
ucccuggguuagacugccagcuc

SEQ ID NO: 3230785 - RNA, 22 nt, Human
ucccuggguuagacugccagcu

SEQ ID NO: 3230786 - RNA, 17 nt, Human
ucccugguaagaaaaag

SEQ ID NO: 3230787 - RNA, 21 nt, Human
acuccugcaggcagccaggcc

SEQ ID NO: 3230788 - RNA, 20 nt, Human
ucccuggguuagacugccag

SEQ ID NO: 3230789 - RNA, 12 nt, Human
ucccugucccag

SEQ ID NO: 3230790 - RNA, 15 nt, Human
ucccugguggcagcu

SEQ ID NO: 3230791 - RNA, 18 nt, Human
ucccuuaagaaugaguuu

SEQ ID NO: 3230792 - RNA, 22 nt, Human
ucccuuaagaaugaguuucuua

SEQ ID NO: 3230793 - RNA, 19 nt, Human
ucccuuaagaaugaguuuc

SEQ ID NO: 3230794 - RNA, 20 nt, Human
ucccugaaggaaccaaagcg

SEQ ID NO: 3230795 - RNA, 11 nt, Human
ucccugaaggc

SEQ ID NO: 3230796 - RNA, 15 nt, Human
ucccugaaggccccg

SEQ ID NO: 3230797 - RNA, 14 nt, Human
ucccucuuucccuc

SEQ ID NO: 3230798 - RNA, 20 nt, Human
ucccucuuucccucccuucc

SEQ ID NO: 3230799 - RNA, 18 nt, Human
ucccucuuucccucccuu

SEQ ID NO: 3230800 - RNA, 15 nt, Human
ucccggcccugccug

SEQ ID NO: 3230801 - RNA, 14 nt, Human
ucccggcccugccu

SEQ ID NO: 3230802 - RNA, 22 nt, Human
ucccggcugcccuuucugggca

SEQ ID NO: 3230803 - RNA, 13 nt, Human
ucccggcugcccu

SEQ ID NO: 3230804 - RNA, 14 nt, Human
ucccggcugcccuu

SEQ ID NO: 3230805 - RNA, 15 nt, Human
ucccggcugcccuuu

SEQ ID NO: 3230806 - RNA, 18 nt, Human
ucccggcugcccuuucug

SEQ ID NO: 3230807 - RNA, 11 nt, Human
ucccugaggca

SEQ ID NO: 3230808 - RNA, 23 nt, Human
ucccugacugggggcagacaugg

SEQ ID NO: 3230809 - RNA, 12 nt, Human
ucccugacuggg

SEQ ID NO: 3230810 - RNA, 22 nt, Human
ucccugaggcagguccccagac

SEQ ID NO: 3230811 - RNA, 21 nt, Human
ucccugaggcagguccccaga

SEQ ID NO: 3230812 - RNA, 20 nt, Human
ucccugaggcagguccccag

SEQ ID NO: 3230813 - RNA, 11 nt, Human
ucccugagcag

SEQ ID NO: 3230814 - RNA, 16 nt, Human
ucccugaaggccccgc

SEQ ID NO: 3230815 - RNA, 17 nt, Human
ucccugaucccuuccac

SEQ ID NO: 3230816 - RNA, 15 nt, Human
ucccugaucccuucc

SEQ ID NO: 3230817 - RNA, 15 nt, Human
ucccugauaaauauu

SEQ ID NO: 3230818 - RNA, 14 nt, Human
ucccugauaaauau

SEQ ID NO: 3230819 - RNA, 14 nt, Human
ucccugaucccuuc

SEQ ID NO: 3230820 - RNA, 15 nt, Human
ucccugaucccugau

SEQ ID NO: 3230821 - RNA, 16 nt, Human
acuaccuccucuccug

SEQ ID NO: 3230822 - RNA, 14 nt, Human
acuaccuccucucc

SEQ ID NO: 3230823 - RNA, 17 nt, Human
acuacucccccaggugg

SEQ ID NO: 3230824 - RNA, 14 nt, Human
acuaccuggcugcg

SEQ ID NO: 3230825 - RNA, 12 nt, Human
acuaccuggcug

SEQ ID NO: 3230826 - RNA, 17 nt, Human
acuaccuccucuccuga

SEQ ID NO: 3230827 - RNA, 18 nt, Human
acuacucaaagcaaaagu

SEQ ID NO: 3230828 - RNA, 16 nt, Human
acuacucaaagcaaaa

SEQ ID NO: 3230829 - RNA, 21 nt, Human
acucacauuuauucugcucac

SEQ ID NO: 3230830 - RNA, 12 nt, Human
acucaccccagc

SEQ ID NO: 3230831 - RNA, 16 nt, Human
uccccuaaucuuuucu

SEQ ID NO: 3230832 - RNA, 17 nt, Human
uccccucccagggagca

SEQ ID NO: 3230833 - RNA, 14 nt, Human
uccccucccaggga

SEQ ID NO: 3230834 - RNA, 14 nt, Human
uccccuccaggagu

SEQ ID NO: 3230835 - RNA, 16 nt, Human
uccccucggagaagag

SEQ ID NO: 3230836 - RNA, 17 nt, Human
uccccucggagaagagc

SEQ ID NO: 3230837 - RNA, 17 nt, Human
ucccgaguagcugggac

SEQ ID NO: 3230838 - RNA, 16 nt, Human
ucccgaguagcuggga

SEQ ID NO: 3230839 - RNA, 18 nt, Human
ucccgaguagcugggacu

SEQ ID NO: 3230840 - RNA, 20 nt, Human
ucccgaguagcugagauuau

SEQ ID NO: 3230841 - RNA, 15 nt, Human
ucccgaguagcuggg

SEQ ID NO: 3230842 - RNA, 19 nt, Human
ucccgagacggcacugaga

SEQ ID NO: 3230843 - RNA, 18 nt, Human
ucccgaauagcugggacu

SEQ ID NO: 3230844 - RNA, 20 nt, Human
ucccgaauagcugggacuac

SEQ ID NO: 3230845 - RNA, 15 nt, Human
acgguuuuacugcag

SEQ ID NO: 3230846 - RNA, 23 nt, Human
acguggcugcuucaaggauccug

SEQ ID NO: 3230847 - RNA, 20 nt, Human
acguagucggcacagccugg

SEQ ID NO: 3230848 - RNA, 13 nt, Human
acguauuauuguc

SEQ ID NO: 3230849 - RNA, 19 nt, Human
acguuccucuccaccugca

SEQ ID NO: 3230850 - RNA, 16 nt, Human
acgugugcaugugucu

SEQ ID NO: 3230851 - RNA, 15 nt, Human
acgugugcauguguc

SEQ ID NO: 3230852 - RNA, 23 nt, Human
acguguauguuuuucaguucaaa

SEQ ID NO: 3230853 - RNA, 19 nt, Human
acguguauguuuuucaguu

SEQ ID NO: 3230854 - RNA, 16 nt, Human
acguguauguuuuuca

SEQ ID NO: 3230855 - RNA, 13 nt, Human
acguguauguuuu

SEQ ID NO: 3230856 - RNA, 11 nt, Human
acguguauguu

SEQ ID NO: 3230857 - RNA, 15 nt, Human
ucccaccccacacac

SEQ ID NO: 3230858 - RNA, 20 nt, Human
ucccaccccacacacgccag

SEQ ID NO: 3230859 - RNA, 16 nt, Human
ucccacaaaggagagc

SEQ ID NO: 3230860 - RNA, 20 nt, Human
acgggaggguaaggcugugg

SEQ ID NO: 3230861 - RNA, 19 nt, Human
ucccaccccauccuccagg

SEQ ID NO: 3230862 - RNA, 18 nt, Human
ucccaccccauccuccag

SEQ ID NO: 3230863 - RNA, 10 nt, Human
acgguuccua

SEQ ID NO: 3230864 - RNA, 20 nt, Human
acgguuccuacacaggacag

SEQ ID NO: 3230865 - RNA, 18 nt, Human
acgguuccuacacaggac

SEQ ID NO: 3230866 - RNA, 17 nt, Human
acgguuccuacacagga

SEQ ID NO: 3230867 - RNA, 19 nt, Human
acgguucaaaccugugaag

SEQ ID NO: 3230868 - RNA, 19 nt, Human
uccauccugaggcuccacu

SEQ ID NO: 3230869 - RNA, 15 nt, Human
uccauccuuucuccu

SEQ ID NO: 3230870 - RNA, 16 nt, Human
uccaucuaaacugccc

SEQ ID NO: 3230871 - RNA, 21 nt, Human
uccaucuaaaaauauacaugu

SEQ ID NO: 3230872 - RNA, 16 nt, Human
uccaucuaaaaauaua

SEQ ID NO: 3230873 - RNA, 15 nt, Human
uccaucuaaaaauau

SEQ ID NO: 3230874 - RNA, 14 nt, Human
uccaucuaaaaaua

SEQ ID NO: 3230875 - RNA, 18 nt, Human
uccaucuaaacugccccc

SEQ ID NO: 3230876 - RNA, 20 nt, Human
uccauccugaggcuccacuu

SEQ ID NO: 3230877 - RNA, 21 nt, Human
uccauccugaggcuccacuug

SEQ ID NO: 3230878 - RNA, 22 nt, Human
acgccagauucuuuccugaggc

SEQ ID NO: 3230879 - RNA, 23 nt, Human
acgccagauucuuuccugaggcu

SEQ ID NO: 3230880 - RNA, 13 nt, Human
uccaugaagaugu

SEQ ID NO: 3230881 - RNA, 20 nt, Human
uccaucucuugcuuguuccu

SEQ ID NO: 3230882 - RNA, 21 nt, Human
uccaugaagauguagaggaga

SEQ ID NO: 3230883 - RNA, 23 nt, Human
uccauucuccagggguuuacagu

SEQ ID NO: 3230884 - RNA, 21 nt, Human
ucccaaagcagugcaugcugu

SEQ ID NO: 3230885 - RNA, 17 nt, Human
ucccaaagcagugcaug

SEQ ID NO: 3230886 - RNA, 18 nt, Human
ucccaaagcagugcaugc

SEQ ID NO: 3230887 - RNA, 13 nt, Human
ucccaaagugcug

SEQ ID NO: 3230888 - RNA, 12 nt, Human
ucccaaaggcau

SEQ ID NO: 3230889 - RNA, 18 nt, Human
ucccaaacccuucagugc

SEQ ID NO: 3230890 - RNA, 17 nt, Human
ucccaaaaucaccguac

SEQ ID NO: 3230891 - RNA, 16 nt, Human
ucccaaagcagugcau

SEQ ID NO: 3230892 - RNA, 15 nt, Human
uccauuucacuggcu

SEQ ID NO: 3230893 - RNA, 14 nt, Human
uccauuucacuggc

SEQ ID NO: 3230894 - RNA, 17 nt, Human
uccauuuccuuaugcug

SEQ ID NO: 3230895 - RNA, 15 nt, Human
uccauuuuuuauauu

SEQ ID NO: 3230896 - RNA, 12 nt, Human
ucccaaaagcua

SEQ ID NO: 3230897 - RNA, 17 nt, Human
acuacaguccucccauc

SEQ ID NO: 3230898 - RNA, 18 nt, Human
acuacagggccgccggca

SEQ ID NO: 3230899 - RNA, 15 nt, Human
acuacaggcacccac

SEQ ID NO: 3230900 - RNA, 11 nt, Human
acuacaggcac

SEQ ID NO: 3230901 - RNA, 20 nt, Human
acuacaauauguacauuucu

SEQ ID NO: 3230902 - RNA, 13 nt, Human
acuacaauaugua

SEQ ID NO: 3230903 - RNA, 18 nt, Human
acuacaauauguacauuu

SEQ ID NO: 3230904 - RNA, 16 nt, Human
acuacaauauguacau

SEQ ID NO: 3230905 - RNA, 13 nt, Human
ucccagcagccag

SEQ ID NO: 3230906 - RNA, 15 nt, Human
ucccagcagccagcc

SEQ ID NO: 3230907 - RNA, 14 nt, Human
ucccagcagccagc

SEQ ID NO: 3230908 - RNA, 16 nt, Human
ucccagcagccagcca

SEQ ID NO: 3230909 - RNA, 17 nt, Human
ucccagcaucgcacucu

SEQ ID NO: 3230910 - RNA, 17 nt, Human
ucccagcugugcucugg

SEQ ID NO: 3230911 - RNA, 22 nt, Human
ucccagucauuuaauaaaugug

SEQ ID NO: 3230912 - RNA, 14 nt, Human
ucccagucauuuaa

SEQ ID NO: 3230913 - RNA, 15 nt, Human
ucccaguagaaaaua

SEQ ID NO: 3230914 - RNA, 15 nt, Human
ucccaucacccgcua

SEQ ID NO: 3230915 - RNA, 16 nt, Human
ucccauaugccugggc

SEQ ID NO: 3230916 - RNA, 22 nt, Human
ucccauaugccugggcagaagg

SEQ ID NO: 3230917 - RNA, 16 nt, Human
ucccaguagaaaauau

SEQ ID NO: 3230918 - RNA, 23 nt, Human
uccccaccaucugcugucuuuuc

SEQ ID NO: 3230919 - RNA, 19 nt, Human
uccccaccaucugcugucu

SEQ ID NO: 3230920 - RNA, 18 nt, Human
uccccaccaucugcuguc

SEQ ID NO: 3230921 - RNA, 15 nt, Human
uccccaccaucugcu

SEQ ID NO: 3230922 - RNA, 14 nt, Human
uccccaccaucugc

SEQ ID NO: 3230923 - RNA, 17 nt, Human
uccccaugucucgacuc

SEQ ID NO: 3230924 - RNA, 18 nt, Human
uccccaccgcagacagga

SEQ ID NO: 3230925 - RNA, 21 nt, Human
uccccaccgcagacaggacca

SEQ ID NO: 3230926 - RNA, 17 nt, Human
uccccaccgcagacagg

SEQ ID NO: 3230927 - RNA, 17 nt, Human
uccccacccuccccuuc

SEQ ID NO: 3230928 - RNA, 15 nt, Human
acuaccaaaggacac

SEQ ID NO: 3230929 - RNA, 14 nt, Human
acuaccccuugauu

SEQ ID NO: 3230930 - RNA, 21 nt, Human
acuaccccuugauuuuccauc

SEQ ID NO: 3230931 - RNA, 19 nt, Human
ucugcaggaaauaggccca

SEQ ID NO: 3230932 - RNA, 20 nt, Human
ucugcacuccccugcugggu

SEQ ID NO: 3230933 - RNA, 14 nt, Human
ucugauuccagcac

SEQ ID NO: 3230934 - RNA, 22 nt, Human
ucugagacucgcgacaaugcaa

SEQ ID NO: 3230935 - RNA, 23 nt, Human
ucugagacucgcgacaaugcaaa

SEQ ID NO: 3230936 - RNA, 15 nt, Human
ucugacgggauuugu

SEQ ID NO: 3230937 - RNA, 14 nt, Human
ucugaccuuaaaug

SEQ ID NO: 3230938 - RNA, 20 nt, Human
ucugagagaggcuaaaaugu

SEQ ID NO: 3230939 - RNA, 22 nt, Human
ucugagagaggcuaaaauguuu

SEQ ID NO: 3230940 - RNA, 21 nt, Human
ucugagagaggcuaaaauguu

SEQ ID NO: 3230941 - RNA, 16 nt, Human
ucugagagcaaacugg

SEQ ID NO: 3230942 - RNA, 15 nt, Human
ucugagagcaaacug

SEQ ID NO: 3230943 - RNA, 14 nt, Human
ucugagagauuugg

SEQ ID NO: 3230944 - RNA, 23 nt, Human
ucugagagaggcuaaaauguuuu

SEQ ID NO: 3230945 - RNA, 23 nt, Human
ucugaguuguuaccccaagcgcc

SEQ ID NO: 3230946 - RNA, 19 nt, Human
ucugaguuguuaccccaag

SEQ ID NO: 3230947 - RNA, 23 nt, Human
ucugaguuccggcaccaguagca

SEQ ID NO: 3230948 - RNA, 19 nt, Human
ucugaguucuguguauuuu

SEQ ID NO: 3230949 - RNA, 18 nt, Human
ucugcacuccccugcugg

SEQ ID NO: 3230950 - RNA, 19 nt, Human
ucugcacuccccugcuggg

SEQ ID NO: 3230951 - RNA, 17 nt, Human
ucugcacuccccugcug

SEQ ID NO: 3230952 - RNA, 21 nt, Human
ucugauguauuuugugaguuu

SEQ ID NO: 3230953 - RNA, 15 nt, Human
ucugauguauuuugu

SEQ ID NO: 3230954 - RNA, 23 nt, Human
ucugaugcaagcaagaaacacug

SEQ ID NO: 3230955 - RNA, 12 nt, Human
agaaauaucugu

SEQ ID NO: 3230956 - RNA, 23 nt, Human
agaaauauuuuaauuuuuaaaug

SEQ ID NO: 3230957 - RNA, 19 nt, Human
agaaaucaaguaaugaauc

SEQ ID NO: 3230958 - RNA, 15 nt, Human
agaaaucaauaguug

SEQ ID NO: 3230959 - RNA, 19 nt, Human
agaaaucaauaguugaauu

SEQ ID NO: 3230960 - RNA, 20 nt, Human
agaaauaucugaaaauguau

SEQ ID NO: 3230961 - RNA, 19 nt, Human
agaaauaucugaaaaugua

SEQ ID NO: 3230962 - RNA, 14 nt, Human
agaaauauaauuga

SEQ ID NO: 3230963 - RNA, 23 nt, Human
agaaacuuguucuuccaaagcag

SEQ ID NO: 3230964 - RNA, 13 nt, Human
agaaacuuguucu

SEQ ID NO: 3230965 - RNA, 22 nt, Human
agaaagccuuucauuuugcuuu

SEQ ID NO: 3230966 - RNA, 20 nt, Human
agaaagccuuucauuuugcu

SEQ ID NO: 3230967 - RNA, 18 nt, Human
agaaagccuguuguuuaa

SEQ ID NO: 3230968 - RNA, 14 nt, Human
agaaaggaaaagaa

SEQ ID NO: 3230969 - RNA, 14 nt, Human
agaaaggaaaccuu

SEQ ID NO: 3230970 - RNA, 15 nt, Human
agaaaggaaaccuuu

SEQ ID NO: 3230971 - RNA, 21 nt, Human
agaaaggaaaccuuuucuugu

SEQ ID NO: 3230972 - RNA, 21 nt, Human
ucugaacuuggcgcugccccu

SEQ ID NO: 3230973 - RNA, 14 nt, Human
ucugaagauuguuu

SEQ ID NO: 3230974 - RNA, 19 nt, Human
ucugaagauuguuuaucua

SEQ ID NO: 3230975 - RNA, 18 nt, Human
ucugaagauuguuuaucu

SEQ ID NO: 3230976 - RNA, 18 nt, Human
ucugaagucacugcacag

SEQ ID NO: 3230977 - RNA, 16 nt, Human
ucugaagucacugcac

SEQ ID NO: 3230978 - RNA, 15 nt, Human
ucugaagucacugca

SEQ ID NO: 3230979 - RNA, 17 nt, Human
ucugaauuuaucuuuga

SEQ ID NO: 3230980 - RNA, 20 nt, Human
ucugaauuggaaugcacuca

SEQ ID NO: 3230981 - RNA, 21 nt, Human
ucugaauuuaucuuugauaac

SEQ ID NO: 3230982 - RNA, 19 nt, Human
ucugaauuuaucuuugaua

SEQ ID NO: 3230983 - RNA, 15 nt, Human
ucugacaacagacuu

SEQ ID NO: 3230984 - RNA, 16 nt, Human
ucugacaacagacuuc

SEQ ID NO: 3230985 - RNA, 17 nt, Human
agaaaaagcaaaaggca

SEQ ID NO: 3230986 - RNA, 16 nt, Human
agaaaaagcaaaaggc

SEQ ID NO: 3230987 - RNA, 12 nt, Human
agaaaaagcaaa

SEQ ID NO: 3230988 - RNA, 19 nt, Human
agaaaagacgcaccagccc

SEQ ID NO: 3230989 - RNA, 17 nt, Human
agaaaacuuuuaugcaa

SEQ ID NO: 3230990 - RNA, 18 nt, Human
agaaaagaaaaaaaaaga

SEQ ID NO: 3230991 - RNA, 17 nt, Human
agaaaagaaaaaaaaag

SEQ ID NO: 3230992 - RNA, 12 nt, Human
agaaaacuuugu

SEQ ID NO: 3230993 - RNA, 9 nt, Human
agaaaagaa

SEQ ID NO: 3230994 - RNA, 20 nt, Human
agaaaacuuuguuaggccaa

SEQ ID NO: 3230995 - RNA, 14 nt, Human
agaaaacuuuguua

SEQ ID NO: 3230996 - RNA, 13 nt, Human
agaaaagaaaaaa

SEQ ID NO: 3230997 - RNA, 12 nt, Human
agaaaagaaaaa

SEQ ID NO: 3230998 - RNA, 11 nt, Human
agaaaagaaaa

SEQ ID NO: 3230999 - RNA, 10 nt, Human
agaaaagaaa

SEQ ID NO: 3231000 - RNA, 16 nt, Human
agaaacagcuaugaga

SEQ ID NO: 3231001 - RNA, 15 nt, Human
agaaacacugaaaag

SEQ ID NO: 3231002 - RNA, 16 nt, Human
agaaacacugaaaaga

SEQ ID NO: 3231003 - RNA, 17 nt, Human
agaaacacugaaaagaa

SEQ ID NO: 3231004 - RNA, 19 nt, Human
agaaacacugaaaagaagg

SEQ ID NO: 3231005 - RNA, 23 nt, Human
agaaacuuaagguuaccuuuguu

SEQ ID NO: 3231006 - RNA, 17 nt, Human
agaaacuaaaacaaaua

SEQ ID NO: 3231007 - RNA, 15 nt, Human
agaaacuccaugaug

SEQ ID NO: 3231008 - RNA, 21 nt, Human
ucucuggccuucggccuccau

SEQ ID NO: 3231009 - RNA, 22 nt, Human
ucucuggccuucggccuccauc

SEQ ID NO: 3231010 - RNA, 17 nt, Human
ucucuugagccugggag

SEQ ID NO: 3231011 - RNA, 14 nt, Human
ucucuugauucaua

SEQ ID NO: 3231012 - RNA, 16 nt, Human
ucucuugauucauaau

SEQ ID NO: 3231013 - RNA, 18 nt, Human
ucucuugagccugggagg

SEQ ID NO: 3231014 - RNA, 20 nt, Human
ucucuuuaaugucacaggca

SEQ ID NO: 3231015 - RNA, 13 nt, Human
agaaaaagaaaaa

SEQ ID NO: 3231016 - RNA, 13 nt, Human
ucucuugccucag

SEQ ID NO: 3231017 - RNA, 16 nt, Human
ucucuugccucagccu

SEQ ID NO: 3231018 - RNA, 22 nt, Human
ucucuugccucagcuuccccag

SEQ ID NO: 3231019 - RNA, 13 nt, Human
ucucugcuggacg

SEQ ID NO: 3231020 - RNA, 15 nt, Human
ucucuggcacuuuga

SEQ ID NO: 3231021 - RNA, 12 nt, Human
ucucuggccuuc

SEQ ID NO: 3231022 - RNA, 11 nt, Human
ucucugcccuc

SEQ ID NO: 3231023 - RNA, 15 nt, Human
ucucugcccuccaag

SEQ ID NO: 3231024 - RNA, 16 nt, Human
ucucugcccuccaaga

SEQ ID NO: 3231025 - RNA, 17 nt, Human
ucucugcccuccaagac

SEQ ID NO: 3231026 - RNA, 13 nt, Human
ucucucacuccuu

SEQ ID NO: 3231027 - RNA, 15 nt, Human
ucucucacuccuuga

SEQ ID NO: 3231028 - RNA, 21 nt, Human
ucucucaggccaaacucaccu

SEQ ID NO: 3231029 - RNA, 17 nt, Human
ucucucacagacaggac

SEQ ID NO: 3231030 - RNA, 15 nt, Human
ucucucacagacagg

SEQ ID NO: 3231031 - RNA, 17 nt, Human
ucucuccagccccugga

SEQ ID NO: 3231032 - RNA, 16 nt, Human
ucucuccagccccugg

SEQ ID NO: 3231033 - RNA, 18 nt, Human
ucucuccagccccuggau

SEQ ID NO: 3231034 - RNA, 19 nt, Human
ucucuccagccccuggaug

SEQ ID NO: 3231035 - RNA, 23 nt, Human
ucucucacagacaggaccccugc

SEQ ID NO: 3231036 - RNA, 19 nt, Human
ucucucacagacaggaccc

SEQ ID NO: 3231037 - RNA, 18 nt, Human
ucucuccaaggugugccc

SEQ ID NO: 3231038 - RNA, 14 nt, Human
ucucucauuugugu

SEQ ID NO: 3231039 - RNA, 16 nt, Human
ucucauuccagaggaa

SEQ ID NO: 3231040 - RNA, 14 nt, Human
ucucauuacuuguu

SEQ ID NO: 3231041 - RNA, 14 nt, Human
ucucagggccuggu

SEQ ID NO: 3231042 - RNA, 15 nt, Human
ucucagggccugguc

SEQ ID NO: 3231043 - RNA, 19 nt, Human
ucucagggccuggucguuu

SEQ ID NO: 3231044 - RNA, 15 nt, Human
acuuguggacacagc

SEQ ID NO: 3231045 - RNA, 12 nt, Human
ucucagggccug

SEQ ID NO: 3231046 - RNA, 13 nt, Human
ucucagggccugg

SEQ ID NO: 3231047 - RNA, 16 nt, Human
ucuccaggcuguaucc

SEQ ID NO: 3231048 - RNA, 16 nt, Human
ucuccagggguuuaca

SEQ ID NO: 3231049 - RNA, 19 nt, Human
ucuccagggguuuacagug

SEQ ID NO: 3231050 - RNA, 11 nt, Human
ucuccaggcug

SEQ ID NO: 3231051 - RNA, 21 nt, Human
ucuccuccuuuucacaguucu

SEQ ID NO: 3231052 - RNA, 16 nt, Human
acuuucuagccagagg

SEQ ID NO: 3231053 - RNA, 17 nt, Human
acuuucuagccagagga

SEQ ID NO: 3231054 - RNA, 22 nt, Human
acuuuaacuuaguuuugcauag

SEQ ID NO: 3231055 - RNA, 21 nt, Human
acuuuaacuuaguuuugcaua

SEQ ID NO: 3231056 - RNA, 20 nt, Human
acuuuaacuuaguuuugcau

SEQ ID NO: 3231057 - RNA, 16 nt, Human
ucuccauguuugaugu

SEQ ID NO: 3231058 - RNA, 14 nt, Human
ucucccacaugcca

SEQ ID NO: 3231059 - RNA, 15 nt, Human
ucuccuacugaggau

SEQ ID NO: 3231060 - RNA, 14 nt, Human
ucuccuacugagga

SEQ ID NO: 3231061 - RNA, 17 nt, Human
ucucaccuugguuccug

SEQ ID NO: 3231062 - RNA, 11 nt, Human
ucucacuccuu

SEQ ID NO: 3231063 - RNA, 18 nt, Human
ucucacacucuaacugua

SEQ ID NO: 3231064 - RNA, 12 nt, Human
ucucacagacag

SEQ ID NO: 3231065 - RNA, 14 nt, Human
ucucacagacagga

SEQ ID NO: 3231066 - RNA, 13 nt, Human
ucucacagacagg

SEQ ID NO: 3231067 - RNA, 22 nt, Human
ucucacagacaggaccccugca

SEQ ID NO: 3231068 - RNA, 21 nt, Human
ucucacagacaggaccccugc

SEQ ID NO: 3231069 - RNA, 20 nt, Human
ucucacagacaggaccccug

SEQ ID NO: 3231070 - RNA, 19 nt, Human
ucucacagacaggaccccu

SEQ ID NO: 3231071 - RNA, 23 nt, Human
ucucacagacaggaccccugcag

SEQ ID NO: 3231072 - RNA, 14 nt, Human
ucucacagcuaugc

SEQ ID NO: 3231073 - RNA, 17 nt, Human
ucucacagcuaugcaaa

SEQ ID NO: 3231074 - RNA, 18 nt, Human
ucucacagcuaugcaaaa

SEQ ID NO: 3231075 - RNA, 22 nt, Human
ucucacagcuaugcaaaaagcu

SEQ ID NO: 3231076 - RNA, 11 nt, Human
acuucagcuga

SEQ ID NO: 3231077 - RNA, 16 nt, Human
acuucagcugacuuuu

SEQ ID NO: 3231078 - RNA, 14 nt, Human
acuucaggcucuuc

SEQ ID NO: 3231079 - RNA, 21 nt, Human
ucuauuucaucagaacagcug

SEQ ID NO: 3231080 - RNA, 15 nt, Human
ucuauuucaucagaa

SEQ ID NO: 3231081 - RNA, 13 nt, Human
acuucagcucugu

SEQ ID NO: 3231082 - RNA, 23 nt, Human
ucucacacaugagcaucaggcca

SEQ ID NO: 3231083 - RNA, 22 nt, Human
ucuauuucccccuuucuuccuc

SEQ ID NO: 3231084 - RNA, 21 nt, Human
ucuauuucccccuuucuuccu

SEQ ID NO: 3231085 - RNA, 19 nt, Human
ucuauuucccccuuucuuc

SEQ ID NO: 3231086 - RNA, 18 nt, Human
ucuauuucccccuuucuu

SEQ ID NO: 3231087 - RNA, 23 nt, Human
acuucuaaguaaaaccacagcag

SEQ ID NO: 3231088 - RNA, 23 nt, Human
acuucuaaaacuguacuuugauu

SEQ ID NO: 3231089 - RNA, 22 nt, Human
acuucuaaaacuguacuuugau

SEQ ID NO: 3231090 - RNA, 21 nt, Human
acuucuaaaacuguacuuuga

SEQ ID NO: 3231091 - RNA, 19 nt, Human
acuucuaaaacuguacuuu

SEQ ID NO: 3231092 - RNA, 16 nt, Human
acuucuaaaacuguac

SEQ ID NO: 3231093 - RNA, 15 nt, Human
acuucuaaaacugua

SEQ ID NO: 3231094 - RNA, 14 nt, Human
acuucuaaaacugu

SEQ ID NO: 3231095 - RNA, 21 nt, Human
acuucuaaguaaaaccacagc

SEQ ID NO: 3231096 - RNA, 23 nt, Human
acuucuaaguugaguauauuaua

SEQ ID NO: 3231097 - RNA, 19 nt, Human
acuucuaaguugaguauau

SEQ ID NO: 3231098 - RNA, 14 nt, Human
acuucuccacccug

SEQ ID NO: 3231099 - RNA, 12 nt, Human
ucucacucuguc

SEQ ID NO: 3231100 - RNA, 13 nt, Human
ucucacuccuuga

SEQ ID NO: 3231101 - RNA, 18 nt, Human
ucucacuccuaccuggua

SEQ ID NO: 3231102 - RNA, 22 nt, Human
acuucgggaggucgaggcagga

SEQ ID NO: 3231103 - RNA, 14 nt, Human
acuuccuugccagu

SEQ ID NO: 3231104 - RNA, 15 nt, Human
acuuccugugacuuc

SEQ ID NO: 3231105 - RNA, 15 nt, Human
acuuccuuacuuuua

SEQ ID NO: 3231106 - RNA, 21 nt, Human
acuugaacccauauuuguaca

SEQ ID NO: 3231107 - RNA, 14 nt, Human
acuugaaccauaaa

SEQ ID NO: 3231108 - RNA, 15 nt, Human
acuugaaccauaaaa

SEQ ID NO: 3231109 - RNA, 16 nt, Human
acuugaaccauaaaau

SEQ ID NO: 3231110 - RNA, 17 nt, Human
acuugaaccauaaaaug

SEQ ID NO: 3231111 - RNA, 19 nt, Human
acuugaaccauaaaauguc

SEQ ID NO: 3231112 - RNA, 20 nt, Human
acuugaaccauaaaaugucc

SEQ ID NO: 3231113 - RNA, 22 nt, Human
acuugaaccauaaaauguccag

SEQ ID NO: 3231114 - RNA, 19 nt, Human
acuugaacccgggaggcag

SEQ ID NO: 3231115 - RNA, 20 nt, Human
acuugaacccgggaggcaga

SEQ ID NO: 3231116 - RNA, 16 nt, Human
acuucuccacccugcu

SEQ ID NO: 3231117 - RNA, 15 nt, Human
acuucuccacccugc

SEQ ID NO: 3231118 - RNA, 19 nt, Human
acuugagcccagagugaac

SEQ ID NO: 3231119 - RNA, 19 nt, Human
acuugagaauuacccuuuu

SEQ ID NO: 3231120 - RNA, 16 nt, Human
acuugagaugauuucc

SEQ ID NO: 3231121 - RNA, 15 nt, Human
acuugaauaguauug

SEQ ID NO: 3231122 - RNA, 16 nt, Human
acuugaauaguauugu

SEQ ID NO: 3231123 - RNA, 18 nt, Human
acuugaauaguauugugu

SEQ ID NO: 3231124 - RNA, 19 nt, Human
acuugaaccauaguuacug

SEQ ID NO: 3231125 - RNA, 16 nt, Human
acuuguggacacagcu

SEQ ID NO: 3231126 - RNA, 17 nt, Human
acuuguggacacagcuc

SEQ ID NO: 3231127 - RNA, 14 nt, Human
acuuggaugaguuu

SEQ ID NO: 3231128 - RNA, 21 nt, Human
acuuggaugaguuuugggaag

SEQ ID NO: 3231129 - RNA, 15 nt, Human
acuugccuuugaaga

SEQ ID NO: 3231130 - RNA, 14 nt, Human
acuugccuuugaag

SEQ ID NO: 3231131 - RNA, 16 nt, Human
acuugccuuugaagag

SEQ ID NO: 3231132 - RNA, 23 nt, Human
acuggccaguggcuggaucugug

SEQ ID NO: 3231133 - RNA, 14 nt, Human
uccuucagugccuu

SEQ ID NO: 3231134 - RNA, 15 nt, Human
uccuucagugccuua

SEQ ID NO: 3231135 - RNA, 14 nt, Human
acuggccucugcug

SEQ ID NO: 3231136 - RNA, 17 nt, Human
acuggccgcgggggcag

SEQ ID NO: 3231137 - RNA, 16 nt, Human
uccuucagugccuuau

SEQ ID NO: 3231138 - RNA, 17 nt, Human
uccuucagugccuuaug

SEQ ID NO: 3231139 - RNA, 15 nt, Human
uccuucccacucugu

SEQ ID NO: 3231140 - RNA, 17 nt, Human
uccuucccacucuucuc

SEQ ID NO: 3231141 - RNA, 14 nt, Human
uccuucccacucuu

SEQ ID NO: 3231142 - RNA, 19 nt, Human
uccuucccacucuucucau

SEQ ID NO: 3231143 - RNA, 13 nt, Human
uccuugucaguug

SEQ ID NO: 3231144 - RNA, 22 nt, Human
uccuuggugucgggcaugacac

SEQ ID NO: 3231145 - RNA, 16 nt, Human
uccuugguuauauuuu

SEQ ID NO: 3231146 - RNA, 21 nt, Human
uccuugguuauauuuuuuuaa

SEQ ID NO: 3231147 - RNA, 14 nt, Human
uccuuuaauaugaa

SEQ ID NO: 3231148 - RNA, 19 nt, Human
uccuuuagcgcccaguugg

SEQ ID NO: 3231149 - RNA, 15 nt, Human
uccuuuagcgcccag

SEQ ID NO: 3231150 - RNA, 18 nt, Human
uccuuuaauaugaaauuu

SEQ ID NO: 3231151 - RNA, 15 nt, Human
uccuuuaauaugaaa

SEQ ID NO: 3231152 - RNA, 22 nt, Human
uccuuuagcgcccaguugggug

SEQ ID NO: 3231153 - RNA, 12 nt, Human
uccuuuagaaac

SEQ ID NO: 3231154 - RNA, 13 nt, Human
uccuuuagaaaca

SEQ ID NO: 3231155 - RNA, 19 nt, Human
uccuuuagauagcagccug

SEQ ID NO: 3231156 - RNA, 20 nt, Human
uccuuuagauagcagccugg

SEQ ID NO: 3231157 - RNA, 22 nt, Human
uccuuuagauagcagccuggcu

SEQ ID NO: 3231158 - RNA, 12 nt, Human
uccuuucuugau

SEQ ID NO: 3231159 - RNA, 17 nt, Human
uccuuucugaucuucac

SEQ ID NO: 3231160 - RNA, 11 nt, Human
ucgagaauugu

SEQ ID NO: 3231161 - RNA, 14 nt, Human
ucgacuugcauuuu

SEQ ID NO: 3231162 - RNA, 16 nt, Human
ucgagcaugccuggau

SEQ ID NO: 3231163 - RNA, 18 nt, Human
ucgagcaugccuggaugg

SEQ ID NO: 3231164 - RNA, 15 nt, Human
ucgagcaugccugga

SEQ ID NO: 3231165 - RNA, 16 nt, Human
ucgcgacaaugcaaac

SEQ ID NO: 3231166 - RNA, 14 nt, Human
ucgcgacaaugcaa

SEQ ID NO: 3231167 - RNA, 19 nt, Human
ucgcgacaaugcaaaccau

SEQ ID NO: 3231168 - RNA, 19 nt, Human
ucgagcuccccccaggucu

SEQ ID NO: 3231169 - RNA, 23 nt, Human
ucgcuccaacuccaacauccacu

SEQ ID NO: 3231170 - RNA, 23 nt, Human
acuggcuugaauuggugacauuu

SEQ ID NO: 3231171 - RNA, 23 nt, Human
ucgcuagcauuucccaacacaaa

SEQ ID NO: 3231172 - RNA, 17 nt, Human
ucgcuacauuuccgcca

SEQ ID NO: 3231173 - RNA, 18 nt, Human
ucgcuauugucaccaggg

SEQ ID NO: 3231174 - RNA, 14 nt, Human
ucgcuccaacucca

SEQ ID NO: 3231175 - RNA, 21 nt, Human
ucgcggccucuucucucagac

SEQ ID NO: 3231176 - RNA, 18 nt, Human
acugccucccccaggguc

SEQ ID NO: 3231177 - RNA, 13 nt, Human
acugccuccccca

SEQ ID NO: 3231178 - RNA, 21 nt, Human
acugccuccccaaggcccccu

SEQ ID NO: 3231179 - RNA, 16 nt, Human
acugcauucuucugau

SEQ ID NO: 3231180 - RNA, 17 nt, Human
acugcauucuucugauc

SEQ ID NO: 3231181 - RNA, 13 nt, Human
acugccugccuua

SEQ ID NO: 3231182 - RNA, 14 nt, Human
acugccugccuuaa

SEQ ID NO: 3231183 - RNA, 15 nt, Human
acugccugccuuaag

SEQ ID NO: 3231184 - RNA, 18 nt, Human
acugccugccuuaaguga

SEQ ID NO: 3231185 - RNA, 15 nt, Human
acugccucuuccucc

SEQ ID NO: 3231186 - RNA, 14 nt, Human
acugccucuuccuc

SEQ ID NO: 3231187 - RNA, 16 nt, Human
acugcauaugaaagga

SEQ ID NO: 3231188 - RNA, 21 nt, Human
uccuagaaauuccccacccug

SEQ ID NO: 3231189 - RNA, 22 nt, Human
uccuagaaauuccccacccuga

SEQ ID NO: 3231190 - RNA, 14 nt, Human
uccuagagaacugu

SEQ ID NO: 3231191 - RNA, 18 nt, Human
uccuagacagguguuuau

SEQ ID NO: 3231192 - RNA, 18 nt, Human
uccuagaauguuucauuu

SEQ ID NO: 3231193 - RNA, 23 nt, Human
acugcauccuccgccucccgggu

SEQ ID NO: 3231194 - RNA, 21 nt, Human
acugcaucuugguuauuucug

SEQ ID NO: 3231195 - RNA, 20 nt, Human
acugcaucaagaugugacau

SEQ ID NO: 3231196 - RNA, 22 nt, Human
acugcaucaagaugugacaugu

SEQ ID NO: 3231197 - RNA, 17 nt, Human
acugcauccuccgccuc

SEQ ID NO: 3231198 - RNA, 20 nt, Human
acugcauccuccgccucccg

SEQ ID NO: 3231199 - RNA, 18 nt, Human
acugcuaagaauauuuga

SEQ ID NO: 3231200 - RNA, 16 nt, Human
acugcuaagaauauuu

SEQ ID NO: 3231201 - RNA, 21 nt, Human
acugcuaaggauuagucccug

SEQ ID NO: 3231202 - RNA, 11 nt, Human
acugcucucac

SEQ ID NO: 3231203 - RNA, 22 nt, Human
acugcuccugagcccccagcuu

SEQ ID NO: 3231204 - RNA, 21 nt, Human
acugcuccugagcccccagcu

SEQ ID NO: 3231205 - RNA, 20 nt, Human
acugcuccugagcccccagc

SEQ ID NO: 3231206 - RNA, 19 nt, Human
acugcuccugagcccccag

SEQ ID NO: 3231207 - RNA, 15 nt, Human
acugcuggcugccuu

SEQ ID NO: 3231208 - RNA, 14 nt, Human
acugcuggcugccu

SEQ ID NO: 3231209 - RNA, 13 nt, Human
acugcuccugagc

SEQ ID NO: 3231210 - RNA, 18 nt, Human
acugcuccugagccccca

SEQ ID NO: 3231211 - RNA, 17 nt, Human
acugcuccugagccccc

SEQ ID NO: 3231212 - RNA, 16 nt, Human
acugcuccugagcccc

SEQ ID NO: 3231213 - RNA, 15 nt, Human
acugcuccugagccc

SEQ ID NO: 3231214 - RNA, 21 nt, Human
acugcucucaccuugguuccu

SEQ ID NO: 3231215 - RNA, 13 nt, Human
acugcucucaccu

SEQ ID NO: 3231216 - RNA, 22 nt, Human
acugcucucaccuugguuccug

SEQ ID NO: 3231217 - RNA, 20 nt, Human
acuggcacaguuuucugaga

SEQ ID NO: 3231218 - RNA, 19 nt, Human
acuggcacaguuuucugag

SEQ ID NO: 3231219 - RNA, 23 nt, Human
acuggcaaugguaguuucugugg

SEQ ID NO: 3231220 - RNA, 16 nt, Human
acuggccacaguuguu

SEQ ID NO: 3231221 - RNA, 13 nt, Human
acuggcacaguuu

SEQ ID NO: 3231222 - RNA, 21 nt, Human
acuggcaaugguaguuucugu

SEQ ID NO: 3231223 - RNA, 16 nt, Human
acuggcaaugguaguu

SEQ ID NO: 3231224 - RNA, 13 nt, Human
acuggauaaauug

SEQ ID NO: 3231225 - RNA, 14 nt, Human
acuggauaaauugu

SEQ ID NO: 3231226 - RNA, 18 nt, Human
acuggauaaauuguuuag

SEQ ID NO: 3231227 - RNA, 19 nt, Human
acuggauaaauuguuuagu

SEQ ID NO: 3231228 - RNA, 18 nt, Human
acuggaucucuuaagaca

SEQ ID NO: 3231229 - RNA, 21 nt, Human
acugcuugugaaaggaaagag

SEQ ID NO: 3231230 - RNA, 13 nt, Human
acugcuuaauuca

SEQ ID NO: 3231231 - RNA, 16 nt, Human
acugcuuaauucaaau

SEQ ID NO: 3231232 - RNA, 20 nt, Human
acugcuuaccuacuuucuuc

SEQ ID NO: 3231233 - RNA, 21 nt, Human
acugcuuaccuacuuucuuca

SEQ ID NO: 3231234 - RNA, 14 nt, Human
acugcuuugagaaa

SEQ ID NO: 3231235 - RNA, 23 nt, Human
acugcuuucuuucguuuguuugu

SEQ ID NO: 3231236 - RNA, 17 nt, Human
acugcuuucuuucguuu

SEQ ID NO: 3231237 - RNA, 19 nt, Human
ucgguguccccaccaucug

SEQ ID NO: 3231238 - RNA, 16 nt, Human
ucgguguccccaccau

SEQ ID NO: 3231239 - RNA, 20 nt, Human
ucgguuaacaaauaacaacu

SEQ ID NO: 3231240 - RNA, 15 nt, Human
ucgguuaacaaauaa

SEQ ID NO: 3231241 - RNA, 21 nt, Human
ucgguguccccaccaucugcu

SEQ ID NO: 3231242 - RNA, 20 nt, Human
ucgguguccccaccaucugc

SEQ ID NO: 3231243 - RNA, 17 nt, Human
ucggugccaucagugcc

SEQ ID NO: 3231244 - RNA, 17 nt, Human
ucguaaacaucucagag

SEQ ID NO: 3231245 - RNA, 17 nt, Human
ucguuugaaucacagua

SEQ ID NO: 3231246 - RNA, 22 nt, Human
ucuaaaauauuuaugaagaaaa

SEQ ID NO: 3231247 - RNA, 22 nt, Human
ucuaaaacuguacuuugauuca

SEQ ID NO: 3231248 - RNA, 19 nt, Human
ucuaaaacuguacuuugau

SEQ ID NO: 3231249 - RNA, 18 nt, Human
ucuaaaacuguacuuuga

SEQ ID NO: 3231250 - RNA, 15 nt, Human
ucuaaaacuguacuu

SEQ ID NO: 3231251 - RNA, 12 nt, Human
ucuaaaacugua

SEQ ID NO: 3231252 - RNA, 19 nt, Human
ucuaaaaauauacauguuu

SEQ ID NO: 3231253 - RNA, 18 nt, Human
ucuaaaaauaacuguaau

SEQ ID NO: 3231254 - RNA, 15 nt, Human
ucuaaaaauauacau

SEQ ID NO: 3231255 - RNA, 14 nt, Human
ucuaaaaauauaca

SEQ ID NO: 3231256 - RNA, 14 nt, Human
ucuaaaaagucaga

SEQ ID NO: 3231257 - RNA, 15 nt, Human
ucuaaaaagucagau

SEQ ID NO: 3231258 - RNA, 22 nt, Human
ucggguuuuauuguuuaaaauc

SEQ ID NO: 3231259 - RNA, 15 nt, Human
ucgguacccaccaca

SEQ ID NO: 3231260 - RNA, 20 nt, Human
ucgggccccaccugcagcuc

SEQ ID NO: 3231261 - RNA, 19 nt, Human
ucgggggggacccuccaag

SEQ ID NO: 3231262 - RNA, 23 nt, Human
ucgggggggacccuccaaggcca

SEQ ID NO: 3231263 - RNA, 11 nt, Human
ucgggcaugac

SEQ ID NO: 3231264 - RNA, 12 nt, Human
ucgggcaugaca

SEQ ID NO: 3231265 - RNA, 17 nt, Human
ucgggccccaccugcag

SEQ ID NO: 3231266 - RNA, 15 nt, Human
ucgggccccaccugc

SEQ ID NO: 3231267 - RNA, 19 nt, Human
ucgggaggucgaggcagga

SEQ ID NO: 3231268 - RNA, 21 nt, Human
ucgggaggucgaggcaggagg

SEQ ID NO: 3231269 - RNA, 17 nt, Human
ucgggaggucgaggcag

SEQ ID NO: 3231270 - RNA, 13 nt, Human
ucggcuggcuccc

SEQ ID NO: 3231271 - RNA, 17 nt, Human
ucggcuggcuccccugc

SEQ ID NO: 3231272 - RNA, 18 nt, Human
ucggcuggcuccccugca

SEQ ID NO: 3231273 - RNA, 19 nt, Human
ucggcuggcuccccugcag

SEQ ID NO: 3231274 - RNA, 20 nt, Human
ucggcuggcuccccugcagc

SEQ ID NO: 3231275 - RNA, 21 nt, Human
ucggcuggcuccccugcagcc

SEQ ID NO: 3231276 - RNA, 18 nt, Human
ucggcucacugcauccuc

SEQ ID NO: 3231277 - RNA, 22 nt, Human
ucggcuccaguccccagaacuc

SEQ ID NO: 3231278 - RNA, 13 nt, Human
acuguguauauuu

SEQ ID NO: 3231279 - RNA, 15 nt, Human
acuguguauauuuga

SEQ ID NO: 3231280 - RNA, 16 nt, Human
acuguguauauuugau

SEQ ID NO: 3231281 - RNA, 17 nt, Human
acuguguauauuugauu

SEQ ID NO: 3231282 - RNA, 18 nt, Human
acuguguauauuugauuu

SEQ ID NO: 3231283 - RNA, 19 nt, Human
acuguguauauuugauuua

SEQ ID NO: 3231284 - RNA, 21 nt, Human
acuguggguuuguggggggag

SEQ ID NO: 3231285 - RNA, 22 nt, Human
acuguggguuuguggggggagg

SEQ ID NO: 3231286 - RNA, 23 nt, Human
acuguggguuuguggggggaggc

SEQ ID NO: 3231287 - RNA, 19 nt, Human
acugugguagguguuugaa

SEQ ID NO: 3231288 - RNA, 16 nt, Human
acugggaacagaacuc

SEQ ID NO: 3231289 - RNA, 21 nt, Human
acugucagcuccccucggaga

SEQ ID NO: 3231290 - RNA, 17 nt, Human
acuguccuacccacccu

SEQ ID NO: 3231291 - RNA, 18 nt, Human
acuguccuacccacccuc

SEQ ID NO: 3231292 - RNA, 22 nt, Human
acugugcugagucugaaggcug

SEQ ID NO: 3231293 - RNA, 15 nt, Human
acuguccuaacaugg

SEQ ID NO: 3231294 - RNA, 22 nt, Human
acuguggagacugcuccugagc

SEQ ID NO: 3231295 - RNA, 17 nt, Human
acuguggagacugcucc

SEQ ID NO: 3231296 - RNA, 15 nt, Human
acuguggagacugcu

SEQ ID NO: 3231297 - RNA, 11 nt, Human
acuguggagac

SEQ ID NO: 3231298 - RNA, 23 nt, Human
ucuaaguaaaaccacagcaguug

SEQ ID NO: 3231299 - RNA, 20 nt, Human
ucuaaguaaaaccacagcag

SEQ ID NO: 3231300 - RNA, 22 nt, Human
ucuaaguaaaaccacagcaguu

SEQ ID NO: 3231301 - RNA, 21 nt, Human
ucuaaguaaaaccacagcagu

SEQ ID NO: 3231302 - RNA, 13 nt, Human
ucuaaagcugcca

SEQ ID NO: 3231303 - RNA, 14 nt, Human
ucuaaagcugccag

SEQ ID NO: 3231304 - RNA, 15 nt, Human
ucuaaagcugccagc

SEQ ID NO: 3231305 - RNA, 15 nt, Human
ucuaaggcaggaugu

SEQ ID NO: 3231306 - RNA, 11 nt, Human
ucuaaggacaa

SEQ ID NO: 3231307 - RNA, 19 nt, Human
acuguucccugagguggga

SEQ ID NO: 3231308 - RNA, 16 nt, Human
acuguucccugaggug

SEQ ID NO: 3231309 - RNA, 18 nt, Human
acuguuauucuuugcacu

SEQ ID NO: 3231310 - RNA, 16 nt, Human
acuguuauucuuugca

SEQ ID NO: 3231311 - RNA, 15 nt, Human
acuguuauucuuugc

SEQ ID NO: 3231312 - RNA, 13 nt, Human
acuguuauucuuu

SEQ ID NO: 3231313 - RNA, 14 nt, Human
acuguucucugccc

SEQ ID NO: 3231314 - RNA, 19 nt, Human
acuguuauucuuugcacuu

SEQ ID NO: 3231315 - RNA, 20 nt, Human
acuguucucugcccuccaag

SEQ ID NO: 3231316 - RNA, 21 nt, Human
acuguucucugcccuccaaga

SEQ ID NO: 3231317 - RNA, 19 nt, Human
acuguucucugcccuccaa

SEQ ID NO: 3231318 - RNA, 13 nt, Human
ucuacaguguccu

SEQ ID NO: 3231319 - RNA, 22 nt, Human
ucuaccaacuuucaagaacuug

SEQ ID NO: 3231320 - RNA, 18 nt, Human
ucuaccaacuuucaagaa

SEQ ID NO: 3231321 - RNA, 17 nt, Human
ucuaccaacuuucaaga

SEQ ID NO: 3231322 - RNA, 14 nt, Human
ucuaccaacuuuca

SEQ ID NO: 3231323 - RNA, 13 nt, Human
acuguuagaaugu

SEQ ID NO: 3231324 - RNA, 12 nt, Human
acuguuauucuu

SEQ ID NO: 3231325 - RNA, 14 nt, Human
acuguuaucauuuu

SEQ ID NO: 3231326 - RNA, 13 nt, Human
acuguuaucauuu

SEQ ID NO: 3231327 - RNA, 15 nt, Human
acuguuagaauguaa

SEQ ID NO: 3231328 - RNA, 14 nt, Human
acuguuagaaugua

SEQ ID NO: 3231329 - RNA, 16 nt, Human
acuguuaccauuggaa

SEQ ID NO: 3231330 - RNA, 18 nt, Human
acuguuaccauuggaaau

SEQ ID NO: 3231331 - RNA, 17 nt, Human
acuguuaccauuggaaa

SEQ ID NO: 3231332 - RNA, 22 nt, Human
acuguuaccauuggaaauuuca

SEQ ID NO: 3231333 - RNA, 21 nt, Human
acuguuaccauuggaaauuuc

SEQ ID NO: 3231334 - RNA, 19 nt, Human
acuguuaccauuggaaauu

SEQ ID NO: 3231335 - RNA, 14 nt, Human
acuguuacuugaua

SEQ ID NO: 3231336 - RNA, 13 nt, Human
acuuaauaaucaa

SEQ ID NO: 3231337 - RNA, 15 nt, Human
acuuaauaaucaaga

SEQ ID NO: 3231338 - RNA, 19 nt, Human
acuuaauaaucaagagccu

SEQ ID NO: 3231339 - RNA, 22 nt, Human
acuuaauaaucaagagccuuaa

SEQ ID NO: 3231340 - RNA, 12 nt, Human
acuguuguauaa

SEQ ID NO: 3231341 - RNA, 14 nt, Human
acuguugcccaggc

SEQ ID NO: 3231342 - RNA, 13 nt, Human
acuguugcccagg

SEQ ID NO: 3231343 - RNA, 12 nt, Human
acuguugcccag

SEQ ID NO: 3231344 - RNA, 18 nt, Human
acuguugcccaggcuggc

SEQ ID NO: 3231345 - RNA, 17 nt, Human
acuguugcccaggcugg

SEQ ID NO: 3231346 - RNA, 23 nt, Human
acuuaauaaucaagagccuuaaa

SEQ ID NO: 3231347 - RNA, 23 nt, Human
acuuaauaucuucauuucuaaau

SEQ ID NO: 3231348 - RNA, 23 nt, Human
acuuaccugaagggguuuucuug

SEQ ID NO: 3231349 - RNA, 20 nt, Human
acuuaccugaguugaagagg

SEQ ID NO: 3231350 - RNA, 19 nt, Human
acuuaccugaguugaagag

SEQ ID NO: 3231351 - RNA, 14 nt, Human
acuucagcucuguu

SEQ ID NO: 3231352 - RNA, 15 nt, Human
acuuaguuugugaau

SEQ ID NO: 3231353 - RNA, 17 nt, Human
acuuaguuuugcauagu

SEQ ID NO: 3231354 - RNA, 13 nt, Human
acuuaguuuugca

SEQ ID NO: 3231355 - RNA, 16 nt, Human
acuuagaaauugcauu

SEQ ID NO: 3231356 - RNA, 21 nt, Human
acuuagaaucccuguguuaau

SEQ ID NO: 3231357 - RNA, 22 nt, Human
acuuagagcuuuuuuuuuuuaa

SEQ ID NO: 3231358 - RNA, 23 nt, Human
acuuagagcuuuuuuuuuuuaau

SEQ ID NO: 3231359 - RNA, 19 nt, Human
acuuagaaucccuguguua

SEQ ID NO: 3231360 - RNA, 20 nt, Human
acuuagaaucccuguguuaa

SEQ ID NO: 3231361 - RNA, 22 nt, Human
acuuagaaucccuguguuaauu

SEQ ID NO: 3231362 - RNA, 19 nt, Human
acuuagacucuaguauuua

SEQ ID NO: 3231363 - RNA, 18 nt, Human
acuuagaaucccuguguu

SEQ ID NO: 3231364 - RNA, 14 nt, Human
agaggccauggagg

SEQ ID NO: 3231365 - RNA, 19 nt, Human
agaggccaugggccuccug

SEQ ID NO: 3231366 - RNA, 17 nt, Human
agaggcuaugugagcac

SEQ ID NO: 3231367 - RNA, 20 nt, Human
agaggccccaauaccccaug

SEQ ID NO: 3231368 - RNA, 10 nt, Human
agaggcucag

SEQ ID NO: 3231369 - RNA, 18 nt, Human
agaggcucagauuguaau

SEQ ID NO: 3231370 - RNA, 13 nt, Human
agaggcagggucu

SEQ ID NO: 3231371 - RNA, 10 nt, Human
agaggcaggg

SEQ ID NO: 3231372 - RNA, 19 nt, Human
agaggcagccccauucugc

SEQ ID NO: 3231373 - RNA, 13 nt, Human
agaggcagcccca

SEQ ID NO: 3231374 - RNA, 24 nt, Human
agaggcagccccauucugccugcc

SEQ ID NO: 3231375 - RNA, 14 nt, Human
agaggaaaagaaau

SEQ ID NO: 3231376 - RNA, 18 nt, Human
agagcuuagaaacuggaa

SEQ ID NO: 3231377 - RNA, 20 nt, Human
agagguuuggcuccugccca

SEQ ID NO: 3231378 - RNA, 18 nt, Human
agagguuuggcuccugcc

SEQ ID NO: 3231379 - RNA, 12 nt, Human
agaguacuuugg

SEQ ID NO: 3231380 - RNA, 17 nt, Human
agaguacuuugguuucu

SEQ ID NO: 3231381 - RNA, 19 nt, Human
agaguacuuugguuucuga

SEQ ID NO: 3231382 - RNA, 12 nt, Human
agaguacacugc

SEQ ID NO: 3231383 - RNA, 13 nt, Human
agaguacacugcc

SEQ ID NO: 3231384 - RNA, 15 nt, Human
agaguacacugccug

SEQ ID NO: 3231385 - RNA, 19 nt, Human
agaguacacugccugccuu

SEQ ID NO: 3231386 - RNA, 18 nt, Human
agaguaaucuuguugguu

SEQ ID NO: 3231387 - RNA, 18 nt, Human
agaguagagguauaauug

SEQ ID NO: 3231388 - RNA, 20 nt, Human
ugaagcaaacaguugacaau

SEQ ID NO: 3231389 - RNA, 15 nt, Human
ugaagcaaacaguug

SEQ ID NO: 3231390 - RNA, 15 nt, Human
agagguugcagugag

SEQ ID NO: 3231391 - RNA, 19 nt, Human
agagguccacaacacacag

SEQ ID NO: 3231392 - RNA, 21 nt, Human
agaggucccaagguucugggu

SEQ ID NO: 3231393 - RNA, 13 nt, Human
agagguauaauug

SEQ ID NO: 3231394 - RNA, 21 nt, Human
agagguaucuuacuuuccucu

SEQ ID NO: 3231395 - RNA, 21 nt, Human
agaggccccaauaccccaugg

SEQ ID NO: 3231396 - RNA, 13 nt, Human
agaggcugaggac

SEQ ID NO: 3231397 - RNA, 20 nt, Human
ugaacgauccuucaaagucu

SEQ ID NO: 3231398 - RNA, 13 nt, Human
ugaacgcccagag

SEQ ID NO: 3231399 - RNA, 12 nt, Human
ugaacuccuggc

SEQ ID NO: 3231400 - RNA, 11 nt, Human
ugaacuccugg

SEQ ID NO: 3231401 - RNA, 15 nt, Human
ugaacuccuggccuc

SEQ ID NO: 3231402 - RNA, 14 nt, Human
ugaacuccuggccu

SEQ ID NO: 3231403 - RNA, 19 nt, Human
ugaacaaauuuacagagac

SEQ ID NO: 3231404 - RNA, 20 nt, Human
ugaacaaauuuacagagaca

SEQ ID NO: 3231405 - RNA, 18 nt, Human
ugaacaaauuuacagaga

SEQ ID NO: 3231406 - RNA, 15 nt, Human
ugaaauuuuuauuaa

SEQ ID NO: 3231407 - RNA, 22 nt, Human
ugaaccgaugagaaauaaaguu

SEQ ID NO: 3231408 - RNA, 18 nt, Human
ugaacaacgagccuuuuc

SEQ ID NO: 3231409 - RNA, 19 nt, Human
ugaacaacgagccuuuuca

SEQ ID NO: 3231410 - RNA, 12 nt, Human
ugaaccugaaua

SEQ ID NO: 3231411 - RNA, 14 nt, Human
agagcugcgggcug

SEQ ID NO: 3231412 - RNA, 21 nt, Human
ugaagaaagccuguuguuuaa

SEQ ID NO: 3231413 - RNA, 19 nt, Human
agagcuguucacagccaga

SEQ ID NO: 3231414 - RNA, 21 nt, Human
agagcuguucacagccagacu

SEQ ID NO: 3231415 - RNA, 18 nt, Human
agagcuguugaugggaug

SEQ ID NO: 3231416 - RNA, 14 nt, Human
agagcuuagggucu

SEQ ID NO: 3231417 - RNA, 18 nt, Human
agagcuuagggucucagg

SEQ ID NO: 3231418 - RNA, 22 nt, Human
agagcuucuguugcugccucau

SEQ ID NO: 3231419 - RNA, 15 nt, Human
agagcuuaacagugu

SEQ ID NO: 3231420 - RNA, 12 nt, Human
agagcuuagaaa

SEQ ID NO: 3231421 - RNA, 14 nt, Human
agagcuuagaaacu

SEQ ID NO: 3231422 - RNA, 13 nt, Human
agagcuuagaaac

SEQ ID NO: 3231423 - RNA, 16 nt, Human
ugaagaaacagcuaug

SEQ ID NO: 3231424 - RNA, 24 nt, Human
ugaagaaaauacuuaaauguuaug

SEQ ID NO: 3231425 - RNA, 22 nt, Human
ugaagaaaauacuuaaauguua

SEQ ID NO: 3231426 - RNA, 20 nt, Human
ugaagaaaauacuuaaaugu

SEQ ID NO: 3231427 - RNA, 18 nt, Human
ugaagaaaauacuuaaau

SEQ ID NO: 3231428 - RNA, 16 nt, Human
ugaagaaaauacuuaa

SEQ ID NO: 3231429 - RNA, 14 nt, Human
ugaagaaaauacuu

SEQ ID NO: 3231430 - RNA, 12 nt, Human
ugaagaaaauac

SEQ ID NO: 3231431 - RNA, 22 nt, Human
ugaaauauauggucuaauguuu

SEQ ID NO: 3231432 - RNA, 16 nt, Human
ugaaauauaugugaaa

SEQ ID NO: 3231433 - RNA, 17 nt, Human
ugaaauauaugugaaag

SEQ ID NO: 3231434 - RNA, 19 nt, Human
ugaaauauaugugaaagga

SEQ ID NO: 3231435 - RNA, 23 nt, Human
ugaaauaucaucacguauguuau

SEQ ID NO: 3231436 - RNA, 14 nt, Human
ugaaauuuuagaaa

SEQ ID NO: 3231437 - RNA, 16 nt, Human
ugaaauuuuagaaaua

SEQ ID NO: 3231438 - RNA, 18 nt, Human
ugaaauuuuagaaauauu

SEQ ID NO: 3231439 - RNA, 13 nt, Human
ugaaagugccuuu

SEQ ID NO: 3231440 - RNA, 14 nt, Human
ugaaagugccuuug

SEQ ID NO: 3231441 - RNA, 16 nt, Human
ugaaagugccuuugca

SEQ ID NO: 3231442 - RNA, 17 nt, Human
ugaaagugccuuugcag

SEQ ID NO: 3231443 - RNA, 14 nt, Human
ugaaauaagccaga

SEQ ID NO: 3231444 - RNA, 21 nt, Human
ugaaagugccuuugcagcuca

SEQ ID NO: 3231445 - RNA, 17 nt, Human
ugaaauaagccagacau

SEQ ID NO: 3231446 - RNA, 18 nt, Human
ugaaauaagccagacauc

SEQ ID NO: 3231447 - RNA, 20 nt, Human
ugaaauaagccagacaucaa

SEQ ID NO: 3231448 - RNA, 23 nt, Human
ugaaauaagccagacaucaacag

SEQ ID NO: 3231449 - RNA, 18 nt, Human
agagcugccaccugccug

SEQ ID NO: 3231450 - RNA, 13 nt, Human
agagcugccagug

SEQ ID NO: 3231451 - RNA, 12 nt, Human
agagcugccagu

SEQ ID NO: 3231452 - RNA, 14 nt, Human
agagcugccaccug

SEQ ID NO: 3231453 - RNA, 15 nt, Human
agagcguugaaguug

SEQ ID NO: 3231454 - RNA, 14 nt, Human
agagcgcagcaucc

SEQ ID NO: 3231455 - RNA, 13 nt, Human
agagcgcagcccg

SEQ ID NO: 3231456 - RNA, 18 nt, Human
agagccuuuuucuaggcc

SEQ ID NO: 3231457 - RNA, 16 nt, Human
agagcgacagagcagu

SEQ ID NO: 3231458 - RNA, 15 nt, Human
agagcgacagagcag

SEQ ID NO: 3231459 - RNA, 16 nt, Human
agagcagugggccugg

SEQ ID NO: 3231460 - RNA, 18 nt, Human
agagcauuccagucaggc

SEQ ID NO: 3231461 - RNA, 17 nt, Human
agagcauuccagucagg

SEQ ID NO: 3231462 - RNA, 16 nt, Human
agagcauuccagucag

SEQ ID NO: 3231463 - RNA, 23 nt, Human
agagcauuauaaucaccagggcc

SEQ ID NO: 3231464 - RNA, 21 nt, Human
agagcauuccagucaggcucu

SEQ ID NO: 3231465 - RNA, 19 nt, Human
agagcauuccagucaggcu

SEQ ID NO: 3231466 - RNA, 21 nt, Human
agagccuugcggaagguucua

SEQ ID NO: 3231467 - RNA, 22 nt, Human
agagccuuccaggggugggaca

SEQ ID NO: 3231468 - RNA, 11 nt, Human
agagccuugcg

SEQ ID NO: 3231469 - RNA, 17 nt, Human
agagcagagaccauccc

SEQ ID NO: 3231470 - RNA, 18 nt, Human
agagcagagaccaucccu

SEQ ID NO: 3231471 - RNA, 20 nt, Human
agagcagagaccaucccuga

SEQ ID NO: 3231472 - RNA, 22 nt, Human
agagcagaaauucuguuuuuaa

SEQ ID NO: 3231473 - RNA, 12 nt, Human
agagcagcaagg

SEQ ID NO: 3231474 - RNA, 16 nt, Human
agagcaagagagcagc

SEQ ID NO: 3231475 - RNA, 13 nt, Human
agagcaagagagc

SEQ ID NO: 3231476 - RNA, 20 nt, Human
agagcaagagagcagcaagg

SEQ ID NO: 3231477 - RNA, 21 nt, Human
agagcaaggaagguaaaaagu

SEQ ID NO: 3231478 - RNA, 17 nt, Human
agagcaaggaagguaaa

SEQ ID NO: 3231479 - RNA, 23 nt, Human
agagcaaggaagguaaaaaguua

SEQ ID NO: 3231480 - RNA, 12 nt, Human
agagcagagacc

SEQ ID NO: 3231481 - RNA, 20 nt, Human
agagcagaaauucuguuuuu

SEQ ID NO: 3231482 - RNA, 17 nt, Human
agagcagaaauucuguu

SEQ ID NO: 3231483 - RNA, 15 nt, Human
agagcagaaauucug

SEQ ID NO: 3231484 - RNA, 14 nt, Human
agagcagaaauucu

SEQ ID NO: 3231485 - RNA, 22 nt, Human
agagauuuggggcuaaagacug

SEQ ID NO: 3231486 - RNA, 16 nt, Human
agagauugugguuuca

SEQ ID NO: 3231487 - RNA, 21 nt, Human
agagauuuggggcuaaagacu

SEQ ID NO: 3231488 - RNA, 14 nt, Human
agagauuuggggcu

SEQ ID NO: 3231489 - RNA, 17 nt, Human
ucuuuggacccugaggc

SEQ ID NO: 3231490 - RNA, 21 nt, Human
ucuuuggacccugaggcccag

SEQ ID NO: 3231491 - RNA, 16 nt, Human
ucuuuggacccugagg

SEQ ID NO: 3231492 - RNA, 14 nt, Human
ucuuuggaguuaaa

SEQ ID NO: 3231493 - RNA, 20 nt, Human
ucuuuggaguuaaaaugcac

SEQ ID NO: 3231494 - RNA, 15 nt, Human
agauccauuaauuua

SEQ ID NO: 3231495 - RNA, 18 nt, Human
agauccauuaauuuaaau

SEQ ID NO: 3231496 - RNA, 22 nt, Human
agauccauuuuuuauauuucaa

SEQ ID NO: 3231497 - RNA, 15 nt, Human
agaugcaccagcccu

SEQ ID NO: 3231498 - RNA, 14 nt, Human
agaugcaccagccc

SEQ ID NO: 3231499 - RNA, 11 nt, Human
agaugccuggg

SEQ ID NO: 3231500 - RNA, 14 nt, Human
agaugcuagaacuc

SEQ ID NO: 3231501 - RNA, 16 nt, Human
agaugcuacuaagaaa

SEQ ID NO: 3231502 - RNA, 17 nt, Human
agauguggaaaagccaa

SEQ ID NO: 3231503 - RNA, 14 nt, Human
agaugugcugcuuu

SEQ ID NO: 3231504 - RNA, 22 nt, Human
agauguggaaaagccaagaggc

SEQ ID NO: 3231505 - RNA, 16 nt, Human
agaugugcugcuuuga

SEQ ID NO: 3231506 - RNA, 14 nt, Human
agauguuaaaauaa

SEQ ID NO: 3231507 - RNA, 15 nt, Human
agauguuaaaauaaa

SEQ ID NO: 3231508 - RNA, 17 nt, Human
agauguuaaaauaaaug

SEQ ID NO: 3231509 - RNA, 18 nt, Human
agauguuaaaauaaaugg

SEQ ID NO: 3231510 - RNA, 17 nt, Human
agauguuauauuuuucu

SEQ ID NO: 3231511 - RNA, 21 nt, Human
agauguuauauuuuucuuaaa

SEQ ID NO: 3231512 - RNA, 19 nt, Human
agauguuauauuuuucuua

SEQ ID NO: 3231513 - RNA, 15 nt, Human
agaugcuucucacug

SEQ ID NO: 3231514 - RNA, 20 nt, Human
agaugcugugccccuggccu

SEQ ID NO: 3231515 - RNA, 15 nt, Human
agaugcugugccccu

SEQ ID NO: 3231516 - RNA, 17 nt, Human
ugacccacaagaaauga

SEQ ID NO: 3231517 - RNA, 23 nt, Human
ugaccauucuccaccugccaggg

SEQ ID NO: 3231518 - RNA, 13 nt, Human
ugacccacugcuu

SEQ ID NO: 3231519 - RNA, 12 nt, Human
ugacccacugcu

SEQ ID NO: 3231520 - RNA, 22 nt, Human
ugacauuguagagcuucuggca

SEQ ID NO: 3231521 - RNA, 21 nt, Human
ugacauuguuggccaaagcca

SEQ ID NO: 3231522 - RNA, 20 nt, Human
ugacauuguuggccaaagcc

SEQ ID NO: 3231523 - RNA, 18 nt, Human
ugaccaaugauggucacc

SEQ ID NO: 3231524 - RNA, 19 nt, Human
ugacauuuagucccucaag

SEQ ID NO: 3231525 - RNA, 13 nt, Human
agaucagccuggg

SEQ ID NO: 3231526 - RNA, 15 nt, Human
agaucagccugggca

SEQ ID NO: 3231527 - RNA, 14 nt, Human
agaucagccagaag

SEQ ID NO: 3231528 - RNA, 23 nt, Human
agaucauaguuuuauuuauauuu

SEQ ID NO: 3231529 - RNA, 13 nt, Human
agaucauaguuuu

SEQ ID NO: 3231530 - RNA, 14 nt, Human
agaucauaguuuua

SEQ ID NO: 3231531 - RNA, 16 nt, Human
agaucauaguuuuauu

SEQ ID NO: 3231532 - RNA, 17 nt, Human
agaucauaguuuuauuu

SEQ ID NO: 3231533 - RNA, 19 nt, Human
agaucauaguuuuauuuau

SEQ ID NO: 3231534 - RNA, 20 nt, Human
agaucauaguuuuauuuaua

SEQ ID NO: 3231535 - RNA, 22 nt, Human
agaucauaguuuuauuuauauu

SEQ ID NO: 3231536 - RNA, 20 nt, Human
ugacagggcacaccgggcac

SEQ ID NO: 3231537 - RNA, 16 nt, Human
ugacagggcacaccgg

SEQ ID NO: 3231538 - RNA, 11 nt, Human
ugacagggcac

SEQ ID NO: 3231539 - RNA, 18 nt, Human
ugacaggcgaaagaaaac

SEQ ID NO: 3231540 - RNA, 14 nt, Human
ugacaggccugucc

SEQ ID NO: 3231541 - RNA, 21 nt, Human
ugacacacagcucuguccugg

SEQ ID NO: 3231542 - RNA, 16 nt, Human
ugacagcgcacagcug

SEQ ID NO: 3231543 - RNA, 20 nt, Human
ugacaggcaaugcuggcugu

SEQ ID NO: 3231544 - RNA, 19 nt, Human
ugacagcgcacagcugcuc

SEQ ID NO: 3231545 - RNA, 17 nt, Human
ugacagcgcacagcugc

SEQ ID NO: 3231546 - RNA, 12 nt, Human
agauaaauauua

SEQ ID NO: 3231547 - RNA, 14 nt, Human
agauaaauauuaua

SEQ ID NO: 3231548 - RNA, 12 nt, Human
agauaaaugugc

SEQ ID NO: 3231549 - RNA, 12 nt, Human
agauacucuggg

SEQ ID NO: 3231550 - RNA, 23 nt, Human
agauacuacugaccagacaagcu

SEQ ID NO: 3231551 - RNA, 21 nt, Human
agauacuacugaccagacaag

SEQ ID NO: 3231552 - RNA, 16 nt, Human
agauaaaugauucaaa

SEQ ID NO: 3231553 - RNA, 16 nt, Human
agaucacgccacugca

SEQ ID NO: 3231554 - RNA, 15 nt, Human
agaucacgccacugc

SEQ ID NO: 3231555 - RNA, 14 nt, Human
agaucacgccacug

SEQ ID NO: 3231556 - RNA, 18 nt, Human
agaucacgccacugcacu

SEQ ID NO: 3231557 - RNA, 17 nt, Human
agaucacgccacugcac

SEQ ID NO: 3231558 - RNA, 20 nt, Human
ugacacacagcucuguccug

SEQ ID NO: 3231559 - RNA, 11 nt, Human
ugaauuuucua

SEQ ID NO: 3231560 - RNA, 17 nt, Human
ugaauuuucuaaaagcu

SEQ ID NO: 3231561 - RNA, 22 nt, Human
ugaauuuucuaaaagcuuucau

SEQ ID NO: 3231562 - RNA, 21 nt, Human
ugaauuuucauuuuacaguua

SEQ ID NO: 3231563 - RNA, 19 nt, Human
ugaauuuucauuuuacagu

SEQ ID NO: 3231564 - RNA, 18 nt, Human
ugaauuuucauuuuacag

SEQ ID NO: 3231565 - RNA, 17 nt, Human
ugaauuuucauuuuaca

SEQ ID NO: 3231566 - RNA, 12 nt, Human
ugaauuuucauu

SEQ ID NO: 3231567 - RNA, 11 nt, Human
ugaauuuucau

SEQ ID NO: 3231568 - RNA, 16 nt, Human
ugaauuuucauuuuac

SEQ ID NO: 3231569 - RNA, 15 nt, Human
ugaauuuucauuuua

SEQ ID NO: 3231570 - RNA, 14 nt, Human
ugaauuuucauuuu

SEQ ID NO: 3231571 - RNA, 13 nt, Human
ugaauuuucauuu

SEQ ID NO: 3231572 - RNA, 23 nt, Human
agagucauuguaauguugugaau

SEQ ID NO: 3231573 - RNA, 22 nt, Human
agagucauuguaauguugugaa

SEQ ID NO: 3231574 - RNA, 21 nt, Human
agagucauuguaauguuguga

SEQ ID NO: 3231575 - RNA, 14 nt, Human
agaguccccccacu

SEQ ID NO: 3231576 - RNA, 22 nt, Human
agagucagaaguuucugccgca

SEQ ID NO: 3231577 - RNA, 16 nt, Human
agagucauuguaaugu

SEQ ID NO: 3231578 - RNA, 14 nt, Human
agagucauuguaau

SEQ ID NO: 3231579 - RNA, 20 nt, Human
ugaaugguuuucaaaauaaa

SEQ ID NO: 3231580 - RNA, 19 nt, Human
ugaaugucagugugacuga

SEQ ID NO: 3231581 - RNA, 17 nt, Human
agaguuggcaugacucu

SEQ ID NO: 3231582 - RNA, 22 nt, Human
agagucucacuguugcccaggc

SEQ ID NO: 3231583 - RNA, 18 nt, Human
agaguccccccacuccca

SEQ ID NO: 3231584 - RNA, 15 nt, Human
agaguccccccacuc

SEQ ID NO: 3231585 - RNA, 21 nt, Human
agaguccccccacucccagca

SEQ ID NO: 3231586 - RNA, 22 nt, Human
agagucugagggcuuguaguuc

SEQ ID NO: 3231587 - RNA, 23 nt, Human
agagucugagggcuuguaguucu

SEQ ID NO: 3231588 - RNA, 21 nt, Human
agagucuggggaccagcuugg

SEQ ID NO: 3231589 - RNA, 12 nt, Human
agagucugaggg

SEQ ID NO: 3231590 - RNA, 14 nt, Human
agagucugagggcu

SEQ ID NO: 3231591 - RNA, 21 nt, Human
agagucugagggcuuguaguu

SEQ ID NO: 3231592 - RNA, 22 nt, Human
agaaccccuggcuccaggccag

SEQ ID NO: 3231593 - RNA, 15 nt, Human
agaaugucaguaugu

SEQ ID NO: 3231594 - RNA, 16 nt, Human
agaaugucaguaugug

SEQ ID NO: 3231595 - RNA, 13 nt, Human
agaaugucaguau

SEQ ID NO: 3231596 - RNA, 23 nt, Human
agaaccccaggguccuguagccc

SEQ ID NO: 3231597 - RNA, 21 nt, Human
agaacccauggaaaaaugcca

SEQ ID NO: 3231598 - RNA, 17 nt, Human
agaaugucaguaugugg

SEQ ID NO: 3231599 - RNA, 19 nt, Human
agaaugucaguauguggaa

SEQ ID NO: 3231600 - RNA, 21 nt, Human
agaauguguuuaaacuugguu

SEQ ID NO: 3231601 - RNA, 23 nt, Human
agaauuaacacaugauccugcaa

SEQ ID NO: 3231602 - RNA, 18 nt, Human
agaauuaccauuuguuaa

SEQ ID NO: 3231603 - RNA, 19 nt, Human
agaauuaccauuuguuaau

SEQ ID NO: 3231604 - RNA, 22 nt, Human
agaauuaccauuuguuaauauc

SEQ ID NO: 3231605 - RNA, 23 nt, Human
agaauguugaaacugacuugcug

SEQ ID NO: 3231606 - RNA, 13 nt, Human
agaauguuucauu

SEQ ID NO: 3231607 - RNA, 15 nt, Human
agaauguuucauuug

SEQ ID NO: 3231608 - RNA, 13 nt, Human
ucuggggaccagc

SEQ ID NO: 3231609 - RNA, 23 nt, Human
ucuggguuccuuccucugagccu

SEQ ID NO: 3231610 - RNA, 16 nt, Human
ucuggguuccuuccuc

SEQ ID NO: 3231611 - RNA, 21 nt, Human
ucugguaaucgggguauaaua

SEQ ID NO: 3231612 - RNA, 22 nt, Human
ucuggguuccuuccucugagcc

SEQ ID NO: 3231613 - RNA, 18 nt, Human
ucuggguagcuguaaggc

SEQ ID NO: 3231614 - RNA, 20 nt, Human
agaauuauaauuaguuccuc

SEQ ID NO: 3231615 - RNA, 20 nt, Human
agaauucucagaaucucaaa

SEQ ID NO: 3231616 - RNA, 12 nt, Human
ucuguauuugaa

SEQ ID NO: 3231617 - RNA, 24 nt, Human
ucuguccaggcacugcugcccagc

SEQ ID NO: 3231618 - RNA, 18 nt, Human
ucugucccaguuaacugu

SEQ ID NO: 3231619 - RNA, 14 nt, Human
ucugugaagagcaa

SEQ ID NO: 3231620 - RNA, 11 nt, Human
ucugugaauaa

SEQ ID NO: 3231621 - RNA, 13 nt, Human
ucugugaauaagc

SEQ ID NO: 3231622 - RNA, 12 nt, Human
ucugugaauaag

SEQ ID NO: 3231623 - RNA, 16 nt, Human
ucugugaauaagccau

SEQ ID NO: 3231624 - RNA, 18 nt, Human
ucuguacgucugacaggc

SEQ ID NO: 3231625 - RNA, 14 nt, Human
ucuguaugauucua

SEQ ID NO: 3231626 - RNA, 16 nt, Human
ucuguucugauauuaa

SEQ ID NO: 3231627 - RNA, 23 nt, Human
ucuguucugauauuaauuuauca

SEQ ID NO: 3231628 - RNA, 19 nt, Human
ucuguucugcacacagcac

SEQ ID NO: 3231629 - RNA, 17 nt, Human
ucuguucugcacacagc

SEQ ID NO: 3231630 - RNA, 18 nt, Human
ucuguucugcacacagca

SEQ ID NO: 3231631 - RNA, 13 nt, Human
ucugugcaccugg

SEQ ID NO: 3231632 - RNA, 14 nt, Human
ucugugcaccuggg

SEQ ID NO: 3231633 - RNA, 16 nt, Human
ucugugcaccugggcu

SEQ ID NO: 3231634 - RNA, 13 nt, Human
agacacaagccuu

SEQ ID NO: 3231635 - RNA, 15 nt, Human
agacacacaaagcag

SEQ ID NO: 3231636 - RNA, 14 nt, Human
agacacacaaagca

SEQ ID NO: 3231637 - RNA, 14 nt, Human
agacacaagccuuc

SEQ ID NO: 3231638 - RNA, 17 nt, Human
agaauucucuuauccaa

SEQ ID NO: 3231639 - RNA, 17 nt, Human
agacacaggcccggcuc

SEQ ID NO: 3231640 - RNA, 22 nt, Human
agacacaggcccggcuccaggc

SEQ ID NO: 3231641 - RNA, 21 nt, Human
agacacaggcccggcuccagg

SEQ ID NO: 3231642 - RNA, 20 nt, Human
agacacaggcccggcuccag

SEQ ID NO: 3231643 - RNA, 19 nt, Human
agacacaggcccggcucca

SEQ ID NO: 3231644 - RNA, 22 nt, Human
agacacuuuuucuuuacaaaca

SEQ ID NO: 3231645 - RNA, 13 nt, Human
agacagcugccug

SEQ ID NO: 3231646 - RNA, 14 nt, Human
agacagcugccugg

SEQ ID NO: 3231647 - RNA, 21 nt, Human
agacacauguccaagaagccc

SEQ ID NO: 3231648 - RNA, 22 nt, Human
agacacauguccaagaagccca

SEQ ID NO: 3231649 - RNA, 16 nt, Human
agacacaggcccggcu

SEQ ID NO: 3231650 - RNA, 23 nt, Human
agacacaggcccggcuccaggcu

SEQ ID NO: 3231651 - RNA, 24 nt, Human
agacacauguccaagaagcccagg

SEQ ID NO: 3231652 - RNA, 19 nt, Human
agacaccuugacagggcac

SEQ ID NO: 3231653 - RNA, 22 nt, Human
agacaccuugacagggcacacc

SEQ ID NO: 3231654 - RNA, 20 nt, Human
agacacauguccaagaagcc

SEQ ID NO: 3231655 - RNA, 18 nt, Human
agacacauuaucuucugg

SEQ ID NO: 3231656 - RNA, 19 nt, Human
ucuuacuuuccugaaaaua

SEQ ID NO: 3231657 - RNA, 22 nt, Human
ucuuacugcuuaauucaaauaa

SEQ ID NO: 3231658 - RNA, 13 nt, Human
ucuuacucugccg

SEQ ID NO: 3231659 - RNA, 16 nt, Human
ucuuacauaaaccauu

SEQ ID NO: 3231660 - RNA, 19 nt, Human
ucuuacauaaaccauuuuu

SEQ ID NO: 3231661 - RNA, 15 nt, Human
ucuuaccgacaagca

SEQ ID NO: 3231662 - RNA, 20 nt, Human
ucuuaccuugaacugaaggc

SEQ ID NO: 3231663 - RNA, 22 nt, Human
ucuuaccgacaagcacagucag

SEQ ID NO: 3231664 - RNA, 17 nt, Human
ucuuaccgacaagcaca

SEQ ID NO: 3231665 - RNA, 18 nt, Human
ucuuacuuuguaaauucu

SEQ ID NO: 3231666 - RNA, 20 nt, Human
ucuuacuuuguaaauucuga

SEQ ID NO: 3231667 - RNA, 22 nt, Human
ucuuacuuuguaaauucugauu

SEQ ID NO: 3231668 - RNA, 15 nt, Human
ucuuagaaaagguga

SEQ ID NO: 3231669 - RNA, 11 nt, Human
ucuuacuuugu

SEQ ID NO: 3231670 - RNA, 13 nt, Human
ucuuacuuuguaa

SEQ ID NO: 3231671 - RNA, 14 nt, Human
ucuuacuuuguaaa

SEQ ID NO: 3231672 - RNA, 15 nt, Human
ucuuacuuuguaaau

SEQ ID NO: 3231673 - RNA, 16 nt, Human
ucuuacuuuguaaauu

SEQ ID NO: 3231674 - RNA, 17 nt, Human
ucuuacuuuguaaauuc

SEQ ID NO: 3231675 - RNA, 12 nt, Human
ucuuagauguau

SEQ ID NO: 3231676 - RNA, 18 nt, Human
ucuuaugggcuggguucu

SEQ ID NO: 3231677 - RNA, 22 nt, Human
ucuuagaaaaggugauaaaauc

SEQ ID NO: 3231678 - RNA, 20 nt, Human
ucuuagaaaaggugauaaaa

SEQ ID NO: 3231679 - RNA, 22 nt, Human
ucuuauuaguuccccaaauaca

SEQ ID NO: 3231680 - RNA, 22 nt, Human
ucuuauuaaaguuucaaaaauc

SEQ ID NO: 3231681 - RNA, 21 nt, Human
ucuuauuaaaguuucaaaaau

SEQ ID NO: 3231682 - RNA, 20 nt, Human
ucuuauuaaaguuucaaaaa

SEQ ID NO: 3231683 - RNA, 19 nt, Human
ucuuauuaaaguuucaaaa

SEQ ID NO: 3231684 - RNA, 14 nt, Human
ucuuauuaaaacac

SEQ ID NO: 3231685 - RNA, 14 nt, Human
ucuuauuaaaguuu

SEQ ID NO: 3231686 - RNA, 12 nt, Human
ucuuauuaaagu

SEQ ID NO: 3231687 - RNA, 18 nt, Human
ucuuauuaaaguuucaaa

SEQ ID NO: 3231688 - RNA, 17 nt, Human
ucuuauuaaaguuucaa

SEQ ID NO: 3231689 - RNA, 16 nt, Human
ucuuauuaaaguuuca

SEQ ID NO: 3231690 - RNA, 15 nt, Human
ucuuauuaaaguuuc

SEQ ID NO: 3231691 - RNA, 12 nt, Human
agacagucccug

SEQ ID NO: 3231692 - RNA, 18 nt, Human
agacagucacaaauuucu

SEQ ID NO: 3231693 - RNA, 15 nt, Human
agacagucacaaauu

SEQ ID NO: 3231694 - RNA, 15 nt, Human
agacagcugccuggg

SEQ ID NO: 3231695 - RNA, 13 nt, Human
agacagucccugc

SEQ ID NO: 3231696 - RNA, 19 nt, Human
agacagucccugccaaugg

SEQ ID NO: 3231697 - RNA, 14 nt, Human
agacagugaauuug

SEQ ID NO: 3231698 - RNA, 12 nt, Human
ucuuaauuugga

SEQ ID NO: 3231699 - RNA, 13 nt, Human
ucuuaauuuggaa

SEQ ID NO: 3231700 - RNA, 16 nt, Human
ucuuaauuuggaaacu

SEQ ID NO: 3231701 - RNA, 17 nt, Human
ucuuaauuuggaaacua

SEQ ID NO: 3231702 - RNA, 18 nt, Human
ucuuaauuuggaaacuaa

SEQ ID NO: 3231703 - RNA, 19 nt, Human
ucuuaauuuggaaacuaau

SEQ ID NO: 3231704 - RNA, 22 nt, Human
ucuuaauuuggaaacuaauaaa

SEQ ID NO: 3231705 - RNA, 19 nt, Human
ucuuaauggaugaaaucau

SEQ ID NO: 3231706 - RNA, 18 nt, Human
ucuuaauggaugaaauca

SEQ ID NO: 3231707 - RNA, 21 nt, Human
agacauuugcuaugagcuggg

SEQ ID NO: 3231708 - RNA, 20 nt, Human
ucuucuguacgucugacagg

SEQ ID NO: 3231709 - RNA, 22 nt, Human
ucuucuuauacagauaaaacau

SEQ ID NO: 3231710 - RNA, 13 nt, Human
ucuucuucaaacc

SEQ ID NO: 3231711 - RNA, 18 nt, Human
ucuucuuccacacaugca

SEQ ID NO: 3231712 - RNA, 15 nt, Human
ucuucuucaaaccuu

SEQ ID NO: 3231713 - RNA, 16 nt, Human
ucuuauuucauuucuu

SEQ ID NO: 3231714 - RNA, 20 nt, Human
ucuucugagcuuacguaguu

SEQ ID NO: 3231715 - RNA, 15 nt, Human
ucuuauuucauuucu

SEQ ID NO: 3231716 - RNA, 17 nt, Human
ucuuauuuaaugaaaga

SEQ ID NO: 3231717 - RNA, 19 nt, Human
ucuuauuccauauuagaaa

SEQ ID NO: 3231718 - RNA, 18 nt, Human
ucuuauuccauauuagaa

SEQ ID NO: 3231719 - RNA, 14 nt, Human
ucuuauuccauauu

SEQ ID NO: 3231720 - RNA, 22 nt, Human
ucuucuguacgucugacaggca

SEQ ID NO: 3231721 - RNA, 21 nt, Human
ucuucuguacgucugacaggc

SEQ ID NO: 3231722 - RNA, 12 nt, Human
ucuucuggaaug

SEQ ID NO: 3231723 - RNA, 19 nt, Human
ucuucugcuucagccuccc

SEQ ID NO: 3231724 - RNA, 23 nt, Human
ucuucugcuuuguugugugccuc

SEQ ID NO: 3231725 - RNA, 21 nt, Human
ucuucugcuuuguugugugcc

SEQ ID NO: 3231726 - RNA, 13 nt, Human
ucuucugcuuugu

SEQ ID NO: 3231727 - RNA, 12 nt, Human
ucuucugcuuug

SEQ ID NO: 3231728 - RNA, 22 nt, Human
ucuucugcuucagccucccgag

SEQ ID NO: 3231729 - RNA, 22 nt, Human
ucuucugagcuuacguaguucu

SEQ ID NO: 3231730 - RNA, 20 nt, Human
ucuucugaguggcuaaaacu

SEQ ID NO: 3231731 - RNA, 19 nt, Human
ucuucugaucacugaaaua

SEQ ID NO: 3231732 - RNA, 21 nt, Human
ucuucugaguggcuaaaacuu

SEQ ID NO: 3231733 - RNA, 23 nt, Human
agacuauucaaacagucucagga

SEQ ID NO: 3231734 - RNA, 22 nt, Human
agaccugccccuccucucugcc

SEQ ID NO: 3231735 - RNA, 23 nt, Human
agaccugccccuccucucugccc

SEQ ID NO: 3231736 - RNA, 16 nt, Human
agaccugccccuccuc

SEQ ID NO: 3231737 - RNA, 13 nt, Human
agaccugccccuc

SEQ ID NO: 3231738 - RNA, 21 nt, Human
agacucaguggggaggggcug

SEQ ID NO: 3231739 - RNA, 18 nt, Human
agaccgugaagauacuuu

SEQ ID NO: 3231740 - RNA, 14 nt, Human
agacccggcugcgu

SEQ ID NO: 3231741 - RNA, 21 nt, Human
agaccccuggcuuuucacugc

SEQ ID NO: 3231742 - RNA, 14 nt, Human
agaccccuggcuuu

SEQ ID NO: 3231743 - RNA, 15 nt, Human
agaccccuggcuuuu

SEQ ID NO: 3231744 - RNA, 18 nt, Human
agaccaaacagugcuguu

SEQ ID NO: 3231745 - RNA, 16 nt, Human
agaccaaacagugcug

SEQ ID NO: 3231746 - RNA, 17 nt, Human
agaccaaauggaaacag

SEQ ID NO: 3231747 - RNA, 17 nt, Human
agaccgaacuguuguau

SEQ ID NO: 3231748 - RNA, 20 nt, Human
agaccgaacuguuguauaaa

SEQ ID NO: 3231749 - RNA, 13 nt, Human
agaccgucuuccu

SEQ ID NO: 3231750 - RNA, 14 nt, Human
agaccgucuuccuc

SEQ ID NO: 3231751 - RNA, 15 nt, Human
agaccgucuuccucc

SEQ ID NO: 3231752 - RNA, 16 nt, Human
agaccgucuuccucca

SEQ ID NO: 3231753 - RNA, 18 nt, Human
agaccgucuuccuccaac

SEQ ID NO: 3231754 - RNA, 22 nt, Human
ucuuuaaugucacaggcagguc

SEQ ID NO: 3231755 - RNA, 19 nt, Human
ucuuuaaugucacaggcag

SEQ ID NO: 3231756 - RNA, 17 nt, Human
ucuuuaggucuuugccu

SEQ ID NO: 3231757 - RNA, 20 nt, Human
ucuuuaauuaaaaccuggga

SEQ ID NO: 3231758 - RNA, 14 nt, Human
ucuuuaauuaaaac

SEQ ID NO: 3231759 - RNA, 20 nt, Human
ucuuuaaugucacaggcagg

SEQ ID NO: 3231760 - RNA, 13 nt, Human
ucuugguuccagc

SEQ ID NO: 3231761 - RNA, 17 nt, Human
ucuugaucaguaguuug

SEQ ID NO: 3231762 - RNA, 21 nt, Human
ucuugauaauuuuccuuuaau

SEQ ID NO: 3231763 - RNA, 19 nt, Human
ucuugguuccagccugcca

SEQ ID NO: 3231764 - RNA, 18 nt, Human
ucuugguuccagccugcc

SEQ ID NO: 3231765 - RNA, 17 nt, Human
ucuugguuccagccugc

SEQ ID NO: 3231766 - RNA, 14 nt, Human
ucuuucuuccucug

SEQ ID NO: 3231767 - RNA, 20 nt, Human
ucuuuauaauucuacuuuga

SEQ ID NO: 3231768 - RNA, 13 nt, Human
ucuuucugcuuug

SEQ ID NO: 3231769 - RNA, 15 nt, Human
agacucgcgacaaug

SEQ ID NO: 3231770 - RNA, 17 nt, Human
agacucgcgacaaugca

SEQ ID NO: 3231771 - RNA, 18 nt, Human
agacucgcgacaaugcaa

SEQ ID NO: 3231772 - RNA, 19 nt, Human
agacucgcgacaaugcaaa

SEQ ID NO: 3231773 - RNA, 23 nt, Human
agacuccugcaggcagccaggcc

SEQ ID NO: 3231774 - RNA, 17 nt, Human
ucuuucuuccucugcug

SEQ ID NO: 3231775 - RNA, 16 nt, Human
ucuuucuuccucugcu

SEQ ID NO: 3231776 - RNA, 15 nt, Human
ucuuucuuccucugc

SEQ ID NO: 3231777 - RNA, 21 nt, Human
agacuuaaagggcccaaugaa

SEQ ID NO: 3231778 - RNA, 20 nt, Human
agacucgcgacaaugcaaac

SEQ ID NO: 3231779 - RNA, 14 nt, Human
agacuguacaaagu

SEQ ID NO: 3231780 - RNA, 16 nt, Human
agacuguacaaaguag

SEQ ID NO: 3231781 - RNA, 15 nt, Human
agacuguacaaagua

SEQ ID NO: 3231782 - RNA, 14 nt, Human
agagaaaaaagcca

SEQ ID NO: 3231783 - RNA, 14 nt, Human
agagaauguauuug

SEQ ID NO: 3231784 - RNA, 14 nt, Human
agagacaaguaauu

SEQ ID NO: 3231785 - RNA, 15 nt, Human
agagacaaguaauuu

SEQ ID NO: 3231786 - RNA, 19 nt, Human
agagacaaguaauuucagu

SEQ ID NO: 3231787 - RNA, 20 nt, Human
agagacaaguaauuucagug

SEQ ID NO: 3231788 - RNA, 15 nt, Human
agagaauuaaacgaa

SEQ ID NO: 3231789 - RNA, 24 nt, Human
agagacagaaagcagaacagugau

SEQ ID NO: 3231790 - RNA, 15 nt, Human
agagacagaaagcag

SEQ ID NO: 3231791 - RNA, 19 nt, Human
agagacaauagcauuagaa

SEQ ID NO: 3231792 - RNA, 19 nt, Human
agacuuuucuuucagccaa

SEQ ID NO: 3231793 - RNA, 17 nt, Human
agacuuuagcuuucuga

SEQ ID NO: 3231794 - RNA, 22 nt, Human
agagaaaaaauauuuuccugcc

SEQ ID NO: 3231795 - RNA, 19 nt, Human
agacuuuuuuuaaauagua

SEQ ID NO: 3231796 - RNA, 18 nt, Human
agacuuguaugaaagaug

SEQ ID NO: 3231797 - RNA, 16 nt, Human
agacuuguauauucua

SEQ ID NO: 3231798 - RNA, 21 nt, Human
agacuuguauauucuauuuua

SEQ ID NO: 3231799 - RNA, 18 nt, Human
agacuuguauauucuauu

SEQ ID NO: 3231800 - RNA, 15 nt, Human
aacacuguucucugc

SEQ ID NO: 3231801 - RNA, 20 nt, Human
aacacuguucucugcccucc

SEQ ID NO: 3231802 - RNA, 21 nt, Human
aacacuguguauuguuguaaa

SEQ ID NO: 3231803 - RNA, 17 nt, Human
aacacucauugaccuga

SEQ ID NO: 3231804 - RNA, 21 nt, Human
aacacucauugaccugaggcc

SEQ ID NO: 3231805 - RNA, 12 nt, Human
aacacuccuuca

SEQ ID NO: 3231806 - RNA, 11 nt, Human
aacacucugag

SEQ ID NO: 3231807 - RNA, 12 nt, Human
aacacucugaga

SEQ ID NO: 3231808 - RNA, 13 nt, Human
aacacucugagac

SEQ ID NO: 3231809 - RNA, 14 nt, Human
aacacucugagacu

SEQ ID NO: 3231810 - RNA, 22 nt, Human
guccaagggguccccuccagga

SEQ ID NO: 3231811 - RNA, 20 nt, Human
guccaagggguccccuccag

SEQ ID NO: 3231812 - RNA, 15 nt, Human
guccacaacacacag

SEQ ID NO: 3231813 - RNA, 16 nt, Human
guccauuuuuacaagu

SEQ ID NO: 3231814 - RNA, 23 nt, Human
guccauuuuuacaaguuauagua

SEQ ID NO: 3231815 - RNA, 24 nt, Human
guccaagcauaccaacacgagcag

SEQ ID NO: 3231816 - RNA, 13 nt, Human
guccaagcagauu

SEQ ID NO: 3231817 - RNA, 11 nt, Human
gucauuuucau

SEQ ID NO: 3231818 - RNA, 19 nt, Human
gucauuugagcagggcuca

SEQ ID NO: 3231819 - RNA, 16 nt, Human
aacacuugugacuuuu

SEQ ID NO: 3231820 - RNA, 21 nt, Human
aacacuugugacuuuugcuuu

SEQ ID NO: 3231821 - RNA, 22 nt, Human
gucauuugagcagggcucagcg

SEQ ID NO: 3231822 - RNA, 21 nt, Human
gucauuugagcagggcucagc

SEQ ID NO: 3231823 - RNA, 11 nt, Human
aacacuuccau

SEQ ID NO: 3231824 - RNA, 21 nt, Human
aacacuguucucugcccucca

SEQ ID NO: 3231825 - RNA, 21 nt, Human
aacacuguuaucauuuuuucc

SEQ ID NO: 3231826 - RNA, 18 nt, Human
aacacuguuaucauuuuu

SEQ ID NO: 3231827 - RNA, 12 nt, Human
aacacuguuauc

SEQ ID NO: 3231828 - RNA, 17 nt, Human
aacaaugccuauuguaa

SEQ ID NO: 3231829 - RNA, 18 nt, Human
aacaaugccuauuguaau

SEQ ID NO: 3231830 - RNA, 23 nt, Human
aacaaugccuauuguaauauaga

SEQ ID NO: 3231831 - RNA, 14 nt, Human
aacaauuuucagau

SEQ ID NO: 3231832 - RNA, 23 nt, Human
aacaauuuucagauuugcacaaa

SEQ ID NO: 3231833 - RNA, 22 nt, Human
aacaauuuucagauuugcacaa

SEQ ID NO: 3231834 - RNA, 21 nt, Human
aacaauuuucagauuugcaca

SEQ ID NO: 3231835 - RNA, 20 nt, Human
aacaauuuucagauuugcac

SEQ ID NO: 3231836 - RNA, 19 nt, Human
aacaauuuucagauuugca

SEQ ID NO: 3231837 - RNA, 18 nt, Human
aacaauuuucagauuugc

SEQ ID NO: 3231838 - RNA, 17 nt, Human
aacaauuuucagauuug

SEQ ID NO: 3231839 - RNA, 16 nt, Human
aacaauuuucagauuu

SEQ ID NO: 3231840 - RNA, 23 nt, Human
aacaaggcaaggcugucaauuac

SEQ ID NO: 3231841 - RNA, 16 nt, Human
aacaaggcuugcugca

SEQ ID NO: 3231842 - RNA, 15 nt, Human
aacaauaaagcaaua

SEQ ID NO: 3231843 - RNA, 23 nt, Human
aacaauaggaugggcuucugugc

SEQ ID NO: 3231844 - RNA, 19 nt, Human
aaauuuuucauauuuuaau

SEQ ID NO: 3231845 - RNA, 17 nt, Human
aaauuuuucauauuuua

SEQ ID NO: 3231846 - RNA, 16 nt, Human
aaauuuuucauauuuu

SEQ ID NO: 3231847 - RNA, 15 nt, Human
aaauuuuucauauuu

SEQ ID NO: 3231848 - RNA, 12 nt, Human
aaauuuuucaua

SEQ ID NO: 3231849 - RNA, 14 nt, Human
aaauuuuucauauu

SEQ ID NO: 3231850 - RNA, 13 nt, Human
aaauuuuucauau

SEQ ID NO: 3231851 - RNA, 15 nt, Human
gucacaggcaggucc

SEQ ID NO: 3231852 - RNA, 13 nt, Human
gucacaggcaggu

SEQ ID NO: 3231853 - RNA, 16 nt, Human
gucacaggcaggucca

SEQ ID NO: 3231854 - RNA, 12 nt, Human
gucacaggcagg

SEQ ID NO: 3231855 - RNA, 14 nt, Human
aacauuucauaauu

SEQ ID NO: 3231856 - RNA, 15 nt, Human
aacauuuauauguag

SEQ ID NO: 3231857 - RNA, 16 nt, Human
aacauuguagccucaa

SEQ ID NO: 3231858 - RNA, 22 nt, Human
aacauuguccccaaugaauaua

SEQ ID NO: 3231859 - RNA, 14 nt, Human
aacauuguagccuc

SEQ ID NO: 3231860 - RNA, 21 nt, Human
aacauugcauauaacuuauau

SEQ ID NO: 3231861 - RNA, 20 nt, Human
aacauugcauauaacuuaua

SEQ ID NO: 3231862 - RNA, 14 nt, Human
aacauacucccauc

SEQ ID NO: 3231863 - RNA, 15 nt, Human
aacauacucccaucu

SEQ ID NO: 3231864 - RNA, 22 nt, Human
aacauacaaaugcaucuuugau

SEQ ID NO: 3231865 - RNA, 14 nt, Human
aacauacaaaugca

SEQ ID NO: 3231866 - RNA, 15 nt, Human
aacauacaaaugcau

SEQ ID NO: 3231867 - RNA, 20 nt, Human
aacauacaaaugcaucuuug

SEQ ID NO: 3231868 - RNA, 21 nt, Human
aacauacaaaugcaucuuuga

SEQ ID NO: 3231869 - RNA, 15 nt, Human
aacauucuauuucaa

SEQ ID NO: 3231870 - RNA, 18 nt, Human
aacauucuccuguggaag

SEQ ID NO: 3231871 - RNA, 14 nt, Human
aacauucuauuuca

SEQ ID NO: 3231872 - RNA, 21 nt, Human
aacauacgugugcaugugucu

SEQ ID NO: 3231873 - RNA, 18 nt, Human
guccucuuaacuguggug

SEQ ID NO: 3231874 - RNA, 18 nt, Human
guccuuaucuagcugcau

SEQ ID NO: 3231875 - RNA, 17 nt, Human
guccuuaucuagcugca

SEQ ID NO: 3231876 - RNA, 16 nt, Human
guccuuaucuagcugc

SEQ ID NO: 3231877 - RNA, 22 nt, Human
aacaguuuaugcagugcugcuu

SEQ ID NO: 3231878 - RNA, 23 nt, Human
aacaguuuaugcagugcugcuuu

SEQ ID NO: 3231879 - RNA, 13 nt, Human
aacaguuucaaaa

SEQ ID NO: 3231880 - RNA, 21 nt, Human
aacaguacccugguugugugu

SEQ ID NO: 3231881 - RNA, 14 nt, Human
aacaguaaucaguu

SEQ ID NO: 3231882 - RNA, 15 nt, Human
aacagugcuguuucc

SEQ ID NO: 3231883 - RNA, 20 nt, Human
aacaguguggccucuucuga

SEQ ID NO: 3231884 - RNA, 22 nt, Human
aacaguagugauaguuguaccg

SEQ ID NO: 3231885 - RNA, 23 nt, Human
aacaggcugggcuucaguggcag

SEQ ID NO: 3231886 - RNA, 19 nt, Human
aacagguuuuccugaagaa

SEQ ID NO: 3231887 - RNA, 13 nt, Human
aacaggcugggcu

SEQ ID NO: 3231888 - RNA, 22 nt, Human
aacaggcugggcuucaguggca

SEQ ID NO: 3231889 - RNA, 19 nt, Human
aacagacuggaagcacagc

SEQ ID NO: 3231890 - RNA, 12 nt, Human
aacagaaauugg

SEQ ID NO: 3231891 - RNA, 14 nt, Human
aacagaaauuggua

SEQ ID NO: 3231892 - RNA, 13 nt, Human
aacagaaauuggu

SEQ ID NO: 3231893 - RNA, 22 nt, Human
aacagaaauugguaccuugcac

SEQ ID NO: 3231894 - RNA, 15 nt, Human
aacagaaauugguac

SEQ ID NO: 3231895 - RNA, 22 nt, Human
aacacuugugacuuuugcuuua

SEQ ID NO: 3231896 - RNA, 23 nt, Human
aacacuugugacuuuugcuuuaa

SEQ ID NO: 3231897 - RNA, 14 nt, Human
aacacuuuaauggg

SEQ ID NO: 3231898 - RNA, 13 nt, Human
guccgagcuuuga

SEQ ID NO: 3231899 - RNA, 15 nt, Human
gucccaacuuguaaa

SEQ ID NO: 3231900 - RNA, 19 nt, Human
aaccaaagcgaauuuuaaa

SEQ ID NO: 3231901 - RNA, 22 nt, Human
aaccaaaaguuauuaaaauugu

SEQ ID NO: 3231902 - RNA, 20 nt, Human
aaccaaaaguuauuaaaauu

SEQ ID NO: 3231903 - RNA, 18 nt, Human
aaccacaucuugcucugc

SEQ ID NO: 3231904 - RNA, 16 nt, Human
aaccacaaaacucauc

SEQ ID NO: 3231905 - RNA, 21 nt, Human
aaccaucauugaaaucuuuuu

SEQ ID NO: 3231906 - RNA, 19 nt, Human
aaccaucauugaaaucuuu

SEQ ID NO: 3231907 - RNA, 20 nt, Human
aaccaucauugaaaucuuuu

SEQ ID NO: 3231908 - RNA, 22 nt, Human
aaccacaucuugcucugcugac

SEQ ID NO: 3231909 - RNA, 20 nt, Human
aaccacaucuugcucugcug

SEQ ID NO: 3231910 - RNA, 16 nt, Human
gucucccucccuuggg

SEQ ID NO: 3231911 - RNA, 20 nt, Human
gucuccgaaaugcugucuuu

SEQ ID NO: 3231912 - RNA, 16 nt, Human
gucuccuacugaggau

SEQ ID NO: 3231913 - RNA, 16 nt, Human
aacauuuugucauaua

SEQ ID NO: 3231914 - RNA, 14 nt, Human
aaccaaaaagaaaa

SEQ ID NO: 3231915 - RNA, 20 nt, Human
gucuccucuauccugggcuu

SEQ ID NO: 3231916 - RNA, 15 nt, Human
gucuccucaggacca

SEQ ID NO: 3231917 - RNA, 14 nt, Human
gucuccucaggacc

SEQ ID NO: 3231918 - RNA, 22 nt, Human
gucucccccacccuuguuccag

SEQ ID NO: 3231919 - RNA, 20 nt, Human
gucucccccacccuuguucc

SEQ ID NO: 3231920 - RNA, 18 nt, Human
gucucccccacccuuguu

SEQ ID NO: 3231921 - RNA, 13 nt, Human
gucuccauguuug

SEQ ID NO: 3231922 - RNA, 19 nt, Human
gucucccauaugcagaaau

SEQ ID NO: 3231923 - RNA, 19 nt, Human
gucucaugcuccuuaaugg

SEQ ID NO: 3231924 - RNA, 18 nt, Human
gucucauagguuaaaaaa

SEQ ID NO: 3231925 - RNA, 22 nt, Human
gucucauaguuggacuuucuag

SEQ ID NO: 3231926 - RNA, 14 nt, Human
aaccuccugggcua

SEQ ID NO: 3231927 - RNA, 17 nt, Human
aaccuccgccucuuggg

SEQ ID NO: 3231928 - RNA, 12 nt, Human
aacccccagcuc

SEQ ID NO: 3231929 - RNA, 20 nt, Human
aaccuaguuaaagaaaggaa

SEQ ID NO: 3231930 - RNA, 21 nt, Human
aaccuaguuaaagaaaggaaa

SEQ ID NO: 3231931 - RNA, 22 nt, Human
aaccuaguuaaagaaaggaaaa

SEQ ID NO: 3231932 - RNA, 15 nt, Human
aacccccagccugcu

SEQ ID NO: 3231933 - RNA, 14 nt, Human
aacccccagccugc

SEQ ID NO: 3231934 - RNA, 13 nt, Human
aacccccagccug

SEQ ID NO: 3231935 - RNA, 20 nt, Human
aacccauauuuguacaccaa

SEQ ID NO: 3231936 - RNA, 17 nt, Human
aacccagcucuggucca

SEQ ID NO: 3231937 - RNA, 15 nt, Human
aacccagcuuacauu

SEQ ID NO: 3231938 - RNA, 23 nt, Human
aacccagcugcaccccuuccugg

SEQ ID NO: 3231939 - RNA, 21 nt, Human
aacccagcugcaccccuuccu

SEQ ID NO: 3231940 - RNA, 16 nt, Human
aacccagcugcacccc

SEQ ID NO: 3231941 - RNA, 15 nt, Human
aacccagcugcaccc

SEQ ID NO: 3231942 - RNA, 11 nt, Human
aacccagcugc

SEQ ID NO: 3231943 - RNA, 18 nt, Human
aacccaaauguucaucaa

SEQ ID NO: 3231944 - RNA, 11 nt, Human
aacccagcucu

SEQ ID NO: 3231945 - RNA, 13 nt, Human
aacccagcucugg

SEQ ID NO: 3231946 - RNA, 14 nt, Human
aacccagcucuggu

SEQ ID NO: 3231947 - RNA, 13 nt, Human
aacccaaauguuc

SEQ ID NO: 3231948 - RNA, 23 nt, Human
aaccauuuugcugucccuuuucc

SEQ ID NO: 3231949 - RNA, 14 nt, Human
aaccauuuuuguua

SEQ ID NO: 3231950 - RNA, 22 nt, Human
aaccauuuuuguuacucucuuc

SEQ ID NO: 3231951 - RNA, 13 nt, Human
aacucccuuucaa

SEQ ID NO: 3231952 - RNA, 14 nt, Human
aacucccuuucaac

SEQ ID NO: 3231953 - RNA, 15 nt, Human
gugaacacaucagcu

SEQ ID NO: 3231954 - RNA, 20 nt, Human
aacucuaaguguuugcugca

SEQ ID NO: 3231955 - RNA, 17 nt, Human
aacucuaaguguuugcu

SEQ ID NO: 3231956 - RNA, 19 nt, Human
gugaaccaccacacccagc

SEQ ID NO: 3231957 - RNA, 15 nt, Human
aacuaggcauuugua

SEQ ID NO: 3231958 - RNA, 17 nt, Human
aacuaggcauuuguaaa

SEQ ID NO: 3231959 - RNA, 18 nt, Human
aacuaggcauuuguaaau

SEQ ID NO: 3231960 - RNA, 23 nt, Human
aacuaggcauuuguaaauauuaa

SEQ ID NO: 3231961 - RNA, 23 nt, Human
aacuaggaaggcacuucugccug

SEQ ID NO: 3231962 - RNA, 13 nt, Human
aacucccugcccc

SEQ ID NO: 3231963 - RNA, 19 nt, Human
aacucccugccccccagcc

SEQ ID NO: 3231964 - RNA, 12 nt, Human
aacuccaugaug

SEQ ID NO: 3231965 - RNA, 18 nt, Human
aacuaggaaggcacuucu

SEQ ID NO: 3231966 - RNA, 20 nt, Human
aacuagauuacauucaguug

SEQ ID NO: 3231967 - RNA, 22 nt, Human
aacguggcugcuucaaggaucc

SEQ ID NO: 3231968 - RNA, 16 nt, Human
aacguggcugcuucaa

SEQ ID NO: 3231969 - RNA, 19 nt, Human
aacguggcugcuucaagga

SEQ ID NO: 3231970 - RNA, 15 nt, Human
aacguggcugcuuca

SEQ ID NO: 3231971 - RNA, 20 nt, Human
aaccugcucuccucuugcca

SEQ ID NO: 3231972 - RNA, 15 nt, Human
aaccugcucuccucu

SEQ ID NO: 3231973 - RNA, 11 nt, Human
aaccugcucuc

SEQ ID NO: 3231974 - RNA, 15 nt, Human
aacuaaaguuguacu

SEQ ID NO: 3231975 - RNA, 16 nt, Human
aacuaaaguuguacuu

SEQ ID NO: 3231976 - RNA, 19 nt, Human
aacuaaaguuguacuuuaa

SEQ ID NO: 3231977 - RNA, 17 nt, Human
aacuaaaguuguacuuu

SEQ ID NO: 3231978 - RNA, 22 nt, Human
aacuaauaaaauauuuucugug

SEQ ID NO: 3231979 - RNA, 23 nt, Human
aacuaauaaaauauuuucugugu

SEQ ID NO: 3231980 - RNA, 14 nt, Human
aacuaaauuuuaaa

SEQ ID NO: 3231981 - RNA, 16 nt, Human
aacuaaauuuuaaagc

SEQ ID NO: 3231982 - RNA, 18 nt, Human
aacuaaauuuuaaagcca

SEQ ID NO: 3231983 - RNA, 14 nt, Human
gucuggcugcagag

SEQ ID NO: 3231984 - RNA, 13 nt, Human
gucuggcugcaga

SEQ ID NO: 3231985 - RNA, 12 nt, Human
gucuggcugcag

SEQ ID NO: 3231986 - RNA, 15 nt, Human
gucuggcuucacaga

SEQ ID NO: 3231987 - RNA, 22 nt, Human
gucuuaauuaaaagaauauuuu

SEQ ID NO: 3231988 - RNA, 18 nt, Human
gucuuacauaaaccauuu

SEQ ID NO: 3231989 - RNA, 21 nt, Human
gucuuaauuaaaagaauauuu

SEQ ID NO: 3231990 - RNA, 19 nt, Human
gucuuaauuaaaagaauau

SEQ ID NO: 3231991 - RNA, 20 nt, Human
gucugcuggucacuucuucu

SEQ ID NO: 3231992 - RNA, 18 nt, Human
aaccucuagaauuuuaag

SEQ ID NO: 3231993 - RNA, 20 nt, Human
aaccucugauuuauuuugua

SEQ ID NO: 3231994 - RNA, 12 nt, Human
aaccucuuccuc

SEQ ID NO: 3231995 - RNA, 16 nt, Human
gucugcuccagcucug

SEQ ID NO: 3231996 - RNA, 14 nt, Human
gucugcuccagcuc

SEQ ID NO: 3231997 - RNA, 18 nt, Human
gucugcuccagcucuggc

SEQ ID NO: 3231998 - RNA, 23 nt, Human
gucuuccuauuucagaaguuuaa

SEQ ID NO: 3231999 - RNA, 20 nt, Human
gucuuccuauuucagaaguu

SEQ ID NO: 3232000 - RNA, 18 nt, Human
gucuuccuauuucagaag

SEQ ID NO: 3232001 - RNA, 16 nt, Human
gucuuccuauuucaga

SEQ ID NO: 3232002 - RNA, 22 nt, Human
gucuuccuacucuucucucugc

SEQ ID NO: 3232003 - RNA, 19 nt, Human
gucuuccuacucuucucuc

SEQ ID NO: 3232004 - RNA, 16 nt, Human
gucuuccuacucuucu

SEQ ID NO: 3232005 - RNA, 14 nt, Human
gucuuccuacucuu

SEQ ID NO: 3232006 - RNA, 15 nt, Human
gucuuccuccaaccc

SEQ ID NO: 3232007 - RNA, 15 nt, Human
gucuuagauguauau

SEQ ID NO: 3232008 - RNA, 18 nt, Human
gucuuagaucauaguuuu

SEQ ID NO: 3232009 - RNA, 14 nt, Human
gucuuuggacccug

SEQ ID NO: 3232010 - RNA, 15 nt, Human
gucuuuggacccuga

SEQ ID NO: 3232011 - RNA, 17 nt, Human
gucuuuggacccugagg

SEQ ID NO: 3232012 - RNA, 14 nt, Human
gucuuuucuugcau

SEQ ID NO: 3232013 - RNA, 19 nt, Human
gucuuuucuugcaugaggc

SEQ ID NO: 3232014 - RNA, 24 nt, Human
gucuuuucuugcaugaggcuagug

SEQ ID NO: 3232015 - RNA, 20 nt, Human
gucuuuucuuugccaucucu

SEQ ID NO: 3232016 - RNA, 19 nt, Human
gucuuuucuuugccaucuc

SEQ ID NO: 3232017 - RNA, 16 nt, Human
gucuuugagcucccac

SEQ ID NO: 3232018 - RNA, 15 nt, Human
gucuuuucuuugcca

SEQ ID NO: 3232019 - RNA, 17 nt, Human
gucuuuuccucgcuucu

SEQ ID NO: 3232020 - RNA, 18 nt, Human
guauguggaagugugggu

SEQ ID NO: 3232021 - RNA, 21 nt, Human
guauguggaagugugggucug

SEQ ID NO: 3232022 - RNA, 19 nt, Human
guaugugggggucugugug

SEQ ID NO: 3232023 - RNA, 20 nt, Human
guaugugggggucugugugu

SEQ ID NO: 3232024 - RNA, 16 nt, Human
guauguggaagugugg

SEQ ID NO: 3232025 - RNA, 17 nt, Human
guauguggaaguguggg

SEQ ID NO: 3232026 - RNA, 15 nt, Human
guauguggaagugug

SEQ ID NO: 3232027 - RNA, 15 nt, Human
guaugggagagaaga

SEQ ID NO: 3232028 - RNA, 16 nt, Human
guaugggacuggccuc

SEQ ID NO: 3232029 - RNA, 14 nt, Human
guauucucuuuuca

SEQ ID NO: 3232030 - RNA, 12 nt, Human
guauucucuuuu

SEQ ID NO: 3232031 - RNA, 15 nt, Human
guauucugucuucau

SEQ ID NO: 3232032 - RNA, 18 nt, Human
guauucucuuuucaagaa

SEQ ID NO: 3232033 - RNA, 15 nt, Human
guauucuuauuuaau

SEQ ID NO: 3232034 - RNA, 16 nt, Human
guauugccaaacauua

SEQ ID NO: 3232035 - RNA, 15 nt, Human
guauugccaaacauu

SEQ ID NO: 3232036 - RNA, 16 nt, Human
guaugcacaauuccau

SEQ ID NO: 3232037 - RNA, 15 nt, Human
guaugcaguguagau

SEQ ID NO: 3232038 - RNA, 19 nt, Human
guaugcaguguagauuuua

SEQ ID NO: 3232039 - RNA, 15 nt, Human
guaugcacaauucca

SEQ ID NO: 3232040 - RNA, 23 nt, Human
guaugcaagcaguuucaauaaag

SEQ ID NO: 3232041 - RNA, 18 nt, Human
guaugcaagcaguuucaa

SEQ ID NO: 3232042 - RNA, 15 nt, Human
guaugcaagcaguuu

SEQ ID NO: 3232043 - RNA, 20 nt, Human
guauggaagguggagcguuc

SEQ ID NO: 3232044 - RNA, 14 nt, Human
guaugggagagaag

SEQ ID NO: 3232045 - RNA, 21 nt, Human
guauggcuuuauuuuuuugaa

SEQ ID NO: 3232046 - RNA, 22 nt, Human
guauggcuuuauuuuuuugaac

SEQ ID NO: 3232047 - RNA, 21 nt, Human
guaucccaugagccucagcau

SEQ ID NO: 3232048 - RNA, 19 nt, Human
guaucaaucuuuagaaaag

SEQ ID NO: 3232049 - RNA, 19 nt, Human
guaucaacacacauuuuaa

SEQ ID NO: 3232050 - RNA, 22 nt, Human
guaucagagauguccauuuuua

SEQ ID NO: 3232051 - RNA, 22 nt, Human
guaugaucacggcucacugcag

SEQ ID NO: 3232052 - RNA, 21 nt, Human
guauaaagaauaggacuuguu

SEQ ID NO: 3232053 - RNA, 12 nt, Human
guauaaacuuuu

SEQ ID NO: 3232054 - RNA, 22 nt, Human
guauaaagaauaggacuuguuu

SEQ ID NO: 3232055 - RNA, 18 nt, Human
guauaaaggcauugauau

SEQ ID NO: 3232056 - RNA, 17 nt, Human
guauauucuauuuuaca

SEQ ID NO: 3232057 - RNA, 18 nt, Human
guauauucuauuuuacaa

SEQ ID NO: 3232058 - RNA, 19 nt, Human
guaucaaauacauuuaaaa

SEQ ID NO: 3232059 - RNA, 14 nt, Human
guauauuauaauag

SEQ ID NO: 3232060 - RNA, 12 nt, Human
guauauuauaau

SEQ ID NO: 3232061 - RNA, 22 nt, Human
guauaaauugucuuuaaaaacu

SEQ ID NO: 3232062 - RNA, 23 nt, Human
guauaaauuuauuuacugcuagu

SEQ ID NO: 3232063 - RNA, 14 nt, Human
guauaaauuuauuu

SEQ ID NO: 3232064 - RNA, 13 nt, Human
guauaaauuuauu

SEQ ID NO: 3232065 - RNA, 12 nt, Human
guauaaauuuau

SEQ ID NO: 3232066 - RNA, 17 nt, Human
guaguucuguauuugaa

SEQ ID NO: 3232067 - RNA, 18 nt, Human
guaguucuguauuugaaa

SEQ ID NO: 3232068 - RNA, 20 nt, Human
guaguucuguauuugaaagu

SEQ ID NO: 3232069 - RNA, 14 nt, Human
guaguucuuuaaac

SEQ ID NO: 3232070 - RNA, 16 nt, Human
guaguucuaccggcuu

SEQ ID NO: 3232071 - RNA, 14 nt, Human
guaguucuguauuu

SEQ ID NO: 3232072 - RNA, 15 nt, Human
guaguucuguauuug

SEQ ID NO: 3232073 - RNA, 16 nt, Human
guaguucuguauuuga

SEQ ID NO: 3232074 - RNA, 20 nt, Human
aaauguaauguggcuucugg

SEQ ID NO: 3232075 - RNA, 16 nt, Human
aaauguacauguauua

SEQ ID NO: 3232076 - RNA, 14 nt, Human
aaauguacauguau

SEQ ID NO: 3232077 - RNA, 13 nt, Human
aaauguacaugua

SEQ ID NO: 3232078 - RNA, 12 nt, Human
aaauguacaugu

SEQ ID NO: 3232079 - RNA, 23 nt, Human
aaauguacauguauuaaauuaca

SEQ ID NO: 3232080 - RNA, 17 nt, Human
aaauguacauguauuaa

SEQ ID NO: 3232081 - RNA, 17 nt, Human
aaauguagcuucaguca

SEQ ID NO: 3232082 - RNA, 19 nt, Human
aaauguagcuucagucauu

SEQ ID NO: 3232083 - RNA, 21 nt, Human
aaauguagcuucagucauuaa

SEQ ID NO: 3232084 - RNA, 22 nt, Human
aaauguagcuucagucauuaaa

SEQ ID NO: 3232085 - RNA, 20 nt, Human
guaguucaagaaaugaagag

SEQ ID NO: 3232086 - RNA, 19 nt, Human
guaguucaagaaaugaaga

SEQ ID NO: 3232087 - RNA, 15 nt, Human
guaguucaagaaaug

SEQ ID NO: 3232088 - RNA, 16 nt, Human
aaauguaagggaaacu

SEQ ID NO: 3232089 - RNA, 22 nt, Human
aaauguaagggaaacugccagc

SEQ ID NO: 3232090 - RNA, 15 nt, Human
aaauguuaaagaugu

SEQ ID NO: 3232091 - RNA, 12 nt, Human
aaauguuaaaga

SEQ ID NO: 3232092 - RNA, 24 nt, Human
guauugccaaacauuaauguugau

SEQ ID NO: 3232093 - RNA, 23 nt, Human
guauugccaaacauuaauguuga

SEQ ID NO: 3232094 - RNA, 21 nt, Human
guauugccaaacauuaauguu

SEQ ID NO: 3232095 - RNA, 17 nt, Human
guauugccaaacauuaa

SEQ ID NO: 3232096 - RNA, 19 nt, Human
guauuuaagccuaaagauu

SEQ ID NO: 3232097 - RNA, 17 nt, Human
guauuuaagccuaaaga

SEQ ID NO: 3232098 - RNA, 12 nt, Human
guauuuaagccu

SEQ ID NO: 3232099 - RNA, 20 nt, Human
aaauuacguacuaaggauac

SEQ ID NO: 3232100 - RNA, 14 nt, Human
aaauuacuguguua

SEQ ID NO: 3232101 - RNA, 15 nt, Human
aaauuacuauagcaa

SEQ ID NO: 3232102 - RNA, 19 nt, Human
aaauuacuauagcaaagua

SEQ ID NO: 3232103 - RNA, 23 nt, Human
aaauguuauguauauggugguaa

SEQ ID NO: 3232104 - RNA, 14 nt, Human
aaauguuauguaua

SEQ ID NO: 3232105 - RNA, 13 nt, Human
aaauguuauguau

SEQ ID NO: 3232106 - RNA, 12 nt, Human
aaauguuaugua

SEQ ID NO: 3232107 - RNA, 16 nt, Human
aaauguuaaagaugua

SEQ ID NO: 3232108 - RNA, 21 nt, Human
aaauguuaaagauguagcaaa

SEQ ID NO: 3232109 - RNA, 13 nt, Human
aaauguuaacaau

SEQ ID NO: 3232110 - RNA, 23 nt, Human
aaauguuaacaaugccuauugua

SEQ ID NO: 3232111 - RNA, 20 nt, Human
aaauguuaaguugaugguga

SEQ ID NO: 3232112 - RNA, 18 nt, Human
aaauuauaggagacuugu

SEQ ID NO: 3232113 - RNA, 19 nt, Human
aaauuagauccuaagaugu

SEQ ID NO: 3232114 - RNA, 20 nt, Human
aaauuagauccuaagaugug

SEQ ID NO: 3232115 - RNA, 11 nt, Human
aaauuagaaaa

SEQ ID NO: 3232116 - RNA, 12 nt, Human
aaauuagaaaau

SEQ ID NO: 3232117 - RNA, 13 nt, Human
aaauuagaaaaua

SEQ ID NO: 3232118 - RNA, 15 nt, Human
aaauuagaaaauauu

SEQ ID NO: 3232119 - RNA, 17 nt, Human
aaauuagaaaauauucu

SEQ ID NO: 3232120 - RNA, 19 nt, Human
aaauuagaaaauauucucu

SEQ ID NO: 3232121 - RNA, 12 nt, Human
aaauuauauucc

SEQ ID NO: 3232122 - RNA, 14 nt, Human
aaauucaugcugcu

SEQ ID NO: 3232123 - RNA, 18 nt, Human
aaauucauggcaugcuua

SEQ ID NO: 3232124 - RNA, 21 nt, Human
aaauucauggcaugcuuaaau

SEQ ID NO: 3232125 - RNA, 20 nt, Human
aaauucaguuuuuuuccagu

SEQ ID NO: 3232126 - RNA, 14 nt, Human
aaauucccuaaagc

SEQ ID NO: 3232127 - RNA, 15 nt, Human
aaauucccuaaagcc

SEQ ID NO: 3232128 - RNA, 16 nt, Human
aaauuccccacccuga

SEQ ID NO: 3232129 - RNA, 21 nt, Human
aaauucccuuuucaccuuuuc

SEQ ID NO: 3232130 - RNA, 20 nt, Human
aaauuucgcuucuuagaaca

SEQ ID NO: 3232131 - RNA, 21 nt, Human
aaauuuacuacaauauguaca

SEQ ID NO: 3232132 - RNA, 19 nt, Human
aaauuccucaacaguguuu

SEQ ID NO: 3232133 - RNA, 19 nt, Human
gucaaaguggugagaggca

SEQ ID NO: 3232134 - RNA, 18 nt, Human
gucaaaguggugagaggc

SEQ ID NO: 3232135 - RNA, 17 nt, Human
guauuuuuguauucaau

SEQ ID NO: 3232136 - RNA, 17 nt, Human
guauuuuuuaaugcuaa

SEQ ID NO: 3232137 - RNA, 20 nt, Human
gucacacaguauuacuucug

SEQ ID NO: 3232138 - RNA, 16 nt, Human
gucacacacuuuggcu

SEQ ID NO: 3232139 - RNA, 15 nt, Human
gucacaaauuucucu

SEQ ID NO: 3232140 - RNA, 14 nt, Human
gucaacuacacaaa

SEQ ID NO: 3232141 - RNA, 16 nt, Human
gucaaaugcuagaaaa

SEQ ID NO: 3232142 - RNA, 16 nt, Human
guaggaacugcugggc

SEQ ID NO: 3232143 - RNA, 15 nt, Human
guaggaagacuuugg

SEQ ID NO: 3232144 - RNA, 16 nt, Human
guagcuuaagaaaaaa

SEQ ID NO: 3232145 - RNA, 15 nt, Human
guagcuuaagaaaaa

SEQ ID NO: 3232146 - RNA, 13 nt, Human
guagcuuugcacu

SEQ ID NO: 3232147 - RNA, 11 nt, Human
guagcuuugca

SEQ ID NO: 3232148 - RNA, 18 nt, Human
guaggaagguuaauguuc

SEQ ID NO: 3232149 - RNA, 16 nt, Human
guaggaauauuauauu

SEQ ID NO: 3232150 - RNA, 21 nt, Human
guaggacaaggugcaggcagg

SEQ ID NO: 3232151 - RNA, 20 nt, Human
guaggacaaggugcaggcag

SEQ ID NO: 3232152 - RNA, 21 nt, Human
guaggaauauuauauuuggau

SEQ ID NO: 3232153 - RNA, 20 nt, Human
guaggaauauuauauuugga

SEQ ID NO: 3232154 - RNA, 19 nt, Human
guaggaauauuauauuugg

SEQ ID NO: 3232155 - RNA, 18 nt, Human
guaggaauauuauauuug

SEQ ID NO: 3232156 - RNA, 17 nt, Human
guaggaauauuauauuu

SEQ ID NO: 3232157 - RNA, 13 nt, Human
guaggauuacuag

SEQ ID NO: 3232158 - RNA, 22 nt, Human
guaggauaugccugcucuuugg

SEQ ID NO: 3232159 - RNA, 14 nt, Human
guaggauaugccug

SEQ ID NO: 3232160 - RNA, 18 nt, Human
guaggcaagauggcacag

SEQ ID NO: 3232161 - RNA, 15 nt, Human
guaggaguucuauuu

SEQ ID NO: 3232162 - RNA, 22 nt, Human
guaggcagccugagagucuaga

SEQ ID NO: 3232163 - RNA, 21 nt, Human
guagcugggacuacaggcacc

SEQ ID NO: 3232164 - RNA, 18 nt, Human
guagcugggauuacaggc

SEQ ID NO: 3232165 - RNA, 14 nt, Human
guagcuucagucau

SEQ ID NO: 3232166 - RNA, 16 nt, Human
guagcuucagucauua

SEQ ID NO: 3232167 - RNA, 21 nt, Human
guagcuucagucauuaaauua

SEQ ID NO: 3232168 - RNA, 20 nt, Human
guagcuguaaggcaugaagg

SEQ ID NO: 3232169 - RNA, 19 nt, Human
guagcugggacuacaggca

SEQ ID NO: 3232170 - RNA, 18 nt, Human
guagcugggacuacaggc

SEQ ID NO: 3232171 - RNA, 12 nt, Human
guagcugggacu

SEQ ID NO: 3232172 - RNA, 22 nt, Human
guagcugggaaagcauaaagcu

SEQ ID NO: 3232173 - RNA, 22 nt, Human
guagcucuaggagggcuggcaa

SEQ ID NO: 3232174 - RNA, 16 nt, Human
guagcugcaaaaauaa

SEQ ID NO: 3232175 - RNA, 13 nt, Human
aaaggacugugau

SEQ ID NO: 3232176 - RNA, 24 nt, Human
aaaggaguuucuuuagcugacaga

SEQ ID NO: 3232177 - RNA, 19 nt, Human
aaaggagacuguguuuggu

SEQ ID NO: 3232178 - RNA, 17 nt, Human
aaaugaaaaucgugaca

SEQ ID NO: 3232179 - RNA, 11 nt, Human
aaaugaaaauu

SEQ ID NO: 3232180 - RNA, 16 nt, Human
aaaucuaugauuccag

SEQ ID NO: 3232181 - RNA, 14 nt, Human
aaaucuaugauucc

SEQ ID NO: 3232182 - RNA, 22 nt, Human
aaaucuauagaaaguguucugu

SEQ ID NO: 3232183 - RNA, 13 nt, Human
aaaucuauagaaa

SEQ ID NO: 3232184 - RNA, 19 nt, Human
aaaucuauagaaaguguuc

SEQ ID NO: 3232185 - RNA, 17 nt, Human
aaaucuauagaaagugu

SEQ ID NO: 3232186 - RNA, 15 nt, Human
aaaucuauagaaagu

SEQ ID NO: 3232187 - RNA, 14 nt, Human
aaaucuauagaaag

SEQ ID NO: 3232188 - RNA, 18 nt, Human
aaaucuagaagagucuau

SEQ ID NO: 3232189 - RNA, 19 nt, Human
aaaucuacacuccagugag

SEQ ID NO: 3232190 - RNA, 15 nt, Human
aaaucuaagcugugu

SEQ ID NO: 3232191 - RNA, 15 nt, Human
aaaucuaacauuauu

SEQ ID NO: 3232192 - RNA, 13 nt, Human
aaaucgaugcagu

SEQ ID NO: 3232193 - RNA, 15 nt, Human
aaaucccauuuaaaa

SEQ ID NO: 3232194 - RNA, 18 nt, Human
aaaucccuuaccucggug

SEQ ID NO: 3232195 - RNA, 21 nt, Human
aaaugcaugauugcagaauug

SEQ ID NO: 3232196 - RNA, 18 nt, Human
aaaugcaugauugcagaa

SEQ ID NO: 3232197 - RNA, 18 nt, Human
aaaugcaucuuugaugug

SEQ ID NO: 3232198 - RNA, 19 nt, Human
aaaugcaucuuugaugugu

SEQ ID NO: 3232199 - RNA, 20 nt, Human
aaaugcaucuuugauguguu

SEQ ID NO: 3232200 - RNA, 21 nt, Human
aaaugcaucuuugauguguug

SEQ ID NO: 3232201 - RNA, 15 nt, Human
aaaugcaucuuugau

SEQ ID NO: 3232202 - RNA, 16 nt, Human
aaaugcaucuuugaug

SEQ ID NO: 3232203 - RNA, 14 nt, Human
aaaugcaucuuuga

SEQ ID NO: 3232204 - RNA, 17 nt, Human
aaaugcaguuacaaauu

SEQ ID NO: 3232205 - RNA, 22 nt, Human
aaaugcaaaaaaucuuaauacu

SEQ ID NO: 3232206 - RNA, 20 nt, Human
aaaugcaaaaaaucuuaaua

SEQ ID NO: 3232207 - RNA, 22 nt, Human
aaaugcaaacugggcuggaaga

SEQ ID NO: 3232208 - RNA, 21 nt, Human
aaaugauuuaaauuuaaguaa

SEQ ID NO: 3232209 - RNA, 23 nt, Human
aaaugauugcuuuuaaaauuuua

SEQ ID NO: 3232210 - RNA, 22 nt, Human
aaaugauugcuuuuaaaauuuu

SEQ ID NO: 3232211 - RNA, 20 nt, Human
aaaugauugcuuuuaaaauu

SEQ ID NO: 3232212 - RNA, 17 nt, Human
aaaugauugcuuuuaaa

SEQ ID NO: 3232213 - RNA, 16 nt, Human
aaaugauugcuuuuaa

SEQ ID NO: 3232214 - RNA, 19 nt, Human
aaaugaugugccugcuuca

SEQ ID NO: 3232215 - RNA, 13 nt, Human
aaaugcccagccc

SEQ ID NO: 3232216 - RNA, 13 nt, Human
aaaugcccagcuu

SEQ ID NO: 3232217 - RNA, 18 nt, Human
aaaugcccagccccuucu

SEQ ID NO: 3232218 - RNA, 14 nt, Human
aaaugcccagcccc

SEQ ID NO: 3232219 - RNA, 15 nt, Human
aaaugcccagccccu

SEQ ID NO: 3232220 - RNA, 18 nt, Human
aaaugggcagagcagaga

SEQ ID NO: 3232221 - RNA, 20 nt, Human
aaaugggcagagcagagacc

SEQ ID NO: 3232222 - RNA, 15 nt, Human
aaaugggcagagcag

SEQ ID NO: 3232223 - RNA, 21 nt, Human
aaaugccuccaaaguauugua

SEQ ID NO: 3232224 - RNA, 21 nt, Human
aaauggcuucggacaaaauau

SEQ ID NO: 3232225 - RNA, 23 nt, Human
aaauggcuucggacaaaauaucu

SEQ ID NO: 3232226 - RNA, 13 nt, Human
aaaugagccuggc

SEQ ID NO: 3232227 - RNA, 19 nt, Human
aaaugagccuggcaagaau

SEQ ID NO: 3232228 - RNA, 18 nt, Human
aaaugagcuugauuaaau

SEQ ID NO: 3232229 - RNA, 19 nt, Human
aaaugagcuugauuaaauc

SEQ ID NO: 3232230 - RNA, 9 nt, Human
aaaugaggg

SEQ ID NO: 3232231 - RNA, 22 nt, Human
aaaugaguccaaacuggaauga

SEQ ID NO: 3232232 - RNA, 23 nt, Human
aaaugagguacucuccuggaaau

SEQ ID NO: 3232233 - RNA, 16 nt, Human
aaaugagguacucucc

SEQ ID NO: 3232234 - RNA, 19 nt, Human
aaaugaggucagagccugc

SEQ ID NO: 3232235 - RNA, 17 nt, Human
aaaugaggucagagccu

SEQ ID NO: 3232236 - RNA, 14 nt, Human
aaaugacuuuauua

SEQ ID NO: 3232237 - RNA, 15 nt, Human
aaaugacuuuauuau

SEQ ID NO: 3232238 - RNA, 18 nt, Human
aaaugacuuuauuauuua

SEQ ID NO: 3232239 - RNA, 20 nt, Human
aaaugacuuuauuauuuauu

SEQ ID NO: 3232240 - RNA, 21 nt, Human
aaaugacuuuauuauuuauuu

SEQ ID NO: 3232241 - RNA, 21 nt, Human
aaaugaauaaugccuuuguaa

SEQ ID NO: 3232242 - RNA, 22 nt, Human
aaaugacaccaucuuuuauucu

SEQ ID NO: 3232243 - RNA, 21 nt, Human
aaaugaaagcagggacuugaa

SEQ ID NO: 3232244 - RNA, 22 nt, Human
aaaugaaagcagggacuugaac

SEQ ID NO: 3232245 - RNA, 15 nt, Human
aaaugaaauguaugc

SEQ ID NO: 3232246 - RNA, 14 nt, Human
aaaugaacaucuau

SEQ ID NO: 3232247 - RNA, 18 nt, Human
aaaugaacacaaauuaug

SEQ ID NO: 3232248 - RNA, 16 nt, Human
aaaugaacacaaauua

SEQ ID NO: 3232249 - RNA, 15 nt, Human
aaaugaacacaaauu

SEQ ID NO: 3232250 - RNA, 13 nt, Human
aaaugaacacaaa

SEQ ID NO: 3232251 - RNA, 19 nt, Human
aaaugaagagcuguugaug

SEQ ID NO: 3232252 - RNA, 16 nt, Human
aaaugaagaauuuaaa

SEQ ID NO: 3232253 - RNA, 18 nt, Human
aaaugaagaauuuaaaga

SEQ ID NO: 3232254 - RNA, 13 nt, Human
aaaugaagaauuu

SEQ ID NO: 3232255 - RNA, 15 nt, Human
aaaugaagaauuuaa

SEQ ID NO: 3232256 - RNA, 23 nt, Human
guguuuccuggcacugcuuccag

SEQ ID NO: 3232257 - RNA, 16 nt, Human
guguugugcuuucaag

SEQ ID NO: 3232258 - RNA, 16 nt, Human
guguugcuuauguugu

SEQ ID NO: 3232259 - RNA, 12 nt, Human
guguuggaaaaa

SEQ ID NO: 3232260 - RNA, 17 nt, Human
guguugccacuuuccaa

SEQ ID NO: 3232261 - RNA, 18 nt, Human
guguguaugcgugugugu

SEQ ID NO: 3232262 - RNA, 17 nt, Human
gugucuuuccacuccuc

SEQ ID NO: 3232263 - RNA, 15 nt, Human
gugucuuucuaagaa

SEQ ID NO: 3232264 - RNA, 16 nt, Human
gugucuuucuaagaaa

SEQ ID NO: 3232265 - RNA, 21 nt, Human
gugucuuucuaagaaaucaag

SEQ ID NO: 3232266 - RNA, 15 nt, Human
gugucuuucucuuuu

SEQ ID NO: 3232267 - RNA, 18 nt, Human
gugucuugcaauggcagc

SEQ ID NO: 3232268 - RNA, 17 nt, Human
gugucuugcaauggcag

SEQ ID NO: 3232269 - RNA, 12 nt, Human
aagcaaucaaga

SEQ ID NO: 3232270 - RNA, 14 nt, Human
aagcaauauuguau

SEQ ID NO: 3232271 - RNA, 17 nt, Human
aagcaauauuguauauu

SEQ ID NO: 3232272 - RNA, 14 nt, Human
guguguaauuuaaa

SEQ ID NO: 3232273 - RNA, 13 nt, Human
gugugaggcagga

SEQ ID NO: 3232274 - RNA, 16 nt, Human
guguguagauaguaug

SEQ ID NO: 3232275 - RNA, 21 nt, Human
gugugaccacugcagaagaca

SEQ ID NO: 3232276 - RNA, 17 nt, Human
gugugacuacuccccca

SEQ ID NO: 3232277 - RNA, 18 nt, Human
gugucuuuuuucacuaca

SEQ ID NO: 3232278 - RNA, 17 nt, Human
gugugaaaaugugugug

SEQ ID NO: 3232279 - RNA, 12 nt, Human
gugguuuggaau

SEQ ID NO: 3232280 - RNA, 16 nt, Human
gugguuuguggcuuua

SEQ ID NO: 3232281 - RNA, 21 nt, Human
aagagguuuggcuccugccca

SEQ ID NO: 3232282 - RNA, 14 nt, Human
gugguuuucuguuu

SEQ ID NO: 3232283 - RNA, 16 nt, Human
gugguuuucuguuucu

SEQ ID NO: 3232284 - RNA, 17 nt, Human
gugguuuucuguuucua

SEQ ID NO: 3232285 - RNA, 18 nt, Human
aagagguuuuaaaaaaau

SEQ ID NO: 3232286 - RNA, 19 nt, Human
aagauauacuuguuuuugu

SEQ ID NO: 3232287 - RNA, 16 nt, Human
aagauauacuuguuuu

SEQ ID NO: 3232288 - RNA, 15 nt, Human
aagauauacuuguuu

SEQ ID NO: 3232289 - RNA, 12 nt, Human
aagaugcagccg

SEQ ID NO: 3232290 - RNA, 13 nt, Human
aagauauuccuga

SEQ ID NO: 3232291 - RNA, 19 nt, Human
aagauauuugcaguuuuuc

SEQ ID NO: 3232292 - RNA, 20 nt, Human
aagauauuugcaguuuuuca

SEQ ID NO: 3232293 - RNA, 12 nt, Human
aagauauuuuau

SEQ ID NO: 3232294 - RNA, 21 nt, Human
aagauauacuuguuuuuguaa

SEQ ID NO: 3232295 - RNA, 12 nt, Human
aagcaaaggaga

SEQ ID NO: 3232296 - RNA, 13 nt, Human
aagcaaaggagau

SEQ ID NO: 3232297 - RNA, 22 nt, Human
aagcaagaggcaagcugaaauu

SEQ ID NO: 3232298 - RNA, 23 nt, Human
aagcaagaggcaagcugaaauuu

SEQ ID NO: 3232299 - RNA, 14 nt, Human
aagaugugacaugu

SEQ ID NO: 3232300 - RNA, 18 nt, Human
aagaugugacauguuuua

SEQ ID NO: 3232301 - RNA, 22 nt, Human
aagcaaacugguuauuuaaaau

SEQ ID NO: 3232302 - RNA, 22 nt, Human
aagcaaagacuuuccucuuagu

SEQ ID NO: 3232303 - RNA, 21 nt, Human
aagcaaagcacccauuucaau

SEQ ID NO: 3232304 - RNA, 23 nt, Human
aagaugucucagguuuguuuugu

SEQ ID NO: 3232305 - RNA, 15 nt, Human
guggggggcuucaua

SEQ ID NO: 3232306 - RNA, 20 nt, Human
gugggggccccgucucaggu

SEQ ID NO: 3232307 - RNA, 19 nt, Human
gugggggccccgucucagg

SEQ ID NO: 3232308 - RNA, 16 nt, Human
guggggggcuucauac

SEQ ID NO: 3232309 - RNA, 20 nt, Human
gugggggaucacagccucug

SEQ ID NO: 3232310 - RNA, 21 nt, Human
gugggaguaguuggagcauug

SEQ ID NO: 3232311 - RNA, 14 nt, Human
guggguacgggagg

SEQ ID NO: 3232312 - RNA, 12 nt, Human
guggggggaggc

SEQ ID NO: 3232313 - RNA, 14 nt, Human
gugggggggcagag

SEQ ID NO: 3232314 - RNA, 15 nt, Human
gugggggggcagagc

SEQ ID NO: 3232315 - RNA, 13 nt, Human
gugggucugugug

SEQ ID NO: 3232316 - RNA, 14 nt, Human
gugggucuggagga

SEQ ID NO: 3232317 - RNA, 16 nt, Human
gugggucugugugugu

SEQ ID NO: 3232318 - RNA, 21 nt, Human
guggugggcauucucucucca

SEQ ID NO: 3232319 - RNA, 13 nt, Human
gugggagugugua

SEQ ID NO: 3232320 - RNA, 14 nt, Human
gugggaguguguaa

SEQ ID NO: 3232321 - RNA, 13 nt, Human
gugggagugggcc

SEQ ID NO: 3232322 - RNA, 14 nt, Human
gugggagugggccc

SEQ ID NO: 3232323 - RNA, 23 nt, Human
gugggaggaucucuugagccugg

SEQ ID NO: 3232324 - RNA, 22 nt, Human
gugggacacccugugauggggc

SEQ ID NO: 3232325 - RNA, 22 nt, Human
guggcgcagcauauucaggaag

SEQ ID NO: 3232326 - RNA, 23 nt, Human
guggcgcagcauauucaggaagc

SEQ ID NO: 3232327 - RNA, 17 nt, Human
aagacuguacaaaguag

SEQ ID NO: 3232328 - RNA, 16 nt, Human
aagacuguacaaagua

SEQ ID NO: 3232329 - RNA, 18 nt, Human
aagacuaucuaaauguug

SEQ ID NO: 3232330 - RNA, 17 nt, Human
aagacuaucuaaauguu

SEQ ID NO: 3232331 - RNA, 16 nt, Human
aagacuaucuaaaugu

SEQ ID NO: 3232332 - RNA, 23 nt, Human
aagaccuggggcugcugugaagc

SEQ ID NO: 3232333 - RNA, 18 nt, Human
aagacccuugugguccca

SEQ ID NO: 3232334 - RNA, 21 nt, Human
aagacccuuguggucccaccc

SEQ ID NO: 3232335 - RNA, 22 nt, Human
aagacccuuguggucccacccc

SEQ ID NO: 3232336 - RNA, 22 nt, Human
aagaccuaaccagggccagaag

SEQ ID NO: 3232337 - RNA, 19 nt, Human
aagagcuguucacagccag

SEQ ID NO: 3232338 - RNA, 13 nt, Human
aagagccuuaaaa

SEQ ID NO: 3232339 - RNA, 14 nt, Human
aagagccuuaaaac

SEQ ID NO: 3232340 - RNA, 16 nt, Human
aagagccuuaaaacau

SEQ ID NO: 3232341 - RNA, 12 nt, Human
aagagcuuuccu

SEQ ID NO: 3232342 - RNA, 21 nt, Human
aagagcuuagaaacuggaaau

SEQ ID NO: 3232343 - RNA, 19 nt, Human
aagagcuuagaaacuggaa

SEQ ID NO: 3232344 - RNA, 14 nt, Human
aagagcuuagaaac

SEQ ID NO: 3232345 - RNA, 16 nt, Human
aagagcuuaacagugu

SEQ ID NO: 3232346 - RNA, 13 nt, Human
aagagcuuagaaa

SEQ ID NO: 3232347 - RNA, 17 nt, Human
guggcccgacagccugg

SEQ ID NO: 3232348 - RNA, 22 nt, Human
guggcccgguugaacucacucc

SEQ ID NO: 3232349 - RNA, 19 nt, Human
guggcccgacagccuggca

SEQ ID NO: 3232350 - RNA, 18 nt, Human
guggcccgacagccuggc

SEQ ID NO: 3232351 - RNA, 19 nt, Human
aagaggaaaauauugacaa

SEQ ID NO: 3232352 - RNA, 16 nt, Human
aagaggaaaagaaauc

SEQ ID NO: 3232353 - RNA, 13 nt, Human
aagaggaaaagaa

SEQ ID NO: 3232354 - RNA, 22 nt, Human
aagacuuaaagggcccaaugaa

SEQ ID NO: 3232355 - RNA, 24 nt, Human
aagacuuaaagggcccaaugaauu

SEQ ID NO: 3232356 - RNA, 12 nt, Human
aagacuucaaaa

SEQ ID NO: 3232357 - RNA, 21 nt, Human
aagacuucaaaauauugagca

SEQ ID NO: 3232358 - RNA, 21 nt, Human
aagagauuuaaacucugaauu

SEQ ID NO: 3232359 - RNA, 17 nt, Human
aagagcaaggaagguaa

SEQ ID NO: 3232360 - RNA, 16 nt, Human
gugcucaaaaugcaaa

SEQ ID NO: 3232361 - RNA, 23 nt, Human
gugcuauuguagagccagagguc

SEQ ID NO: 3232362 - RNA, 24 nt, Human
gugcuauuacgaaguucaagauca

SEQ ID NO: 3232363 - RNA, 13 nt, Human
gugcuauuaauau

SEQ ID NO: 3232364 - RNA, 14 nt, Human
gugcuauuaauauu

SEQ ID NO: 3232365 - RNA, 12 nt, Human
gugcuauguucu

SEQ ID NO: 3232366 - RNA, 19 nt, Human
gugcuaucucccccagccc

SEQ ID NO: 3232367 - RNA, 22 nt, Human
gugcuaucucccccagccccau

SEQ ID NO: 3232368 - RNA, 14 nt, Human
guggaagugugggu

SEQ ID NO: 3232369 - RNA, 15 nt, Human
guggaaguguggguc

SEQ ID NO: 3232370 - RNA, 19 nt, Human
guggaagugugggucugug

SEQ ID NO: 3232371 - RNA, 20 nt, Human
guggaagugugggucugugu

SEQ ID NO: 3232372 - RNA, 20 nt, Human
gugcugggauuacaggugug

SEQ ID NO: 3232373 - RNA, 20 nt, Human
gugcugggauuacaggcgug

SEQ ID NO: 3232374 - RNA, 22 nt, Human
gugcugggauuacaagcgugag

SEQ ID NO: 3232375 - RNA, 21 nt, Human
gugcugggauuacaagcguga

SEQ ID NO: 3232376 - RNA, 17 nt, Human
guggacacagcucuucu

SEQ ID NO: 3232377 - RNA, 22 nt, Human
guggacacagcucuucuccagg

SEQ ID NO: 3232378 - RNA, 18 nt, Human
guggacacagcucuucuc

SEQ ID NO: 3232379 - RNA, 15 nt, Human
guggaauuauuuuaa

SEQ ID NO: 3232380 - RNA, 18 nt, Human
guggaauuauuuuaaaag

SEQ ID NO: 3232381 - RNA, 16 nt, Human
guggaauuauuuuaaa

SEQ ID NO: 3232382 - RNA, 21 nt, Human
guggaagugugggucugugug

SEQ ID NO: 3232383 - RNA, 22 nt, Human
guggaagugugggucugugugu

SEQ ID NO: 3232384 - RNA, 20 nt, Human
guggaugccugguggcagcu

SEQ ID NO: 3232385 - RNA, 23 nt, Human
guggacccugaaaugugugugau

SEQ ID NO: 3232386 - RNA, 16 nt, Human
guggacccugaaaugu

SEQ ID NO: 3232387 - RNA, 19 nt, Human
guggacccugaaaugugug

SEQ ID NO: 3232388 - RNA, 18 nt, Human
guggacccugaaaugugu

SEQ ID NO: 3232389 - RNA, 21 nt, Human
guggaugccugguggcagcug

SEQ ID NO: 3232390 - RNA, 21 nt, Human
guggauggaaggggcugacag

SEQ ID NO: 3232391 - RNA, 20 nt, Human
guggcaccugucugcuccag

SEQ ID NO: 3232392 - RNA, 18 nt, Human
guggcaccugucugcucc

SEQ ID NO: 3232393 - RNA, 15 nt, Human
guggcaccugucugc

SEQ ID NO: 3232394 - RNA, 14 nt, Human
guggcaccugucug

SEQ ID NO: 3232395 - RNA, 18 nt, Human
guggcaccagcagccugg

SEQ ID NO: 3232396 - RNA, 14 nt, Human
guggauugcucauc

SEQ ID NO: 3232397 - RNA, 19 nt, Human
guggcaccagcagccugga

SEQ ID NO: 3232398 - RNA, 18 nt, Human
guggauucuuguuuugcu

SEQ ID NO: 3232399 - RNA, 22 nt, Human
guggauucuuguuuugcuuccc

SEQ ID NO: 3232400 - RNA, 23 nt, Human
aagaaugaagguuuuuguaaaga

SEQ ID NO: 3232401 - RNA, 18 nt, Human
aagaaugaagguuuuugu

SEQ ID NO: 3232402 - RNA, 22 nt, Human
aagaaugaagguuuuuguaaag

SEQ ID NO: 3232403 - RNA, 21 nt, Human
aagaaugaagguuuuuguaaa

SEQ ID NO: 3232404 - RNA, 12 nt, Human
aagaaucuacuu

SEQ ID NO: 3232405 - RNA, 13 nt, Human
aagaaucuacuua

SEQ ID NO: 3232406 - RNA, 14 nt, Human
guggcagcucaccu

SEQ ID NO: 3232407 - RNA, 16 nt, Human
guggcagcucaccucu

SEQ ID NO: 3232408 - RNA, 17 nt, Human
guggcagcuauaggaaa

SEQ ID NO: 3232409 - RNA, 20 nt, Human
aagaauugucuuucugucuc

SEQ ID NO: 3232410 - RNA, 17 nt, Human
aagaauugccagucuuu

SEQ ID NO: 3232411 - RNA, 20 nt, Human
aagaauugccagucuuuugu

SEQ ID NO: 3232412 - RNA, 13 nt, Human
aagaauuuaaaga

SEQ ID NO: 3232413 - RNA, 14 nt, Human
aagaauuuaaagaa

SEQ ID NO: 3232414 - RNA, 16 nt, Human
aagaauuuacuuugga

SEQ ID NO: 3232415 - RNA, 13 nt, Human
aagacaaauagua

SEQ ID NO: 3232416 - RNA, 15 nt, Human
aagacccgagcuggg

SEQ ID NO: 3232417 - RNA, 23 nt, Human
aagaccccuuaccacugcucuga

SEQ ID NO: 3232418 - RNA, 21 nt, Human
aagaaugaguuucuuagacuu

SEQ ID NO: 3232419 - RNA, 14 nt, Human
aagaaugaguuucu

SEQ ID NO: 3232420 - RNA, 20 nt, Human
aagaaugcaugcuuuccaua

SEQ ID NO: 3232421 - RNA, 15 nt, Human
aagaaugcaugcuuu

SEQ ID NO: 3232422 - RNA, 16 nt, Human
aagaauugaagcagga

SEQ ID NO: 3232423 - RNA, 13 nt, Human
aagaauguaaagc

SEQ ID NO: 3232424 - RNA, 12 nt, Human
aagaauguaaag

SEQ ID NO: 3232425 - RNA, 17 nt, Human
aacuuggugcuuauuga

SEQ ID NO: 3232426 - RNA, 20 nt, Human
aacuuggugcuuauugauau

SEQ ID NO: 3232427 - RNA, 18 nt, Human
aacuugucuuuggacccu

SEQ ID NO: 3232428 - RNA, 11 nt, Human
gugccuuaugg

SEQ ID NO: 3232429 - RNA, 17 nt, Human
aacuuggcgcugccccu

SEQ ID NO: 3232430 - RNA, 18 nt, Human
gugccuuauguugaaaaa

SEQ ID NO: 3232431 - RNA, 12 nt, Human
aacuugggaacu

SEQ ID NO: 3232432 - RNA, 11 nt, Human
aacuugggagu

SEQ ID NO: 3232433 - RNA, 23 nt, Human
aacuugggagugugguuucuuuu

SEQ ID NO: 3232434 - RNA, 22 nt, Human
aacuugggagugugguuucuuu

SEQ ID NO: 3232435 - RNA, 12 nt, Human
aacuuuaccaug

SEQ ID NO: 3232436 - RNA, 13 nt, Human
aacuuuaaaccug

SEQ ID NO: 3232437 - RNA, 21 nt, Human
aacuuuaaaccuguagaauca

SEQ ID NO: 3232438 - RNA, 13 nt, Human
aacuuguuuucug

SEQ ID NO: 3232439 - RNA, 15 nt, Human
aagaaaaaaaaagaa

SEQ ID NO: 3232440 - RNA, 14 nt, Human
aagaaaaaaaaaga

SEQ ID NO: 3232441 - RNA, 19 nt, Human
aagaaaaaaaaagaaaaaa

SEQ ID NO: 3232442 - RNA, 18 nt, Human
aagaaaaaaaaagaaaaa

SEQ ID NO: 3232443 - RNA, 13 nt, Human
aagaaaaaaaugu

SEQ ID NO: 3232444 - RNA, 20 nt, Human
aagaaaaaaaugucaaaagu

SEQ ID NO: 3232445 - RNA, 21 nt, Human
gugccuuauggaacacucuga

SEQ ID NO: 3232446 - RNA, 23 nt, Human
gugccuuauggaacacucugaga

SEQ ID NO: 3232447 - RNA, 14 nt, Human
gugccuuauggaac

SEQ ID NO: 3232448 - RNA, 15 nt, Human
gugccucugccuguc

SEQ ID NO: 3232449 - RNA, 13 nt, Human
gugccucugggac

SEQ ID NO: 3232450 - RNA, 12 nt, Human
gugccucuggga

SEQ ID NO: 3232451 - RNA, 12 nt, Human
gugccucugccu

SEQ ID NO: 3232452 - RNA, 13 nt, Human
gugccucugccug

SEQ ID NO: 3232453 - RNA, 22 nt, Human
gugccucacauuuuuuucuacc

SEQ ID NO: 3232454 - RNA, 22 nt, Human
gugccgagaaggaagccuccca

SEQ ID NO: 3232455 - RNA, 13 nt, Human
gugccgagcccuu

SEQ ID NO: 3232456 - RNA, 21 nt, Human
gugaaccaccacacccagccc

SEQ ID NO: 3232457 - RNA, 15 nt, Human
gugccucaagagaag

SEQ ID NO: 3232458 - RNA, 12 nt, Human
gugccuaaaaua

SEQ ID NO: 3232459 - RNA, 16 nt, Human
gugccuaaauaaguua

SEQ ID NO: 3232460 - RNA, 17 nt, Human
gugccuaaaauaagaau

SEQ ID NO: 3232461 - RNA, 12 nt, Human
aagaaauaucug

SEQ ID NO: 3232462 - RNA, 20 nt, Human
aagaaauauguauucuguaa

SEQ ID NO: 3232463 - RNA, 15 nt, Human
aagaaauaucuguga

SEQ ID NO: 3232464 - RNA, 17 nt, Human
aagaaauaucugugaaa

SEQ ID NO: 3232465 - RNA, 18 nt, Human
aagaaauaucugugaaau

SEQ ID NO: 3232466 - RNA, 19 nt, Human
aagaaauaucugugaaaua

SEQ ID NO: 3232467 - RNA, 15 nt, Human
aagaaauaguucugu

SEQ ID NO: 3232468 - RNA, 12 nt, Human
aagaaauaauuu

SEQ ID NO: 3232469 - RNA, 13 nt, Human
aagaaauacugua

SEQ ID NO: 3232470 - RNA, 15 nt, Human
aagaaauacuguaca

SEQ ID NO: 3232471 - RNA, 21 nt, Human
aagaaauaauuuuauuccaga

SEQ ID NO: 3232472 - RNA, 22 nt, Human
aagaaagacuaucuaaauguug

SEQ ID NO: 3232473 - RNA, 20 nt, Human
aagaaagacuaucuaaaugu

SEQ ID NO: 3232474 - RNA, 16 nt, Human
aagaaagaacuaucuu

SEQ ID NO: 3232475 - RNA, 17 nt, Human
aagaaacuuguccuucc

SEQ ID NO: 3232476 - RNA, 21 nt, Human
aagaaacucuauggucuuaua

SEQ ID NO: 3232477 - RNA, 19 nt, Human
aagaaacucuauggucuua

SEQ ID NO: 3232478 - RNA, 17 nt, Human
aagaaaaagcaaaaggc

SEQ ID NO: 3232479 - RNA, 18 nt, Human
aagaaaaagaaaaagaaa

SEQ ID NO: 3232480 - RNA, 11 nt, Human
aagaaaaaagu

SEQ ID NO: 3232481 - RNA, 13 nt, Human
aagaaaaagcaaa

SEQ ID NO: 3232482 - RNA, 20 nt, Human
aagaaaaaagagaaaagaaa

SEQ ID NO: 3232483 - RNA, 18 nt, Human
aagaaaaaagagaaaaga

SEQ ID NO: 3232484 - RNA, 23 nt, Human
aagaaaaaaccguguuugucucu

SEQ ID NO: 3232485 - RNA, 16 nt, Human
aagaagugaaaaucua

SEQ ID NO: 3232486 - RNA, 22 nt, Human
aagaagugaaaaucuacacucc

SEQ ID NO: 3232487 - RNA, 16 nt, Human
aagaagcuuuauuucu

SEQ ID NO: 3232488 - RNA, 14 nt, Human
aagaaggaaagaug

SEQ ID NO: 3232489 - RNA, 18 nt, Human
aagaaggaaagaugguua

SEQ ID NO: 3232490 - RNA, 21 nt, Human
gugcuaucucccccagcccca

SEQ ID NO: 3232491 - RNA, 22 nt, Human
gugcuaggaacacuccuucaca

SEQ ID NO: 3232492 - RNA, 17 nt, Human
gugcuaggaacacuccu

SEQ ID NO: 3232493 - RNA, 15 nt, Human
aagaauagggcccau

SEQ ID NO: 3232494 - RNA, 22 nt, Human
aagaauagggcccaugggaggg

SEQ ID NO: 3232495 - RNA, 18 nt, Human
gugcuaggaacacuccuu

SEQ ID NO: 3232496 - RNA, 13 nt, Human
aagaauaggacuu

SEQ ID NO: 3232497 - RNA, 17 nt, Human
aagaauagcuuuaauga

SEQ ID NO: 3232498 - RNA, 22 nt, Human
aagaauaggacuuguuuuuguu

SEQ ID NO: 3232499 - RNA, 21 nt, Human
aagaauaggacuuguuuuugu

SEQ ID NO: 3232500 - RNA, 19 nt, Human
aagaauaggacuuguuuuu

SEQ ID NO: 3232501 - RNA, 17 nt, Human
aagaauaggacuuguuu

SEQ ID NO: 3232502 - RNA, 17 nt, Human
aagaauagcauuguaaa

SEQ ID NO: 3232503 - RNA, 23 nt, Human
aagaauagcauuguaaaagcauu

SEQ ID NO: 3232504 - RNA, 18 nt, Human
aagaauagcauuguaaaa

SEQ ID NO: 3232505 - RNA, 23 nt, Human
aaggcuauggggauagaugugug

SEQ ID NO: 3232506 - RNA, 16 nt, Human
aaggccaaaggaagca

SEQ ID NO: 3232507 - RNA, 22 nt, Human
aaggccaccucuuccuggccgg

SEQ ID NO: 3232508 - RNA, 21 nt, Human
aaggccaccucuuccuggccg

SEQ ID NO: 3232509 - RNA, 20 nt, Human
aaggccaccucuuccuggcc

SEQ ID NO: 3232510 - RNA, 14 nt, Human
aaggccaccucuuc

SEQ ID NO: 3232511 - RNA, 18 nt, Human
aaggccaaaggaagcaca

SEQ ID NO: 3232512 - RNA, 16 nt, Human
guugcccagugugagg

SEQ ID NO: 3232513 - RNA, 17 nt, Human
guugcccaggcuggcgu

SEQ ID NO: 3232514 - RNA, 15 nt, Human
guugcccaggcaggu

SEQ ID NO: 3232515 - RNA, 21 nt, Human
guugcccaggcuggcgugcag

SEQ ID NO: 3232516 - RNA, 18 nt, Human
guugcccaggcaggucuu

SEQ ID NO: 3232517 - RNA, 14 nt, Human
aaggcuccaggagc

SEQ ID NO: 3232518 - RNA, 17 nt, Human
guugcccaggcaggucu

SEQ ID NO: 3232519 - RNA, 15 nt, Human
aaggauccugagcca

SEQ ID NO: 3232520 - RNA, 17 nt, Human
aaggauccugagccaga

SEQ ID NO: 3232521 - RNA, 18 nt, Human
aaggaugaucuaggaaga

SEQ ID NO: 3232522 - RNA, 23 nt, Human
aaggaugaucuaggaagacuuug

SEQ ID NO: 3232523 - RNA, 14 nt, Human
aaggauccugagcc

SEQ ID NO: 3232524 - RNA, 13 nt, Human
aaggauccugagc

SEQ ID NO: 3232525 - RNA, 21 nt, Human
guugaugggaugauugaagaa

SEQ ID NO: 3232526 - RNA, 17 nt, Human
guugaugggaugauuga

SEQ ID NO: 3232527 - RNA, 24 nt, Human
guugaugcaauccuuacaaaugau

SEQ ID NO: 3232528 - RNA, 12 nt, Human
guugaugcaauc

SEQ ID NO: 3232529 - RNA, 23 nt, Human
guugaugaucuuugcagacaggc

SEQ ID NO: 3232530 - RNA, 21 nt, Human
guugaugccugugaacugaac

SEQ ID NO: 3232531 - RNA, 19 nt, Human
aaggaugcccaaagaugca

SEQ ID NO: 3232532 - RNA, 19 nt, Human
aaggaugccccgucccccu

SEQ ID NO: 3232533 - RNA, 18 nt, Human
guuguaucagcacgugug

SEQ ID NO: 3232534 - RNA, 15 nt, Human
guuguagacaaagua

SEQ ID NO: 3232535 - RNA, 14 nt, Human
guuguaugaucugu

SEQ ID NO: 3232536 - RNA, 21 nt, Human
guuguauaaauuuauuuacug

SEQ ID NO: 3232537 - RNA, 19 nt, Human
guuguauaaauuuauuuac

SEQ ID NO: 3232538 - RNA, 17 nt, Human
guuguauaaauuuauuu

SEQ ID NO: 3232539 - RNA, 16 nt, Human
guuguauaaauuuauu

SEQ ID NO: 3232540 - RNA, 12 nt, Human
guuguauucauu

SEQ ID NO: 3232541 - RNA, 20 nt, Human
guuuaaaacuaguuagauuc

SEQ ID NO: 3232542 - RNA, 18 nt, Human
guuguaccgcaaugugac

SEQ ID NO: 3232543 - RNA, 23 nt, Human
guuguaccucuuuugcuugccaa

SEQ ID NO: 3232544 - RNA, 16 nt, Human
guuguagauacaauca

SEQ ID NO: 3232545 - RNA, 18 nt, Human
guuguagauacaaucagc

SEQ ID NO: 3232546 - RNA, 19 nt, Human
guuguagauacaaucagcu

SEQ ID NO: 3232547 - RNA, 21 nt, Human
guuguagauacaaucagcugc

SEQ ID NO: 3232548 - RNA, 13 nt, Human
guuguacuuuaaa

SEQ ID NO: 3232549 - RNA, 18 nt, Human
guuggucccccuuccaug

SEQ ID NO: 3232550 - RNA, 18 nt, Human
guugguauuaauaaaaag

SEQ ID NO: 3232551 - RNA, 13 nt, Human
guuggguggaugc

SEQ ID NO: 3232552 - RNA, 17 nt, Human
guugcugucagucuuga

SEQ ID NO: 3232553 - RNA, 15 nt, Human
guugcugguacacac

SEQ ID NO: 3232554 - RNA, 14 nt, Human
guugcugguacaca

SEQ ID NO: 3232555 - RNA, 12 nt, Human
guugcugccuca

SEQ ID NO: 3232556 - RNA, 12 nt, Human
guugcugguaaa

SEQ ID NO: 3232557 - RNA, 16 nt, Human
guugcugguaaaauga

SEQ ID NO: 3232558 - RNA, 13 nt, Human
guuuaugugugug

SEQ ID NO: 3232559 - RNA, 16 nt, Human
guuuaugugugugugu

SEQ ID NO: 3232560 - RNA, 22 nt, Human
guuuaugugcuauuaauauuug

SEQ ID NO: 3232561 - RNA, 23 nt, Human
guuuaugugcuauuaauauuugu

SEQ ID NO: 3232562 - RNA, 12 nt, Human
guuuauguuuug

SEQ ID NO: 3232563 - RNA, 14 nt, Human
guuuauuaaaugcu

SEQ ID NO: 3232564 - RNA, 15 nt, Human
guuuauuaaaugcuu

SEQ ID NO: 3232565 - RNA, 15 nt, Human
guuuauuaaauugca

SEQ ID NO: 3232566 - RNA, 23 nt, Human
guuuauguuuugguccacuuuuc

SEQ ID NO: 3232567 - RNA, 23 nt, Human
guuuaauugaaagaauguaaagc

SEQ ID NO: 3232568 - RNA, 13 nt, Human
guuuaaaagaaaa

SEQ ID NO: 3232569 - RNA, 14 nt, Human
guuuaaaagaaaaa

SEQ ID NO: 3232570 - RNA, 18 nt, Human
guuuaaaagaaaaaauga

SEQ ID NO: 3232571 - RNA, 16 nt, Human
guuuaaaaucauuucu

SEQ ID NO: 3232572 - RNA, 10 nt, Human
guuuaaaauc

SEQ ID NO: 3232573 - RNA, 23 nt, Human
guuuaaggaauaugggagaaaua

SEQ ID NO: 3232574 - RNA, 18 nt, Human
guuuaagcagaauuggaa

SEQ ID NO: 3232575 - RNA, 12 nt, Human
guuuaagcagaa

SEQ ID NO: 3232576 - RNA, 19 nt, Human
guuuaagcagaauuggaaa

SEQ ID NO: 3232577 - RNA, 20 nt, Human
guuuaagacauuuuuggaag

SEQ ID NO: 3232578 - RNA, 14 nt, Human
guuugccccguucu

SEQ ID NO: 3232579 - RNA, 19 nt, Human
guuugccccguucuguuug

SEQ ID NO: 3232580 - RNA, 20 nt, Human
guuugccacuuugcaaagga

SEQ ID NO: 3232581 - RNA, 15 nt, Human
guuugcauuucagaa

SEQ ID NO: 3232582 - RNA, 14 nt, Human
guuugcauuucaga

SEQ ID NO: 3232583 - RNA, 16 nt, Human
guuugggaccccuggu

SEQ ID NO: 3232584 - RNA, 21 nt, Human
guuugggaagagcuuagaaac

SEQ ID NO: 3232585 - RNA, 22 nt, Human
guuugggaccccuggugguuca

SEQ ID NO: 3232586 - RNA, 23 nt, Human
guuugggaagagcuuagaaacug

SEQ ID NO: 3232587 - RNA, 13 nt, Human
guuugccucugcc

SEQ ID NO: 3232588 - RNA, 15 nt, Human
guuucuguccuguaa

SEQ ID NO: 3232589 - RNA, 19 nt, Human
guuucuguccuguaacugu

SEQ ID NO: 3232590 - RNA, 17 nt, Human
guuucugucguuaaaaa

SEQ ID NO: 3232591 - RNA, 21 nt, Human
guuugauucagacagcugccu

SEQ ID NO: 3232592 - RNA, 21 nt, Human
guuugauuugucacugcuuca

SEQ ID NO: 3232593 - RNA, 22 nt, Human
guuugauucagacagcugccug

SEQ ID NO: 3232594 - RNA, 22 nt, Human
guuucugugguuggcugggaaa

SEQ ID NO: 3232595 - RNA, 14 nt, Human
guuucugucuccuc

SEQ ID NO: 3232596 - RNA, 22 nt, Human
guuucugucguuaaaaacagau

SEQ ID NO: 3232597 - RNA, 21 nt, Human
guuucugugguuggcugggaa

SEQ ID NO: 3232598 - RNA, 16 nt, Human
guuuucuuaacuuaaa

SEQ ID NO: 3232599 - RNA, 14 nt, Human
guuuucuguuucua

SEQ ID NO: 3232600 - RNA, 23 nt, Human
guuuucugagaaagacuauucaa

SEQ ID NO: 3232601 - RNA, 19 nt, Human
guuuuagaaacaauaugga

SEQ ID NO: 3232602 - RNA, 16 nt, Human
guuuuacccuauaucu

SEQ ID NO: 3232603 - RNA, 23 nt, Human
guuuuacaauaaaaucuugaaaa

SEQ ID NO: 3232604 - RNA, 20 nt, Human
guuugggccccagaggcugg

SEQ ID NO: 3232605 - RNA, 14 nt, Human
aaguaagucucaag

SEQ ID NO: 3232606 - RNA, 17 nt, Human
aagguuuuuguaaagau

SEQ ID NO: 3232607 - RNA, 14 nt, Human
aagguuuuuguaaa

SEQ ID NO: 3232608 - RNA, 18 nt, Human
aagguuuuuguaaagauu

SEQ ID NO: 3232609 - RNA, 20 nt, Human
guuucuaaagcugccagccg

SEQ ID NO: 3232610 - RNA, 16 nt, Human
aaguaagucucaaggu

SEQ ID NO: 3232611 - RNA, 17 nt, Human
aaguaagucucaaggua

SEQ ID NO: 3232612 - RNA, 16 nt, Human
aaggguaucaggugcu

SEQ ID NO: 3232613 - RNA, 12 nt, Human
aagggguuuucu

SEQ ID NO: 3232614 - RNA, 22 nt, Human
aagggguuuucuugauaauuuu

SEQ ID NO: 3232615 - RNA, 13 nt, Human
aagggguuuucuu

SEQ ID NO: 3232616 - RNA, 14 nt, Human
aagguaaaaaguua

SEQ ID NO: 3232617 - RNA, 14 nt, Human
aagguuuuugauag

SEQ ID NO: 3232618 - RNA, 19 nt, Human
aagguuuuugauagcauug

SEQ ID NO: 3232619 - RNA, 21 nt, Human
aagggguaggauuacuaggug

SEQ ID NO: 3232620 - RNA, 20 nt, Human
aagggcuuuucaaaaucauu

SEQ ID NO: 3232621 - RNA, 21 nt, Human
aaggggaaucuggagguagcc

SEQ ID NO: 3232622 - RNA, 16 nt, Human
aaggggaaucuggagg

SEQ ID NO: 3232623 - RNA, 15 nt, Human
aaggggaauuaacaa

SEQ ID NO: 3232624 - RNA, 23 nt, Human
aaggggaauguuugccucugccu

SEQ ID NO: 3232625 - RNA, 22 nt, Human
aaggggaauguuugccucugcc

SEQ ID NO: 3232626 - RNA, 19 nt, Human
aagggccuggccugagcug

SEQ ID NO: 3232627 - RNA, 13 nt, Human
aagggaaaaauca

SEQ ID NO: 3232628 - RNA, 14 nt, Human
aagggcuuuccugu

SEQ ID NO: 3232629 - RNA, 14 nt, Human
aagggccuggccug

SEQ ID NO: 3232630 - RNA, 17 nt, Human
aagggccuggccugagc

SEQ ID NO: 3232631 - RNA, 15 nt, Human
aaggcuuauaaaaca

SEQ ID NO: 3232632 - RNA, 16 nt, Human
aaggcuuauaaaacag

SEQ ID NO: 3232633 - RNA, 17 nt, Human
guuuauuuuucuguuac

SEQ ID NO: 3232634 - RNA, 16 nt, Human
guuucaaaaaucugaa

SEQ ID NO: 3232635 - RNA, 13 nt, Human
guuucaaaaaucu

SEQ ID NO: 3232636 - RNA, 15 nt, Human
guuucaaaaaucuga

SEQ ID NO: 3232637 - RNA, 14 nt, Human
guuucaaaaaucug

SEQ ID NO: 3232638 - RNA, 13 nt, Human
aagggccuggccu

SEQ ID NO: 3232639 - RNA, 22 nt, Human
aaggcuuuucaaccacaaaacu

SEQ ID NO: 3232640 - RNA, 15 nt, Human
aaggcuugcugcaga

SEQ ID NO: 3232641 - RNA, 17 nt, Human
guguuucauccuuccca

SEQ ID NO: 3232642 - RNA, 12 nt, Human
guuaagccuuug

SEQ ID NO: 3232643 - RNA, 13 nt, Human
guuaagccuuugg

SEQ ID NO: 3232644 - RNA, 16 nt, Human
guuaagccuuuggaaa

SEQ ID NO: 3232645 - RNA, 17 nt, Human
guguuugucucuucugg

SEQ ID NO: 3232646 - RNA, 15 nt, Human
guguuugucucuucu

SEQ ID NO: 3232647 - RNA, 12 nt, Human
guguuugucucu

SEQ ID NO: 3232648 - RNA, 18 nt, Human
guuaagucuaucugguau

SEQ ID NO: 3232649 - RNA, 21 nt, Human
guuaagucuaucugguauuaa

SEQ ID NO: 3232650 - RNA, 22 nt, Human
guuaaguugauggugaugaaau

SEQ ID NO: 3232651 - RNA, 22 nt, Human
guuaaggagaaucauguuucuu

SEQ ID NO: 3232652 - RNA, 14 nt, Human
guuaaucuuaaugu

SEQ ID NO: 3232653 - RNA, 17 nt, Human
guuaaucuuaauguaua

SEQ ID NO: 3232654 - RNA, 19 nt, Human
guuaaucuuaauguauauc

SEQ ID NO: 3232655 - RNA, 18 nt, Human
guuaaugauagcuacugu

SEQ ID NO: 3232656 - RNA, 16 nt, Human
guuaauguauauaaaa

SEQ ID NO: 3232657 - RNA, 17 nt, Human
guuaauguauauaaaaa

SEQ ID NO: 3232658 - RNA, 18 nt, Human
guuaauguauauaaaaau

SEQ ID NO: 3232659 - RNA, 13 nt, Human
guuaguaaucugu

SEQ ID NO: 3232660 - RNA, 15 nt, Human
guuaguaaucuguau

SEQ ID NO: 3232661 - RNA, 17 nt, Human
guuaguaaucuguauaa

SEQ ID NO: 3232662 - RNA, 20 nt, Human
guuaguaaucuguauaauac

SEQ ID NO: 3232663 - RNA, 14 nt, Human
guuagaugcuacua

SEQ ID NO: 3232664 - RNA, 11 nt, Human
guuagauguuu

SEQ ID NO: 3232665 - RNA, 12 nt, Human
guuagauguuug

SEQ ID NO: 3232666 - RNA, 16 nt, Human
guuagauuaagaaaua

SEQ ID NO: 3232667 - RNA, 13 nt, Human
guuagauuaagaa

SEQ ID NO: 3232668 - RNA, 21 nt, Human
guuagauauagagucauugua

SEQ ID NO: 3232669 - RNA, 20 nt, Human
guuacaaauuauaauguauu

SEQ ID NO: 3232670 - RNA, 17 nt, Human
guuacaaauuauaaugu

SEQ ID NO: 3232671 - RNA, 15 nt, Human
guuacaaauuauaau

SEQ ID NO: 3232672 - RNA, 21 nt, Human
guuacaaaauguaacuguuac

SEQ ID NO: 3232673 - RNA, 18 nt, Human
guuacaaaauguaacugu

SEQ ID NO: 3232674 - RNA, 17 nt, Human
guuacaaaauguaacug

SEQ ID NO: 3232675 - RNA, 16 nt, Human
guuacaaaauguaacu

SEQ ID NO: 3232676 - RNA, 14 nt, Human
guuacaaaauguaa

SEQ ID NO: 3232677 - RNA, 13 nt, Human
guuacaaaaugua

SEQ ID NO: 3232678 - RNA, 15 nt, Human
aagccuggucagccc

SEQ ID NO: 3232679 - RNA, 14 nt, Human
aagccuggaaaaaa

SEQ ID NO: 3232680 - RNA, 17 nt, Human
aagccugcuccuucccu

SEQ ID NO: 3232681 - RNA, 16 nt, Human
aagccugcuccuuccc

SEQ ID NO: 3232682 - RNA, 12 nt, Human
aagccugcuccu

SEQ ID NO: 3232683 - RNA, 16 nt, Human
aagcuaggccuggcca

SEQ ID NO: 3232684 - RNA, 18 nt, Human
aagcuaggccuggccaga

SEQ ID NO: 3232685 - RNA, 17 nt, Human
aagcuaggccuggccag

SEQ ID NO: 3232686 - RNA, 15 nt, Human
aagccucgacacaga

SEQ ID NO: 3232687 - RNA, 19 nt, Human
aagccuccuccagccgcca

SEQ ID NO: 3232688 - RNA, 19 nt, Human
guucaggguuggccccugc

SEQ ID NO: 3232689 - RNA, 17 nt, Human
guucaguguuucugggg

SEQ ID NO: 3232690 - RNA, 15 nt, Human
guucaguguuucugg

SEQ ID NO: 3232691 - RNA, 18 nt, Human
guucaggguuggccccug

SEQ ID NO: 3232692 - RNA, 17 nt, Human
guucaggguuggccccu

SEQ ID NO: 3232693 - RNA, 22 nt, Human
guuauuuauucugggaauguau

SEQ ID NO: 3232694 - RNA, 18 nt, Human
guuauuucccuuuagcug

SEQ ID NO: 3232695 - RNA, 23 nt, Human
guuauuucccuuuagcuguguua

SEQ ID NO: 3232696 - RNA, 17 nt, Human
guucagcuccagcucac

SEQ ID NO: 3232697 - RNA, 16 nt, Human
guucagcuccagcuca

SEQ ID NO: 3232698 - RNA, 15 nt, Human
guucagcuccagcuc

SEQ ID NO: 3232699 - RNA, 20 nt, Human
guucccuuugacgccauccc

SEQ ID NO: 3232700 - RNA, 21 nt, Human
guucccuuugacgccauccca

SEQ ID NO: 3232701 - RNA, 16 nt, Human
guucuacccaggugcu

SEQ ID NO: 3232702 - RNA, 23 nt, Human
guucugggacacaguucaauucu

SEQ ID NO: 3232703 - RNA, 12 nt, Human
guucuguauuug

SEQ ID NO: 3232704 - RNA, 14 nt, Human
guucuguauuugaa

SEQ ID NO: 3232705 - RNA, 21 nt, Human
guucuguaaaauggaaaacuu

SEQ ID NO: 3232706 - RNA, 22 nt, Human
guucuguaaaauggaaaacuua

SEQ ID NO: 3232707 - RNA, 12 nt, Human
guucugguguua

SEQ ID NO: 3232708 - RNA, 14 nt, Human
guucuuuaaacugu

SEQ ID NO: 3232709 - RNA, 23 nt, Human
guucuuuaaacugucgugucaua

SEQ ID NO: 3232710 - RNA, 23 nt, Human
guucuuguuuuuaaguuugcacu

SEQ ID NO: 3232711 - RNA, 18 nt, Human
guucuuguuuuuaaguuu

SEQ ID NO: 3232712 - RNA, 17 nt, Human
guucuuaguuugcaguu

SEQ ID NO: 3232713 - RNA, 15 nt, Human
guuccccaaauacaa

SEQ ID NO: 3232714 - RNA, 16 nt, Human
guucuuacugcuuaau

SEQ ID NO: 3232715 - RNA, 17 nt, Human
guucuuauuuuuauaac

SEQ ID NO: 3232716 - RNA, 20 nt, Human
guugaggaaagcacagaggc

SEQ ID NO: 3232717 - RNA, 22 nt, Human
guugaugaucuuugcagacagg

SEQ ID NO: 3232718 - RNA, 15 nt, Human
guugauaaaaauacu

SEQ ID NO: 3232719 - RNA, 15 nt, Human
aagcuaucuucaugu

SEQ ID NO: 3232720 - RNA, 22 nt, Human
aagcuaucuucauguaaauuga

SEQ ID NO: 3232721 - RNA, 18 nt, Human
aagcugaaauuuuagaaa

SEQ ID NO: 3232722 - RNA, 20 nt, Human
aagcugaaauuuuagaaaua

SEQ ID NO: 3232723 - RNA, 22 nt, Human
aagcugaaauuuuagaaauauu

SEQ ID NO: 3232724 - RNA, 17 nt, Human
aagcugaacacugaagu

SEQ ID NO: 3232725 - RNA, 18 nt, Human
aagcugaacacauuucuu

SEQ ID NO: 3232726 - RNA, 18 nt, Human
aagcuuauuaaaacucau

SEQ ID NO: 3232727 - RNA, 21 nt, Human
aagcugaaucagacaguggau

SEQ ID NO: 3232728 - RNA, 16 nt, Human
aagcuuauuuuggaga

SEQ ID NO: 3232729 - RNA, 20 nt, Human
guucccuacuuccugugacu

SEQ ID NO: 3232730 - RNA, 20 nt, Human
guucccauuugcuccuuucu

SEQ ID NO: 3232731 - RNA, 16 nt, Human
guucccauuugcuccu

SEQ ID NO: 3232732 - RNA, 22 nt, Human
guucccaagaaaggaaaccuuu

SEQ ID NO: 3232733 - RNA, 13 nt, Human
aagcuuuauuucu

SEQ ID NO: 3232734 - RNA, 16 nt, Human
aagcuuuauuucuagc

SEQ ID NO: 3232735 - RNA, 20 nt, Human
aagcuuuauuucuagcuuuu

SEQ ID NO: 3232736 - RNA, 13 nt, Human
aagcuuuaaauua

SEQ ID NO: 3232737 - RNA, 14 nt, Human
aagcuuuaaauuau

SEQ ID NO: 3232738 - RNA, 17 nt, Human
aagcuuuaaauuaugug

SEQ ID NO: 3232739 - RNA, 20 nt, Human
guuccaugaguuaucaugaa

SEQ ID NO: 3232740 - RNA, 21 nt, Human
aagcuuucaugucccagaacu

SEQ ID NO: 3232741 - RNA, 21 nt, Human
acaccccaccugcgcuucacu

SEQ ID NO: 3232742 - RNA, 13 nt, Human
acaccccaccugc

SEQ ID NO: 3232743 - RNA, 16 nt, Human
acaccccaccugcgcu

SEQ ID NO: 3232744 - RNA, 14 nt, Human
acaccccaccugcg

SEQ ID NO: 3232745 - RNA, 14 nt, Human
acacccaugaaaga

SEQ ID NO: 3232746 - RNA, 12 nt, Human
acaccccaccug

SEQ ID NO: 3232747 - RNA, 12 nt, Human
acacccagggaa

SEQ ID NO: 3232748 - RNA, 15 nt, Human
acaccuccucccacu

SEQ ID NO: 3232749 - RNA, 14 nt, Human
acaccuccucccac

SEQ ID NO: 3232750 - RNA, 11 nt, Human
acaccuccugg

SEQ ID NO: 3232751 - RNA, 14 nt, Human
acaccuccuggggc

SEQ ID NO: 3232752 - RNA, 22 nt, Human
acaccuccucccacugcccacu

SEQ ID NO: 3232753 - RNA, 20 nt, Human
acaccuccucccacugccca

SEQ ID NO: 3232754 - RNA, 18 nt, Human
acaccucugcacaagcug

SEQ ID NO: 3232755 - RNA, 16 nt, Human
acaccuugacagggca

SEQ ID NO: 3232756 - RNA, 15 nt, Human
acaccuugacagggc

SEQ ID NO: 3232757 - RNA, 14 nt, Human
acaccuugacaggg

SEQ ID NO: 3232758 - RNA, 19 nt, Human
acaccugcagauucuagga

SEQ ID NO: 3232759 - RNA, 19 nt, Human
acaccugcagccucccucc

SEQ ID NO: 3232760 - RNA, 13 nt, Human
uauaacuacauau

SEQ ID NO: 3232761 - RNA, 17 nt, Human
uauaaccuaguuaaaga

SEQ ID NO: 3232762 - RNA, 20 nt, Human
uauaaccuaguuaaagaaag

SEQ ID NO: 3232763 - RNA, 22 nt, Human
uauaaccuaguuaaagaaagga

SEQ ID NO: 3232764 - RNA, 18 nt, Human
uauaacuacauauugaau

SEQ ID NO: 3232765 - RNA, 15 nt, Human
acacuaaccacgcug

SEQ ID NO: 3232766 - RNA, 19 nt, Human
acacuaaccacgcuggacc

SEQ ID NO: 3232767 - RNA, 17 nt, Human
acacuaaccacgcugga

SEQ ID NO: 3232768 - RNA, 16 nt, Human
acacuaaccacgcugg

SEQ ID NO: 3232769 - RNA, 14 nt, Human
uauaaaaauggcuu

SEQ ID NO: 3232770 - RNA, 21 nt, Human
uauaaaacagaguaaucuugu

SEQ ID NO: 3232771 - RNA, 23 nt, Human
uauaaaacagcccuauuucuuga

SEQ ID NO: 3232772 - RNA, 21 nt, Human
uaguucaagaaaugaagagcu

SEQ ID NO: 3232773 - RNA, 20 nt, Human
uaguucaagaaaugaagagc

SEQ ID NO: 3232774 - RNA, 14 nt, Human
uaguucaagaaaug

SEQ ID NO: 3232775 - RNA, 18 nt, Human
uaguucaagaaaugaaga

SEQ ID NO: 3232776 - RNA, 15 nt, Human
uaguucaagaaauga

SEQ ID NO: 3232777 - RNA, 13 nt, Human
uaguuauguaaau

SEQ ID NO: 3232778 - RNA, 15 nt, Human
uaguuauguaaauaa

SEQ ID NO: 3232779 - RNA, 19 nt, Human
uaguuauguaaauaauucu

SEQ ID NO: 3232780 - RNA, 20 nt, Human
uaguuauguaaauaauucuu

SEQ ID NO: 3232781 - RNA, 21 nt, Human
uaguuauguaaauaauucuuu

SEQ ID NO: 3232782 - RNA, 21 nt, Human
uaguuuuuccuaucauguuaa

SEQ ID NO: 3232783 - RNA, 13 nt, Human
uaguuuugcuuuu

SEQ ID NO: 3232784 - RNA, 14 nt, Human
uaguucagcaaaac

SEQ ID NO: 3232785 - RNA, 12 nt, Human
uaguuuugcaua

SEQ ID NO: 3232786 - RNA, 18 nt, Human
uauaaaauguaucaacac

SEQ ID NO: 3232787 - RNA, 22 nt, Human
uauaaaauggcaacaaacugca

SEQ ID NO: 3232788 - RNA, 20 nt, Human
uauaaaauggcaacaaacug

SEQ ID NO: 3232789 - RNA, 16 nt, Human
uauaaaauggcaacaa

SEQ ID NO: 3232790 - RNA, 18 nt, Human
acacauguccaagaagcc

SEQ ID NO: 3232791 - RNA, 19 nt, Human
acacauguccaagaagccc

SEQ ID NO: 3232792 - RNA, 13 nt, Human
acacauguccaag

SEQ ID NO: 3232793 - RNA, 21 nt, Human
acacauguccaagaagcccag

SEQ ID NO: 3232794 - RNA, 22 nt, Human
acacauguccaagaagcccagg

SEQ ID NO: 3232795 - RNA, 13 nt, Human
acacauuaucuuc

SEQ ID NO: 3232796 - RNA, 14 nt, Human
acacauuaucuucu

SEQ ID NO: 3232797 - RNA, 15 nt, Human
acacauuaucuucug

SEQ ID NO: 3232798 - RNA, 18 nt, Human
acacauuucacugucugu

SEQ ID NO: 3232799 - RNA, 13 nt, Human
acacccagcccac

SEQ ID NO: 3232800 - RNA, 12 nt, Human
acacccagccca

SEQ ID NO: 3232801 - RNA, 23 nt, Human
acacauuuguugccagauuucag

SEQ ID NO: 3232802 - RNA, 22 nt, Human
acacauuuguugccagauuuca

SEQ ID NO: 3232803 - RNA, 11 nt, Human
acacauuucuu

SEQ ID NO: 3232804 - RNA, 16 nt, Human
uaguacuucuucugua

SEQ ID NO: 3232805 - RNA, 17 nt, Human
uaguacuucuucuguaa

SEQ ID NO: 3232806 - RNA, 18 nt, Human
uaguacuucuucuguaau

SEQ ID NO: 3232807 - RNA, 19 nt, Human
uaguacuucuucuguaaua

SEQ ID NO: 3232808 - RNA, 14 nt, Human
uaguacugugaauc

SEQ ID NO: 3232809 - RNA, 23 nt, Human
uaguacuggauuauucaggcuuu

SEQ ID NO: 3232810 - RNA, 13 nt, Human
uaguagagacagg

SEQ ID NO: 3232811 - RNA, 18 nt, Human
uaguacuuuauagaagaa

SEQ ID NO: 3232812 - RNA, 16 nt, Human
uaguacuuuauagaag

SEQ ID NO: 3232813 - RNA, 13 nt, Human
uaguacuuuauag

SEQ ID NO: 3232814 - RNA, 15 nt, Human
uaguacuuuauagaa

SEQ ID NO: 3232815 - RNA, 14 nt, Human
uaguacuuuauaga

SEQ ID NO: 3232816 - RNA, 12 nt, Human
uaguagagacag

SEQ ID NO: 3232817 - RNA, 21 nt, Human
uaguacuuuauagaagaaugc

SEQ ID NO: 3232818 - RNA, 18 nt, Human
uagucuuuagcuauuacu

SEQ ID NO: 3232819 - RNA, 19 nt, Human
uagucuuuagcuauuacug

SEQ ID NO: 3232820 - RNA, 11 nt, Human
uagucuuggaa

SEQ ID NO: 3232821 - RNA, 23 nt, Human
uagucuuggaagcuguuuggaaa

SEQ ID NO: 3232822 - RNA, 13 nt, Human
uagucucaagaau

SEQ ID NO: 3232823 - RNA, 17 nt, Human
uagucuuaagaacugcu

SEQ ID NO: 3232824 - RNA, 14 nt, Human
uaguaauaaagacu

SEQ ID NO: 3232825 - RNA, 22 nt, Human
uaguaagucuugccuauauuuu

SEQ ID NO: 3232826 - RNA, 15 nt, Human
uaguaaguuaaugua

SEQ ID NO: 3232827 - RNA, 16 nt, Human
uaguaaguuaauguau

SEQ ID NO: 3232828 - RNA, 23 nt, Human
uaguaaguuaauguauauaaaaa

SEQ ID NO: 3232829 - RNA, 18 nt, Human
uagguuucuaaaaaguca

SEQ ID NO: 3232830 - RNA, 20 nt, Human
uagguuucuaaaaagucaga

SEQ ID NO: 3232831 - RNA, 13 nt, Human
uaguaagauacug

SEQ ID NO: 3232832 - RNA, 14 nt, Human
uaguaagaucucuu

SEQ ID NO: 3232833 - RNA, 21 nt, Human
uaguaagaucucuuucuaaag

SEQ ID NO: 3232834 - RNA, 23 nt, Human
uaguaagcggcucaagcccagga

SEQ ID NO: 3232835 - RNA, 21 nt, Human
uagguuggcaaaaaggcagga

SEQ ID NO: 3232836 - RNA, 17 nt, Human
acacagugaccauacua

SEQ ID NO: 3232837 - RNA, 18 nt, Human
acacaggacagggguucc

SEQ ID NO: 3232838 - RNA, 22 nt, Human
acacaguauuacuucugcuaca

SEQ ID NO: 3232839 - RNA, 11 nt, Human
acacagugagu

SEQ ID NO: 3232840 - RNA, 22 nt, Human
acacagcucuucuccaggcugu

SEQ ID NO: 3232841 - RNA, 13 nt, Human
acacagcugcuuu

SEQ ID NO: 3232842 - RNA, 19 nt, Human
acacaagaccagugcuuag

SEQ ID NO: 3232843 - RNA, 21 nt, Human
acaaugguuuucuuguguguu

SEQ ID NO: 3232844 - RNA, 19 nt, Human
uagcuuauuuuuacaguua

SEQ ID NO: 3232845 - RNA, 16 nt, Human
acaaugccuauuguaa

SEQ ID NO: 3232846 - RNA, 20 nt, Human
acaaugccuauuguaauaua

SEQ ID NO: 3232847 - RNA, 15 nt, Human
acaaugguuuucuug

SEQ ID NO: 3232848 - RNA, 14 nt, Human
acaaugguaacauu

SEQ ID NO: 3232849 - RNA, 20 nt, Human
acacacucaaaucaagaaac

SEQ ID NO: 3232850 - RNA, 19 nt, Human
acacacagcucuguccugg

SEQ ID NO: 3232851 - RNA, 12 nt, Human
acacacagcucu

SEQ ID NO: 3232852 - RNA, 11 nt, Human
acacacagcuc

SEQ ID NO: 3232853 - RNA, 20 nt, Human
acagauagauauaugcucug

SEQ ID NO: 3232854 - RNA, 20 nt, Human
acagaugccauauaguguua

SEQ ID NO: 3232855 - RNA, 23 nt, Human
acagaugggugcuuggaggaagg

SEQ ID NO: 3232856 - RNA, 13 nt, Human
acagauucuuuau

SEQ ID NO: 3232857 - RNA, 17 nt, Human
uaucuuguucaggaaaa

SEQ ID NO: 3232858 - RNA, 18 nt, Human
acagcccuauuucuugau

SEQ ID NO: 3232859 - RNA, 17 nt, Human
acagcccuauuucuuga

SEQ ID NO: 3232860 - RNA, 16 nt, Human
uaucuuggcagguagg

SEQ ID NO: 3232861 - RNA, 22 nt, Human
uaugaaagauggcugugccucu

SEQ ID NO: 3232862 - RNA, 20 nt, Human
uaugaaagauggcugugccu

SEQ ID NO: 3232863 - RNA, 23 nt, Human
uaugaaagauggcugugccucug

SEQ ID NO: 3232864 - RNA, 12 nt, Human
uaucuuugauaa

SEQ ID NO: 3232865 - RNA, 23 nt, Human
acagcccgggcucugccucccau

SEQ ID NO: 3232866 - RNA, 20 nt, Human
acagcaacgaucacaaauga

SEQ ID NO: 3232867 - RNA, 21 nt, Human
acagcaacgaucacaaaugac

SEQ ID NO: 3232868 - RNA, 22 nt, Human
acagcaacgaucacaaaugacu

SEQ ID NO: 3232869 - RNA, 15 nt, Human
acagcccuauuucuu

SEQ ID NO: 3232870 - RNA, 21 nt, Human
acagcccgggcucugccuccc

SEQ ID NO: 3232871 - RNA, 22 nt, Human
acagcccgggcucugccuccca

SEQ ID NO: 3232872 - RNA, 20 nt, Human
acagcccgggcucugccucc

SEQ ID NO: 3232873 - RNA, 17 nt, Human
uaucucaaaacugcacu

SEQ ID NO: 3232874 - RNA, 14 nt, Human
uauccuacuucccc

SEQ ID NO: 3232875 - RNA, 17 nt, Human
uauccuacuuccccuuc

SEQ ID NO: 3232876 - RNA, 13 nt, Human
uaucucagggccu

SEQ ID NO: 3232877 - RNA, 14 nt, Human
uaucucaaauugua

SEQ ID NO: 3232878 - RNA, 19 nt, Human
uaucucagauauuugcacc

SEQ ID NO: 3232879 - RNA, 15 nt, Human
uaucucagauguuaa

SEQ ID NO: 3232880 - RNA, 16 nt, Human
uaucucagauguuaaa

SEQ ID NO: 3232881 - RNA, 19 nt, Human
uaucucagauguuaaaaua

SEQ ID NO: 3232882 - RNA, 18 nt, Human
uaucucagauauuugcac

SEQ ID NO: 3232883 - RNA, 17 nt, Human
uaucucagauauuugca

SEQ ID NO: 3232884 - RNA, 16 nt, Human
uaucucagauauuugc

SEQ ID NO: 3232885 - RNA, 15 nt, Human
uaucccggcugcccu

SEQ ID NO: 3232886 - RNA, 14 nt, Human
uaucccugauaaau

SEQ ID NO: 3232887 - RNA, 16 nt, Human
uaucccggcugcccuu

SEQ ID NO: 3232888 - RNA, 21 nt, Human
acagagcaagugagacccugu

SEQ ID NO: 3232889 - RNA, 23 nt, Human
acagagcaaccccuggaccccag

SEQ ID NO: 3232890 - RNA, 22 nt, Human
acagagcaaccccuggacccca

SEQ ID NO: 3232891 - RNA, 20 nt, Human
acagagcaaccccuggaccc

SEQ ID NO: 3232892 - RNA, 16 nt, Human
acagagcaaccccugg

SEQ ID NO: 3232893 - RNA, 15 nt, Human
acagagaugucucuu

SEQ ID NO: 3232894 - RNA, 18 nt, Human
acagagcuacacagggga

SEQ ID NO: 3232895 - RNA, 16 nt, Human
acagagcaguugagag

SEQ ID NO: 3232896 - RNA, 13 nt, Human
acagagaugucuc

SEQ ID NO: 3232897 - RNA, 18 nt, Human
uaucucugaguucugugu

SEQ ID NO: 3232898 - RNA, 21 nt, Human
uaucuccuuuguauucugucu

SEQ ID NO: 3232899 - RNA, 19 nt, Human
uauauuuaaagggaaauug

SEQ ID NO: 3232900 - RNA, 16 nt, Human
uauauucuauuuuaca

SEQ ID NO: 3232901 - RNA, 23 nt, Human
uauauuccuuuucccaggaaaga

SEQ ID NO: 3232902 - RNA, 19 nt, Human
uauauuccucuugcauuuc

SEQ ID NO: 3232903 - RNA, 18 nt, Human
uauauuccagguuuaagu

SEQ ID NO: 3232904 - RNA, 21 nt, Human
uauauuccagguuuaaguaga

SEQ ID NO: 3232905 - RNA, 22 nt, Human
uauauuccagguuuaaguagau

SEQ ID NO: 3232906 - RNA, 15 nt, Human
acagacacaggcccg

SEQ ID NO: 3232907 - RNA, 17 nt, Human
acagacacaggcccggc

SEQ ID NO: 3232908 - RNA, 18 nt, Human
acagacacaggcccggcu

SEQ ID NO: 3232909 - RNA, 19 nt, Human
acagacuggaagcacagcu

SEQ ID NO: 3232910 - RNA, 17 nt, Human
acagacuggaagcacag

SEQ ID NO: 3232911 - RNA, 21 nt, Human
acagacuggaagcacagcuuc

SEQ ID NO: 3232912 - RNA, 13 nt, Human
acacuuaaaaaug

SEQ ID NO: 3232913 - RNA, 15 nt, Human
acacuuaaaaauggu

SEQ ID NO: 3232914 - RNA, 19 nt, Human
acacuguuuguuccagaau

SEQ ID NO: 3232915 - RNA, 14 nt, Human
acacuugucggcuc

SEQ ID NO: 3232916 - RNA, 15 nt, Human
acacuugugacuuuu

SEQ ID NO: 3232917 - RNA, 14 nt, Human
acacuugugacuuu

SEQ ID NO: 3232918 - RNA, 21 nt, Human
acacuugugacuuuugcuuua

SEQ ID NO: 3232919 - RNA, 20 nt, Human
acacuugugacuuuugcuuu

SEQ ID NO: 3232920 - RNA, 18 nt, Human
acacuugugacuuuugcu

SEQ ID NO: 3232921 - RNA, 18 nt, Human
acagaaaauucuucucca

SEQ ID NO: 3232922 - RNA, 16 nt, Human
acacuuuucauaucau

SEQ ID NO: 3232923 - RNA, 17 nt, Human
acacuuuucauaucauu

SEQ ID NO: 3232924 - RNA, 18 nt, Human
acacuuuucauaucauuu

SEQ ID NO: 3232925 - RNA, 20 nt, Human
acacuuguugauuaauggaa

SEQ ID NO: 3232926 - RNA, 23 nt, Human
acacuuguugauuaauggaaaug

SEQ ID NO: 3232927 - RNA, 13 nt, Human
acacuuuaauggg

SEQ ID NO: 3232928 - RNA, 16 nt, Human
acacucacccaacaau

SEQ ID NO: 3232929 - RNA, 22 nt, Human
acacucacauuuauucugcuca

SEQ ID NO: 3232930 - RNA, 16 nt, Human
uauaaggacuuccuga

SEQ ID NO: 3232931 - RNA, 12 nt, Human
acacucagcugu

SEQ ID NO: 3232932 - RNA, 13 nt, Human
acacucagcuguu

SEQ ID NO: 3232933 - RNA, 14 nt, Human
acacucagcuguuc

SEQ ID NO: 3232934 - RNA, 20 nt, Human
acacucagcuguucagauug

SEQ ID NO: 3232935 - RNA, 14 nt, Human
acacuccagugaga

SEQ ID NO: 3232936 - RNA, 13 nt, Human
acacuccuucaca

SEQ ID NO: 3232937 - RNA, 11 nt, Human
acacucugaga

SEQ ID NO: 3232938 - RNA, 13 nt, Human
acacucugagacu

SEQ ID NO: 3232939 - RNA, 16 nt, Human
acacucuaacuguaua

SEQ ID NO: 3232940 - RNA, 17 nt, Human
acacucuaacuguauau

SEQ ID NO: 3232941 - RNA, 10 nt, Human
acacuguuau

SEQ ID NO: 3232942 - RNA, 15 nt, Human
acacuguuauuuuca

SEQ ID NO: 3232943 - RNA, 21 nt, Human
acacuguuauuuucagcauga

SEQ ID NO: 3232944 - RNA, 22 nt, Human
acacuguucucugcccuccaag

SEQ ID NO: 3232945 - RNA, 23 nt, Human
acacuguucucugcccuccaaga

SEQ ID NO: 3232946 - RNA, 16 nt, Human
acacuguucucugccc

SEQ ID NO: 3232947 - RNA, 17 nt, Human
acacuguucucugcccu

SEQ ID NO: 3232948 - RNA, 18 nt, Human
acacuguucucugcccuc

SEQ ID NO: 3232949 - RNA, 20 nt, Human
acacuguucucugcccucca

SEQ ID NO: 3232950 - RNA, 14 nt, Human
acacuguucucugc

SEQ ID NO: 3232951 - RNA, 15 nt, Human
acacuguucucugcc

SEQ ID NO: 3232952 - RNA, 22 nt, Human
acacugaaaagaaggaaagaug

SEQ ID NO: 3232953 - RNA, 12 nt, Human
acacugaaauaa

SEQ ID NO: 3232954 - RNA, 13 nt, Human
uagauauaaugaa

SEQ ID NO: 3232955 - RNA, 14 nt, Human
uagauauaaugaac

SEQ ID NO: 3232956 - RNA, 20 nt, Human
uagauauaaugaacaaaauu

SEQ ID NO: 3232957 - RNA, 23 nt, Human
uagauauaaugaacaaaauuauu

SEQ ID NO: 3232958 - RNA, 23 nt, Human
acaaauaguaggcaagauggcac

SEQ ID NO: 3232959 - RNA, 22 nt, Human
acaaauaguaggcaagauggca

SEQ ID NO: 3232960 - RNA, 16 nt, Human
acaaauauuaaaaagu

SEQ ID NO: 3232961 - RNA, 12 nt, Human
acaaauauuaaa

SEQ ID NO: 3232962 - RNA, 18 nt, Human
acaaauauuaaaaagucu

SEQ ID NO: 3232963 - RNA, 20 nt, Human
acaaauauuaaaaagucuuu

SEQ ID NO: 3232964 - RNA, 13 nt, Human
acaaauauuauuu

SEQ ID NO: 3232965 - RNA, 15 nt, Human
acaaauauuauuugu

SEQ ID NO: 3232966 - RNA, 21 nt, Human
acaaauauuauuuguguuucc

SEQ ID NO: 3232967 - RNA, 16 nt, Human
uagaugcuacuaagaa

SEQ ID NO: 3232968 - RNA, 20 nt, Human
uagauccauuaauuuaaaug

SEQ ID NO: 3232969 - RNA, 17 nt, Human
uagauccuaagaugugu

SEQ ID NO: 3232970 - RNA, 21 nt, Human
uagauccuaagauguguucuu

SEQ ID NO: 3232971 - RNA, 14 nt, Human
acaaauaacaacuu

SEQ ID NO: 3232972 - RNA, 22 nt, Human
acaaauaacaacuuuuuuuucu

SEQ ID NO: 3232973 - RNA, 15 nt, Human
acaaauaacaacuuu

SEQ ID NO: 3232974 - RNA, 18 nt, Human
acaaaguuuaucuuggcc

SEQ ID NO: 3232975 - RNA, 14 nt, Human
acaaaguuucagag

SEQ ID NO: 3232976 - RNA, 18 nt, Human
acaaaguuucagaguaua

SEQ ID NO: 3232977 - RNA, 19 nt, Human
acaaaguuucagaguauau

SEQ ID NO: 3232978 - RNA, 20 nt, Human
acaaaguuucagaguauauu

SEQ ID NO: 3232979 - RNA, 22 nt, Human
acaaaguuucagaguauauugu

SEQ ID NO: 3232980 - RNA, 14 nt, Human
acaaaacuuuucua

SEQ ID NO: 3232981 - RNA, 21 nt, Human
acaaaacuuagcaucuaauuu

SEQ ID NO: 3232982 - RNA, 21 nt, Human
acaaagcgugguggacaugca

SEQ ID NO: 3232983 - RNA, 18 nt, Human
acaaagcccuuccauguc

SEQ ID NO: 3232984 - RNA, 21 nt, Human
aauuuguuggggcuuuacaua

SEQ ID NO: 3232985 - RNA, 21 nt, Human
aauuuuucuuauuucauuucu

SEQ ID NO: 3232986 - RNA, 21 nt, Human
aauuuuucuguauagacagga

SEQ ID NO: 3232987 - RNA, 22 nt, Human
aauuuuuaccauaguuuucuca

SEQ ID NO: 3232988 - RNA, 18 nt, Human
aauuuuugcuuuuagaaa

SEQ ID NO: 3232989 - RNA, 19 nt, Human
aauuuuugcuuuuagaaaa

SEQ ID NO: 3232990 - RNA, 20 nt, Human
aauuuuugcuuuuagaaaag

SEQ ID NO: 3232991 - RNA, 18 nt, Human
aauuuuugguugaauaaa

SEQ ID NO: 3232992 - RNA, 16 nt, Human
aauuuuugguugaaua

SEQ ID NO: 3232993 - RNA, 14 nt, Human
aauuuuugguugaa

SEQ ID NO: 3232994 - RNA, 20 nt, Human
aauuuuuuggcacuugccau

SEQ ID NO: 3232995 - RNA, 23 nt, Human
aauuuuuggugggugaaaggaau

SEQ ID NO: 3232996 - RNA, 15 nt, Human
aauuuuuuuguauga

SEQ ID NO: 3232997 - RNA, 17 nt, Human
aauuuuuuuguaugaaa

SEQ ID NO: 3232998 - RNA, 18 nt, Human
aauuuuuuuguaugaaaa

SEQ ID NO: 3232999 - RNA, 19 nt, Human
aauuuuuuuguaugaaaac

SEQ ID NO: 3233000 - RNA, 20 nt, Human
aauuuuuuuucaugcuuuau

SEQ ID NO: 3233001 - RNA, 14 nt, Human
uacuuuuuugaaau

SEQ ID NO: 3233002 - RNA, 15 nt, Human
uacuuuuuugaaauc

SEQ ID NO: 3233003 - RNA, 15 nt, Human
aauuugcagcuucca

SEQ ID NO: 3233004 - RNA, 16 nt, Human
aauuuguggugauuug

SEQ ID NO: 3233005 - RNA, 14 nt, Human
aauuuguggugauu

SEQ ID NO: 3233006 - RNA, 16 nt, Human
aauuuguuauaaugaa

SEQ ID NO: 3233007 - RNA, 19 nt, Human
aauuuguguaaauuauuga

SEQ ID NO: 3233008 - RNA, 17 nt, Human
aauuuguguaauauuac

SEQ ID NO: 3233009 - RNA, 14 nt, Human
aauuuguguguuuu

SEQ ID NO: 3233010 - RNA, 17 nt, Human
aauuuguguguuuuuag

SEQ ID NO: 3233011 - RNA, 21 nt, Human
aauuuguguguuuuuagcugu

SEQ ID NO: 3233012 - RNA, 23 nt, Human
aauuuguguguuuuuagcuguga

SEQ ID NO: 3233013 - RNA, 18 nt, Human
aauuugggggaaaauuua

SEQ ID NO: 3233014 - RNA, 9 nt, Human
aauuuggaa

SEQ ID NO: 3233015 - RNA, 14 nt, Human
aauuuggaaacuaa

SEQ ID NO: 3233016 - RNA, 16 nt, Human
aauuuggaaacuaaua

SEQ ID NO: 3233017 - RNA, 17 nt, Human
aauuuggaaacuaauaa

SEQ ID NO: 3233018 - RNA, 18 nt, Human
aauuuggaaacuaauaaa

SEQ ID NO: 3233019 - RNA, 20 nt, Human
aauuuggaaacuaauaaaau

SEQ ID NO: 3233020 - RNA, 21 nt, Human
aauuuggaaacuaauaaaaua

SEQ ID NO: 3233021 - RNA, 12 nt, Human
aauuugcugcug

SEQ ID NO: 3233022 - RNA, 13 nt, Human
aauuugcugcuga

SEQ ID NO: 3233023 - RNA, 12 nt, Human
acaaucuucugu

SEQ ID NO: 3233024 - RNA, 18 nt, Human
uagccuuuaccugugaag

SEQ ID NO: 3233025 - RNA, 22 nt, Human
uagccuuuaccugugaaguguu

SEQ ID NO: 3233026 - RNA, 13 nt, Human
uagccuuucuuuu

SEQ ID NO: 3233027 - RNA, 14 nt, Human
uagcuauuacugga

SEQ ID NO: 3233028 - RNA, 15 nt, Human
uagcuauuacuggau

SEQ ID NO: 3233029 - RNA, 14 nt, Human
uagcuaugcuguau

SEQ ID NO: 3233030 - RNA, 16 nt, Human
uagcuaugcuguaucu

SEQ ID NO: 3233031 - RNA, 21 nt, Human
uagcuaugcuguaucugugcu

SEQ ID NO: 3233032 - RNA, 20 nt, Human
uagcgacaacagauuggauu

SEQ ID NO: 3233033 - RNA, 15 nt, Human
uagcuacagugcaua

SEQ ID NO: 3233034 - RNA, 21 nt, Human
uagcuacguuuacucacagcc

SEQ ID NO: 3233035 - RNA, 19 nt, Human
uagcgacaacagauuggau

SEQ ID NO: 3233036 - RNA, 15 nt, Human
acaagcuccaagcuc

SEQ ID NO: 3233037 - RNA, 16 nt, Human
acaagcuccaagcucc

SEQ ID NO: 3233038 - RNA, 17 nt, Human
acaagcuccaagcuccc

SEQ ID NO: 3233039 - RNA, 19 nt, Human
acaagcuccaagcucccag

SEQ ID NO: 3233040 - RNA, 22 nt, Human
acaagcuccaagcucccaggca

SEQ ID NO: 3233041 - RNA, 22 nt, Human
acaagccuggaaaaaaacauca

SEQ ID NO: 3233042 - RNA, 20 nt, Human
acaaguugagcuaugacuua

SEQ ID NO: 3233043 - RNA, 21 nt, Human
acaaguugagcuaugacuuaa

SEQ ID NO: 3233044 - RNA, 22 nt, Human
acaauaggaugggcuucugugc

SEQ ID NO: 3233045 - RNA, 18 nt, Human
acaaucucggcucacugc

SEQ ID NO: 3233046 - RNA, 20 nt, Human
acaaucucggcucacugcau

SEQ ID NO: 3233047 - RNA, 21 nt, Human
acaauauaagagcuuccaauu

SEQ ID NO: 3233048 - RNA, 18 nt, Human
acaauaugcccuuucugg

SEQ ID NO: 3233049 - RNA, 18 nt, Human
acaauauguacauuucua

SEQ ID NO: 3233050 - RNA, 17 nt, Human
acaauauguacauuucu

SEQ ID NO: 3233051 - RNA, 15 nt, Human
acaaaugcaucuuug

SEQ ID NO: 3233052 - RNA, 16 nt, Human
acaaaugcaucuuuga

SEQ ID NO: 3233053 - RNA, 18 nt, Human
acaaaugcaucuuugaug

SEQ ID NO: 3233054 - RNA, 20 nt, Human
acaaaugcaucuuugaugug

SEQ ID NO: 3233055 - RNA, 18 nt, Human
acaaaugacuuuauuauu

SEQ ID NO: 3233056 - RNA, 21 nt, Human
acaaaugacuuuauuauuuau

SEQ ID NO: 3233057 - RNA, 23 nt, Human
acaaaugacuuuauuauuuauuu

SEQ ID NO: 3233058 - RNA, 15 nt, Human
acaaaugauugcuuu

SEQ ID NO: 3233059 - RNA, 21 nt, Human
acaaaugauugcuuuuaaaau

SEQ ID NO: 3233060 - RNA, 19 nt, Human
acaaaugauugcuuuuaaa

SEQ ID NO: 3233061 - RNA, 18 nt, Human
acaaaugauugcuuuuaa

SEQ ID NO: 3233062 - RNA, 16 nt, Human
acaaaugauugcuuuu

SEQ ID NO: 3233063 - RNA, 15 nt, Human
acaaaugacuuuauu

SEQ ID NO: 3233064 - RNA, 16 nt, Human
acaaaugacuuuauua

SEQ ID NO: 3233065 - RNA, 17 nt, Human
acaaaugacuuuauuau

SEQ ID NO: 3233066 - RNA, 23 nt, Human
uagcaagguuuggugcaaaguau

SEQ ID NO: 3233067 - RNA, 22 nt, Human
uagcaaaugagacagcagucuu

SEQ ID NO: 3233068 - RNA, 21 nt, Human
uagcaaagcggguuauaauga

SEQ ID NO: 3233069 - RNA, 17 nt, Human
acaaauuuacagagaca

SEQ ID NO: 3233070 - RNA, 22 nt, Human
acaaauuguuacuccauauaua

SEQ ID NO: 3233071 - RNA, 18 nt, Human
acaacagucuucauuuuu

SEQ ID NO: 3233072 - RNA, 16 nt, Human
acaacauccaaguggc

SEQ ID NO: 3233073 - RNA, 22 nt, Human
acaacauagcagaucuguuuug

SEQ ID NO: 3233074 - RNA, 17 nt, Human
acaacaucuuuuucuac

SEQ ID NO: 3233075 - RNA, 13 nt, Human
acaagacacagug

SEQ ID NO: 3233076 - RNA, 22 nt, Human
acaagagcccaggccuccuaca

SEQ ID NO: 3233077 - RNA, 18 nt, Human
acaagagcuuaacagugu

SEQ ID NO: 3233078 - RNA, 19 nt, Human
acaagagcuuaacagugug

SEQ ID NO: 3233079 - RNA, 18 nt, Human
acaagagcccaggccucc

SEQ ID NO: 3233080 - RNA, 14 nt, Human
acaagacacaguga

SEQ ID NO: 3233081 - RNA, 23 nt, Human
acaacauccaaguggccuccguc

SEQ ID NO: 3233082 - RNA, 13 nt, Human
acaagcuccaagc

SEQ ID NO: 3233083 - RNA, 17 nt, Human
acaagcgugagccacug

SEQ ID NO: 3233084 - RNA, 19 nt, Human
acaagauugucauuaguga

SEQ ID NO: 3233085 - RNA, 13 nt, Human
aauuuaguuguuu

SEQ ID NO: 3233086 - RNA, 20 nt, Human
aauuuauuagcccugcauuu

SEQ ID NO: 3233087 - RNA, 17 nt, Human
aauuuaucagauugcuu

SEQ ID NO: 3233088 - RNA, 20 nt, Human
aauuuaucagauugcuuuug

SEQ ID NO: 3233089 - RNA, 22 nt, Human
aauuuaucagauugcuuuugug

SEQ ID NO: 3233090 - RNA, 14 nt, Human
aauuuaugugaugg

SEQ ID NO: 3233091 - RNA, 17 nt, Human
aauuuacagagacagaa

SEQ ID NO: 3233092 - RNA, 18 nt, Human
aauuuacagagacagaaa

SEQ ID NO: 3233093 - RNA, 15 nt, Human
aauuuaccugaaguc

SEQ ID NO: 3233094 - RNA, 17 nt, Human
aauuuaccugaagucuu

SEQ ID NO: 3233095 - RNA, 14 nt, Human
aauuuacugugacu

SEQ ID NO: 3233096 - RNA, 15 nt, Human
aauuuacuuuggaaa

SEQ ID NO: 3233097 - RNA, 16 nt, Human
aauuuacuacaauaug

SEQ ID NO: 3233098 - RNA, 23 nt, Human
aauuuacuacaauauguacauuu

SEQ ID NO: 3233099 - RNA, 22 nt, Human
aauuuacuacaauauguacauu

SEQ ID NO: 3233100 - RNA, 21 nt, Human
aauuuacuacaauauguacau

SEQ ID NO: 3233101 - RNA, 17 nt, Human
aauuuacuacaauaugu

SEQ ID NO: 3233102 - RNA, 21 nt, Human
aauuuaaggucuguuugcugu

SEQ ID NO: 3233103 - RNA, 16 nt, Human
aauuuaaggucuguuu

SEQ ID NO: 3233104 - RNA, 18 nt, Human
aauuuaaaugauuuaaau

SEQ ID NO: 3233105 - RNA, 15 nt, Human
aauuggaaaagacua

SEQ ID NO: 3233106 - RNA, 19 nt, Human
aauuggaaaagacuaagau

SEQ ID NO: 3233107 - RNA, 18 nt, Human
aauuggaagucuaagaac

SEQ ID NO: 3233108 - RNA, 18 nt, Human
aauuggaaugcacucaga

SEQ ID NO: 3233109 - RNA, 12 nt, Human
uacuucuucugu

SEQ ID NO: 3233110 - RNA, 14 nt, Human
uacuucuucuguaa

SEQ ID NO: 3233111 - RNA, 15 nt, Human
uacuucuucuguaau

SEQ ID NO: 3233112 - RNA, 17 nt, Human
uacuucuucuguaauau

SEQ ID NO: 3233113 - RNA, 15 nt, Human
uacuuucuguuaaaa

SEQ ID NO: 3233114 - RNA, 12 nt, Human
uacuuucuguua

SEQ ID NO: 3233115 - RNA, 17 nt, Human
uacuuuccaauucuccu

SEQ ID NO: 3233116 - RNA, 19 nt, Human
uacuuuccaauucuccuuu

SEQ ID NO: 3233117 - RNA, 18 nt, Human
uacuuuguauuguccuau

SEQ ID NO: 3233118 - RNA, 21 nt, Human
uacuuugucuaagaaacauug

SEQ ID NO: 3233119 - RNA, 17 nt, Human
uacuuugucuaagaaac

SEQ ID NO: 3233120 - RNA, 20 nt, Human
uacuuugucuaagaaacauu

SEQ ID NO: 3233121 - RNA, 19 nt, Human
uacuuugucuaagaaacau

SEQ ID NO: 3233122 - RNA, 17 nt, Human
uacuuucuguuaaaaug

SEQ ID NO: 3233123 - RNA, 15 nt, Human
uacuuucuucaaaau

SEQ ID NO: 3233124 - RNA, 17 nt, Human
uacuuucuucagguaaa

SEQ ID NO: 3233125 - RNA, 15 nt, Human
uacuucugcuacaua

SEQ ID NO: 3233126 - RNA, 20 nt, Human
uacuucuccacccugcucuc

SEQ ID NO: 3233127 - RNA, 16 nt, Human
uacuucuuauacauuu

SEQ ID NO: 3233128 - RNA, 13 nt, Human
uacuucuugaaua

SEQ ID NO: 3233129 - RNA, 20 nt, Human
uacuucuugaauauaaaaaa

SEQ ID NO: 3233130 - RNA, 21 nt, Human
uacuucuugaauauaaaaaau

SEQ ID NO: 3233131 - RNA, 15 nt, Human
uacuucuuauacauu

SEQ ID NO: 3233132 - RNA, 14 nt, Human
uacuucuuauacau

SEQ ID NO: 3233133 - RNA, 22 nt, Human
uacuuauuuaugaacagacuuu

SEQ ID NO: 3233134 - RNA, 23 nt, Human
uacuuccaagacuuauuuucaca

SEQ ID NO: 3233135 - RNA, 18 nt, Human
uacuucauguaauccaaa

SEQ ID NO: 3233136 - RNA, 14 nt, Human
uacuuccccuuccu

SEQ ID NO: 3233137 - RNA, 15 nt, Human
uacuuccccuuccua

SEQ ID NO: 3233138 - RNA, 18 nt, Human
uacuuccccuuccuaauu

SEQ ID NO: 3233139 - RNA, 20 nt, Human
uacuuccccuuccuaauucc

SEQ ID NO: 3233140 - RNA, 18 nt, Human
uacuucuccacccugcuc

SEQ ID NO: 3233141 - RNA, 13 nt, Human
uacuucuccaccc

SEQ ID NO: 3233142 - RNA, 23 nt, Human
uacuuccugugacuucagcucug

SEQ ID NO: 3233143 - RNA, 11 nt, Human
aauuucuuuug

SEQ ID NO: 3233144 - RNA, 16 nt, Human
aauuugaaaaugauaa

SEQ ID NO: 3233145 - RNA, 19 nt, Human
uacuguacaaugacuuuau

SEQ ID NO: 3233146 - RNA, 17 nt, Human
aauugagccuaaaaaua

SEQ ID NO: 3233147 - RNA, 23 nt, Human
aauugagccuaaaaauaaagcac

SEQ ID NO: 3233148 - RNA, 17 nt, Human
aauugauguugaugcaa

SEQ ID NO: 3233149 - RNA, 16 nt, Human
aauugauguugaugca

SEQ ID NO: 3233150 - RNA, 23 nt, Human
aauugagcugcuuuuuuugaaac

SEQ ID NO: 3233151 - RNA, 22 nt, Human
aauugagcugcuuuuuuugaaa

SEQ ID NO: 3233152 - RNA, 15 nt, Human
aauugauguugaugc

SEQ ID NO: 3233153 - RNA, 14 nt, Human
aauugauguugaug

SEQ ID NO: 3233154 - RNA, 13 nt, Human
aauugauguugau

SEQ ID NO: 3233155 - RNA, 12 nt, Human
aauugauguuga

SEQ ID NO: 3233156 - RNA, 15 nt, Human
aauugcaaucuauaa

SEQ ID NO: 3233157 - RNA, 16 nt, Human
uacugggagccuaccc

SEQ ID NO: 3233158 - RNA, 13 nt, Human
uacugguaagauu

SEQ ID NO: 3233159 - RNA, 17 nt, Human
uacugguaagauuguua

SEQ ID NO: 3233160 - RNA, 21 nt, Human
uacugguaagauuguuauuaa

SEQ ID NO: 3233161 - RNA, 17 nt, Human
uacugagagugaacaaa

SEQ ID NO: 3233162 - RNA, 20 nt, Human
uacugacuccaaccauucaa

SEQ ID NO: 3233163 - RNA, 17 nt, Human
uacugaccagacaagcu

SEQ ID NO: 3233164 - RNA, 14 nt, Human
uacucuagagaagu

SEQ ID NO: 3233165 - RNA, 16 nt, Human
uacucuacccucuuag

SEQ ID NO: 3233166 - RNA, 17 nt, Human
uacucaaacuccauucu

SEQ ID NO: 3233167 - RNA, 22 nt, Human
uacucuacccucuuagaaaaac

SEQ ID NO: 3233168 - RNA, 18 nt, Human
uacuaaaaauacaaaaaa

SEQ ID NO: 3233169 - RNA, 18 nt, Human
uacuagacugccacaagg

SEQ ID NO: 3233170 - RNA, 18 nt, Human
uacuagagauauuuugua

SEQ ID NO: 3233171 - RNA, 20 nt, Human
uacuagagauauuuuguaaa

SEQ ID NO: 3233172 - RNA, 23 nt, Human
uacuagagauauuuuguaaaaug

SEQ ID NO: 3233173 - RNA, 24 nt, Human
uacuagagauauuuuguaaaaugu

SEQ ID NO: 3233174 - RNA, 16 nt, Human
uacuagaguuggcaug

SEQ ID NO: 3233175 - RNA, 23 nt, Human
uacuagauuugggagaagggcag

SEQ ID NO: 3233176 - RNA, 16 nt, Human
uacuagauuugggaga

SEQ ID NO: 3233177 - RNA, 14 nt, Human
uacuaaaaauacaa

SEQ ID NO: 3233178 - RNA, 13 nt, Human
uacgugaguccug

SEQ ID NO: 3233179 - RNA, 16 nt, Human
uacgucugacaggcaa

SEQ ID NO: 3233180 - RNA, 23 nt, Human
uacggauccugcacugacucugg

SEQ ID NO: 3233181 - RNA, 14 nt, Human
uacgucugacaggc

SEQ ID NO: 3233182 - RNA, 15 nt, Human
uacgucugacaggca

SEQ ID NO: 3233183 - RNA, 22 nt, Human
uacggauccugcacugacucug

SEQ ID NO: 3233184 - RNA, 18 nt, Human
aauugacaggcgaaagaa

SEQ ID NO: 3233185 - RNA, 24 nt, Human
uacgcuccaucgcugucaucucag

SEQ ID NO: 3233186 - RNA, 16 nt, Human
aauguguguaugugug

SEQ ID NO: 3233187 - RNA, 16 nt, Human
aaugugugugauguga

SEQ ID NO: 3233188 - RNA, 16 nt, Human
aauugaaguuucaagu

SEQ ID NO: 3233189 - RNA, 20 nt, Human
aauugaaguuucaaguuuua

SEQ ID NO: 3233190 - RNA, 23 nt, Human
aaugugugugaugugacauuugu

SEQ ID NO: 3233191 - RNA, 21 nt, Human
aaugugugugaugugacauuu

SEQ ID NO: 3233192 - RNA, 15 nt, Human
aaugugucuuucuaa

SEQ ID NO: 3233193 - RNA, 18 nt, Human
aaugugucuuucuaagaa

SEQ ID NO: 3233194 - RNA, 21 nt, Human
aaugugugagugcauguacua

SEQ ID NO: 3233195 - RNA, 20 nt, Human
aaugugugagugcauguacu

SEQ ID NO: 3233196 - RNA, 18 nt, Human
aaugugugagugcaugua

SEQ ID NO: 3233197 - RNA, 15 nt, Human
aauguguguaugugu

SEQ ID NO: 3233198 - RNA, 16 nt, Human
aaugugugcccagcuu

SEQ ID NO: 3233199 - RNA, 16 nt, Human
aauguguauaaauugu

SEQ ID NO: 3233200 - RNA, 18 nt, Human
aauguguauaaauugucu

SEQ ID NO: 3233201 - RNA, 15 nt, Human
uaauuuaucagauug

SEQ ID NO: 3233202 - RNA, 15 nt, Human
uaauuuaaaauugug

SEQ ID NO: 3233203 - RNA, 16 nt, Human
uaauuuaaaauuguga

SEQ ID NO: 3233204 - RNA, 23 nt, Human
uaauuguuguuuguauguauaau

SEQ ID NO: 3233205 - RNA, 22 nt, Human
uaauuguuguuuguauguauaa

SEQ ID NO: 3233206 - RNA, 13 nt, Human
uaauuccacagcu

SEQ ID NO: 3233207 - RNA, 14 nt, Human
uaauuccacagcug

SEQ ID NO: 3233208 - RNA, 17 nt, Human
uaauuccacagcugcuc

SEQ ID NO: 3233209 - RNA, 15 nt, Human
uaauuguuguuugua

SEQ ID NO: 3233210 - RNA, 19 nt, Human
uaauuguuguuuguaugua

SEQ ID NO: 3233211 - RNA, 18 nt, Human
uaauuguuguuuguaugu

SEQ ID NO: 3233212 - RNA, 15 nt, Human
uaauuccaugaaugu

SEQ ID NO: 3233213 - RNA, 16 nt, Human
uaauuauuugucucag

SEQ ID NO: 3233214 - RNA, 13 nt, Human
uaauuauuugaau

SEQ ID NO: 3233215 - RNA, 12 nt, Human
uaauuauuugaa

SEQ ID NO: 3233216 - RNA, 17 nt, Human
uaauuauuuauuacaua

SEQ ID NO: 3233217 - RNA, 21 nt, Human
uaauucaaagcaccaaaauaa

SEQ ID NO: 3233218 - RNA, 19 nt, Human
uaauucaaagcaccaaaau

SEQ ID NO: 3233219 - RNA, 12 nt, Human
uaauucaaagca

SEQ ID NO: 3233220 - RNA, 14 nt, Human
aaugagccuggcaa

SEQ ID NO: 3233221 - RNA, 17 nt, Human
aaugagcuugauuaaau

SEQ ID NO: 3233222 - RNA, 18 nt, Human
aaugagcuugauuaaauc

SEQ ID NO: 3233223 - RNA, 19 nt, Human
aaugagcuugauuaaauca

SEQ ID NO: 3233224 - RNA, 14 nt, Human
uacaaaaacacagc

SEQ ID NO: 3233225 - RNA, 13 nt, Human
uacaaaaacacag

SEQ ID NO: 3233226 - RNA, 21 nt, Human
uacaaaaaaaaaaaaaaauua

SEQ ID NO: 3233227 - RNA, 11 nt, Human
uaauuucagug

SEQ ID NO: 3233228 - RNA, 15 nt, Human
uaauuucaguguaaa

SEQ ID NO: 3233229 - RNA, 16 nt, Human
uaauuucaguguaaag

SEQ ID NO: 3233230 - RNA, 19 nt, Human
uaauuucaagcuuauuuug

SEQ ID NO: 3233231 - RNA, 11 nt, Human
uaauuucaagc

SEQ ID NO: 3233232 - RNA, 15 nt, Human
uacaaaaacacagca

SEQ ID NO: 3233233 - RNA, 15 nt, Human
uacaaaaagcauaaa

SEQ ID NO: 3233234 - RNA, 20 nt, Human
uacaaaaagcauaaaaauua

SEQ ID NO: 3233235 - RNA, 12 nt, Human
uacaaaacuuua

SEQ ID NO: 3233236 - RNA, 23 nt, Human
uacaaaaccacaguguaccauua

SEQ ID NO: 3233237 - RNA, 21 nt, Human
uacaaaaccacaguguaccau

SEQ ID NO: 3233238 - RNA, 20 nt, Human
uacaaaaccacaguguacca

SEQ ID NO: 3233239 - RNA, 20 nt, Human
aaugcccagccccuucugac

SEQ ID NO: 3233240 - RNA, 22 nt, Human
aaugcccagccccuucugaccc

SEQ ID NO: 3233241 - RNA, 23 nt, Human
aaugcccagccccuucugaccca

SEQ ID NO: 3233242 - RNA, 24 nt, Human
aaugcccagccccuucugacccau

SEQ ID NO: 3233243 - RNA, 16 nt, Human
aauggacguguuauga

SEQ ID NO: 3233244 - RNA, 13 nt, Human
aauggacauuucu

SEQ ID NO: 3233245 - RNA, 18 nt, Human
aauggaagacagcucuua

SEQ ID NO: 3233246 - RNA, 17 nt, Human
aauggaaaacuuaguuu

SEQ ID NO: 3233247 - RNA, 22 nt, Human
aauggaaaacuuaguuugugaa

SEQ ID NO: 3233248 - RNA, 20 nt, Human
aauggaaaaugccaugaauu

SEQ ID NO: 3233249 - RNA, 17 nt, Human
aauggaaacagaggacc

SEQ ID NO: 3233250 - RNA, 16 nt, Human
aauggaagagagaaag

SEQ ID NO: 3233251 - RNA, 18 nt, Human
aauggaaacagaggacca

SEQ ID NO: 3233252 - RNA, 14 nt, Human
aaugcuuuuagugu

SEQ ID NO: 3233253 - RNA, 16 nt, Human
aaugcuuuuagugugu

SEQ ID NO: 3233254 - RNA, 21 nt, Human
aaugcuuuuagugugugcaua

SEQ ID NO: 3233255 - RNA, 22 nt, Human
aaugcugucuuucuugcucccu

SEQ ID NO: 3233256 - RNA, 21 nt, Human
aaugcugucuuucuugcuccc

SEQ ID NO: 3233257 - RNA, 19 nt, Human
aaugcugucuuucuugcuc

SEQ ID NO: 3233258 - RNA, 17 nt, Human
aaugcugucuuucuugc

SEQ ID NO: 3233259 - RNA, 14 nt, Human
aaugcccagccccu

SEQ ID NO: 3233260 - RNA, 15 nt, Human
aaugcccagccccuu

SEQ ID NO: 3233261 - RNA, 13 nt, Human
aaugcccagcccc

SEQ ID NO: 3233262 - RNA, 16 nt, Human
aaugcauaaaauguua

SEQ ID NO: 3233263 - RNA, 21 nt, Human
uacaagcgugagccacugcac

SEQ ID NO: 3233264 - RNA, 23 nt, Human
uacaaaauguaacuguuaccauu

SEQ ID NO: 3233265 - RNA, 18 nt, Human
uacaaaauguaacuguua

SEQ ID NO: 3233266 - RNA, 15 nt, Human
uacaaaauguaacug

SEQ ID NO: 3233267 - RNA, 14 nt, Human
uacaaaauguaacu

SEQ ID NO: 3233268 - RNA, 12 nt, Human
uacaaaauguaa

SEQ ID NO: 3233269 - RNA, 18 nt, Human
uacaaguacugguaagau

SEQ ID NO: 3233270 - RNA, 14 nt, Human
uacaaggacagccc

SEQ ID NO: 3233271 - RNA, 21 nt, Human
uacaaggccccaagguuuaca

SEQ ID NO: 3233272 - RNA, 22 nt, Human
uacaaggccccaagguuuacau

SEQ ID NO: 3233273 - RNA, 22 nt, Human
uacaaguaguucuguauuugaa

SEQ ID NO: 3233274 - RNA, 23 nt, Human
uacaaguaguucuguauuugaaa

SEQ ID NO: 3233275 - RNA, 17 nt, Human
uacaaguaguucuguau

SEQ ID NO: 3233276 - RNA, 18 nt, Human
uacaaguaguucuguauu

SEQ ID NO: 3233277 - RNA, 19 nt, Human
uacaaguaguucuguauuu

SEQ ID NO: 3233278 - RNA, 21 nt, Human
uacaaguaguucuguauuuga

SEQ ID NO: 3233279 - RNA, 15 nt, Human
uacaaguaguucugu

SEQ ID NO: 3233280 - RNA, 16 nt, Human
uacaaguaguucugua

SEQ ID NO: 3233281 - RNA, 14 nt, Human
uacaaguaguucug

SEQ ID NO: 3233282 - RNA, 13 nt, Human
aaugcauaaaaug

SEQ ID NO: 3233283 - RNA, 20 nt, Human
aaugcaguuacaaauuauaa

SEQ ID NO: 3233284 - RNA, 17 nt, Human
aaugcaguuacaaauua

SEQ ID NO: 3233285 - RNA, 23 nt, Human
aaugcaguuacaaauuauaaugu

SEQ ID NO: 3233286 - RNA, 14 nt, Human
uacagaggacagua

SEQ ID NO: 3233287 - RNA, 23 nt, Human
uacagagcccacgcccccacugg

SEQ ID NO: 3233288 - RNA, 20 nt, Human
uacagagccguaaaaacuga

SEQ ID NO: 3233289 - RNA, 19 nt, Human
uacagagccguaaaaacug

SEQ ID NO: 3233290 - RNA, 18 nt, Human
uacagaggacaguauuug

SEQ ID NO: 3233291 - RNA, 15 nt, Human
uacaggcauagaguu

SEQ ID NO: 3233292 - RNA, 19 nt, Human
uacacucaagcaugaagau

SEQ ID NO: 3233293 - RNA, 22 nt, Human
uacagagccguaaaaacugaag

SEQ ID NO: 3233294 - RNA, 17 nt, Human
uacaggcuccugccacc

SEQ ID NO: 3233295 - RNA, 14 nt, Human
uacaggcuccugcc

SEQ ID NO: 3233296 - RNA, 15 nt, Human
uacaggcuccugcca

SEQ ID NO: 3233297 - RNA, 22 nt, Human
uacaggcgugagccaccgugcc

SEQ ID NO: 3233298 - RNA, 15 nt, Human
uacaguaaugucaua

SEQ ID NO: 3233299 - RNA, 17 nt, Human
uacaguaaugucauaaa

SEQ ID NO: 3233300 - RNA, 18 nt, Human
uacaguaaugucauaaag

SEQ ID NO: 3233301 - RNA, 14 nt, Human
aauggacauuucua

SEQ ID NO: 3233302 - RNA, 20 nt, Human
aauggacgguuuaggugaaa

SEQ ID NO: 3233303 - RNA, 21 nt, Human
uacauauuagcgacaacagau

SEQ ID NO: 3233304 - RNA, 23 nt, Human
uacauauguauacaugugccaug

SEQ ID NO: 3233305 - RNA, 18 nt, Human
uacauauguauacaugug

SEQ ID NO: 3233306 - RNA, 17 nt, Human
uacauauguauacaugu

SEQ ID NO: 3233307 - RNA, 12 nt, Human
uacauauugaau

SEQ ID NO: 3233308 - RNA, 12 nt, Human
aauguacugcau

SEQ ID NO: 3233309 - RNA, 16 nt, Human
uacaucacguuaaagu

SEQ ID NO: 3233310 - RNA, 15 nt, Human
uacaguaucucaggg

SEQ ID NO: 3233311 - RNA, 16 nt, Human
uacauagucugaagug

SEQ ID NO: 3233312 - RNA, 17 nt, Human
aauguaugcuucauaca

SEQ ID NO: 3233313 - RNA, 17 nt, Human
aauguacugauuucagu

SEQ ID NO: 3233314 - RNA, 19 nt, Human
aauguacugauuucaguaa

SEQ ID NO: 3233315 - RNA, 18 nt, Human
aauguaugcuucauacag

SEQ ID NO: 3233316 - RNA, 21 nt, Human
aauguaugcuucauacaggga

SEQ ID NO: 3233317 - RNA, 14 nt, Human
aauguauguaaaua

SEQ ID NO: 3233318 - RNA, 15 nt, Human
aauguauguaaauag

SEQ ID NO: 3233319 - RNA, 18 nt, Human
aauguacugcauaugaaa

SEQ ID NO: 3233320 - RNA, 14 nt, Human
aauguacugcauau

SEQ ID NO: 3233321 - RNA, 14 nt, Human
aauguauguguaag

SEQ ID NO: 3233322 - RNA, 12 nt, Human
aauguaugugua

SEQ ID NO: 3233323 - RNA, 20 nt, Human
aauguauucauauuuguacu

SEQ ID NO: 3233324 - RNA, 17 nt, Human
aauguauucauauuugu

SEQ ID NO: 3233325 - RNA, 16 nt, Human
aauguauucauauuug

SEQ ID NO: 3233326 - RNA, 15 nt, Human
aauguauucauauuu

SEQ ID NO: 3233327 - RNA, 11 nt, Human
aaugugauaug

SEQ ID NO: 3233328 - RNA, 19 nt, Human
aaugugauauaaacagcuu

SEQ ID NO: 3233329 - RNA, 14 nt, Human
aauguggcuccugg

SEQ ID NO: 3233330 - RNA, 23 nt, Human
aaugugagugguugaauaugauu

SEQ ID NO: 3233331 - RNA, 22 nt, Human
aaugugagugguugaauaugau

SEQ ID NO: 3233332 - RNA, 14 nt, Human
aaugugacuuugaa

SEQ ID NO: 3233333 - RNA, 14 nt, Human
uaaugaaacuugga

SEQ ID NO: 3233334 - RNA, 14 nt, Human
uaaucauauuagac

SEQ ID NO: 3233335 - RNA, 12 nt, Human
uaaucauauuag

SEQ ID NO: 3233336 - RNA, 22 nt, Human
uaaucauauuagacuucuguuu

SEQ ID NO: 3233337 - RNA, 19 nt, Human
uaaugaaagacuguacaaa

SEQ ID NO: 3233338 - RNA, 18 nt, Human
uaaugaaagacuguacaa

SEQ ID NO: 3233339 - RNA, 17 nt, Human
uaaugaaagacuguaca

SEQ ID NO: 3233340 - RNA, 14 nt, Human
uaaugaaagacugu

SEQ ID NO: 3233341 - RNA, 15 nt, Human
uaaugaaacuuggau

SEQ ID NO: 3233342 - RNA, 20 nt, Human
uaaugacaggccuguccaac

SEQ ID NO: 3233343 - RNA, 15 nt, Human
uaaugacaggccugu

SEQ ID NO: 3233344 - RNA, 23 nt, Human
uaaugaaagacuguacaaaguag

SEQ ID NO: 3233345 - RNA, 22 nt, Human
uaaugaaagacuguacaaagua

SEQ ID NO: 3233346 - RNA, 15 nt, Human
uaaugacuuaagcac

SEQ ID NO: 3233347 - RNA, 21 nt, Human
uaaugacuuaagcacacuuga

SEQ ID NO: 3233348 - RNA, 17 nt, Human
uaaugagcaauaucugc

SEQ ID NO: 3233349 - RNA, 21 nt, Human
uaaucaccagggccaaaagcu

SEQ ID NO: 3233350 - RNA, 21 nt, Human
uaaucacccuaccaacuuuac

SEQ ID NO: 3233351 - RNA, 23 nt, Human
uaaucacccuaccaacuuuacug

SEQ ID NO: 3233352 - RNA, 23 nt, Human
uaaucaagagccuuaaaacauca

SEQ ID NO: 3233353 - RNA, 14 nt, Human
uaaucaagagccuu

SEQ ID NO: 3233354 - RNA, 18 nt, Human
uaaucaagagccuuaaaa

SEQ ID NO: 3233355 - RNA, 19 nt, Human
uaaucaagagccuuaaaac

SEQ ID NO: 3233356 - RNA, 20 nt, Human
uaaucaagagccuuaaaaca

SEQ ID NO: 3233357 - RNA, 23 nt, Human
uaaucaacauggcuacuugcuuu

SEQ ID NO: 3233358 - RNA, 18 nt, Human
uaauaggcucugccugac

SEQ ID NO: 3233359 - RNA, 13 nt, Human
aaucuucugaacu

SEQ ID NO: 3233360 - RNA, 20 nt, Human
aaucuucugaacuuggcgcu

SEQ ID NO: 3233361 - RNA, 21 nt, Human
aaucuuccuggucgaaaguua

SEQ ID NO: 3233362 - RNA, 19 nt, Human
aaucuuccuggucgaaagu

SEQ ID NO: 3233363 - RNA, 21 nt, Human
aaucuuauuaaaguuucaaaa

SEQ ID NO: 3233364 - RNA, 20 nt, Human
aaucuuauuaaaguuucaaa

SEQ ID NO: 3233365 - RNA, 17 nt, Human
uaauaccuuagaaggua

SEQ ID NO: 3233366 - RNA, 23 nt, Human
aaucuuccuggucgaaaguuagu

SEQ ID NO: 3233367 - RNA, 22 nt, Human
uaauacugaaccacuuguagau

SEQ ID NO: 3233368 - RNA, 20 nt, Human
uaauacugaaccacuuguag

SEQ ID NO: 3233369 - RNA, 21 nt, Human
uaauacugaaccacuuguaga

SEQ ID NO: 3233370 - RNA, 13 nt, Human
uaauacugaacca

SEQ ID NO: 3233371 - RNA, 14 nt, Human
uaauacugaaccac

SEQ ID NO: 3233372 - RNA, 15 nt, Human
uaauacugaaccacu

SEQ ID NO: 3233373 - RNA, 19 nt, Human
uaauacugaaccacuugua

SEQ ID NO: 3233374 - RNA, 13 nt, Human
uaauacucuauuu

SEQ ID NO: 3233375 - RNA, 14 nt, Human
uaauacucuauuuu

SEQ ID NO: 3233376 - RNA, 21 nt, Human
uaauguaacugcucuugggca

SEQ ID NO: 3233377 - RNA, 13 nt, Human
uaaugaggaaacu

SEQ ID NO: 3233378 - RNA, 21 nt, Human
uaaugagcaauaucugcuaga

SEQ ID NO: 3233379 - RNA, 18 nt, Human
uaaugagcaauaucugcu

SEQ ID NO: 3233380 - RNA, 22 nt, Human
uaauggugaugcagucuuagau

SEQ ID NO: 3233381 - RNA, 18 nt, Human
aaucuuguugguucacca

SEQ ID NO: 3233382 - RNA, 19 nt, Human
aaucuuguugguucaccau

SEQ ID NO: 3233383 - RNA, 13 nt, Human
aaucuuguuuuga

SEQ ID NO: 3233384 - RNA, 14 nt, Human
aaucuuguuuugaa

SEQ ID NO: 3233385 - RNA, 17 nt, Human
aaucuuguuuugaaaau

SEQ ID NO: 3233386 - RNA, 23 nt, Human
aaucuuguuuugaaaauaaccua

SEQ ID NO: 3233387 - RNA, 19 nt, Human
aaucuugugaaaauaauug

SEQ ID NO: 3233388 - RNA, 14 nt, Human
aaucuugugaaaau

SEQ ID NO: 3233389 - RNA, 18 nt, Human
aaucuuuguaccaaaauu

SEQ ID NO: 3233390 - RNA, 20 nt, Human
aaucuuuguaccaaaauuuu

SEQ ID NO: 3233391 - RNA, 23 nt, Human
aaucuuuguaccaaaauuuuaaa

SEQ ID NO: 3233392 - RNA, 22 nt, Human
aaugacagguuugggaccccug

SEQ ID NO: 3233393 - RNA, 15 nt, Human
aaugacaggccuguc

SEQ ID NO: 3233394 - RNA, 15 nt, Human
aaugagccuggcaag

SEQ ID NO: 3233395 - RNA, 22 nt, Human
aaugagacagcagucuuaugcu

SEQ ID NO: 3233396 - RNA, 13 nt, Human
aaugagacagcag

SEQ ID NO: 3233397 - RNA, 19 nt, Human
aaucuuauuaaaguuucaa

SEQ ID NO: 3233398 - RNA, 23 nt, Human
aaucugucugcuggucacuucuu

SEQ ID NO: 3233399 - RNA, 11 nt, Human
aaucugucugc

SEQ ID NO: 3233400 - RNA, 22 nt, Human
aaucugucugcuggucacuucu

SEQ ID NO: 3233401 - RNA, 14 nt, Human
aaucugucugcugg

SEQ ID NO: 3233402 - RNA, 15 nt, Human
aaucucaaauaacua

SEQ ID NO: 3233403 - RNA, 15 nt, Human
aaucuauagaaagug

SEQ ID NO: 3233404 - RNA, 12 nt, Human
aaucucaaauag

SEQ ID NO: 3233405 - RNA, 16 nt, Human
aaucucaaauaggcua

SEQ ID NO: 3233406 - RNA, 22 nt, Human
aaucucaaauaggcuauuaaaa

SEQ ID NO: 3233407 - RNA, 13 nt, Human
aaucucaaauaac

SEQ ID NO: 3233408 - RNA, 14 nt, Human
aaucuauagaaagu

SEQ ID NO: 3233409 - RNA, 22 nt, Human
aaucuagccagugaacauaauu

SEQ ID NO: 3233410 - RNA, 13 nt, Human
aaucuacugcauu

SEQ ID NO: 3233411 - RNA, 14 nt, Human
aaucuacugcauuu

SEQ ID NO: 3233412 - RNA, 12 nt, Human
aaucuacuuaac

SEQ ID NO: 3233413 - RNA, 21 nt, Human
aaucuacuuaacccugacaaa

SEQ ID NO: 3233414 - RNA, 15 nt, Human
aaucuacugcauuua

SEQ ID NO: 3233415 - RNA, 13 nt, Human
aaucuagaagagu

SEQ ID NO: 3233416 - RNA, 19 nt, Human
aauccuuacaaaugauugc

SEQ ID NO: 3233417 - RNA, 17 nt, Human
aauccuugauaauauau

SEQ ID NO: 3233418 - RNA, 19 nt, Human
aauccuugauaauauauug

SEQ ID NO: 3233419 - RNA, 14 nt, Human
aaucuaacauuauu

SEQ ID NO: 3233420 - RNA, 15 nt, Human
aaucuaacauuauua

SEQ ID NO: 3233421 - RNA, 17 nt, Human
aaucauuguccagagcu

SEQ ID NO: 3233422 - RNA, 15 nt, Human
aaucauuguccagag

SEQ ID NO: 3233423 - RNA, 12 nt, Human
uaaguagauuuc

SEQ ID NO: 3233424 - RNA, 15 nt, Human
uaaguagauuucaug

SEQ ID NO: 3233425 - RNA, 19 nt, Human
uaaguacuauguaucaaug

SEQ ID NO: 3233426 - RNA, 13 nt, Human
aaucauguuucuu

SEQ ID NO: 3233427 - RNA, 15 nt, Human
aaucaugccaguauu

SEQ ID NO: 3233428 - RNA, 17 nt, Human
aaucaugccaguauuuu

SEQ ID NO: 3233429 - RNA, 15 nt, Human
aaucaucauuauuau

SEQ ID NO: 3233430 - RNA, 12 nt, Human
uaauaaaauauu

SEQ ID NO: 3233431 - RNA, 13 nt, Human
uaauaaaauauuu

SEQ ID NO: 3233432 - RNA, 14 nt, Human
uaauaaaauauuuu

SEQ ID NO: 3233433 - RNA, 15 nt, Human
uaauaaaauauuuuc

SEQ ID NO: 3233434 - RNA, 17 nt, Human
uaauaaaauauuuucug

SEQ ID NO: 3233435 - RNA, 18 nt, Human
uaauaaaauauuuucugu

SEQ ID NO: 3233436 - RNA, 19 nt, Human
uaauaaaauauuuucugug

SEQ ID NO: 3233437 - RNA, 20 nt, Human
uaauaaaauauuuucugugu

SEQ ID NO: 3233438 - RNA, 21 nt, Human
uaauaaaauauuuucugugug

SEQ ID NO: 3233439 - RNA, 22 nt, Human
uaauaaaauauuuucugugugu

SEQ ID NO: 3233440 - RNA, 12 nt, Human
uaauaaaaucac

SEQ ID NO: 3233441 - RNA, 21 nt, Human
uaaguuuugacaagcuggcuu

SEQ ID NO: 3233442 - RNA, 11 nt, Human
uaauaaaacug

SEQ ID NO: 3233443 - RNA, 12 nt, Human
uaauaaaacuga

SEQ ID NO: 3233444 - RNA, 13 nt, Human
uaauaaaacugau

SEQ ID NO: 3233445 - RNA, 15 nt, Human
uaauaaaacugaugu

SEQ ID NO: 3233446 - RNA, 19 nt, Human
uaauaaaacugaugugaaa

SEQ ID NO: 3233447 - RNA, 21 nt, Human
uaaguuuggcaaacagaaugu

SEQ ID NO: 3233448 - RNA, 20 nt, Human
uaaguuugcacucaaaucuu

SEQ ID NO: 3233449 - RNA, 12 nt, Human
uaaguuugcacu

SEQ ID NO: 3233450 - RNA, 17 nt, Human
uaaguuugcacucaaau

SEQ ID NO: 3233451 - RNA, 13 nt, Human
uaaguuugcacuc

SEQ ID NO: 3233452 - RNA, 17 nt, Human
uaacauagaauugcaau

SEQ ID NO: 3233453 - RNA, 13 nt, Human
uaacaugcugugu

SEQ ID NO: 3233454 - RNA, 14 nt, Human
uaacaugcugugua

SEQ ID NO: 3233455 - RNA, 15 nt, Human
uaacaugcuguguaa

SEQ ID NO: 3233456 - RNA, 18 nt, Human
uaacaugcuguguaagcu

SEQ ID NO: 3233457 - RNA, 21 nt, Human
uaacaugcuguguaagcugug

SEQ ID NO: 3233458 - RNA, 22 nt, Human
uaacaugcuguguaagcugugu

SEQ ID NO: 3233459 - RNA, 20 nt, Human
uaacaugcccauauuuuacu

SEQ ID NO: 3233460 - RNA, 14 nt, Human
uaacauggaaguac

SEQ ID NO: 3233461 - RNA, 12 nt, Human
uaacuaaaauaa

SEQ ID NO: 3233462 - RNA, 19 nt, Human
uaacuaaaauaauuuugua

SEQ ID NO: 3233463 - RNA, 18 nt, Human
uaacuaaaauaauuuugu

SEQ ID NO: 3233464 - RNA, 15 nt, Human
uaacuaaaagguaug

SEQ ID NO: 3233465 - RNA, 14 nt, Human
uaacuaaaagguau

SEQ ID NO: 3233466 - RNA, 15 nt, Human
uaacauggaaguacu

SEQ ID NO: 3233467 - RNA, 15 nt, Human
uaaccucugcuuuua

SEQ ID NO: 3233468 - RNA, 17 nt, Human
uaaccucugcuuuuauc

SEQ ID NO: 3233469 - RNA, 20 nt, Human
uaaccucugcuuuuaucuca

SEQ ID NO: 3233470 - RNA, 18 nt, Human
uaaccucuguucaggaag

SEQ ID NO: 3233471 - RNA, 14 nt, Human
uaaccucuguucag

SEQ ID NO: 3233472 - RNA, 14 nt, Human
aauauccauauuaa

SEQ ID NO: 3233473 - RNA, 17 nt, Human
aauaucaaauuaauugu

SEQ ID NO: 3233474 - RNA, 14 nt, Human
aauaucaaauuaau

SEQ ID NO: 3233475 - RNA, 19 nt, Human
aauaucaaauuaauugugu

SEQ ID NO: 3233476 - RNA, 21 nt, Human
aauaucaaauuaauuguguga

SEQ ID NO: 3233477 - RNA, 13 nt, Human
aauaucacucauu

SEQ ID NO: 3233478 - RNA, 15 nt, Human
aauaucacucauuaa

SEQ ID NO: 3233479 - RNA, 16 nt, Human
aauaucacucauuaau

SEQ ID NO: 3233480 - RNA, 17 nt, Human
aauaucacucauuaauu

SEQ ID NO: 3233481 - RNA, 18 nt, Human
aauauauuacuuaacugu

SEQ ID NO: 3233482 - RNA, 21 nt, Human
aauauauuaguaagauacugu

SEQ ID NO: 3233483 - RNA, 20 nt, Human
aauauauggucuaauguuua

SEQ ID NO: 3233484 - RNA, 19 nt, Human
aauauauggucuaauguuu

SEQ ID NO: 3233485 - RNA, 18 nt, Human
aauauauggucuaauguu

SEQ ID NO: 3233486 - RNA, 17 nt, Human
aauauauggucuaaugu

SEQ ID NO: 3233487 - RNA, 13 nt, Human
aauauaugugaaa

SEQ ID NO: 3233488 - RNA, 14 nt, Human
aauauaugugaaag

SEQ ID NO: 3233489 - RNA, 16 nt, Human
aauagacagcaugaga

SEQ ID NO: 3233490 - RNA, 14 nt, Human
aauagcugggacua

SEQ ID NO: 3233491 - RNA, 13 nt, Human
aauagcugggacu

SEQ ID NO: 3233492 - RNA, 13 nt, Human
aauagcauguugu

SEQ ID NO: 3233493 - RNA, 15 nt, Human
aauagcauguuguag

SEQ ID NO: 3233494 - RNA, 16 nt, Human
aauagcauguuguaga

SEQ ID NO: 3233495 - RNA, 17 nt, Human
aauagcauguuguagau

SEQ ID NO: 3233496 - RNA, 18 nt, Human
aauagcauguuguagaua

SEQ ID NO: 3233497 - RNA, 16 nt, Human
aauagaugcugacugu

SEQ ID NO: 3233498 - RNA, 15 nt, Human
aauaggacuuguuuu

SEQ ID NO: 3233499 - RNA, 14 nt, Human
aauaggacuuguuu

SEQ ID NO: 3233500 - RNA, 17 nt, Human
aauaggagggaaaccuu

SEQ ID NO: 3233501 - RNA, 19 nt, Human
aauaggagggaaaccuuug

SEQ ID NO: 3233502 - RNA, 14 nt, Human
aauaggaugggcuu

SEQ ID NO: 3233503 - RNA, 20 nt, Human
aauaggaugggcuucugugc

SEQ ID NO: 3233504 - RNA, 15 nt, Human
aauaggcaaauuaau

SEQ ID NO: 3233505 - RNA, 16 nt, Human
aauaggcaaauuaauc

SEQ ID NO: 3233506 - RNA, 20 nt, Human
aauaggcuauuaaaaaaguc

SEQ ID NO: 3233507 - RNA, 21 nt, Human
aauaggcuauuaaaaaagucu

SEQ ID NO: 3233508 - RNA, 19 nt, Human
aauagggcccaugggaggg

SEQ ID NO: 3233509 - RNA, 20 nt, Human
aauagggcccaugggaggga

SEQ ID NO: 3233510 - RNA, 21 nt, Human
aauaguaggcaagauggcaca

SEQ ID NO: 3233511 - RNA, 13 nt, Human
aauaguaggcaag

SEQ ID NO: 3233512 - RNA, 16 nt, Human
aauaguaauauaauac

SEQ ID NO: 3233513 - RNA, 18 nt, Human
aauagggcuaggaauaua

SEQ ID NO: 3233514 - RNA, 15 nt, Human
aauaguaauauaaua

SEQ ID NO: 3233515 - RNA, 14 nt, Human
aauaguaauauaau

SEQ ID NO: 3233516 - RNA, 13 nt, Human
aauaguaauauaa

SEQ ID NO: 3233517 - RNA, 12 nt, Human
aauaguaauaua

SEQ ID NO: 3233518 - RNA, 15 nt, Human
aauaggaaaaacuga

SEQ ID NO: 3233519 - RNA, 16 nt, Human
aauaggaaaaacugau

SEQ ID NO: 3233520 - RNA, 16 nt, Human
aauagcuuuaaugaua

SEQ ID NO: 3233521 - RNA, 15 nt, Human
aauagcuuuaaugau

SEQ ID NO: 3233522 - RNA, 17 nt, Human
aauaggaaaaacugauu

SEQ ID NO: 3233523 - RNA, 18 nt, Human
aauaggaaaaacugauuu

SEQ ID NO: 3233524 - RNA, 19 nt, Human
aauaggaaaaacugauuuu

SEQ ID NO: 3233525 - RNA, 14 nt, Human
aauauuguuaaggg

SEQ ID NO: 3233526 - RNA, 14 nt, Human
aauauuucuucaaa

SEQ ID NO: 3233527 - RNA, 15 nt, Human
aauauuucuucaaau

SEQ ID NO: 3233528 - RNA, 16 nt, Human
aauauuucuucaaaua

SEQ ID NO: 3233529 - RNA, 20 nt, Human
aauauuucuucaaauaucuc

SEQ ID NO: 3233530 - RNA, 14 nt, Human
aaucagaauggaag

SEQ ID NO: 3233531 - RNA, 21 nt, Human
aaucagaagauagucuuggaa

SEQ ID NO: 3233532 - RNA, 15 nt, Human
aaucacuuucauaau

SEQ ID NO: 3233533 - RNA, 23 nt, Human
aaucacuguguauauuugauuua

SEQ ID NO: 3233534 - RNA, 22 nt, Human
aaucacuguguauauuugauuu

SEQ ID NO: 3233535 - RNA, 17 nt, Human
aauauuuucauuauaca

SEQ ID NO: 3233536 - RNA, 21 nt, Human
aaucacuguguauauuugauu

SEQ ID NO: 3233537 - RNA, 21 nt, Human
aauauuuuaauuuuuaaaugc

SEQ ID NO: 3233538 - RNA, 20 nt, Human
aauauuuuaauuuuuaaaug

SEQ ID NO: 3233539 - RNA, 11 nt, Human
aauauuuuaau

SEQ ID NO: 3233540 - RNA, 17 nt, Human
aauaugcaaagcacuga

SEQ ID NO: 3233541 - RNA, 15 nt, Human
aauaugcaaagcacu

SEQ ID NO: 3233542 - RNA, 14 nt, Human
aauaugaugacaau

SEQ ID NO: 3233543 - RNA, 16 nt, Human
aauaugaugacaauca

SEQ ID NO: 3233544 - RNA, 18 nt, Human
aauaugauuaaaaauauc

SEQ ID NO: 3233545 - RNA, 24 nt, Human
aauaugcaaagcacugacuucuaa

SEQ ID NO: 3233546 - RNA, 18 nt, Human
aauauugauaugcuuaua

SEQ ID NO: 3233547 - RNA, 17 nt, Human
aauauugauaugcuuau

SEQ ID NO: 3233548 - RNA, 11 nt, Human
aauauugcuga

SEQ ID NO: 3233549 - RNA, 12 nt, Human
aauauugcugau

SEQ ID NO: 3233550 - RNA, 13 nt, Human
aauauugcugaug

SEQ ID NO: 3233551 - RNA, 15 nt, Human
aauauugcugauggu

SEQ ID NO: 3233552 - RNA, 18 nt, Human
aauauugcugauggugca

SEQ ID NO: 3233553 - RNA, 21 nt, Human
aauauugcugauggugcaaug

SEQ ID NO: 3233554 - RNA, 22 nt, Human
aauauugcugauggugcaauga

SEQ ID NO: 3233555 - RNA, 18 nt, Human
uaagaauauuugaaugua

SEQ ID NO: 3233556 - RNA, 15 nt, Human
uaagaauauuugaau

SEQ ID NO: 3233557 - RNA, 18 nt, Human
uaacuuugguuaaaaucu

SEQ ID NO: 3233558 - RNA, 18 nt, Human
uaagaaugaguuucuuag

SEQ ID NO: 3233559 - RNA, 13 nt, Human
uaagaaugaguuu

SEQ ID NO: 3233560 - RNA, 17 nt, Human
uaagacauuuuuggaag

SEQ ID NO: 3233561 - RNA, 20 nt, Human
uaagaaugaguuucuuagac

SEQ ID NO: 3233562 - RNA, 19 nt, Human
uaacuaacaaacagauucu

SEQ ID NO: 3233563 - RNA, 14 nt, Human
uaacuaaauuuuaa

SEQ ID NO: 3233564 - RNA, 19 nt, Human
uaacuaaauuuuaaagcca

SEQ ID NO: 3233565 - RNA, 20 nt, Human
uaacuaaaauaauuuuguaa

SEQ ID NO: 3233566 - RNA, 21 nt, Human
uaacuaaaauaauuuuguaau

SEQ ID NO: 3233567 - RNA, 14 nt, Human
uaacuaaaauguau

SEQ ID NO: 3233568 - RNA, 16 nt, Human
uaacuaaaauguaucu

SEQ ID NO: 3233569 - RNA, 17 nt, Human
uaacuaaaauguaucua

SEQ ID NO: 3233570 - RNA, 23 nt, Human
uaacuaaaauguaucuaagaaua

SEQ ID NO: 3233571 - RNA, 22 nt, Human
uaacuaccuuuggcuuaauucc

SEQ ID NO: 3233572 - RNA, 21 nt, Human
uaacuaccuuuggcuuaauuc

SEQ ID NO: 3233573 - RNA, 17 nt, Human
uaacuaccuuuggcuua

SEQ ID NO: 3233574 - RNA, 18 nt, Human
uaacuacauauugaauag

SEQ ID NO: 3233575 - RNA, 13 nt, Human
aauauccucaauu

SEQ ID NO: 3233576 - RNA, 15 nt, Human
aauaucucuauuuaa

SEQ ID NO: 3233577 - RNA, 16 nt, Human
aauaucucuauuuaau

SEQ ID NO: 3233578 - RNA, 23 nt, Human
aauaucucuauuuaauuuugaca

SEQ ID NO: 3233579 - RNA, 18 nt, Human
aauaucucugaguucugu

SEQ ID NO: 3233580 - RNA, 21 nt, Human
aauaucuaguaauauauuuaa

SEQ ID NO: 3233581 - RNA, 18 nt, Human
aauaucuaguaauauauu

SEQ ID NO: 3233582 - RNA, 16 nt, Human
aauaucuaguaauaua

SEQ ID NO: 3233583 - RNA, 19 nt, Human
aauaucugaaaauguaugu

SEQ ID NO: 3233584 - RNA, 18 nt, Human
aauaucugaaaauguaug

SEQ ID NO: 3233585 - RNA, 17 nt, Human
aauaucugaaaauguau

SEQ ID NO: 3233586 - RNA, 16 nt, Human
aauaucugaaaaugua

SEQ ID NO: 3233587 - RNA, 19 nt, Human
aauaucuuuuuuuuaauaa

SEQ ID NO: 3233588 - RNA, 23 nt, Human
aauaugaaauuuuuuuucaugcu

SEQ ID NO: 3233589 - RNA, 20 nt, Human
aauaugaaauuuuuuuucau

SEQ ID NO: 3233590 - RNA, 12 nt, Human
aauaucuuucug

SEQ ID NO: 3233591 - RNA, 20 nt, Human
aauaucugaaaauguaugug

SEQ ID NO: 3233592 - RNA, 18 nt, Human
aauaucuucguuaguaau

SEQ ID NO: 3233593 - RNA, 17 nt, Human
aauaucuugcuugaacu

SEQ ID NO: 3233594 - RNA, 15 nt, Human
aauaucuugcuugaa

SEQ ID NO: 3233595 - RNA, 14 nt, Human
aauaucugugaaau

SEQ ID NO: 3233596 - RNA, 19 nt, Human
aauaucugugaaauaucau

SEQ ID NO: 3233597 - RNA, 20 nt, Human
uaaauguugaaagaucaaaa

SEQ ID NO: 3233598 - RNA, 15 nt, Human
uaaauguugaaagau

SEQ ID NO: 3233599 - RNA, 19 nt, Human
uaaauguuauguauauggu

SEQ ID NO: 3233600 - RNA, 16 nt, Human
uaaauguuauguauau

SEQ ID NO: 3233601 - RNA, 15 nt, Human
uaaauguuauguaua

SEQ ID NO: 3233602 - RNA, 14 nt, Human
uaaauguuauguau

SEQ ID NO: 3233603 - RNA, 19 nt, Human
uaaaugcaaccauuugaaa

SEQ ID NO: 3233604 - RNA, 16 nt, Human
uaaaugcaguuacaaa

SEQ ID NO: 3233605 - RNA, 21 nt, Human
uaaaugcaguuacaaauuaua

SEQ ID NO: 3233606 - RNA, 19 nt, Human
uaaaugcaguuacaaauua

SEQ ID NO: 3233607 - RNA, 17 nt, Human
uaaaugcaguuacaaau

SEQ ID NO: 3233608 - RNA, 21 nt, Human
uaaaucuguccaacugagaag

SEQ ID NO: 3233609 - RNA, 18 nt, Human
uaaaucucuucuguguuu

SEQ ID NO: 3233610 - RNA, 14 nt, Human
uaaaucucuucugu

SEQ ID NO: 3233611 - RNA, 17 nt, Human
aauacaaaguuagagaa

SEQ ID NO: 3233612 - RNA, 18 nt, Human
uaaauaaguuauaaagau

SEQ ID NO: 3233613 - RNA, 12 nt, Human
uaaauaauucuu

SEQ ID NO: 3233614 - RNA, 23 nt, Human
aauaacuuagacucuaguauuua

SEQ ID NO: 3233615 - RNA, 15 nt, Human
aauaacuguaauuau

SEQ ID NO: 3233616 - RNA, 12 nt, Human
aauaagaaaaga

SEQ ID NO: 3233617 - RNA, 16 nt, Human
aauaauuauuuauuac

SEQ ID NO: 3233618 - RNA, 20 nt, Human
aauaagaauagaacaacaua

SEQ ID NO: 3233619 - RNA, 22 nt, Human
aauaacuguaauuauuugaaug

SEQ ID NO: 3233620 - RNA, 14 nt, Human
aauaauucuuuuuu

SEQ ID NO: 3233621 - RNA, 15 nt, Human
aauaauucuuuuuua

SEQ ID NO: 3233622 - RNA, 20 nt, Human
aauaauucuuuuuuauuaau

SEQ ID NO: 3233623 - RNA, 21 nt, Human
aauaauucuuuuuuauuaauc

SEQ ID NO: 3233624 - RNA, 23 nt, Human
aauaauucuuuuuuauuaaucac

SEQ ID NO: 3233625 - RNA, 13 nt, Human
aauaauugacagg

SEQ ID NO: 3233626 - RNA, 17 nt, Human
aauaauuuguggugauu

SEQ ID NO: 3233627 - RNA, 14 nt, Human
aauaauuuuaucuc

SEQ ID NO: 3233628 - RNA, 11 nt, Human
aauaauuuuau

SEQ ID NO: 3233629 - RNA, 13 nt, Human
aauaauuuuguaa

SEQ ID NO: 3233630 - RNA, 15 nt, Human
aauaauuuuguaaug

SEQ ID NO: 3233631 - RNA, 14 nt, Human
aauaauuuuguaau

SEQ ID NO: 3233632 - RNA, 16 nt, Human
aauaaccguaaagguu

SEQ ID NO: 3233633 - RNA, 21 nt, Human
aauaacugauuaguaagucuu

SEQ ID NO: 3233634 - RNA, 13 nt, Human
aauaacugaauuu

SEQ ID NO: 3233635 - RNA, 15 nt, Human
aauaacugaauuugg

SEQ ID NO: 3233636 - RNA, 16 nt, Human
aauaacugaauuugga

SEQ ID NO: 3233637 - RNA, 22 nt, Human
aauaacauguaauuaaguacua

SEQ ID NO: 3233638 - RNA, 14 nt, Human
aauaaauuggaguu

SEQ ID NO: 3233639 - RNA, 20 nt, Human
aauaaauugcuccuugacau

SEQ ID NO: 3233640 - RNA, 16 nt, Human
aauaaauugcuccuug

SEQ ID NO: 3233641 - RNA, 22 nt, Human
aauaaaugguuuggugcuuuuu

SEQ ID NO: 3233642 - RNA, 15 nt, Human
aauaaaguuaaaagu

SEQ ID NO: 3233643 - RNA, 12 nt, Human
aauaaaguuuga

SEQ ID NO: 3233644 - RNA, 16 nt, Human
aauaaaucauaaaacu

SEQ ID NO: 3233645 - RNA, 19 nt, Human
aauaaauccacccauguua

SEQ ID NO: 3233646 - RNA, 12 nt, Human
aauaaaacugau

SEQ ID NO: 3233647 - RNA, 15 nt, Human
aauaaaacugaugug

SEQ ID NO: 3233648 - RNA, 18 nt, Human
aauaaaacugaugugaaa

SEQ ID NO: 3233649 - RNA, 19 nt, Human
aauaaaacugaugugaaac

SEQ ID NO: 3233650 - RNA, 12 nt, Human
aauaaaacuguc

SEQ ID NO: 3233651 - RNA, 13 nt, Human
uaaaguauaaugu

SEQ ID NO: 3233652 - RNA, 15 nt, Human
uaaaguauaauguuu

SEQ ID NO: 3233653 - RNA, 17 nt, Human
uaaaguauacucuuagg

SEQ ID NO: 3233654 - RNA, 21 nt, Human
uaaaguaguaaaagaagaaau

SEQ ID NO: 3233655 - RNA, 23 nt, Human
uaaaguacugagcagugauauuc

SEQ ID NO: 3233656 - RNA, 22 nt, Human
uaaaguacugagcagugauauu

SEQ ID NO: 3233657 - RNA, 19 nt, Human
uaaaguacugagcagugau

SEQ ID NO: 3233658 - RNA, 20 nt, Human
uaaaguaauuguuccagaga

SEQ ID NO: 3233659 - RNA, 17 nt, Human
uaaaguaauuguuccag

SEQ ID NO: 3233660 - RNA, 13 nt, Human
uaaaguaauuggu

SEQ ID NO: 3233661 - RNA, 21 nt, Human
uaaagguuucuauuuucucug

SEQ ID NO: 3233662 - RNA, 15 nt, Human
uaaagguuuauuuuu

SEQ ID NO: 3233663 - RNA, 21 nt, Human
uaaagguuuauuuuucuguua

SEQ ID NO: 3233664 - RNA, 20 nt, Human
guuuugaaauaaaaagagua

SEQ ID NO: 3233665 - RNA, 16 nt, Human
guuuucuuuuaauuuu

SEQ ID NO: 3233666 - RNA, 23 nt, Human
guuuucuugauaauuuuccuuua

SEQ ID NO: 3233667 - RNA, 21 nt, Human
guuuucuugauaauuuuccuu

SEQ ID NO: 3233668 - RNA, 16 nt, Human
guuuucuugauaauuu

SEQ ID NO: 3233669 - RNA, 23 nt, Human
uaaaggucacuuuucacauccuu

SEQ ID NO: 3233670 - RNA, 19 nt, Human
uaaagggcccaaugaauua

SEQ ID NO: 3233671 - RNA, 20 nt, Human
uaaagggcccaaugaauuau

SEQ ID NO: 3233672 - RNA, 21 nt, Human
uaaagggcccaaugaauuauu

SEQ ID NO: 3233673 - RNA, 20 nt, Human
uaaagguuaccgauuucaaa

SEQ ID NO: 3233674 - RNA, 14 nt, Human
aauaaaaagacaac

SEQ ID NO: 3233675 - RNA, 21 nt, Human
aaguuuugugaaauuuuucau

SEQ ID NO: 3233676 - RNA, 14 nt, Human
aauaaaaaaaagaa

SEQ ID NO: 3233677 - RNA, 13 nt, Human
aauaaaaaaaaga

SEQ ID NO: 3233678 - RNA, 16 nt, Human
aauaaaaauucuagau

SEQ ID NO: 3233679 - RNA, 20 nt, Human
aaguuuugugaaauuuuuca

SEQ ID NO: 3233680 - RNA, 19 nt, Human
aaguuuugugaaauuuuuc

SEQ ID NO: 3233681 - RNA, 18 nt, Human
aaguuuugugaaauuuuu

SEQ ID NO: 3233682 - RNA, 16 nt, Human
aaguuuugugaaauuu

SEQ ID NO: 3233683 - RNA, 15 nt, Human
aaguuuugugaaauu

SEQ ID NO: 3233684 - RNA, 14 nt, Human
aaguuuugugaaau

SEQ ID NO: 3233685 - RNA, 13 nt, Human
aaguuuugugaaa

SEQ ID NO: 3233686 - RNA, 12 nt, Human
aaguuuugugaa

SEQ ID NO: 3233687 - RNA, 15 nt, Human
uaaagucagaaguuu

SEQ ID NO: 3233688 - RNA, 19 nt, Human
uaaaguauuuggguuuugu

SEQ ID NO: 3233689 - RNA, 11 nt, Human
aaguuuuguga

SEQ ID NO: 3233690 - RNA, 21 nt, Human
uaaaguaugcauuauuaaauu

SEQ ID NO: 3233691 - RNA, 13 nt, Human
uaaaguauucuuu

SEQ ID NO: 3233692 - RNA, 23 nt, Human
uaaaguauucuuuuucuuuuuua

SEQ ID NO: 3233693 - RNA, 16 nt, Human
aaccuuuugagugccu

SEQ ID NO: 3233694 - RNA, 23 nt, Human
aaccuuuugagugccuuacacaa

SEQ ID NO: 3233695 - RNA, 18 nt, Human
aaccuuuuuauuucaaac

SEQ ID NO: 3233696 - RNA, 13 nt, Human
aaccuuuucuugu

SEQ ID NO: 3233697 - RNA, 22 nt, Human
aaccuuuucuuguaucuggauu

SEQ ID NO: 3233698 - RNA, 20 nt, Human
aacauggcuacuugcuuuga

SEQ ID NO: 3233699 - RNA, 12 nt, Human
aacccucagagc

SEQ ID NO: 3233700 - RNA, 19 nt, Human
aacccucagagccaccccu

SEQ ID NO: 3233701 - RNA, 21 nt, Human
aaccguguuugucucuucugg

SEQ ID NO: 3233702 - RNA, 20 nt, Human
aaccguguuugucucuucug

SEQ ID NO: 3233703 - RNA, 19 nt, Human
aaccguguuugucucuucu

SEQ ID NO: 3233704 - RNA, 22 nt, Human
aaccguaaagguuuauuuuucu

SEQ ID NO: 3233705 - RNA, 13 nt, Human
aaccgggauggga

SEQ ID NO: 3233706 - RNA, 21 nt, Human
aacccugacaaauuuuaauua

SEQ ID NO: 3233707 - RNA, 16 nt, Human
aacaggcccuccuccc

SEQ ID NO: 3233708 - RNA, 18 nt, Human
aacaucuuuauugaaauu

SEQ ID NO: 3233709 - RNA, 19 nt, Human
aacaucuuuauugaaauuc

SEQ ID NO: 3233710 - RNA, 20 nt, Human
aacaugacucuuuauugucu

SEQ ID NO: 3233711 - RNA, 19 nt, Human
aacagcccuauuucuugau

SEQ ID NO: 3233712 - RNA, 15 nt, Human
aacagccgcuccaga

SEQ ID NO: 3233713 - RNA, 22 nt, Human
aacaggcaaacauuuucucuua

SEQ ID NO: 3233714 - RNA, 11 nt, Human
aacaggcagau

SEQ ID NO: 3233715 - RNA, 23 nt, Human
aaauucuucuccacuuucuagcc

SEQ ID NO: 3233716 - RNA, 22 nt, Human
aaauucuguuuuuaaaaauuag

SEQ ID NO: 3233717 - RNA, 21 nt, Human
aaauauuuuuuuuucuuucag

SEQ ID NO: 3233718 - RNA, 13 nt, Human
aaaucuuuuugcu

SEQ ID NO: 3233719 - RNA, 14 nt, Human
aaaucuuuuugcuu

SEQ ID NO: 3233720 - RNA, 14 nt, Human
aaaucucaucccua

SEQ ID NO: 3233721 - RNA, 16 nt, Human
aaaugcuucauuugua

SEQ ID NO: 3233722 - RNA, 19 nt, Human
aaaugcuucauuuguaugu

SEQ ID NO: 3233723 - RNA, 23 nt, Human
aaaugcuucauuuguaugucaaa

SEQ ID NO: 3233724 - RNA, 22 nt, Human
aaauggaguuggaguucauuca

SEQ ID NO: 3233725 - RNA, 14 nt, Human
aaauggaguuggag

SEQ ID NO: 3233726 - RNA, 23 nt, Human
aaaugcugucuuucuugcucccu

SEQ ID NO: 3233727 - RNA, 22 nt, Human
aaaugcugucuuucuugcuccc

SEQ ID NO: 3233728 - RNA, 22 nt, Human
aaauauuuaugaagaaaauacu

SEQ ID NO: 3233729 - RNA, 16 nt, Human
aaauauuuaugaagaa

SEQ ID NO: 3233730 - RNA, 15 nt, Human
aaauauuuaugaaga

SEQ ID NO: 3233731 - RNA, 13 nt, Human
aaauauuuaugaa

SEQ ID NO: 3233732 - RNA, 22 nt, Human
aaauauuuagauguaauuuugu

SEQ ID NO: 3233733 - RNA, 21 nt, Human
aaauauuuaauguugaacaaa

SEQ ID NO: 3233734 - RNA, 17 nt, Human
aaauauuuaauguugaa

SEQ ID NO: 3233735 - RNA, 12 nt, Human
aaauauuguuaa

SEQ ID NO: 3233736 - RNA, 20 nt, Human
aaaggaugcccaaagaugca

SEQ ID NO: 3233737 - RNA, 22 nt, Human
aaauguuuucauauuuuucaaa

SEQ ID NO: 3233738 - RNA, 18 nt, Human
aaauguuuucagcuagga

SEQ ID NO: 3233739 - RNA, 11 nt, Human
aaauguuuuca

SEQ ID NO: 3233740 - RNA, 15 nt, Human
aaauguuuucagcua

SEQ ID NO: 3233741 - RNA, 14 nt, Human
aaauguuuucagcu

SEQ ID NO: 3233742 - RNA, 19 nt, Human
aaauucuguuuuuaaaaau

SEQ ID NO: 3233743 - RNA, 17 nt, Human
aaauucuguuuuuaaaa

SEQ ID NO: 3233744 - RNA, 15 nt, Human
aaauucuguuuuuaa

SEQ ID NO: 3233745 - RNA, 12 nt, Human
aaauucuguuuu

SEQ ID NO: 3233746 - RNA, 23 nt, Human
aaauguuuuguaaacuuugaaau

SEQ ID NO: 3233747 - RNA, 13 nt, Human
aaauguuuuguaa

SEQ ID NO: 3233748 - RNA, 14 nt, Human
aaauguuuuguaaa

SEQ ID NO: 3233749 - RNA, 16 nt, Human
aaauguuuuguaaacu

SEQ ID NO: 3233750 - RNA, 22 nt, Human
aaauguuuuguaaacuuugaaa

SEQ ID NO: 3233751 - RNA, 21 nt, Human
aaauguuuuguaaacuuugaa

SEQ ID NO: 3233752 - RNA, 20 nt, Human
aaauguuuuguaaacuuuga

SEQ ID NO: 3233753 - RNA, 19 nt, Human
aaauguuuuguaaacuuug

SEQ ID NO: 3233754 - RNA, 13 nt, Human
aaauguucaucaa

SEQ ID NO: 3233755 - RNA, 23 nt, Human
aaauggaguuggaguucauucau

SEQ ID NO: 3233756 - RNA, 18 nt, Human
aaauggcaacaaacugca

SEQ ID NO: 3233757 - RNA, 15 nt, Human
aaauggcaacaaacu

SEQ ID NO: 3233758 - RNA, 17 nt, Human
aaauggcaaguuuucca

SEQ ID NO: 3233759 - RNA, 20 nt, Human
aaauggcaacaaacugcaca

SEQ ID NO: 3233760 - RNA, 17 nt, Human
aaaagauaaauauuaua

SEQ ID NO: 3233761 - RNA, 21 nt, Human
aaaagauaccuuaaaauuuga

SEQ ID NO: 3233762 - RNA, 17 nt, Human
aaaagauaccuuaaaau

SEQ ID NO: 3233763 - RNA, 22 nt, Human
aaaagauaccuuaaaauuugaa

SEQ ID NO: 3233764 - RNA, 14 nt, Human
aaaagauaaauauu

SEQ ID NO: 3233765 - RNA, 12 nt, Human
aaaagauaaaga

SEQ ID NO: 3233766 - RNA, 22 nt, Human
aaaagauaaagaccagaaauuc

SEQ ID NO: 3233767 - RNA, 15 nt, Human
aaaagaguuaaggca

SEQ ID NO: 3233768 - RNA, 19 nt, Human
aaaagaguguaaaauauuu

SEQ ID NO: 3233769 - RNA, 21 nt, Human
aaaagauaaaaaaacagcuuu

SEQ ID NO: 3233770 - RNA, 19 nt, Human
aaaagagaugaugaaaaua

SEQ ID NO: 3233771 - RNA, 16 nt, Human
aaaagagaugaugaaa

SEQ ID NO: 3233772 - RNA, 21 nt, Human
aaaagagaccacccauaucau

SEQ ID NO: 3233773 - RNA, 22 nt, Human
aaaagagaccacccauaucaug

SEQ ID NO: 3233774 - RNA, 17 nt, Human
aaaagacuaagaucggu

SEQ ID NO: 3233775 - RNA, 19 nt, Human
aaaagacgcaccagcccag

SEQ ID NO: 3233776 - RNA, 16 nt, Human
aaaagagaaaagaaaa

SEQ ID NO: 3233777 - RNA, 14 nt, Human
aaaagagaaaagaa

SEQ ID NO: 3233778 - RNA, 13 nt, Human
aaaagagaaaaga

SEQ ID NO: 3233779 - RNA, 13 nt, Human
aaaagaauauuuu

SEQ ID NO: 3233780 - RNA, 14 nt, Human
aaaagaaggaaaga

SEQ ID NO: 3233781 - RNA, 14 nt, Human
aaaagaaguagugu

SEQ ID NO: 3233782 - RNA, 13 nt, Human
aaaagacuccaaa

SEQ ID NO: 3233783 - RNA, 12 nt, Human
aaaagaauauuu

SEQ ID NO: 3233784 - RNA, 22 nt, Human
aaaagaaaucuauagaaagugu

SEQ ID NO: 3233785 - RNA, 12 nt, Human
aaaagaaaucua

SEQ ID NO: 3233786 - RNA, 14 nt, Human
aaaagaaaucaaua

SEQ ID NO: 3233787 - RNA, 21 nt, Human
aaaagaaaucaauaguugaau

SEQ ID NO: 3233788 - RNA, 11 nt, Human
aaaagaaagaa

SEQ ID NO: 3233789 - RNA, 20 nt, Human
aaaagaaacucuauggucuu

SEQ ID NO: 3233790 - RNA, 10 nt, Human
aaaagaaaga

SEQ ID NO: 3233791 - RNA, 17 nt, Human
aaaagaaagaaaaucag

SEQ ID NO: 3233792 - RNA, 15 nt, Human
aaaagaaaauaaaaa

SEQ ID NO: 3233793 - RNA, 14 nt, Human
aaaagaaaauaaaa

SEQ ID NO: 3233794 - RNA, 16 nt, Human
aaaagaaaagucaagg

SEQ ID NO: 3233795 - RNA, 12 nt, Human
aaaagaaaacaa

SEQ ID NO: 3233796 - RNA, 14 nt, Human
aaaagaaaaacugu

SEQ ID NO: 3233797 - RNA, 11 nt, Human
aaaagaaaaac

SEQ ID NO: 3233798 - RNA, 22 nt, Human
aaaagaaaaaaaaagaaaaaag

SEQ ID NO: 3233799 - RNA, 11 nt, Human
aaaagaaaaag

SEQ ID NO: 3233800 - RNA, 19 nt, Human
aaaagaaaaaaaaagaaaa

SEQ ID NO: 3233801 - RNA, 18 nt, Human
aaaagaaaaaaaaagaaa

SEQ ID NO: 3233802 - RNA, 17 nt, Human
aaaagaaaaaaaaagaa

SEQ ID NO: 3233803 - RNA, 16 nt, Human
aaaagaaaaaaaaaga

SEQ ID NO: 3233804 - RNA, 11 nt, Human
aaaagaaaaaa

SEQ ID NO: 3233805 - RNA, 9 nt, Human
aaaagaaaa

SEQ ID NO: 3233806 - RNA, 12 nt, Human
aaaagaaaaaaa

SEQ ID NO: 3233807 - RNA, 19 nt, Human
aaaacuuuguuaggccaaa

SEQ ID NO: 3233808 - RNA, 17 nt, Human
aaaacuuuguuaggcca

SEQ ID NO: 3233809 - RNA, 22 nt, Human
aaaacagccauaggcccuuuca

SEQ ID NO: 3233810 - RNA, 19 nt, Human
aaaacagaguaaucuuguu

SEQ ID NO: 3233811 - RNA, 22 nt, Human
aaaacagaguaaucuuguuggu

SEQ ID NO: 3233812 - RNA, 18 nt, Human
aaaacagaguaaucuugu

SEQ ID NO: 3233813 - RNA, 11 nt, Human
aaaacuuuguu

SEQ ID NO: 3233814 - RNA, 19 nt, Human
aaaacacuguucucugccc

SEQ ID NO: 3233815 - RNA, 15 nt, Human
aaaacaccuucuaua

SEQ ID NO: 3233816 - RNA, 13 nt, Human
aaaacagaaauug

SEQ ID NO: 3233817 - RNA, 16 nt, Human
aaaacagaaauuggua

SEQ ID NO: 3233818 - RNA, 15 nt, Human
aaaacagaaauuggu

SEQ ID NO: 3233819 - RNA, 14 nt, Human
aaaacaccagcuuu

SEQ ID NO: 3233820 - RNA, 10 nt, Human
aaaaucauuu

SEQ ID NO: 3233821 - RNA, 12 nt, Human
aaaauaaaacug

SEQ ID NO: 3233822 - RNA, 14 nt, Human
aaaauaaaacuguc

SEQ ID NO: 3233823 - RNA, 12 nt, Human
aaaaucauuucu

SEQ ID NO: 3233824 - RNA, 11 nt, Human
aaaaucauuuc

SEQ ID NO: 3233825 - RNA, 13 nt, Human
aaaaucagccugc

SEQ ID NO: 3233826 - RNA, 17 nt, Human
aaaaucagccugcucca

SEQ ID NO: 3233827 - RNA, 21 nt, Human
aaaaucagccugcuccagcug

SEQ ID NO: 3233828 - RNA, 18 nt, Human
aaaaguuguaugaucugu

SEQ ID NO: 3233829 - RNA, 16 nt, Human
aaaaguuguaugaucu

SEQ ID NO: 3233830 - RNA, 15 nt, Human
aaaaguuguaugauc

SEQ ID NO: 3233831 - RNA, 20 nt, Human
aaaaguccauaccuuauaua

SEQ ID NO: 3233832 - RNA, 13 nt, Human
aaaagucacaguu

SEQ ID NO: 3233833 - RNA, 23 nt, Human
aaaagucaccaaauagugugaaa

SEQ ID NO: 3233834 - RNA, 19 nt, Human
aaaagucuuuuaaaaagua

SEQ ID NO: 3233835 - RNA, 18 nt, Human
aaaagucuuuuaaaaagu

SEQ ID NO: 3233836 - RNA, 14 nt, Human
aaaagucuuuuaaa

SEQ ID NO: 3233837 - RNA, 15 nt, Human
aaaagucagauguuu

SEQ ID NO: 3233838 - RNA, 19 nt, Human
aaaagucuuaggugaacaa

SEQ ID NO: 3233839 - RNA, 16 nt, Human
aaagccuccuccagcc

SEQ ID NO: 3233840 - RNA, 17 nt, Human
aaagccauucugauuau

SEQ ID NO: 3233841 - RNA, 17 nt, Human
aaagcauuguaaaugug

SEQ ID NO: 3233842 - RNA, 15 nt, Human
aaagcauuguaaaug

SEQ ID NO: 3233843 - RNA, 17 nt, Human
aaagcauguuuugcaug

SEQ ID NO: 3233844 - RNA, 16 nt, Human
aaagcauguuuugcau

SEQ ID NO: 3233845 - RNA, 19 nt, Human
aaagaaaaaaaugucaaaa

SEQ ID NO: 3233846 - RNA, 18 nt, Human
aaagaaaaaagagaaaag

SEQ ID NO: 3233847 - RNA, 10 nt, Human
aaagaaaaaa

SEQ ID NO: 3233848 - RNA, 22 nt, Human
aaagaaaaaaaaaaagaaagaa

SEQ ID NO: 3233849 - RNA, 16 nt, Human
aaagaaaaaaaaagaa

SEQ ID NO: 3233850 - RNA, 15 nt, Human
aaagaaaaaaauguc

SEQ ID NO: 3233851 - RNA, 16 nt, Human
aaagaaaaaaauguca

SEQ ID NO: 3233852 - RNA, 18 nt, Human
aaaaucuagaagagucua

SEQ ID NO: 3233853 - RNA, 22 nt, Human
aaacugcacaugauuucacaaa

SEQ ID NO: 3233854 - RNA, 21 nt, Human
aaacugcacaugauuucacaa

SEQ ID NO: 3233855 - RNA, 20 nt, Human
aaacugcacaugauuucaca

SEQ ID NO: 3233856 - RNA, 18 nt, Human
aaacugcacaugauuuca

SEQ ID NO: 3233857 - RNA, 17 nt, Human
aaacugcacaugauuuc

SEQ ID NO: 3233858 - RNA, 14 nt, Human
aaacugcacaugau

SEQ ID NO: 3233859 - RNA, 9 nt, Human
aaagaaaaa

SEQ ID NO: 3233860 - RNA, 11 nt, Human
aaagaaaaaaa

SEQ ID NO: 3233861 - RNA, 21 nt, Human
aaagaaaaaaaaaaaagccag

SEQ ID NO: 3233862 - RNA, 22 nt, Human
aaagaaaaaaaaaaaagccagc

SEQ ID NO: 3233863 - RNA, 15 nt, Human
aaacugcacugucaa

SEQ ID NO: 3233864 - RNA, 12 nt, Human
aaacugcacaug

SEQ ID NO: 3233865 - RNA, 12 nt, Human
aaacucuuaaaa

SEQ ID NO: 3233866 - RNA, 23 nt, Human
aaacucuuaaaacccaagugccu

SEQ ID NO: 3233867 - RNA, 22 nt, Human
aaacugauuuuuuuuuccuuca

SEQ ID NO: 3233868 - RNA, 23 nt, Human
aaacugauuuuuuuuuccuucag

SEQ ID NO: 3233869 - RNA, 17 nt, Human
aaacccacccuuucuac

SEQ ID NO: 3233870 - RNA, 12 nt, Human
aaacccagcucu

SEQ ID NO: 3233871 - RNA, 16 nt, Human
aaacccagcucugguc

SEQ ID NO: 3233872 - RNA, 15 nt, Human
aaaccgccaaggcug

SEQ ID NO: 3233873 - RNA, 16 nt, Human
aaaccgccaaggcugg

SEQ ID NO: 3233874 - RNA, 18 nt, Human
aaacucuguuacacuuuu

SEQ ID NO: 3233875 - RNA, 22 nt, Human
aaacucuguuacacuuuuugga

SEQ ID NO: 3233876 - RNA, 16 nt, Human
aaaccauuuuuguuac

SEQ ID NO: 3233877 - RNA, 18 nt, Human
aaaccauuuuuguuacuc

SEQ ID NO: 3233878 - RNA, 23 nt, Human
aaaccauuuuuguuacucucuuc

SEQ ID NO: 3233879 - RNA, 21 nt, Human
aaaccaggcuuucuagaaaga

SEQ ID NO: 3233880 - RNA, 12 nt, Human
aauaaacuuucu

SEQ ID NO: 3233881 - RNA, 23 nt, Human
aaguuuaaggaauaugggagaaa

SEQ ID NO: 3233882 - RNA, 23 nt, Human
aaguuggaaacacuaaauguuaa

SEQ ID NO: 3233883 - RNA, 22 nt, Human
aaguuggaaacacuaaauguua

SEQ ID NO: 3233884 - RNA, 21 nt, Human
aaguuggaaacacuaaauguu

SEQ ID NO: 3233885 - RNA, 20 nt, Human
aaguuggaaacacuaaaugu

SEQ ID NO: 3233886 - RNA, 19 nt, Human
aaguuggaaacacuaaaug

SEQ ID NO: 3233887 - RNA, 15 nt, Human
aaguuggaaacacua

SEQ ID NO: 3233888 - RNA, 14 nt, Human
aaguugcuggaaag

SEQ ID NO: 3233889 - RNA, 16 nt, Human
aaguugguauuaauaa

SEQ ID NO: 3233890 - RNA, 19 nt, Human
aaguugguauuaauaaaaa

SEQ ID NO: 3233891 - RNA, 20 nt, Human
aaguugguauuaauaaaaag

SEQ ID NO: 3233892 - RNA, 21 nt, Human
aaguugguauuaauaaaaaga

SEQ ID NO: 3233893 - RNA, 19 nt, Human
aaguuuaaauauuaagcau

SEQ ID NO: 3233894 - RNA, 15 nt, Human
aaguuuaaggaauau

SEQ ID NO: 3233895 - RNA, 14 nt, Human
aaguuuaaggaaua

SEQ ID NO: 3233896 - RNA, 21 nt, Human
aaguuguacuccaauggcuga

SEQ ID NO: 3233897 - RNA, 14 nt, Human
aaguuguacuuuaa

SEQ ID NO: 3233898 - RNA, 12 nt, Human
aaguuguacuuu

SEQ ID NO: 3233899 - RNA, 21 nt, Human
aaguuguacuuuaaaaauuua

SEQ ID NO: 3233900 - RNA, 20 nt, Human
aaguuguacuuuaaaaauuu

SEQ ID NO: 3233901 - RNA, 18 nt, Human
aaguuguacuuuaaaaau

SEQ ID NO: 3233902 - RNA, 15 nt, Human
aaguuguacuuuaaa

SEQ ID NO: 3233903 - RNA, 23 nt, Human
aaguggccuccgucacuaccugg

SEQ ID NO: 3233904 - RNA, 12 nt, Human
aagugcugggau

SEQ ID NO: 3233905 - RNA, 21 nt, Human
aaguggcaccugucugcucca

SEQ ID NO: 3233906 - RNA, 18 nt, Human
aaguggcaccugucugcu

SEQ ID NO: 3233907 - RNA, 17 nt, Human
aaguggcaccugucugc

SEQ ID NO: 3233908 - RNA, 13 nt, Human
aaguggcaccugu

SEQ ID NO: 3233909 - RNA, 23 nt, Human
aaguggcaaagcuguucuuccug

SEQ ID NO: 3233910 - RNA, 22 nt, Human
aaguggcaaagcuguucuuccu

SEQ ID NO: 3233911 - RNA, 19 nt, Human
aaguggcaaagcuguucuu

SEQ ID NO: 3233912 - RNA, 13 nt, Human
aaguggcaaagcu

SEQ ID NO: 3233913 - RNA, 14 nt, Human
aaguggacuggagg

SEQ ID NO: 3233914 - RNA, 16 nt, Human
aauaaagcaauaagaa

SEQ ID NO: 3233915 - RNA, 14 nt, Human
aaugaagcaguauu

SEQ ID NO: 3233916 - RNA, 16 nt, Human
aaugaagcaguauuuu

SEQ ID NO: 3233917 - RNA, 20 nt, Human
aaugaaagacuguacaaagu

SEQ ID NO: 3233918 - RNA, 18 nt, Human
aaugaaagacuguacaaa

SEQ ID NO: 3233919 - RNA, 21 nt, Human
aaugaaagacuguacaaagua

SEQ ID NO: 3233920 - RNA, 20 nt, Human
aaugaugccaugaggaacaa

SEQ ID NO: 3233921 - RNA, 19 nt, Human
aaugaauaaugccuuugua

SEQ ID NO: 3233922 - RNA, 20 nt, Human
aaugaauaaugccuuuguaa

SEQ ID NO: 3233923 - RNA, 15 nt, Human
aaugaauaauggaaa

SEQ ID NO: 3233924 - RNA, 17 nt, Human
aaugaauaauggaaaau

SEQ ID NO: 3233925 - RNA, 21 nt, Human
aaugaauaauggaaaaugcca

SEQ ID NO: 3233926 - RNA, 10 nt, Human
aaugaauaau

SEQ ID NO: 3233927 - RNA, 15 nt, Human
aaucugaagauuguu

SEQ ID NO: 3233928 - RNA, 14 nt, Human
aaucugaagauugu

SEQ ID NO: 3233929 - RNA, 14 nt, Human
aaucucagugcuuu

SEQ ID NO: 3233930 - RNA, 15 nt, Human
aaucucagugcuuuc

SEQ ID NO: 3233931 - RNA, 16 nt, Human
aaucucagugcuuucc

SEQ ID NO: 3233932 - RNA, 23 nt, Human
aaucugaggaauggacauuucua

SEQ ID NO: 3233933 - RNA, 18 nt, Human
aaucugaauuggaaugca

SEQ ID NO: 3233934 - RNA, 21 nt, Human
aaucugaagauuguuuaucua

SEQ ID NO: 3233935 - RNA, 18 nt, Human
aaucugaagauuguuuau

SEQ ID NO: 3233936 - RNA, 17 nt, Human
aaucugaagauuguuua

SEQ ID NO: 3233937 - RNA, 19 nt, Human
aauaugugauuuuuuuucc

SEQ ID NO: 3233938 - RNA, 12 nt, Human
aauaugugauuu

SEQ ID NO: 3233939 - RNA, 13 nt, Human
aauauuaagaaag

SEQ ID NO: 3233940 - RNA, 13 nt, Human
aauauuaagcaug

SEQ ID NO: 3233941 - RNA, 23 nt, Human
aauauguggaguucaucuugaau

SEQ ID NO: 3233942 - RNA, 21 nt, Human
aauaugugaaggaccuucacu

SEQ ID NO: 3233943 - RNA, 19 nt, Human
aauaugugaaggaccuuca

SEQ ID NO: 3233944 - RNA, 11 nt, Human
aauaugugaag

SEQ ID NO: 3233945 - RNA, 14 nt, Human
aauauauagcauuu

SEQ ID NO: 3233946 - RNA, 13 nt, Human
aauauauagcauu

SEQ ID NO: 3233947 - RNA, 15 nt, Human
aaucaccgaaaacgu

SEQ ID NO: 3233948 - RNA, 19 nt, Human
aaucaccgaugcaaacauu

SEQ ID NO: 3233949 - RNA, 20 nt, Human
aaucaccuaauuaauuucag

SEQ ID NO: 3233950 - RNA, 19 nt, Human
aaucaccuaauuaauuuca

SEQ ID NO: 3233951 - RNA, 23 nt, Human
aaucaccgaaaacguggcugcuu

SEQ ID NO: 3233952 - RNA, 21 nt, Human
aaucaccgaaaacguggcugc

SEQ ID NO: 3233953 - RNA, 22 nt, Human
aaucaaugcuauaacuauguug

SEQ ID NO: 3233954 - RNA, 12 nt, Human
aaucaauaguug

SEQ ID NO: 3233955 - RNA, 14 nt, Human
aauauuaagacaau

SEQ ID NO: 3233956 - RNA, 23 nt, Human
aaucaauaacagccgcuccagag

SEQ ID NO: 3233957 - RNA, 17 nt, Human
aaucaauaacagccgcu

SEQ ID NO: 3233958 - RNA, 23 nt, Human
aaucaaguuggcuucuaaucaaa

SEQ ID NO: 3233959 - RNA, 13 nt, Human
aaucaaagugcua

SEQ ID NO: 3233960 - RNA, 22 nt, Human
aaucaaauaaaaauucuagauu

SEQ ID NO: 3233961 - RNA, 16 nt, Human
aauauuacuuuaacau

SEQ ID NO: 3233962 - RNA, 19 nt, Human
aauauuacuuuaacaugcc

SEQ ID NO: 3233963 - RNA, 22 nt, Human
aauauuaagcaugacagaaaau

SEQ ID NO: 3233964 - RNA, 21 nt, Human
aauauuaagcaugacagaaaa

SEQ ID NO: 3233965 - RNA, 20 nt, Human
aagaguaggaagacuuugga

SEQ ID NO: 3233966 - RNA, 19 nt, Human
aagaguuggggacagaacu

SEQ ID NO: 3233967 - RNA, 16 nt, Human
aagagaaaagaaaaaa

SEQ ID NO: 3233968 - RNA, 15 nt, Human
aagagaaaagagaga

SEQ ID NO: 3233969 - RNA, 15 nt, Human
aagagaaaagaaaaa

SEQ ID NO: 3233970 - RNA, 14 nt, Human
aagagaaaagaaaa

SEQ ID NO: 3233971 - RNA, 17 nt, Human
aagacuuuuccaacccu

SEQ ID NO: 3233972 - RNA, 14 nt, Human
aagaccagaaauuc

SEQ ID NO: 3233973 - RNA, 18 nt, Human
aagagaaaacaucucauc

SEQ ID NO: 3233974 - RNA, 11 nt, Human
aagagaaaaga

SEQ ID NO: 3233975 - RNA, 13 nt, Human
aagagaaaagaaa

SEQ ID NO: 3233976 - RNA, 12 nt, Human
aagagaaaagaa

SEQ ID NO: 3233977 - RNA, 13 nt, Human
aagagaaaaaaua

SEQ ID NO: 3233978 - RNA, 19 nt, Human
aagacuuuucuuucagcca

SEQ ID NO: 3233979 - RNA, 21 nt, Human
aagacuuuuccaacccucauc

SEQ ID NO: 3233980 - RNA, 12 nt, Human
aagacuuuucuu

SEQ ID NO: 3233981 - RNA, 18 nt, Human
aagaagaaauaguucugu

SEQ ID NO: 3233982 - RNA, 21 nt, Human
aagaagaacucaccaggguuu

SEQ ID NO: 3233983 - RNA, 20 nt, Human
aagacaaugugaaaagaaaa

SEQ ID NO: 3233984 - RNA, 23 nt, Human
aagacacaggggacacccagaaa

SEQ ID NO: 3233985 - RNA, 19 nt, Human
aagacaaugugaaaagaaa

SEQ ID NO: 3233986 - RNA, 17 nt, Human
aagacaacauuguaaga

SEQ ID NO: 3233987 - RNA, 14 nt, Human
aagacaacauugua

SEQ ID NO: 3233988 - RNA, 22 nt, Human
aagacaauagcacuuaaauucc

SEQ ID NO: 3233989 - RNA, 18 nt, Human
aagaacuuguuuaauaaa

SEQ ID NO: 3233990 - RNA, 15 nt, Human
aagaacuuguuuaau

SEQ ID NO: 3233991 - RNA, 14 nt, Human
aagaacuuguuuaa

SEQ ID NO: 3233992 - RNA, 12 nt, Human
aagaacuuguuu

SEQ ID NO: 3233993 - RNA, 12 nt, Human
aagaacugcuuu

SEQ ID NO: 3233994 - RNA, 14 nt, Human
aagaacuaucuuca

SEQ ID NO: 3233995 - RNA, 18 nt, Human
aagaacucaccaggguuu

SEQ ID NO: 3233996 - RNA, 16 nt, Human
aagaacuaucuucauc

SEQ ID NO: 3233997 - RNA, 20 nt, Human
aacgcaggcccccaggugcc

SEQ ID NO: 3233998 - RNA, 16 nt, Human
aacgcagcccugcuuu

SEQ ID NO: 3233999 - RNA, 12 nt, Human
aacgcagcccug

SEQ ID NO: 3234000 - RNA, 17 nt, Human
aacgcccacuucccugg

SEQ ID NO: 3234001 - RNA, 22 nt, Human
aagaacccauggaaaaaugcca
